United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 128

SEQ ID NO: 5429124 - DNA, 24 bp, Homo sapiens
ggccactgcagtcacccctgtctg

SEQ ID NO: 5429125 - DNA, 14 bp, Homo sapiens
ggccactgccctct

SEQ ID NO: 5429126 - DNA, 17 bp, Homo sapiens
ggccactgccctctcca

SEQ ID NO: 5429127 - DNA, 22 bp, Homo sapiens
ggccactgccctctccacaccc

SEQ ID NO: 5429128 - DNA, 13 bp, Homo sapiens
ggccactgcgcca

SEQ ID NO: 5429129 - DNA, 14 bp, Homo sapiens
ggccactggaagga

SEQ ID NO: 5429130 - DNA, 18 bp, Homo sapiens
ggccactggatcctgctg

SEQ ID NO: 5429131 - DNA, 20 bp, Homo sapiens
ggccactggatcctgctgct

SEQ ID NO: 5429132 - DNA, 22 bp, Homo sapiens
ggccactggatcctgctgcttt

SEQ ID NO: 5429133 - DNA, 19 bp, Homo sapiens
ggccactggcacttgcctg

SEQ ID NO: 5429134 - DNA, 23 bp, Homo sapiens
ggccactggcacttgcctgctgc

SEQ ID NO: 5429135 - DNA, 13 bp, Homo sapiens
ggccactggccct

SEQ ID NO: 5429136 - DNA, 12 bp, Homo sapiens
ggccactgggcc

SEQ ID NO: 5429137 - DNA, 20 bp, Homo sapiens
ggccactgggccctgagcca

SEQ ID NO: 5429138 - DNA, 19 bp, Homo sapiens
ggccactgtccctgtcctt

SEQ ID NO: 5429139 - DNA, 20 bp, Homo sapiens
ggccactgtgaagagaacca

SEQ ID NO: 5429140 - DNA, 15 bp, Homo sapiens
ggccactgtggccag

SEQ ID NO: 5429141 - DNA, 18 bp, Homo sapiens
ggccactgtggccagagc

SEQ ID NO: 5429142 - DNA, 19 bp, Homo sapiens
ggccactgtggccagagct

SEQ ID NO: 5429143 - DNA, 20 bp, Homo sapiens
ggccactgtggccagagctg

SEQ ID NO: 5429144 - DNA, 13 bp, Homo sapiens
ggccactgtgggt

SEQ ID NO: 5429145 - DNA, 17 bp, Homo sapiens
ggccactgtgtctctgt

SEQ ID NO: 5429146 - DNA, 16 bp, Homo sapiens
ggccactgtgttcctt

SEQ ID NO: 5429147 - DNA, 19 bp, Homo sapiens
ggccaggcagaatggctgc

SEQ ID NO: 5429148 - DNA, 21 bp, Homo sapiens
ggccaggcagaatggctgcac

SEQ ID NO: 5429149 - DNA, 23 bp, Homo sapiens
ggccaggcagaatggctgcacgt

SEQ ID NO: 5429150 - DNA, 11 bp, Homo sapiens
ggccaggccac

SEQ ID NO: 5429151 - DNA, 14 bp, Homo sapiens
ggccaggccagagg

SEQ ID NO: 5429152 - DNA, 13 bp, Homo sapiens
ggccaggccagct

SEQ ID NO: 5429153 - DNA, 15 bp, Homo sapiens
ggccaggccagctgc

SEQ ID NO: 5429154 - DNA, 15 bp, Homo sapiens
ggccaggccagggga

SEQ ID NO: 5429155 - DNA, 13 bp, Homo sapiens
ggccaggccatgg

SEQ ID NO: 5429156 - DNA, 16 bp, Homo sapiens
ggccaggccatggcca

SEQ ID NO: 5429157 - DNA, 14 bp, Homo sapiens
ggccaggcccaggc

SEQ ID NO: 5429158 - DNA, 15 bp, Homo sapiens
ggccaggccctcctg

SEQ ID NO: 5429159 - DNA, 23 bp, Homo sapiens
ggccaggccctcctgctggctga

SEQ ID NO: 5429160 - DNA, 14 bp, Homo sapiens
ggccaggccctctg

SEQ ID NO: 5429161 - DNA, 12 bp, Homo sapiens
ggccaggccctg

SEQ ID NO: 5429162 - DNA, 14 bp, Homo sapiens
ggccaggccctgga

SEQ ID NO: 5429163 - DNA, 16 bp, Homo sapiens
ggccaggccctggagg

SEQ ID NO: 5429164 - DNA, 22 bp, Homo sapiens
ggccaggccctggagggcagag

SEQ ID NO: 5429165 - DNA, 17 bp, Homo sapiens
ggccaggccctgggtct

SEQ ID NO: 5429166 - DNA, 17 bp, Homo sapiens
ggccaggccgcgcccag

SEQ ID NO: 5429167 - DNA, 22 bp, Homo sapiens
ggccaggcctcgcacttgcaga

SEQ ID NO: 5429168 - DNA, 22 bp, Homo sapiens
ggccaggcctctgctggctcag

SEQ ID NO: 5429169 - DNA, 23 bp, Homo sapiens
ggccaggcctctgctggctcagg

SEQ ID NO: 5429170 - DNA, 13 bp, Homo sapiens
ggccaggcctgca

SEQ ID NO: 5429171 - DNA, 16 bp, Homo sapiens
ggccaggcctgcagac

SEQ ID NO: 5429172 - DNA, 13 bp, Homo sapiens
ggccaggcctgcc

SEQ ID NO: 5429173 - DNA, 20 bp, Homo sapiens
ggccaggcgagcctgactct

SEQ ID NO: 5429174 - DNA, 20 bp, Homo sapiens
ggccaggcgcggtggctcac

SEQ ID NO: 5429175 - DNA, 13 bp, Homo sapiens
ggccaggctcccg

SEQ ID NO: 5429176 - DNA, 14 bp, Homo sapiens
ggccaggctccctg

SEQ ID NO: 5429177 - DNA, 23 bp, Homo sapiens
ggccaggctccctgaccaccctg

SEQ ID NO: 5429178 - DNA, 21 bp, Homo sapiens
ggccaggctgatgggacagaa

SEQ ID NO: 5429179 - DNA, 15 bp, Homo sapiens
ggccaggctgctctt

SEQ ID NO: 5429180 - DNA, 22 bp, Homo sapiens
ggccaggctgggtcgccctgga

SEQ ID NO: 5429181 - DNA, 12 bp, Homo sapiens
ggccaggctggt

SEQ ID NO: 5429182 - DNA, 14 bp, Homo sapiens
ggccaggctggtct

SEQ ID NO: 5429183 - DNA, 19 bp, Homo sapiens
ggccaggctggtctaaaac

SEQ ID NO: 5429184 - DNA, 18 bp, Homo sapiens
ggccaggcttgtctcgaa

SEQ ID NO: 5429185 - DNA, 15 bp, Homo sapiens
ggccagggacccagg

SEQ ID NO: 5429186 - DNA, 22 bp, Homo sapiens
ggccagggacccaggtgtgcct

SEQ ID NO: 5429187 - DNA, 17 bp, Homo sapiens
ggccagggagaagctcc

SEQ ID NO: 5429188 - DNA, 22 bp, Homo sapiens
ggccagggaggagccccagtgg

SEQ ID NO: 5429189 - DNA, 14 bp, Homo sapiens
ggccagggaggcag

SEQ ID NO: 5429190 - DNA, 17 bp, Homo sapiens
ggccagggaggcagagc

SEQ ID NO: 5429191 - DNA, 13 bp, Homo sapiens
ggccagggaggcg

SEQ ID NO: 5429192 - DNA, 16 bp, Homo sapiens
ggccagggaggcgcag

SEQ ID NO: 5429193 - DNA, 21 bp, Homo sapiens
ggccagggaggcgcagggaca

SEQ ID NO: 5429194 - DNA, 15 bp, Homo sapiens
ggccagggcaatgcc

SEQ ID NO: 5429195 - DNA, 16 bp, Homo sapiens
ggccagggcaatgcca

SEQ ID NO: 5429196 - DNA, 17 bp, Homo sapiens
ggccagggcaatgccat

SEQ ID NO: 5429197 - DNA, 17 bp, Homo sapiens
ggccagggcctctgtgc

SEQ ID NO: 5429198 - DNA, 16 bp, Homo sapiens
ggccagggcggccagg

SEQ ID NO: 5429199 - DNA, 17 bp, Homo sapiens
ggccagggcggccaggg

SEQ ID NO: 5429200 - DNA, 20 bp, Homo sapiens
ggccagggctatagctcagg

SEQ ID NO: 5429201 - DNA, 21 bp, Homo sapiens
ggccagggctcaccagctggg

SEQ ID NO: 5429202 - DNA, 19 bp, Homo sapiens
ggccagggctcctgtggca

SEQ ID NO: 5429203 - DNA, 13 bp, Homo sapiens
ggccagggctctg

SEQ ID NO: 5429204 - DNA, 15 bp, Homo sapiens
ggccagggctctggc

SEQ ID NO: 5429205 - DNA, 17 bp, Homo sapiens
ggccagggctgccctga

SEQ ID NO: 5429206 - DNA, 18 bp, Homo sapiens
ggccagggctgccctgag

SEQ ID NO: 5429207 - DNA, 14 bp, Homo sapiens
ggccagggctggat

SEQ ID NO: 5429208 - DNA, 15 bp, Homo sapiens
ggccagggctggatg

SEQ ID NO: 5429209 - DNA, 23 bp, Homo sapiens
ggccagggctggatggacagaca

SEQ ID NO: 5429210 - DNA, 14 bp, Homo sapiens
ggccagggctttgg

SEQ ID NO: 5429211 - DNA, 13 bp, Homo sapiens
ggccaggggccag

SEQ ID NO: 5429212 - DNA, 14 bp, Homo sapiens
ggccaggggccagg

SEQ ID NO: 5429213 - DNA, 18 bp, Homo sapiens
ggccaggggtgctcctgt

SEQ ID NO: 5429214 - DNA, 19 bp, Homo sapiens
ggccaggggtgggagcatc

SEQ ID NO: 5429215 - DNA, 19 bp, Homo sapiens
ggccagggtctcgtcagga

SEQ ID NO: 5429216 - DNA, 19 bp, Homo sapiens
ggccagggtgggaagagaa

SEQ ID NO: 5429217 - DNA, 19 bp, Homo sapiens
ggccaggtagcagcaaata

SEQ ID NO: 5429218 - DNA, 18 bp, Homo sapiens
ggccaggtctggcgccag

SEQ ID NO: 5429219 - DNA, 22 bp, Homo sapiens
ggccaggtctggcgccaggggc

SEQ ID NO: 5429220 - DNA, 14 bp, Homo sapiens
ggccaggtgcacag

SEQ ID NO: 5429221 - DNA, 16 bp, Homo sapiens
ggccaggtgcctcctg

SEQ ID NO: 5429222 - DNA, 16 bp, Homo sapiens
ggccaggtgcggcctg

SEQ ID NO: 5429223 - DNA, 15 bp, Homo sapiens
ggccaggtgggcgga

SEQ ID NO: 5429224 - DNA, 18 bp, Homo sapiens
ggccaggtgggcggacaa

SEQ ID NO: 5429225 - DNA, 23 bp, Homo sapiens
ggccaggtgggcgggcagcacag

SEQ ID NO: 5429226 - DNA, 22 bp, Homo sapiens
ggccaggttggaaaagaaatca

SEQ ID NO: 5429227 - DNA, 17 bp, Homo sapiens
ggccaggttgtgtccca

SEQ ID NO: 5429228 - DNA, 23 bp, Homo sapiens
ggccagtcaacggggggctcctg

SEQ ID NO: 5429229 - DNA, 14 bp, Homo sapiens
ggccagtccaggct

SEQ ID NO: 5429230 - DNA, 20 bp, Homo sapiens
ggccagtcccacggctctgt

SEQ ID NO: 5429231 - DNA, 13 bp, Homo sapiens
ggccagtccccat

SEQ ID NO: 5429232 - DNA, 15 bp, Homo sapiens
ggccagtccccgagg

SEQ ID NO: 5429233 - DNA, 19 bp, Homo sapiens
ggccagtccccgaggagct

SEQ ID NO: 5429234 - DNA, 17 bp, Homo sapiens
ggccagtccctgaggca

SEQ ID NO: 5429235 - DNA, 23 bp, Homo sapiens
ggccagtccctgaggcaggtccc

SEQ ID NO: 5429236 - DNA, 15 bp, Homo sapiens
ggccagtcctagagc

SEQ ID NO: 5429237 - DNA, 20 bp, Homo sapiens
ggccagtcctagagctcctg

SEQ ID NO: 5429238 - DNA, 12 bp, Homo sapiens
ggccagtcctgg

SEQ ID NO: 5429239 - DNA, 21 bp, Homo sapiens
ggccagtcctggttgtctgaa

SEQ ID NO: 5429240 - DNA, 23 bp, Homo sapiens
ggccagtctgtggatcagagatg

SEQ ID NO: 5429241 - DNA, 15 bp, Homo sapiens
ggccagtcttcctct

SEQ ID NO: 5429242 - DNA, 16 bp, Homo sapiens
ggccagtcttcctctt

SEQ ID NO: 5429243 - DNA, 18 bp, Homo sapiens
ggccagtgagatcaatgt

SEQ ID NO: 5429244 - DNA, 21 bp, Homo sapiens
ggccagtgagatcaatgtgac

SEQ ID NO: 5429245 - DNA, 15 bp, Homo sapiens
ggccagtgagggctg

SEQ ID NO: 5429246 - DNA, 18 bp, Homo sapiens
ggccagtgagggctgggc

SEQ ID NO: 5429247 - DNA, 13 bp, Homo sapiens
ggccagtgatgat

SEQ ID NO: 5429248 - DNA, 15 bp, Homo sapiens
ggccagtgccaggac

SEQ ID NO: 5429249 - DNA, 13 bp, Homo sapiens
ggccagtggacag

SEQ ID NO: 5429250 - DNA, 14 bp, Homo sapiens
ggccagtggcactc

SEQ ID NO: 5429251 - DNA, 17 bp, Homo sapiens
ggccagtggcactctgt

SEQ ID NO: 5429252 - DNA, 19 bp, Homo sapiens
ggccagtggccttccccag

SEQ ID NO: 5429253 - DNA, 22 bp, Homo sapiens
ggccagtggccttccccagcat

SEQ ID NO: 5429254 - DNA, 14 bp, Homo sapiens
ggccagtggcggaa

SEQ ID NO: 5429255 - DNA, 15 bp, Homo sapiens
ggccagtgggcctgg

SEQ ID NO: 5429256 - DNA, 21 bp, Homo sapiens
ggccagtggggaactgagggc

SEQ ID NO: 5429257 - DNA, 16 bp, Homo sapiens
ggccagtggggcctgt

SEQ ID NO: 5429258 - DNA, 18 bp, Homo sapiens
ggccagtggggcctgtgg

SEQ ID NO: 5429259 - DNA, 14 bp, Homo sapiens
ggccagtgtctggg

SEQ ID NO: 5429260 - DNA, 13 bp, Homo sapiens
ggccagtgtctgt

SEQ ID NO: 5429261 - DNA, 16 bp, Homo sapiens
ggccagtgtgacaagg

SEQ ID NO: 5429262 - DNA, 20 bp, Homo sapiens
ggccagtgtgacaaggattg

SEQ ID NO: 5429263 - DNA, 16 bp, Homo sapiens
ggccagttgatctgct

SEQ ID NO: 5429264 - DNA, 18 bp, Homo sapiens
ggccagttgatctgctct

SEQ ID NO: 5429265 - DNA, 17 bp, Homo sapiens
ggccagttgcccagagc

SEQ ID NO: 5429266 - DNA, 20 bp, Homo sapiens
ggccagttgcccagagcact

SEQ ID NO: 5429267 - DNA, 17 bp, Homo sapiens
ggccagttggtccccct

SEQ ID NO: 5429268 - DNA, 23 bp, Homo sapiens
ggccataagcaacaattttcaga

SEQ ID NO: 5429269 - DNA, 15 bp, Homo sapiens
ggccataccaggtgc

SEQ ID NO: 5429270 - DNA, 14 bp, Homo sapiens
ggccatactgcctt

SEQ ID NO: 5429271 - DNA, 14 bp, Homo sapiens
ggccatagaggccc

SEQ ID NO: 5429272 - DNA, 15 bp, Homo sapiens
ggccatagaggccca

SEQ ID NO: 5429273 - DNA, 16 bp, Homo sapiens
ggccataggagaggag

SEQ ID NO: 5429274 - DNA, 22 bp, Homo sapiens
ggccatatttacctcagcctgg

SEQ ID NO: 5429275 - DNA, 18 bp, Homo sapiens
ggccatattttaaaaaat

SEQ ID NO: 5429276 - DNA, 16 bp, Homo sapiens
ggccatcacaggatgc

SEQ ID NO: 5429277 - DNA, 20 bp, Homo sapiens
ggccatcacaggatgccagc

SEQ ID NO: 5429278 - DNA, 13 bp, Homo sapiens
ggccatcactcag

SEQ ID NO: 5429279 - DNA, 22 bp, Homo sapiens
ggccatcagcaccacgtgccaa

SEQ ID NO: 5429280 - DNA, 18 bp, Homo sapiens
ggccatcagggccctgcc

SEQ ID NO: 5429281 - DNA, 21 bp, Homo sapiens
ggccatcagggccctgcccca

SEQ ID NO: 5429282 - DNA, 22 bp, Homo sapiens
ggccatcagggccctgccccag

SEQ ID NO: 5429283 - DNA, 14 bp, Homo sapiens
ggccatcagggtgg

SEQ ID NO: 5429284 - DNA, 11 bp, Homo sapiens
ggccatccact

SEQ ID NO: 5429285 - DNA, 13 bp, Homo sapiens
ggccatccactgt

SEQ ID NO: 5429286 - DNA, 16 bp, Homo sapiens
ggccatcccaaggtct

SEQ ID NO: 5429287 - DNA, 16 bp, Homo sapiens
ggccatccctgggccc

SEQ ID NO: 5429288 - DNA, 21 bp, Homo sapiens
ggccatccctgggcccctcca

SEQ ID NO: 5429289 - DNA, 14 bp, Homo sapiens
ggccatccctgtga

SEQ ID NO: 5429290 - DNA, 19 bp, Homo sapiens
ggccatccggcccccagag

SEQ ID NO: 5429291 - DNA, 22 bp, Homo sapiens
ggccatccggcccccagagcgc

SEQ ID NO: 5429292 - DNA, 14 bp, Homo sapiens
ggccatcctaccca

SEQ ID NO: 5429293 - DNA, 20 bp, Homo sapiens
ggccatccttccctgtctgc

SEQ ID NO: 5429294 - DNA, 14 bp, Homo sapiens
ggccatcggtcctg

SEQ ID NO: 5429295 - DNA, 15 bp, Homo sapiens
ggccatctcaggaga

SEQ ID NO: 5429296 - DNA, 18 bp, Homo sapiens
ggccatctccctccccag

SEQ ID NO: 5429297 - DNA, 21 bp, Homo sapiens
ggccatctctgaacttcagct

SEQ ID NO: 5429298 - DNA, 23 bp, Homo sapiens
ggccatctgactgccaagccaga

SEQ ID NO: 5429299 - DNA, 13 bp, Homo sapiens
ggccatctgctcc

SEQ ID NO: 5429300 - DNA, 14 bp, Homo sapiens
ggccatctggagag

SEQ ID NO: 5429301 - DNA, 20 bp, Homo sapiens
ggccatctggagagcccaga

SEQ ID NO: 5429302 - DNA, 22 bp, Homo sapiens
ggccatctgtaaatatcccaga

SEQ ID NO: 5429303 - DNA, 19 bp, Homo sapiens
ggccatcttccaggtgggg

SEQ ID NO: 5429304 - DNA, 18 bp, Homo sapiens
ggccatgaatctctgcct

SEQ ID NO: 5429305 - DNA, 23 bp, Homo sapiens
ggccatgaccactttccccgtgg

SEQ ID NO: 5429306 - DNA, 17 bp, Homo sapiens
ggccatgaccctgcctc

SEQ ID NO: 5429307 - DNA, 18 bp, Homo sapiens
ggccatgaccctgcctct

SEQ ID NO: 5429308 - DNA, 17 bp, Homo sapiens
ggccatgagctccagac

SEQ ID NO: 5429309 - DNA, 23 bp, Homo sapiens
ggccatgagggctggagaccaga

SEQ ID NO: 5429310 - DNA, 21 bp, Homo sapiens
ggccatgattcgcccaaagcc

SEQ ID NO: 5429311 - DNA, 23 bp, Homo sapiens
ggccatgcaggaggtggagaaaa

SEQ ID NO: 5429312 - DNA, 16 bp, Homo sapiens
ggccatgcccaccgcc

SEQ ID NO: 5429313 - DNA, 16 bp, Homo sapiens
ggccatgccccacccc

SEQ ID NO: 5429314 - DNA, 21 bp, Homo sapiens
ggccatgcctcctcaggagcc

SEQ ID NO: 5429315 - DNA, 18 bp, Homo sapiens
ggccatgctcaacccccc

SEQ ID NO: 5429316 - DNA, 22 bp, Homo sapiens
ggccatgctcaacccccctccc

SEQ ID NO: 5429317 - DNA, 15 bp, Homo sapiens
ggccatgctcctctt

SEQ ID NO: 5429318 - DNA, 17 bp, Homo sapiens
ggccatgctcctcttcc

SEQ ID NO: 5429319 - DNA, 16 bp, Homo sapiens
ggccatgctgagagct

SEQ ID NO: 5429320 - DNA, 22 bp, Homo sapiens
ggccatgctgaggcctgggccg

SEQ ID NO: 5429321 - DNA, 15 bp, Homo sapiens
ggccatgctgtccct

SEQ ID NO: 5429322 - DNA, 21 bp, Homo sapiens
ggccatgctgtccctgcactg

SEQ ID NO: 5429323 - DNA, 22 bp, Homo sapiens
ggccatgctgtgtgagaccagg

SEQ ID NO: 5429324 - DNA, 17 bp, Homo sapiens
ggccatgcttcttgccc

SEQ ID NO: 5429325 - DNA, 14 bp, Homo sapiens
ggcccctggcccag

SEQ ID NO: 5429326 - DNA, 18 bp, Homo sapiens
ggcccctggcccagcggc

SEQ ID NO: 5429327 - DNA, 17 bp, Homo sapiens
ggcccctggcccaggag

SEQ ID NO: 5429328 - DNA, 18 bp, Homo sapiens
ggcccctggcccaggagg

SEQ ID NO: 5429329 - DNA, 15 bp, Homo sapiens
ggcccctggcctgcc

SEQ ID NO: 5429330 - DNA, 22 bp, Homo sapiens
ggcccctgggctctcacccagt

SEQ ID NO: 5429331 - DNA, 20 bp, Homo sapiens
ggcccctgggcttggcctgc

SEQ ID NO: 5429332 - DNA, 21 bp, Homo sapiens
ggcccctgggcttggcctgct

SEQ ID NO: 5429333 - DNA, 12 bp, Homo sapiens
ggcccctgggga

SEQ ID NO: 5429334 - DNA, 13 bp, Homo sapiens
ggcccctggggct

SEQ ID NO: 5429335 - DNA, 16 bp, Homo sapiens
ggcccctgggtttctt

SEQ ID NO: 5429336 - DNA, 17 bp, Homo sapiens
ggcccctggtctgccct

SEQ ID NO: 5429337 - DNA, 13 bp, Homo sapiens
ggcccctggtggc

SEQ ID NO: 5429338 - DNA, 13 bp, Homo sapiens
ggcccctgtcccc

SEQ ID NO: 5429339 - DNA, 13 bp, Homo sapiens
ggcccctgtgtga

SEQ ID NO: 5429340 - DNA, 20 bp, Homo sapiens
ggccccttcacttctgacca

SEQ ID NO: 5429341 - DNA, 21 bp, Homo sapiens
ggccccttcacttctgaccac

SEQ ID NO: 5429342 - DNA, 22 bp, Homo sapiens
ggccccttcacttctgaccaca

SEQ ID NO: 5429343 - DNA, 22 bp, Homo sapiens
ggccccttccacgggggctgtg

SEQ ID NO: 5429344 - DNA, 12 bp, Homo sapiens
ggccccttccca

SEQ ID NO: 5429345 - DNA, 15 bp, Homo sapiens
ggccccttcccacgt

SEQ ID NO: 5429346 - DNA, 22 bp, Homo sapiens
ggccccttcccagccagcccgc

SEQ ID NO: 5429347 - DNA, 14 bp, Homo sapiens
ggccccttctccag

SEQ ID NO: 5429348 - DNA, 23 bp, Homo sapiens
ggccccttctccagcaagcagtg

SEQ ID NO: 5429349 - DNA, 23 bp, Homo sapiens
ggccccttggcgggcagcccagc

SEQ ID NO: 5429350 - DNA, 19 bp, Homo sapiens
ggcccctttgggccctgca

SEQ ID NO: 5429351 - DNA, 21 bp, Homo sapiens
ggcccctttgggccctgcatg

SEQ ID NO: 5429352 - DNA, 16 bp, Homo sapiens
ggccccttttcactcc

SEQ ID NO: 5429353 - DNA, 18 bp, Homo sapiens
ggccccttttcactccct

SEQ ID NO: 5429354 - DNA, 23 bp, Homo sapiens
ggcccgaaggtctctctggctct

SEQ ID NO: 5429355 - DNA, 16 bp, Homo sapiens
ggcccgacagcctggc

SEQ ID NO: 5429356 - DNA, 13 bp, Homo sapiens
ggcccgagcagct

SEQ ID NO: 5429357 - DNA, 14 bp, Homo sapiens
ggcccgagcgcctg

SEQ ID NO: 5429358 - DNA, 17 bp, Homo sapiens
ggcccgagcgcctgcgt

SEQ ID NO: 5429359 - DNA, 18 bp, Homo sapiens
ggcccgagggtcccaagg

SEQ ID NO: 5429360 - DNA, 20 bp, Homo sapiens
ggcccgcaccccggcctcag

SEQ ID NO: 5429361 - DNA, 18 bp, Homo sapiens
ggcccgcactcaggagca

SEQ ID NO: 5429362 - DNA, 22 bp, Homo sapiens
ggcccgcactcaggagcacagc

SEQ ID NO: 5429363 - DNA, 15 bp, Homo sapiens
ggcccgcagtgctgg

SEQ ID NO: 5429364 - DNA, 14 bp, Homo sapiens
ggcccgcccctcgc

SEQ ID NO: 5429365 - DNA, 21 bp, Homo sapiens
ggcccgcccctcgctgctgct

SEQ ID NO: 5429366 - DNA, 14 bp, Homo sapiens
ggcccgccctgccc

SEQ ID NO: 5429367 - DNA, 19 bp, Homo sapiens
ggcccgccctgcccgggct

SEQ ID NO: 5429368 - DNA, 18 bp, Homo sapiens
ggcccgcctgccacctct

SEQ ID NO: 5429369 - DNA, 19 bp, Homo sapiens
ggcccgcctggcagaactg

SEQ ID NO: 5429370 - DNA, 23 bp, Homo sapiens
ggcccgcctggcagaactgagct

SEQ ID NO: 5429371 - DNA, 17 bp, Homo sapiens
ggcccgcgcagctgcct

SEQ ID NO: 5429372 - DNA, 12 bp, Homo sapiens
ggcccgcggcct

SEQ ID NO: 5429373 - DNA, 14 bp, Homo sapiens
ggcccgcggcctgc

SEQ ID NO: 5429374 - DNA, 16 bp, Homo sapiens
ggcccgcggcctgcac

SEQ ID NO: 5429375 - DNA, 22 bp, Homo sapiens
ggcccgcggcctgcaccgaccc

SEQ ID NO: 5429376 - DNA, 19 bp, Homo sapiens
ggcccgcgggcacagccag

SEQ ID NO: 5429377 - DNA, 20 bp, Homo sapiens
ggcccgcgggcacagccagc

SEQ ID NO: 5429378 - DNA, 18 bp, Homo sapiens
ggcccgctcaacctctca

SEQ ID NO: 5429379 - DNA, 19 bp, Homo sapiens
ggcccgctcaacctctcag

SEQ ID NO: 5429380 - DNA, 12 bp, Homo sapiens
ggcccgctgcct

SEQ ID NO: 5429381 - DNA, 17 bp, Homo sapiens
ggcccgcttgcctcggc

SEQ ID NO: 5429382 - DNA, 19 bp, Homo sapiens
ggcccgcttgcctcggctc

SEQ ID NO: 5429383 - DNA, 22 bp, Homo sapiens
ggcccgcttgcctcggctcctg

SEQ ID NO: 5429384 - DNA, 13 bp, Homo sapiens
ggcccgctttgcc

SEQ ID NO: 5429385 - DNA, 16 bp, Homo sapiens
ggcccgctttgcctgc

SEQ ID NO: 5429386 - DNA, 17 bp, Homo sapiens
ggcccgctttgcctgct

SEQ ID NO: 5429387 - DNA, 18 bp, Homo sapiens
ggcccggaagttgctgtg

SEQ ID NO: 5429388 - DNA, 20 bp, Homo sapiens
ggcccggagaaacctgatga

SEQ ID NO: 5429389 - DNA, 13 bp, Homo sapiens
ggcccggagcagc

SEQ ID NO: 5429390 - DNA, 16 bp, Homo sapiens
ggcccggatccaggat

SEQ ID NO: 5429391 - DNA, 13 bp, Homo sapiens
ggcccggcatgag

SEQ ID NO: 5429392 - DNA, 16 bp, Homo sapiens
ggcccggcatgaggcc

SEQ ID NO: 5429393 - DNA, 19 bp, Homo sapiens
ggcccggcatgaggccccg

SEQ ID NO: 5429394 - DNA, 14 bp, Homo sapiens
ggcccggccacacc

SEQ ID NO: 5429395 - DNA, 15 bp, Homo sapiens
ggcccggccacaccc

SEQ ID NO: 5429396 - DNA, 21 bp, Homo sapiens
ggcccggccacacccagcggc

SEQ ID NO: 5429397 - DNA, 13 bp, Homo sapiens
ggcccggccagcg

SEQ ID NO: 5429398 - DNA, 22 bp, Homo sapiens
ggcccggccagcgggcacaggg

SEQ ID NO: 5429399 - DNA, 21 bp, Homo sapiens
ggcccggcccacgcagagccc

SEQ ID NO: 5429400 - DNA, 16 bp, Homo sapiens
ggcccggccccgagag

SEQ ID NO: 5429401 - DNA, 14 bp, Homo sapiens
ggcccggcccctca

SEQ ID NO: 5429402 - DNA, 17 bp, Homo sapiens
ggcccggcccctcaccc

SEQ ID NO: 5429403 - DNA, 18 bp, Homo sapiens
ggcccggcccctcctgac

SEQ ID NO: 5429404 - DNA, 16 bp, Homo sapiens
ggcccggccggagggc

SEQ ID NO: 5429405 - DNA, 15 bp, Homo sapiens
ggcccggccggcctg

SEQ ID NO: 5429406 - DNA, 21 bp, Homo sapiens
ggcccggccggcctggcaccg

SEQ ID NO: 5429407 - DNA, 20 bp, Homo sapiens
ggcccggcctattgcttggg

SEQ ID NO: 5429408 - DNA, 15 bp, Homo sapiens
ggcccggctccaggc

SEQ ID NO: 5429409 - DNA, 16 bp, Homo sapiens
ggcccggctgagcccc

SEQ ID NO: 5429410 - DNA, 19 bp, Homo sapiens
ggcccggctgagcccccca

SEQ ID NO: 5429411 - DNA, 16 bp, Homo sapiens
ggcccgggcccaggca

SEQ ID NO: 5429412 - DNA, 14 bp, Homo sapiens
ggcccgggcccccg

SEQ ID NO: 5429413 - DNA, 14 bp, Homo sapiens
ggcccgggcccctg

SEQ ID NO: 5429414 - DNA, 15 bp, Homo sapiens
ggcccggggcccttc

SEQ ID NO: 5429415 - DNA, 19 bp, Homo sapiens
ggcccggggctggcggcta

SEQ ID NO: 5429416 - DNA, 14 bp, Homo sapiens
ggcccgggtcccac

SEQ ID NO: 5429417 - DNA, 18 bp, Homo sapiens
ggcccggtcccagtccgg

SEQ ID NO: 5429418 - DNA, 20 bp, Homo sapiens
ggcccggtggcggcagggcc

SEQ ID NO: 5429419 - DNA, 15 bp, Homo sapiens
ggcccgtcatgttcc

SEQ ID NO: 5429420 - DNA, 14 bp, Homo sapiens
ggcccgtcggagct

SEQ ID NO: 5429421 - DNA, 22 bp, Homo sapiens
ggcccgtcggagctgcctgcag

SEQ ID NO: 5429422 - DNA, 19 bp, Homo sapiens
ggcccgtctgtccatctgc

SEQ ID NO: 5429423 - DNA, 13 bp, Homo sapiens
ggcccgtgacaga

SEQ ID NO: 5429424 - DNA, 13 bp, Homo sapiens
ggcccgtgcagct

SEQ ID NO: 5429425 - DNA, 17 bp, Homo sapiens
ggcccgtgcgcagccgc

SEQ ID NO: 5429426 - DNA, 14 bp, Homo sapiens
ggcccgtgtaaata

SEQ ID NO: 5429427 - DNA, 21 bp, Homo sapiens
ggcccgtgtaaatatgtacat

SEQ ID NO: 5429428 - DNA, 20 bp, Homo sapiens
ggcccgttgtctccctggcc

SEQ ID NO: 5429429 - DNA, 23 bp, Homo sapiens
ggccctaagaggtttttcctctt

SEQ ID NO: 5429430 - DNA, 15 bp, Homo sapiens
ggccctaagccactc

SEQ ID NO: 5429431 - DNA, 16 bp, Homo sapiens
ggccctaccagcgccc

SEQ ID NO: 5429432 - DNA, 21 bp, Homo sapiens
ggccctaccagcgcccgctgg

SEQ ID NO: 5429433 - DNA, 19 bp, Homo sapiens
ggccctaccctcctgctga

SEQ ID NO: 5429434 - DNA, 24 bp, Homo sapiens
ggccctaccctcctgctgagctgc

SEQ ID NO: 5429435 - DNA, 15 bp, Homo sapiens
ggccctacctgggga

SEQ ID NO: 5429436 - DNA, 17 bp, Homo sapiens
ggccctacttccaggat

SEQ ID NO: 5429437 - DNA, 23 bp, Homo sapiens
ggccctagcccagcgctctgcct

SEQ ID NO: 5429438 - DNA, 15 bp, Homo sapiens
ggccctagctttacg

SEQ ID NO: 5429439 - DNA, 22 bp, Homo sapiens
ggccctaggattcctcccccag

SEQ ID NO: 5429440 - DNA, 12 bp, Homo sapiens
ggccctaggcat

SEQ ID NO: 5429441 - DNA, 23 bp, Homo sapiens
ggccctaggcatactctccagga

SEQ ID NO: 5429442 - DNA, 15 bp, Homo sapiens
ggccctaggcccctc

SEQ ID NO: 5429443 - DNA, 17 bp, Homo sapiens
ggccctaggcccctcct

SEQ ID NO: 5429444 - DNA, 17 bp, Homo sapiens
ggccctatgtctcagga

SEQ ID NO: 5429445 - DNA, 18 bp, Homo sapiens
ggccctatgtctcaggag

SEQ ID NO: 5429446 - DNA, 23 bp, Homo sapiens
ggccctcaaggcctcccacagtg

SEQ ID NO: 5429447 - DNA, 18 bp, Homo sapiens
ggccctcacccctgccct

SEQ ID NO: 5429448 - DNA, 21 bp, Homo sapiens
ggccctcacccctgccctggg

SEQ ID NO: 5429449 - DNA, 22 bp, Homo sapiens
ggccctcacccctgccctggga

SEQ ID NO: 5429450 - DNA, 14 bp, Homo sapiens
ggccctcactcaag

SEQ ID NO: 5429451 - DNA, 16 bp, Homo sapiens
ggccctcagctccctg

SEQ ID NO: 5429452 - DNA, 11 bp, Homo sapiens
ggccctcaggc

SEQ ID NO: 5429453 - DNA, 19 bp, Homo sapiens
ggccctcaggccattcccc

SEQ ID NO: 5429454 - DNA, 21 bp, Homo sapiens
ggccctcagtagtccctgcac

SEQ ID NO: 5429455 - DNA, 21 bp, Homo sapiens
ggccctcagtcttcctgccgg

SEQ ID NO: 5429456 - DNA, 14 bp, Homo sapiens
ggccctcagtgggc

SEQ ID NO: 5429457 - DNA, 22 bp, Homo sapiens
ggccctcatctatgaggaaagg

SEQ ID NO: 5429458 - DNA, 21 bp, Homo sapiens
ggccctccacacctgcggccc

SEQ ID NO: 5429459 - DNA, 15 bp, Homo sapiens
ggccctccagagccc

SEQ ID NO: 5429460 - DNA, 17 bp, Homo sapiens
ggccctccagagcccca

SEQ ID NO: 5429461 - DNA, 17 bp, Homo sapiens
ggccctccatgggctag

SEQ ID NO: 5429462 - DNA, 17 bp, Homo sapiens
ggccctcccaccacccc

SEQ ID NO: 5429463 - DNA, 13 bp, Homo sapiens
ggccctcccaggc

SEQ ID NO: 5429464 - DNA, 13 bp, Homo sapiens
ggccctccccaca

SEQ ID NO: 5429465 - DNA, 22 bp, Homo sapiens
ggccctcccccagctccttggc

SEQ ID NO: 5429466 - DNA, 12 bp, Homo sapiens
ggccctccctca

SEQ ID NO: 5429467 - DNA, 15 bp, Homo sapiens
ggccctccctcccta

SEQ ID NO: 5429468 - DNA, 21 bp, Homo sapiens
ggccctccctccctagccctt

SEQ ID NO: 5429469 - DNA, 21 bp, Homo sapiens
ggccctccctctactcttcct

SEQ ID NO: 5429470 - DNA, 14 bp, Homo sapiens
ggccctccctgcgc

SEQ ID NO: 5429471 - DNA, 20 bp, Homo sapiens
ggccctccctgttccccaga

SEQ ID NO: 5429472 - DNA, 21 bp, Homo sapiens
ggccctccctgttccccagag

SEQ ID NO: 5429473 - DNA, 23 bp, Homo sapiens
ggccctccctgttccccagagaa

SEQ ID NO: 5429474 - DNA, 23 bp, Homo sapiens
ggccctcccttggaaacctgccc

SEQ ID NO: 5429475 - DNA, 15 bp, Homo sapiens
ggccctccgacagcc

SEQ ID NO: 5429476 - DNA, 22 bp, Homo sapiens
ggccctccgaccacttccaggg

SEQ ID NO: 5429477 - DNA, 16 bp, Homo sapiens
ggccctcctaccctgc

SEQ ID NO: 5429478 - DNA, 21 bp, Homo sapiens
ggccctcctaccctgcgccca

SEQ ID NO: 5429479 - DNA, 12 bp, Homo sapiens
ggccctcctcag

SEQ ID NO: 5429480 - DNA, 13 bp, Homo sapiens
ggccctcctcagc

SEQ ID NO: 5429481 - DNA, 16 bp, Homo sapiens
ggccctcctcagctcc

SEQ ID NO: 5429482 - DNA, 18 bp, Homo sapiens
ggccctcctctggtcact

SEQ ID NO: 5429483 - DNA, 13 bp, Homo sapiens
ggccctcctggga

SEQ ID NO: 5429484 - DNA, 14 bp, Homo sapiens
ggccctcctgggaa

SEQ ID NO: 5429485 - DNA, 21 bp, Homo sapiens
ggccctccttccctcctgtgc

SEQ ID NO: 5429486 - DNA, 23 bp, Homo sapiens
ggccctccttccctcctgtgccc

SEQ ID NO: 5429487 - DNA, 16 bp, Homo sapiens
ggccctcgctgccagc

SEQ ID NO: 5429488 - DNA, 18 bp, Homo sapiens
ggccctcggagctggctg

SEQ ID NO: 5429489 - DNA, 20 bp, Homo sapiens
ggccctcggagctggctgtg

SEQ ID NO: 5429490 - DNA, 16 bp, Homo sapiens
ggccctcgggccctct

SEQ ID NO: 5429491 - DNA, 19 bp, Homo sapiens
ggccctcggtcagcgactg

SEQ ID NO: 5429492 - DNA, 20 bp, Homo sapiens
ggccctcggtggctgcacag

SEQ ID NO: 5429493 - DNA, 21 bp, Homo sapiens
ggccctctagcttctaccctt

SEQ ID NO: 5429494 - DNA, 16 bp, Homo sapiens
ggccctctcccctgcc

SEQ ID NO: 5429495 - DNA, 17 bp, Homo sapiens
ggccctctcccttaccc

SEQ ID NO: 5429496 - DNA, 12 bp, Homo sapiens
ggccctctcttc

SEQ ID NO: 5429497 - DNA, 22 bp, Homo sapiens
ggccctctgaggctcagccctg

SEQ ID NO: 5429498 - DNA, 15 bp, Homo sapiens
ggccctctgcccact

SEQ ID NO: 5429499 - DNA, 22 bp, Homo sapiens
ggccctctgccgaccgcctgct

SEQ ID NO: 5429500 - DNA, 13 bp, Homo sapiens
ggccctctgcctg

SEQ ID NO: 5429501 - DNA, 14 bp, Homo sapiens
ggccctctgcctgc

SEQ ID NO: 5429502 - DNA, 15 bp, Homo sapiens
ggcctcagggccagg

SEQ ID NO: 5429503 - DNA, 17 bp, Homo sapiens
ggcctcagggccaggaa

SEQ ID NO: 5429504 - DNA, 20 bp, Homo sapiens
ggcctcagggccaggaagga

SEQ ID NO: 5429505 - DNA, 17 bp, Homo sapiens
ggcctcagggcgctcag

SEQ ID NO: 5429506 - DNA, 19 bp, Homo sapiens
ggcctcagggcgctcagac

SEQ ID NO: 5429507 - DNA, 22 bp, Homo sapiens
ggcctcagggcgctcagacggc

SEQ ID NO: 5429508 - DNA, 18 bp, Homo sapiens
ggcctcagggctccttgt

SEQ ID NO: 5429509 - DNA, 15 bp, Homo sapiens
ggcctcagggtcctg

SEQ ID NO: 5429510 - DNA, 19 bp, Homo sapiens
ggcctcagggtctaaggag

SEQ ID NO: 5429511 - DNA, 17 bp, Homo sapiens
ggcctcaggtgctgtcc

SEQ ID NO: 5429512 - DNA, 18 bp, Homo sapiens
ggcctcaggtgctgtcca

SEQ ID NO: 5429513 - DNA, 11 bp, Homo sapiens
ggcctcagtct

SEQ ID NO: 5429514 - DNA, 13 bp, Homo sapiens
ggcctcagtgcca

SEQ ID NO: 5429515 - DNA, 22 bp, Homo sapiens
ggcctcagtggactttccaccc

SEQ ID NO: 5429516 - DNA, 17 bp, Homo sapiens
ggcctcagtttccccat

SEQ ID NO: 5429517 - DNA, 21 bp, Homo sapiens
ggcctcagtttctccatcagc

SEQ ID NO: 5429518 - DNA, 14 bp, Homo sapiens
ggcctcatcctcct

SEQ ID NO: 5429519 - DNA, 21 bp, Homo sapiens
ggcctcatctcacctctcgca

SEQ ID NO: 5429520 - DNA, 17 bp, Homo sapiens
ggcctcatgcctgctga

SEQ ID NO: 5429521 - DNA, 16 bp, Homo sapiens
ggcctcatgtggctgg

SEQ ID NO: 5429522 - DNA, 17 bp, Homo sapiens
ggcctcatgtggctgga

SEQ ID NO: 5429523 - DNA, 20 bp, Homo sapiens
ggcctcatgtggctggaaga

SEQ ID NO: 5429524 - DNA, 23 bp, Homo sapiens
ggcctccaaccttctgccctcct

SEQ ID NO: 5429525 - DNA, 16 bp, Homo sapiens
ggcctccaacgcccct

SEQ ID NO: 5429526 - DNA, 23 bp, Homo sapiens
ggcctccaagtccacagtggaac

SEQ ID NO: 5429527 - DNA, 17 bp, Homo sapiens
ggcctccacctctgtgc

SEQ ID NO: 5429528 - DNA, 22 bp, Homo sapiens
ggcctccactcccccacctgac

SEQ ID NO: 5429529 - DNA, 11 bp, Homo sapiens
ggcctccagaa

SEQ ID NO: 5429530 - DNA, 13 bp, Homo sapiens
ggcctccagaacc

SEQ ID NO: 5429531 - DNA, 15 bp, Homo sapiens
ggcctccagaactca

SEQ ID NO: 5429532 - DNA, 16 bp, Homo sapiens
ggcctccagcctctcc

SEQ ID NO: 5429533 - DNA, 18 bp, Homo sapiens
ggcctccagcctctcccg

SEQ ID NO: 5429534 - DNA, 14 bp, Homo sapiens
ggcctccagctcag

SEQ ID NO: 5429535 - DNA, 16 bp, Homo sapiens
ggcctccagctcagca

SEQ ID NO: 5429536 - DNA, 13 bp, Homo sapiens
ggcctccaggagg

SEQ ID NO: 5429537 - DNA, 17 bp, Homo sapiens
ggcctccaggaggggcc

SEQ ID NO: 5429538 - DNA, 19 bp, Homo sapiens
ggcctccaggcccgtctgt

SEQ ID NO: 5429539 - DNA, 14 bp, Homo sapiens
ggcctccaggctgg

SEQ ID NO: 5429540 - DNA, 15 bp, Homo sapiens
ggcctccaggctggg

SEQ ID NO: 5429541 - DNA, 15 bp, Homo sapiens
ggcctccagggccca

SEQ ID NO: 5429542 - DNA, 19 bp, Homo sapiens
ggcctccatcctcatctct

SEQ ID NO: 5429543 - DNA, 17 bp, Homo sapiens
ggcctcccaaaagactc

SEQ ID NO: 5429544 - DNA, 13 bp, Homo sapiens
ggcctcccaaagt

SEQ ID NO: 5429545 - DNA, 18 bp, Homo sapiens
ggcctcccaaagtgctga

SEQ ID NO: 5429546 - DNA, 23 bp, Homo sapiens
ggcctcccaaagtgctgagattg

SEQ ID NO: 5429547 - DNA, 14 bp, Homo sapiens
ggcctcccaactca

SEQ ID NO: 5429548 - DNA, 23 bp, Homo sapiens
ggcctcccaactcaccccagccc

SEQ ID NO: 5429549 - DNA, 14 bp, Homo sapiens
ggcctcccaagctg

SEQ ID NO: 5429550 - DNA, 21 bp, Homo sapiens
ggcctcccaataaagctggac

SEQ ID NO: 5429551 - DNA, 16 bp, Homo sapiens
ggcctcccacagactc

SEQ ID NO: 5429552 - DNA, 13 bp, Homo sapiens
ggcctcccacagt

SEQ ID NO: 5429553 - DNA, 14 bp, Homo sapiens
ggcctcccacagtg

SEQ ID NO: 5429554 - DNA, 13 bp, Homo sapiens
ggcctcccaccag

SEQ ID NO: 5429555 - DNA, 23 bp, Homo sapiens
ggcctcccacccgatgctgcttt

SEQ ID NO: 5429556 - DNA, 24 bp, Homo sapiens
ggcctcccaccgcagcgtcccccg

SEQ ID NO: 5429557 - DNA, 11 bp, Homo sapiens
ggcctcccact

SEQ ID NO: 5429558 - DNA, 14 bp, Homo sapiens
ggcctcccactccc

SEQ ID NO: 5429559 - DNA, 18 bp, Homo sapiens
ggcctcccactcccatgg

SEQ ID NO: 5429560 - DNA, 17 bp, Homo sapiens
ggcctcccagccacccg

SEQ ID NO: 5429561 - DNA, 10 bp, Homo sapiens
ggcctccccc

SEQ ID NO: 5429562 - DNA, 13 bp, Homo sapiens
ggcctcccccaac

SEQ ID NO: 5429563 - DNA, 21 bp, Homo sapiens
ggcctcccccaacacctgctg

SEQ ID NO: 5429564 - DNA, 15 bp, Homo sapiens
ggcctcccccacttt

SEQ ID NO: 5429565 - DNA, 17 bp, Homo sapiens
ggcctcccccagccagg

SEQ ID NO: 5429566 - DNA, 22 bp, Homo sapiens
ggcctccccccagcccctcctc

SEQ ID NO: 5429567 - DNA, 23 bp, Homo sapiens
ggcctccccccagcccctcctcc

SEQ ID NO: 5429568 - DNA, 23 bp, Homo sapiens
ggcctccccgggggtccccggac

SEQ ID NO: 5429569 - DNA, 18 bp, Homo sapiens
ggcctcccctccatgggc

SEQ ID NO: 5429570 - DNA, 13 bp, Homo sapiens
ggcctcccctgag

SEQ ID NO: 5429571 - DNA, 22 bp, Homo sapiens
ggcctcccctgaggatcccctg

SEQ ID NO: 5429572 - DNA, 17 bp, Homo sapiens
ggcctcccctgccacca

SEQ ID NO: 5429573 - DNA, 14 bp, Homo sapiens
ggcctcccctgctg

SEQ ID NO: 5429574 - DNA, 21 bp, Homo sapiens
ggcctcccctgggcagggttc

SEQ ID NO: 5429575 - DNA, 21 bp, Homo sapiens
ggcctcccggggcccaggact

SEQ ID NO: 5429576 - DNA, 23 bp, Homo sapiens
ggcctccctagcacctcccccta

SEQ ID NO: 5429577 - DNA, 13 bp, Homo sapiens
ggcctccctcagg

SEQ ID NO: 5429578 - DNA, 15 bp, Homo sapiens
ggcctccctcaggct

SEQ ID NO: 5429579 - DNA, 20 bp, Homo sapiens
ggcctccctccgtccctctg

SEQ ID NO: 5429580 - DNA, 13 bp, Homo sapiens
ggcctccctcctt

SEQ ID NO: 5429581 - DNA, 17 bp, Homo sapiens
ggcctccctccttgggt

SEQ ID NO: 5429582 - DNA, 15 bp, Homo sapiens
ggcctccctcgggct

SEQ ID NO: 5429583 - DNA, 15 bp, Homo sapiens
ggcctccctctctct

SEQ ID NO: 5429584 - DNA, 13 bp, Homo sapiens
ggcctccctgcag

SEQ ID NO: 5429585 - DNA, 12 bp, Homo sapiens
ggcctccctgcc

SEQ ID NO: 5429586 - DNA, 19 bp, Homo sapiens
ggcctccctgccagtaggg

SEQ ID NO: 5429587 - DNA, 16 bp, Homo sapiens
ggcctccctgctgtgc

SEQ ID NO: 5429588 - DNA, 20 bp, Homo sapiens
ggcctccctggctcctccgt

SEQ ID NO: 5429589 - DNA, 21 bp, Homo sapiens
ggcctccctggctcctccgtc

SEQ ID NO: 5429590 - DNA, 15 bp, Homo sapiens
ggcctccctgttcac

SEQ ID NO: 5429591 - DNA, 14 bp, Homo sapiens
ggcctcccttctcc

SEQ ID NO: 5429592 - DNA, 20 bp, Homo sapiens
ggcctccctttgtgtgcata

SEQ ID NO: 5429593 - DNA, 15 bp, Homo sapiens
ggcctccgaggctcc

SEQ ID NO: 5429594 - DNA, 19 bp, Homo sapiens
ggcctccgcctgggtcatg

SEQ ID NO: 5429595 - DNA, 23 bp, Homo sapiens
ggcctccgcctgggtcatgggcc

SEQ ID NO: 5429596 - DNA, 16 bp, Homo sapiens
ggcctccggcctcccc

SEQ ID NO: 5429597 - DNA, 23 bp, Homo sapiens
ggcctccggcgtcagcctccagc

SEQ ID NO: 5429598 - DNA, 19 bp, Homo sapiens
ggcctcctaggggaagggg

SEQ ID NO: 5429599 - DNA, 20 bp, Homo sapiens
ggcctcctaggggaaggggg

SEQ ID NO: 5429600 - DNA, 15 bp, Homo sapiens
ggcctcctcagcctc

SEQ ID NO: 5429601 - DNA, 11 bp, Homo sapiens
ggcctcctccc

SEQ ID NO: 5429602 - DNA, 13 bp, Homo sapiens
ggcctcctccccc

SEQ ID NO: 5429603 - DNA, 21 bp, Homo sapiens
ggcctcctcctagctggagtg

SEQ ID NO: 5429604 - DNA, 14 bp, Homo sapiens
ggcctcctcctagg

SEQ ID NO: 5429605 - DNA, 23 bp, Homo sapiens
ggcctcctcctcacccttcccgg

SEQ ID NO: 5429606 - DNA, 17 bp, Homo sapiens
ggcctcctcggagagca

SEQ ID NO: 5429607 - DNA, 21 bp, Homo sapiens
ggcctcctcggagagcagcag

SEQ ID NO: 5429608 - DNA, 15 bp, Homo sapiens
ggcctcctctaacag

SEQ ID NO: 5429609 - DNA, 23 bp, Homo sapiens
ggcctcctctaacaggggctggt

SEQ ID NO: 5429610 - DNA, 14 bp, Homo sapiens
ggcctcctcttcac

SEQ ID NO: 5429611 - DNA, 23 bp, Homo sapiens
ggcctcctcttcaccccggcagg

SEQ ID NO: 5429612 - DNA, 15 bp, Homo sapiens
ggcctcctgcctcta

SEQ ID NO: 5429613 - DNA, 12 bp, Homo sapiens
ggcctcctgggg

SEQ ID NO: 5429614 - DNA, 14 bp, Homo sapiens
ggcctcctgggggc

SEQ ID NO: 5429615 - DNA, 14 bp, Homo sapiens
ggcctccttctgag

SEQ ID NO: 5429616 - DNA, 23 bp, Homo sapiens
ggcctccttcttccacttctcca

SEQ ID NO: 5429617 - DNA, 16 bp, Homo sapiens
ggcctccttgcttgtt

SEQ ID NO: 5429618 - DNA, 17 bp, Homo sapiens
ggcctccttgcttgtta

SEQ ID NO: 5429619 - DNA, 22 bp, Homo sapiens
ggcctcgcacttgcagaggagc

SEQ ID NO: 5429620 - DNA, 14 bp, Homo sapiens
ggcctcgcctgccc

SEQ ID NO: 5429621 - DNA, 15 bp, Homo sapiens
ggcctcgcctgccct

SEQ ID NO: 5429622 - DNA, 16 bp, Homo sapiens
ggcctcgcctgccctc

SEQ ID NO: 5429623 - DNA, 19 bp, Homo sapiens
ggcctcgcctgccctcctc

SEQ ID NO: 5429624 - DNA, 20 bp, Homo sapiens
ggcctcgcctgccctcctct

SEQ ID NO: 5429625 - DNA, 22 bp, Homo sapiens
ggcctcgcctgccctcctctcc

SEQ ID NO: 5429626 - DNA, 14 bp, Homo sapiens
ggcctcgcctgggc

SEQ ID NO: 5429627 - DNA, 16 bp, Homo sapiens
ggcctcgcctgggccc

SEQ ID NO: 5429628 - DNA, 20 bp, Homo sapiens
ggcctcgcctgggcccaggc

SEQ ID NO: 5429629 - DNA, 21 bp, Homo sapiens
ggcctcgcctgggcccaggct

SEQ ID NO: 5429630 - DNA, 23 bp, Homo sapiens
ggcctcgcctgggcccaggctct

SEQ ID NO: 5429631 - DNA, 20 bp, Homo sapiens
ggcctcggacttagctggga

SEQ ID NO: 5429632 - DNA, 13 bp, Homo sapiens
ggcctcggagcct

SEQ ID NO: 5429633 - DNA, 15 bp, Homo sapiens
ggcctcggagcctca

SEQ ID NO: 5429634 - DNA, 19 bp, Homo sapiens
ggcctcggagcctcatccg

SEQ ID NO: 5429635 - DNA, 19 bp, Homo sapiens
ggcctcggaggctcctccc

SEQ ID NO: 5429636 - DNA, 14 bp, Homo sapiens
ggcctcggcccctc

SEQ ID NO: 5429637 - DNA, 15 bp, Homo sapiens
ggcctcggcctggct

SEQ ID NO: 5429638 - DNA, 17 bp, Homo sapiens
ggcctcggcctggcttc

SEQ ID NO: 5429639 - DNA, 18 bp, Homo sapiens
ggcctcggctgtctcctg

SEQ ID NO: 5429640 - DNA, 19 bp, Homo sapiens
ggcctcggctgtctcctgt

SEQ ID NO: 5429641 - DNA, 22 bp, Homo sapiens
ggcctcgggacacctgccctgc

SEQ ID NO: 5429642 - DNA, 16 bp, Homo sapiens
ggcctcgggacctcag

SEQ ID NO: 5429643 - DNA, 18 bp, Homo sapiens
ggcctcggggcagggcag

SEQ ID NO: 5429644 - DNA, 15 bp, Homo sapiens
ggcctcgtaccagcc

SEQ ID NO: 5429645 - DNA, 17 bp, Homo sapiens
ggcctcgtaccagccag

SEQ ID NO: 5429646 - DNA, 20 bp, Homo sapiens
ggcctcgtgctccgcagggc

SEQ ID NO: 5429647 - DNA, 17 bp, Homo sapiens
ggcctctaaccccaggc

SEQ ID NO: 5429648 - DNA, 23 bp, Homo sapiens
ggcctctactaggtctgctcctg

SEQ ID NO: 5429649 - DNA, 13 bp, Homo sapiens
ggcctctagaaca

SEQ ID NO: 5429650 - DNA, 23 bp, Homo sapiens
ggcctctagaacacccactggcc

SEQ ID NO: 5429651 - DNA, 23 bp, Homo sapiens
ggcctctcacctctgtgcctctg

SEQ ID NO: 5429652 - DNA, 19 bp, Homo sapiens
ggcctctccaaccactgtg

SEQ ID NO: 5429653 - DNA, 19 bp, Homo sapiens
ggcctctccagcctcagcc

SEQ ID NO: 5429654 - DNA, 20 bp, Homo sapiens
ggcctctccatttgctcttc

SEQ ID NO: 5429655 - DNA, 20 bp, Homo sapiens
ggcctctccctcctccagga

SEQ ID NO: 5429656 - DNA, 23 bp, Homo sapiens
ggcctctccctcctccaggaagc

SEQ ID NO: 5429657 - DNA, 14 bp, Homo sapiens
ggcctctccctgcc

SEQ ID NO: 5429658 - DNA, 15 bp, Homo sapiens
ggcctctccctgcct

SEQ ID NO: 5429659 - DNA, 18 bp, Homo sapiens
ggcctctcggtgctccat

SEQ ID NO: 5429660 - DNA, 13 bp, Homo sapiens
ggcctctctagca

SEQ ID NO: 5429661 - DNA, 15 bp, Homo sapiens
ggcctctctcctgcc

SEQ ID NO: 5429662 - DNA, 19 bp, Homo sapiens
ggcctctctctctctcctc

SEQ ID NO: 5429663 - DNA, 22 bp, Homo sapiens
ggcctctctctctctcctcagg

SEQ ID NO: 5429664 - DNA, 14 bp, Homo sapiens
ggcctctctctgcc

SEQ ID NO: 5429665 - DNA, 12 bp, Homo sapiens
ggcctctctgcc

SEQ ID NO: 5429666 - DNA, 15 bp, Homo sapiens
ggcctctctgcccca

SEQ ID NO: 5429667 - DNA, 15 bp, Homo sapiens
ggcctctctggaaga

SEQ ID NO: 5429668 - DNA, 15 bp, Homo sapiens
ggcctctctggcctc

SEQ ID NO: 5429669 - DNA, 19 bp, Homo sapiens
ggcctctctggcctcccac

SEQ ID NO: 5429670 - DNA, 20 bp, Homo sapiens
ggcctctctggcctcccacc

SEQ ID NO: 5429671 - DNA, 18 bp, Homo sapiens
ggcctctctgggggaggc

SEQ ID NO: 5429672 - DNA, 19 bp, Homo sapiens
ggcctctcttttccccgcc

SEQ ID NO: 5429673 - DNA, 14 bp, Homo sapiens
ggcctctgagccca

SEQ ID NO: 5429674 - DNA, 13 bp, Homo sapiens
ggcctctgaggag

SEQ ID NO: 5429675 - DNA, 17 bp, Homo sapiens
ggcctctgaggagccca

SEQ ID NO: 5429676 - DNA, 14 bp, Homo sapiens
ggcctctgcactcc

SEQ ID NO: 5429677 - DNA, 12 bp, Homo sapiens
ggcctctgcaga

SEQ ID NO: 5429678 - DNA, 16 bp, Homo sapiens
ggcctctgccatcctc

SEQ ID NO: 5429679 - DNA, 23 bp, Homo sapiens
ggcctctgccccgtctcatgagg

SEQ ID NO: 5429680 - DNA, 23 bp, Homo sapiens
ggcctgtgcttggaggcctcaga

SEQ ID NO: 5429681 - DNA, 15 bp, Homo sapiens
ggcctgtggcacagc

SEQ ID NO: 5429682 - DNA, 16 bp, Homo sapiens
ggcctgtggcacagcc

SEQ ID NO: 5429683 - DNA, 14 bp, Homo sapiens
ggcctgtggcaggc

SEQ ID NO: 5429684 - DNA, 15 bp, Homo sapiens
ggcctgtggcaggcc

SEQ ID NO: 5429685 - DNA, 16 bp, Homo sapiens
ggcctgtggcaggcct

SEQ ID NO: 5429686 - DNA, 17 bp, Homo sapiens
ggcctgtggcaggccta

SEQ ID NO: 5429687 - DNA, 21 bp, Homo sapiens
ggcctgtggggactgaacctg

SEQ ID NO: 5429688 - DNA, 17 bp, Homo sapiens
ggcctgtggggagccga

SEQ ID NO: 5429689 - DNA, 20 bp, Homo sapiens
ggcctgtgtccagcagctgc

SEQ ID NO: 5429690 - DNA, 21 bp, Homo sapiens
ggcctgtgtccagcagctgcg

SEQ ID NO: 5429691 - DNA, 12 bp, Homo sapiens
ggcctgtgtccc

SEQ ID NO: 5429692 - DNA, 21 bp, Homo sapiens
ggcctgtgtctagttgtttga

SEQ ID NO: 5429693 - DNA, 17 bp, Homo sapiens
ggcctgtgtggaggcct

SEQ ID NO: 5429694 - DNA, 15 bp, Homo sapiens
ggcctgtgtgtaagc

SEQ ID NO: 5429695 - DNA, 12 bp, Homo sapiens
ggcctgtgtgtg

SEQ ID NO: 5429696 - DNA, 16 bp, Homo sapiens
ggcctgtgttcttcct

SEQ ID NO: 5429697 - DNA, 19 bp, Homo sapiens
ggcctgtgttcttcctggc

SEQ ID NO: 5429698 - DNA, 22 bp, Homo sapiens
ggcctgtgttcttcctggccgc

SEQ ID NO: 5429699 - DNA, 13 bp, Homo sapiens
ggcctgttcccta

SEQ ID NO: 5429700 - DNA, 17 bp, Homo sapiens
ggcctgttccctgagga

SEQ ID NO: 5429701 - DNA, 21 bp, Homo sapiens
ggcctgttccctgaggacctg

SEQ ID NO: 5429702 - DNA, 21 bp, Homo sapiens
ggcctgttcccttgtggcttg

SEQ ID NO: 5429703 - DNA, 22 bp, Homo sapiens
ggcctgttctcttggctgcaaa

SEQ ID NO: 5429704 - DNA, 14 bp, Homo sapiens
ggcctgttctgtag

SEQ ID NO: 5429705 - DNA, 16 bp, Homo sapiens
ggcctgttctgtagga

SEQ ID NO: 5429706 - DNA, 19 bp, Homo sapiens
ggcctgttctgtaggagag

SEQ ID NO: 5429707 - DNA, 20 bp, Homo sapiens
ggcctgttctgtaggagaga

SEQ ID NO: 5429708 - DNA, 23 bp, Homo sapiens
ggcctgttctgtaggagagactg

SEQ ID NO: 5429709 - DNA, 22 bp, Homo sapiens
ggcctgttgatgtttacatggc

SEQ ID NO: 5429710 - DNA, 11 bp, Homo sapiens
ggcctgttgcc

SEQ ID NO: 5429711 - DNA, 15 bp, Homo sapiens
ggcctgttgcccttt

SEQ ID NO: 5429712 - DNA, 21 bp, Homo sapiens
ggcctgttgctatagagccta

SEQ ID NO: 5429713 - DNA, 24 bp, Homo sapiens
ggcctgttgctatagagcctacct

SEQ ID NO: 5429714 - DNA, 22 bp, Homo sapiens
ggcctgttgggcagagctggac

SEQ ID NO: 5429715 - DNA, 17 bp, Homo sapiens
ggcctgtttggcctctc

SEQ ID NO: 5429716 - DNA, 14 bp, Homo sapiens
ggccttaagaactg

SEQ ID NO: 5429717 - DNA, 17 bp, Homo sapiens
ggccttacctcccctgc

SEQ ID NO: 5429718 - DNA, 20 bp, Homo sapiens
ggccttacctcccctgccag

SEQ ID NO: 5429719 - DNA, 24 bp, Homo sapiens
ggccttacctcccctgccagggct

SEQ ID NO: 5429720 - DNA, 15 bp, Homo sapiens
ggccttagaaaacat

SEQ ID NO: 5429721 - DNA, 15 bp, Homo sapiens
ggccttaggaagagc

SEQ ID NO: 5429722 - DNA, 15 bp, Homo sapiens
ggccttagggcactg

SEQ ID NO: 5429723 - DNA, 21 bp, Homo sapiens
ggccttaggggtcatgtatga

SEQ ID NO: 5429724 - DNA, 21 bp, Homo sapiens
ggccttagtgggccagggctg

SEQ ID NO: 5429725 - DNA, 14 bp, Homo sapiens
ggccttcaccaagc

SEQ ID NO: 5429726 - DNA, 17 bp, Homo sapiens
ggccttccagctgctgt

SEQ ID NO: 5429727 - DNA, 15 bp, Homo sapiens
ggccttcccatggcc

SEQ ID NO: 5429728 - DNA, 18 bp, Homo sapiens
ggccttcccctcccagcc

SEQ ID NO: 5429729 - DNA, 21 bp, Homo sapiens
ggccttcccctcccagccctg

SEQ ID NO: 5429730 - DNA, 22 bp, Homo sapiens
ggccttcccgccggaggccagc

SEQ ID NO: 5429731 - DNA, 15 bp, Homo sapiens
ggccttccctcccca

SEQ ID NO: 5429732 - DNA, 14 bp, Homo sapiens
ggccttcctgccct

SEQ ID NO: 5429733 - DNA, 18 bp, Homo sapiens
ggccttcgattttaaata

SEQ ID NO: 5429734 - DNA, 19 bp, Homo sapiens
ggccttcgggaccctgggg

SEQ ID NO: 5429735 - DNA, 13 bp, Homo sapiens
ggccttctcagcc

SEQ ID NO: 5429736 - DNA, 22 bp, Homo sapiens
ggccttctcagcctacagcagt

SEQ ID NO: 5429737 - DNA, 14 bp, Homo sapiens
ggccttctcagctc

SEQ ID NO: 5429738 - DNA, 17 bp, Homo sapiens
ggccttctcccctcttc

SEQ ID NO: 5429739 - DNA, 19 bp, Homo sapiens
ggccttctcccctcttctg

SEQ ID NO: 5429740 - DNA, 20 bp, Homo sapiens
ggccttctgcctgctgacca

SEQ ID NO: 5429741 - DNA, 21 bp, Homo sapiens
ggccttctgctgcccaggcca

SEQ ID NO: 5429742 - DNA, 20 bp, Homo sapiens
ggccttctggttttaggaaa

SEQ ID NO: 5429743 - DNA, 12 bp, Homo sapiens
ggccttcttggt

SEQ ID NO: 5429744 - DNA, 18 bp, Homo sapiens
ggccttgaagactccctg

SEQ ID NO: 5429745 - DNA, 23 bp, Homo sapiens
ggccttgacatcagttcctttgt

SEQ ID NO: 5429746 - DNA, 18 bp, Homo sapiens
ggccttgagtctctgaat

SEQ ID NO: 5429747 - DNA, 18 bp, Homo sapiens
ggccttgatgactgcctt

SEQ ID NO: 5429748 - DNA, 16 bp, Homo sapiens
ggccttgcagctggcc

SEQ ID NO: 5429749 - DNA, 12 bp, Homo sapiens
ggccttgccagt

SEQ ID NO: 5429750 - DNA, 15 bp, Homo sapiens
ggccttgcctccagg

SEQ ID NO: 5429751 - DNA, 17 bp, Homo sapiens
ggccttgcggaagccat

SEQ ID NO: 5429752 - DNA, 21 bp, Homo sapiens
ggccttgcggaagccataggg

SEQ ID NO: 5429753 - DNA, 19 bp, Homo sapiens
ggccttgcggctcctcagg

SEQ ID NO: 5429754 - DNA, 12 bp, Homo sapiens
ggccttgctctg

SEQ ID NO: 5429755 - DNA, 15 bp, Homo sapiens
ggccttgctctgagc

SEQ ID NO: 5429756 - DNA, 22 bp, Homo sapiens
ggccttgctggggtccagggct

SEQ ID NO: 5429757 - DNA, 15 bp, Homo sapiens
ggccttgctgtcatg

SEQ ID NO: 5429758 - DNA, 22 bp, Homo sapiens
ggccttgctttgtctggcctca

SEQ ID NO: 5429759 - DNA, 22 bp, Homo sapiens
ggccttggatcgctaagctggc

SEQ ID NO: 5429760 - DNA, 19 bp, Homo sapiens
ggccttggcatgggcgcag

SEQ ID NO: 5429761 - DNA, 22 bp, Homo sapiens
ggccttggcatgggcgcaggcc

SEQ ID NO: 5429762 - DNA, 16 bp, Homo sapiens
ggccttggcctggagc

SEQ ID NO: 5429763 - DNA, 17 bp, Homo sapiens
ggccttgggggtctgct

SEQ ID NO: 5429764 - DNA, 23 bp, Homo sapiens
ggccttggggtgggggccaggcc

SEQ ID NO: 5429765 - DNA, 17 bp, Homo sapiens
ggccttgggtgttccac

SEQ ID NO: 5429766 - DNA, 18 bp, Homo sapiens
ggccttggtatgtgccag

SEQ ID NO: 5429767 - DNA, 20 bp, Homo sapiens
ggccttggtggagcagccag

SEQ ID NO: 5429768 - DNA, 18 bp, Homo sapiens
ggccttggttcctccagc

SEQ ID NO: 5429769 - DNA, 19 bp, Homo sapiens
ggccttggttcctccagca

SEQ ID NO: 5429770 - DNA, 20 bp, Homo sapiens
ggccttgtcaggacccaggc

SEQ ID NO: 5429771 - DNA, 21 bp, Homo sapiens
ggccttgtcaggacccaggcc

SEQ ID NO: 5429772 - DNA, 19 bp, Homo sapiens
ggccttgtccccagctcca

SEQ ID NO: 5429773 - DNA, 18 bp, Homo sapiens
ggccttgtggtccaaata

SEQ ID NO: 5429774 - DNA, 20 bp, Homo sapiens
ggccttgtgtgtcaggccct

SEQ ID NO: 5429775 - DNA, 23 bp, Homo sapiens
ggccttgtgtgtcaggccctctg

SEQ ID NO: 5429776 - DNA, 15 bp, Homo sapiens
ggccttgttctctct

SEQ ID NO: 5429777 - DNA, 14 bp, Homo sapiens
ggcctttaaaattt

SEQ ID NO: 5429778 - DNA, 21 bp, Homo sapiens
ggcctttatctcaacggaagc

SEQ ID NO: 5429779 - DNA, 23 bp, Homo sapiens
ggcctttcagtgtagcgggagga

SEQ ID NO: 5429780 - DNA, 14 bp, Homo sapiens
ggcctttcctacat

SEQ ID NO: 5429781 - DNA, 13 bp, Homo sapiens
ggcctttcctctg

SEQ ID NO: 5429782 - DNA, 16 bp, Homo sapiens
ggcctttcctggaagc

SEQ ID NO: 5429783 - DNA, 12 bp, Homo sapiens
ggcctttcttct

SEQ ID NO: 5429784 - DNA, 17 bp, Homo sapiens
ggcctttcttggggaga

SEQ ID NO: 5429785 - DNA, 13 bp, Homo sapiens
ggcctttgagctc

SEQ ID NO: 5429786 - DNA, 17 bp, Homo sapiens
ggcctttgctgcccttg

SEQ ID NO: 5429787 - DNA, 23 bp, Homo sapiens
ggcctttgcttatgaatatttat

SEQ ID NO: 5429788 - DNA, 14 bp, Homo sapiens
ggcctttggcttca

SEQ ID NO: 5429789 - DNA, 19 bp, Homo sapiens
ggcctttgtaagacacaca

SEQ ID NO: 5429790 - DNA, 21 bp, Homo sapiens
ggcctttgtaagacacacagc

SEQ ID NO: 5429791 - DNA, 23 bp, Homo sapiens
ggcctttgtaagacacacagcct

SEQ ID NO: 5429792 - DNA, 15 bp, Homo sapiens
ggccttttccaaatg

SEQ ID NO: 5429793 - DNA, 22 bp, Homo sapiens
ggccttttgacggccttcttgg

SEQ ID NO: 5429794 - DNA, 22 bp, Homo sapiens
ggccttttgctacgtgcctccc

SEQ ID NO: 5429795 - DNA, 23 bp, Homo sapiens
ggccttttgttaaacccttctgt

SEQ ID NO: 5429796 - DNA, 15 bp, Homo sapiens
ggcctttttcattta

SEQ ID NO: 5429797 - DNA, 15 bp, Homo sapiens
ggcctttttgagcca

SEQ ID NO: 5429798 - DNA, 14 bp, Homo sapiens
ggcgaagcctgagc

SEQ ID NO: 5429799 - DNA, 21 bp, Homo sapiens
ggcgaagcctgagcaggcagg

SEQ ID NO: 5429800 - DNA, 16 bp, Homo sapiens
ggcgaaggccattggg

SEQ ID NO: 5429801 - DNA, 17 bp, Homo sapiens
ggcgaataaatgttcaa

SEQ ID NO: 5429802 - DNA, 17 bp, Homo sapiens
ggcgaatctcaaaatta

SEQ ID NO: 5429803 - DNA, 17 bp, Homo sapiens
ggcgacaagagtgagac

SEQ ID NO: 5429804 - DNA, 17 bp, Homo sapiens
ggcgacagagcaagact

SEQ ID NO: 5429805 - DNA, 23 bp, Homo sapiens
ggcgacagagcgagagtctgtct

SEQ ID NO: 5429806 - DNA, 19 bp, Homo sapiens
ggcgaccccgtcacagcct

SEQ ID NO: 5429807 - DNA, 13 bp, Homo sapiens
ggcgacccctcag

SEQ ID NO: 5429808 - DNA, 17 bp, Homo sapiens
ggcgacccctcagtgct

SEQ ID NO: 5429809 - DNA, 16 bp, Homo sapiens
ggcgaccgccctccgc

SEQ ID NO: 5429810 - DNA, 14 bp, Homo sapiens
ggcgaccgggcctc

SEQ ID NO: 5429811 - DNA, 15 bp, Homo sapiens
ggcgaccgggcctcc

SEQ ID NO: 5429812 - DNA, 12 bp, Homo sapiens
ggcgactgtgaa

SEQ ID NO: 5429813 - DNA, 18 bp, Homo sapiens
ggcgacttcctctccagc

SEQ ID NO: 5429814 - DNA, 15 bp, Homo sapiens
ggcgagagaggagcc

SEQ ID NO: 5429815 - DNA, 15 bp, Homo sapiens
ggcgagaggaggggc

SEQ ID NO: 5429816 - DNA, 20 bp, Homo sapiens
ggcgagcatgggggctgcca

SEQ ID NO: 5429817 - DNA, 21 bp, Homo sapiens
ggcgagcatgggggctgccag

SEQ ID NO: 5429818 - DNA, 20 bp, Homo sapiens
ggcgagccagattaggcctg

SEQ ID NO: 5429819 - DNA, 18 bp, Homo sapiens
ggcgagcccttagccttg

SEQ ID NO: 5429820 - DNA, 14 bp, Homo sapiens
ggcgaggaaaaaca

SEQ ID NO: 5429821 - DNA, 11 bp, Homo sapiens
ggcgaggcaga

SEQ ID NO: 5429822 - DNA, 15 bp, Homo sapiens
ggcgaggcagaggac

SEQ ID NO: 5429823 - DNA, 20 bp, Homo sapiens
ggcgaggcccttggcgggca

SEQ ID NO: 5429824 - DNA, 14 bp, Homo sapiens
ggcgaggccgccca

SEQ ID NO: 5429825 - DNA, 22 bp, Homo sapiens
ggcgaggccggagagctggtga

SEQ ID NO: 5429826 - DNA, 23 bp, Homo sapiens
ggcgaggcctgacacaggccagc

SEQ ID NO: 5429827 - DNA, 19 bp, Homo sapiens
ggcgaggcgaagctgagcg

SEQ ID NO: 5429828 - DNA, 21 bp, Homo sapiens
ggcgaggcgaagctgagcggg

SEQ ID NO: 5429829 - DNA, 15 bp, Homo sapiens
ggcgaggctgcctct

SEQ ID NO: 5429830 - DNA, 16 bp, Homo sapiens
ggcgaggctgcctctg

SEQ ID NO: 5429831 - DNA, 15 bp, Homo sapiens
ggcgagggaggggag

SEQ ID NO: 5429832 - DNA, 19 bp, Homo sapiens
ggcgagggaggggaggtgg

SEQ ID NO: 5429833 - DNA, 21 bp, Homo sapiens
ggcgaggggagggtggcaggt

SEQ ID NO: 5429834 - DNA, 17 bp, Homo sapiens
ggcgaggggttggtggg

SEQ ID NO: 5429835 - DNA, 22 bp, Homo sapiens
ggcgagtcaccctcctcacaga

SEQ ID NO: 5429836 - DNA, 15 bp, Homo sapiens
ggcgagtcactgcct

SEQ ID NO: 5429837 - DNA, 16 bp, Homo sapiens
ggcgagtcactgcctc

SEQ ID NO: 5429838 - DNA, 18 bp, Homo sapiens
ggcgagtccaggagctca

SEQ ID NO: 5429839 - DNA, 23 bp, Homo sapiens
ggcgagtccaggagctcaggaag

SEQ ID NO: 5429840 - DNA, 16 bp, Homo sapiens
ggcgagtgccaggact

SEQ ID NO: 5429841 - DNA, 17 bp, Homo sapiens
ggcgatccacctgtctc

SEQ ID NO: 5429842 - DNA, 18 bp, Homo sapiens
ggcgatccacctgtctca

SEQ ID NO: 5429843 - DNA, 17 bp, Homo sapiens
ggcgatctcccagggct

SEQ ID NO: 5429844 - DNA, 22 bp, Homo sapiens
ggcgatctcccagggctctctg

SEQ ID NO: 5429845 - DNA, 14 bp, Homo sapiens
ggcgatgccacgct

SEQ ID NO: 5429846 - DNA, 18 bp, Homo sapiens
ggcgcaaaggtgcctcat

SEQ ID NO: 5429847 - DNA, 14 bp, Homo sapiens
ggcgcaagcctgta

SEQ ID NO: 5429848 - DNA, 14 bp, Homo sapiens
ggcgcaccccacag

SEQ ID NO: 5429849 - DNA, 16 bp, Homo sapiens
ggcgcaccccacagct

SEQ ID NO: 5429850 - DNA, 18 bp, Homo sapiens
ggcgcaccccacagctgg

SEQ ID NO: 5429851 - DNA, 19 bp, Homo sapiens
ggcgcacccggcagccccc

SEQ ID NO: 5429852 - DNA, 20 bp, Homo sapiens
ggcgcacccggcagcccccc

SEQ ID NO: 5429853 - DNA, 12 bp, Homo sapiens
ggcgcactgtga

SEQ ID NO: 5429854 - DNA, 17 bp, Homo sapiens
ggcgcagagccctccag

SEQ ID NO: 5429855 - DNA, 20 bp, Homo sapiens
ggcgcagagccctccaggcc

SEQ ID NO: 5429856 - DNA, 14 bp, Homo sapiens
ggctcactgcaggc

SEQ ID NO: 5429857 - DNA, 12 bp, Homo sapiens
ggctcactggca

SEQ ID NO: 5429858 - DNA, 14 bp, Homo sapiens
ggctcactggcagg

SEQ ID NO: 5429859 - DNA, 14 bp, Homo sapiens
ggctcactggctgg

SEQ ID NO: 5429860 - DNA, 20 bp, Homo sapiens
ggctcacttttcatccttcc

SEQ ID NO: 5429861 - DNA, 21 bp, Homo sapiens
ggctcagaaaataccttagct

SEQ ID NO: 5429862 - DNA, 14 bp, Homo sapiens
ggctcagacccctc

SEQ ID NO: 5429863 - DNA, 15 bp, Homo sapiens
ggctcagacccctca

SEQ ID NO: 5429864 - DNA, 19 bp, Homo sapiens
ggctcagagagtacactgt

SEQ ID NO: 5429865 - DNA, 19 bp, Homo sapiens
ggctcagagctgctgagca

SEQ ID NO: 5429866 - DNA, 17 bp, Homo sapiens
ggctcagagcttgaaga

SEQ ID NO: 5429867 - DNA, 15 bp, Homo sapiens
ggctcagagctttgt

SEQ ID NO: 5429868 - DNA, 20 bp, Homo sapiens
ggctcagagggtgtcctgca

SEQ ID NO: 5429869 - DNA, 19 bp, Homo sapiens
ggctcagagtgaccctcag

SEQ ID NO: 5429870 - DNA, 13 bp, Homo sapiens
ggctcagatctca

SEQ ID NO: 5429871 - DNA, 17 bp, Homo sapiens
ggctcagatgaaatgca

SEQ ID NO: 5429872 - DNA, 22 bp, Homo sapiens
ggctcagatggactgggaggag

SEQ ID NO: 5429873 - DNA, 21 bp, Homo sapiens
ggctcagatggggcctgggct

SEQ ID NO: 5429874 - DNA, 18 bp, Homo sapiens
ggctcagcaaggccacct

SEQ ID NO: 5429875 - DNA, 16 bp, Homo sapiens
ggctcagcagggctgg

SEQ ID NO: 5429876 - DNA, 14 bp, Homo sapiens
ggctcagcatcctc

SEQ ID NO: 5429877 - DNA, 16 bp, Homo sapiens
ggctcagcatcctcca

SEQ ID NO: 5429878 - DNA, 15 bp, Homo sapiens
ggctcagccagcact

SEQ ID NO: 5429879 - DNA, 21 bp, Homo sapiens
ggctcagccctagccctcagc

SEQ ID NO: 5429880 - DNA, 10 bp, Homo sapiens
ggctcagcct

SEQ ID NO: 5429881 - DNA, 11 bp, Homo sapiens
ggctcagcctg

SEQ ID NO: 5429882 - DNA, 13 bp, Homo sapiens
ggctcagcctggt

SEQ ID NO: 5429883 - DNA, 20 bp, Homo sapiens
ggctcagcctggtgggcctc

SEQ ID NO: 5429884 - DNA, 18 bp, Homo sapiens
ggctcagccttgcacacc

SEQ ID NO: 5429885 - DNA, 19 bp, Homo sapiens
ggctcagcggggacagctc

SEQ ID NO: 5429886 - DNA, 22 bp, Homo sapiens
ggctcagcggggacagctcctt

SEQ ID NO: 5429887 - DNA, 23 bp, Homo sapiens
ggctcagcggggacagctccttc

SEQ ID NO: 5429888 - DNA, 13 bp, Homo sapiens
ggctcagctctgg

SEQ ID NO: 5429889 - DNA, 18 bp, Homo sapiens
ggctcagctctggctcac

SEQ ID NO: 5429890 - DNA, 12 bp, Homo sapiens
ggctcagctgtg

SEQ ID NO: 5429891 - DNA, 12 bp, Homo sapiens
ggctcaggaaaa

SEQ ID NO: 5429892 - DNA, 22 bp, Homo sapiens
ggctcaggaagaaaccccaagc

SEQ ID NO: 5429893 - DNA, 11 bp, Homo sapiens
ggctcaggaga

SEQ ID NO: 5429894 - DNA, 22 bp, Homo sapiens
ggctcaggagagggccttcccc

SEQ ID NO: 5429895 - DNA, 15 bp, Homo sapiens
ggctcaggcaagccc

SEQ ID NO: 5429896 - DNA, 19 bp, Homo sapiens
ggctcaggcaagcccctca

SEQ ID NO: 5429897 - DNA, 12 bp, Homo sapiens
ggctcaggcaga

SEQ ID NO: 5429898 - DNA, 15 bp, Homo sapiens
ggctcaggcaggggc

SEQ ID NO: 5429899 - DNA, 11 bp, Homo sapiens
ggctcaggctc

SEQ ID NO: 5429900 - DNA, 14 bp, Homo sapiens
ggctcagggaggga

SEQ ID NO: 5429901 - DNA, 14 bp, Homo sapiens
ggctcagggccagg

SEQ ID NO: 5429902 - DNA, 16 bp, Homo sapiens
ggctcagggccaggtc

SEQ ID NO: 5429903 - DNA, 17 bp, Homo sapiens
ggctcagggccaggtcc

SEQ ID NO: 5429904 - DNA, 19 bp, Homo sapiens
ggctcagggcccacctcct

SEQ ID NO: 5429905 - DNA, 12 bp, Homo sapiens
ggctcagggctg

SEQ ID NO: 5429906 - DNA, 16 bp, Homo sapiens
ggctcagggttggcca

SEQ ID NO: 5429907 - DNA, 20 bp, Homo sapiens
ggctcaggtggggtcactct

SEQ ID NO: 5429908 - DNA, 13 bp, Homo sapiens
ggctcagtgccac

SEQ ID NO: 5429909 - DNA, 15 bp, Homo sapiens
ggctcagtgccacct

SEQ ID NO: 5429910 - DNA, 20 bp, Homo sapiens
ggctcagtttgtataaactg

SEQ ID NO: 5429911 - DNA, 20 bp, Homo sapiens
ggctcatattcctgcagcct

SEQ ID NO: 5429912 - DNA, 22 bp, Homo sapiens
ggctcatattcctgcagcctgg

SEQ ID NO: 5429913 - DNA, 17 bp, Homo sapiens
ggctcatcggtggaagc

SEQ ID NO: 5429914 - DNA, 21 bp, Homo sapiens
ggctcatgcctgtaatctcag

SEQ ID NO: 5429915 - DNA, 17 bp, Homo sapiens
ggctcatggccctgtag

SEQ ID NO: 5429916 - DNA, 22 bp, Homo sapiens
ggctcatggcgtaatgggcctg

SEQ ID NO: 5429917 - DNA, 23 bp, Homo sapiens
ggctcatggcgtaatgggcctgc

SEQ ID NO: 5429918 - DNA, 18 bp, Homo sapiens
ggctcattctgcaatgag

SEQ ID NO: 5429919 - DNA, 14 bp, Homo sapiens
ggctcattcttttc

SEQ ID NO: 5429920 - DNA, 16 bp, Homo sapiens
ggctcatttaaaacag

SEQ ID NO: 5429921 - DNA, 17 bp, Homo sapiens
ggctccaaaccctcgag

SEQ ID NO: 5429922 - DNA, 12 bp, Homo sapiens
ggctccaacaga

SEQ ID NO: 5429923 - DNA, 13 bp, Homo sapiens
ggctccaactcct

SEQ ID NO: 5429924 - DNA, 16 bp, Homo sapiens
ggctccaagaggctga

SEQ ID NO: 5429925 - DNA, 17 bp, Homo sapiens
ggctccaagaggctgag

SEQ ID NO: 5429926 - DNA, 12 bp, Homo sapiens
ggctccacacag

SEQ ID NO: 5429927 - DNA, 16 bp, Homo sapiens
ggctccacacagcagt

SEQ ID NO: 5429928 - DNA, 17 bp, Homo sapiens
ggctccacacagcagtg

SEQ ID NO: 5429929 - DNA, 19 bp, Homo sapiens
ggctccacacagcagtgtc

SEQ ID NO: 5429930 - DNA, 22 bp, Homo sapiens
ggctccacacagcagtgtcccc

SEQ ID NO: 5429931 - DNA, 18 bp, Homo sapiens
ggctccacacctccaatg

SEQ ID NO: 5429932 - DNA, 16 bp, Homo sapiens
ggctccacacctccac

SEQ ID NO: 5429933 - DNA, 22 bp, Homo sapiens
ggctccacctgttcaggagctg

SEQ ID NO: 5429934 - DNA, 15 bp, Homo sapiens
ggctccacgccctgg

SEQ ID NO: 5429935 - DNA, 16 bp, Homo sapiens
ggctccacttggtctg

SEQ ID NO: 5429936 - DNA, 16 bp, Homo sapiens
ggctccagacaggagg

SEQ ID NO: 5429937 - DNA, 19 bp, Homo sapiens
ggctccagacaggaggagt

SEQ ID NO: 5429938 - DNA, 12 bp, Homo sapiens
ggctccagagca

SEQ ID NO: 5429939 - DNA, 15 bp, Homo sapiens
ggctccagagggcac

SEQ ID NO: 5429940 - DNA, 16 bp, Homo sapiens
ggctccagatgcaggg

SEQ ID NO: 5429941 - DNA, 18 bp, Homo sapiens
ggctccagcaccttcttt

SEQ ID NO: 5429942 - DNA, 18 bp, Homo sapiens
ggctccagcatccagcct

SEQ ID NO: 5429943 - DNA, 16 bp, Homo sapiens
ggctccagcccagccc

SEQ ID NO: 5429944 - DNA, 22 bp, Homo sapiens
ggctccagcccctcttggagaa

SEQ ID NO: 5429945 - DNA, 23 bp, Homo sapiens
ggctccagcccctcttggagaag

SEQ ID NO: 5429946 - DNA, 17 bp, Homo sapiens
ggctccagcctgtcggc

SEQ ID NO: 5429947 - DNA, 12 bp, Homo sapiens
ggctccagctca

SEQ ID NO: 5429948 - DNA, 12 bp, Homo sapiens
ggctccagctgg

SEQ ID NO: 5429949 - DNA, 20 bp, Homo sapiens
ggctccaggactccactgga

SEQ ID NO: 5429950 - DNA, 12 bp, Homo sapiens
ggctccaggagc

SEQ ID NO: 5429951 - DNA, 14 bp, Homo sapiens
ggctccaggcagca

SEQ ID NO: 5429952 - DNA, 12 bp, Homo sapiens
ggctccaggctc

SEQ ID NO: 5429953 - DNA, 17 bp, Homo sapiens
ggctccagttgaacact

SEQ ID NO: 5429954 - DNA, 17 bp, Homo sapiens
ggctccatatcatttga

SEQ ID NO: 5429955 - DNA, 18 bp, Homo sapiens
ggctccatgattctctga

SEQ ID NO: 5429956 - DNA, 22 bp, Homo sapiens
ggctccatgattctctgagtgg

SEQ ID NO: 5429957 - DNA, 19 bp, Homo sapiens
ggctccatgcacctccctt

SEQ ID NO: 5429958 - DNA, 11 bp, Homo sapiens
ggctccatgct

SEQ ID NO: 5429959 - DNA, 16 bp, Homo sapiens
ggctccatgctgggtc

SEQ ID NO: 5429960 - DNA, 14 bp, Homo sapiens
ggctccatgctggt

SEQ ID NO: 5429961 - DNA, 16 bp, Homo sapiens
ggctccatggaggagg

SEQ ID NO: 5429962 - DNA, 23 bp, Homo sapiens
ggctccatggggaagtgctcccc

SEQ ID NO: 5429963 - DNA, 12 bp, Homo sapiens
ggctcccaaggt

SEQ ID NO: 5429964 - DNA, 18 bp, Homo sapiens
ggctcccaagtcacaccc

SEQ ID NO: 5429965 - DNA, 18 bp, Homo sapiens
ggctcccaatcagctttt

SEQ ID NO: 5429966 - DNA, 15 bp, Homo sapiens
ggctcccacaggtct

SEQ ID NO: 5429967 - DNA, 21 bp, Homo sapiens
ggctcccacaggtcttcactg

SEQ ID NO: 5429968 - DNA, 17 bp, Homo sapiens
ggctcccaccctcaagg

SEQ ID NO: 5429969 - DNA, 20 bp, Homo sapiens
ggctcccaccggtgccaaac

SEQ ID NO: 5429970 - DNA, 19 bp, Homo sapiens
ggctcccacgccctcctcc

SEQ ID NO: 5429971 - DNA, 22 bp, Homo sapiens
ggctcccacgccctcctccctc

SEQ ID NO: 5429972 - DNA, 19 bp, Homo sapiens
ggctcccactgcccctgca

SEQ ID NO: 5429973 - DNA, 18 bp, Homo sapiens
ggctcccagacccagggc

SEQ ID NO: 5429974 - DNA, 14 bp, Homo sapiens
ggctcccagcagag

SEQ ID NO: 5429975 - DNA, 16 bp, Homo sapiens
ggctcccagccaggcc

SEQ ID NO: 5429976 - DNA, 12 bp, Homo sapiens
ggctcccagcct

SEQ ID NO: 5429977 - DNA, 15 bp, Homo sapiens
ggctcccagcctaag

SEQ ID NO: 5429978 - DNA, 16 bp, Homo sapiens
ggctcccagcctaagg

SEQ ID NO: 5429979 - DNA, 22 bp, Homo sapiens
ggctcccagctcctttctcctg

SEQ ID NO: 5429980 - DNA, 13 bp, Homo sapiens
ggctcccaggaca

SEQ ID NO: 5429981 - DNA, 14 bp, Homo sapiens
ggctcccaggacac

SEQ ID NO: 5429982 - DNA, 21 bp, Homo sapiens
ggctcccaggagcctgcccag

SEQ ID NO: 5429983 - DNA, 13 bp, Homo sapiens
ggctcccaggggc

SEQ ID NO: 5429984 - DNA, 13 bp, Homo sapiens
ggctcccatctcc

SEQ ID NO: 5429985 - DNA, 15 bp, Homo sapiens
ggctcccatctccct

SEQ ID NO: 5429986 - DNA, 19 bp, Homo sapiens
ggctcccatgaccatactg

SEQ ID NO: 5429987 - DNA, 16 bp, Homo sapiens
ggctcccatgggctag

SEQ ID NO: 5429988 - DNA, 15 bp, Homo sapiens
ggctcccatgtgagt

SEQ ID NO: 5429989 - DNA, 21 bp, Homo sapiens
ggctcccattttcagttccct

SEQ ID NO: 5429990 - DNA, 22 bp, Homo sapiens
ggctcccattttcagttccctc

SEQ ID NO: 5429991 - DNA, 16 bp, Homo sapiens
ggctccccaaggctgc

SEQ ID NO: 5429992 - DNA, 12 bp, Homo sapiens
ggctccccacct

SEQ ID NO: 5429993 - DNA, 14 bp, Homo sapiens
ggctccccacctgg

SEQ ID NO: 5429994 - DNA, 13 bp, Homo sapiens
ggctccccacgag

SEQ ID NO: 5429995 - DNA, 21 bp, Homo sapiens
ggctccccacgagtcacctgc

SEQ ID NO: 5429996 - DNA, 12 bp, Homo sapiens
ggctccccagaa

SEQ ID NO: 5429997 - DNA, 21 bp, Homo sapiens
ggctccccagaactggctggg

SEQ ID NO: 5429998 - DNA, 21 bp, Homo sapiens
ggctccccatgtgtcctggtt

SEQ ID NO: 5429999 - DNA, 17 bp, Homo sapiens
ggctccccctccccagg

SEQ ID NO: 5430000 - DNA, 20 bp, Homo sapiens
ggctccccctctgcttctcg

SEQ ID NO: 5430001 - DNA, 15 bp, Homo sapiens
ggctccccctgccag

SEQ ID NO: 5430002 - DNA, 18 bp, Homo sapiens
ggctccccgcctccactc

SEQ ID NO: 5430003 - DNA, 11 bp, Homo sapiens
ggctcccctct

SEQ ID NO: 5430004 - DNA, 14 bp, Homo sapiens
ggctcccctctgct

SEQ ID NO: 5430005 - DNA, 15 bp, Homo sapiens
ggctcccctcttcct

SEQ ID NO: 5430006 - DNA, 18 bp, Homo sapiens
ggctcccctcttcctctt

SEQ ID NO: 5430007 - DNA, 13 bp, Homo sapiens
ggctcccctgagg

SEQ ID NO: 5430008 - DNA, 11 bp, Homo sapiens
ggctcccctgg

SEQ ID NO: 5430009 - DNA, 13 bp, Homo sapiens
ggctcccctgggg

SEQ ID NO: 5430010 - DNA, 13 bp, Homo sapiens
ggctcccctggtc

SEQ ID NO: 5430011 - DNA, 20 bp, Homo sapiens
ggctcccctttttcttcctc

SEQ ID NO: 5430012 - DNA, 19 bp, Homo sapiens
ggctcccgaccccatccac

SEQ ID NO: 5430013 - DNA, 17 bp, Homo sapiens
ggctcccgccaccctca

SEQ ID NO: 5430014 - DNA, 20 bp, Homo sapiens
ggctcccgcctccaacccct

SEQ ID NO: 5430015 - DNA, 21 bp, Homo sapiens
ggctcccgcttgctctcctgg

SEQ ID NO: 5430016 - DNA, 17 bp, Homo sapiens
ggctcccgggtccttgg

SEQ ID NO: 5430017 - DNA, 22 bp, Homo sapiens
ggctcccgtgtatctggacact

SEQ ID NO: 5430018 - DNA, 20 bp, Homo sapiens
ggctccctacattccccaga

SEQ ID NO: 5430019 - DNA, 16 bp, Homo sapiens
ggctccctcccaccca

SEQ ID NO: 5430020 - DNA, 18 bp, Homo sapiens
ggctccctcccacccaac

SEQ ID NO: 5430021 - DNA, 17 bp, Homo sapiens
ggctccctccctcccag

SEQ ID NO: 5430022 - DNA, 22 bp, Homo sapiens
ggctccctccctcccagatcca

SEQ ID NO: 5430023 - DNA, 23 bp, Homo sapiens
ggctccctccctcccagatccag

SEQ ID NO: 5430024 - DNA, 19 bp, Homo sapiens
ggctccctccctccctgct

SEQ ID NO: 5430025 - DNA, 23 bp, Homo sapiens
ggctccctccctccctgctccct

SEQ ID NO: 5430026 - DNA, 17 bp, Homo sapiens
ggctccctccgccccca

SEQ ID NO: 5430027 - DNA, 12 bp, Homo sapiens
ggctccctcctc

SEQ ID NO: 5430028 - DNA, 14 bp, Homo sapiens
ggctccctcctctg

SEQ ID NO: 5430029 - DNA, 17 bp, Homo sapiens
ggctccctcctctggca

SEQ ID NO: 5430030 - DNA, 16 bp, Homo sapiens
ggctccctcctggagc

SEQ ID NO: 5430031 - DNA, 15 bp, Homo sapiens
ggctccctctctcct

SEQ ID NO: 5430032 - DNA, 16 bp, Homo sapiens
ggctccctctctcctg

SEQ ID NO: 5430033 - DNA, 19 bp, Homo sapiens
ggctccctctctcctggac

SEQ ID NO: 5430034 - DNA, 20 bp, Homo sapiens
ggctccctctctcctggact

SEQ ID NO: 5430035 - DNA, 15 bp, Homo sapiens
ggctccctctctggt

SEQ ID NO: 5430036 - DNA, 16 bp, Homo sapiens
ggctctcctggcttcc

SEQ ID NO: 5430037 - DNA, 17 bp, Homo sapiens
ggctctcgggtggggga

SEQ ID NO: 5430038 - DNA, 18 bp, Homo sapiens
ggctctcgggtgggggag

SEQ ID NO: 5430039 - DNA, 22 bp, Homo sapiens
ggctctcgggtgggggagccag

SEQ ID NO: 5430040 - DNA, 21 bp, Homo sapiens
ggctctctaagaaaagagagg

SEQ ID NO: 5430041 - DNA, 19 bp, Homo sapiens
ggctctctcacccagcctg

SEQ ID NO: 5430042 - DNA, 14 bp, Homo sapiens
ggctctctccagga

SEQ ID NO: 5430043 - DNA, 16 bp, Homo sapiens
ggctctctcctctctc

SEQ ID NO: 5430044 - DNA, 23 bp, Homo sapiens
ggctctctgacgtcaacccaagc

SEQ ID NO: 5430045 - DNA, 23 bp, Homo sapiens
ggctctctgagactctttagagc

SEQ ID NO: 5430046 - DNA, 17 bp, Homo sapiens
ggctctctgtaggcaca

SEQ ID NO: 5430047 - DNA, 14 bp, Homo sapiens
ggctctgaaagcca

SEQ ID NO: 5430048 - DNA, 23 bp, Homo sapiens
ggctctgaaagctgcttctgggg

SEQ ID NO: 5430049 - DNA, 13 bp, Homo sapiens
ggctctgaaataa

SEQ ID NO: 5430050 - DNA, 17 bp, Homo sapiens
ggctctgaaataaaatg

SEQ ID NO: 5430051 - DNA, 16 bp, Homo sapiens
ggctctgaagcaaggc

SEQ ID NO: 5430052 - DNA, 21 bp, Homo sapiens
ggctctgaatctctcaaaatg

SEQ ID NO: 5430053 - DNA, 21 bp, Homo sapiens
ggctctgaatgtagccagccc

SEQ ID NO: 5430054 - DNA, 18 bp, Homo sapiens
ggctctgagaaggggagg

SEQ ID NO: 5430055 - DNA, 17 bp, Homo sapiens
ggctctgagacacaccc

SEQ ID NO: 5430056 - DNA, 23 bp, Homo sapiens
ggctctgagagccccaggactgg

SEQ ID NO: 5430057 - DNA, 15 bp, Homo sapiens
ggctctgagagtcta

SEQ ID NO: 5430058 - DNA, 17 bp, Homo sapiens
ggctctgagcaggggca

SEQ ID NO: 5430059 - DNA, 19 bp, Homo sapiens
ggctctgagcaggggcagg

SEQ ID NO: 5430060 - DNA, 16 bp, Homo sapiens
ggctctgagggtctga

SEQ ID NO: 5430061 - DNA, 11 bp, Homo sapiens
ggctctgattc

SEQ ID NO: 5430062 - DNA, 20 bp, Homo sapiens
ggctctgcaattcccctctg

SEQ ID NO: 5430063 - DNA, 20 bp, Homo sapiens
ggctctgcacagacaagcag

SEQ ID NO: 5430064 - DNA, 18 bp, Homo sapiens
ggctctgcacccacgtgc

SEQ ID NO: 5430065 - DNA, 15 bp, Homo sapiens
ggctctgcacccagc

SEQ ID NO: 5430066 - DNA, 16 bp, Homo sapiens
ggctctgcacccctct

SEQ ID NO: 5430067 - DNA, 17 bp, Homo sapiens
ggctctgcactaagaga

SEQ ID NO: 5430068 - DNA, 22 bp, Homo sapiens
ggctctgcagcacattgccctg

SEQ ID NO: 5430069 - DNA, 19 bp, Homo sapiens
ggctctgcatacacatgca

SEQ ID NO: 5430070 - DNA, 21 bp, Homo sapiens
ggctctgccaatgtgggctgc

SEQ ID NO: 5430071 - DNA, 22 bp, Homo sapiens
ggctctgccaatgtgggctgcc

SEQ ID NO: 5430072 - DNA, 14 bp, Homo sapiens
ggctctgccaccct

SEQ ID NO: 5430073 - DNA, 14 bp, Homo sapiens
ggctctgccagcgt

SEQ ID NO: 5430074 - DNA, 12 bp, Homo sapiens
ggctctgccagt

SEQ ID NO: 5430075 - DNA, 17 bp, Homo sapiens
ggctctgccagtcctgt

SEQ ID NO: 5430076 - DNA, 19 bp, Homo sapiens
ggctctgccagtggatccc

SEQ ID NO: 5430077 - DNA, 20 bp, Homo sapiens
ggctctgcccacctggggtc

SEQ ID NO: 5430078 - DNA, 18 bp, Homo sapiens
ggctctgccccagaggcc

SEQ ID NO: 5430079 - DNA, 14 bp, Homo sapiens
ggctctgccccagc

SEQ ID NO: 5430080 - DNA, 18 bp, Homo sapiens
ggctctgccccctccccc

SEQ ID NO: 5430081 - DNA, 19 bp, Homo sapiens
ggctctgccccctccccca

SEQ ID NO: 5430082 - DNA, 14 bp, Homo sapiens
ggctctgccccgca

SEQ ID NO: 5430083 - DNA, 14 bp, Homo sapiens
ggctctgcccctca

SEQ ID NO: 5430084 - DNA, 16 bp, Homo sapiens
ggctctgcccctcagg

SEQ ID NO: 5430085 - DNA, 17 bp, Homo sapiens
ggctctgcccctcaggg

SEQ ID NO: 5430086 - DNA, 17 bp, Homo sapiens
ggctctgccctggaaag

SEQ ID NO: 5430087 - DNA, 12 bp, Homo sapiens
ggctctgcctca

SEQ ID NO: 5430088 - DNA, 16 bp, Homo sapiens
ggctctgcctcccatc

SEQ ID NO: 5430089 - DNA, 21 bp, Homo sapiens
ggctctgcctgtctggtgcct

SEQ ID NO: 5430090 - DNA, 20 bp, Homo sapiens
ggctctgcgttggcttctcc

SEQ ID NO: 5430091 - DNA, 21 bp, Homo sapiens
ggctctggacagcagaagcct

SEQ ID NO: 5430092 - DNA, 15 bp, Homo sapiens
ggctctggacctcag

SEQ ID NO: 5430093 - DNA, 16 bp, Homo sapiens
ggctctggacctcagg

SEQ ID NO: 5430094 - DNA, 21 bp, Homo sapiens
ggctctggacctcaggagggc

SEQ ID NO: 5430095 - DNA, 12 bp, Homo sapiens
ggctctggactc

SEQ ID NO: 5430096 - DNA, 13 bp, Homo sapiens
ggctctggactcc

SEQ ID NO: 5430097 - DNA, 14 bp, Homo sapiens
ggctctggactcca

SEQ ID NO: 5430098 - DNA, 16 bp, Homo sapiens
ggctctggactctaaa

SEQ ID NO: 5430099 - DNA, 16 bp, Homo sapiens
ggctctggagcccact

SEQ ID NO: 5430100 - DNA, 17 bp, Homo sapiens
ggctctggagcccactg

SEQ ID NO: 5430101 - DNA, 19 bp, Homo sapiens
ggctctggagcccactgta

SEQ ID NO: 5430102 - DNA, 23 bp, Homo sapiens
ggctctggagcccactgtacttg

SEQ ID NO: 5430103 - DNA, 23 bp, Homo sapiens
ggctctggcaggtggccagggct

SEQ ID NO: 5430104 - DNA, 16 bp, Homo sapiens
ggctctggccaagggc

SEQ ID NO: 5430105 - DNA, 17 bp, Homo sapiens
ggctctggccaagggcc

SEQ ID NO: 5430106 - DNA, 13 bp, Homo sapiens
ggctctggccacc

SEQ ID NO: 5430107 - DNA, 18 bp, Homo sapiens
ggctctggccaccctggc

SEQ ID NO: 5430108 - DNA, 21 bp, Homo sapiens
ggctctggccaccctggcccg

SEQ ID NO: 5430109 - DNA, 12 bp, Homo sapiens
ggctctggcccc

SEQ ID NO: 5430110 - DNA, 20 bp, Homo sapiens
ggctctggcccttgcctttg

SEQ ID NO: 5430111 - DNA, 10 bp, Homo sapiens
ggctctggct

SEQ ID NO: 5430112 - DNA, 17 bp, Homo sapiens
ggctctgggaaggggtg

SEQ ID NO: 5430113 - DNA, 18 bp, Homo sapiens
ggctctgggaaggggtgc

SEQ ID NO: 5430114 - DNA, 23 bp, Homo sapiens
ggctctgggaaggggtgccctct

SEQ ID NO: 5430115 - DNA, 16 bp, Homo sapiens
ggctctgggagagcca

SEQ ID NO: 5430116 - DNA, 17 bp, Homo sapiens
ggctctgggcacagtgc

SEQ ID NO: 5430117 - DNA, 19 bp, Homo sapiens
ggctctgggccgggcctgg

SEQ ID NO: 5430118 - DNA, 16 bp, Homo sapiens
ggctctgggcggcccg

SEQ ID NO: 5430119 - DNA, 14 bp, Homo sapiens
ggctctgggctcag

SEQ ID NO: 5430120 - DNA, 20 bp, Homo sapiens
ggctctgggctcagggctgg

SEQ ID NO: 5430121 - DNA, 12 bp, Homo sapiens
ggctctgggctg

SEQ ID NO: 5430122 - DNA, 13 bp, Homo sapiens
ggctctgggctgg

SEQ ID NO: 5430123 - DNA, 22 bp, Homo sapiens
ggctctgggctggctgctccta

SEQ ID NO: 5430124 - DNA, 13 bp, Homo sapiens
ggctctggggcag

SEQ ID NO: 5430125 - DNA, 19 bp, Homo sapiens
ggctctgggggacccaggt

SEQ ID NO: 5430126 - DNA, 21 bp, Homo sapiens
ggctctggggtaggctgctcc

SEQ ID NO: 5430127 - DNA, 18 bp, Homo sapiens
ggctctgggtgctgccct

SEQ ID NO: 5430128 - DNA, 20 bp, Homo sapiens
ggctctgggtgggcggggca

SEQ ID NO: 5430129 - DNA, 19 bp, Homo sapiens
ggctctgggttcgggaaga

SEQ ID NO: 5430130 - DNA, 21 bp, Homo sapiens
ggctctggtggccactgagct

SEQ ID NO: 5430131 - DNA, 17 bp, Homo sapiens
ggctctggttcctccag

SEQ ID NO: 5430132 - DNA, 15 bp, Homo sapiens
ggctctgtcactcca

SEQ ID NO: 5430133 - DNA, 16 bp, Homo sapiens
ggctctgtcttcctgg

SEQ ID NO: 5430134 - DNA, 19 bp, Homo sapiens
ggctctgtgcccggtgcca

SEQ ID NO: 5430135 - DNA, 21 bp, Homo sapiens
ggctctgtgcccggtgccatc

SEQ ID NO: 5430136 - DNA, 14 bp, Homo sapiens
ggctctgtgccttg

SEQ ID NO: 5430137 - DNA, 15 bp, Homo sapiens
ggctctgtgccttgg

SEQ ID NO: 5430138 - DNA, 12 bp, Homo sapiens
ggctctgtgctg

SEQ ID NO: 5430139 - DNA, 16 bp, Homo sapiens
ggctctgtgctgaccc

SEQ ID NO: 5430140 - DNA, 18 bp, Homo sapiens
ggctctgtgctgaccctc

SEQ ID NO: 5430141 - DNA, 13 bp, Homo sapiens
ggctctgtggagg

SEQ ID NO: 5430142 - DNA, 19 bp, Homo sapiens
ggctctgtgtgttaaaatg

SEQ ID NO: 5430143 - DNA, 21 bp, Homo sapiens
ggctctgttatcagctgggca

SEQ ID NO: 5430144 - DNA, 18 bp, Homo sapiens
ggctctgttatgcaagca

SEQ ID NO: 5430145 - DNA, 21 bp, Homo sapiens
ggctctgttatgcaagcacaa

SEQ ID NO: 5430146 - DNA, 13 bp, Homo sapiens
ggctctgttcctc

SEQ ID NO: 5430147 - DNA, 11 bp, Homo sapiens
ggctctgtttg

SEQ ID NO: 5430148 - DNA, 22 bp, Homo sapiens
ggctcttaagcagcatggaaaa

SEQ ID NO: 5430149 - DNA, 23 bp, Homo sapiens
ggctcttaagcagcatggaaaaa

SEQ ID NO: 5430150 - DNA, 19 bp, Homo sapiens
ggctcttatgtgtgccttt

SEQ ID NO: 5430151 - DNA, 20 bp, Homo sapiens
ggctcttatgtgtgcctttg

SEQ ID NO: 5430152 - DNA, 14 bp, Homo sapiens
ggctcttccaggct

SEQ ID NO: 5430153 - DNA, 15 bp, Homo sapiens
ggctcttccaggctg

SEQ ID NO: 5430154 - DNA, 17 bp, Homo sapiens
ggctcttccaggctggg

SEQ ID NO: 5430155 - DNA, 18 bp, Homo sapiens
ggctcttccaggctggga

SEQ ID NO: 5430156 - DNA, 21 bp, Homo sapiens
ggctcttcccctagacctccc

SEQ ID NO: 5430157 - DNA, 13 bp, Homo sapiens
ggctcttcctgga

SEQ ID NO: 5430158 - DNA, 17 bp, Homo sapiens
ggctcttctccccagag

SEQ ID NO: 5430159 - DNA, 16 bp, Homo sapiens
ggctcttctcctttca

SEQ ID NO: 5430160 - DNA, 23 bp, Homo sapiens
ggctcttctcctttcacaacctt

SEQ ID NO: 5430161 - DNA, 17 bp, Homo sapiens
ggctcttctttcccaaa

SEQ ID NO: 5430162 - DNA, 20 bp, Homo sapiens
ggctcttgatacccccctct

SEQ ID NO: 5430163 - DNA, 21 bp, Homo sapiens
ggctcttgatacccccctctg

SEQ ID NO: 5430164 - DNA, 17 bp, Homo sapiens
ggctcttggcttccaga

SEQ ID NO: 5430165 - DNA, 20 bp, Homo sapiens
ggctcttgtgctggatggag

SEQ ID NO: 5430166 - DNA, 13 bp, Homo sapiens
ggctctttccttg

SEQ ID NO: 5430167 - DNA, 13 bp, Homo sapiens
ggctgaaaacaat

SEQ ID NO: 5430168 - DNA, 20 bp, Homo sapiens
ggctgaaaatgcaaagctga

SEQ ID NO: 5430169 - DNA, 20 bp, Homo sapiens
ggctgaaataaaagcctctg

SEQ ID NO: 5430170 - DNA, 20 bp, Homo sapiens
ggctgaaatatccacccagc

SEQ ID NO: 5430171 - DNA, 22 bp, Homo sapiens
ggctgaaattatgtcaaatgga

SEQ ID NO: 5430172 - DNA, 14 bp, Homo sapiens
ggctgaaattctcc

SEQ ID NO: 5430173 - DNA, 17 bp, Homo sapiens
ggctgaaattctcctgg

SEQ ID NO: 5430174 - DNA, 21 bp, Homo sapiens
ggctgaaattctcctggaggt

SEQ ID NO: 5430175 - DNA, 21 bp, Homo sapiens
ggctgaacactccaattaagg

SEQ ID NO: 5430176 - DNA, 15 bp, Homo sapiens
ggctgaacagtgctc

SEQ ID NO: 5430177 - DNA, 18 bp, Homo sapiens
ggctgaacagtgctctgc

SEQ ID NO: 5430178 - DNA, 14 bp, Homo sapiens
ggctgaacatgcct

SEQ ID NO: 5430179 - DNA, 18 bp, Homo sapiens
ggctgaacatgcctgcca

SEQ ID NO: 5430180 - DNA, 14 bp, Homo sapiens
ggctgaaccctcag

SEQ ID NO: 5430181 - DNA, 16 bp, Homo sapiens
ggctgaaccctgtgct

SEQ ID NO: 5430182 - DNA, 21 bp, Homo sapiens
ggctgaaccctgtgctggtgt

SEQ ID NO: 5430183 - DNA, 22 bp, Homo sapiens
ggctgaaccctgtgctggtgtc

SEQ ID NO: 5430184 - DNA, 17 bp, Homo sapiens
ggctgaacggggagaaa

SEQ ID NO: 5430185 - DNA, 20 bp, Homo sapiens
ggctgaacggggagaaaagg

SEQ ID NO: 5430186 - DNA, 18 bp, Homo sapiens
ggctgaactacaagtgta

SEQ ID NO: 5430187 - DNA, 18 bp, Homo sapiens
ggctgaagaaacacagca

SEQ ID NO: 5430188 - DNA, 19 bp, Homo sapiens
ggctgaagagagggacagg

SEQ ID NO: 5430189 - DNA, 23 bp, Homo sapiens
ggctgaagaggaccagaggagca

SEQ ID NO: 5430190 - DNA, 22 bp, Homo sapiens
ggctgaagccacacagcccaga

SEQ ID NO: 5430191 - DNA, 12 bp, Homo sapiens
ggctgaagctgg

SEQ ID NO: 5430192 - DNA, 13 bp, Homo sapiens
ggctgaagctgga

SEQ ID NO: 5430193 - DNA, 20 bp, Homo sapiens
ggctgaagctggagcagcgg

SEQ ID NO: 5430194 - DNA, 14 bp, Homo sapiens
ggctgaaggactgt

SEQ ID NO: 5430195 - DNA, 20 bp, Homo sapiens
ggctgaagggaagcccagcc

SEQ ID NO: 5430196 - DNA, 18 bp, Homo sapiens
ggctgaatcttctggaga

SEQ ID NO: 5430197 - DNA, 16 bp, Homo sapiens
ggctgacacctaccat

SEQ ID NO: 5430198 - DNA, 23 bp, Homo sapiens
ggctgacacctaccatgctgctt

SEQ ID NO: 5430199 - DNA, 21 bp, Homo sapiens
ggctgacacttcaaggtgaca

SEQ ID NO: 5430200 - DNA, 22 bp, Homo sapiens
ggctgacacttcaaggtgacag

SEQ ID NO: 5430201 - DNA, 17 bp, Homo sapiens
ggctgacagactcactg

SEQ ID NO: 5430202 - DNA, 13 bp, Homo sapiens
ggctgacagagca

SEQ ID NO: 5430203 - DNA, 19 bp, Homo sapiens
ggctgacagagcaggtctg

SEQ ID NO: 5430204 - DNA, 21 bp, Homo sapiens
ggctgacagagcaggtctgca

SEQ ID NO: 5430205 - DNA, 19 bp, Homo sapiens
ggctgacatgctcacacat

SEQ ID NO: 5430206 - DNA, 16 bp, Homo sapiens
ggctgaccaggccctg

SEQ ID NO: 5430207 - DNA, 17 bp, Homo sapiens
ggctgaccaggccctgc

SEQ ID NO: 5430208 - DNA, 15 bp, Homo sapiens
ggctgaccatgctca

SEQ ID NO: 5430209 - DNA, 15 bp, Homo sapiens
ggctgacccagcatc

SEQ ID NO: 5430210 - DNA, 20 bp, Homo sapiens
ggctgacccagcatctccca

SEQ ID NO: 5430211 - DNA, 18 bp, Homo sapiens
ggctgacccagtccctgg

SEQ ID NO: 5430212 - DNA, 19 bp, Homo sapiens
ggctgacccagtccctggg

SEQ ID NO: 5430213 - DNA, 16 bp, Homo sapiens
ggctgggggagagccg

SEQ ID NO: 5430214 - DNA, 19 bp, Homo sapiens
ggctgggggagagccgtgg

SEQ ID NO: 5430215 - DNA, 17 bp, Homo sapiens
ggctgggggagggactg

SEQ ID NO: 5430216 - DNA, 16 bp, Homo sapiens
ggctgggggcaggagg

SEQ ID NO: 5430217 - DNA, 17 bp, Homo sapiens
ggctgggggcaggaggg

SEQ ID NO: 5430218 - DNA, 18 bp, Homo sapiens
ggctgggggcatggggga

SEQ ID NO: 5430219 - DNA, 18 bp, Homo sapiens
ggctgggggccagctcca

SEQ ID NO: 5430220 - DNA, 19 bp, Homo sapiens
ggctgggggccagggctgg

SEQ ID NO: 5430221 - DNA, 14 bp, Homo sapiens
ggctgggggcctca

SEQ ID NO: 5430222 - DNA, 17 bp, Homo sapiens
ggctgggggcctcagtg

SEQ ID NO: 5430223 - DNA, 19 bp, Homo sapiens
ggctgggggcctcagtgcc

SEQ ID NO: 5430224 - DNA, 22 bp, Homo sapiens
ggctgggggcgggggagccaac

SEQ ID NO: 5430225 - DNA, 15 bp, Homo sapiens
ggctgggggctgcag

SEQ ID NO: 5430226 - DNA, 16 bp, Homo sapiens
ggctgggggtagcctg

SEQ ID NO: 5430227 - DNA, 17 bp, Homo sapiens
ggctgggggtgctagac

SEQ ID NO: 5430228 - DNA, 16 bp, Homo sapiens
ggctgggggtgctgga

SEQ ID NO: 5430229 - DNA, 10 bp, Homo sapiens
ggctggggtc

SEQ ID NO: 5430230 - DNA, 18 bp, Homo sapiens
ggctggggtcacagaggc

SEQ ID NO: 5430231 - DNA, 19 bp, Homo sapiens
ggctggggtcacagaggca

SEQ ID NO: 5430232 - DNA, 20 bp, Homo sapiens
ggctggggtcacagaggcat

SEQ ID NO: 5430233 - DNA, 19 bp, Homo sapiens
ggctggggtcctcctgtgc

SEQ ID NO: 5430234 - DNA, 23 bp, Homo sapiens
ggctggggtcctcctgtgctatt

SEQ ID NO: 5430235 - DNA, 15 bp, Homo sapiens
ggctggggtcttggg

SEQ ID NO: 5430236 - DNA, 14 bp, Homo sapiens
ggctggggtgagag

SEQ ID NO: 5430237 - DNA, 17 bp, Homo sapiens
ggctggggtgagagagg

SEQ ID NO: 5430238 - DNA, 18 bp, Homo sapiens
ggctggggttgccagagg

SEQ ID NO: 5430239 - DNA, 20 bp, Homo sapiens
ggctggggttgccagaggcc

SEQ ID NO: 5430240 - DNA, 22 bp, Homo sapiens
ggctggggttgccagaggccct

SEQ ID NO: 5430241 - DNA, 18 bp, Homo sapiens
ggctgggtcacaggaagg

SEQ ID NO: 5430242 - DNA, 12 bp, Homo sapiens
ggctgggtcagg

SEQ ID NO: 5430243 - DNA, 19 bp, Homo sapiens
ggctgggtcagggccagac

SEQ ID NO: 5430244 - DNA, 19 bp, Homo sapiens
ggctgggtcctgccagctg

SEQ ID NO: 5430245 - DNA, 14 bp, Homo sapiens
ggctgggtcgcccc

SEQ ID NO: 5430246 - DNA, 16 bp, Homo sapiens
ggctgggtgcccacag

SEQ ID NO: 5430247 - DNA, 17 bp, Homo sapiens
ggctgggtgcccacagc

SEQ ID NO: 5430248 - DNA, 12 bp, Homo sapiens
ggctgggtgctg

SEQ ID NO: 5430249 - DNA, 19 bp, Homo sapiens
ggctgggttctacccaggt

SEQ ID NO: 5430250 - DNA, 22 bp, Homo sapiens
ggctgggttctacccaggtgct

SEQ ID NO: 5430251 - DNA, 16 bp, Homo sapiens
ggctgggttggcgcac

SEQ ID NO: 5430252 - DNA, 19 bp, Homo sapiens
ggctgggttggcgcaccct

SEQ ID NO: 5430253 - DNA, 19 bp, Homo sapiens
ggctggtaacagttcatgt

SEQ ID NO: 5430254 - DNA, 13 bp, Homo sapiens
ggctggtaaggga

SEQ ID NO: 5430255 - DNA, 22 bp, Homo sapiens
ggctggtagcagcaggctcagg

SEQ ID NO: 5430256 - DNA, 19 bp, Homo sapiens
ggctggtattggtggcttt

SEQ ID NO: 5430257 - DNA, 15 bp, Homo sapiens
ggctggtcactctgc

SEQ ID NO: 5430258 - DNA, 14 bp, Homo sapiens
ggctggtcctccca

SEQ ID NO: 5430259 - DNA, 15 bp, Homo sapiens
ggctggtcctgggag

SEQ ID NO: 5430260 - DNA, 23 bp, Homo sapiens
ggctggtcgtgaactcctgagct

SEQ ID NO: 5430261 - DNA, 20 bp, Homo sapiens
ggctggtctcgaactcctga

SEQ ID NO: 5430262 - DNA, 23 bp, Homo sapiens
ggctggtctcgaactcctggcct

SEQ ID NO: 5430263 - DNA, 15 bp, Homo sapiens
ggctggtctgatgga

SEQ ID NO: 5430264 - DNA, 24 bp, Homo sapiens
ggctggtgacgttcagcctttgtc

SEQ ID NO: 5430265 - DNA, 17 bp, Homo sapiens
ggctggtgagaccccgc

SEQ ID NO: 5430266 - DNA, 17 bp, Homo sapiens
ggctggtgaggtcctgg

SEQ ID NO: 5430267 - DNA, 10 bp, Homo sapiens
ggctggtgcc

SEQ ID NO: 5430268 - DNA, 15 bp, Homo sapiens
ggctggtgccagcct

SEQ ID NO: 5430269 - DNA, 14 bp, Homo sapiens
ggctggtgccaggc

SEQ ID NO: 5430270 - DNA, 16 bp, Homo sapiens
ggctggtgccaggcgc

SEQ ID NO: 5430271 - DNA, 13 bp, Homo sapiens
ggctggtgcccca

SEQ ID NO: 5430272 - DNA, 21 bp, Homo sapiens
ggctggtgccccacagctacc

SEQ ID NO: 5430273 - DNA, 19 bp, Homo sapiens
ggctggtgctgtggccagg

SEQ ID NO: 5430274 - DNA, 14 bp, Homo sapiens
ggctggtggcaagt

SEQ ID NO: 5430275 - DNA, 14 bp, Homo sapiens
ggctggtggcccag

SEQ ID NO: 5430276 - DNA, 10 bp, Homo sapiens
ggctggtggg

SEQ ID NO: 5430277 - DNA, 15 bp, Homo sapiens
ggctggtgggaaggc

SEQ ID NO: 5430278 - DNA, 18 bp, Homo sapiens
ggctggtgggaaggccgg

SEQ ID NO: 5430279 - DNA, 15 bp, Homo sapiens
ggctggtgggcacca

SEQ ID NO: 5430280 - DNA, 11 bp, Homo sapiens
ggctggtgggt

SEQ ID NO: 5430281 - DNA, 13 bp, Homo sapiens
ggctggtgggtct

SEQ ID NO: 5430282 - DNA, 19 bp, Homo sapiens
ggctggtgtcttgagacca

SEQ ID NO: 5430283 - DNA, 22 bp, Homo sapiens
ggctggtgtgtcatactgtgca

SEQ ID NO: 5430284 - DNA, 16 bp, Homo sapiens
ggctggtgttaacaga

SEQ ID NO: 5430285 - DNA, 14 bp, Homo sapiens
ggctggttaatgta

SEQ ID NO: 5430286 - DNA, 17 bp, Homo sapiens
ggctggttggtgctttg

SEQ ID NO: 5430287 - DNA, 18 bp, Homo sapiens
ggctggtttgcccagagc

SEQ ID NO: 5430288 - DNA, 18 bp, Homo sapiens
ggctggtttggaatgctt

SEQ ID NO: 5430289 - DNA, 16 bp, Homo sapiens
ggctggtttggtggcc

SEQ ID NO: 5430290 - DNA, 21 bp, Homo sapiens
ggctggttttgtaagatgctg

SEQ ID NO: 5430291 - DNA, 22 bp, Homo sapiens
ggctggttttgtaagatgctgg

SEQ ID NO: 5430292 - DNA, 23 bp, Homo sapiens
ggctggttttgtaagatgctggg

SEQ ID NO: 5430293 - DNA, 17 bp, Homo sapiens
ggctgtaaacagctctg

SEQ ID NO: 5430294 - DNA, 22 bp, Homo sapiens
ggctgtaaactataaactactg

SEQ ID NO: 5430295 - DNA, 21 bp, Homo sapiens
ggctgtaaagcaaactggggc

SEQ ID NO: 5430296 - DNA, 22 bp, Homo sapiens
ggctgtaaatcctagacttgaa

SEQ ID NO: 5430297 - DNA, 13 bp, Homo sapiens
ggctgtaaattga

SEQ ID NO: 5430298 - DNA, 17 bp, Homo sapiens
ggctgtaacctgctgga

SEQ ID NO: 5430299 - DNA, 16 bp, Homo sapiens
ggctgtaactgccagg

SEQ ID NO: 5430300 - DNA, 18 bp, Homo sapiens
ggctgtaactgccaggct

SEQ ID NO: 5430301 - DNA, 17 bp, Homo sapiens
ggctgtacctgttcctc

SEQ ID NO: 5430302 - DNA, 15 bp, Homo sapiens
ggctgtactgccaag

SEQ ID NO: 5430303 - DNA, 18 bp, Homo sapiens
ggctgtatcccatgagcc

SEQ ID NO: 5430304 - DNA, 16 bp, Homo sapiens
ggctgtattttctttt

SEQ ID NO: 5430305 - DNA, 15 bp, Homo sapiens
ggctgtcagcaggaa

SEQ ID NO: 5430306 - DNA, 18 bp, Homo sapiens
ggctgtcagcaggaagca

SEQ ID NO: 5430307 - DNA, 15 bp, Homo sapiens
ggctgtcaggacacc

SEQ ID NO: 5430308 - DNA, 22 bp, Homo sapiens
ggctgtcagtgtttggtgcacg

SEQ ID NO: 5430309 - DNA, 13 bp, Homo sapiens
ggctgtcatctga

SEQ ID NO: 5430310 - DNA, 14 bp, Homo sapiens
ggctgtccagcctt

SEQ ID NO: 5430311 - DNA, 15 bp, Homo sapiens
ggctgtccagcctta

SEQ ID NO: 5430312 - DNA, 15 bp, Homo sapiens
ggctgtccagtgccc

SEQ ID NO: 5430313 - DNA, 13 bp, Homo sapiens
ggctgtcccaagc

SEQ ID NO: 5430314 - DNA, 14 bp, Homo sapiens
ggctgtcccaagct

SEQ ID NO: 5430315 - DNA, 18 bp, Homo sapiens
ggctgtcccaagctccca

SEQ ID NO: 5430316 - DNA, 21 bp, Homo sapiens
ggctgtccccctcctcccagg

SEQ ID NO: 5430317 - DNA, 13 bp, Homo sapiens
ggctgtcccctcc

SEQ ID NO: 5430318 - DNA, 23 bp, Homo sapiens
ggctgtcccctccatctggggat

SEQ ID NO: 5430319 - DNA, 15 bp, Homo sapiens
ggctgtcccctgcaa

SEQ ID NO: 5430320 - DNA, 15 bp, Homo sapiens
ggctgtcccggaggc

SEQ ID NO: 5430321 - DNA, 20 bp, Homo sapiens
ggctgtccctcatggagacc

SEQ ID NO: 5430322 - DNA, 13 bp, Homo sapiens
ggctgtccgtgtg

SEQ ID NO: 5430323 - DNA, 17 bp, Homo sapiens
ggctgtccgtgtgcctc

SEQ ID NO: 5430324 - DNA, 20 bp, Homo sapiens
ggctgtccgtgtgcctcctg

SEQ ID NO: 5430325 - DNA, 21 bp, Homo sapiens
ggctgtcctaccatcagctct

SEQ ID NO: 5430326 - DNA, 22 bp, Homo sapiens
ggctgtcctaccatcagctctg

SEQ ID NO: 5430327 - DNA, 23 bp, Homo sapiens
ggctgtcctaccatcagctctgc

SEQ ID NO: 5430328 - DNA, 18 bp, Homo sapiens
ggctgtcctccttcctgg

SEQ ID NO: 5430329 - DNA, 22 bp, Homo sapiens
ggctgtcctccttcctgggacc

SEQ ID NO: 5430330 - DNA, 21 bp, Homo sapiens
ggctgtcctcttaagacacta

SEQ ID NO: 5430331 - DNA, 16 bp, Homo sapiens
ggctgtcctgagcccc

SEQ ID NO: 5430332 - DNA, 20 bp, Homo sapiens
ggctgtcctgctgccctccc

SEQ ID NO: 5430333 - DNA, 21 bp, Homo sapiens
ggctgtcctgctgccctccca

SEQ ID NO: 5430334 - DNA, 10 bp, Homo sapiens
ggctgtcctt

SEQ ID NO: 5430335 - DNA, 19 bp, Homo sapiens
ggctgtcctttccagtggc

SEQ ID NO: 5430336 - DNA, 22 bp, Homo sapiens
ggctgtcctttccagtggcctg

SEQ ID NO: 5430337 - DNA, 13 bp, Homo sapiens
ggctgtcggcgct

SEQ ID NO: 5430338 - DNA, 17 bp, Homo sapiens
ggctgtcgtccccctcc

SEQ ID NO: 5430339 - DNA, 12 bp, Homo sapiens
ggctgtctcctg

SEQ ID NO: 5430340 - DNA, 19 bp, Homo sapiens
ggctgtctcctgtccccgg

SEQ ID NO: 5430341 - DNA, 18 bp, Homo sapiens
ggctgtctctcccttcca

SEQ ID NO: 5430342 - DNA, 14 bp, Homo sapiens
ggctgtctctgtcc

SEQ ID NO: 5430343 - DNA, 16 bp, Homo sapiens
ggctgtctgaccagag

SEQ ID NO: 5430344 - DNA, 19 bp, Homo sapiens
ggctgtctgcacagagggt

SEQ ID NO: 5430345 - DNA, 15 bp, Homo sapiens
ggctgtctgcctgta

SEQ ID NO: 5430346 - DNA, 20 bp, Homo sapiens
ggctgtctgcctgtattttc

SEQ ID NO: 5430347 - DNA, 14 bp, Homo sapiens
ggctgtctgggtgt

SEQ ID NO: 5430348 - DNA, 14 bp, Homo sapiens
ggctgtctgtcacc

SEQ ID NO: 5430349 - DNA, 14 bp, Homo sapiens
ggctgtctgtgcca

SEQ ID NO: 5430350 - DNA, 18 bp, Homo sapiens
ggctgtctgtgccatggc

SEQ ID NO: 5430351 - DNA, 17 bp, Homo sapiens
ggctgtctgttgtattc

SEQ ID NO: 5430352 - DNA, 22 bp, Homo sapiens
ggctgtcttctcaggctctgcc

SEQ ID NO: 5430353 - DNA, 23 bp, Homo sapiens
ggctgtcttctcaggctctgccc

SEQ ID NO: 5430354 - DNA, 17 bp, Homo sapiens
ggctgtcttctcccaga

SEQ ID NO: 5430355 - DNA, 22 bp, Homo sapiens
ggctgtcttctcccagagcaca

SEQ ID NO: 5430356 - DNA, 20 bp, Homo sapiens
ggctgtgaagacccaggaga

SEQ ID NO: 5430357 - DNA, 19 bp, Homo sapiens
ggctgtgacaaccctggcc

SEQ ID NO: 5430358 - DNA, 22 bp, Homo sapiens
ggctgtgacaaccctggcctca

SEQ ID NO: 5430359 - DNA, 16 bp, Homo sapiens
ggctgtgacacctggt

SEQ ID NO: 5430360 - DNA, 15 bp, Homo sapiens
ggctgtgacctcttc

SEQ ID NO: 5430361 - DNA, 21 bp, Homo sapiens
ggctgtgactctgggcaggga

SEQ ID NO: 5430362 - DNA, 11 bp, Homo sapiens
ggctgtgagca

SEQ ID NO: 5430363 - DNA, 14 bp, Homo sapiens
ggctgtgagcagcc

SEQ ID NO: 5430364 - DNA, 14 bp, Homo sapiens
ggctgtgaggacag

SEQ ID NO: 5430365 - DNA, 13 bp, Homo sapiens
ggctgtgaggccc

SEQ ID NO: 5430366 - DNA, 18 bp, Homo sapiens
ggctgtgcagcctgtcct

SEQ ID NO: 5430367 - DNA, 14 bp, Homo sapiens
ggctgtgcagtcct

SEQ ID NO: 5430368 - DNA, 18 bp, Homo sapiens
ggctgtgccaggctggga

SEQ ID NO: 5430369 - DNA, 14 bp, Homo sapiens
ggctgtgcccagca

SEQ ID NO: 5430370 - DNA, 15 bp, Homo sapiens
ggctgtgcccagcag

SEQ ID NO: 5430371 - DNA, 15 bp, Homo sapiens
ggctgtgccccacct

SEQ ID NO: 5430372 - DNA, 16 bp, Homo sapiens
ggctgtgccccacctg

SEQ ID NO: 5430373 - DNA, 17 bp, Homo sapiens
ggctgtgccccacctgt

SEQ ID NO: 5430374 - DNA, 14 bp, Homo sapiens
ggctgtgcccctga

SEQ ID NO: 5430375 - DNA, 15 bp, Homo sapiens
ggctgtgcccctgat

SEQ ID NO: 5430376 - DNA, 22 bp, Homo sapiens
ggctgtgcccctgatgcagcct

SEQ ID NO: 5430377 - DNA, 20 bp, Homo sapiens
ggctgtgcctgaggctggct

SEQ ID NO: 5430378 - DNA, 22 bp, Homo sapiens
ggctgtgcctgaggctggctgg

SEQ ID NO: 5430379 - DNA, 15 bp, Homo sapiens
ggctgtgcctgcttc

SEQ ID NO: 5430380 - DNA, 19 bp, Homo sapiens
ggctgtgcgctgacaacca

SEQ ID NO: 5430381 - DNA, 18 bp, Homo sapiens
ggctgtgctacctgagcc

SEQ ID NO: 5430382 - DNA, 14 bp, Homo sapiens
ggctgtgctcagag

SEQ ID NO: 5430383 - DNA, 19 bp, Homo sapiens
ggctgtgctcttcctctgg

SEQ ID NO: 5430384 - DNA, 20 bp, Homo sapiens
ggctgtgctcttcctctggt

SEQ ID NO: 5430385 - DNA, 22 bp, Homo sapiens
ggctgtgctgcttttgagcctc

SEQ ID NO: 5430386 - DNA, 13 bp, Homo sapiens
ggctgtgctggga

SEQ ID NO: 5430387 - DNA, 17 bp, Homo sapiens
ggctgtgcttgaaggcc

SEQ ID NO: 5430388 - DNA, 20 bp, Homo sapiens
ggctgtgcttgaaggccctg

SEQ ID NO: 5430389 - DNA, 23 bp, Homo sapiens
ggctgtggaccatggagtggcag

SEQ ID NO: 5430390 - DNA, 22 bp, Homo sapiens
ggctgtggaccgtggacaggcc

SEQ ID NO: 5430391 - DNA, 24 bp, Homo sapiens
ggctttgttcttgtcatcagtaag

SEQ ID NO: 5430392 - DNA, 17 bp, Homo sapiens
ggcttttaaaaggaaaa

SEQ ID NO: 5430393 - DNA, 22 bp, Homo sapiens
ggcttttaaacctgttcctgac

SEQ ID NO: 5430394 - DNA, 13 bp, Homo sapiens
ggcttttaagaaa

SEQ ID NO: 5430395 - DNA, 18 bp, Homo sapiens
ggcttttaccattagcat

SEQ ID NO: 5430396 - DNA, 18 bp, Homo sapiens
ggcttttactgaagcctt

SEQ ID NO: 5430397 - DNA, 18 bp, Homo sapiens
ggcttttaggaactttat

SEQ ID NO: 5430398 - DNA, 20 bp, Homo sapiens
ggcttttattaatgcacttt

SEQ ID NO: 5430399 - DNA, 13 bp, Homo sapiens
ggcttttcacccc

SEQ ID NO: 5430400 - DNA, 14 bp, Homo sapiens
ggcttttccagtgt

SEQ ID NO: 5430401 - DNA, 21 bp, Homo sapiens
ggcttttccctgggtggagca

SEQ ID NO: 5430402 - DNA, 16 bp, Homo sapiens
ggcttttccttttgca

SEQ ID NO: 5430403 - DNA, 19 bp, Homo sapiens
ggcttttcgcttgcttctg

SEQ ID NO: 5430404 - DNA, 14 bp, Homo sapiens
ggcttttctcagct

SEQ ID NO: 5430405 - DNA, 16 bp, Homo sapiens
ggcttttctcccagct

SEQ ID NO: 5430406 - DNA, 22 bp, Homo sapiens
ggcttttctggggcccaggaag

SEQ ID NO: 5430407 - DNA, 13 bp, Homo sapiens
ggcttttctgttt

SEQ ID NO: 5430408 - DNA, 21 bp, Homo sapiens
ggcttttgctttccctgaagc

SEQ ID NO: 5430409 - DNA, 18 bp, Homo sapiens
ggcttttggtgaatttgt

SEQ ID NO: 5430410 - DNA, 14 bp, Homo sapiens
ggcttttgtgcatt

SEQ ID NO: 5430411 - DNA, 14 bp, Homo sapiens
ggcttttgttctga

SEQ ID NO: 5430412 - DNA, 21 bp, Homo sapiens
ggctttttactattaacatga

SEQ ID NO: 5430413 - DNA, 16 bp, Homo sapiens
ggctttttcctctgag

SEQ ID NO: 5430414 - DNA, 16 bp, Homo sapiens
ggctttttttttctct

SEQ ID NO: 5430415 - DNA, 13 bp, Homo sapiens
gggaaaaaaaaaa

SEQ ID NO: 5430416 - DNA, 16 bp, Homo sapiens
gggaaaaaaaaaaaag

SEQ ID NO: 5430417 - DNA, 21 bp, Homo sapiens
gggaaaaaaaaaaaagaaaag

SEQ ID NO: 5430418 - DNA, 13 bp, Homo sapiens
gggaaaaaaaggt

SEQ ID NO: 5430419 - DNA, 18 bp, Homo sapiens
gggaaaaaagaaagaaaa

SEQ ID NO: 5430420 - DNA, 17 bp, Homo sapiens
gggaaaaactgcagtca

SEQ ID NO: 5430421 - DNA, 23 bp, Homo sapiens
gggaaaaactggctttttcccag

SEQ ID NO: 5430422 - DNA, 14 bp, Homo sapiens
gggaaaaagagact

SEQ ID NO: 5430423 - DNA, 15 bp, Homo sapiens
gggaaaaagagactc

SEQ ID NO: 5430424 - DNA, 23 bp, Homo sapiens
gggaaaaagaggatctggagaac

SEQ ID NO: 5430425 - DNA, 13 bp, Homo sapiens
gggaaaaatggga

SEQ ID NO: 5430426 - DNA, 22 bp, Homo sapiens
gggaaaacaaaaatatcttgca

SEQ ID NO: 5430427 - DNA, 22 bp, Homo sapiens
gggaaaacacggccctcctggg

SEQ ID NO: 5430428 - DNA, 15 bp, Homo sapiens
gggaaaacagaaaac

SEQ ID NO: 5430429 - DNA, 14 bp, Homo sapiens
gggaaaacctcagt

SEQ ID NO: 5430430 - DNA, 22 bp, Homo sapiens
gggaaaacgggcagtctgctct

SEQ ID NO: 5430431 - DNA, 15 bp, Homo sapiens
gggaaaactcttcat

SEQ ID NO: 5430432 - DNA, 20 bp, Homo sapiens
gggaaaacttcactccaaag

SEQ ID NO: 5430433 - DNA, 15 bp, Homo sapiens
gggaaaagaagctgt

SEQ ID NO: 5430434 - DNA, 22 bp, Homo sapiens
gggaaaatatagacctatgata

SEQ ID NO: 5430435 - DNA, 21 bp, Homo sapiens
gggaaaatgttttgtaagaaa

SEQ ID NO: 5430436 - DNA, 22 bp, Homo sapiens
gggaaacaaataatttgaactt

SEQ ID NO: 5430437 - DNA, 16 bp, Homo sapiens
gggaaacaatgaaaac

SEQ ID NO: 5430438 - DNA, 19 bp, Homo sapiens
gggaaacactgaaatgaaa

SEQ ID NO: 5430439 - DNA, 16 bp, Homo sapiens
gggaaacagcctctct

SEQ ID NO: 5430440 - DNA, 15 bp, Homo sapiens
gggaaacagggagcc

SEQ ID NO: 5430441 - DNA, 20 bp, Homo sapiens
gggaaaccctggagccatcc

SEQ ID NO: 5430442 - DNA, 19 bp, Homo sapiens
gggaaacctgcctttgtat

SEQ ID NO: 5430443 - DNA, 18 bp, Homo sapiens
gggaaacctgtgaaagct

SEQ ID NO: 5430444 - DNA, 18 bp, Homo sapiens
gggaaacgggctccttcc

SEQ ID NO: 5430445 - DNA, 18 bp, Homo sapiens
gggaaacgtctcccagat

SEQ ID NO: 5430446 - DNA, 20 bp, Homo sapiens
gggaaacgtgggttcaattt

SEQ ID NO: 5430447 - DNA, 20 bp, Homo sapiens
gggaaactgagggcagagag

SEQ ID NO: 5430448 - DNA, 21 bp, Homo sapiens
gggaaactgagggcagagagg

SEQ ID NO: 5430449 - DNA, 14 bp, Homo sapiens
gggaaacttggctc

SEQ ID NO: 5430450 - DNA, 17 bp, Homo sapiens
gggaaacttgtcacttg

SEQ ID NO: 5430451 - DNA, 12 bp, Homo sapiens
gggaaagaagaa

SEQ ID NO: 5430452 - DNA, 14 bp, Homo sapiens
gggaaagaagaaac

SEQ ID NO: 5430453 - DNA, 21 bp, Homo sapiens
gggaaagacatccataaagaa

SEQ ID NO: 5430454 - DNA, 12 bp, Homo sapiens
gggaaagagaca

SEQ ID NO: 5430455 - DNA, 14 bp, Homo sapiens
gggaaagagggagc

SEQ ID NO: 5430456 - DNA, 15 bp, Homo sapiens
gggaaagccacctct

SEQ ID NO: 5430457 - DNA, 12 bp, Homo sapiens
gggaaagccagc

SEQ ID NO: 5430458 - DNA, 14 bp, Homo sapiens
gggaaagccagcct

SEQ ID NO: 5430459 - DNA, 18 bp, Homo sapiens
gggaaagccatgaccttg

SEQ ID NO: 5430460 - DNA, 16 bp, Homo sapiens
gggaaagcgggcagcc

SEQ ID NO: 5430461 - DNA, 11 bp, Homo sapiens
gggaaagctgt

SEQ ID NO: 5430462 - DNA, 18 bp, Homo sapiens
gggaaaggaaaaccaggg

SEQ ID NO: 5430463 - DNA, 17 bp, Homo sapiens
gggaaaggaaacgcccc

SEQ ID NO: 5430464 - DNA, 18 bp, Homo sapiens
gggaaagggatggtcagg

SEQ ID NO: 5430465 - DNA, 13 bp, Homo sapiens
gggaaaggggaca

SEQ ID NO: 5430466 - DNA, 17 bp, Homo sapiens
gggaaaggggacaagga

SEQ ID NO: 5430467 - DNA, 12 bp, Homo sapiens
gggaaaggtgct

SEQ ID NO: 5430468 - DNA, 15 bp, Homo sapiens
gggaaaggtgctcaa

SEQ ID NO: 5430469 - DNA, 23 bp, Homo sapiens
gggaaagtcagctttcagagcca

SEQ ID NO: 5430470 - DNA, 14 bp, Homo sapiens
gggaaataagagag

SEQ ID NO: 5430471 - DNA, 21 bp, Homo sapiens
gggaaataccttgagcagaat

SEQ ID NO: 5430472 - DNA, 21 bp, Homo sapiens
gggaaatagcggccctggagg

SEQ ID NO: 5430473 - DNA, 18 bp, Homo sapiens
gggaaatccaactccagg

SEQ ID NO: 5430474 - DNA, 15 bp, Homo sapiens
gggaaatgagccagc

SEQ ID NO: 5430475 - DNA, 12 bp, Homo sapiens
gggaaatgcatt

SEQ ID NO: 5430476 - DNA, 16 bp, Homo sapiens
gggaaatggccttccc

SEQ ID NO: 5430477 - DNA, 16 bp, Homo sapiens
gggaaatgtaatactg

SEQ ID NO: 5430478 - DNA, 23 bp, Homo sapiens
gggaaatgtaatactggaataat

SEQ ID NO: 5430479 - DNA, 18 bp, Homo sapiens
gggaaatgtacacttttt

SEQ ID NO: 5430480 - DNA, 12 bp, Homo sapiens
gggaaatgtgga

SEQ ID NO: 5430481 - DNA, 12 bp, Homo sapiens
gggaaattaatc

SEQ ID NO: 5430482 - DNA, 20 bp, Homo sapiens
gggaaattgaagtgtcttct

SEQ ID NO: 5430483 - DNA, 23 bp, Homo sapiens
gggaaattggcagttcctggcat

SEQ ID NO: 5430484 - DNA, 23 bp, Homo sapiens
gggaaattgtaaatcctgtgttt

SEQ ID NO: 5430485 - DNA, 13 bp, Homo sapiens
gggaaatttttca

SEQ ID NO: 5430486 - DNA, 21 bp, Homo sapiens
gggaacaaaactgttcttttg

SEQ ID NO: 5430487 - DNA, 15 bp, Homo sapiens
gggaacaaattttca

SEQ ID NO: 5430488 - DNA, 14 bp, Homo sapiens
gggaacaagtgtac

SEQ ID NO: 5430489 - DNA, 14 bp, Homo sapiens
gggaacaatttggc

SEQ ID NO: 5430490 - DNA, 17 bp, Homo sapiens
gggaacacagctacaac

SEQ ID NO: 5430491 - DNA, 16 bp, Homo sapiens
gggaacacagttctgg

SEQ ID NO: 5430492 - DNA, 17 bp, Homo sapiens
gggaacactgagaaaga

SEQ ID NO: 5430493 - DNA, 13 bp, Homo sapiens
gggaacactgccc

SEQ ID NO: 5430494 - DNA, 16 bp, Homo sapiens
gggaacagacaggaga

SEQ ID NO: 5430495 - DNA, 18 bp, Homo sapiens
gggaacagagcgggcctc

SEQ ID NO: 5430496 - DNA, 19 bp, Homo sapiens
gggaacagagcgggcctct

SEQ ID NO: 5430497 - DNA, 22 bp, Homo sapiens
gggaacagccactcccctccac

SEQ ID NO: 5430498 - DNA, 15 bp, Homo sapiens
gggaacagccccagg

SEQ ID NO: 5430499 - DNA, 17 bp, Homo sapiens
gggaacagccccagggt

SEQ ID NO: 5430500 - DNA, 17 bp, Homo sapiens
gggaacagcctgagccg

SEQ ID NO: 5430501 - DNA, 16 bp, Homo sapiens
gggaacaggagaccca

SEQ ID NO: 5430502 - DNA, 21 bp, Homo sapiens
gggaacagtaaagaaagcaga

SEQ ID NO: 5430503 - DNA, 12 bp, Homo sapiens
gggaacagtgtt

SEQ ID NO: 5430504 - DNA, 20 bp, Homo sapiens
gggaacatgacccagcctga

SEQ ID NO: 5430505 - DNA, 13 bp, Homo sapiens
gggaacatgagcc

SEQ ID NO: 5430506 - DNA, 16 bp, Homo sapiens
gggaacatggctggcc

SEQ ID NO: 5430507 - DNA, 16 bp, Homo sapiens
gggaacatggggagga

SEQ ID NO: 5430508 - DNA, 14 bp, Homo sapiens
gggaacatttccga

SEQ ID NO: 5430509 - DNA, 19 bp, Homo sapiens
gggaacatttctgtaaata

SEQ ID NO: 5430510 - DNA, 16 bp, Homo sapiens
gggaacccagccctgg

SEQ ID NO: 5430511 - DNA, 17 bp, Homo sapiens
gggaacccccttccccg

SEQ ID NO: 5430512 - DNA, 12 bp, Homo sapiens
gggaaccctccc

SEQ ID NO: 5430513 - DNA, 15 bp, Homo sapiens
gggaaccctccccaa

SEQ ID NO: 5430514 - DNA, 16 bp, Homo sapiens
gggaaccgccctcctg

SEQ ID NO: 5430515 - DNA, 18 bp, Homo sapiens
gggaaccgccctcctgat

SEQ ID NO: 5430516 - DNA, 19 bp, Homo sapiens
gggaacctagctacactga

SEQ ID NO: 5430517 - DNA, 19 bp, Homo sapiens
gggaacctagtactctctg

SEQ ID NO: 5430518 - DNA, 21 bp, Homo sapiens
gggaacctagtactctctgct

SEQ ID NO: 5430519 - DNA, 14 bp, Homo sapiens
gggaacctgtgtcc

SEQ ID NO: 5430520 - DNA, 15 bp, Homo sapiens
gggaacctgtgtccg

SEQ ID NO: 5430521 - DNA, 16 bp, Homo sapiens
gggaacgatgtgtctg

SEQ ID NO: 5430522 - DNA, 14 bp, Homo sapiens
gggaacgcagaggc

SEQ ID NO: 5430523 - DNA, 14 bp, Homo sapiens
gggaacgcagcctc

SEQ ID NO: 5430524 - DNA, 19 bp, Homo sapiens
gggaacgcagcctccagtt

SEQ ID NO: 5430525 - DNA, 20 bp, Homo sapiens
gggaacgtgtgtccaggctc

SEQ ID NO: 5430526 - DNA, 23 bp, Homo sapiens
gggaactcacctggggctgctgg

SEQ ID NO: 5430527 - DNA, 13 bp, Homo sapiens
gggaactcatcaa

SEQ ID NO: 5430528 - DNA, 14 bp, Homo sapiens
gggaactccactct

SEQ ID NO: 5430529 - DNA, 17 bp, Homo sapiens
gggaactctcctggcct

SEQ ID NO: 5430530 - DNA, 13 bp, Homo sapiens
gggaactctgaca

SEQ ID NO: 5430531 - DNA, 19 bp, Homo sapiens
gggaactgaatcaggaaac

SEQ ID NO: 5430532 - DNA, 11 bp, Homo sapiens
gggaactgacc

SEQ ID NO: 5430533 - DNA, 18 bp, Homo sapiens
gggaactgacgctggaga

SEQ ID NO: 5430534 - DNA, 20 bp, Homo sapiens
gggaactgatgtagaaggca

SEQ ID NO: 5430535 - DNA, 15 bp, Homo sapiens
gggaactgcagacct

SEQ ID NO: 5430536 - DNA, 20 bp, Homo sapiens
gggaactgcagacctgtcct

SEQ ID NO: 5430537 - DNA, 13 bp, Homo sapiens
gggaactggccaa

SEQ ID NO: 5430538 - DNA, 16 bp, Homo sapiens
gggaactggccaagct

SEQ ID NO: 5430539 - DNA, 21 bp, Homo sapiens
gggaactggccaagctgaggt

SEQ ID NO: 5430540 - DNA, 13 bp, Homo sapiens
gggaactgtgcaa

SEQ ID NO: 5430541 - DNA, 18 bp, Homo sapiens
gggaactttctggactcc

SEQ ID NO: 5430542 - DNA, 15 bp, Homo sapiens
gggaagaaaaaggaa

SEQ ID NO: 5430543 - DNA, 19 bp, Homo sapiens
gggaagaaaagagctttct

SEQ ID NO: 5430544 - DNA, 19 bp, Homo sapiens
gggaagaagcagagagatg

SEQ ID NO: 5430545 - DNA, 18 bp, Homo sapiens
gggaagaagctctctcct

SEQ ID NO: 5430546 - DNA, 14 bp, Homo sapiens
gggaagaaggggcc

SEQ ID NO: 5430547 - DNA, 17 bp, Homo sapiens
gggaagacagagcaggc

SEQ ID NO: 5430548 - DNA, 11 bp, Homo sapiens
gggaagacagt

SEQ ID NO: 5430549 - DNA, 14 bp, Homo sapiens
gggaagacagtggc

SEQ ID NO: 5430550 - DNA, 20 bp, Homo sapiens
gggaagacctgaaagagagg

SEQ ID NO: 5430551 - DNA, 18 bp, Homo sapiens
gggaagactcaggagtct

SEQ ID NO: 5430552 - DNA, 19 bp, Homo sapiens
gggaagagaaatacaagat

SEQ ID NO: 5430553 - DNA, 14 bp, Homo sapiens
gggaagagaagaaa

SEQ ID NO: 5430554 - DNA, 16 bp, Homo sapiens
gggaagagaagacaaa

SEQ ID NO: 5430555 - DNA, 20 bp, Homo sapiens
gggaagagaagagggcccag

SEQ ID NO: 5430556 - DNA, 13 bp, Homo sapiens
gggaagagagcct

SEQ ID NO: 5430557 - DNA, 15 bp, Homo sapiens
gggaagagagcctgc

SEQ ID NO: 5430558 - DNA, 17 bp, Homo sapiens
gggaagagaggagttca

SEQ ID NO: 5430559 - DNA, 22 bp, Homo sapiens
gggaagagaggagttcaatgat

SEQ ID NO: 5430560 - DNA, 23 bp, Homo sapiens
gggaagagaggagttcaatgatc

SEQ ID NO: 5430561 - DNA, 16 bp, Homo sapiens
gggaagagatccaaag

SEQ ID NO: 5430562 - DNA, 19 bp, Homo sapiens
gggaagagatccaaagact

SEQ ID NO: 5430563 - DNA, 15 bp, Homo sapiens
gggaagagcacagcc

SEQ ID NO: 5430564 - DNA, 18 bp, Homo sapiens
gggaagagcacagccctc

SEQ ID NO: 5430565 - DNA, 22 bp, Homo sapiens
gggaagagcacagccctcccgc

SEQ ID NO: 5430566 - DNA, 17 bp, Homo sapiens
gggaagagctcccctcc

SEQ ID NO: 5430567 - DNA, 17 bp, Homo sapiens
gggaagaggactgtgtg

SEQ ID NO: 5430568 - DNA, 19 bp, Homo sapiens
gggaagaggatgagcagag

SEQ ID NO: 5430569 - DNA, 12 bp, Homo sapiens
gggaagaggcct

SEQ ID NO: 5430570 - DNA, 13 bp, Homo sapiens
gggacctcctccc

SEQ ID NO: 5430571 - DNA, 18 bp, Homo sapiens
gggacctgaatgacctgc

SEQ ID NO: 5430572 - DNA, 12 bp, Homo sapiens
gggacctgagag

SEQ ID NO: 5430573 - DNA, 17 bp, Homo sapiens
gggacctgatggagagt

SEQ ID NO: 5430574 - DNA, 21 bp, Homo sapiens
gggacctgatggagagtgaga

SEQ ID NO: 5430575 - DNA, 18 bp, Homo sapiens
gggacctgctgctcagta

SEQ ID NO: 5430576 - DNA, 13 bp, Homo sapiens
gggacctggaagg

SEQ ID NO: 5430577 - DNA, 18 bp, Homo sapiens
gggacctggtaccctcct

SEQ ID NO: 5430578 - DNA, 20 bp, Homo sapiens
gggaccttctgagccttcta

SEQ ID NO: 5430579 - DNA, 22 bp, Homo sapiens
gggaccttgtgggaccagtccc

SEQ ID NO: 5430580 - DNA, 21 bp, Homo sapiens
gggacgaagaagagccacagt

SEQ ID NO: 5430581 - DNA, 21 bp, Homo sapiens
gggacgacccggggcgggctg

SEQ ID NO: 5430582 - DNA, 16 bp, Homo sapiens
gggacgagcagagcgc

SEQ ID NO: 5430583 - DNA, 23 bp, Homo sapiens
gggacgagcagagcgcagccccc

SEQ ID NO: 5430584 - DNA, 17 bp, Homo sapiens
gggacgagggccaggca

SEQ ID NO: 5430585 - DNA, 22 bp, Homo sapiens
gggacgcacagcactgcctgcc

SEQ ID NO: 5430586 - DNA, 14 bp, Homo sapiens
gggacgcaggcccc

SEQ ID NO: 5430587 - DNA, 21 bp, Homo sapiens
gggacgcaggcccctctcctc

SEQ ID NO: 5430588 - DNA, 13 bp, Homo sapiens
gggacgcccagcc

SEQ ID NO: 5430589 - DNA, 14 bp, Homo sapiens
gggacgcccagccc

SEQ ID NO: 5430590 - DNA, 18 bp, Homo sapiens
gggacgcccagcccccac

SEQ ID NO: 5430591 - DNA, 21 bp, Homo sapiens
gggacgcccagcccccacccc

SEQ ID NO: 5430592 - DNA, 21 bp, Homo sapiens
gggacgcctgggggtgccagg

SEQ ID NO: 5430593 - DNA, 15 bp, Homo sapiens
gggacgcctgtgtca

SEQ ID NO: 5430594 - DNA, 20 bp, Homo sapiens
gggacgcggccggcggcctc

SEQ ID NO: 5430595 - DNA, 20 bp, Homo sapiens
gggacgctccgctgccgtgc

SEQ ID NO: 5430596 - DNA, 13 bp, Homo sapiens
gggacgctgagga

SEQ ID NO: 5430597 - DNA, 14 bp, Homo sapiens
gggacgcttccaga

SEQ ID NO: 5430598 - DNA, 20 bp, Homo sapiens
gggacgcttccagaccacct

SEQ ID NO: 5430599 - DNA, 22 bp, Homo sapiens
gggacgcttccagaccacctgc

SEQ ID NO: 5430600 - DNA, 23 bp, Homo sapiens
gggacgcttccagaccacctgcc

SEQ ID NO: 5430601 - DNA, 22 bp, Homo sapiens
gggacgcttttgagtgggccct

SEQ ID NO: 5430602 - DNA, 22 bp, Homo sapiens
gggacggggcccgccccaggcc

SEQ ID NO: 5430603 - DNA, 17 bp, Homo sapiens
gggacggggctgacatc

SEQ ID NO: 5430604 - DNA, 23 bp, Homo sapiens
gggacgtcctgccacctggggca

SEQ ID NO: 5430605 - DNA, 16 bp, Homo sapiens
gggacgtgagagaagg

SEQ ID NO: 5430606 - DNA, 20 bp, Homo sapiens
gggacgtggctcagccagca

SEQ ID NO: 5430607 - DNA, 14 bp, Homo sapiens
gggacgtggtcagg

SEQ ID NO: 5430608 - DNA, 22 bp, Homo sapiens
gggacgttcgtggtcctgcgct

SEQ ID NO: 5430609 - DNA, 23 bp, Homo sapiens
gggacgttgctgagccagctgca

SEQ ID NO: 5430610 - DNA, 14 bp, Homo sapiens
gggacgtttctcat

SEQ ID NO: 5430611 - DNA, 19 bp, Homo sapiens
gggactacaggcgtgagcc

SEQ ID NO: 5430612 - DNA, 20 bp, Homo sapiens
gggactacaggctcatgcca

SEQ ID NO: 5430613 - DNA, 18 bp, Homo sapiens
gggactacctctgtgcct

SEQ ID NO: 5430614 - DNA, 15 bp, Homo sapiens
gggactagcccctgt

SEQ ID NO: 5430615 - DNA, 20 bp, Homo sapiens
gggactagtttataggagaa

SEQ ID NO: 5430616 - DNA, 20 bp, Homo sapiens
gggactatctttgctgcaga

SEQ ID NO: 5430617 - DNA, 19 bp, Homo sapiens
gggactcaagggtccagaa

SEQ ID NO: 5430618 - DNA, 19 bp, Homo sapiens
gggactcaatgcactgaca

SEQ ID NO: 5430619 - DNA, 16 bp, Homo sapiens
gggactcactggcagc

SEQ ID NO: 5430620 - DNA, 18 bp, Homo sapiens
gggactcactggcagccc

SEQ ID NO: 5430621 - DNA, 21 bp, Homo sapiens
gggactcactggcagccccag

SEQ ID NO: 5430622 - DNA, 23 bp, Homo sapiens
gggactcactggcagccccagca

SEQ ID NO: 5430623 - DNA, 17 bp, Homo sapiens
gggactcagccctgagg

SEQ ID NO: 5430624 - DNA, 20 bp, Homo sapiens
gggactcaggtctgtaactg

SEQ ID NO: 5430625 - DNA, 18 bp, Homo sapiens
gggactcagtgagctggg

SEQ ID NO: 5430626 - DNA, 20 bp, Homo sapiens
gggactcagttgttctgagc

SEQ ID NO: 5430627 - DNA, 16 bp, Homo sapiens
gggactcatccttgcc

SEQ ID NO: 5430628 - DNA, 13 bp, Homo sapiens
gggactccaagcc

SEQ ID NO: 5430629 - DNA, 18 bp, Homo sapiens
gggactccaagccctggg

SEQ ID NO: 5430630 - DNA, 16 bp, Homo sapiens
gggactccagaagcag

SEQ ID NO: 5430631 - DNA, 19 bp, Homo sapiens
gggactcccaggaccctgt

SEQ ID NO: 5430632 - DNA, 19 bp, Homo sapiens
gggactccggctgtgctgg

SEQ ID NO: 5430633 - DNA, 14 bp, Homo sapiens
gggactcctccctg

SEQ ID NO: 5430634 - DNA, 18 bp, Homo sapiens
gggactcctccctggggg

SEQ ID NO: 5430635 - DNA, 21 bp, Homo sapiens
gggactcctccctgggggtgg

SEQ ID NO: 5430636 - DNA, 12 bp, Homo sapiens
gggactcctggt

SEQ ID NO: 5430637 - DNA, 21 bp, Homo sapiens
gggactcgcagcacccacagc

SEQ ID NO: 5430638 - DNA, 20 bp, Homo sapiens
gggactcggtgagccggggc

SEQ ID NO: 5430639 - DNA, 12 bp, Homo sapiens
gggactctccaa

SEQ ID NO: 5430640 - DNA, 23 bp, Homo sapiens
gggactctccaggcaccgcctgc

SEQ ID NO: 5430641 - DNA, 13 bp, Homo sapiens
gggactctccata

SEQ ID NO: 5430642 - DNA, 18 bp, Homo sapiens
gggactctcctcctcccc

SEQ ID NO: 5430643 - DNA, 21 bp, Homo sapiens
gggactctcctcctcccctcc

SEQ ID NO: 5430644 - DNA, 10 bp, Homo sapiens
gggactctgc

SEQ ID NO: 5430645 - DNA, 23 bp, Homo sapiens
gggactctgtctggccagggagg

SEQ ID NO: 5430646 - DNA, 16 bp, Homo sapiens
gggactcttccctggg

SEQ ID NO: 5430647 - DNA, 18 bp, Homo sapiens
gggactcttccctgggaa

SEQ ID NO: 5430648 - DNA, 15 bp, Homo sapiens
gggactgaagccaaa

SEQ ID NO: 5430649 - DNA, 15 bp, Homo sapiens
gggactgaccagcag

SEQ ID NO: 5430650 - DNA, 22 bp, Homo sapiens
gggactgaccttcggcagtggc

SEQ ID NO: 5430651 - DNA, 24 bp, Homo sapiens
gggactgactttccgagcctccag

SEQ ID NO: 5430652 - DNA, 13 bp, Homo sapiens
gggactgagaaat

SEQ ID NO: 5430653 - DNA, 15 bp, Homo sapiens
gggactgagaaattt

SEQ ID NO: 5430654 - DNA, 14 bp, Homo sapiens
gggactgagccagt

SEQ ID NO: 5430655 - DNA, 21 bp, Homo sapiens
gggactgatgtcatcttgagc

SEQ ID NO: 5430656 - DNA, 22 bp, Homo sapiens
gggactgccacctccccttgcc

SEQ ID NO: 5430657 - DNA, 16 bp, Homo sapiens
gggactgctaaataaa

SEQ ID NO: 5430658 - DNA, 17 bp, Homo sapiens
gggactgctgctctccc

SEQ ID NO: 5430659 - DNA, 21 bp, Homo sapiens
gggactgctgctctcccaagg

SEQ ID NO: 5430660 - DNA, 18 bp, Homo sapiens
gggactgctgctgcctgg

SEQ ID NO: 5430661 - DNA, 12 bp, Homo sapiens
gggactgctggc

SEQ ID NO: 5430662 - DNA, 15 bp, Homo sapiens
gggactgctggctca

SEQ ID NO: 5430663 - DNA, 14 bp, Homo sapiens
gggactggacagcc

SEQ ID NO: 5430664 - DNA, 17 bp, Homo sapiens
gggactggacagccagg

SEQ ID NO: 5430665 - DNA, 23 bp, Homo sapiens
gggactggacagctttgctccgc

SEQ ID NO: 5430666 - DNA, 21 bp, Homo sapiens
gggactggagcctgctgccct

SEQ ID NO: 5430667 - DNA, 14 bp, Homo sapiens
gggactggagtcag

SEQ ID NO: 5430668 - DNA, 21 bp, Homo sapiens
gggactggagtcagatgagca

SEQ ID NO: 5430669 - DNA, 15 bp, Homo sapiens
gggactggcccaccc

SEQ ID NO: 5430670 - DNA, 16 bp, Homo sapiens
gggactggcccacccc

SEQ ID NO: 5430671 - DNA, 15 bp, Homo sapiens
gggactgggagggcc

SEQ ID NO: 5430672 - DNA, 17 bp, Homo sapiens
gggactgggagggccca

SEQ ID NO: 5430673 - DNA, 20 bp, Homo sapiens
gggactggggatgtgggagg

SEQ ID NO: 5430674 - DNA, 19 bp, Homo sapiens
gggactggtccaggcatgg

SEQ ID NO: 5430675 - DNA, 13 bp, Homo sapiens
gggactgtatttc

SEQ ID NO: 5430676 - DNA, 19 bp, Homo sapiens
gggactgtatttctgtgga

SEQ ID NO: 5430677 - DNA, 19 bp, Homo sapiens
gggactgtcacactggtgc

SEQ ID NO: 5430678 - DNA, 21 bp, Homo sapiens
gggactgtcttcaaccctgcc

SEQ ID NO: 5430679 - DNA, 21 bp, Homo sapiens
gggactgtctttcagatacat

SEQ ID NO: 5430680 - DNA, 12 bp, Homo sapiens
gggactgtgaag

SEQ ID NO: 5430681 - DNA, 14 bp, Homo sapiens
gggactgtgcctgg

SEQ ID NO: 5430682 - DNA, 15 bp, Homo sapiens
gggactgtgcctttg

SEQ ID NO: 5430683 - DNA, 22 bp, Homo sapiens
gggactgtggtgacttctgctg

SEQ ID NO: 5430684 - DNA, 14 bp, Homo sapiens
gggactgttccaaa

SEQ ID NO: 5430685 - DNA, 19 bp, Homo sapiens
gggactgttccaaagccag

SEQ ID NO: 5430686 - DNA, 15 bp, Homo sapiens
gggacttcaaaatca

SEQ ID NO: 5430687 - DNA, 22 bp, Homo sapiens
gggacttccctagaagtcttca

SEQ ID NO: 5430688 - DNA, 17 bp, Homo sapiens
gggacttccgctccctg

SEQ ID NO: 5430689 - DNA, 20 bp, Homo sapiens
gggacttccgctccctggat

SEQ ID NO: 5430690 - DNA, 15 bp, Homo sapiens
gggacttccttgctc

SEQ ID NO: 5430691 - DNA, 21 bp, Homo sapiens
gggacttcttacccaaagcac

SEQ ID NO: 5430692 - DNA, 14 bp, Homo sapiens
gggacttcttttca

SEQ ID NO: 5430693 - DNA, 15 bp, Homo sapiens
gggacttggaagctc

SEQ ID NO: 5430694 - DNA, 17 bp, Homo sapiens
gggacttggagagcaaa

SEQ ID NO: 5430695 - DNA, 18 bp, Homo sapiens
gggacttggagagcaaag

SEQ ID NO: 5430696 - DNA, 14 bp, Homo sapiens
gggacttggctgtc

SEQ ID NO: 5430697 - DNA, 16 bp, Homo sapiens
gggacttggctgtcct

SEQ ID NO: 5430698 - DNA, 17 bp, Homo sapiens
gggacttggctgtcctt

SEQ ID NO: 5430699 - DNA, 22 bp, Homo sapiens
gggacttggggatttctggtca

SEQ ID NO: 5430700 - DNA, 16 bp, Homo sapiens
gggacttgtcccaagt

SEQ ID NO: 5430701 - DNA, 18 bp, Homo sapiens
gggacttgtttagagagc

SEQ ID NO: 5430702 - DNA, 20 bp, Homo sapiens
gggacttgtttagagagcct

SEQ ID NO: 5430703 - DNA, 23 bp, Homo sapiens
gggacttgtttagagagcctgtc

SEQ ID NO: 5430704 - DNA, 19 bp, Homo sapiens
gggagaaaaaaaaagcaaa

SEQ ID NO: 5430705 - DNA, 15 bp, Homo sapiens
gggagaaaagacatg

SEQ ID NO: 5430706 - DNA, 14 bp, Homo sapiens
gggagaaaagccag

SEQ ID NO: 5430707 - DNA, 15 bp, Homo sapiens
gggagaaaagccaga

SEQ ID NO: 5430708 - DNA, 21 bp, Homo sapiens
gggagaaaaggaaaagaaaaa

SEQ ID NO: 5430709 - DNA, 20 bp, Homo sapiens
gggagaaaatcatcaagaag

SEQ ID NO: 5430710 - DNA, 13 bp, Homo sapiens
gggagaaagtagg

SEQ ID NO: 5430711 - DNA, 15 bp, Homo sapiens
gggagaaataatgca

SEQ ID NO: 5430712 - DNA, 21 bp, Homo sapiens
gggagaaccaaaaagaggcta

SEQ ID NO: 5430713 - DNA, 15 bp, Homo sapiens
gggagaacccttcct

SEQ ID NO: 5430714 - DNA, 16 bp, Homo sapiens
gggagaagaaatacag

SEQ ID NO: 5430715 - DNA, 23 bp, Homo sapiens
gggagaagcgggctgggggtagc

SEQ ID NO: 5430716 - DNA, 14 bp, Homo sapiens
gggagaagctgaag

SEQ ID NO: 5430717 - DNA, 18 bp, Homo sapiens
gggagaaggaagggcaga

SEQ ID NO: 5430718 - DNA, 15 bp, Homo sapiens
gggagaaggagaggc

SEQ ID NO: 5430719 - DNA, 21 bp, Homo sapiens
gggagaaggcatgagaaagaa

SEQ ID NO: 5430720 - DNA, 14 bp, Homo sapiens
gggagaagggagaa

SEQ ID NO: 5430721 - DNA, 13 bp, Homo sapiens
gggagaagggcca

SEQ ID NO: 5430722 - DNA, 16 bp, Homo sapiens
gggagaagtggcccct

SEQ ID NO: 5430723 - DNA, 23 bp, Homo sapiens
gggagaatcacttaagcctggaa

SEQ ID NO: 5430724 - DNA, 17 bp, Homo sapiens
gggagaatcagcagaac

SEQ ID NO: 5430725 - DNA, 12 bp, Homo sapiens
gggagaatctga

SEQ ID NO: 5430726 - DNA, 15 bp, Homo sapiens
gggagaatggctctg

SEQ ID NO: 5430727 - DNA, 22 bp, Homo sapiens
gggagaatgtcagtatgtggaa

SEQ ID NO: 5430728 - DNA, 22 bp, Homo sapiens
gggagacaccgcgcatctcttc

SEQ ID NO: 5430729 - DNA, 15 bp, Homo sapiens
gggagacacctcaga

SEQ ID NO: 5430730 - DNA, 18 bp, Homo sapiens
gggagacagaagcctgga

SEQ ID NO: 5430731 - DNA, 19 bp, Homo sapiens
gggagacagcttctctgca

SEQ ID NO: 5430732 - DNA, 21 bp, Homo sapiens
gggagacagcttctctgcagt

SEQ ID NO: 5430733 - DNA, 20 bp, Homo sapiens
gggagacagttgagagcggg

SEQ ID NO: 5430734 - DNA, 16 bp, Homo sapiens
gggagacatggaccag

SEQ ID NO: 5430735 - DNA, 21 bp, Homo sapiens
gggagaccccttgttgcactg

SEQ ID NO: 5430736 - DNA, 23 bp, Homo sapiens
gggagaccccttgttgcactgcc

SEQ ID NO: 5430737 - DNA, 16 bp, Homo sapiens
gggagaccctgggaga

SEQ ID NO: 5430738 - DNA, 17 bp, Homo sapiens
gggagaccctgggagag

SEQ ID NO: 5430739 - DNA, 9 bp, Homo sapiens
gggagacct

SEQ ID NO: 5430740 - DNA, 20 bp, Homo sapiens
gggagactgggctgagggag

SEQ ID NO: 5430741 - DNA, 18 bp, Homo sapiens
gggagacttaggccagag

SEQ ID NO: 5430742 - DNA, 20 bp, Homo sapiens
gggagacttaggccagaggt

SEQ ID NO: 5430743 - DNA, 18 bp, Homo sapiens
gggagacttgttctagag

SEQ ID NO: 5430744 - DNA, 14 bp, Homo sapiens
gggagactttctga

SEQ ID NO: 5430745 - DNA, 13 bp, Homo sapiens
gggagagacacag

SEQ ID NO: 5430746 - DNA, 13 bp, Homo sapiens
gggagtgggagag

SEQ ID NO: 5430747 - DNA, 17 bp, Homo sapiens
gggagtgggagaggaag

SEQ ID NO: 5430748 - DNA, 14 bp, Homo sapiens
gggagtgggcacct

SEQ ID NO: 5430749 - DNA, 18 bp, Homo sapiens
gggagtgggcacctcaga

SEQ ID NO: 5430750 - DNA, 19 bp, Homo sapiens
gggagtggggaagtgatct

SEQ ID NO: 5430751 - DNA, 13 bp, Homo sapiens
gggagtggggagg

SEQ ID NO: 5430752 - DNA, 18 bp, Homo sapiens
gggagtggggaggagaga

SEQ ID NO: 5430753 - DNA, 12 bp, Homo sapiens
gggagtggggcc

SEQ ID NO: 5430754 - DNA, 19 bp, Homo sapiens
gggagtggggcctttgcca

SEQ ID NO: 5430755 - DNA, 17 bp, Homo sapiens
gggagtgtactcccagg

SEQ ID NO: 5430756 - DNA, 18 bp, Homo sapiens
gggagtgtactcccaggg

SEQ ID NO: 5430757 - DNA, 14 bp, Homo sapiens
gggagtgtctgcag

SEQ ID NO: 5430758 - DNA, 15 bp, Homo sapiens
gggagtgtgatgcag

SEQ ID NO: 5430759 - DNA, 21 bp, Homo sapiens
gggagtgtggtttctttttga

SEQ ID NO: 5430760 - DNA, 12 bp, Homo sapiens
gggagtgttccc

SEQ ID NO: 5430761 - DNA, 16 bp, Homo sapiens
gggagttaagacctgg

SEQ ID NO: 5430762 - DNA, 17 bp, Homo sapiens
gggagttaagacctggc

SEQ ID NO: 5430763 - DNA, 18 bp, Homo sapiens
gggagttagggagagaga

SEQ ID NO: 5430764 - DNA, 23 bp, Homo sapiens
gggagttagggagagagaagcag

SEQ ID NO: 5430765 - DNA, 22 bp, Homo sapiens
gggagttgtcaagtctctgctg

SEQ ID NO: 5430766 - DNA, 16 bp, Homo sapiens
gggagtttgagaccag

SEQ ID NO: 5430767 - DNA, 16 bp, Homo sapiens
gggagttttgctctct

SEQ ID NO: 5430768 - DNA, 23 bp, Homo sapiens
gggataactgatttctatggctt

SEQ ID NO: 5430769 - DNA, 19 bp, Homo sapiens
gggatacagatctcagggc

SEQ ID NO: 5430770 - DNA, 20 bp, Homo sapiens
gggatacaggcccctgggtt

SEQ ID NO: 5430771 - DNA, 15 bp, Homo sapiens
gggatacatgctctt

SEQ ID NO: 5430772 - DNA, 13 bp, Homo sapiens
gggatactgcagg

SEQ ID NO: 5430773 - DNA, 13 bp, Homo sapiens
gggatacttagtg

SEQ ID NO: 5430774 - DNA, 13 bp, Homo sapiens
gggatagagagag

SEQ ID NO: 5430775 - DNA, 22 bp, Homo sapiens
gggatagatgaatactaaatgg

SEQ ID NO: 5430776 - DNA, 13 bp, Homo sapiens
gggatagatgtgt

SEQ ID NO: 5430777 - DNA, 15 bp, Homo sapiens
gggataggccagccg

SEQ ID NO: 5430778 - DNA, 15 bp, Homo sapiens
gggataggggcagag

SEQ ID NO: 5430779 - DNA, 19 bp, Homo sapiens
gggatagtcaccttttaaa

SEQ ID NO: 5430780 - DNA, 22 bp, Homo sapiens
gggatagtctgggtcagaccca

SEQ ID NO: 5430781 - DNA, 23 bp, Homo sapiens
gggatagtctgggtcagacccat

SEQ ID NO: 5430782 - DNA, 19 bp, Homo sapiens
gggatagtgttctgctcct

SEQ ID NO: 5430783 - DNA, 20 bp, Homo sapiens
gggatagtgttctgctcctg

SEQ ID NO: 5430784 - DNA, 21 bp, Homo sapiens
gggatagtgttctgctcctgc

SEQ ID NO: 5430785 - DNA, 22 bp, Homo sapiens
gggatagtgttctgctcctgct

SEQ ID NO: 5430786 - DNA, 22 bp, Homo sapiens
gggatataaaaacagattctga

SEQ ID NO: 5430787 - DNA, 15 bp, Homo sapiens
gggatataggagagg

SEQ ID NO: 5430788 - DNA, 23 bp, Homo sapiens
gggatatccctatgtcccagccc

SEQ ID NO: 5430789 - DNA, 16 bp, Homo sapiens
gggatatggcaggact

SEQ ID NO: 5430790 - DNA, 14 bp, Homo sapiens
gggatatggctgcc

SEQ ID NO: 5430791 - DNA, 13 bp, Homo sapiens
gggatattgcctt

SEQ ID NO: 5430792 - DNA, 20 bp, Homo sapiens
gggatattgccttatttgtc

SEQ ID NO: 5430793 - DNA, 14 bp, Homo sapiens
gggatattttgaaa

SEQ ID NO: 5430794 - DNA, 16 bp, Homo sapiens
gggatattttgaaatg

SEQ ID NO: 5430795 - DNA, 15 bp, Homo sapiens
gggatatttttttct

SEQ ID NO: 5430796 - DNA, 18 bp, Homo sapiens
gggatcaaacctttctgg

SEQ ID NO: 5430797 - DNA, 23 bp, Homo sapiens
gggatcaaagttctgctttctcc

SEQ ID NO: 5430798 - DNA, 17 bp, Homo sapiens
gggatcaataggaaagc

SEQ ID NO: 5430799 - DNA, 13 bp, Homo sapiens
gggatcacaaggt

SEQ ID NO: 5430800 - DNA, 22 bp, Homo sapiens
gggatcacagagacattcctcc

SEQ ID NO: 5430801 - DNA, 23 bp, Homo sapiens
gggatcacagcctcacccctgcc

SEQ ID NO: 5430802 - DNA, 14 bp, Homo sapiens
gggatcacagggcc

SEQ ID NO: 5430803 - DNA, 12 bp, Homo sapiens
gggatcactggc

SEQ ID NO: 5430804 - DNA, 22 bp, Homo sapiens
gggatcagagtctggcctgcca

SEQ ID NO: 5430805 - DNA, 23 bp, Homo sapiens
gggatcagccccgcctgtcacaa

SEQ ID NO: 5430806 - DNA, 22 bp, Homo sapiens
gggatcagcttcttgcactcct

SEQ ID NO: 5430807 - DNA, 13 bp, Homo sapiens
gggatcaggagcc

SEQ ID NO: 5430808 - DNA, 18 bp, Homo sapiens
gggatcaggggtaggaat

SEQ ID NO: 5430809 - DNA, 18 bp, Homo sapiens
gggatcagtggggcccca

SEQ ID NO: 5430810 - DNA, 21 bp, Homo sapiens
gggatcatttttccaggactc

SEQ ID NO: 5430811 - DNA, 19 bp, Homo sapiens
gggatccacgctgggccta

SEQ ID NO: 5430812 - DNA, 14 bp, Homo sapiens
gggatccagagacc

SEQ ID NO: 5430813 - DNA, 13 bp, Homo sapiens
gggatccagccac

SEQ ID NO: 5430814 - DNA, 14 bp, Homo sapiens
gggatccagttcca

SEQ ID NO: 5430815 - DNA, 14 bp, Homo sapiens
gggatcccacagcc

SEQ ID NO: 5430816 - DNA, 14 bp, Homo sapiens
gggatcccaccctg

SEQ ID NO: 5430817 - DNA, 19 bp, Homo sapiens
gggatccctgtctttccta

SEQ ID NO: 5430818 - DNA, 14 bp, Homo sapiens
gggatcctctctcc

SEQ ID NO: 5430819 - DNA, 21 bp, Homo sapiens
gggatcctggagcccctgtgt

SEQ ID NO: 5430820 - DNA, 23 bp, Homo sapiens
gggatcctggagttctggttcct

SEQ ID NO: 5430821 - DNA, 21 bp, Homo sapiens
gggatcgcaccttttatacca

SEQ ID NO: 5430822 - DNA, 20 bp, Homo sapiens
gggatctaaaaggaggacag

SEQ ID NO: 5430823 - DNA, 12 bp, Homo sapiens
gggatctcaggg

SEQ ID NO: 5430824 - DNA, 21 bp, Homo sapiens
gggatctgaaatccataaact

SEQ ID NO: 5430825 - DNA, 15 bp, Homo sapiens
gggatctggggaagg

SEQ ID NO: 5430826 - DNA, 16 bp, Homo sapiens
gggatctggggaagga

SEQ ID NO: 5430827 - DNA, 13 bp, Homo sapiens
gggatctgggggg

SEQ ID NO: 5430828 - DNA, 20 bp, Homo sapiens
gggatctggggggtggggag

SEQ ID NO: 5430829 - DNA, 19 bp, Homo sapiens
gggatctggtcctacccat

SEQ ID NO: 5430830 - DNA, 16 bp, Homo sapiens
gggatctgtttgaaca

SEQ ID NO: 5430831 - DNA, 14 bp, Homo sapiens
gggatgacctccag

SEQ ID NO: 5430832 - DNA, 15 bp, Homo sapiens
gggatgacctccaga

SEQ ID NO: 5430833 - DNA, 17 bp, Homo sapiens
gggatgacctccagaag

SEQ ID NO: 5430834 - DNA, 19 bp, Homo sapiens
gggatgactaaaatattta

SEQ ID NO: 5430835 - DNA, 20 bp, Homo sapiens
gggatgactaaaatatttat

SEQ ID NO: 5430836 - DNA, 14 bp, Homo sapiens
gggatgagcctctc

SEQ ID NO: 5430837 - DNA, 20 bp, Homo sapiens
gggatgagcctctccttgcc

SEQ ID NO: 5430838 - DNA, 18 bp, Homo sapiens
gggatgatggcagagcca

SEQ ID NO: 5430839 - DNA, 22 bp, Homo sapiens
gggatgatggcagagccaggct

SEQ ID NO: 5430840 - DNA, 20 bp, Homo sapiens
gggatgccactcctccctcc

SEQ ID NO: 5430841 - DNA, 17 bp, Homo sapiens
gggatgcccctggccct

SEQ ID NO: 5430842 - DNA, 19 bp, Homo sapiens
gggatgcccctggccctgc

SEQ ID NO: 5430843 - DNA, 23 bp, Homo sapiens
gggatgcccctggccctgcctca

SEQ ID NO: 5430844 - DNA, 15 bp, Homo sapiens
gggatgcctcaccac

SEQ ID NO: 5430845 - DNA, 18 bp, Homo sapiens
gggatgcgtgggaggcag

SEQ ID NO: 5430846 - DNA, 20 bp, Homo sapiens
gggatgctatttcagccaat

SEQ ID NO: 5430847 - DNA, 21 bp, Homo sapiens
gggatgctatttcagccaatc

SEQ ID NO: 5430848 - DNA, 23 bp, Homo sapiens
gggatgctatttcagccaatctg

SEQ ID NO: 5430849 - DNA, 11 bp, Homo sapiens
gggatgctctt

SEQ ID NO: 5430850 - DNA, 22 bp, Homo sapiens
gggatgctctttaaataataaa

SEQ ID NO: 5430851 - DNA, 17 bp, Homo sapiens
gggatggacaggaaagg

SEQ ID NO: 5430852 - DNA, 12 bp, Homo sapiens
gggatggaccct

SEQ ID NO: 5430853 - DNA, 18 bp, Homo sapiens
gggatggaccctcgcagc

SEQ ID NO: 5430854 - DNA, 16 bp, Homo sapiens
gggatggagaaagaag

SEQ ID NO: 5430855 - DNA, 20 bp, Homo sapiens
gggatggagaatgccagccc

SEQ ID NO: 5430856 - DNA, 14 bp, Homo sapiens
gggatggaggagaa

SEQ ID NO: 5430857 - DNA, 15 bp, Homo sapiens
gggatggaggagaag

SEQ ID NO: 5430858 - DNA, 18 bp, Homo sapiens
gggatggaggccagagtc

SEQ ID NO: 5430859 - DNA, 20 bp, Homo sapiens
gggatggattggcctccagg

SEQ ID NO: 5430860 - DNA, 14 bp, Homo sapiens
gggatggcagtggc

SEQ ID NO: 5430861 - DNA, 15 bp, Homo sapiens
gggatggcagtggct

SEQ ID NO: 5430862 - DNA, 17 bp, Homo sapiens
gggatggcagtggctgt

SEQ ID NO: 5430863 - DNA, 12 bp, Homo sapiens
gggatggccagg

SEQ ID NO: 5430864 - DNA, 22 bp, Homo sapiens
gggatggctatattaggcatgt

SEQ ID NO: 5430865 - DNA, 15 bp, Homo sapiens
gggatggcttggggg

SEQ ID NO: 5430866 - DNA, 15 bp, Homo sapiens
gggatgggacctgat

SEQ ID NO: 5430867 - DNA, 15 bp, Homo sapiens
gggatgggagccggg

SEQ ID NO: 5430868 - DNA, 12 bp, Homo sapiens
gggatgggaggt

SEQ ID NO: 5430869 - DNA, 16 bp, Homo sapiens
gggatgggcacaggct

SEQ ID NO: 5430870 - DNA, 14 bp, Homo sapiens
gggatgggccaggg

SEQ ID NO: 5430871 - DNA, 13 bp, Homo sapiens
gggatgggctcta

SEQ ID NO: 5430872 - DNA, 13 bp, Homo sapiens
gggatggggaggg

SEQ ID NO: 5430873 - DNA, 16 bp, Homo sapiens
gggatggggatgcttc

SEQ ID NO: 5430874 - DNA, 15 bp, Homo sapiens
gggatggggcctccc

SEQ ID NO: 5430875 - DNA, 22 bp, Homo sapiens
gggatggggcctccctccttgg

SEQ ID NO: 5430876 - DNA, 14 bp, Homo sapiens
gggatggtagtttt

SEQ ID NO: 5430877 - DNA, 17 bp, Homo sapiens
gggatggtcaggcccag

SEQ ID NO: 5430878 - DNA, 15 bp, Homo sapiens
gggatggtcctgggg

SEQ ID NO: 5430879 - DNA, 16 bp, Homo sapiens
gggatggtggcacagg

SEQ ID NO: 5430880 - DNA, 19 bp, Homo sapiens
gggatggtggcacaggcac

SEQ ID NO: 5430881 - DNA, 17 bp, Homo sapiens
gggatgtacatctctcc

SEQ ID NO: 5430882 - DNA, 12 bp, Homo sapiens
gggatgtagaac

SEQ ID NO: 5430883 - DNA, 21 bp, Homo sapiens
gggatgtcagcagacacacat

SEQ ID NO: 5430884 - DNA, 14 bp, Homo sapiens
gggatgtctctcat

SEQ ID NO: 5430885 - DNA, 13 bp, Homo sapiens
gggatgtgagccc

SEQ ID NO: 5430886 - DNA, 16 bp, Homo sapiens
gggatgtgagccccag

SEQ ID NO: 5430887 - DNA, 20 bp, Homo sapiens
gggatgtggctgcagcagcg

SEQ ID NO: 5430888 - DNA, 12 bp, Homo sapiens
gggatgtgtcct

SEQ ID NO: 5430889 - DNA, 18 bp, Homo sapiens
gggatgtgtcctgacact

SEQ ID NO: 5430890 - DNA, 22 bp, Homo sapiens
gggatgtttgtgctgcagacaa

SEQ ID NO: 5430891 - DNA, 15 bp, Homo sapiens
gggattaagggcaaa

SEQ ID NO: 5430892 - DNA, 15 bp, Homo sapiens
gggattacaggcatg

SEQ ID NO: 5430893 - DNA, 13 bp, Homo sapiens
gggattacaggct

SEQ ID NO: 5430894 - DNA, 18 bp, Homo sapiens
gggattatgggtcacagg

SEQ ID NO: 5430895 - DNA, 20 bp, Homo sapiens
gggattatgggtcacaggaa

SEQ ID NO: 5430896 - DNA, 16 bp, Homo sapiens
gggattcaaatgcatg

SEQ ID NO: 5430897 - DNA, 17 bp, Homo sapiens
gggattcaaatgcatga

SEQ ID NO: 5430898 - DNA, 22 bp, Homo sapiens
gggattcaggaaaaggcctggg

SEQ ID NO: 5430899 - DNA, 14 bp, Homo sapiens
gggattcaggggct

SEQ ID NO: 5430900 - DNA, 15 bp, Homo sapiens
gggattcccaccaag

SEQ ID NO: 5430901 - DNA, 12 bp, Homo sapiens
gggattccctgg

SEQ ID NO: 5430902 - DNA, 13 bp, Homo sapiens
gggattccctggt

SEQ ID NO: 5430903 - DNA, 20 bp, Homo sapiens
gggattcctcccctggaagt

SEQ ID NO: 5430904 - DNA, 13 bp, Homo sapiens
gggattcctgacc

SEQ ID NO: 5430905 - DNA, 14 bp, Homo sapiens
gggattcctgaccc

SEQ ID NO: 5430906 - DNA, 21 bp, Homo sapiens
gggattcctgacccaggccgc

SEQ ID NO: 5430907 - DNA, 15 bp, Homo sapiens
gggattctgagcagt

SEQ ID NO: 5430908 - DNA, 14 bp, Homo sapiens
gggattctgtgttt

SEQ ID NO: 5430909 - DNA, 20 bp, Homo sapiens
gggattcttaaagttgaatt

SEQ ID NO: 5430910 - DNA, 20 bp, Homo sapiens
gggattgaaggggcttctaa

SEQ ID NO: 5430911 - DNA, 22 bp, Homo sapiens
gggattgaaggggcttctaatg

SEQ ID NO: 5430912 - DNA, 18 bp, Homo sapiens
gggattgtctcagggccg

SEQ ID NO: 5430913 - DNA, 15 bp, Homo sapiens
gggatttaatttcca

SEQ ID NO: 5430914 - DNA, 18 bp, Homo sapiens
gggatttcaagggactgg

SEQ ID NO: 5430915 - DNA, 22 bp, Homo sapiens
gggatttcaccactcaaaggcc

SEQ ID NO: 5430916 - DNA, 17 bp, Homo sapiens
gggatttctcccagctc

SEQ ID NO: 5430917 - DNA, 14 bp, Homo sapiens
gggatttctggtca

SEQ ID NO: 5430918 - DNA, 14 bp, Homo sapiens
gggatttcttaggg

SEQ ID NO: 5430919 - DNA, 19 bp, Homo sapiens
gggatttcttcgctgctct

SEQ ID NO: 5430920 - DNA, 15 bp, Homo sapiens
gggatttgctcctgg

SEQ ID NO: 5430921 - DNA, 19 bp, Homo sapiens
gggatttgtccttggggac

SEQ ID NO: 5430922 - DNA, 23 bp, Homo sapiens
gggattttaaaaacatgagaaat

SEQ ID NO: 5430923 - DNA, 15 bp, Homo sapiens
gggattttagtaagt

SEQ ID NO: 5430924 - DNA, 17 bp, Homo sapiens
gggcaaaacccaggaca

SEQ ID NO: 5430925 - DNA, 20 bp, Homo sapiens
gggcaggtctagtgttcctg

SEQ ID NO: 5430926 - DNA, 19 bp, Homo sapiens
gggcaggtggccgcccctg

SEQ ID NO: 5430927 - DNA, 16 bp, Homo sapiens
gggcaggtgggagctg

SEQ ID NO: 5430928 - DNA, 18 bp, Homo sapiens
gggcaggtggtggcactg

SEQ ID NO: 5430929 - DNA, 20 bp, Homo sapiens
gggcaggtgtttctttcctg

SEQ ID NO: 5430930 - DNA, 17 bp, Homo sapiens
gggcaggttggtggggg

SEQ ID NO: 5430931 - DNA, 22 bp, Homo sapiens
gggcagtactcctccctggggg

SEQ ID NO: 5430932 - DNA, 17 bp, Homo sapiens
gggcagtatgtgatgga

SEQ ID NO: 5430933 - DNA, 19 bp, Homo sapiens
gggcagtcctgagtgggtg

SEQ ID NO: 5430934 - DNA, 21 bp, Homo sapiens
gggcagtcgctgcagggagca

SEQ ID NO: 5430935 - DNA, 18 bp, Homo sapiens
gggcagtctgctctgctg

SEQ ID NO: 5430936 - DNA, 20 bp, Homo sapiens
gggcagtgacaagtggaggg

SEQ ID NO: 5430937 - DNA, 15 bp, Homo sapiens
gggcagtgactggca

SEQ ID NO: 5430938 - DNA, 11 bp, Homo sapiens
gggcagtgcca

SEQ ID NO: 5430939 - DNA, 14 bp, Homo sapiens
gggcagtgccacag

SEQ ID NO: 5430940 - DNA, 20 bp, Homo sapiens
gggcagtgccacagcctgct

SEQ ID NO: 5430941 - DNA, 14 bp, Homo sapiens
gggcagtgccccag

SEQ ID NO: 5430942 - DNA, 13 bp, Homo sapiens
gggcagtgcctcc

SEQ ID NO: 5430943 - DNA, 19 bp, Homo sapiens
gggcagtgctagtgagctg

SEQ ID NO: 5430944 - DNA, 18 bp, Homo sapiens
gggcagtgcttggcccag

SEQ ID NO: 5430945 - DNA, 19 bp, Homo sapiens
gggcagtgcttggcccagg

SEQ ID NO: 5430946 - DNA, 23 bp, Homo sapiens
gggcagtgcttggcccaggagtt

SEQ ID NO: 5430947 - DNA, 17 bp, Homo sapiens
gggcagtggaagagctg

SEQ ID NO: 5430948 - DNA, 14 bp, Homo sapiens
gggcagtggagagg

SEQ ID NO: 5430949 - DNA, 20 bp, Homo sapiens
gggcagtggaggctgctgtg

SEQ ID NO: 5430950 - DNA, 14 bp, Homo sapiens
gggcagtggccaag

SEQ ID NO: 5430951 - DNA, 18 bp, Homo sapiens
gggcagtggccaagcctg

SEQ ID NO: 5430952 - DNA, 23 bp, Homo sapiens
gggcagtgtgaggacctccctgt

SEQ ID NO: 5430953 - DNA, 16 bp, Homo sapiens
gggcagtgtggcctct

SEQ ID NO: 5430954 - DNA, 16 bp, Homo sapiens
gggcagttagagcagc

SEQ ID NO: 5430955 - DNA, 16 bp, Homo sapiens
gggcagttctcccagg

SEQ ID NO: 5430956 - DNA, 16 bp, Homo sapiens
gggcagtttgggaagg

SEQ ID NO: 5430957 - DNA, 15 bp, Homo sapiens
gggcatactaataaa

SEQ ID NO: 5430958 - DNA, 15 bp, Homo sapiens
gggcatagaaactga

SEQ ID NO: 5430959 - DNA, 15 bp, Homo sapiens
gggcatagcctttcc

SEQ ID NO: 5430960 - DNA, 21 bp, Homo sapiens
gggcatagggtttggaagaaa

SEQ ID NO: 5430961 - DNA, 20 bp, Homo sapiens
gggcatcagctttccctggc

SEQ ID NO: 5430962 - DNA, 19 bp, Homo sapiens
gggcatccacccagtgctg

SEQ ID NO: 5430963 - DNA, 22 bp, Homo sapiens
gggcatccacccagtgctgcca

SEQ ID NO: 5430964 - DNA, 19 bp, Homo sapiens
gggcatccacgtagggggc

SEQ ID NO: 5430965 - DNA, 19 bp, Homo sapiens
gggcatccataccagctcg

SEQ ID NO: 5430966 - DNA, 14 bp, Homo sapiens
gggcatccatgggg

SEQ ID NO: 5430967 - DNA, 23 bp, Homo sapiens
gggcatccatggggtctctcaca

SEQ ID NO: 5430968 - DNA, 17 bp, Homo sapiens
gggcatccccagccccc

SEQ ID NO: 5430969 - DNA, 18 bp, Homo sapiens
gggcatccctcctggtac

SEQ ID NO: 5430970 - DNA, 15 bp, Homo sapiens
gggcatcctgcttcc

SEQ ID NO: 5430971 - DNA, 22 bp, Homo sapiens
gggcatctcgtgccagggcagg

SEQ ID NO: 5430972 - DNA, 13 bp, Homo sapiens
gggcatctcttcc

SEQ ID NO: 5430973 - DNA, 17 bp, Homo sapiens
gggcatctcttccccag

SEQ ID NO: 5430974 - DNA, 18 bp, Homo sapiens
gggcatctcttccccaga

SEQ ID NO: 5430975 - DNA, 20 bp, Homo sapiens
gggcatctcttccccagaga

SEQ ID NO: 5430976 - DNA, 17 bp, Homo sapiens
gggcatctgcccctccc

SEQ ID NO: 5430977 - DNA, 15 bp, Homo sapiens
gggcatctggccctg

SEQ ID NO: 5430978 - DNA, 21 bp, Homo sapiens
gggcatctggccctgctgccc

SEQ ID NO: 5430979 - DNA, 13 bp, Homo sapiens
gggcatctggcct

SEQ ID NO: 5430980 - DNA, 17 bp, Homo sapiens
gggcatcttgctggcta

SEQ ID NO: 5430981 - DNA, 20 bp, Homo sapiens
gggcatgacccagtgaagat

SEQ ID NO: 5430982 - DNA, 22 bp, Homo sapiens
gggcatgacctcagtcaggcac

SEQ ID NO: 5430983 - DNA, 20 bp, Homo sapiens
gggcatgagcattggataca

SEQ ID NO: 5430984 - DNA, 22 bp, Homo sapiens
gggcatgaggggttcctcccct

SEQ ID NO: 5430985 - DNA, 17 bp, Homo sapiens
gggcatgcacacggctg

SEQ ID NO: 5430986 - DNA, 22 bp, Homo sapiens
gggcatgcacacggctggtcac

SEQ ID NO: 5430987 - DNA, 23 bp, Homo sapiens
gggcatgcacacggctggtcact

SEQ ID NO: 5430988 - DNA, 16 bp, Homo sapiens
gggcatgccccggcca

SEQ ID NO: 5430989 - DNA, 20 bp, Homo sapiens
gggcatgccccggccacctc

SEQ ID NO: 5430990 - DNA, 13 bp, Homo sapiens
gggcatgccttgt

SEQ ID NO: 5430991 - DNA, 14 bp, Homo sapiens
gggcatgctggggc

SEQ ID NO: 5430992 - DNA, 17 bp, Homo sapiens
gggcatggacagggcca

SEQ ID NO: 5430993 - DNA, 22 bp, Homo sapiens
gggcatggacgttcggggcatg

SEQ ID NO: 5430994 - DNA, 15 bp, Homo sapiens
gggcatggccaggtg

SEQ ID NO: 5430995 - DNA, 17 bp, Homo sapiens
gggcatggccgcttcta

SEQ ID NO: 5430996 - DNA, 13 bp, Homo sapiens
gggcatggcttgc

SEQ ID NO: 5430997 - DNA, 13 bp, Homo sapiens
gggcatgggcctc

SEQ ID NO: 5430998 - DNA, 17 bp, Homo sapiens
gggcatgggcctctctg

SEQ ID NO: 5430999 - DNA, 22 bp, Homo sapiens
gggcatgggggaggctctgaag

SEQ ID NO: 5431000 - DNA, 17 bp, Homo sapiens
gggcatggggtgggcct

SEQ ID NO: 5431001 - DNA, 22 bp, Homo sapiens
gggcatgggtcgggagagggga

SEQ ID NO: 5431002 - DNA, 19 bp, Homo sapiens
gggcatggtaccagccctg

SEQ ID NO: 5431003 - DNA, 20 bp, Homo sapiens
gggcatggtaccagccctgg

SEQ ID NO: 5431004 - DNA, 16 bp, Homo sapiens
gggcatggtagctcaa

SEQ ID NO: 5431005 - DNA, 19 bp, Homo sapiens
gggcatggtatttgagaca

SEQ ID NO: 5431006 - DNA, 19 bp, Homo sapiens
gggcatgtattagccagtc

SEQ ID NO: 5431007 - DNA, 16 bp, Homo sapiens
gggcatgtccccagtg

SEQ ID NO: 5431008 - DNA, 15 bp, Homo sapiens
gggcatgtctgcctg

SEQ ID NO: 5431009 - DNA, 16 bp, Homo sapiens
gggcatgtgtatgtgt

SEQ ID NO: 5431010 - DNA, 15 bp, Homo sapiens
gggcatgtgtgcctg

SEQ ID NO: 5431011 - DNA, 19 bp, Homo sapiens
gggcatgttgggataaata

SEQ ID NO: 5431012 - DNA, 23 bp, Homo sapiens
gggcattcacaacccgagttacc

SEQ ID NO: 5431013 - DNA, 17 bp, Homo sapiens
gggcattcgggccacag

SEQ ID NO: 5431014 - DNA, 18 bp, Homo sapiens
gggcattcgggccacagg

SEQ ID NO: 5431015 - DNA, 19 bp, Homo sapiens
gggcattcgggccacaggg

SEQ ID NO: 5431016 - DNA, 13 bp, Homo sapiens
gggcattgacaaa

SEQ ID NO: 5431017 - DNA, 18 bp, Homo sapiens
gggcattgatggggaagg

SEQ ID NO: 5431018 - DNA, 23 bp, Homo sapiens
gggcattgatggggaaggaggct

SEQ ID NO: 5431019 - DNA, 13 bp, Homo sapiens
gggcattgcagcc

SEQ ID NO: 5431020 - DNA, 16 bp, Homo sapiens
gggcattgcagccttg

SEQ ID NO: 5431021 - DNA, 15 bp, Homo sapiens
gggcattgcctgtga

SEQ ID NO: 5431022 - DNA, 23 bp, Homo sapiens
gggcattgctcagcccgcttggc

SEQ ID NO: 5431023 - DNA, 14 bp, Homo sapiens
gggcattgggctga

SEQ ID NO: 5431024 - DNA, 18 bp, Homo sapiens
gggcatttaatcaggagg

SEQ ID NO: 5431025 - DNA, 16 bp, Homo sapiens
gggcatttattttata

SEQ ID NO: 5431026 - DNA, 15 bp, Homo sapiens
gggcatttggcttcc

SEQ ID NO: 5431027 - DNA, 19 bp, Homo sapiens
gggcattttcctcctctgc

SEQ ID NO: 5431028 - DNA, 20 bp, Homo sapiens
gggcattttcctcctctgcc

SEQ ID NO: 5431029 - DNA, 13 bp, Homo sapiens
gggccaaaaggaa

SEQ ID NO: 5431030 - DNA, 15 bp, Homo sapiens
gggccaaaaggaaaa

SEQ ID NO: 5431031 - DNA, 19 bp, Homo sapiens
gggccaaaagggcagccag

SEQ ID NO: 5431032 - DNA, 14 bp, Homo sapiens
gggccaaagcacag

SEQ ID NO: 5431033 - DNA, 19 bp, Homo sapiens
gggccaaagcacagctggg

SEQ ID NO: 5431034 - DNA, 16 bp, Homo sapiens
gggccaacaaggactc

SEQ ID NO: 5431035 - DNA, 20 bp, Homo sapiens
gggccaacctcaggctccta

SEQ ID NO: 5431036 - DNA, 22 bp, Homo sapiens
gggccaacttgagggcccagag

SEQ ID NO: 5431037 - DNA, 17 bp, Homo sapiens
gggccaagacagatgga

SEQ ID NO: 5431038 - DNA, 15 bp, Homo sapiens
gggccaagagagaca

SEQ ID NO: 5431039 - DNA, 12 bp, Homo sapiens
gggccaagccag

SEQ ID NO: 5431040 - DNA, 16 bp, Homo sapiens
gggccaaggacctgag

SEQ ID NO: 5431041 - DNA, 13 bp, Homo sapiens
gggccaaggactg

SEQ ID NO: 5431042 - DNA, 17 bp, Homo sapiens
gggccaagtccactgtc

SEQ ID NO: 5431043 - DNA, 19 bp, Homo sapiens
gggccaataccctactgtg

SEQ ID NO: 5431044 - DNA, 15 bp, Homo sapiens
gggccacacagaaac

SEQ ID NO: 5431045 - DNA, 13 bp, Homo sapiens
gggccacagggcg

SEQ ID NO: 5431046 - DNA, 14 bp, Homo sapiens
gggccaccaaagct

SEQ ID NO: 5431047 - DNA, 18 bp, Homo sapiens
gggccaccagctccactg

SEQ ID NO: 5431048 - DNA, 22 bp, Homo sapiens
gggccaccagctccactggcct

SEQ ID NO: 5431049 - DNA, 23 bp, Homo sapiens
gggccaccagctccactggcctg

SEQ ID NO: 5431050 - DNA, 20 bp, Homo sapiens
gggccaccaggatcagccag

SEQ ID NO: 5431051 - DNA, 20 bp, Homo sapiens
gggccacccaaatgtgtaca

SEQ ID NO: 5431052 - DNA, 21 bp, Homo sapiens
gggccacccaccagggctcag

SEQ ID NO: 5431053 - DNA, 14 bp, Homo sapiens
gggccaccctgctg

SEQ ID NO: 5431054 - DNA, 15 bp, Homo sapiens
gggccaccctgctgc

SEQ ID NO: 5431055 - DNA, 18 bp, Homo sapiens
gggccaccgcccagctca

SEQ ID NO: 5431056 - DNA, 17 bp, Homo sapiens
gggccaccggtgggcag

SEQ ID NO: 5431057 - DNA, 19 bp, Homo sapiens
gggccaccggtgggcagtg

SEQ ID NO: 5431058 - DNA, 16 bp, Homo sapiens
gggccacctccccagg

SEQ ID NO: 5431059 - DNA, 23 bp, Homo sapiens
gggccacctcctaccccttcctg

SEQ ID NO: 5431060 - DNA, 18 bp, Homo sapiens
gggccacctcctccccct

SEQ ID NO: 5431061 - DNA, 21 bp, Homo sapiens
gggccacgccccagcccgaca

SEQ ID NO: 5431062 - DNA, 14 bp, Homo sapiens
gggccacgtgccag

SEQ ID NO: 5431063 - DNA, 20 bp, Homo sapiens
gggccacgtgtgctgtggcc

SEQ ID NO: 5431064 - DNA, 19 bp, Homo sapiens
gggccactccttcctgccc

SEQ ID NO: 5431065 - DNA, 21 bp, Homo sapiens
gggccactccttcctgcccca

SEQ ID NO: 5431066 - DNA, 14 bp, Homo sapiens
gggccactgaccca

SEQ ID NO: 5431067 - DNA, 11 bp, Homo sapiens
gggccactgcc

SEQ ID NO: 5431068 - DNA, 17 bp, Homo sapiens
gggccactgccagcagc

SEQ ID NO: 5431069 - DNA, 16 bp, Homo sapiens
gggccactgccctctc

SEQ ID NO: 5431070 - DNA, 14 bp, Homo sapiens
gggccactggaagg

SEQ ID NO: 5431071 - DNA, 11 bp, Homo sapiens
gggccactggg

SEQ ID NO: 5431072 - DNA, 22 bp, Homo sapiens
gggccactggtccccaacaatg

SEQ ID NO: 5431073 - DNA, 20 bp, Homo sapiens
gggccactgtggtggcagtg

SEQ ID NO: 5431074 - DNA, 21 bp, Homo sapiens
gggccactgtgtttctgtgct

SEQ ID NO: 5431075 - DNA, 21 bp, Homo sapiens
gggccactttttttttatact

SEQ ID NO: 5431076 - DNA, 18 bp, Homo sapiens
gggccagaaggagggcag

SEQ ID NO: 5431077 - DNA, 17 bp, Homo sapiens
gggccagacagaccttc

SEQ ID NO: 5431078 - DNA, 19 bp, Homo sapiens
gggccagacagaccttcac

SEQ ID NO: 5431079 - DNA, 21 bp, Homo sapiens
gggccagacagaccttcacag

SEQ ID NO: 5431080 - DNA, 20 bp, Homo sapiens
gggccagagagcaggggagc

SEQ ID NO: 5431081 - DNA, 11 bp, Homo sapiens
gggccagagcc

SEQ ID NO: 5431082 - DNA, 12 bp, Homo sapiens
gggccagagcca

SEQ ID NO: 5431083 - DNA, 14 bp, Homo sapiens
gggccagagccagg

SEQ ID NO: 5431084 - DNA, 15 bp, Homo sapiens
gggccagagccaggg

SEQ ID NO: 5431085 - DNA, 14 bp, Homo sapiens
gggccagagcctgg

SEQ ID NO: 5431086 - DNA, 12 bp, Homo sapiens
gggccagagcta

SEQ ID NO: 5431087 - DNA, 18 bp, Homo sapiens
gggccagagctagggctg

SEQ ID NO: 5431088 - DNA, 21 bp, Homo sapiens
gggccagagctagggctgctg

SEQ ID NO: 5431089 - DNA, 13 bp, Homo sapiens
gggccagagctga

SEQ ID NO: 5431090 - DNA, 23 bp, Homo sapiens
gggccagaggaactgtccagaga

SEQ ID NO: 5431091 - DNA, 15 bp, Homo sapiens
gggccagaggctggg

SEQ ID NO: 5431092 - DNA, 19 bp, Homo sapiens
gggccagaggctgggagtc

SEQ ID NO: 5431093 - DNA, 23 bp, Homo sapiens
gggccagagttccacaaatctat

SEQ ID NO: 5431094 - DNA, 16 bp, Homo sapiens
gggccagatccagcct

SEQ ID NO: 5431095 - DNA, 13 bp, Homo sapiens
gggccagatgaca

SEQ ID NO: 5431096 - DNA, 20 bp, Homo sapiens
gggccagcacagctgaggac

SEQ ID NO: 5431097 - DNA, 15 bp, Homo sapiens
gggccagcagagggc

SEQ ID NO: 5431098 - DNA, 12 bp, Homo sapiens
gggccagcaggc

SEQ ID NO: 5431099 - DNA, 15 bp, Homo sapiens
gggccagcaggctcc

SEQ ID NO: 5431100 - DNA, 18 bp, Homo sapiens
gggccagcaggctcctgg

SEQ ID NO: 5431101 - DNA, 22 bp, Homo sapiens
gggccagcatatatacttgcaa

SEQ ID NO: 5431102 - DNA, 15 bp, Homo sapiens
gggcctggggtgcat

SEQ ID NO: 5431103 - DNA, 20 bp, Homo sapiens
gggcctgggtccccctcctg

SEQ ID NO: 5431104 - DNA, 21 bp, Homo sapiens
gggcctgggtccccctcctgc

SEQ ID NO: 5431105 - DNA, 20 bp, Homo sapiens
gggcctggtctcaccctgga

SEQ ID NO: 5431106 - DNA, 12 bp, Homo sapiens
gggcctgtacag

SEQ ID NO: 5431107 - DNA, 15 bp, Homo sapiens
gggcctgtactgcct

SEQ ID NO: 5431108 - DNA, 16 bp, Homo sapiens
gggcctgtccacaggc

SEQ ID NO: 5431109 - DNA, 10 bp, Homo sapiens
gggcctgtct

SEQ ID NO: 5431110 - DNA, 16 bp, Homo sapiens
gggcctgtggaatgag

SEQ ID NO: 5431111 - DNA, 12 bp, Homo sapiens
gggcctgtgtgc

SEQ ID NO: 5431112 - DNA, 14 bp, Homo sapiens
gggcctgtgtggag

SEQ ID NO: 5431113 - DNA, 19 bp, Homo sapiens
gggcctgtttggtgaggac

SEQ ID NO: 5431114 - DNA, 16 bp, Homo sapiens
gggccttaaaagccat

SEQ ID NO: 5431115 - DNA, 18 bp, Homo sapiens
gggccttaggaagagcct

SEQ ID NO: 5431116 - DNA, 17 bp, Homo sapiens
gggccttagggcactgg

SEQ ID NO: 5431117 - DNA, 20 bp, Homo sapiens
gggccttcccctcccagccc

SEQ ID NO: 5431118 - DNA, 11 bp, Homo sapiens
gggccttcctt

SEQ ID NO: 5431119 - DNA, 20 bp, Homo sapiens
gggccttcgggaccctgggg

SEQ ID NO: 5431120 - DNA, 14 bp, Homo sapiens
gggccttctcagct

SEQ ID NO: 5431121 - DNA, 17 bp, Homo sapiens
gggccttgaagactccc

SEQ ID NO: 5431122 - DNA, 16 bp, Homo sapiens
gggccttgagcatctg

SEQ ID NO: 5431123 - DNA, 17 bp, Homo sapiens
gggccttgagcatctgg

SEQ ID NO: 5431124 - DNA, 16 bp, Homo sapiens
gggccttgatgactgc

SEQ ID NO: 5431125 - DNA, 18 bp, Homo sapiens
gggccttgatgactgcct

SEQ ID NO: 5431126 - DNA, 20 bp, Homo sapiens
gggccttgcggaagccatag

SEQ ID NO: 5431127 - DNA, 21 bp, Homo sapiens
gggccttgctctgagcacagg

SEQ ID NO: 5431128 - DNA, 23 bp, Homo sapiens
gggccttggatcgctaagctggc

SEQ ID NO: 5431129 - DNA, 22 bp, Homo sapiens
gggccttggcctcccctgctga

SEQ ID NO: 5431130 - DNA, 13 bp, Homo sapiens
gggccttgggctc

SEQ ID NO: 5431131 - DNA, 14 bp, Homo sapiens
gggccttgggctcc

SEQ ID NO: 5431132 - DNA, 23 bp, Homo sapiens
gggccttgtctctcactgcattt

SEQ ID NO: 5431133 - DNA, 14 bp, Homo sapiens
gggccttgtgtgct

SEQ ID NO: 5431134 - DNA, 21 bp, Homo sapiens
gggcctttctcctccccacct

SEQ ID NO: 5431135 - DNA, 14 bp, Homo sapiens
gggcctttgagcct

SEQ ID NO: 5431136 - DNA, 17 bp, Homo sapiens
gggcctttgccagcaga

SEQ ID NO: 5431137 - DNA, 21 bp, Homo sapiens
gggccttttctggcaccgcag

SEQ ID NO: 5431138 - DNA, 14 bp, Homo sapiens
gggccttttctgtg

SEQ ID NO: 5431139 - DNA, 15 bp, Homo sapiens
gggccttttgcccgg

SEQ ID NO: 5431140 - DNA, 20 bp, Homo sapiens
gggcgaccccgtcacagcct

SEQ ID NO: 5431141 - DNA, 18 bp, Homo sapiens
gggcgagaaaggcctctg

SEQ ID NO: 5431142 - DNA, 15 bp, Homo sapiens
gggcgagctgcagga

SEQ ID NO: 5431143 - DNA, 12 bp, Homo sapiens
gggcgaggcaga

SEQ ID NO: 5431144 - DNA, 12 bp, Homo sapiens
gggcgagggagg

SEQ ID NO: 5431145 - DNA, 13 bp, Homo sapiens
gggcgagggaggg

SEQ ID NO: 5431146 - DNA, 21 bp, Homo sapiens
gggcgagggatgatgagggaa

SEQ ID NO: 5431147 - DNA, 18 bp, Homo sapiens
gggcgatcgcggcggagc

SEQ ID NO: 5431148 - DNA, 19 bp, Homo sapiens
gggcgcaccccacagctgg

SEQ ID NO: 5431149 - DNA, 20 bp, Homo sapiens
gggcgcagctgaagcctgga

SEQ ID NO: 5431150 - DNA, 22 bp, Homo sapiens
gggcgcagctgaagcctggacg

SEQ ID NO: 5431151 - DNA, 15 bp, Homo sapiens
gggcgcaggcccagt

SEQ ID NO: 5431152 - DNA, 12 bp, Homo sapiens
gggcgcaggccg

SEQ ID NO: 5431153 - DNA, 21 bp, Homo sapiens
gggcgcatgcctcccaggcca

SEQ ID NO: 5431154 - DNA, 15 bp, Homo sapiens
gggcgccaggacagc

SEQ ID NO: 5431155 - DNA, 13 bp, Homo sapiens
gggcgccagggtg

SEQ ID NO: 5431156 - DNA, 13 bp, Homo sapiens
gggcgcccacctc

SEQ ID NO: 5431157 - DNA, 19 bp, Homo sapiens
gggcgcccagcagcctgcc

SEQ ID NO: 5431158 - DNA, 21 bp, Homo sapiens
gggcgcccagcagcctgccag

SEQ ID NO: 5431159 - DNA, 15 bp, Homo sapiens
gggcgcccagcccag

SEQ ID NO: 5431160 - DNA, 20 bp, Homo sapiens
gggcgcccagcccaggcctg

SEQ ID NO: 5431161 - DNA, 13 bp, Homo sapiens
gggcgcccggact

SEQ ID NO: 5431162 - DNA, 15 bp, Homo sapiens
gggcgccctggaagc

SEQ ID NO: 5431163 - DNA, 22 bp, Homo sapiens
gggcgccgcaaaccacactgga

SEQ ID NO: 5431164 - DNA, 19 bp, Homo sapiens
gggcgcctgcgctcctctg

SEQ ID NO: 5431165 - DNA, 13 bp, Homo sapiens
gggcgcctgggtc

SEQ ID NO: 5431166 - DNA, 16 bp, Homo sapiens
gggcgcctgtcgggcc

SEQ ID NO: 5431167 - DNA, 21 bp, Homo sapiens
gggcgcgcgcccccaggaccc

SEQ ID NO: 5431168 - DNA, 23 bp, Homo sapiens
gggcgcgcgcccccaggaccccc

SEQ ID NO: 5431169 - DNA, 23 bp, Homo sapiens
gggcgcggccagccccggccctg

SEQ ID NO: 5431170 - DNA, 14 bp, Homo sapiens
gggcgcggctggga

SEQ ID NO: 5431171 - DNA, 13 bp, Homo sapiens
gggcgctcagacg

SEQ ID NO: 5431172 - DNA, 21 bp, Homo sapiens
gggcgctcagacggcggccag

SEQ ID NO: 5431173 - DNA, 12 bp, Homo sapiens
gggcgctcagga

SEQ ID NO: 5431174 - DNA, 17 bp, Homo sapiens
gggcgctcaggacccag

SEQ ID NO: 5431175 - DNA, 19 bp, Homo sapiens
gggcgctcaggacccaggc

SEQ ID NO: 5431176 - DNA, 20 bp, Homo sapiens
gggcgctcaggacccaggcc

SEQ ID NO: 5431177 - DNA, 21 bp, Homo sapiens
gggcgctcaggacccaggccc

SEQ ID NO: 5431178 - DNA, 17 bp, Homo sapiens
gggcgctccggcagagg

SEQ ID NO: 5431179 - DNA, 20 bp, Homo sapiens
gggcgctccggcagaggcag

SEQ ID NO: 5431180 - DNA, 14 bp, Homo sapiens
gggcgctcctccca

SEQ ID NO: 5431181 - DNA, 15 bp, Homo sapiens
gggcgctcgctcagg

SEQ ID NO: 5431182 - DNA, 22 bp, Homo sapiens
gggcgctcggtctccaccccag

SEQ ID NO: 5431183 - DNA, 15 bp, Homo sapiens
gggcgctgcagcctc

SEQ ID NO: 5431184 - DNA, 18 bp, Homo sapiens
gggcgctgcagcctccct

SEQ ID NO: 5431185 - DNA, 21 bp, Homo sapiens
gggcgctgcagcctcccttcc

SEQ ID NO: 5431186 - DNA, 23 bp, Homo sapiens
gggcgctggacactctctgccct

SEQ ID NO: 5431187 - DNA, 15 bp, Homo sapiens
gggcgctggcccagc

SEQ ID NO: 5431188 - DNA, 23 bp, Homo sapiens
gggcgctggcccagccggcctct

SEQ ID NO: 5431189 - DNA, 14 bp, Homo sapiens
gggcgctgtggctc

SEQ ID NO: 5431190 - DNA, 19 bp, Homo sapiens
gggcggacaaaagggccag

SEQ ID NO: 5431191 - DNA, 21 bp, Homo sapiens
gggcggacaaaagggccaggt

SEQ ID NO: 5431192 - DNA, 13 bp, Homo sapiens
gggcggagccttc

SEQ ID NO: 5431193 - DNA, 19 bp, Homo sapiens
gggcggagcgcctccttag

SEQ ID NO: 5431194 - DNA, 13 bp, Homo sapiens
gggcggaggcggc

SEQ ID NO: 5431195 - DNA, 12 bp, Homo sapiens
gggcggagggag

SEQ ID NO: 5431196 - DNA, 14 bp, Homo sapiens
gggcggcacagcct

SEQ ID NO: 5431197 - DNA, 15 bp, Homo sapiens
gggcggcagggctgg

SEQ ID NO: 5431198 - DNA, 19 bp, Homo sapiens
gggcggcatccgagcccct

SEQ ID NO: 5431199 - DNA, 13 bp, Homo sapiens
gggcggccaggca

SEQ ID NO: 5431200 - DNA, 13 bp, Homo sapiens
gggcggccaggga

SEQ ID NO: 5431201 - DNA, 21 bp, Homo sapiens
gggcggcccacgccagctggc

SEQ ID NO: 5431202 - DNA, 16 bp, Homo sapiens
gggcggctcctggtgc

SEQ ID NO: 5431203 - DNA, 13 bp, Homo sapiens
gggcggctgagag

SEQ ID NO: 5431204 - DNA, 21 bp, Homo sapiens
gggcggctggaaagaggagaa

SEQ ID NO: 5431205 - DNA, 15 bp, Homo sapiens
gggcgggagtggggg

SEQ ID NO: 5431206 - DNA, 13 bp, Homo sapiens
gggcgggccagga

SEQ ID NO: 5431207 - DNA, 16 bp, Homo sapiens
gggcgggccagggtgg

SEQ ID NO: 5431208 - DNA, 13 bp, Homo sapiens
gggcgggcgtggg

SEQ ID NO: 5431209 - DNA, 13 bp, Homo sapiens
gggcgggctcaga

SEQ ID NO: 5431210 - DNA, 17 bp, Homo sapiens
gggcgggctcagagctt

SEQ ID NO: 5431211 - DNA, 14 bp, Homo sapiens
gggcggggagaaga

SEQ ID NO: 5431212 - DNA, 12 bp, Homo sapiens
gggcggggcagg

SEQ ID NO: 5431213 - DNA, 16 bp, Homo sapiens
gggcggggcaggaatg

SEQ ID NO: 5431214 - DNA, 13 bp, Homo sapiens
gggcggggcccag

SEQ ID NO: 5431215 - DNA, 20 bp, Homo sapiens
gggcgggggagccaacagca

SEQ ID NO: 5431216 - DNA, 22 bp, Homo sapiens
gggcggtcaataattgtggaga

SEQ ID NO: 5431217 - DNA, 20 bp, Homo sapiens
gggcggtccagaggaggtgc

SEQ ID NO: 5431218 - DNA, 17 bp, Homo sapiens
gggcggtgtcaggtccc

SEQ ID NO: 5431219 - DNA, 14 bp, Homo sapiens
gggcgtcaggcaga

SEQ ID NO: 5431220 - DNA, 21 bp, Homo sapiens
gggcgtccagctcagccctgg

SEQ ID NO: 5431221 - DNA, 13 bp, Homo sapiens
gggcgtctccccc

SEQ ID NO: 5431222 - DNA, 17 bp, Homo sapiens
gggcgtctcccccagag

SEQ ID NO: 5431223 - DNA, 20 bp, Homo sapiens
gggcgtctcccccagagtgc

SEQ ID NO: 5431224 - DNA, 21 bp, Homo sapiens
gggcgtctgactccctcccca

SEQ ID NO: 5431225 - DNA, 14 bp, Homo sapiens
gggcgtctgagctg

SEQ ID NO: 5431226 - DNA, 17 bp, Homo sapiens
gggcgtctgttccccct

SEQ ID NO: 5431227 - DNA, 15 bp, Homo sapiens
gggcgtgaggaactc

SEQ ID NO: 5431228 - DNA, 14 bp, Homo sapiens
gggcgtgaggtccc

SEQ ID NO: 5431229 - DNA, 22 bp, Homo sapiens
gggcgtgctagaggttgcagca

SEQ ID NO: 5431230 - DNA, 20 bp, Homo sapiens
gggcgtggaccacccgccct

SEQ ID NO: 5431231 - DNA, 13 bp, Homo sapiens
gggcgtggaggga

SEQ ID NO: 5431232 - DNA, 21 bp, Homo sapiens
gggcgtggatcgagtgtagct

SEQ ID NO: 5431233 - DNA, 13 bp, Homo sapiens
gggcgtggctggc

SEQ ID NO: 5431234 - DNA, 22 bp, Homo sapiens
gggcgtggggaatgggcaggtg

SEQ ID NO: 5431235 - DNA, 13 bp, Homo sapiens
gggcgtgtccctc

SEQ ID NO: 5431236 - DNA, 14 bp, Homo sapiens
gggcgtgtccctcc

SEQ ID NO: 5431237 - DNA, 17 bp, Homo sapiens
gggcgtgtccctcctct

SEQ ID NO: 5431238 - DNA, 23 bp, Homo sapiens
gggcgtgtggtttccctgcccct

SEQ ID NO: 5431239 - DNA, 21 bp, Homo sapiens
gggcgtgtgtgacactgatga

SEQ ID NO: 5431240 - DNA, 14 bp, Homo sapiens
gggcgtgttgtttt

SEQ ID NO: 5431241 - DNA, 23 bp, Homo sapiens
gggcgttatgtaagtttctaaga

SEQ ID NO: 5431242 - DNA, 18 bp, Homo sapiens
gggcgttgggagcctagc

SEQ ID NO: 5431243 - DNA, 13 bp, Homo sapiens
gggctaaatgaag

SEQ ID NO: 5431244 - DNA, 20 bp, Homo sapiens
gggctaacatttaggagaag

SEQ ID NO: 5431245 - DNA, 17 bp, Homo sapiens
gggctaacgggaggctg

SEQ ID NO: 5431246 - DNA, 14 bp, Homo sapiens
gggctaactggccc

SEQ ID NO: 5431247 - DNA, 16 bp, Homo sapiens
gggctaactggcccca

SEQ ID NO: 5431248 - DNA, 19 bp, Homo sapiens
gggctaactggccccaggc

SEQ ID NO: 5431249 - DNA, 20 bp, Homo sapiens
gggctaactggccccaggcg

SEQ ID NO: 5431250 - DNA, 21 bp, Homo sapiens
gggctaactggccccaggcgg

SEQ ID NO: 5431251 - DNA, 23 bp, Homo sapiens
gggctaagcggtggaggaaggct

SEQ ID NO: 5431252 - DNA, 20 bp, Homo sapiens
gggctaaggcctcttgctgg

SEQ ID NO: 5431253 - DNA, 18 bp, Homo sapiens
gggctaaggggctagggc

SEQ ID NO: 5431254 - DNA, 17 bp, Homo sapiens
gggctaagtccagctct

SEQ ID NO: 5431255 - DNA, 22 bp, Homo sapiens
gggctaattatatattttgttg

SEQ ID NO: 5431256 - DNA, 20 bp, Homo sapiens
gggctacaaaggaggacaag

SEQ ID NO: 5431257 - DNA, 12 bp, Homo sapiens
gggctacacaga

SEQ ID NO: 5431258 - DNA, 19 bp, Homo sapiens
gggctacacagaccctgcc

SEQ ID NO: 5431259 - DNA, 22 bp, Homo sapiens
gggctacacagaccctgcccac

SEQ ID NO: 5431260 - DNA, 23 bp, Homo sapiens
gggctacaccttagcctgccctc

SEQ ID NO: 5431261 - DNA, 14 bp, Homo sapiens
gggctactcagcag

SEQ ID NO: 5431262 - DNA, 20 bp, Homo sapiens
gggctactgcagctttacat

SEQ ID NO: 5431263 - DNA, 14 bp, Homo sapiens
gggctactggcagc

SEQ ID NO: 5431264 - DNA, 15 bp, Homo sapiens
gggctactggcagct

SEQ ID NO: 5431265 - DNA, 16 bp, Homo sapiens
gggctactggcagctc

SEQ ID NO: 5431266 - DNA, 19 bp, Homo sapiens
gggctactggcagctcctc

SEQ ID NO: 5431267 - DNA, 17 bp, Homo sapiens
gggctagaacctggaga

SEQ ID NO: 5431268 - DNA, 16 bp, Homo sapiens
gggctagactgggctg

SEQ ID NO: 5431269 - DNA, 19 bp, Homo sapiens
gggctagactgggctggct

SEQ ID NO: 5431270 - DNA, 13 bp, Homo sapiens
gggctagcactgg

SEQ ID NO: 5431271 - DNA, 14 bp, Homo sapiens
gggctagcagaagt

SEQ ID NO: 5431272 - DNA, 16 bp, Homo sapiens
gggctagccctgagcc

SEQ ID NO: 5431273 - DNA, 12 bp, Homo sapiens
gggctagggctg

SEQ ID NO: 5431274 - DNA, 21 bp, Homo sapiens
gggctagtgtgagtggcagcc

SEQ ID NO: 5431275 - DNA, 22 bp, Homo sapiens
gggctagtgtgagtggcagcca

SEQ ID NO: 5431276 - DNA, 23 bp, Homo sapiens
gggctagtgtgagtggcagccat

SEQ ID NO: 5431277 - DNA, 15 bp, Homo sapiens
gggctagttgggctt

SEQ ID NO: 5431278 - DNA, 22 bp, Homo sapiens
gggctatcaacttaataagata

SEQ ID NO: 5431279 - DNA, 14 bp, Homo sapiens
gggctatggacaca

SEQ ID NO: 5431280 - DNA, 17 bp, Homo sapiens
gggctatggtgtggact

SEQ ID NO: 5431281 - DNA, 12 bp, Homo sapiens
gggctgtgatcg

SEQ ID NO: 5431282 - DNA, 16 bp, Homo sapiens
gggctgtgccaacctg

SEQ ID NO: 5431283 - DNA, 16 bp, Homo sapiens
gggctgtgcccggccc

SEQ ID NO: 5431284 - DNA, 20 bp, Homo sapiens
gggctgtgcccggccccacc

SEQ ID NO: 5431285 - DNA, 11 bp, Homo sapiens
gggctgtgcta

SEQ ID NO: 5431286 - DNA, 23 bp, Homo sapiens
gggctgtgcttgaaggccctgct

SEQ ID NO: 5431287 - DNA, 15 bp, Homo sapiens
gggctgtggccctgc

SEQ ID NO: 5431288 - DNA, 15 bp, Homo sapiens
gggctgtggctctgg

SEQ ID NO: 5431289 - DNA, 21 bp, Homo sapiens
gggctgtggctgggtggtcag

SEQ ID NO: 5431290 - DNA, 21 bp, Homo sapiens
gggctgtgtcctaaggcccat

SEQ ID NO: 5431291 - DNA, 21 bp, Homo sapiens
gggctgtgttgactgctgctc

SEQ ID NO: 5431292 - DNA, 16 bp, Homo sapiens
gggctgttctgtttcc

SEQ ID NO: 5431293 - DNA, 21 bp, Homo sapiens
gggctgttgaagtcaccttgt

SEQ ID NO: 5431294 - DNA, 16 bp, Homo sapiens
gggctgttgagatgcc

SEQ ID NO: 5431295 - DNA, 19 bp, Homo sapiens
gggctgttggacagctgct

SEQ ID NO: 5431296 - DNA, 18 bp, Homo sapiens
gggcttacaaagccttac

SEQ ID NO: 5431297 - DNA, 22 bp, Homo sapiens
gggcttacctgtacactgactt

SEQ ID NO: 5431298 - DNA, 15 bp, Homo sapiens
gggcttagaatgggg

SEQ ID NO: 5431299 - DNA, 14 bp, Homo sapiens
gggcttatatctgg

SEQ ID NO: 5431300 - DNA, 17 bp, Homo sapiens
gggcttatcatcagccc

SEQ ID NO: 5431301 - DNA, 16 bp, Homo sapiens
gggcttatctagccaa

SEQ ID NO: 5431302 - DNA, 19 bp, Homo sapiens
gggcttatctagccaaaga

SEQ ID NO: 5431303 - DNA, 15 bp, Homo sapiens
gggcttatgtctctg

SEQ ID NO: 5431304 - DNA, 17 bp, Homo sapiens
gggcttcaacagccaag

SEQ ID NO: 5431305 - DNA, 21 bp, Homo sapiens
gggcttcacagccacacctgg

SEQ ID NO: 5431306 - DNA, 16 bp, Homo sapiens
gggcttcactgtataa

SEQ ID NO: 5431307 - DNA, 15 bp, Homo sapiens
gggcttcagggcagg

SEQ ID NO: 5431308 - DNA, 19 bp, Homo sapiens
gggcttcagggcaggtggg

SEQ ID NO: 5431309 - DNA, 20 bp, Homo sapiens
gggcttcagtggcagctgct

SEQ ID NO: 5431310 - DNA, 12 bp, Homo sapiens
gggcttcatctg

SEQ ID NO: 5431311 - DNA, 21 bp, Homo sapiens
gggcttcattccggactggca

SEQ ID NO: 5431312 - DNA, 14 bp, Homo sapiens
gggcttccacagtg

SEQ ID NO: 5431313 - DNA, 14 bp, Homo sapiens
gggcttccatgcct

SEQ ID NO: 5431314 - DNA, 12 bp, Homo sapiens
gggcttccctag

SEQ ID NO: 5431315 - DNA, 14 bp, Homo sapiens
gggcttccctctgc

SEQ ID NO: 5431316 - DNA, 16 bp, Homo sapiens
gggcttccctggcctc

SEQ ID NO: 5431317 - DNA, 22 bp, Homo sapiens
gggcttcccttctccccagcca

SEQ ID NO: 5431318 - DNA, 18 bp, Homo sapiens
gggcttcctgaggggaga

SEQ ID NO: 5431319 - DNA, 19 bp, Homo sapiens
gggcttcctgcccttccct

SEQ ID NO: 5431320 - DNA, 13 bp, Homo sapiens
gggcttcctggag

SEQ ID NO: 5431321 - DNA, 15 bp, Homo sapiens
gggcttcctggtgct

SEQ ID NO: 5431322 - DNA, 11 bp, Homo sapiens
gggcttcctta

SEQ ID NO: 5431323 - DNA, 13 bp, Homo sapiens
gggcttctaatga

SEQ ID NO: 5431324 - DNA, 22 bp, Homo sapiens
gggcttctctccgcgggtggga

SEQ ID NO: 5431325 - DNA, 13 bp, Homo sapiens
gggcttctctggg

SEQ ID NO: 5431326 - DNA, 19 bp, Homo sapiens
gggcttctctgggaccagg

SEQ ID NO: 5431327 - DNA, 17 bp, Homo sapiens
gggcttctgcaccctcc

SEQ ID NO: 5431328 - DNA, 23 bp, Homo sapiens
gggcttctgcaccctccaccctg

SEQ ID NO: 5431329 - DNA, 22 bp, Homo sapiens
gggcttctgcggggctgagacg

SEQ ID NO: 5431330 - DNA, 21 bp, Homo sapiens
gggcttctgcggtgaggcagg

SEQ ID NO: 5431331 - DNA, 16 bp, Homo sapiens
gggcttctgcgtccac

SEQ ID NO: 5431332 - DNA, 23 bp, Homo sapiens
gggcttctgcgtccaccaggcct

SEQ ID NO: 5431333 - DNA, 18 bp, Homo sapiens
gggcttctgtccaaggca

SEQ ID NO: 5431334 - DNA, 23 bp, Homo sapiens
gggcttctgtgcacctgggctct

SEQ ID NO: 5431335 - DNA, 18 bp, Homo sapiens
gggcttctgttctctgct

SEQ ID NO: 5431336 - DNA, 20 bp, Homo sapiens
gggcttctgttctctgctga

SEQ ID NO: 5431337 - DNA, 22 bp, Homo sapiens
gggcttctgttctctgctgagg

SEQ ID NO: 5431338 - DNA, 16 bp, Homo sapiens
gggcttcttcctcaca

SEQ ID NO: 5431339 - DNA, 16 bp, Homo sapiens
gggcttgaatttgcat

SEQ ID NO: 5431340 - DNA, 13 bp, Homo sapiens
gggcttgactttt

SEQ ID NO: 5431341 - DNA, 16 bp, Homo sapiens
gggcttgacttttgta

SEQ ID NO: 5431342 - DNA, 18 bp, Homo sapiens
gggcttgcaagaggaggt

SEQ ID NO: 5431343 - DNA, 13 bp, Homo sapiens
gggcttgccttct

SEQ ID NO: 5431344 - DNA, 14 bp, Homo sapiens
gggcttgccttctg

SEQ ID NO: 5431345 - DNA, 14 bp, Homo sapiens
gggcttggaagggc

SEQ ID NO: 5431346 - DNA, 13 bp, Homo sapiens
gggcttggcctgg

SEQ ID NO: 5431347 - DNA, 16 bp, Homo sapiens
gggcttggcctggaga

SEQ ID NO: 5431348 - DNA, 22 bp, Homo sapiens
gggcttggctgccccattccag

SEQ ID NO: 5431349 - DNA, 20 bp, Homo sapiens
gggcttgggcctaggctgca

SEQ ID NO: 5431350 - DNA, 13 bp, Homo sapiens
gggcttgggcctg

SEQ ID NO: 5431351 - DNA, 14 bp, Homo sapiens
gggcttgggcctgc

SEQ ID NO: 5431352 - DNA, 17 bp, Homo sapiens
gggcttgggcctgcacc

SEQ ID NO: 5431353 - DNA, 20 bp, Homo sapiens
gggcttggggaccagagctg

SEQ ID NO: 5431354 - DNA, 19 bp, Homo sapiens
gggcttggggagcaggtct

SEQ ID NO: 5431355 - DNA, 15 bp, Homo sapiens
gggcttggggctgca

SEQ ID NO: 5431356 - DNA, 20 bp, Homo sapiens
gggcttggtggccaagcctg

SEQ ID NO: 5431357 - DNA, 17 bp, Homo sapiens
gggcttgtagttcttta

SEQ ID NO: 5431358 - DNA, 18 bp, Homo sapiens
gggcttgtggactctctg

SEQ ID NO: 5431359 - DNA, 21 bp, Homo sapiens
gggcttgtggactctctgcct

SEQ ID NO: 5431360 - DNA, 18 bp, Homo sapiens
gggcttgtggtggctgct

SEQ ID NO: 5431361 - DNA, 19 bp, Homo sapiens
gggcttgtttttcttcagc

SEQ ID NO: 5431362 - DNA, 15 bp, Homo sapiens
gggctttagggacct

SEQ ID NO: 5431363 - DNA, 16 bp, Homo sapiens
gggctttcacgggccc

SEQ ID NO: 5431364 - DNA, 21 bp, Homo sapiens
gggctttccttttatttttta

SEQ ID NO: 5431365 - DNA, 19 bp, Homo sapiens
gggctttcggggagggcgc

SEQ ID NO: 5431366 - DNA, 19 bp, Homo sapiens
gggctttcgtccacagctt

SEQ ID NO: 5431367 - DNA, 23 bp, Homo sapiens
gggctttctcttccccttcctgt

SEQ ID NO: 5431368 - DNA, 14 bp, Homo sapiens
gggctttctggaga

SEQ ID NO: 5431369 - DNA, 16 bp, Homo sapiens
gggctttgagggtgga

SEQ ID NO: 5431370 - DNA, 22 bp, Homo sapiens
gggctttgatgttccttccagt

SEQ ID NO: 5431371 - DNA, 19 bp, Homo sapiens
gggctttgcaggctctggg

SEQ ID NO: 5431372 - DNA, 14 bp, Homo sapiens
gggctttgggccca

SEQ ID NO: 5431373 - DNA, 15 bp, Homo sapiens
gggctttgggcccaa

SEQ ID NO: 5431374 - DNA, 15 bp, Homo sapiens
gggctttggggctgg

SEQ ID NO: 5431375 - DNA, 17 bp, Homo sapiens
gggctttggttccttct

SEQ ID NO: 5431376 - DNA, 21 bp, Homo sapiens
gggctttggttccttctctgg

SEQ ID NO: 5431377 - DNA, 22 bp, Homo sapiens
gggctttggttccttctctggg

SEQ ID NO: 5431378 - DNA, 22 bp, Homo sapiens
gggctttgtgaccagaaagctt

SEQ ID NO: 5431379 - DNA, 21 bp, Homo sapiens
gggctttgttgtgagaatggc

SEQ ID NO: 5431380 - DNA, 16 bp, Homo sapiens
gggcttttaaaaggaa

SEQ ID NO: 5431381 - DNA, 17 bp, Homo sapiens
gggcttttaaaaggaaa

SEQ ID NO: 5431382 - DNA, 17 bp, Homo sapiens
gggcttttccctgggtg

SEQ ID NO: 5431383 - DNA, 19 bp, Homo sapiens
gggcttttctggggcccag

SEQ ID NO: 5431384 - DNA, 16 bp, Homo sapiens
gggcttttgttctgag

SEQ ID NO: 5431385 - DNA, 20 bp, Homo sapiens
gggcttttgttctgaggggt

SEQ ID NO: 5431386 - DNA, 14 bp, Homo sapiens
gggcttttttcttt

SEQ ID NO: 5431387 - DNA, 11 bp, Homo sapiens
ggggaaaaaaa

SEQ ID NO: 5431388 - DNA, 14 bp, Homo sapiens
ggggaaaaaaaaga

SEQ ID NO: 5431389 - DNA, 22 bp, Homo sapiens
ggggaaaaaaaatctctcagag

SEQ ID NO: 5431390 - DNA, 14 bp, Homo sapiens
ggggaaaaaaatgt

SEQ ID NO: 5431391 - DNA, 15 bp, Homo sapiens
ggggaaaaaattaac

SEQ ID NO: 5431392 - DNA, 21 bp, Homo sapiens
ggggaaaaagaccaggtctac

SEQ ID NO: 5431393 - DNA, 15 bp, Homo sapiens
ggggaaaacctcagt

SEQ ID NO: 5431394 - DNA, 23 bp, Homo sapiens
ggggaaaacgggcagtctgctct

SEQ ID NO: 5431395 - DNA, 18 bp, Homo sapiens
ggggaaacgtctcccaga

SEQ ID NO: 5431396 - DNA, 15 bp, Homo sapiens
ggggaaactctggtg

SEQ ID NO: 5431397 - DNA, 22 bp, Homo sapiens
ggggaaagacactgcctgggct

SEQ ID NO: 5431398 - DNA, 21 bp, Homo sapiens
ggggaaagcaaagcacagaga

SEQ ID NO: 5431399 - DNA, 17 bp, Homo sapiens
ggggaaagggctggctg

SEQ ID NO: 5431400 - DNA, 18 bp, Homo sapiens
ggggaaatgtggagaaga

SEQ ID NO: 5431401 - DNA, 17 bp, Homo sapiens
ggggaacactgagaaag

SEQ ID NO: 5431402 - DNA, 18 bp, Homo sapiens
ggggaacactgagaaaga

SEQ ID NO: 5431403 - DNA, 20 bp, Homo sapiens
ggggaacagagcgggcctct

SEQ ID NO: 5431404 - DNA, 22 bp, Homo sapiens
ggggaacatcaccctatatata

SEQ ID NO: 5431405 - DNA, 21 bp, Homo sapiens
ggggaacatggctggcctggt

SEQ ID NO: 5431406 - DNA, 14 bp, Homo sapiens
ggggaacccagccc

SEQ ID NO: 5431407 - DNA, 20 bp, Homo sapiens
ggggaacccagccctggggt

SEQ ID NO: 5431408 - DNA, 14 bp, Homo sapiens
ggggaacgcagagg

SEQ ID NO: 5431409 - DNA, 23 bp, Homo sapiens
ggggaactcaaaggactgacctg

SEQ ID NO: 5431410 - DNA, 21 bp, Homo sapiens
ggggaactcagatccagggac

SEQ ID NO: 5431411 - DNA, 18 bp, Homo sapiens
ggggaactcccccagagg

SEQ ID NO: 5431412 - DNA, 13 bp, Homo sapiens
ggggaactcctgg

SEQ ID NO: 5431413 - DNA, 16 bp, Homo sapiens
ggggaactggcagcgc

SEQ ID NO: 5431414 - DNA, 21 bp, Homo sapiens
ggggaactggccaagctgagg

SEQ ID NO: 5431415 - DNA, 12 bp, Homo sapiens
ggggaagacagt

SEQ ID NO: 5431416 - DNA, 16 bp, Homo sapiens
ggggaagacagtggcc

SEQ ID NO: 5431417 - DNA, 17 bp, Homo sapiens
ggggaagacagtggccc

SEQ ID NO: 5431418 - DNA, 22 bp, Homo sapiens
ggggaagacccattccttccca

SEQ ID NO: 5431419 - DNA, 14 bp, Homo sapiens
ggggaagagagagg

SEQ ID NO: 5431420 - DNA, 22 bp, Homo sapiens
ggggaagagagaggcctgggtg

SEQ ID NO: 5431421 - DNA, 13 bp, Homo sapiens
ggggaagagagcc

SEQ ID NO: 5431422 - DNA, 18 bp, Homo sapiens
ggggaagagagcctgccc

SEQ ID NO: 5431423 - DNA, 18 bp, Homo sapiens
ggggaagagcacagccct

SEQ ID NO: 5431424 - DNA, 23 bp, Homo sapiens
ggggaagattttatgcacagcct

SEQ ID NO: 5431425 - DNA, 21 bp, Homo sapiens
ggggaagcaaaggggggaggt

SEQ ID NO: 5431426 - DNA, 20 bp, Homo sapiens
ggggaagcaccagcctcagt

SEQ ID NO: 5431427 - DNA, 22 bp, Homo sapiens
ggggaagcccattcctctgcca

SEQ ID NO: 5431428 - DNA, 14 bp, Homo sapiens
ggggaagcctcctg

SEQ ID NO: 5431429 - DNA, 15 bp, Homo sapiens
ggggaagccttgcac

SEQ ID NO: 5431430 - DNA, 19 bp, Homo sapiens
ggggaagctgcagcttggg

SEQ ID NO: 5431431 - DNA, 14 bp, Homo sapiens
ggggaagctggctt

SEQ ID NO: 5431432 - DNA, 14 bp, Homo sapiens
ggggaagctgggcc

SEQ ID NO: 5431433 - DNA, 13 bp, Homo sapiens
ggggaaggagcca

SEQ ID NO: 5431434 - DNA, 15 bp, Homo sapiens
ggggaaggagccagt

SEQ ID NO: 5431435 - DNA, 13 bp, Homo sapiens
ggggaaggaggga

SEQ ID NO: 5431436 - DNA, 20 bp, Homo sapiens
ggggaaggcagaggctggca

SEQ ID NO: 5431437 - DNA, 15 bp, Homo sapiens
ggggaaggccttgct

SEQ ID NO: 5431438 - DNA, 14 bp, Homo sapiens
ggggaagggaagga

SEQ ID NO: 5431439 - DNA, 13 bp, Homo sapiens
ggggaagggccag

SEQ ID NO: 5431440 - DNA, 22 bp, Homo sapiens
ggggaagggccagtctgggctg

SEQ ID NO: 5431441 - DNA, 23 bp, Homo sapiens
ggggaagggccagtctgggctgc

SEQ ID NO: 5431442 - DNA, 14 bp, Homo sapiens
ggggaagggggtgc

SEQ ID NO: 5431443 - DNA, 13 bp, Homo sapiens
ggggaagggtggg

SEQ ID NO: 5431444 - DNA, 15 bp, Homo sapiens
ggggaagggtgggga

SEQ ID NO: 5431445 - DNA, 16 bp, Homo sapiens
ggggaagtgagaaggg

SEQ ID NO: 5431446 - DNA, 16 bp, Homo sapiens
ggggaagtgctcccca

SEQ ID NO: 5431447 - DNA, 19 bp, Homo sapiens
ggggaagtgctccccacac

SEQ ID NO: 5431448 - DNA, 17 bp, Homo sapiens
ggggaatccgtgtgtgt

SEQ ID NO: 5431449 - DNA, 22 bp, Homo sapiens
ggggaatctggaacgctctagg

SEQ ID NO: 5431450 - DNA, 19 bp, Homo sapiens
ggggaatgagcccagagaa

SEQ ID NO: 5431451 - DNA, 20 bp, Homo sapiens
ggggaatgagggggctcagt

SEQ ID NO: 5431452 - DNA, 18 bp, Homo sapiens
ggggaatgctcccagctg

SEQ ID NO: 5431453 - DNA, 20 bp, Homo sapiens
ggggacacacattctgcctt

SEQ ID NO: 5431454 - DNA, 17 bp, Homo sapiens
ggggacacatgtatttg

SEQ ID NO: 5431455 - DNA, 19 bp, Homo sapiens
ggggacacatgtatttggt

SEQ ID NO: 5431456 - DNA, 15 bp, Homo sapiens
ggggacaccagagct

SEQ ID NO: 5431457 - DNA, 14 bp, Homo sapiens
ggggacaccccaga

SEQ ID NO: 5431458 - DNA, 15 bp, Homo sapiens
ggggacaccccagaa

SEQ ID NO: 5431459 - DNA, 18 bp, Homo sapiens
ggggctgcccttgggcca

SEQ ID NO: 5431460 - DNA, 17 bp, Homo sapiens
ggggctgcgctagcagc

SEQ ID NO: 5431461 - DNA, 22 bp, Homo sapiens
ggggctgcgctagcagcccttg

SEQ ID NO: 5431462 - DNA, 23 bp, Homo sapiens
ggggctgcgtccctgctcagccc

SEQ ID NO: 5431463 - DNA, 22 bp, Homo sapiens
ggggctgctcagcctcatcctg

SEQ ID NO: 5431464 - DNA, 18 bp, Homo sapiens
ggggctgctcccacctgg

SEQ ID NO: 5431465 - DNA, 10 bp, Homo sapiens
ggggctgctg

SEQ ID NO: 5431466 - DNA, 23 bp, Homo sapiens
ggggctgctgctcctctcttggg

SEQ ID NO: 5431467 - DNA, 22 bp, Homo sapiens
ggggctgctgggggctcccctt

SEQ ID NO: 5431468 - DNA, 20 bp, Homo sapiens
ggggctgctgtgtggacggc

SEQ ID NO: 5431469 - DNA, 19 bp, Homo sapiens
ggggctgcttcctcctgga

SEQ ID NO: 5431470 - DNA, 12 bp, Homo sapiens
ggggctggacct

SEQ ID NO: 5431471 - DNA, 13 bp, Homo sapiens
ggggctggaggag

SEQ ID NO: 5431472 - DNA, 16 bp, Homo sapiens
ggggctggaggagccc

SEQ ID NO: 5431473 - DNA, 21 bp, Homo sapiens
ggggctggaggagcccaggcc

SEQ ID NO: 5431474 - DNA, 23 bp, Homo sapiens
ggggctggaggagcccaggccag

SEQ ID NO: 5431475 - DNA, 18 bp, Homo sapiens
ggggctggagggggcaga

SEQ ID NO: 5431476 - DNA, 12 bp, Homo sapiens
ggggctggaggt

SEQ ID NO: 5431477 - DNA, 17 bp, Homo sapiens
ggggctggcactgactg

SEQ ID NO: 5431478 - DNA, 13 bp, Homo sapiens
ggggctggccctg

SEQ ID NO: 5431479 - DNA, 15 bp, Homo sapiens
ggggctggccctgcc

SEQ ID NO: 5431480 - DNA, 21 bp, Homo sapiens
ggggctggccctgccctcccc

SEQ ID NO: 5431481 - DNA, 23 bp, Homo sapiens
ggggctggccctgccctccccca

SEQ ID NO: 5431482 - DNA, 13 bp, Homo sapiens
ggggctggctccc

SEQ ID NO: 5431483 - DNA, 13 bp, Homo sapiens
ggggctgggcaga

SEQ ID NO: 5431484 - DNA, 16 bp, Homo sapiens
ggggctgggcagagga

SEQ ID NO: 5431485 - DNA, 17 bp, Homo sapiens
ggggctgggcagaggaa

SEQ ID NO: 5431486 - DNA, 12 bp, Homo sapiens
ggggctgggcat

SEQ ID NO: 5431487 - DNA, 20 bp, Homo sapiens
ggggctgggcatcccagctt

SEQ ID NO: 5431488 - DNA, 15 bp, Homo sapiens
ggggctggggcagga

SEQ ID NO: 5431489 - DNA, 21 bp, Homo sapiens
ggggctggggtcacagaggca

SEQ ID NO: 5431490 - DNA, 22 bp, Homo sapiens
ggggctgggtccaccctgtcct

SEQ ID NO: 5431491 - DNA, 19 bp, Homo sapiens
ggggctgggttggcgcacc

SEQ ID NO: 5431492 - DNA, 14 bp, Homo sapiens
ggggctggtccttc

SEQ ID NO: 5431493 - DNA, 21 bp, Homo sapiens
ggggctggtgggataggaggg

SEQ ID NO: 5431494 - DNA, 20 bp, Homo sapiens
ggggctgtacacaccctcca

SEQ ID NO: 5431495 - DNA, 17 bp, Homo sapiens
ggggctgtacagtattg

SEQ ID NO: 5431496 - DNA, 22 bp, Homo sapiens
ggggctgtcaccacgtgcagta

SEQ ID NO: 5431497 - DNA, 23 bp, Homo sapiens
ggggctgtcctccttcctgggac

SEQ ID NO: 5431498 - DNA, 15 bp, Homo sapiens
ggggctgtcctgctg

SEQ ID NO: 5431499 - DNA, 12 bp, Homo sapiens
ggggctgtgcat

SEQ ID NO: 5431500 - DNA, 12 bp, Homo sapiens
ggggctgtgcca

SEQ ID NO: 5431501 - DNA, 16 bp, Homo sapiens
ggggctgtggccctgc

SEQ ID NO: 5431502 - DNA, 22 bp, Homo sapiens
ggggctgtggccgtctcctccc

SEQ ID NO: 5431503 - DNA, 15 bp, Homo sapiens
ggggctgtggctctg

SEQ ID NO: 5431504 - DNA, 16 bp, Homo sapiens
ggggctgtggctctgg

SEQ ID NO: 5431505 - DNA, 17 bp, Homo sapiens
ggggctgttgagatgcc

SEQ ID NO: 5431506 - DNA, 20 bp, Homo sapiens
ggggcttataataaaggact

SEQ ID NO: 5431507 - DNA, 14 bp, Homo sapiens
ggggcttcatctct

SEQ ID NO: 5431508 - DNA, 21 bp, Homo sapiens
ggggcttcatctctttagaga

SEQ ID NO: 5431509 - DNA, 14 bp, Homo sapiens
ggggcttccctctg

SEQ ID NO: 5431510 - DNA, 12 bp, Homo sapiens
ggggcttcctgg

SEQ ID NO: 5431511 - DNA, 13 bp, Homo sapiens
ggggcttctctgg

SEQ ID NO: 5431512 - DNA, 19 bp, Homo sapiens
ggggcttctgtgcacctgg

SEQ ID NO: 5431513 - DNA, 22 bp, Homo sapiens
ggggcttctgtgcacctgggct

SEQ ID NO: 5431514 - DNA, 22 bp, Homo sapiens
ggggcttctttctgctggctga

SEQ ID NO: 5431515 - DNA, 14 bp, Homo sapiens
ggggcttgaatttg

SEQ ID NO: 5431516 - DNA, 17 bp, Homo sapiens
ggggcttgaatttgcat

SEQ ID NO: 5431517 - DNA, 18 bp, Homo sapiens
ggggcttgaatttgcatg

SEQ ID NO: 5431518 - DNA, 14 bp, Homo sapiens
ggggcttgccttct

SEQ ID NO: 5431519 - DNA, 15 bp, Homo sapiens
ggggcttgtcctgtg

SEQ ID NO: 5431520 - DNA, 19 bp, Homo sapiens
ggggctttcccaggagaaa

SEQ ID NO: 5431521 - DNA, 17 bp, Homo sapiens
ggggctttcggggaggg

SEQ ID NO: 5431522 - DNA, 19 bp, Homo sapiens
ggggctttcggggagggcg

SEQ ID NO: 5431523 - DNA, 21 bp, Homo sapiens
ggggctttcgtccacagcttc

SEQ ID NO: 5431524 - DNA, 12 bp, Homo sapiens
ggggctttgggc

SEQ ID NO: 5431525 - DNA, 22 bp, Homo sapiens
ggggctttgggcccaagaactg

SEQ ID NO: 5431526 - DNA, 22 bp, Homo sapiens
ggggcttttgtgccaggagtgg

SEQ ID NO: 5431527 - DNA, 20 bp, Homo sapiens
gggggaaaaaaaagaaaaaa

SEQ ID NO: 5431528 - DNA, 17 bp, Homo sapiens
gggggaacgatgtgtct

SEQ ID NO: 5431529 - DNA, 20 bp, Homo sapiens
gggggaacgcccacttccct

SEQ ID NO: 5431530 - DNA, 17 bp, Homo sapiens
gggggaactcagatcca

SEQ ID NO: 5431531 - DNA, 18 bp, Homo sapiens
gggggaactgacgctgga

SEQ ID NO: 5431532 - DNA, 20 bp, Homo sapiens
gggggaacttgtagccagaa

SEQ ID NO: 5431533 - DNA, 16 bp, Homo sapiens
gggggaagcaccagcc

SEQ ID NO: 5431534 - DNA, 16 bp, Homo sapiens
gggggacaacccccca

SEQ ID NO: 5431535 - DNA, 15 bp, Homo sapiens
gggggacctcgggct

SEQ ID NO: 5431536 - DNA, 21 bp, Homo sapiens
gggggacctcgggctgttctg

SEQ ID NO: 5431537 - DNA, 20 bp, Homo sapiens
gggggactctgagcgggagg

SEQ ID NO: 5431538 - DNA, 22 bp, Homo sapiens
gggggactgctttcagtgcctg

SEQ ID NO: 5431539 - DNA, 13 bp, Homo sapiens
gggggagccagag

SEQ ID NO: 5431540 - DNA, 12 bp, Homo sapiens
gggggagccagt

SEQ ID NO: 5431541 - DNA, 14 bp, Homo sapiens
gggggaggagcacc

SEQ ID NO: 5431542 - DNA, 12 bp, Homo sapiens
gggggaggcagg

SEQ ID NO: 5431543 - DNA, 15 bp, Homo sapiens
gggggaggccacccc

SEQ ID NO: 5431544 - DNA, 14 bp, Homo sapiens
gggggaggccgagg

SEQ ID NO: 5431545 - DNA, 13 bp, Homo sapiens
gggggaggctctg

SEQ ID NO: 5431546 - DNA, 12 bp, Homo sapiens
gggggaggggga

SEQ ID NO: 5431547 - DNA, 23 bp, Homo sapiens
gggggaggtgaaaagggcagagg

SEQ ID NO: 5431548 - DNA, 12 bp, Homo sapiens
gggggaggtggg

SEQ ID NO: 5431549 - DNA, 15 bp, Homo sapiens
gggggataccagctg

SEQ ID NO: 5431550 - DNA, 13 bp, Homo sapiens
gggggatgcaggc

SEQ ID NO: 5431551 - DNA, 15 bp, Homo sapiens
gggggatgcccctgg

SEQ ID NO: 5431552 - DNA, 18 bp, Homo sapiens
gggggatgcccctggccc

SEQ ID NO: 5431553 - DNA, 17 bp, Homo sapiens
gggggattcaaatgcat

SEQ ID NO: 5431554 - DNA, 23 bp, Homo sapiens
gggggcaagaagatcacgctccc

SEQ ID NO: 5431555 - DNA, 20 bp, Homo sapiens
gggggcaagaagtagcagtg

SEQ ID NO: 5431556 - DNA, 13 bp, Homo sapiens
gggggcaatctct

SEQ ID NO: 5431557 - DNA, 17 bp, Homo sapiens
gggggcaatctctctct

SEQ ID NO: 5431558 - DNA, 15 bp, Homo sapiens
gggggcacaagactg

SEQ ID NO: 5431559 - DNA, 14 bp, Homo sapiens
gggggcacagccag

SEQ ID NO: 5431560 - DNA, 13 bp, Homo sapiens
gggggcacagctg

SEQ ID NO: 5431561 - DNA, 16 bp, Homo sapiens
gggggcacagctgtct

SEQ ID NO: 5431562 - DNA, 23 bp, Homo sapiens
gggggcacagctgtctgccaggc

SEQ ID NO: 5431563 - DNA, 15 bp, Homo sapiens
gggggcacaggaggc

SEQ ID NO: 5431564 - DNA, 18 bp, Homo sapiens
gggggcaccatctggacg

SEQ ID NO: 5431565 - DNA, 19 bp, Homo sapiens
gggggcaccggctcaggag

SEQ ID NO: 5431566 - DNA, 13 bp, Homo sapiens
gggggcactgtgg

SEQ ID NO: 5431567 - DNA, 18 bp, Homo sapiens
gggggcactgtggtcagg

SEQ ID NO: 5431568 - DNA, 20 bp, Homo sapiens
gggggcactgtggtcaggcc

SEQ ID NO: 5431569 - DNA, 11 bp, Homo sapiens
gggggcagagg

SEQ ID NO: 5431570 - DNA, 12 bp, Homo sapiens
gggggcagaggg

SEQ ID NO: 5431571 - DNA, 18 bp, Homo sapiens
gggggcagagtggcctgt

SEQ ID NO: 5431572 - DNA, 22 bp, Homo sapiens
gggggcagatcttggactcatg

SEQ ID NO: 5431573 - DNA, 16 bp, Homo sapiens
gggggcaggcctccca

SEQ ID NO: 5431574 - DNA, 14 bp, Homo sapiens
gggggcagggcatg

SEQ ID NO: 5431575 - DNA, 22 bp, Homo sapiens
gggggcagtctccccttcctgg

SEQ ID NO: 5431576 - DNA, 11 bp, Homo sapiens
gggggcatcct

SEQ ID NO: 5431577 - DNA, 16 bp, Homo sapiens
gggggcatcctgcttc

SEQ ID NO: 5431578 - DNA, 20 bp, Homo sapiens
gggggcatcctgcttcctga

SEQ ID NO: 5431579 - DNA, 18 bp, Homo sapiens
gggggcatgggggaggct

SEQ ID NO: 5431580 - DNA, 17 bp, Homo sapiens
gggggcatgggtggagg

SEQ ID NO: 5431581 - DNA, 15 bp, Homo sapiens
gggggccaacaccag

SEQ ID NO: 5431582 - DNA, 13 bp, Homo sapiens
gggggccacctgc

SEQ ID NO: 5431583 - DNA, 17 bp, Homo sapiens
gggggccactgtgtttc

SEQ ID NO: 5431584 - DNA, 17 bp, Homo sapiens
gggggccagcacagctg

SEQ ID NO: 5431585 - DNA, 20 bp, Homo sapiens
gggggccagcacagctgagg

SEQ ID NO: 5431586 - DNA, 12 bp, Homo sapiens
gggggccagctg

SEQ ID NO: 5431587 - DNA, 15 bp, Homo sapiens
gggggccagctgggg

SEQ ID NO: 5431588 - DNA, 15 bp, Homo sapiens
gggggccaggcctcg

SEQ ID NO: 5431589 - DNA, 13 bp, Homo sapiens
gggggccaggctg

SEQ ID NO: 5431590 - DNA, 15 bp, Homo sapiens
gggggccaggctgag

SEQ ID NO: 5431591 - DNA, 15 bp, Homo sapiens
gggggccatgagctc

SEQ ID NO: 5431592 - DNA, 18 bp, Homo sapiens
gggggcccaaaggggagc

SEQ ID NO: 5431593 - DNA, 19 bp, Homo sapiens
gggggccccacctcggcac

SEQ ID NO: 5431594 - DNA, 21 bp, Homo sapiens
gggggccccagtcagcctctc

SEQ ID NO: 5431595 - DNA, 15 bp, Homo sapiens
gggggccgggggagg

SEQ ID NO: 5431596 - DNA, 19 bp, Homo sapiens
gggggccgggggaggggcg

SEQ ID NO: 5431597 - DNA, 17 bp, Homo sapiens
gggggcctagtggcttc

SEQ ID NO: 5431598 - DNA, 12 bp, Homo sapiens
gggggcctgcaa

SEQ ID NO: 5431599 - DNA, 14 bp, Homo sapiens
gggggcctggctgg

SEQ ID NO: 5431600 - DNA, 14 bp, Homo sapiens
gggggccttgaaga

SEQ ID NO: 5431601 - DNA, 19 bp, Homo sapiens
gggggcctttaaagactta

SEQ ID NO: 5431602 - DNA, 17 bp, Homo sapiens
gggggcgaggcccctcc

SEQ ID NO: 5431603 - DNA, 18 bp, Homo sapiens
gggggcgcggctgggagg

SEQ ID NO: 5431604 - DNA, 12 bp, Homo sapiens
gggggcgctcag

SEQ ID NO: 5431605 - DNA, 15 bp, Homo sapiens
gggggcggaggagga

SEQ ID NO: 5431606 - DNA, 15 bp, Homo sapiens
gggggcgtggctggc

SEQ ID NO: 5431607 - DNA, 17 bp, Homo sapiens
gggggctaactggcccc

SEQ ID NO: 5431608 - DNA, 18 bp, Homo sapiens
gggggctagggagacgcc

SEQ ID NO: 5431609 - DNA, 19 bp, Homo sapiens
gggggctcagcaaggccac

SEQ ID NO: 5431610 - DNA, 17 bp, Homo sapiens
gggggctccagggggtg

SEQ ID NO: 5431611 - DNA, 19 bp, Homo sapiens
gggggctcccgtggcctgt

SEQ ID NO: 5431612 - DNA, 13 bp, Homo sapiens
gggggctcctgcc

SEQ ID NO: 5431613 - DNA, 15 bp, Homo sapiens
gggggctcctgccca

SEQ ID NO: 5431614 - DNA, 22 bp, Homo sapiens
gggggctcctgcccaggccaca

SEQ ID NO: 5431615 - DNA, 12 bp, Homo sapiens
gggggctctgca

SEQ ID NO: 5431616 - DNA, 12 bp, Homo sapiens
gggggctgaaac

SEQ ID NO: 5431617 - DNA, 16 bp, Homo sapiens
gggggctgaggagcag

SEQ ID NO: 5431618 - DNA, 18 bp, Homo sapiens
gggggctgcacgggatgc

SEQ ID NO: 5431619 - DNA, 15 bp, Homo sapiens
gggggctgctgggcg

SEQ ID NO: 5431620 - DNA, 19 bp, Homo sapiens
gggggctggacctgctgac

SEQ ID NO: 5431621 - DNA, 12 bp, Homo sapiens
gggggctggcct

SEQ ID NO: 5431622 - DNA, 14 bp, Homo sapiens
gggggctggctctg

SEQ ID NO: 5431623 - DNA, 11 bp, Homo sapiens
gggggctggga

SEQ ID NO: 5431624 - DNA, 12 bp, Homo sapiens
gggggctggggt

SEQ ID NO: 5431625 - DNA, 13 bp, Homo sapiens
gggggctggtgcc

SEQ ID NO: 5431626 - DNA, 12 bp, Homo sapiens
gggggctgtgcc

SEQ ID NO: 5431627 - DNA, 22 bp, Homo sapiens
gggggctgtggccctgcccttg

SEQ ID NO: 5431628 - DNA, 22 bp, Homo sapiens
gggggcttcatacacatgagat

SEQ ID NO: 5431629 - DNA, 21 bp, Homo sapiens
gggggcttggggtagagagga

SEQ ID NO: 5431630 - DNA, 13 bp, Homo sapiens
gggggctttggcc

SEQ ID NO: 5431631 - DNA, 14 bp, Homo sapiens
gggggctttgggcc

SEQ ID NO: 5431632 - DNA, 10 bp, Homo sapiens
ggggggagag

SEQ ID NO: 5431633 - DNA, 11 bp, Homo sapiens
ggggggcaggc

SEQ ID NO: 5431634 - DNA, 15 bp, Homo sapiens
ggggggccaaaagga

SEQ ID NO: 5431635 - DNA, 14 bp, Homo sapiens
ggggggcgcctgga

SEQ ID NO: 5431636 - DNA, 16 bp, Homo sapiens
ggggggcggtgtcagg

SEQ ID NO: 5431637 - DNA, 13 bp, Homo sapiens
ggggggctctgcc

SEQ ID NO: 5431638 - DNA, 12 bp, Homo sapiens
ggggggctggga

SEQ ID NO: 5431639 - DNA, 23 bp, Homo sapiens
gggggtaaagcagttcctgtccc

SEQ ID NO: 5431640 - DNA, 17 bp, Homo sapiens
gggtccctgctcccctt

SEQ ID NO: 5431641 - DNA, 16 bp, Homo sapiens
gggtccctgctgtgtt

SEQ ID NO: 5431642 - DNA, 16 bp, Homo sapiens
gggtccgcaccagctg

SEQ ID NO: 5431643 - DNA, 17 bp, Homo sapiens
gggtccgcaccagctgc

SEQ ID NO: 5431644 - DNA, 22 bp, Homo sapiens
gggtccgcaccagctgctctgc

SEQ ID NO: 5431645 - DNA, 23 bp, Homo sapiens
gggtccgcaccagctgctctgcc

SEQ ID NO: 5431646 - DNA, 22 bp, Homo sapiens
gggtccggcctctccctgcctg

SEQ ID NO: 5431647 - DNA, 23 bp, Homo sapiens
gggtccggcctctccctgcctgt

SEQ ID NO: 5431648 - DNA, 18 bp, Homo sapiens
gggtccgtggtagaggcc

SEQ ID NO: 5431649 - DNA, 16 bp, Homo sapiens
gggtcctacggaggga

SEQ ID NO: 5431650 - DNA, 18 bp, Homo sapiens
gggtcctactcctggagc

SEQ ID NO: 5431651 - DNA, 16 bp, Homo sapiens
gggtcctagcccttcc

SEQ ID NO: 5431652 - DNA, 16 bp, Homo sapiens
gggtcctcaggcagtg

SEQ ID NO: 5431653 - DNA, 16 bp, Homo sapiens
gggtcctcctccaggg

SEQ ID NO: 5431654 - DNA, 18 bp, Homo sapiens
gggtcctcctcgctcctc

SEQ ID NO: 5431655 - DNA, 19 bp, Homo sapiens
gggtcctcctcgctcctcc

SEQ ID NO: 5431656 - DNA, 14 bp, Homo sapiens
gggtcctcctgtgc

SEQ ID NO: 5431657 - DNA, 23 bp, Homo sapiens
gggtcctcctttctgagggcccg

SEQ ID NO: 5431658 - DNA, 12 bp, Homo sapiens
gggtcctcggcc

SEQ ID NO: 5431659 - DNA, 13 bp, Homo sapiens
gggtcctcggccc

SEQ ID NO: 5431660 - DNA, 12 bp, Homo sapiens
gggtcctcgggc

SEQ ID NO: 5431661 - DNA, 18 bp, Homo sapiens
gggtcctctagcccactc

SEQ ID NO: 5431662 - DNA, 12 bp, Homo sapiens
gggtcctctctg

SEQ ID NO: 5431663 - DNA, 14 bp, Homo sapiens
gggtcctctctgag

SEQ ID NO: 5431664 - DNA, 14 bp, Homo sapiens
gggtcctctcttcc

SEQ ID NO: 5431665 - DNA, 23 bp, Homo sapiens
gggtcctctcttccacagtggcg

SEQ ID NO: 5431666 - DNA, 20 bp, Homo sapiens
gggtcctctgcttcctgagc

SEQ ID NO: 5431667 - DNA, 23 bp, Homo sapiens
gggtcctgcagcctgcaggacct

SEQ ID NO: 5431668 - DNA, 13 bp, Homo sapiens
gggtcctgcaggg

SEQ ID NO: 5431669 - DNA, 13 bp, Homo sapiens
gggtcctgccagc

SEQ ID NO: 5431670 - DNA, 15 bp, Homo sapiens
gggtcctgccagctg

SEQ ID NO: 5431671 - DNA, 15 bp, Homo sapiens
gggtcctgcctgcag

SEQ ID NO: 5431672 - DNA, 18 bp, Homo sapiens
gggtcctggctcctgagg

SEQ ID NO: 5431673 - DNA, 10 bp, Homo sapiens
gggtcctggg

SEQ ID NO: 5431674 - DNA, 22 bp, Homo sapiens
gggtcctgggaggctgcagcca

SEQ ID NO: 5431675 - DNA, 23 bp, Homo sapiens
gggtcctgggcaggtgggagctg

SEQ ID NO: 5431676 - DNA, 14 bp, Homo sapiens
gggtcctgggctgg

SEQ ID NO: 5431677 - DNA, 16 bp, Homo sapiens
gggtcgaaagctctag

SEQ ID NO: 5431678 - DNA, 21 bp, Homo sapiens
gggtcgcctatttttaaaaag

SEQ ID NO: 5431679 - DNA, 15 bp, Homo sapiens
gggtcgcctgccctg

SEQ ID NO: 5431680 - DNA, 12 bp, Homo sapiens
gggtcggaggtg

SEQ ID NO: 5431681 - DNA, 13 bp, Homo sapiens
gggtcggctcctg

SEQ ID NO: 5431682 - DNA, 18 bp, Homo sapiens
gggtcgggagaggggacg

SEQ ID NO: 5431683 - DNA, 18 bp, Homo sapiens
gggtcgtggagagctagg

SEQ ID NO: 5431684 - DNA, 16 bp, Homo sapiens
gggtctaaagagaaca

SEQ ID NO: 5431685 - DNA, 21 bp, Homo sapiens
gggtctagaggctattcctag

SEQ ID NO: 5431686 - DNA, 20 bp, Homo sapiens
gggtctagccgctgccctgg

SEQ ID NO: 5431687 - DNA, 15 bp, Homo sapiens
gggtctatacattcc

SEQ ID NO: 5431688 - DNA, 19 bp, Homo sapiens
gggtctatacattcctgag

SEQ ID NO: 5431689 - DNA, 17 bp, Homo sapiens
gggtctattccagctca

SEQ ID NO: 5431690 - DNA, 19 bp, Homo sapiens
gggtctcactctctgggga

SEQ ID NO: 5431691 - DNA, 14 bp, Homo sapiens
gggtctcactctgt

SEQ ID NO: 5431692 - DNA, 13 bp, Homo sapiens
gggtctcactgtg

SEQ ID NO: 5431693 - DNA, 11 bp, Homo sapiens
gggtctcagca

SEQ ID NO: 5431694 - DNA, 15 bp, Homo sapiens
gggtctcaggtccag

SEQ ID NO: 5431695 - DNA, 15 bp, Homo sapiens
gggtctcagtgtcct

SEQ ID NO: 5431696 - DNA, 19 bp, Homo sapiens
gggtctccaggaggagact

SEQ ID NO: 5431697 - DNA, 22 bp, Homo sapiens
gggtctccctatgttgcccagg

SEQ ID NO: 5431698 - DNA, 15 bp, Homo sapiens
gggtctccctctcct

SEQ ID NO: 5431699 - DNA, 16 bp, Homo sapiens
gggtctccctctcctg

SEQ ID NO: 5431700 - DNA, 11 bp, Homo sapiens
gggtctccctg

SEQ ID NO: 5431701 - DNA, 18 bp, Homo sapiens
gggtctccctgagcctgc

SEQ ID NO: 5431702 - DNA, 15 bp, Homo sapiens
gggtctccctggagt

SEQ ID NO: 5431703 - DNA, 13 bp, Homo sapiens
gggtctccctggc

SEQ ID NO: 5431704 - DNA, 21 bp, Homo sapiens
gggtctccctggctccctcct

SEQ ID NO: 5431705 - DNA, 17 bp, Homo sapiens
gggtctcctcaggacca

SEQ ID NO: 5431706 - DNA, 12 bp, Homo sapiens
gggtctcctccc

SEQ ID NO: 5431707 - DNA, 18 bp, Homo sapiens
gggtctcctcccagcggc

SEQ ID NO: 5431708 - DNA, 19 bp, Homo sapiens
gggtctcctggaccttgac

SEQ ID NO: 5431709 - DNA, 13 bp, Homo sapiens
gggtctccttggc

SEQ ID NO: 5431710 - DNA, 14 bp, Homo sapiens
gggtctcgcagcct

SEQ ID NO: 5431711 - DNA, 22 bp, Homo sapiens
gggtctctcacagacaggaccc

SEQ ID NO: 5431712 - DNA, 21 bp, Homo sapiens
gggtctctcactgttgcagtg

SEQ ID NO: 5431713 - DNA, 15 bp, Homo sapiens
gggtctctctcggcc

SEQ ID NO: 5431714 - DNA, 14 bp, Homo sapiens
gggtctctgagcag

SEQ ID NO: 5431715 - DNA, 15 bp, Homo sapiens
gggtctctgagcagt

SEQ ID NO: 5431716 - DNA, 12 bp, Homo sapiens
gggtctctggaa

SEQ ID NO: 5431717 - DNA, 14 bp, Homo sapiens
gggtctctggggac

SEQ ID NO: 5431718 - DNA, 14 bp, Homo sapiens
gggtctcttccttc

SEQ ID NO: 5431719 - DNA, 17 bp, Homo sapiens
gggtctgaaaggggtgt

SEQ ID NO: 5431720 - DNA, 13 bp, Homo sapiens
gggtctgacctgg

SEQ ID NO: 5431721 - DNA, 14 bp, Homo sapiens
gggtctgagctgga

SEQ ID NO: 5431722 - DNA, 21 bp, Homo sapiens
gggtctgaggaatccagaccc

SEQ ID NO: 5431723 - DNA, 16 bp, Homo sapiens
gggtctgaggcccctg

SEQ ID NO: 5431724 - DNA, 17 bp, Homo sapiens
gggtctgaggcccctgc

SEQ ID NO: 5431725 - DNA, 19 bp, Homo sapiens
gggtctgaggcccctgcct

SEQ ID NO: 5431726 - DNA, 20 bp, Homo sapiens
gggtctgaggcccctgcctc

SEQ ID NO: 5431727 - DNA, 21 bp, Homo sapiens
gggtctgaggcccctgcctcc

SEQ ID NO: 5431728 - DNA, 18 bp, Homo sapiens
gggtctgagtctatgttc

SEQ ID NO: 5431729 - DNA, 17 bp, Homo sapiens
gggtctgccctgcccat

SEQ ID NO: 5431730 - DNA, 12 bp, Homo sapiens
gggtctgcctcc

SEQ ID NO: 5431731 - DNA, 16 bp, Homo sapiens
gggtctgctctgtgcc

SEQ ID NO: 5431732 - DNA, 18 bp, Homo sapiens
gggtctggactaaccctg

SEQ ID NO: 5431733 - DNA, 22 bp, Homo sapiens
gggtctggagttgatctggaac

SEQ ID NO: 5431734 - DNA, 17 bp, Homo sapiens
gggtctggatgggagga

SEQ ID NO: 5431735 - DNA, 15 bp, Homo sapiens
gggtctggcagagcc

SEQ ID NO: 5431736 - DNA, 19 bp, Homo sapiens
gggtctggctagagggccc

SEQ ID NO: 5431737 - DNA, 12 bp, Homo sapiens
gggtctggctgg

SEQ ID NO: 5431738 - DNA, 18 bp, Homo sapiens
gggtctggctggtgttaa

SEQ ID NO: 5431739 - DNA, 15 bp, Homo sapiens
gggtctgggaggcag

SEQ ID NO: 5431740 - DNA, 13 bp, Homo sapiens
gggtctgggaggg

SEQ ID NO: 5431741 - DNA, 23 bp, Homo sapiens
gggtctgggcagcacctctggtc

SEQ ID NO: 5431742 - DNA, 15 bp, Homo sapiens
gggtctgggcagtgc

SEQ ID NO: 5431743 - DNA, 20 bp, Homo sapiens
gggtctgggcagtgccacag

SEQ ID NO: 5431744 - DNA, 16 bp, Homo sapiens
gggtctggggacaggc

SEQ ID NO: 5431745 - DNA, 19 bp, Homo sapiens
gggtctggggacaggcccg

SEQ ID NO: 5431746 - DNA, 14 bp, Homo sapiens
gggtctggggaggg

SEQ ID NO: 5431747 - DNA, 21 bp, Homo sapiens
gggtctgggggcacaagactg

SEQ ID NO: 5431748 - DNA, 15 bp, Homo sapiens
gggtctgggggcagc

SEQ ID NO: 5431749 - DNA, 16 bp, Homo sapiens
gggtctgggggcagct

SEQ ID NO: 5431750 - DNA, 14 bp, Homo sapiens
gggtctggtgccaa

SEQ ID NO: 5431751 - DNA, 17 bp, Homo sapiens
gggtctgtaaaatcttt

SEQ ID NO: 5431752 - DNA, 20 bp, Homo sapiens
gggtctgtaggttgcacact

SEQ ID NO: 5431753 - DNA, 21 bp, Homo sapiens
gggtctgtaggttgcacactt

SEQ ID NO: 5431754 - DNA, 17 bp, Homo sapiens
gggtctgtgactggatc

SEQ ID NO: 5431755 - DNA, 19 bp, Homo sapiens
gggtctgtgactggatctt

SEQ ID NO: 5431756 - DNA, 20 bp, Homo sapiens
gggtctgtgctgtgcctgct

SEQ ID NO: 5431757 - DNA, 19 bp, Homo sapiens
gggtctgtgggactggccc

SEQ ID NO: 5431758 - DNA, 17 bp, Homo sapiens
gggtctgtgtgaatgtg

SEQ ID NO: 5431759 - DNA, 20 bp, Homo sapiens
gggtcttcagcattccctcc

SEQ ID NO: 5431760 - DNA, 21 bp, Homo sapiens
gggtcttcagcattccctccc

SEQ ID NO: 5431761 - DNA, 12 bp, Homo sapiens
gggtcttcagct

SEQ ID NO: 5431762 - DNA, 17 bp, Homo sapiens
gggtcttcctgcagtgc

SEQ ID NO: 5431763 - DNA, 20 bp, Homo sapiens
gggtcttcttttactggact

SEQ ID NO: 5431764 - DNA, 19 bp, Homo sapiens
gggtcttgaggggaagctg

SEQ ID NO: 5431765 - DNA, 18 bp, Homo sapiens
gggtcttgcaaaattcct

SEQ ID NO: 5431766 - DNA, 20 bp, Homo sapiens
gggtcttgccatgtgctggg

SEQ ID NO: 5431767 - DNA, 22 bp, Homo sapiens
gggtcttgctctgtcacccaga

SEQ ID NO: 5431768 - DNA, 20 bp, Homo sapiens
gggtcttgctctgtccccca

SEQ ID NO: 5431769 - DNA, 16 bp, Homo sapiens
gggtcttgctctgtct

SEQ ID NO: 5431770 - DNA, 23 bp, Homo sapiens
gggtcttgctttctttgacctct

SEQ ID NO: 5431771 - DNA, 14 bp, Homo sapiens
gggtctttcttggg

SEQ ID NO: 5431772 - DNA, 17 bp, Homo sapiens
gggtcttttaccctgtg

SEQ ID NO: 5431773 - DNA, 17 bp, Homo sapiens
gggtctttttctcttct

SEQ ID NO: 5431774 - DNA, 18 bp, Homo sapiens
gggtgaaaagtatggcag

SEQ ID NO: 5431775 - DNA, 15 bp, Homo sapiens
gggtgaaaggcaggg

SEQ ID NO: 5431776 - DNA, 20 bp, Homo sapiens
gggtgaacaaagcagccacg

SEQ ID NO: 5431777 - DNA, 14 bp, Homo sapiens
gggtgaacagctgg

SEQ ID NO: 5431778 - DNA, 16 bp, Homo sapiens
gggtgaactgcaaagc

SEQ ID NO: 5431779 - DNA, 14 bp, Homo sapiens
gggtgaagctgggg

SEQ ID NO: 5431780 - DNA, 14 bp, Homo sapiens
gggtgaaggcagga

SEQ ID NO: 5431781 - DNA, 14 bp, Homo sapiens
gggtgaaggcctgg

SEQ ID NO: 5431782 - DNA, 12 bp, Homo sapiens
gggtgaaggctg

SEQ ID NO: 5431783 - DNA, 15 bp, Homo sapiens
gggtgaagtgcctgc

SEQ ID NO: 5431784 - DNA, 17 bp, Homo sapiens
gggtgacagctccggga

SEQ ID NO: 5431785 - DNA, 19 bp, Homo sapiens
gggtgacagtcctccatcc

SEQ ID NO: 5431786 - DNA, 14 bp, Homo sapiens
gggtgaccaggtcc

SEQ ID NO: 5431787 - DNA, 17 bp, Homo sapiens
gggtgacccacagctct

SEQ ID NO: 5431788 - DNA, 21 bp, Homo sapiens
gggtgacccacagctctgggc

SEQ ID NO: 5431789 - DNA, 14 bp, Homo sapiens
gggtgacgcccagc

SEQ ID NO: 5431790 - DNA, 17 bp, Homo sapiens
gggtgacgcccagctcc

SEQ ID NO: 5431791 - DNA, 14 bp, Homo sapiens
gggtgacgcctgag

SEQ ID NO: 5431792 - DNA, 13 bp, Homo sapiens
gggtgacggccct

SEQ ID NO: 5431793 - DNA, 19 bp, Homo sapiens
gggtgacttccctggtcac

SEQ ID NO: 5431794 - DNA, 23 bp, Homo sapiens
gggtgactttgtctctcctggct

SEQ ID NO: 5431795 - DNA, 18 bp, Homo sapiens
gggtgagaacgtgcccag

SEQ ID NO: 5431796 - DNA, 19 bp, Homo sapiens
gggtgagaacgtgcccagc

SEQ ID NO: 5431797 - DNA, 19 bp, Homo sapiens
gggtgagaatcctgcctct

SEQ ID NO: 5431798 - DNA, 12 bp, Homo sapiens
gggtgagagagg

SEQ ID NO: 5431799 - DNA, 16 bp, Homo sapiens
gggtgagagcacccac

SEQ ID NO: 5431800 - DNA, 14 bp, Homo sapiens
gggtgagaggcagg

SEQ ID NO: 5431801 - DNA, 15 bp, Homo sapiens
gggtgagaggcagga

SEQ ID NO: 5431802 - DNA, 17 bp, Homo sapiens
gggtgagaggcaggaat

SEQ ID NO: 5431803 - DNA, 18 bp, Homo sapiens
gggtgagaggcaggaatg

SEQ ID NO: 5431804 - DNA, 18 bp, Homo sapiens
gggtgagatgctggagaa

SEQ ID NO: 5431805 - DNA, 23 bp, Homo sapiens
gggtgagcagggtcaagcctctt

SEQ ID NO: 5431806 - DNA, 11 bp, Homo sapiens
gggtgagccag

SEQ ID NO: 5431807 - DNA, 18 bp, Homo sapiens
gggtgagctctcaggccg

SEQ ID NO: 5431808 - DNA, 21 bp, Homo sapiens
gggtgagctctcaggccgaga

SEQ ID NO: 5431809 - DNA, 15 bp, Homo sapiens
gggtgaggaccactc

SEQ ID NO: 5431810 - DNA, 12 bp, Homo sapiens
gggtgaggagga

SEQ ID NO: 5431811 - DNA, 21 bp, Homo sapiens
gggtgagggagttagggagag

SEQ ID NO: 5431812 - DNA, 21 bp, Homo sapiens
gggtgagggccttcttaagat

SEQ ID NO: 5431813 - DNA, 13 bp, Homo sapiens
gggtgagtggctg

SEQ ID NO: 5431814 - DNA, 14 bp, Homo sapiens
gggtgatagaacaa

SEQ ID NO: 5431815 - DNA, 19 bp, Homo sapiens
gggtgatcagaaggctggg

SEQ ID NO: 5431816 - DNA, 16 bp, Homo sapiens
gggtgatgagacctgg

SEQ ID NO: 5431817 - DNA, 14 bp, Homo sapiens
gggtgatgagggca

SEQ ID NO: 5431818 - DNA, 17 bp, Homo sapiens
gggtgatgagggcagca

SEQ ID NO: 5431819 - DNA, 22 bp, Homo sapiens
gggtgatgcttttgctgctgct

SEQ ID NO: 5431820 - DNA, 13 bp, Homo sapiens
gggtgtcccagac

SEQ ID NO: 5431821 - DNA, 17 bp, Homo sapiens
gggtgtcccagaccccg

SEQ ID NO: 5431822 - DNA, 19 bp, Homo sapiens
gggtgtcccagtcccagcc

SEQ ID NO: 5431823 - DNA, 19 bp, Homo sapiens
gggtgtccccgctgctgtg

SEQ ID NO: 5431824 - DNA, 13 bp, Homo sapiens
gggtgtcccctgg

SEQ ID NO: 5431825 - DNA, 14 bp, Homo sapiens
gggtgtcccctggt

SEQ ID NO: 5431826 - DNA, 15 bp, Homo sapiens
gggtgtccgagaggc

SEQ ID NO: 5431827 - DNA, 17 bp, Homo sapiens
gggtgtccgagaggctg

SEQ ID NO: 5431828 - DNA, 22 bp, Homo sapiens
gggtgtccgccatccagggtct

SEQ ID NO: 5431829 - DNA, 13 bp, Homo sapiens
gggtgtctccctc

SEQ ID NO: 5431830 - DNA, 23 bp, Homo sapiens
gggtgtctccctcgggggctctt

SEQ ID NO: 5431831 - DNA, 13 bp, Homo sapiens
gggtgtctgcacc

SEQ ID NO: 5431832 - DNA, 21 bp, Homo sapiens
gggtgtcttgggcagagctgg

SEQ ID NO: 5431833 - DNA, 23 bp, Homo sapiens
gggtgtgactcgggagctgcaca

SEQ ID NO: 5431834 - DNA, 12 bp, Homo sapiens
gggtgtgagcag

SEQ ID NO: 5431835 - DNA, 14 bp, Homo sapiens
gggtgtgagcaggg

SEQ ID NO: 5431836 - DNA, 21 bp, Homo sapiens
gggtgtgcaatgtctgagtga

SEQ ID NO: 5431837 - DNA, 14 bp, Homo sapiens
gggtgtgcatgcca

SEQ ID NO: 5431838 - DNA, 13 bp, Homo sapiens
gggtgtgccaggc

SEQ ID NO: 5431839 - DNA, 13 bp, Homo sapiens
gggtgtgccctgg

SEQ ID NO: 5431840 - DNA, 15 bp, Homo sapiens
gggtgtgccctggct

SEQ ID NO: 5431841 - DNA, 13 bp, Homo sapiens
gggtgtgcccttg

SEQ ID NO: 5431842 - DNA, 12 bp, Homo sapiens
gggtgtggcagt

SEQ ID NO: 5431843 - DNA, 15 bp, Homo sapiens
gggtgtggccagcac

SEQ ID NO: 5431844 - DNA, 15 bp, Homo sapiens
gggtgtggcctcagc

SEQ ID NO: 5431845 - DNA, 14 bp, Homo sapiens
gggtgtgggaaagc

SEQ ID NO: 5431846 - DNA, 13 bp, Homo sapiens
gggtgtgggaggc

SEQ ID NO: 5431847 - DNA, 18 bp, Homo sapiens
gggtgtgggtcagggagg

SEQ ID NO: 5431848 - DNA, 15 bp, Homo sapiens
gggtgtggtggcctg

SEQ ID NO: 5431849 - DNA, 11 bp, Homo sapiens
gggtgtgtgcg

SEQ ID NO: 5431850 - DNA, 13 bp, Homo sapiens
gggtgtgtggccc

SEQ ID NO: 5431851 - DNA, 14 bp, Homo sapiens
gggtgtgtgtttgt

SEQ ID NO: 5431852 - DNA, 22 bp, Homo sapiens
gggtgtgtgtttgtgtgagaga

SEQ ID NO: 5431853 - DNA, 21 bp, Homo sapiens
gggtgtgtttggcttggcctt

SEQ ID NO: 5431854 - DNA, 14 bp, Homo sapiens
gggtgttctttcct

SEQ ID NO: 5431855 - DNA, 21 bp, Homo sapiens
gggtgttctttcctgccctgt

SEQ ID NO: 5431856 - DNA, 22 bp, Homo sapiens
gggtgttttgtggggctccccg

SEQ ID NO: 5431857 - DNA, 21 bp, Homo sapiens
gggttaaatattttgctaact

SEQ ID NO: 5431858 - DNA, 13 bp, Homo sapiens
gggttaacaaatg

SEQ ID NO: 5431859 - DNA, 19 bp, Homo sapiens
gggttaacagtaaatatac

SEQ ID NO: 5431860 - DNA, 22 bp, Homo sapiens
gggttaacccttcatcttcctg

SEQ ID NO: 5431861 - DNA, 16 bp, Homo sapiens
gggttaattcatttgg

SEQ ID NO: 5431862 - DNA, 12 bp, Homo sapiens
gggttacaaact

SEQ ID NO: 5431863 - DNA, 16 bp, Homo sapiens
gggttacaaactgcaa

SEQ ID NO: 5431864 - DNA, 13 bp, Homo sapiens
gggttacactgtt

SEQ ID NO: 5431865 - DNA, 22 bp, Homo sapiens
gggttacagtatgcttgctcta

SEQ ID NO: 5431866 - DNA, 18 bp, Homo sapiens
gggttagacaagcctgga

SEQ ID NO: 5431867 - DNA, 18 bp, Homo sapiens
gggttagactgccagctc

SEQ ID NO: 5431868 - DNA, 17 bp, Homo sapiens
gggttagaggagtctgt

SEQ ID NO: 5431869 - DNA, 18 bp, Homo sapiens
gggttaggaatctcttca

SEQ ID NO: 5431870 - DNA, 20 bp, Homo sapiens
gggttaggtggccgctcctc

SEQ ID NO: 5431871 - DNA, 21 bp, Homo sapiens
gggttaggtggccgctcctcc

SEQ ID NO: 5431872 - DNA, 13 bp, Homo sapiens
gggttataatcag

SEQ ID NO: 5431873 - DNA, 13 bp, Homo sapiens
gggttatctctgt

SEQ ID NO: 5431874 - DNA, 18 bp, Homo sapiens
gggttatgtatcagaaga

SEQ ID NO: 5431875 - DNA, 16 bp, Homo sapiens
gggttatttattgaca

SEQ ID NO: 5431876 - DNA, 20 bp, Homo sapiens
gggttcacctgggctgaggc

SEQ ID NO: 5431877 - DNA, 20 bp, Homo sapiens
gggttcacgtaatcctcctg

SEQ ID NO: 5431878 - DNA, 19 bp, Homo sapiens
gggttcactagagctggga

SEQ ID NO: 5431879 - DNA, 19 bp, Homo sapiens
gggttcagcccctcctctg

SEQ ID NO: 5431880 - DNA, 21 bp, Homo sapiens
gggttcagcccctcctctgcc

SEQ ID NO: 5431881 - DNA, 16 bp, Homo sapiens
gggttcagcctcctgt

SEQ ID NO: 5431882 - DNA, 13 bp, Homo sapiens
gggttcagcctgg

SEQ ID NO: 5431883 - DNA, 14 bp, Homo sapiens
gggttcagcctggc

SEQ ID NO: 5431884 - DNA, 15 bp, Homo sapiens
gggttcagcctggcc

SEQ ID NO: 5431885 - DNA, 13 bp, Homo sapiens
gggttcaggggac

SEQ ID NO: 5431886 - DNA, 18 bp, Homo sapiens
gggttcataggggcaggt

SEQ ID NO: 5431887 - DNA, 18 bp, Homo sapiens
gggttcatctagggacac

SEQ ID NO: 5431888 - DNA, 15 bp, Homo sapiens
gggttcatgatgcag

SEQ ID NO: 5431889 - DNA, 17 bp, Homo sapiens
gggttcattattggaat

SEQ ID NO: 5431890 - DNA, 19 bp, Homo sapiens
gggttcatttgtgatgaca

SEQ ID NO: 5431891 - DNA, 20 bp, Homo sapiens
gggttccagacagagtggat

SEQ ID NO: 5431892 - DNA, 23 bp, Homo sapiens
gggttccagacagagtggatctg

SEQ ID NO: 5431893 - DNA, 16 bp, Homo sapiens
gggttccaggctgtgt

SEQ ID NO: 5431894 - DNA, 19 bp, Homo sapiens
gggttcccactggctcctc

SEQ ID NO: 5431895 - DNA, 21 bp, Homo sapiens
gggttccctcctagctctccc

SEQ ID NO: 5431896 - DNA, 18 bp, Homo sapiens
gggttccctttccttcca

SEQ ID NO: 5431897 - DNA, 19 bp, Homo sapiens
gggttcctcccctccagct

SEQ ID NO: 5431898 - DNA, 19 bp, Homo sapiens
gggttcctctgtacagcaa

SEQ ID NO: 5431899 - DNA, 14 bp, Homo sapiens
gggttcctcttccc

SEQ ID NO: 5431900 - DNA, 16 bp, Homo sapiens
gggttcctgctgtggg

SEQ ID NO: 5431901 - DNA, 21 bp, Homo sapiens
gggttcgcaccattctcctgc

SEQ ID NO: 5431902 - DNA, 19 bp, Homo sapiens
gggttcggttgcagggctg

SEQ ID NO: 5431903 - DNA, 19 bp, Homo sapiens
gggttctagacgcccctcc

SEQ ID NO: 5431904 - DNA, 14 bp, Homo sapiens
gggttctatattta

SEQ ID NO: 5431905 - DNA, 22 bp, Homo sapiens
gggttctatatttactgtttat

SEQ ID NO: 5431906 - DNA, 14 bp, Homo sapiens
gggttctctacagg

SEQ ID NO: 5431907 - DNA, 14 bp, Homo sapiens
gggttctgactctg

SEQ ID NO: 5431908 - DNA, 19 bp, Homo sapiens
gggttctgccctgcctgag

SEQ ID NO: 5431909 - DNA, 13 bp, Homo sapiens
gggttctggcagg

SEQ ID NO: 5431910 - DNA, 18 bp, Homo sapiens
gggttctgggagttccct

SEQ ID NO: 5431911 - DNA, 11 bp, Homo sapiens
gggttctgtat

SEQ ID NO: 5431912 - DNA, 14 bp, Homo sapiens
gggttctttcttcc

SEQ ID NO: 5431913 - DNA, 17 bp, Homo sapiens
gggttctttcttcctct

SEQ ID NO: 5431914 - DNA, 15 bp, Homo sapiens
gggttctttggaagc

SEQ ID NO: 5431915 - DNA, 13 bp, Homo sapiens
gggttgaaagaca

SEQ ID NO: 5431916 - DNA, 21 bp, Homo sapiens
gggttgaagacggaaaacaat

SEQ ID NO: 5431917 - DNA, 22 bp, Homo sapiens
gggttgaaggcagtctgaaccc

SEQ ID NO: 5431918 - DNA, 19 bp, Homo sapiens
gggttgaatatagcctgcc

SEQ ID NO: 5431919 - DNA, 20 bp, Homo sapiens
gggttgaatatagcctgcct

SEQ ID NO: 5431920 - DNA, 21 bp, Homo sapiens
gggttgaatatagcctgcctc

SEQ ID NO: 5431921 - DNA, 23 bp, Homo sapiens
gggttgaatatagcctgcctcag

SEQ ID NO: 5431922 - DNA, 13 bp, Homo sapiens
gggttgagagcca

SEQ ID NO: 5431923 - DNA, 21 bp, Homo sapiens
gggttgagcagggatcctggt

SEQ ID NO: 5431924 - DNA, 19 bp, Homo sapiens
gggttgattaaggcagtac

SEQ ID NO: 5431925 - DNA, 19 bp, Homo sapiens
gggttgcagtggagaggga

SEQ ID NO: 5431926 - DNA, 20 bp, Homo sapiens
gggttgccagaggccctgga

SEQ ID NO: 5431927 - DNA, 22 bp, Homo sapiens
gggttgccagaggccctggagg

SEQ ID NO: 5431928 - DNA, 16 bp, Homo sapiens
gggttgccagtcctgc

SEQ ID NO: 5431929 - DNA, 23 bp, Homo sapiens
gggttgcgggggagctggaaata

SEQ ID NO: 5431930 - DNA, 16 bp, Homo sapiens
gggttgcgtctgaggc

SEQ ID NO: 5431931 - DNA, 14 bp, Homo sapiens
gggttgctggagcc

SEQ ID NO: 5431932 - DNA, 21 bp, Homo sapiens
gggttgctggtcctgcacatg

SEQ ID NO: 5431933 - DNA, 15 bp, Homo sapiens
gggttggcagcgcct

SEQ ID NO: 5431934 - DNA, 15 bp, Homo sapiens
gggttggccaggagg

SEQ ID NO: 5431935 - DNA, 16 bp, Homo sapiens
gggttggcccctgccc

SEQ ID NO: 5431936 - DNA, 22 bp, Homo sapiens
gggttggcgcaccctcccctcc

SEQ ID NO: 5431937 - DNA, 13 bp, Homo sapiens
gggttgggacagg

SEQ ID NO: 5431938 - DNA, 14 bp, Homo sapiens
gggttgggcccaga

SEQ ID NO: 5431939 - DNA, 14 bp, Homo sapiens
gggttgggggcact

SEQ ID NO: 5431940 - DNA, 14 bp, Homo sapiens
gggttggggtggga

SEQ ID NO: 5431941 - DNA, 18 bp, Homo sapiens
gggttggggtgggagggc

SEQ ID NO: 5431942 - DNA, 21 bp, Homo sapiens
gggttgggttcatctgagcaa

SEQ ID NO: 5431943 - DNA, 16 bp, Homo sapiens
gggttgggttccagac

SEQ ID NO: 5431944 - DNA, 12 bp, Homo sapiens
gggttggtaagg

SEQ ID NO: 5431945 - DNA, 16 bp, Homo sapiens
gggttggtatctcagg

SEQ ID NO: 5431946 - DNA, 15 bp, Homo sapiens
gggttggtgtgctga

SEQ ID NO: 5431947 - DNA, 18 bp, Homo sapiens
gggttgtactattgttta

SEQ ID NO: 5431948 - DNA, 21 bp, Homo sapiens
gggttgtcaagagagagtcaa

SEQ ID NO: 5431949 - DNA, 17 bp, Homo sapiens
gggttgtccccgctggc

SEQ ID NO: 5431950 - DNA, 13 bp, Homo sapiens
gggttgtgagccc

SEQ ID NO: 5431951 - DNA, 14 bp, Homo sapiens
gggttgtgaggcct

SEQ ID NO: 5431952 - DNA, 23 bp, Homo sapiens
gggttgtgaggcctggccaggca

SEQ ID NO: 5431953 - DNA, 17 bp, Homo sapiens
gggtttacaacaaacac

SEQ ID NO: 5431954 - DNA, 16 bp, Homo sapiens
gggtttatataaataa

SEQ ID NO: 5431955 - DNA, 15 bp, Homo sapiens
gggtttattcactga

SEQ ID NO: 5431956 - DNA, 20 bp, Homo sapiens
gggtttcacctgggccctgg

SEQ ID NO: 5431957 - DNA, 21 bp, Homo sapiens
gggtttcacctgggccctgga

SEQ ID NO: 5431958 - DNA, 20 bp, Homo sapiens
gggtttcactgtgttggcca

SEQ ID NO: 5431959 - DNA, 14 bp, Homo sapiens
gggtttcagggctg

SEQ ID NO: 5431960 - DNA, 15 bp, Homo sapiens
gggtttcagggctga

SEQ ID NO: 5431961 - DNA, 20 bp, Homo sapiens
gggtttcatcatgttggcca

SEQ ID NO: 5431962 - DNA, 17 bp, Homo sapiens
gggtttccacacaggcc

SEQ ID NO: 5431963 - DNA, 22 bp, Homo sapiens
gggtttcctctgccccctcctt

SEQ ID NO: 5431964 - DNA, 14 bp, Homo sapiens
gggtttcctgcagg

SEQ ID NO: 5431965 - DNA, 18 bp, Homo sapiens
gggtttcgactggtccag

SEQ ID NO: 5431966 - DNA, 20 bp, Homo sapiens
gggtttcgactggtccagct

SEQ ID NO: 5431967 - DNA, 20 bp, Homo sapiens
gggtttcgtcatgttggcca

SEQ ID NO: 5431968 - DNA, 17 bp, Homo sapiens
gggtttctaaagctgcc

SEQ ID NO: 5431969 - DNA, 14 bp, Homo sapiens
gggtttctctccca

SEQ ID NO: 5431970 - DNA, 22 bp, Homo sapiens
gggtttctgagctgctctgaat

SEQ ID NO: 5431971 - DNA, 19 bp, Homo sapiens
gggtttctgccctgcccac

SEQ ID NO: 5431972 - DNA, 17 bp, Homo sapiens
gggtttcttaaatatat

SEQ ID NO: 5431973 - DNA, 21 bp, Homo sapiens
gggtttgagagagcagccagg

SEQ ID NO: 5431974 - DNA, 21 bp, Homo sapiens
gggtttgagtcaaaagcctgg

SEQ ID NO: 5431975 - DNA, 22 bp, Homo sapiens
gggtttgccaagccctttgctg

SEQ ID NO: 5431976 - DNA, 22 bp, Homo sapiens
gggtttgcccagtcctgggttg

SEQ ID NO: 5431977 - DNA, 19 bp, Homo sapiens
gggtttgcttttgttttgt

SEQ ID NO: 5431978 - DNA, 20 bp, Homo sapiens
gggtttggaccccagctggg

SEQ ID NO: 5431979 - DNA, 21 bp, Homo sapiens
gggtttggaccccagctggga

SEQ ID NO: 5431980 - DNA, 16 bp, Homo sapiens
gggtttggccagggag

SEQ ID NO: 5431981 - DNA, 18 bp, Homo sapiens
gggtttggccagggaggc

SEQ ID NO: 5431982 - DNA, 23 bp, Homo sapiens
gggtttggcccaagactgggctg

SEQ ID NO: 5431983 - DNA, 15 bp, Homo sapiens
gggtttggcccctgg

SEQ ID NO: 5431984 - DNA, 22 bp, Homo sapiens
gggtttggcgggccaaggactg

SEQ ID NO: 5431985 - DNA, 21 bp, Homo sapiens
gggtttggctgtgtctaaact

SEQ ID NO: 5431986 - DNA, 15 bp, Homo sapiens
gggtttgggagccag

SEQ ID NO: 5431987 - DNA, 15 bp, Homo sapiens
gggtttgggagtcag

SEQ ID NO: 5431988 - DNA, 22 bp, Homo sapiens
gggtttgtacatttttgggggg

SEQ ID NO: 5431989 - DNA, 17 bp, Homo sapiens
gggtttgtgacagggcg

SEQ ID NO: 5431990 - DNA, 19 bp, Homo sapiens
gggtttgtgtttgattggc

SEQ ID NO: 5431991 - DNA, 18 bp, Homo sapiens
gggttttaaacactaatc

SEQ ID NO: 5431992 - DNA, 17 bp, Homo sapiens
gggttttagaaattcta

SEQ ID NO: 5431993 - DNA, 23 bp, Homo sapiens
gggttttattttatttctgaatc

SEQ ID NO: 5431994 - DNA, 16 bp, Homo sapiens
gggttttcaatgtgaa

SEQ ID NO: 5431995 - DNA, 15 bp, Homo sapiens
gggttttcacttcct

SEQ ID NO: 5431996 - DNA, 20 bp, Homo sapiens
gggttttccaagccctcagc

SEQ ID NO: 5431997 - DNA, 23 bp, Homo sapiens
gggttttctaactgtaaatcact

SEQ ID NO: 5431998 - DNA, 21 bp, Homo sapiens
ggtcagcatgtctattcagct

SEQ ID NO: 5431999 - DNA, 15 bp, Homo sapiens
ggtcagccagccctc

SEQ ID NO: 5432000 - DNA, 13 bp, Homo sapiens
ggtcagccagggc

SEQ ID NO: 5432001 - DNA, 15 bp, Homo sapiens
ggtcagccagggcca

SEQ ID NO: 5432002 - DNA, 11 bp, Homo sapiens
ggtcagccatt

SEQ ID NO: 5432003 - DNA, 18 bp, Homo sapiens
ggtcagcccaagattctt

SEQ ID NO: 5432004 - DNA, 15 bp, Homo sapiens
ggtcagcccagcacc

SEQ ID NO: 5432005 - DNA, 14 bp, Homo sapiens
ggtcagccccaagg

SEQ ID NO: 5432006 - DNA, 23 bp, Homo sapiens
ggtcagccttaccttggggctgg

SEQ ID NO: 5432007 - DNA, 15 bp, Homo sapiens
ggtcagcgactggat

SEQ ID NO: 5432008 - DNA, 15 bp, Homo sapiens
ggtcagcgattcctg

SEQ ID NO: 5432009 - DNA, 20 bp, Homo sapiens
ggtcagcggggcagcggggc

SEQ ID NO: 5432010 - DNA, 15 bp, Homo sapiens
ggtcagctctggcca

SEQ ID NO: 5432011 - DNA, 15 bp, Homo sapiens
ggtcagctgggagcc

SEQ ID NO: 5432012 - DNA, 17 bp, Homo sapiens
ggtcagctgggagccag

SEQ ID NO: 5432013 - DNA, 20 bp, Homo sapiens
ggtcaggaacagtggctggg

SEQ ID NO: 5432014 - DNA, 19 bp, Homo sapiens
ggtcaggaagcaggggtgg

SEQ ID NO: 5432015 - DNA, 18 bp, Homo sapiens
ggtcaggaccatcagaga

SEQ ID NO: 5432016 - DNA, 19 bp, Homo sapiens
ggtcaggacggctcctcag

SEQ ID NO: 5432017 - DNA, 22 bp, Homo sapiens
ggtcaggagaggggcagaacag

SEQ ID NO: 5432018 - DNA, 15 bp, Homo sapiens
ggtcaggaggcaggg

SEQ ID NO: 5432019 - DNA, 21 bp, Homo sapiens
ggtcaggagttagaggccagc

SEQ ID NO: 5432020 - DNA, 22 bp, Homo sapiens
ggtcaggagttcgagagcagcc

SEQ ID NO: 5432021 - DNA, 22 bp, Homo sapiens
ggtcaggagttcgaggcgagcc

SEQ ID NO: 5432022 - DNA, 18 bp, Homo sapiens
ggtcaggcccagcctctc

SEQ ID NO: 5432023 - DNA, 13 bp, Homo sapiens
ggtcaggccctgg

SEQ ID NO: 5432024 - DNA, 17 bp, Homo sapiens
ggtcaggccctggaact

SEQ ID NO: 5432025 - DNA, 21 bp, Homo sapiens
ggtcaggcggggtgctgtggt

SEQ ID NO: 5432026 - DNA, 17 bp, Homo sapiens
ggtcaggctgggcagcc

SEQ ID NO: 5432027 - DNA, 20 bp, Homo sapiens
ggtcaggctgggcagcccca

SEQ ID NO: 5432028 - DNA, 12 bp, Homo sapiens
ggtcaggctggt

SEQ ID NO: 5432029 - DNA, 18 bp, Homo sapiens
ggtcaggctggtctcaaa

SEQ ID NO: 5432030 - DNA, 21 bp, Homo sapiens
ggtcagggacttggacaggag

SEQ ID NO: 5432031 - DNA, 11 bp, Homo sapiens
ggtcagggagg

SEQ ID NO: 5432032 - DNA, 23 bp, Homo sapiens
ggtcagggagtgctggctcacag

SEQ ID NO: 5432033 - DNA, 15 bp, Homo sapiens
ggtcagggcagtggc

SEQ ID NO: 5432034 - DNA, 17 bp, Homo sapiens
ggtcagggcagtggcca

SEQ ID NO: 5432035 - DNA, 13 bp, Homo sapiens
ggtcagggccaga

SEQ ID NO: 5432036 - DNA, 20 bp, Homo sapiens
ggtcagggccagactggaag

SEQ ID NO: 5432037 - DNA, 22 bp, Homo sapiens
ggtcaggtgcctcccagccctg

SEQ ID NO: 5432038 - DNA, 16 bp, Homo sapiens
ggtcaggtgggaaagc

SEQ ID NO: 5432039 - DNA, 17 bp, Homo sapiens
ggtcaggtttaacattt

SEQ ID NO: 5432040 - DNA, 18 bp, Homo sapiens
ggtcaggtttaacatttg

SEQ ID NO: 5432041 - DNA, 16 bp, Homo sapiens
ggtcagtctggtggga

SEQ ID NO: 5432042 - DNA, 20 bp, Homo sapiens
ggtcagtgaagcccaggagg

SEQ ID NO: 5432043 - DNA, 15 bp, Homo sapiens
ggtcagtgctgcctg

SEQ ID NO: 5432044 - DNA, 14 bp, Homo sapiens
ggtcagtggctctt

SEQ ID NO: 5432045 - DNA, 17 bp, Homo sapiens
ggtcagtttatgaaaca

SEQ ID NO: 5432046 - DNA, 17 bp, Homo sapiens
ggtcagttttcacagag

SEQ ID NO: 5432047 - DNA, 11 bp, Homo sapiens
ggtcataaaat

SEQ ID NO: 5432048 - DNA, 12 bp, Homo sapiens
ggtcataaagca

SEQ ID NO: 5432049 - DNA, 23 bp, Homo sapiens
ggtcataaatcagaaagtttaga

SEQ ID NO: 5432050 - DNA, 14 bp, Homo sapiens
ggtcataagtgggg

SEQ ID NO: 5432051 - DNA, 16 bp, Homo sapiens
ggtcatagcagtgctt

SEQ ID NO: 5432052 - DNA, 23 bp, Homo sapiens
ggtcatatacatattgtatatat

SEQ ID NO: 5432053 - DNA, 21 bp, Homo sapiens
ggtcatatgtttattcaaaat

SEQ ID NO: 5432054 - DNA, 18 bp, Homo sapiens
ggtcatatttggtgatga

SEQ ID NO: 5432055 - DNA, 16 bp, Homo sapiens
ggtcatcaccaccctt

SEQ ID NO: 5432056 - DNA, 22 bp, Homo sapiens
ggtcatccagactcagagctct

SEQ ID NO: 5432057 - DNA, 16 bp, Homo sapiens
ggtcatcccggggcca

SEQ ID NO: 5432058 - DNA, 18 bp, Homo sapiens
ggtcatcccttcctcctc

SEQ ID NO: 5432059 - DNA, 12 bp, Homo sapiens
ggtcatccttgc

SEQ ID NO: 5432060 - DNA, 21 bp, Homo sapiens
ggtcatcgattcaaactgctc

SEQ ID NO: 5432061 - DNA, 22 bp, Homo sapiens
ggtcatcgattcaaactgctcc

SEQ ID NO: 5432062 - DNA, 21 bp, Homo sapiens
ggtcatctgaccttcaccttg

SEQ ID NO: 5432063 - DNA, 23 bp, Homo sapiens
ggtcatcttggaaaggggaggag

SEQ ID NO: 5432064 - DNA, 15 bp, Homo sapiens
ggtcatgaagggctg

SEQ ID NO: 5432065 - DNA, 20 bp, Homo sapiens
ggtcatgatgctctttccca

SEQ ID NO: 5432066 - DNA, 15 bp, Homo sapiens
ggtcatgccctcctc

SEQ ID NO: 5432067 - DNA, 20 bp, Homo sapiens
ggtcatgccctcctctccca

SEQ ID NO: 5432068 - DNA, 15 bp, Homo sapiens
ggtcatgctcagcct

SEQ ID NO: 5432069 - DNA, 15 bp, Homo sapiens
ggtcatggccacact

SEQ ID NO: 5432070 - DNA, 17 bp, Homo sapiens
ggtcatggccacactgt

SEQ ID NO: 5432071 - DNA, 17 bp, Homo sapiens
ggtcatgtgagtctggg

SEQ ID NO: 5432072 - DNA, 20 bp, Homo sapiens
ggtcatgtgagtctgggata

SEQ ID NO: 5432073 - DNA, 13 bp, Homo sapiens
ggtcatgtgtgca

SEQ ID NO: 5432074 - DNA, 14 bp, Homo sapiens
ggtcatgtgtgcat

SEQ ID NO: 5432075 - DNA, 19 bp, Homo sapiens
ggtcatgtttgcaggggtg

SEQ ID NO: 5432076 - DNA, 15 bp, Homo sapiens
ggtcattaaatacta

SEQ ID NO: 5432077 - DNA, 20 bp, Homo sapiens
ggtcattaaggccacatcca

SEQ ID NO: 5432078 - DNA, 16 bp, Homo sapiens
ggtcattgacctctca

SEQ ID NO: 5432079 - DNA, 17 bp, Homo sapiens
ggtcattgacctctcag

SEQ ID NO: 5432080 - DNA, 22 bp, Homo sapiens
ggtcattgacctctcagggcct

SEQ ID NO: 5432081 - DNA, 23 bp, Homo sapiens
ggtcattgacctctcagggcctg

SEQ ID NO: 5432082 - DNA, 22 bp, Homo sapiens
ggtcattgagggaccaaaaaag

SEQ ID NO: 5432083 - DNA, 17 bp, Homo sapiens
ggtcattggtctccgag

SEQ ID NO: 5432084 - DNA, 20 bp, Homo sapiens
ggtcatttccatgtatgcat

SEQ ID NO: 5432085 - DNA, 16 bp, Homo sapiens
ggtcatttgaatgaga

SEQ ID NO: 5432086 - DNA, 20 bp, Homo sapiens
ggtcattttgactggcttgc

SEQ ID NO: 5432087 - DNA, 22 bp, Homo sapiens
ggtcattttttaaatccagccc

SEQ ID NO: 5432088 - DNA, 18 bp, Homo sapiens
ggtccaaaaaaaggaaaa

SEQ ID NO: 5432089 - DNA, 21 bp, Homo sapiens
ggtccaaaaaaaggaaaaata

SEQ ID NO: 5432090 - DNA, 22 bp, Homo sapiens
ggtccaaaataaaacctcagct

SEQ ID NO: 5432091 - DNA, 20 bp, Homo sapiens
ggtccaaccagacctggaag

SEQ ID NO: 5432092 - DNA, 17 bp, Homo sapiens
ggtccaacgccgccttg

SEQ ID NO: 5432093 - DNA, 13 bp, Homo sapiens
ggtccaagagaca

SEQ ID NO: 5432094 - DNA, 14 bp, Homo sapiens
ggtccaagggccat

SEQ ID NO: 5432095 - DNA, 18 bp, Homo sapiens
ggtccaaggtcaaggcac

SEQ ID NO: 5432096 - DNA, 13 bp, Homo sapiens
ggtccaagtggct

SEQ ID NO: 5432097 - DNA, 15 bp, Homo sapiens
ggtccaatccagcct

SEQ ID NO: 5432098 - DNA, 18 bp, Homo sapiens
ggtccaatcctaggacag

SEQ ID NO: 5432099 - DNA, 17 bp, Homo sapiens
ggtccaatgagctttct

SEQ ID NO: 5432100 - DNA, 18 bp, Homo sapiens
ggtccaatgagctttctg

SEQ ID NO: 5432101 - DNA, 19 bp, Homo sapiens
ggtccaatgagctttctga

SEQ ID NO: 5432102 - DNA, 17 bp, Homo sapiens
ggtccaatgttgttcac

SEQ ID NO: 5432103 - DNA, 18 bp, Homo sapiens
ggtccaattagtttcctt

SEQ ID NO: 5432104 - DNA, 20 bp, Homo sapiens
ggtccaattctcgagcttgg

SEQ ID NO: 5432105 - DNA, 23 bp, Homo sapiens
ggtccacaagcttctgtcctgcc

SEQ ID NO: 5432106 - DNA, 19 bp, Homo sapiens
ggtccacacaccacagaag

SEQ ID NO: 5432107 - DNA, 23 bp, Homo sapiens
ggtccacacccaattccactctg

SEQ ID NO: 5432108 - DNA, 12 bp, Homo sapiens
ggtccacagctg

SEQ ID NO: 5432109 - DNA, 17 bp, Homo sapiens
ggtccacagctggaaag

SEQ ID NO: 5432110 - DNA, 20 bp, Homo sapiens
ggtccacaggaagtgaagaa

SEQ ID NO: 5432111 - DNA, 14 bp, Homo sapiens
ggtccacaggtcca

SEQ ID NO: 5432112 - DNA, 19 bp, Homo sapiens
ggtccacaggtccaaggac

SEQ ID NO: 5432113 - DNA, 21 bp, Homo sapiens
ggtccaccagtgtgtggggga

SEQ ID NO: 5432114 - DNA, 13 bp, Homo sapiens
ggtccacccagga

SEQ ID NO: 5432115 - DNA, 15 bp, Homo sapiens
ggtccacccaggagc

SEQ ID NO: 5432116 - DNA, 22 bp, Homo sapiens
ggtccacccaggagccccgagg

SEQ ID NO: 5432117 - DNA, 14 bp, Homo sapiens
ggtccaccccatgt

SEQ ID NO: 5432118 - DNA, 22 bp, Homo sapiens
ggtccaccccgtcccggccccg

SEQ ID NO: 5432119 - DNA, 23 bp, Homo sapiens
ggtccaccccgttgttgtccctg

SEQ ID NO: 5432120 - DNA, 19 bp, Homo sapiens
ggtccaccggcccctggca

SEQ ID NO: 5432121 - DNA, 14 bp, Homo sapiens
ggtccacctggaga

SEQ ID NO: 5432122 - DNA, 15 bp, Homo sapiens
ggtccacctggagag

SEQ ID NO: 5432123 - DNA, 13 bp, Homo sapiens
ggtccactcttgt

SEQ ID NO: 5432124 - DNA, 12 bp, Homo sapiens
ggtccactgtgt

SEQ ID NO: 5432125 - DNA, 19 bp, Homo sapiens
ggtccacttgccagggctc

SEQ ID NO: 5432126 - DNA, 20 bp, Homo sapiens
ggtccacttttccagtattt

SEQ ID NO: 5432127 - DNA, 21 bp, Homo sapiens
ggtccagaaactcctgtttct

SEQ ID NO: 5432128 - DNA, 14 bp, Homo sapiens
ggtccagaagagaa

SEQ ID NO: 5432129 - DNA, 21 bp, Homo sapiens
ggtccagaaggagacaggcag

SEQ ID NO: 5432130 - DNA, 18 bp, Homo sapiens
ggtccagagaccacacca

SEQ ID NO: 5432131 - DNA, 12 bp, Homo sapiens
ggtccagagtca

SEQ ID NO: 5432132 - DNA, 18 bp, Homo sapiens
ggtccagattgaaaagtg

SEQ ID NO: 5432133 - DNA, 19 bp, Homo sapiens
ggtccagccctccgccagc

SEQ ID NO: 5432134 - DNA, 21 bp, Homo sapiens
ggtccagccctggctgaagga

SEQ ID NO: 5432135 - DNA, 23 bp, Homo sapiens
ggtccagcgtcactccagtgctc

SEQ ID NO: 5432136 - DNA, 15 bp, Homo sapiens
ggtccagctctgaca

SEQ ID NO: 5432137 - DNA, 22 bp, Homo sapiens
ggtccagctctgacatcccttc

SEQ ID NO: 5432138 - DNA, 13 bp, Homo sapiens
ggtccagctctgg

SEQ ID NO: 5432139 - DNA, 14 bp, Homo sapiens
ggtccagctctgga

SEQ ID NO: 5432140 - DNA, 22 bp, Homo sapiens
ggtccagctctggaggggaggg

SEQ ID NO: 5432141 - DNA, 12 bp, Homo sapiens
ggtccagctctt

SEQ ID NO: 5432142 - DNA, 14 bp, Homo sapiens
ggtccagctcttgg

SEQ ID NO: 5432143 - DNA, 21 bp, Homo sapiens
ggtccagctcttggcccctgt

SEQ ID NO: 5432144 - DNA, 20 bp, Homo sapiens
ggtccagctggcctggacag

SEQ ID NO: 5432145 - DNA, 17 bp, Homo sapiens
ggtccagcttgctcttc

SEQ ID NO: 5432146 - DNA, 24 bp, Homo sapiens
ggtccagctttactgtggctgtct

SEQ ID NO: 5432147 - DNA, 14 bp, Homo sapiens
ggtccaggaaggca

SEQ ID NO: 5432148 - DNA, 16 bp, Homo sapiens
ggtccaggaaggcagc

SEQ ID NO: 5432149 - DNA, 22 bp, Homo sapiens
ggtccaggaaggcagctgctct

SEQ ID NO: 5432150 - DNA, 12 bp, Homo sapiens
ggtccaggagat

SEQ ID NO: 5432151 - DNA, 15 bp, Homo sapiens
ggtccaggcaggagg

SEQ ID NO: 5432152 - DNA, 15 bp, Homo sapiens
ggtccaggccaggcc

SEQ ID NO: 5432153 - DNA, 23 bp, Homo sapiens
ggtccaggccaggcctcatcctc

SEQ ID NO: 5432154 - DNA, 22 bp, Homo sapiens
ggtccaggccagtgggcctggt

SEQ ID NO: 5432155 - DNA, 18 bp, Homo sapiens
ggtccaggcccccaaccc

SEQ ID NO: 5432156 - DNA, 12 bp, Homo sapiens
ggtccaggcccg

SEQ ID NO: 5432157 - DNA, 20 bp, Homo sapiens
ggtccaggcctactcctgtc

SEQ ID NO: 5432158 - DNA, 21 bp, Homo sapiens
ggtccagggaagctggccgag

SEQ ID NO: 5432159 - DNA, 11 bp, Homo sapiens
ggtccagggag

SEQ ID NO: 5432160 - DNA, 12 bp, Homo sapiens
ggtccagggagc

SEQ ID NO: 5432161 - DNA, 14 bp, Homo sapiens
ggtccagggcctga

SEQ ID NO: 5432162 - DNA, 15 bp, Homo sapiens
ggtccagggcctgac

SEQ ID NO: 5432163 - DNA, 16 bp, Homo sapiens
ggtccagggcctgaca

SEQ ID NO: 5432164 - DNA, 18 bp, Homo sapiens
ggtccagggctgttggag

SEQ ID NO: 5432165 - DNA, 21 bp, Homo sapiens
ggtccagggttgatcacactc

SEQ ID NO: 5432166 - DNA, 18 bp, Homo sapiens
ggtccaggtcaccagcct

SEQ ID NO: 5432167 - DNA, 17 bp, Homo sapiens
ggtccagtcgggaggag

SEQ ID NO: 5432168 - DNA, 11 bp, Homo sapiens
ggtccagtctg

SEQ ID NO: 5432169 - DNA, 23 bp, Homo sapiens
ggtccagtgcattttgtttctgt

SEQ ID NO: 5432170 - DNA, 13 bp, Homo sapiens
ggtccatatttac

SEQ ID NO: 5432171 - DNA, 23 bp, Homo sapiens
ggtccatccccttcccccatccc

SEQ ID NO: 5432172 - DNA, 14 bp, Homo sapiens
ggtccatcctggtc

SEQ ID NO: 5432173 - DNA, 15 bp, Homo sapiens
ggtccatctctgaaa

SEQ ID NO: 5432174 - DNA, 16 bp, Homo sapiens
ggtccatgcccactgc

SEQ ID NO: 5432175 - DNA, 20 bp, Homo sapiens
ggtctcgatgctgctggcct

SEQ ID NO: 5432176 - DNA, 14 bp, Homo sapiens
ggtctcgcagcctg

SEQ ID NO: 5432177 - DNA, 16 bp, Homo sapiens
ggtctcgcagcctgaa

SEQ ID NO: 5432178 - DNA, 20 bp, Homo sapiens
ggtctcgctttgttgcccag

SEQ ID NO: 5432179 - DNA, 19 bp, Homo sapiens
ggtctcggatcaggctccc

SEQ ID NO: 5432180 - DNA, 20 bp, Homo sapiens
ggtctcggatgacaccctgg

SEQ ID NO: 5432181 - DNA, 20 bp, Homo sapiens
ggtctcgggggtccggaagg

SEQ ID NO: 5432182 - DNA, 21 bp, Homo sapiens
ggtctcgtgttcgctggctga

SEQ ID NO: 5432183 - DNA, 21 bp, Homo sapiens
ggtctcgttttgttgccaaag

SEQ ID NO: 5432184 - DNA, 15 bp, Homo sapiens
ggtctctaggcctga

SEQ ID NO: 5432185 - DNA, 17 bp, Homo sapiens
ggtctctaggcctgaac

SEQ ID NO: 5432186 - DNA, 18 bp, Homo sapiens
ggtctctaggctggggaa

SEQ ID NO: 5432187 - DNA, 16 bp, Homo sapiens
ggtctctagtgctgtg

SEQ ID NO: 5432188 - DNA, 23 bp, Homo sapiens
ggtctctcacagacaggacccct

SEQ ID NO: 5432189 - DNA, 20 bp, Homo sapiens
ggtctctcatacctctggga

SEQ ID NO: 5432190 - DNA, 14 bp, Homo sapiens
ggtctctccactgc

SEQ ID NO: 5432191 - DNA, 17 bp, Homo sapiens
ggtctctcccagctctg

SEQ ID NO: 5432192 - DNA, 18 bp, Homo sapiens
ggtctctcccagctctgg

SEQ ID NO: 5432193 - DNA, 18 bp, Homo sapiens
ggtctctccttcctcttg

SEQ ID NO: 5432194 - DNA, 13 bp, Homo sapiens
ggtctctctccct

SEQ ID NO: 5432195 - DNA, 22 bp, Homo sapiens
ggtctctctccctacctccctc

SEQ ID NO: 5432196 - DNA, 22 bp, Homo sapiens
ggtctctctcggcccctgtctg

SEQ ID NO: 5432197 - DNA, 19 bp, Homo sapiens
ggtctctctctctctacaa

SEQ ID NO: 5432198 - DNA, 13 bp, Homo sapiens
ggtctctctggct

SEQ ID NO: 5432199 - DNA, 12 bp, Homo sapiens
ggtctctctttg

SEQ ID NO: 5432200 - DNA, 15 bp, Homo sapiens
ggtctctctttggac

SEQ ID NO: 5432201 - DNA, 12 bp, Homo sapiens
ggtctctgagca

SEQ ID NO: 5432202 - DNA, 13 bp, Homo sapiens
ggtctctgcccca

SEQ ID NO: 5432203 - DNA, 18 bp, Homo sapiens
ggtctctgggagcccaga

SEQ ID NO: 5432204 - DNA, 20 bp, Homo sapiens
ggtctctgggagcccagaac

SEQ ID NO: 5432205 - DNA, 10 bp, Homo sapiens
ggtctctggt

SEQ ID NO: 5432206 - DNA, 16 bp, Homo sapiens
ggtctctggtcctgtg

SEQ ID NO: 5432207 - DNA, 13 bp, Homo sapiens
ggtctctgtttag

SEQ ID NO: 5432208 - DNA, 17 bp, Homo sapiens
ggtctcttacatggcca

SEQ ID NO: 5432209 - DNA, 20 bp, Homo sapiens
ggtctcttcctgtctggctt

SEQ ID NO: 5432210 - DNA, 13 bp, Homo sapiens
ggtctcttccttc

SEQ ID NO: 5432211 - DNA, 14 bp, Homo sapiens
ggtctcttctccca

SEQ ID NO: 5432212 - DNA, 17 bp, Homo sapiens
ggtctcttctcccagaa

SEQ ID NO: 5432213 - DNA, 22 bp, Homo sapiens
ggtctcttctgaataaagcaat

SEQ ID NO: 5432214 - DNA, 20 bp, Homo sapiens
ggtctcttcttggggcccag

SEQ ID NO: 5432215 - DNA, 15 bp, Homo sapiens
ggtctcttttctcta

SEQ ID NO: 5432216 - DNA, 21 bp, Homo sapiens
ggtctgaaaagaggagccaga

SEQ ID NO: 5432217 - DNA, 13 bp, Homo sapiens
ggtctgaaaggaa

SEQ ID NO: 5432218 - DNA, 14 bp, Homo sapiens
ggtctgaaaggggt

SEQ ID NO: 5432219 - DNA, 21 bp, Homo sapiens
ggtctgaaggaatagccagag

SEQ ID NO: 5432220 - DNA, 12 bp, Homo sapiens
ggtctgaaggcc

SEQ ID NO: 5432221 - DNA, 15 bp, Homo sapiens
ggtctgacccactgc

SEQ ID NO: 5432222 - DNA, 22 bp, Homo sapiens
ggtctgagcaccccctcattcc

SEQ ID NO: 5432223 - DNA, 13 bp, Homo sapiens
ggtctgagccctg

SEQ ID NO: 5432224 - DNA, 14 bp, Homo sapiens
ggtctgagctggac

SEQ ID NO: 5432225 - DNA, 15 bp, Homo sapiens
ggtctgagctgtccc

SEQ ID NO: 5432226 - DNA, 19 bp, Homo sapiens
ggtctgaggaatccagacc

SEQ ID NO: 5432227 - DNA, 16 bp, Homo sapiens
ggtctgaggcccctgc

SEQ ID NO: 5432228 - DNA, 19 bp, Homo sapiens
ggtctgaggcccctgcctc

SEQ ID NO: 5432229 - DNA, 17 bp, Homo sapiens
ggtctgagtctatgttc

SEQ ID NO: 5432230 - DNA, 20 bp, Homo sapiens
ggtctgagtctatgttcaaa

SEQ ID NO: 5432231 - DNA, 19 bp, Homo sapiens
ggtctgagtgcaagttcat

SEQ ID NO: 5432232 - DNA, 19 bp, Homo sapiens
ggtctgagtggggcttcct

SEQ ID NO: 5432233 - DNA, 15 bp, Homo sapiens
ggtctgatattaatc

SEQ ID NO: 5432234 - DNA, 17 bp, Homo sapiens
ggtctgatgccaaagct

SEQ ID NO: 5432235 - DNA, 20 bp, Homo sapiens
ggtctgatgccaaagctgct

SEQ ID NO: 5432236 - DNA, 23 bp, Homo sapiens
ggtctgatgttggaatctgctcc

SEQ ID NO: 5432237 - DNA, 14 bp, Homo sapiens
ggtctgattggctg

SEQ ID NO: 5432238 - DNA, 15 bp, Homo sapiens
ggtctgattggctgc

SEQ ID NO: 5432239 - DNA, 17 bp, Homo sapiens
ggtctgatttgcaggat

SEQ ID NO: 5432240 - DNA, 20 bp, Homo sapiens
ggtctgcaagggcccagagt

SEQ ID NO: 5432241 - DNA, 17 bp, Homo sapiens
ggtctgcaagtcagagg

SEQ ID NO: 5432242 - DNA, 20 bp, Homo sapiens
ggtctgcacacataacacac

SEQ ID NO: 5432243 - DNA, 21 bp, Homo sapiens
ggtctgcagcctgctggggct

SEQ ID NO: 5432244 - DNA, 14 bp, Homo sapiens
ggtctgcaggcagg

SEQ ID NO: 5432245 - DNA, 14 bp, Homo sapiens
ggtctgcattttct

SEQ ID NO: 5432246 - DNA, 19 bp, Homo sapiens
ggtctgcattttctcaggc

SEQ ID NO: 5432247 - DNA, 20 bp, Homo sapiens
ggtctgcattttctcaggca

SEQ ID NO: 5432248 - DNA, 14 bp, Homo sapiens
ggtctgccaggccc

SEQ ID NO: 5432249 - DNA, 15 bp, Homo sapiens
ggtctgccaggcccc

SEQ ID NO: 5432250 - DNA, 23 bp, Homo sapiens
ggtctgccctctgcatcctctgg

SEQ ID NO: 5432251 - DNA, 12 bp, Homo sapiens
ggtctgccctgg

SEQ ID NO: 5432252 - DNA, 11 bp, Homo sapiens
ggtctgcctcc

SEQ ID NO: 5432253 - DNA, 22 bp, Homo sapiens
ggtctgcctggttccctcccca

SEQ ID NO: 5432254 - DNA, 18 bp, Homo sapiens
ggtctgcgccttgggatg

SEQ ID NO: 5432255 - DNA, 14 bp, Homo sapiens
ggtctgctcccaag

SEQ ID NO: 5432256 - DNA, 20 bp, Homo sapiens
ggtctgctcccaaggggcct

SEQ ID NO: 5432257 - DNA, 22 bp, Homo sapiens
ggtctgctcccaaggggcctga

SEQ ID NO: 5432258 - DNA, 17 bp, Homo sapiens
ggtctgctcctgtggcg

SEQ ID NO: 5432259 - DNA, 20 bp, Homo sapiens
ggtctgctcctgtggcggtg

SEQ ID NO: 5432260 - DNA, 16 bp, Homo sapiens
ggtctgctctgtgcct

SEQ ID NO: 5432261 - DNA, 18 bp, Homo sapiens
ggtctggaatggactggg

SEQ ID NO: 5432262 - DNA, 14 bp, Homo sapiens
ggtctggcagagcc

SEQ ID NO: 5432263 - DNA, 15 bp, Homo sapiens
ggtctggcagcctcc

SEQ ID NO: 5432264 - DNA, 17 bp, Homo sapiens
ggtctggcagggcagca

SEQ ID NO: 5432265 - DNA, 19 bp, Homo sapiens
ggtctggccgtacttgtga

SEQ ID NO: 5432266 - DNA, 14 bp, Homo sapiens
ggtctggcctcagg

SEQ ID NO: 5432267 - DNA, 12 bp, Homo sapiens
ggtctggcctgt

SEQ ID NO: 5432268 - DNA, 12 bp, Homo sapiens
ggtctggctaga

SEQ ID NO: 5432269 - DNA, 14 bp, Homo sapiens
ggtctggctgagcc

SEQ ID NO: 5432270 - DNA, 18 bp, Homo sapiens
ggtctggctgagcccctg

SEQ ID NO: 5432271 - DNA, 12 bp, Homo sapiens
ggtctggctggt

SEQ ID NO: 5432272 - DNA, 14 bp, Homo sapiens
ggtctggctggtgt

SEQ ID NO: 5432273 - DNA, 23 bp, Homo sapiens
ggtctggctggtgttaacagaag

SEQ ID NO: 5432274 - DNA, 16 bp, Homo sapiens
ggtctgggacttcctt

SEQ ID NO: 5432275 - DNA, 17 bp, Homo sapiens
ggtctgggacttccttg

SEQ ID NO: 5432276 - DNA, 20 bp, Homo sapiens
ggtctgggagaggcagagtg

SEQ ID NO: 5432277 - DNA, 20 bp, Homo sapiens
ggtctgggatatggctgccc

SEQ ID NO: 5432278 - DNA, 18 bp, Homo sapiens
ggtctgggatggacagga

SEQ ID NO: 5432279 - DNA, 14 bp, Homo sapiens
ggtctgggcaagta

SEQ ID NO: 5432280 - DNA, 20 bp, Homo sapiens
ggtctgggcaagtagcagga

SEQ ID NO: 5432281 - DNA, 19 bp, Homo sapiens
ggtctgggcagtgccacag

SEQ ID NO: 5432282 - DNA, 22 bp, Homo sapiens
ggtctgggcagtgccacagcct

SEQ ID NO: 5432283 - DNA, 18 bp, Homo sapiens
ggtctgggcgtccagctc

SEQ ID NO: 5432284 - DNA, 23 bp, Homo sapiens
ggtctgggcgtccagctcagccc

SEQ ID NO: 5432285 - DNA, 14 bp, Homo sapiens
ggtctgggctgggc

SEQ ID NO: 5432286 - DNA, 21 bp, Homo sapiens
ggtctgggctgggcacctgac

SEQ ID NO: 5432287 - DNA, 21 bp, Homo sapiens
ggtctgggggcacaagactga

SEQ ID NO: 5432288 - DNA, 15 bp, Homo sapiens
ggtctggtaaatatg

SEQ ID NO: 5432289 - DNA, 17 bp, Homo sapiens
ggtctggtaactgcaga

SEQ ID NO: 5432290 - DNA, 12 bp, Homo sapiens
ggtctggtcagg

SEQ ID NO: 5432291 - DNA, 15 bp, Homo sapiens
ggtctggtcaggcaa

SEQ ID NO: 5432292 - DNA, 14 bp, Homo sapiens
ggtctggtgtaaaa

SEQ ID NO: 5432293 - DNA, 12 bp, Homo sapiens
ggtctgtaactg

SEQ ID NO: 5432294 - DNA, 16 bp, Homo sapiens
ggtctgtaactgccca

SEQ ID NO: 5432295 - DNA, 18 bp, Homo sapiens
ggtctgtaactgcccagc

SEQ ID NO: 5432296 - DNA, 19 bp, Homo sapiens
ggtctgtaactgcccagcc

SEQ ID NO: 5432297 - DNA, 21 bp, Homo sapiens
ggtctgtaactgcccagcccc

SEQ ID NO: 5432298 - DNA, 14 bp, Homo sapiens
ggtctgtagggatt

SEQ ID NO: 5432299 - DNA, 15 bp, Homo sapiens
ggtctgtaggttgca

SEQ ID NO: 5432300 - DNA, 18 bp, Homo sapiens
ggtctgtatatacatttc

SEQ ID NO: 5432301 - DNA, 16 bp, Homo sapiens
ggtctgtatgtcatgg

SEQ ID NO: 5432302 - DNA, 14 bp, Homo sapiens
ggtctgtcccacca

SEQ ID NO: 5432303 - DNA, 23 bp, Homo sapiens
ggtctgtcccgggtactcagtca

SEQ ID NO: 5432304 - DNA, 16 bp, Homo sapiens
ggtctgtcctgacagc

SEQ ID NO: 5432305 - DNA, 15 bp, Homo sapiens
ggtctgtctgctttg

SEQ ID NO: 5432306 - DNA, 14 bp, Homo sapiens
ggtctgtcttttaa

SEQ ID NO: 5432307 - DNA, 24 bp, Homo sapiens
ggtctgtgagatgctagaactccc

SEQ ID NO: 5432308 - DNA, 19 bp, Homo sapiens
ggtctgtgcattgtggctg

SEQ ID NO: 5432309 - DNA, 21 bp, Homo sapiens
ggtctgtgcattgtggctgtc

SEQ ID NO: 5432310 - DNA, 13 bp, Homo sapiens
ggtctgtgcccga

SEQ ID NO: 5432311 - DNA, 15 bp, Homo sapiens
ggtctgtgcccgagg

SEQ ID NO: 5432312 - DNA, 20 bp, Homo sapiens
ggtctgtgctgtgcctgcta

SEQ ID NO: 5432313 - DNA, 14 bp, Homo sapiens
ggtctgtggccagt

SEQ ID NO: 5432314 - DNA, 21 bp, Homo sapiens
ggtctgtggctcctcccgaaa

SEQ ID NO: 5432315 - DNA, 16 bp, Homo sapiens
ggtctgtgggactggc

SEQ ID NO: 5432316 - DNA, 18 bp, Homo sapiens
ggtctgtgtctcttttct

SEQ ID NO: 5432317 - DNA, 16 bp, Homo sapiens
ggtctgtgtgaatgtg

SEQ ID NO: 5432318 - DNA, 11 bp, Homo sapiens
ggtctgtgtgt

SEQ ID NO: 5432319 - DNA, 20 bp, Homo sapiens
ggtctgtgtgtgtgtatgtg

SEQ ID NO: 5432320 - DNA, 21 bp, Homo sapiens
ggtctgtgttctcaacacaca

SEQ ID NO: 5432321 - DNA, 19 bp, Homo sapiens
ggtctgttgaagtgcatgt

SEQ ID NO: 5432322 - DNA, 20 bp, Homo sapiens
ggtctgttgaagtgcatgtt

SEQ ID NO: 5432323 - DNA, 12 bp, Homo sapiens
ggtctgtttgca

SEQ ID NO: 5432324 - DNA, 21 bp, Homo sapiens
ggtctgtttgtctgaacaaag

SEQ ID NO: 5432325 - DNA, 21 bp, Homo sapiens
ggtctgttttgtgtactttta

SEQ ID NO: 5432326 - DNA, 16 bp, Homo sapiens
ggtcttacattgcctg

SEQ ID NO: 5432327 - DNA, 19 bp, Homo sapiens
ggtcttacctctctgggac

SEQ ID NO: 5432328 - DNA, 16 bp, Homo sapiens
ggtcttagctctttct

SEQ ID NO: 5432329 - DNA, 18 bp, Homo sapiens
ggtcttagctctttctct

SEQ ID NO: 5432330 - DNA, 16 bp, Homo sapiens
ggtcttagctttacat

SEQ ID NO: 5432331 - DNA, 23 bp, Homo sapiens
ggtcttagggtacagcccaggcg

SEQ ID NO: 5432332 - DNA, 13 bp, Homo sapiens
ggtcttaggtctt

SEQ ID NO: 5432333 - DNA, 19 bp, Homo sapiens
ggtcttatctgttcagtgt

SEQ ID NO: 5432334 - DNA, 12 bp, Homo sapiens
ggtcttatgatt

SEQ ID NO: 5432335 - DNA, 19 bp, Homo sapiens
ggtcttcactttcctcagt

SEQ ID NO: 5432336 - DNA, 17 bp, Homo sapiens
ggtcttcagcctccctc

SEQ ID NO: 5432337 - DNA, 18 bp, Homo sapiens
ggtcttcagcctccctca

SEQ ID NO: 5432338 - DNA, 18 bp, Homo sapiens
ggtcttcagcctctttct

SEQ ID NO: 5432339 - DNA, 11 bp, Homo sapiens
ggtcttcagct

SEQ ID NO: 5432340 - DNA, 13 bp, Homo sapiens
ggtcttcagcttt

SEQ ID NO: 5432341 - DNA, 15 bp, Homo sapiens
ggtcttccagacctg

SEQ ID NO: 5432342 - DNA, 17 bp, Homo sapiens
ggtcttccctacctcag

SEQ ID NO: 5432343 - DNA, 20 bp, Homo sapiens
ggtcttccctacctcaggca

SEQ ID NO: 5432344 - DNA, 10 bp, Homo sapiens
ggtcttccta

SEQ ID NO: 5432345 - DNA, 21 bp, Homo sapiens
ggtcttcctactcttctctct

SEQ ID NO: 5432346 - DNA, 13 bp, Homo sapiens
ggtcttcctgtgg

SEQ ID NO: 5432347 - DNA, 18 bp, Homo sapiens
ggtcttccttctacccca

SEQ ID NO: 5432348 - DNA, 13 bp, Homo sapiens
ggtcttctcagtt

SEQ ID NO: 5432349 - DNA, 12 bp, Homo sapiens
ggtcttctgcat

SEQ ID NO: 5432350 - DNA, 16 bp, Homo sapiens
ggtcttcttggcagct

SEQ ID NO: 5432351 - DNA, 21 bp, Homo sapiens
ggtcttcttgtgtcctgatga

SEQ ID NO: 5432352 - DNA, 23 bp, Homo sapiens
ggtcttgagccagtaatctttat

SEQ ID NO: 5432353 - DNA, 16 bp, Homo sapiens
ggtcttgaggggaagc

SEQ ID NO: 5432354 - DNA, 20 bp, Homo sapiens
ggtgccatgcctgctccctg

SEQ ID NO: 5432355 - DNA, 15 bp, Homo sapiens
ggtgccatgtggagt

SEQ ID NO: 5432356 - DNA, 17 bp, Homo sapiens
ggtgccatgtggagtgg

SEQ ID NO: 5432357 - DNA, 16 bp, Homo sapiens
ggtgccatttctgaac

SEQ ID NO: 5432358 - DNA, 19 bp, Homo sapiens
ggtgccattttaaatttta

SEQ ID NO: 5432359 - DNA, 17 bp, Homo sapiens
ggtgcccaagccagagg

SEQ ID NO: 5432360 - DNA, 18 bp, Homo sapiens
ggtgcccaagccagaggc

SEQ ID NO: 5432361 - DNA, 22 bp, Homo sapiens
ggtgcccaagctcagaaggctc

SEQ ID NO: 5432362 - DNA, 23 bp, Homo sapiens
ggtgcccacagtgtcaggcactg

SEQ ID NO: 5432363 - DNA, 20 bp, Homo sapiens
ggtgcccaccagctggctct

SEQ ID NO: 5432364 - DNA, 23 bp, Homo sapiens
ggtgcccagaataagttattgca

SEQ ID NO: 5432365 - DNA, 14 bp, Homo sapiens
ggtgcccaggaaag

SEQ ID NO: 5432366 - DNA, 12 bp, Homo sapiens
ggtgcccaggac

SEQ ID NO: 5432367 - DNA, 13 bp, Homo sapiens
ggtgcccatttgt

SEQ ID NO: 5432368 - DNA, 19 bp, Homo sapiens
ggtgccccacaaggcccag

SEQ ID NO: 5432369 - DNA, 23 bp, Homo sapiens
ggtgccccacctccccagagccc

SEQ ID NO: 5432370 - DNA, 19 bp, Homo sapiens
ggtgccccacctgcctggt

SEQ ID NO: 5432371 - DNA, 20 bp, Homo sapiens
ggtgccccacctgcctggtg

SEQ ID NO: 5432372 - DNA, 14 bp, Homo sapiens
ggtgccccaggacc

SEQ ID NO: 5432373 - DNA, 15 bp, Homo sapiens
ggtgccccaggacca

SEQ ID NO: 5432374 - DNA, 17 bp, Homo sapiens
ggtgccccaggaccagc

SEQ ID NO: 5432375 - DNA, 13 bp, Homo sapiens
ggtgccccaggga

SEQ ID NO: 5432376 - DNA, 14 bp, Homo sapiens
ggtgcccccagaca

SEQ ID NO: 5432377 - DNA, 19 bp, Homo sapiens
ggtgccccctcctctccca

SEQ ID NO: 5432378 - DNA, 12 bp, Homo sapiens
ggtgcccctctt

SEQ ID NO: 5432379 - DNA, 17 bp, Homo sapiens
ggtgcccctcttccaaa

SEQ ID NO: 5432380 - DNA, 14 bp, Homo sapiens
ggtgcccctgctca

SEQ ID NO: 5432381 - DNA, 12 bp, Homo sapiens
ggtgcccctggg

SEQ ID NO: 5432382 - DNA, 15 bp, Homo sapiens
ggtgcccctgggaac

SEQ ID NO: 5432383 - DNA, 20 bp, Homo sapiens
ggtgcccgtaatcccagcta

SEQ ID NO: 5432384 - DNA, 16 bp, Homo sapiens
ggtgcccgtgtggcct

SEQ ID NO: 5432385 - DNA, 18 bp, Homo sapiens
ggtgcccgtgtggcctgg

SEQ ID NO: 5432386 - DNA, 21 bp, Homo sapiens
ggtgcccgtgtggcctgggtc

SEQ ID NO: 5432387 - DNA, 24 bp, Homo sapiens
ggtgcccgtgtggcctgggtcctc

SEQ ID NO: 5432388 - DNA, 13 bp, Homo sapiens
ggtgccctctcca

SEQ ID NO: 5432389 - DNA, 20 bp, Homo sapiens
ggtgccctggatgcccagga

SEQ ID NO: 5432390 - DNA, 14 bp, Homo sapiens
ggtgccctggccca

SEQ ID NO: 5432391 - DNA, 15 bp, Homo sapiens
ggtgccctggcccag

SEQ ID NO: 5432392 - DNA, 12 bp, Homo sapiens
ggtgccctgtgg

SEQ ID NO: 5432393 - DNA, 17 bp, Homo sapiens
ggtgcccttggaggcca

SEQ ID NO: 5432394 - DNA, 18 bp, Homo sapiens
ggtgcccttggaggccag

SEQ ID NO: 5432395 - DNA, 22 bp, Homo sapiens
ggtgcccttggaggccagccag

SEQ ID NO: 5432396 - DNA, 16 bp, Homo sapiens
ggtgccctttcctggc

SEQ ID NO: 5432397 - DNA, 16 bp, Homo sapiens
ggtgccgctttctctg

SEQ ID NO: 5432398 - DNA, 19 bp, Homo sapiens
ggtgccgctttctctgagg

SEQ ID NO: 5432399 - DNA, 19 bp, Homo sapiens
ggtgccggaaagagagctg

SEQ ID NO: 5432400 - DNA, 17 bp, Homo sapiens
ggtgccgtgagcaggct

SEQ ID NO: 5432401 - DNA, 20 bp, Homo sapiens
ggtgcctaacctgggacctg

SEQ ID NO: 5432402 - DNA, 22 bp, Homo sapiens
ggtgcctaggttggtttcccct

SEQ ID NO: 5432403 - DNA, 19 bp, Homo sapiens
ggtgcctagtattgacaaa

SEQ ID NO: 5432404 - DNA, 19 bp, Homo sapiens
ggtgcctatatctgagaga

SEQ ID NO: 5432405 - DNA, 20 bp, Homo sapiens
ggtgcctatctgcctggagg

SEQ ID NO: 5432406 - DNA, 22 bp, Homo sapiens
ggtgcctcagactccgccctcc

SEQ ID NO: 5432407 - DNA, 20 bp, Homo sapiens
ggtgcctcagagcaggctca

SEQ ID NO: 5432408 - DNA, 15 bp, Homo sapiens
ggtgcctcaggacct

SEQ ID NO: 5432409 - DNA, 17 bp, Homo sapiens
ggtgcctcagttttcct

SEQ ID NO: 5432410 - DNA, 22 bp, Homo sapiens
ggtgcctcagttttccttctgt

SEQ ID NO: 5432411 - DNA, 14 bp, Homo sapiens
ggtgcctccaggtg

SEQ ID NO: 5432412 - DNA, 20 bp, Homo sapiens
ggtgcctcccagccctgccc

SEQ ID NO: 5432413 - DNA, 22 bp, Homo sapiens
ggtgcctcccagccctgcccag

SEQ ID NO: 5432414 - DNA, 23 bp, Homo sapiens
ggtgcctcccagccctgcccaga

SEQ ID NO: 5432415 - DNA, 13 bp, Homo sapiens
ggtgcctcccagt

SEQ ID NO: 5432416 - DNA, 22 bp, Homo sapiens
ggtgcctcccagtggcctggct

SEQ ID NO: 5432417 - DNA, 15 bp, Homo sapiens
ggtgcctcctgcagt

SEQ ID NO: 5432418 - DNA, 23 bp, Homo sapiens
ggtgcctctgtgcacagtggctt

SEQ ID NO: 5432419 - DNA, 15 bp, Homo sapiens
ggtgcctgagagcag

SEQ ID NO: 5432420 - DNA, 15 bp, Homo sapiens
ggtgcctgagaggca

SEQ ID NO: 5432421 - DNA, 14 bp, Homo sapiens
ggtgcctgagcccg

SEQ ID NO: 5432422 - DNA, 14 bp, Homo sapiens
ggtgcctgaggtct

SEQ ID NO: 5432423 - DNA, 18 bp, Homo sapiens
ggtgcctgattcggctgt

SEQ ID NO: 5432424 - DNA, 19 bp, Homo sapiens
ggtgcctgcacacagagtg

SEQ ID NO: 5432425 - DNA, 13 bp, Homo sapiens
ggtgcctgccata

SEQ ID NO: 5432426 - DNA, 16 bp, Homo sapiens
ggtgcctgcctctgcc

SEQ ID NO: 5432427 - DNA, 18 bp, Homo sapiens
ggtgcctgcctctgccat

SEQ ID NO: 5432428 - DNA, 24 bp, Homo sapiens
ggtgcctgcctctgccatgcccag

SEQ ID NO: 5432429 - DNA, 17 bp, Homo sapiens
ggtgcctgctcaggtgc

SEQ ID NO: 5432430 - DNA, 14 bp, Homo sapiens
ggtgcctgctgtcc

SEQ ID NO: 5432431 - DNA, 23 bp, Homo sapiens
ggtgcctgctttgacgggccagg

SEQ ID NO: 5432432 - DNA, 22 bp, Homo sapiens
ggtgcctggccatgtcacctgg

SEQ ID NO: 5432433 - DNA, 14 bp, Homo sapiens
ggtgcctggccctt

SEQ ID NO: 5432434 - DNA, 13 bp, Homo sapiens
ggtgcctggctgg

SEQ ID NO: 5432435 - DNA, 14 bp, Homo sapiens
ggtgcctgggagga

SEQ ID NO: 5432436 - DNA, 16 bp, Homo sapiens
ggtgcctggggctggc

SEQ ID NO: 5432437 - DNA, 20 bp, Homo sapiens
ggtgcctggtgcgctgtgct

SEQ ID NO: 5432438 - DNA, 17 bp, Homo sapiens
ggtgcctggtgggccac

SEQ ID NO: 5432439 - DNA, 12 bp, Homo sapiens
ggtgcctgtgac

SEQ ID NO: 5432440 - DNA, 17 bp, Homo sapiens
ggtgcctgtgaggcagg

SEQ ID NO: 5432441 - DNA, 21 bp, Homo sapiens
ggtgcctgttatatatttact

SEQ ID NO: 5432442 - DNA, 20 bp, Homo sapiens
ggtgccttcactgggccagt

SEQ ID NO: 5432443 - DNA, 17 bp, Homo sapiens
ggtgccttccaccctgc

SEQ ID NO: 5432444 - DNA, 20 bp, Homo sapiens
ggtgccttccaccctgccct

SEQ ID NO: 5432445 - DNA, 22 bp, Homo sapiens
ggtgccttccaccctgccctgg

SEQ ID NO: 5432446 - DNA, 23 bp, Homo sapiens
ggtgccttcttattctcactcca

SEQ ID NO: 5432447 - DNA, 18 bp, Homo sapiens
ggtgcctttcctgttcag

SEQ ID NO: 5432448 - DNA, 19 bp, Homo sapiens
ggtgcctttcctgttcagc

SEQ ID NO: 5432449 - DNA, 23 bp, Homo sapiens
ggtgcgagagaggtgggcagcag

SEQ ID NO: 5432450 - DNA, 18 bp, Homo sapiens
ggtgcgagtgcgtgaata

SEQ ID NO: 5432451 - DNA, 20 bp, Homo sapiens
ggtgcgagtgtgagagtgtg

SEQ ID NO: 5432452 - DNA, 22 bp, Homo sapiens
ggtgcgcgccaccgtgcctggc

SEQ ID NO: 5432453 - DNA, 15 bp, Homo sapiens
ggtgcggaccggagc

SEQ ID NO: 5432454 - DNA, 24 bp, Homo sapiens
ggtgcggaccggagcggctgagga

SEQ ID NO: 5432455 - DNA, 23 bp, Homo sapiens
ggtgcggatggacactaatgcag

SEQ ID NO: 5432456 - DNA, 13 bp, Homo sapiens
ggtgcggcaggag

SEQ ID NO: 5432457 - DNA, 19 bp, Homo sapiens
ggtgcggcggtcccagctc

SEQ ID NO: 5432458 - DNA, 12 bp, Homo sapiens
ggtgcggctgtg

SEQ ID NO: 5432459 - DNA, 21 bp, Homo sapiens
ggtgcgggcctggccctcact

SEQ ID NO: 5432460 - DNA, 18 bp, Homo sapiens
ggtgcggggcctgcaggc

SEQ ID NO: 5432461 - DNA, 20 bp, Homo sapiens
ggtgcggtaggtgctggcct

SEQ ID NO: 5432462 - DNA, 19 bp, Homo sapiens
ggtgcgtctgggaggttgg

SEQ ID NO: 5432463 - DNA, 16 bp, Homo sapiens
ggtgcgtgaccggccc

SEQ ID NO: 5432464 - DNA, 20 bp, Homo sapiens
ggtgcgtgaccggcccgcca

SEQ ID NO: 5432465 - DNA, 18 bp, Homo sapiens
ggtgcgtgcctgtagtgc

SEQ ID NO: 5432466 - DNA, 13 bp, Homo sapiens
ggtgcgtgtgtct

SEQ ID NO: 5432467 - DNA, 16 bp, Homo sapiens
ggtgcgtgttcagcag

SEQ ID NO: 5432468 - DNA, 21 bp, Homo sapiens
ggtgcgtgttcagcagaacct

SEQ ID NO: 5432469 - DNA, 19 bp, Homo sapiens
ggtgcgtttataattggct

SEQ ID NO: 5432470 - DNA, 16 bp, Homo sapiens
ggtgcgtttttacagt

SEQ ID NO: 5432471 - DNA, 23 bp, Homo sapiens
ggtgctaaagccaaccagccttt

SEQ ID NO: 5432472 - DNA, 19 bp, Homo sapiens
ggtgctaaaggaggccata

SEQ ID NO: 5432473 - DNA, 12 bp, Homo sapiens
ggtgctaaatct

SEQ ID NO: 5432474 - DNA, 16 bp, Homo sapiens
ggtgctaaccccgtct

SEQ ID NO: 5432475 - DNA, 16 bp, Homo sapiens
ggtgctaagcgggccc

SEQ ID NO: 5432476 - DNA, 14 bp, Homo sapiens
ggtgctaatatttt

SEQ ID NO: 5432477 - DNA, 16 bp, Homo sapiens
ggtgctaatattttat

SEQ ID NO: 5432478 - DNA, 22 bp, Homo sapiens
ggtgctagcttgacacagtcag

SEQ ID NO: 5432479 - DNA, 15 bp, Homo sapiens
ggtgctaggcccctg

SEQ ID NO: 5432480 - DNA, 16 bp, Homo sapiens
ggtgctaggcccctgt

SEQ ID NO: 5432481 - DNA, 20 bp, Homo sapiens
ggtgctaggcccctgtgtag

SEQ ID NO: 5432482 - DNA, 16 bp, Homo sapiens
ggtgctagggtgcctg

SEQ ID NO: 5432483 - DNA, 13 bp, Homo sapiens
ggtgctagtaaat

SEQ ID NO: 5432484 - DNA, 21 bp, Homo sapiens
ggtgctataggctggagaagc

SEQ ID NO: 5432485 - DNA, 23 bp, Homo sapiens
ggtgctatctcccccagccccat

SEQ ID NO: 5432486 - DNA, 19 bp, Homo sapiens
ggtgctatgtcccaagagc

SEQ ID NO: 5432487 - DNA, 14 bp, Homo sapiens
ggtgctatttgaag

SEQ ID NO: 5432488 - DNA, 12 bp, Homo sapiens
ggtgctcaaaga

SEQ ID NO: 5432489 - DNA, 14 bp, Homo sapiens
ggtgctcaaagatg

SEQ ID NO: 5432490 - DNA, 20 bp, Homo sapiens
ggtgctcaaagatgtactga

SEQ ID NO: 5432491 - DNA, 22 bp, Homo sapiens
ggtgctcaagggttctttcctc

SEQ ID NO: 5432492 - DNA, 21 bp, Homo sapiens
ggtgctcaataaacttgtgcc

SEQ ID NO: 5432493 - DNA, 22 bp, Homo sapiens
ggtgctcaataaacttgtgcct

SEQ ID NO: 5432494 - DNA, 23 bp, Homo sapiens
ggtgctcaataaacttgtgcctc

SEQ ID NO: 5432495 - DNA, 20 bp, Homo sapiens
ggtgctcaccatgcttccag

SEQ ID NO: 5432496 - DNA, 13 bp, Homo sapiens
ggtgctcactccc

SEQ ID NO: 5432497 - DNA, 22 bp, Homo sapiens
ggtgctcagcccaggcacaact

SEQ ID NO: 5432498 - DNA, 15 bp, Homo sapiens
ggtgctcatgctgct

SEQ ID NO: 5432499 - DNA, 18 bp, Homo sapiens
ggtgctccatctccgcct

SEQ ID NO: 5432500 - DNA, 15 bp, Homo sapiens
ggtgctccctcctca

SEQ ID NO: 5432501 - DNA, 14 bp, Homo sapiens
ggtgctctctgcca

SEQ ID NO: 5432502 - DNA, 16 bp, Homo sapiens
ggtgctctctgccact

SEQ ID NO: 5432503 - DNA, 10 bp, Homo sapiens
ggtgctctgg

SEQ ID NO: 5432504 - DNA, 14 bp, Homo sapiens
ggtgctctggcggc

SEQ ID NO: 5432505 - DNA, 15 bp, Homo sapiens
ggtgctgacggccag

SEQ ID NO: 5432506 - DNA, 17 bp, Homo sapiens
ggtgctgacggccaggg

SEQ ID NO: 5432507 - DNA, 20 bp, Homo sapiens
ggtgctgacggccagggaga

SEQ ID NO: 5432508 - DNA, 16 bp, Homo sapiens
ggtgctgactgaggcc

SEQ ID NO: 5432509 - DNA, 19 bp, Homo sapiens
ggtgctgactgaggcctgc

SEQ ID NO: 5432510 - DNA, 20 bp, Homo sapiens
ggtgctgactgaggcctgct

SEQ ID NO: 5432511 - DNA, 16 bp, Homo sapiens
ggtgctgagcttagcc

SEQ ID NO: 5432512 - DNA, 20 bp, Homo sapiens
ggtgctgaggatacagctct

SEQ ID NO: 5432513 - DNA, 12 bp, Homo sapiens
ggtgctgatgag

SEQ ID NO: 5432514 - DNA, 15 bp, Homo sapiens
ggtgctgatggccct

SEQ ID NO: 5432515 - DNA, 19 bp, Homo sapiens
ggtgctgatgggaaggagg

SEQ ID NO: 5432516 - DNA, 20 bp, Homo sapiens
ggtgctgatgggaaggaggg

SEQ ID NO: 5432517 - DNA, 19 bp, Homo sapiens
ggtgctgcacccctggtgt

SEQ ID NO: 5432518 - DNA, 17 bp, Homo sapiens
ggtgctgcagatttgat

SEQ ID NO: 5432519 - DNA, 14 bp, Homo sapiens
ggtgctgcaggagt

SEQ ID NO: 5432520 - DNA, 22 bp, Homo sapiens
ggtgctgcattgagtccagctt

SEQ ID NO: 5432521 - DNA, 23 bp, Homo sapiens
ggtgctgccaccccttggcactg

SEQ ID NO: 5432522 - DNA, 23 bp, Homo sapiens
ggtgctgccatgacagaggctgc

SEQ ID NO: 5432523 - DNA, 12 bp, Homo sapiens
ggtgctgccgag

SEQ ID NO: 5432524 - DNA, 13 bp, Homo sapiens
ggtgctgccgagg

SEQ ID NO: 5432525 - DNA, 15 bp, Homo sapiens
ggtgctgccgagggc

SEQ ID NO: 5432526 - DNA, 22 bp, Homo sapiens
ggtgctgccgagggctggccgg

SEQ ID NO: 5432527 - DNA, 17 bp, Homo sapiens
ggtgctgcctctacctg

SEQ ID NO: 5432528 - DNA, 22 bp, Homo sapiens
ggtgctgctaattctttgcaaa

SEQ ID NO: 5432529 - DNA, 20 bp, Homo sapiens
ggtgctgctaccctccctgc

SEQ ID NO: 5432530 - DNA, 14 bp, Homo sapiens
ggtggggtgggggt

SEQ ID NO: 5432531 - DNA, 22 bp, Homo sapiens
ggtgggtaattgtacaataaat

SEQ ID NO: 5432532 - DNA, 21 bp, Homo sapiens
ggtgggtaggagcccttctct

SEQ ID NO: 5432533 - DNA, 14 bp, Homo sapiens
ggtgggtataaaag

SEQ ID NO: 5432534 - DNA, 18 bp, Homo sapiens
ggtgggtatcccacctcc

SEQ ID NO: 5432535 - DNA, 14 bp, Homo sapiens
ggtgggtccatggg

SEQ ID NO: 5432536 - DNA, 19 bp, Homo sapiens
ggtgggtcccggctctgtg

SEQ ID NO: 5432537 - DNA, 20 bp, Homo sapiens
ggtgggtccgcatccctgct

SEQ ID NO: 5432538 - DNA, 23 bp, Homo sapiens
ggtgggtctacctcatctctgaa

SEQ ID NO: 5432539 - DNA, 22 bp, Homo sapiens
ggtgggtctatgttccccagga

SEQ ID NO: 5432540 - DNA, 15 bp, Homo sapiens
ggtgggtctgagctg

SEQ ID NO: 5432541 - DNA, 12 bp, Homo sapiens
ggtgggtgaaag

SEQ ID NO: 5432542 - DNA, 15 bp, Homo sapiens
ggtgggtgaaaggaa

SEQ ID NO: 5432543 - DNA, 20 bp, Homo sapiens
ggtgggtgaaggcctggctg

SEQ ID NO: 5432544 - DNA, 18 bp, Homo sapiens
ggtgggtgagctctcagg

SEQ ID NO: 5432545 - DNA, 15 bp, Homo sapiens
ggtgggtgctgccct

SEQ ID NO: 5432546 - DNA, 18 bp, Homo sapiens
ggtgggtgggcctgactg

SEQ ID NO: 5432547 - DNA, 15 bp, Homo sapiens
ggtgggtggtgggct

SEQ ID NO: 5432548 - DNA, 17 bp, Homo sapiens
ggtgggtgtgagcaggg

SEQ ID NO: 5432549 - DNA, 15 bp, Homo sapiens
ggtgggtgtggccag

SEQ ID NO: 5432550 - DNA, 14 bp, Homo sapiens
ggtggtaactgcca

SEQ ID NO: 5432551 - DNA, 19 bp, Homo sapiens
ggtggtacatgcctgtaat

SEQ ID NO: 5432552 - DNA, 22 bp, Homo sapiens
ggtggtactttattcttgctgg

SEQ ID NO: 5432553 - DNA, 18 bp, Homo sapiens
ggtggtagctctgagccc

SEQ ID NO: 5432554 - DNA, 20 bp, Homo sapiens
ggtggtattttcaatagcca

SEQ ID NO: 5432555 - DNA, 14 bp, Homo sapiens
ggtggtcagcccta

SEQ ID NO: 5432556 - DNA, 14 bp, Homo sapiens
ggtggtctgctcgg

SEQ ID NO: 5432557 - DNA, 22 bp, Homo sapiens
ggtggtctgctcgggcccaggc

SEQ ID NO: 5432558 - DNA, 14 bp, Homo sapiens
ggtggtgacctctg

SEQ ID NO: 5432559 - DNA, 15 bp, Homo sapiens
ggtggtgccagaggt

SEQ ID NO: 5432560 - DNA, 12 bp, Homo sapiens
ggtggtgctaaa

SEQ ID NO: 5432561 - DNA, 12 bp, Homo sapiens
ggtggtggacag

SEQ ID NO: 5432562 - DNA, 12 bp, Homo sapiens
ggtggtggagga

SEQ ID NO: 5432563 - DNA, 18 bp, Homo sapiens
ggtggtggagggggctgg

SEQ ID NO: 5432564 - DNA, 14 bp, Homo sapiens
ggtggtggcctggt

SEQ ID NO: 5432565 - DNA, 13 bp, Homo sapiens
ggtggtggggaca

SEQ ID NO: 5432566 - DNA, 16 bp, Homo sapiens
ggtggtgtcgggccct

SEQ ID NO: 5432567 - DNA, 19 bp, Homo sapiens
ggtggttaccaggcactgg

SEQ ID NO: 5432568 - DNA, 15 bp, Homo sapiens
ggtggttagaggaaa

SEQ ID NO: 5432569 - DNA, 13 bp, Homo sapiens
ggtggttcctttg

SEQ ID NO: 5432570 - DNA, 16 bp, Homo sapiens
ggtggttttcagagca

SEQ ID NO: 5432571 - DNA, 20 bp, Homo sapiens
ggtggttttcagagcaggag

SEQ ID NO: 5432572 - DNA, 21 bp, Homo sapiens
ggtggttttcagagcaggagg

SEQ ID NO: 5432573 - DNA, 22 bp, Homo sapiens
ggtggttttcagagcaggaggc

SEQ ID NO: 5432574 - DNA, 15 bp, Homo sapiens
ggtggttttctgttc

SEQ ID NO: 5432575 - DNA, 21 bp, Homo sapiens
ggtggtttttggttacatgga

SEQ ID NO: 5432576 - DNA, 17 bp, Homo sapiens
ggtggttttttccccct

SEQ ID NO: 5432577 - DNA, 14 bp, Homo sapiens
ggtgtaaaaccatg

SEQ ID NO: 5432578 - DNA, 15 bp, Homo sapiens
ggtgtaaaaccatgt

SEQ ID NO: 5432579 - DNA, 22 bp, Homo sapiens
ggtgtaaaatatctacctgccc

SEQ ID NO: 5432580 - DNA, 14 bp, Homo sapiens
ggtgtaaacacatc

SEQ ID NO: 5432581 - DNA, 14 bp, Homo sapiens
ggtgtaaagctggc

SEQ ID NO: 5432582 - DNA, 16 bp, Homo sapiens
ggtgtaaagctggccc

SEQ ID NO: 5432583 - DNA, 17 bp, Homo sapiens
ggtgtaaagctggccct

SEQ ID NO: 5432584 - DNA, 10 bp, Homo sapiens
ggtgtaaata

SEQ ID NO: 5432585 - DNA, 21 bp, Homo sapiens
ggtgtaaccatttgttaactg

SEQ ID NO: 5432586 - DNA, 15 bp, Homo sapiens
ggtgtaacttcctgc

SEQ ID NO: 5432587 - DNA, 16 bp, Homo sapiens
ggtgtaataagacata

SEQ ID NO: 5432588 - DNA, 14 bp, Homo sapiens
ggtgtaatctcaat

SEQ ID NO: 5432589 - DNA, 17 bp, Homo sapiens
ggtgtaatctcaatgca

SEQ ID NO: 5432590 - DNA, 15 bp, Homo sapiens
ggtgtacactaacat

SEQ ID NO: 5432591 - DNA, 22 bp, Homo sapiens
ggtgtactgtactgaagaacag

SEQ ID NO: 5432592 - DNA, 23 bp, Homo sapiens
ggtgtactgtactgaagaacagt

SEQ ID NO: 5432593 - DNA, 15 bp, Homo sapiens
ggtgtagattccctt

SEQ ID NO: 5432594 - DNA, 23 bp, Homo sapiens
ggtgtagctaacagttgccacat

SEQ ID NO: 5432595 - DNA, 18 bp, Homo sapiens
ggtgtagctcctctgctg

SEQ ID NO: 5432596 - DNA, 23 bp, Homo sapiens
ggtgtagctcctctgctgctccc

SEQ ID NO: 5432597 - DNA, 23 bp, Homo sapiens
ggtgtagctcttagaggaaggag

SEQ ID NO: 5432598 - DNA, 18 bp, Homo sapiens
ggtgtagctgtcctctca

SEQ ID NO: 5432599 - DNA, 20 bp, Homo sapiens
ggtgtagggaacggcctgag

SEQ ID NO: 5432600 - DNA, 20 bp, Homo sapiens
ggtgtaggggccacctcctc

SEQ ID NO: 5432601 - DNA, 15 bp, Homo sapiens
ggtgtaggtaaatct

SEQ ID NO: 5432602 - DNA, 13 bp, Homo sapiens
ggtgtataaatgt

SEQ ID NO: 5432603 - DNA, 14 bp, Homo sapiens
ggtgtataaatgta

SEQ ID NO: 5432604 - DNA, 13 bp, Homo sapiens
ggtgtatagtgtt

SEQ ID NO: 5432605 - DNA, 19 bp, Homo sapiens
ggtgtatatcatgaagcct

SEQ ID NO: 5432606 - DNA, 16 bp, Homo sapiens
ggtgtatattatataa

SEQ ID NO: 5432607 - DNA, 16 bp, Homo sapiens
ggtgtatggttctgtg

SEQ ID NO: 5432608 - DNA, 20 bp, Homo sapiens
ggtgtcaataaagctgtgct

SEQ ID NO: 5432609 - DNA, 18 bp, Homo sapiens
ggtgtcacagaggcagtg

SEQ ID NO: 5432610 - DNA, 17 bp, Homo sapiens
ggtgtcacatggggcct

SEQ ID NO: 5432611 - DNA, 19 bp, Homo sapiens
ggtgtcacatggtgcccct

SEQ ID NO: 5432612 - DNA, 24 bp, Homo sapiens
ggtgtcacccaaaccggcaggtgc

SEQ ID NO: 5432613 - DNA, 17 bp, Homo sapiens
ggtgtcaccccagagcc

SEQ ID NO: 5432614 - DNA, 22 bp, Homo sapiens
ggtgtcaccccagagccacaca

SEQ ID NO: 5432615 - DNA, 13 bp, Homo sapiens
ggtgtcaccctgc

SEQ ID NO: 5432616 - DNA, 19 bp, Homo sapiens
ggtgtcacggccaggcaga

SEQ ID NO: 5432617 - DNA, 21 bp, Homo sapiens
ggtgtcactgtccctcctggt

SEQ ID NO: 5432618 - DNA, 13 bp, Homo sapiens
ggtgtcagaagct

SEQ ID NO: 5432619 - DNA, 20 bp, Homo sapiens
ggtgtcagccattgcaccca

SEQ ID NO: 5432620 - DNA, 21 bp, Homo sapiens
ggtgtcagcccctcttccctt

SEQ ID NO: 5432621 - DNA, 13 bp, Homo sapiens
ggtgtcaggctgc

SEQ ID NO: 5432622 - DNA, 16 bp, Homo sapiens
ggtgtcaggtcccagc

SEQ ID NO: 5432623 - DNA, 22 bp, Homo sapiens
ggtgtcatctgctccttcctgt

SEQ ID NO: 5432624 - DNA, 23 bp, Homo sapiens
ggtgtcatggctgaagttggcca

SEQ ID NO: 5432625 - DNA, 18 bp, Homo sapiens
ggtgtcattgctgtagga

SEQ ID NO: 5432626 - DNA, 17 bp, Homo sapiens
ggtgtcatttcattcca

SEQ ID NO: 5432627 - DNA, 18 bp, Homo sapiens
ggtgtcatttcattccat

SEQ ID NO: 5432628 - DNA, 20 bp, Homo sapiens
ggtgtccaccatccccagct

SEQ ID NO: 5432629 - DNA, 12 bp, Homo sapiens
ggtgtccagggt

SEQ ID NO: 5432630 - DNA, 15 bp, Homo sapiens
ggtgtcccagtccca

SEQ ID NO: 5432631 - DNA, 18 bp, Homo sapiens
ggtgtcccagtcccagcc

SEQ ID NO: 5432632 - DNA, 19 bp, Homo sapiens
ggtgtcccagtcccagcct

SEQ ID NO: 5432633 - DNA, 20 bp, Homo sapiens
ggtgtcccagtcccagcctc

SEQ ID NO: 5432634 - DNA, 15 bp, Homo sapiens
ggtgtccccaacagc

SEQ ID NO: 5432635 - DNA, 20 bp, Homo sapiens
ggtgtccccaacagcgccca

SEQ ID NO: 5432636 - DNA, 20 bp, Homo sapiens
ggtgtcccctatcctcccct

SEQ ID NO: 5432637 - DNA, 19 bp, Homo sapiens
ggtgtcccctggtgcccct

SEQ ID NO: 5432638 - DNA, 21 bp, Homo sapiens
ggtgtcccctggtgcccctcc

SEQ ID NO: 5432639 - DNA, 17 bp, Homo sapiens
ggtgtccccttcccctg

SEQ ID NO: 5432640 - DNA, 21 bp, Homo sapiens
ggtgtccccttcccctgctga

SEQ ID NO: 5432641 - DNA, 12 bp, Homo sapiens
ggtgtccctgcc

SEQ ID NO: 5432642 - DNA, 13 bp, Homo sapiens
ggtgtccctgcct

SEQ ID NO: 5432643 - DNA, 19 bp, Homo sapiens
ggtgtccctgcctggccct

SEQ ID NO: 5432644 - DNA, 14 bp, Homo sapiens
ggtgtccctgcctt

SEQ ID NO: 5432645 - DNA, 15 bp, Homo sapiens
ggtgtccgccatcca

SEQ ID NO: 5432646 - DNA, 23 bp, Homo sapiens
ggtgtccgccatccagggtctgg

SEQ ID NO: 5432647 - DNA, 13 bp, Homo sapiens
ggtgtcctctgtc

SEQ ID NO: 5432648 - DNA, 15 bp, Homo sapiens
ggtgtcctctgtccg

SEQ ID NO: 5432649 - DNA, 15 bp, Homo sapiens
ggtgtcctgaagctg

SEQ ID NO: 5432650 - DNA, 20 bp, Homo sapiens
ggtgtcctgaagctgctgga

SEQ ID NO: 5432651 - DNA, 12 bp, Homo sapiens
ggtgtcctgacc

SEQ ID NO: 5432652 - DNA, 17 bp, Homo sapiens
ggtgtcctgaccaccct

SEQ ID NO: 5432653 - DNA, 15 bp, Homo sapiens
ggtgtcctgcctgtc

SEQ ID NO: 5432654 - DNA, 21 bp, Homo sapiens
ggtgtcctgcctgtctgcccc

SEQ ID NO: 5432655 - DNA, 12 bp, Homo sapiens
ggtgtccttccc

SEQ ID NO: 5432656 - DNA, 15 bp, Homo sapiens
ggtgtcctttcccct

SEQ ID NO: 5432657 - DNA, 18 bp, Homo sapiens
ggtgtcctttcccctctc

SEQ ID NO: 5432658 - DNA, 22 bp, Homo sapiens
ggtgtcgaggccacattgctgg

SEQ ID NO: 5432659 - DNA, 23 bp, Homo sapiens
ggtgtcgccgcctgctccctgca

SEQ ID NO: 5432660 - DNA, 20 bp, Homo sapiens
ggtgtcgcgccttctccccc

SEQ ID NO: 5432661 - DNA, 15 bp, Homo sapiens
ggtgtctcaggctgc

SEQ ID NO: 5432662 - DNA, 14 bp, Homo sapiens
ggtgtctcccaaca

SEQ ID NO: 5432663 - DNA, 19 bp, Homo sapiens
ggtgtctcccaacatggga

SEQ ID NO: 5432664 - DNA, 13 bp, Homo sapiens
ggtgtctccctcg

SEQ ID NO: 5432665 - DNA, 18 bp, Homo sapiens
ggtgtctctgggcctgtg

SEQ ID NO: 5432666 - DNA, 14 bp, Homo sapiens
ggtgtctctggtct

SEQ ID NO: 5432667 - DNA, 16 bp, Homo sapiens
ggtgtctggaagctga

SEQ ID NO: 5432668 - DNA, 20 bp, Homo sapiens
ggtgtctggaagctgagcag

SEQ ID NO: 5432669 - DNA, 13 bp, Homo sapiens
ggtgtctggcctg

SEQ ID NO: 5432670 - DNA, 23 bp, Homo sapiens
ggtgtctgtgttccaaccactga

SEQ ID NO: 5432671 - DNA, 22 bp, Homo sapiens
ggtgtcttcattttacattgtg

SEQ ID NO: 5432672 - DNA, 20 bp, Homo sapiens
ggtgtcttccctgcctgtgg

SEQ ID NO: 5432673 - DNA, 16 bp, Homo sapiens
ggtgtcttgagaccag

SEQ ID NO: 5432674 - DNA, 23 bp, Homo sapiens
ggtgtcttgagaccagcctgcca

SEQ ID NO: 5432675 - DNA, 15 bp, Homo sapiens
ggtgtctttctcttt

SEQ ID NO: 5432676 - DNA, 21 bp, Homo sapiens
ggtgtcttttccactcctatg

SEQ ID NO: 5432677 - DNA, 16 bp, Homo sapiens
ggtgtgaacccgggag

SEQ ID NO: 5432678 - DNA, 17 bp, Homo sapiens
ggtgtgaacccgggagc

SEQ ID NO: 5432679 - DNA, 20 bp, Homo sapiens
ggtgtgaactaagttattgc

SEQ ID NO: 5432680 - DNA, 13 bp, Homo sapiens
ggtgtgaatgcac

SEQ ID NO: 5432681 - DNA, 19 bp, Homo sapiens
ggtgtgacctgacacctgc

SEQ ID NO: 5432682 - DNA, 15 bp, Homo sapiens
ggtgtgacctgaggg

SEQ ID NO: 5432683 - DNA, 18 bp, Homo sapiens
ggtgtgactcgggagctg

SEQ ID NO: 5432684 - DNA, 23 bp, Homo sapiens
ggtgtgactcgggagctgcacac

SEQ ID NO: 5432685 - DNA, 18 bp, Homo sapiens
ggtgtgagaagtgccttc

SEQ ID NO: 5432686 - DNA, 22 bp, Homo sapiens
ggtgtgagaagtgccttctcct

SEQ ID NO: 5432687 - DNA, 23 bp, Homo sapiens
ggtgtgagatcctctttactctg

SEQ ID NO: 5432688 - DNA, 14 bp, Homo sapiens
ggtgtgagatggtg

SEQ ID NO: 5432689 - DNA, 13 bp, Homo sapiens
ggtgtgagcagca

SEQ ID NO: 5432690 - DNA, 18 bp, Homo sapiens
ggtgtgagcagggtgacc

SEQ ID NO: 5432691 - DNA, 14 bp, Homo sapiens
ggtgtgagccactg

SEQ ID NO: 5432692 - DNA, 14 bp, Homo sapiens
ggtgtgaggagaga

SEQ ID NO: 5432693 - DNA, 15 bp, Homo sapiens
ggtgtgaggagagag

SEQ ID NO: 5432694 - DNA, 12 bp, Homo sapiens
ggtgtgaggcca

SEQ ID NO: 5432695 - DNA, 14 bp, Homo sapiens
ggtgtgaggctggg

SEQ ID NO: 5432696 - DNA, 22 bp, Homo sapiens
ggtgtgagggcagtgcaaggag

SEQ ID NO: 5432697 - DNA, 20 bp, Homo sapiens
ggtgtgagtaattgaggaaa

SEQ ID NO: 5432698 - DNA, 18 bp, Homo sapiens
ggtgtgatcgtctgactg

SEQ ID NO: 5432699 - DNA, 17 bp, Homo sapiens
ggtgtgcaccagggttg

SEQ ID NO: 5432700 - DNA, 19 bp, Homo sapiens
ggtgtgccagaaagtcccc

SEQ ID NO: 5432701 - DNA, 11 bp, Homo sapiens
ggtgtgccctg

SEQ ID NO: 5432702 - DNA, 14 bp, Homo sapiens
ggtgtgccctggct

SEQ ID NO: 5432703 - DNA, 15 bp, Homo sapiens
ggtgtgccctggctc

SEQ ID NO: 5432704 - DNA, 15 bp, Homo sapiens
ggtgtgcctgcagcc

SEQ ID NO: 5432705 - DNA, 19 bp, Homo sapiens
ggtgtgcctgccctggagg

SEQ ID NO: 5432706 - DNA, 15 bp, Homo sapiens
ggtgtgcctgtgctc

SEQ ID NO: 5432707 - DNA, 16 bp, Homo sapiens
ggtgtgcctgtgctcc

SEQ ID NO: 5432708 - DNA, 17 bp, Homo sapiens
ggtttcgaagtcattaa

SEQ ID NO: 5432709 - DNA, 15 bp, Homo sapiens
ggtttcgactggtcc

SEQ ID NO: 5432710 - DNA, 21 bp, Homo sapiens
ggtttcgactggtccagctct

SEQ ID NO: 5432711 - DNA, 16 bp, Homo sapiens
ggtttcgcagcctgag

SEQ ID NO: 5432712 - DNA, 22 bp, Homo sapiens
ggtttctaaagctgccagccga

SEQ ID NO: 5432713 - DNA, 12 bp, Homo sapiens
ggtttctacaac

SEQ ID NO: 5432714 - DNA, 16 bp, Homo sapiens
ggtttctacttcccct

SEQ ID NO: 5432715 - DNA, 18 bp, Homo sapiens
ggtttctacttcccctgg

SEQ ID NO: 5432716 - DNA, 15 bp, Homo sapiens
ggtttctagcctctg

SEQ ID NO: 5432717 - DNA, 21 bp, Homo sapiens
ggtttctagggtgggccccag

SEQ ID NO: 5432718 - DNA, 11 bp, Homo sapiens
ggtttctcaga

SEQ ID NO: 5432719 - DNA, 20 bp, Homo sapiens
ggtttctcagaatccaaaga

SEQ ID NO: 5432720 - DNA, 18 bp, Homo sapiens
ggtttctcattaaactct

SEQ ID NO: 5432721 - DNA, 15 bp, Homo sapiens
ggtttctcattaaag

SEQ ID NO: 5432722 - DNA, 16 bp, Homo sapiens
ggtttctctccctcct

SEQ ID NO: 5432723 - DNA, 20 bp, Homo sapiens
ggtttctctctacagtgcca

SEQ ID NO: 5432724 - DNA, 21 bp, Homo sapiens
ggtttctctgtgctctgaatg

SEQ ID NO: 5432725 - DNA, 13 bp, Homo sapiens
ggtttctgaaaat

SEQ ID NO: 5432726 - DNA, 14 bp, Homo sapiens
ggtttctgattctt

SEQ ID NO: 5432727 - DNA, 18 bp, Homo sapiens
ggtttctggataaaccac

SEQ ID NO: 5432728 - DNA, 16 bp, Homo sapiens
ggtttctgggggctgg

SEQ ID NO: 5432729 - DNA, 13 bp, Homo sapiens
ggtttcttctctg

SEQ ID NO: 5432730 - DNA, 15 bp, Homo sapiens
ggtttcttctctgga

SEQ ID NO: 5432731 - DNA, 22 bp, Homo sapiens
ggtttcttggggtcccagggaa

SEQ ID NO: 5432732 - DNA, 21 bp, Homo sapiens
ggtttcttgtttaccaaagaa

SEQ ID NO: 5432733 - DNA, 15 bp, Homo sapiens
ggtttctttcagatt

SEQ ID NO: 5432734 - DNA, 22 bp, Homo sapiens
ggtttctttcagattttttgaa

SEQ ID NO: 5432735 - DNA, 15 bp, Homo sapiens
ggtttgaaggagaat

SEQ ID NO: 5432736 - DNA, 18 bp, Homo sapiens
ggtttgaatataaacact

SEQ ID NO: 5432737 - DNA, 18 bp, Homo sapiens
ggtttgacaattttgtct

SEQ ID NO: 5432738 - DNA, 13 bp, Homo sapiens
ggtttgagacaga

SEQ ID NO: 5432739 - DNA, 15 bp, Homo sapiens
ggtttgagacagaca

SEQ ID NO: 5432740 - DNA, 20 bp, Homo sapiens
ggtttgagcacaatctgttc

SEQ ID NO: 5432741 - DNA, 13 bp, Homo sapiens
ggtttgagggtgg

SEQ ID NO: 5432742 - DNA, 17 bp, Homo sapiens
ggtttgatcatttctgc

SEQ ID NO: 5432743 - DNA, 18 bp, Homo sapiens
ggtttgatgccaaagcag

SEQ ID NO: 5432744 - DNA, 14 bp, Homo sapiens
ggtttgattgttta

SEQ ID NO: 5432745 - DNA, 14 bp, Homo sapiens
ggtttgcaaggaag

SEQ ID NO: 5432746 - DNA, 11 bp, Homo sapiens
ggtttgcagtt

SEQ ID NO: 5432747 - DNA, 12 bp, Homo sapiens
ggtttgccaagc

SEQ ID NO: 5432748 - DNA, 16 bp, Homo sapiens
ggtttgccagtgaaga

SEQ ID NO: 5432749 - DNA, 19 bp, Homo sapiens
ggtttgcccagtcctgggt

SEQ ID NO: 5432750 - DNA, 13 bp, Homo sapiens
ggtttgccctgcc

SEQ ID NO: 5432751 - DNA, 23 bp, Homo sapiens
ggtttgcgggggtctgagtctat

SEQ ID NO: 5432752 - DNA, 13 bp, Homo sapiens
ggtttgctcagcc

SEQ ID NO: 5432753 - DNA, 14 bp, Homo sapiens
ggtttggaaaacta

SEQ ID NO: 5432754 - DNA, 14 bp, Homo sapiens
ggtttggaaaataa

SEQ ID NO: 5432755 - DNA, 20 bp, Homo sapiens
ggtttggacaaaatggaata

SEQ ID NO: 5432756 - DNA, 19 bp, Homo sapiens
ggtttggaccccagctggg

SEQ ID NO: 5432757 - DNA, 20 bp, Homo sapiens
ggtttggcaagaacttgttt

SEQ ID NO: 5432758 - DNA, 12 bp, Homo sapiens
ggtttggccagg

SEQ ID NO: 5432759 - DNA, 16 bp, Homo sapiens
ggtttggccagggagg

SEQ ID NO: 5432760 - DNA, 14 bp, Homo sapiens
ggtttggcccaaga

SEQ ID NO: 5432761 - DNA, 22 bp, Homo sapiens
ggtttggcccaagactgggctg

SEQ ID NO: 5432762 - DNA, 12 bp, Homo sapiens
ggtttggcctcc

SEQ ID NO: 5432763 - DNA, 17 bp, Homo sapiens
ggtttggctcctgccca

SEQ ID NO: 5432764 - DNA, 16 bp, Homo sapiens
ggtttgggagccagga

SEQ ID NO: 5432765 - DNA, 18 bp, Homo sapiens
ggtttgggcagtggagag

SEQ ID NO: 5432766 - DNA, 19 bp, Homo sapiens
ggtttgggcagtggagagg

SEQ ID NO: 5432767 - DNA, 20 bp, Homo sapiens
ggtttgggccccattcagaa

SEQ ID NO: 5432768 - DNA, 19 bp, Homo sapiens
ggtttgggcccctcagagc

SEQ ID NO: 5432769 - DNA, 19 bp, Homo sapiens
ggtttgggggacgcccagc

SEQ ID NO: 5432770 - DNA, 20 bp, Homo sapiens
ggtttgggggcgccctctct

SEQ ID NO: 5432771 - DNA, 20 bp, Homo sapiens
ggtttgggtgcctcctgcag

SEQ ID NO: 5432772 - DNA, 21 bp, Homo sapiens
ggtttggtacagttcataatt

SEQ ID NO: 5432773 - DNA, 14 bp, Homo sapiens
ggtttggtgctttt

SEQ ID NO: 5432774 - DNA, 15 bp, Homo sapiens
ggtttggtggccagg

SEQ ID NO: 5432775 - DNA, 15 bp, Homo sapiens
ggtttggtgtatggt

SEQ ID NO: 5432776 - DNA, 15 bp, Homo sapiens
ggtttggtttgcttt

SEQ ID NO: 5432777 - DNA, 15 bp, Homo sapiens
ggtttggttttggaa

SEQ ID NO: 5432778 - DNA, 15 bp, Homo sapiens
ggtttgtaaaatgca

SEQ ID NO: 5432779 - DNA, 13 bp, Homo sapiens
ggtttgtatattg

SEQ ID NO: 5432780 - DNA, 13 bp, Homo sapiens
ggtttgtatgaga

SEQ ID NO: 5432781 - DNA, 11 bp, Homo sapiens
ggtttgtcaac

SEQ ID NO: 5432782 - DNA, 17 bp, Homo sapiens
ggtttgtcaacaaaaag

SEQ ID NO: 5432783 - DNA, 13 bp, Homo sapiens
ggtttgtcaacac

SEQ ID NO: 5432784 - DNA, 18 bp, Homo sapiens
ggtttgtggcgtctccct

SEQ ID NO: 5432785 - DNA, 17 bp, Homo sapiens
ggtttgtggggggaggc

SEQ ID NO: 5432786 - DNA, 14 bp, Homo sapiens
ggtttgtgttcttc

SEQ ID NO: 5432787 - DNA, 14 bp, Homo sapiens
ggtttgtgttgagc

SEQ ID NO: 5432788 - DNA, 19 bp, Homo sapiens
ggtttgtgtttgattggct

SEQ ID NO: 5432789 - DNA, 22 bp, Homo sapiens
ggtttgtttagaagaagtgtgt

SEQ ID NO: 5432790 - DNA, 17 bp, Homo sapiens
ggtttgtttataatgtt

SEQ ID NO: 5432791 - DNA, 15 bp, Homo sapiens
ggtttgtttgcttaa

SEQ ID NO: 5432792 - DNA, 18 bp, Homo sapiens
ggtttgtttgcttaattt

SEQ ID NO: 5432793 - DNA, 19 bp, Homo sapiens
ggtttgtttgcttaatttc

SEQ ID NO: 5432794 - DNA, 21 bp, Homo sapiens
ggtttgtttgcttaatttcct

SEQ ID NO: 5432795 - DNA, 20 bp, Homo sapiens
ggttttaaaatactgtagat

SEQ ID NO: 5432796 - DNA, 20 bp, Homo sapiens
ggttttaaacgacttttgtt

SEQ ID NO: 5432797 - DNA, 15 bp, Homo sapiens
ggttttaactttgtt

SEQ ID NO: 5432798 - DNA, 18 bp, Homo sapiens
ggttttaattgaaggaaa

SEQ ID NO: 5432799 - DNA, 18 bp, Homo sapiens
ggttttaccccagctcca

SEQ ID NO: 5432800 - DNA, 20 bp, Homo sapiens
ggttttacttacaaaaatgg

SEQ ID NO: 5432801 - DNA, 17 bp, Homo sapiens
ggttttaggatacttaa

SEQ ID NO: 5432802 - DNA, 21 bp, Homo sapiens
ggttttaggtctcttcccctc

SEQ ID NO: 5432803 - DNA, 16 bp, Homo sapiens
ggttttatactgaagg

SEQ ID NO: 5432804 - DNA, 15 bp, Homo sapiens
ggttttcagagcagg

SEQ ID NO: 5432805 - DNA, 15 bp, Homo sapiens
ggttttcaggggctt

SEQ ID NO: 5432806 - DNA, 12 bp, Homo sapiens
ggttttcatcta

SEQ ID NO: 5432807 - DNA, 23 bp, Homo sapiens
ggttttccttgaccactggccct

SEQ ID NO: 5432808 - DNA, 20 bp, Homo sapiens
ggttttcgtcatcttccctg

SEQ ID NO: 5432809 - DNA, 22 bp, Homo sapiens
ggttttcgtcatcttccctgcc

SEQ ID NO: 5432810 - DNA, 18 bp, Homo sapiens
ggttttctaactgtaaat

SEQ ID NO: 5432811 - DNA, 21 bp, Homo sapiens
ggttttctaactgtaaatcac

SEQ ID NO: 5432812 - DNA, 19 bp, Homo sapiens
ggttttctagcccctctgg

SEQ ID NO: 5432813 - DNA, 14 bp, Homo sapiens
ggttttctggatgg

SEQ ID NO: 5432814 - DNA, 15 bp, Homo sapiens
ggttttctgggtgtc

SEQ ID NO: 5432815 - DNA, 15 bp, Homo sapiens
ggttttctgttactt

SEQ ID NO: 5432816 - DNA, 13 bp, Homo sapiens
ggttttctgttct

SEQ ID NO: 5432817 - DNA, 15 bp, Homo sapiens
ggttttctgttcttt

SEQ ID NO: 5432818 - DNA, 17 bp, Homo sapiens
ggttttcttaaccatct

SEQ ID NO: 5432819 - DNA, 14 bp, Homo sapiens
ggttttcttcccat

SEQ ID NO: 5432820 - DNA, 23 bp, Homo sapiens
ggttttcttgccaccctctggga

SEQ ID NO: 5432821 - DNA, 13 bp, Homo sapiens
ggttttgaaatgt

SEQ ID NO: 5432822 - DNA, 13 bp, Homo sapiens
ggttttgactgga

SEQ ID NO: 5432823 - DNA, 17 bp, Homo sapiens
ggttttgcatgtctgca

SEQ ID NO: 5432824 - DNA, 23 bp, Homo sapiens
ggttttgccatgttggccaggct

SEQ ID NO: 5432825 - DNA, 20 bp, Homo sapiens
ggttttgccccaagtcctca

SEQ ID NO: 5432826 - DNA, 19 bp, Homo sapiens
ggttttgccctccctctct

SEQ ID NO: 5432827 - DNA, 19 bp, Homo sapiens
ggttttgctattagactgt

SEQ ID NO: 5432828 - DNA, 14 bp, Homo sapiens
ggttttggagtcag

SEQ ID NO: 5432829 - DNA, 15 bp, Homo sapiens
ggttttggagtcagt

SEQ ID NO: 5432830 - DNA, 16 bp, Homo sapiens
ggttttggctctccca

SEQ ID NO: 5432831 - DNA, 21 bp, Homo sapiens
ggttttggggaaatgtggaga

SEQ ID NO: 5432832 - DNA, 15 bp, Homo sapiens
ggttttgtaggtact

SEQ ID NO: 5432833 - DNA, 17 bp, Homo sapiens
ggttttgtattctctga

SEQ ID NO: 5432834 - DNA, 21 bp, Homo sapiens
ggttttgtctcctttccactg

SEQ ID NO: 5432835 - DNA, 19 bp, Homo sapiens
ggtttttaaattttgtaat

SEQ ID NO: 5432836 - DNA, 13 bp, Homo sapiens
ggtttttacctgt

SEQ ID NO: 5432837 - DNA, 19 bp, Homo sapiens
ggtttttatatttctcgta

SEQ ID NO: 5432838 - DNA, 11 bp, Homo sapiens
ggtttttatga

SEQ ID NO: 5432839 - DNA, 12 bp, Homo sapiens
ggtttttatgaa

SEQ ID NO: 5432840 - DNA, 13 bp, Homo sapiens
ggtttttattatt

SEQ ID NO: 5432841 - DNA, 18 bp, Homo sapiens
ggtttttatttctccttt

SEQ ID NO: 5432842 - DNA, 15 bp, Homo sapiens
ggtttttcaattaaa

SEQ ID NO: 5432843 - DNA, 16 bp, Homo sapiens
ggtttttcaattaaac

SEQ ID NO: 5432844 - DNA, 16 bp, Homo sapiens
ggtttttccaaactta

SEQ ID NO: 5432845 - DNA, 12 bp, Homo sapiens
ggtttttctctt

SEQ ID NO: 5432846 - DNA, 23 bp, Homo sapiens
ggtttttgtttgtttcctttgtt

SEQ ID NO: 5432847 - DNA, 17 bp, Homo sapiens
ggttttttaaaaggaaa

SEQ ID NO: 5432848 - DNA, 14 bp, Homo sapiens
ggttttttagttga

SEQ ID NO: 5432849 - DNA, 14 bp, Homo sapiens
ggttttttccccct

SEQ ID NO: 5432850 - DNA, 19 bp, Homo sapiens
ggtttttttcctgtttctg

SEQ ID NO: 5432851 - DNA, 20 bp, Homo sapiens
ggtttttttctttggctgca

SEQ ID NO: 5432852 - DNA, 19 bp, Homo sapiens
ggttttttttaatgtgaat

SEQ ID NO: 5432853 - DNA, 18 bp, Homo sapiens
ggttttttttttttcctt

SEQ ID NO: 5432854 - DNA, 16 bp, Homo sapiens
gtaaaaaaaaaaaagt

SEQ ID NO: 5432855 - DNA, 19 bp, Homo sapiens
gtaaaaaaaaatgcctttg

SEQ ID NO: 5432856 - DNA, 13 bp, Homo sapiens
gtaaaaaaaagaa

SEQ ID NO: 5432857 - DNA, 14 bp, Homo sapiens
gtaaaaaaaagaag

SEQ ID NO: 5432858 - DNA, 22 bp, Homo sapiens
gtaaaaaaatagaaaaaaagaa

SEQ ID NO: 5432859 - DNA, 12 bp, Homo sapiens
gtaaaaaacaaa

SEQ ID NO: 5432860 - DNA, 13 bp, Homo sapiens
gtaaaaaacaaaa

SEQ ID NO: 5432861 - DNA, 15 bp, Homo sapiens
gtaaaaaacaaaaaa

SEQ ID NO: 5432862 - DNA, 23 bp, Homo sapiens
gtaaaaaacaaaaaaaacaacaa

SEQ ID NO: 5432863 - DNA, 15 bp, Homo sapiens
gtaaaaaagaaatga

SEQ ID NO: 5432864 - DNA, 13 bp, Homo sapiens
gtaaaaaagtgtt

SEQ ID NO: 5432865 - DNA, 19 bp, Homo sapiens
gtaaaaaagttaaatgtgt

SEQ ID NO: 5432866 - DNA, 11 bp, Homo sapiens
gtaaaaaatgg

SEQ ID NO: 5432867 - DNA, 18 bp, Homo sapiens
gtaaaaaatggtgtttta

SEQ ID NO: 5432868 - DNA, 22 bp, Homo sapiens
gtaaaaaatgtctcatgtcaat

SEQ ID NO: 5432869 - DNA, 17 bp, Homo sapiens
gtaaaaaattaaagccc

SEQ ID NO: 5432870 - DNA, 15 bp, Homo sapiens
gtaaaaaattcacat

SEQ ID NO: 5432871 - DNA, 23 bp, Homo sapiens
gtaaaaaatttaaaaagcccaac

SEQ ID NO: 5432872 - DNA, 19 bp, Homo sapiens
gtaaaaacagcattgcttt

SEQ ID NO: 5432873 - DNA, 17 bp, Homo sapiens
gtaaaaactagaaggct

SEQ ID NO: 5432874 - DNA, 13 bp, Homo sapiens
gtaaaaagacaaa

SEQ ID NO: 5432875 - DNA, 23 bp, Homo sapiens
gtaaaaagactactggcctctgt

SEQ ID NO: 5432876 - DNA, 20 bp, Homo sapiens
gtaaaaagattatatatcat

SEQ ID NO: 5432877 - DNA, 11 bp, Homo sapiens
gtaaaaagctt

SEQ ID NO: 5432878 - DNA, 18 bp, Homo sapiens
gtaaaaaggggaggagaa

SEQ ID NO: 5432879 - DNA, 18 bp, Homo sapiens
gtaaaaataaaatacttt

SEQ ID NO: 5432880 - DNA, 12 bp, Homo sapiens
gtaaaaatacaa

SEQ ID NO: 5432881 - DNA, 14 bp, Homo sapiens
gtaaaaatacacta

SEQ ID NO: 5432882 - DNA, 14 bp, Homo sapiens
gtaaaaatttaatt

SEQ ID NO: 5432883 - DNA, 12 bp, Homo sapiens
gtaaaacaaaaa

SEQ ID NO: 5432884 - DNA, 22 bp, Homo sapiens
gtaaaacaataataataataaa

SEQ ID NO: 5432885 - DNA, 19 bp, Homo sapiens
gtaaaacaatgccatgaac

SEQ ID NO: 5432886 - DNA, 20 bp, Homo sapiens
gtaaaacaatgccatgaaca

SEQ ID NO: 5432887 - DNA, 20 bp, Homo sapiens
gtaaaacacaccaatcagcg

SEQ ID NO: 5432888 - DNA, 13 bp, Homo sapiens
gtaacaatgtttg

SEQ ID NO: 5432889 - DNA, 19 bp, Homo sapiens
gtaacacataaacaattca

SEQ ID NO: 5432890 - DNA, 18 bp, Homo sapiens
gtaacacataaagtaaat

SEQ ID NO: 5432891 - DNA, 20 bp, Homo sapiens
gtaacacgggaatcacaggt

SEQ ID NO: 5432892 - DNA, 15 bp, Homo sapiens
gtaacactaatatat

SEQ ID NO: 5432893 - DNA, 20 bp, Homo sapiens
gtaacactaatatatttaaa

SEQ ID NO: 5432894 - DNA, 12 bp, Homo sapiens
gtaacactacag

SEQ ID NO: 5432895 - DNA, 16 bp, Homo sapiens
gtaacactgcaagaag

SEQ ID NO: 5432896 - DNA, 16 bp, Homo sapiens
gtaacactggccagcg

SEQ ID NO: 5432897 - DNA, 22 bp, Homo sapiens
gtaacactggccttcccttctc

SEQ ID NO: 5432898 - DNA, 20 bp, Homo sapiens
gtaacactgtgatttatctt

SEQ ID NO: 5432899 - DNA, 18 bp, Homo sapiens
gtaacacttgaaaagtgt

SEQ ID NO: 5432900 - DNA, 15 bp, Homo sapiens
gtaacagaaagggca

SEQ ID NO: 5432901 - DNA, 21 bp, Homo sapiens
gtaacagaaagggcaacaata

SEQ ID NO: 5432902 - DNA, 21 bp, Homo sapiens
gtaacagaacagcttcaggtt

SEQ ID NO: 5432903 - DNA, 14 bp, Homo sapiens
gtaacagacattgt

SEQ ID NO: 5432904 - DNA, 16 bp, Homo sapiens
gtaacagacattgttt

SEQ ID NO: 5432905 - DNA, 14 bp, Homo sapiens
gtaacagatttgct

SEQ ID NO: 5432906 - DNA, 13 bp, Homo sapiens
gtaacagctcctt

SEQ ID NO: 5432907 - DNA, 22 bp, Homo sapiens
gtaacagctctcttcttactca

SEQ ID NO: 5432908 - DNA, 20 bp, Homo sapiens
gtaacaggaaaattttaaaa

SEQ ID NO: 5432909 - DNA, 15 bp, Homo sapiens
gtaacagggcagaaa

SEQ ID NO: 5432910 - DNA, 15 bp, Homo sapiens
gtaacagtattcagt

SEQ ID NO: 5432911 - DNA, 18 bp, Homo sapiens
gtaacagtcatcatttat

SEQ ID NO: 5432912 - DNA, 15 bp, Homo sapiens
gtaacagtgtaaagt

SEQ ID NO: 5432913 - DNA, 16 bp, Homo sapiens
gtaacagttggtgatt

SEQ ID NO: 5432914 - DNA, 14 bp, Homo sapiens
gtaacataataaat

SEQ ID NO: 5432915 - DNA, 19 bp, Homo sapiens
gtaacatagatgcctgggc

SEQ ID NO: 5432916 - DNA, 22 bp, Homo sapiens
gtaacatagatgcctgggcctg

SEQ ID NO: 5432917 - DNA, 17 bp, Homo sapiens
gtaacatagctgtgatt

SEQ ID NO: 5432918 - DNA, 13 bp, Homo sapiens
gtaacatataaat

SEQ ID NO: 5432919 - DNA, 21 bp, Homo sapiens
gtaacatataaattaatacat

SEQ ID NO: 5432920 - DNA, 15 bp, Homo sapiens
gtaacatatgcaaac

SEQ ID NO: 5432921 - DNA, 14 bp, Homo sapiens
gtaacatatttctt

SEQ ID NO: 5432922 - DNA, 15 bp, Homo sapiens
gtaacatcaagccat

SEQ ID NO: 5432923 - DNA, 11 bp, Homo sapiens
gtaacatcctt

SEQ ID NO: 5432924 - DNA, 17 bp, Homo sapiens
gtaacatcctttctatt

SEQ ID NO: 5432925 - DNA, 21 bp, Homo sapiens
gtaacatgacttccttatttc

SEQ ID NO: 5432926 - DNA, 15 bp, Homo sapiens
gtaacatgcaacaaa

SEQ ID NO: 5432927 - DNA, 20 bp, Homo sapiens
gtaacatgcatactttattg

SEQ ID NO: 5432928 - DNA, 16 bp, Homo sapiens
gtaacattataaatga

SEQ ID NO: 5432929 - DNA, 23 bp, Homo sapiens
gtaacattgggtcctgggtcttt

SEQ ID NO: 5432930 - DNA, 14 bp, Homo sapiens
gtaacattgtaaag

SEQ ID NO: 5432931 - DNA, 15 bp, Homo sapiens
gtaacatttctgttc

SEQ ID NO: 5432932 - DNA, 20 bp, Homo sapiens
gtaacatttggagtgtgtat

SEQ ID NO: 5432933 - DNA, 20 bp, Homo sapiens
gtaaccaagagttaagatat

SEQ ID NO: 5432934 - DNA, 15 bp, Homo sapiens
gtaaccaaggccctg

SEQ ID NO: 5432935 - DNA, 20 bp, Homo sapiens
gtaaccaaggccctgtctct

SEQ ID NO: 5432936 - DNA, 23 bp, Homo sapiens
gtaaccagccacagtacatatgt

SEQ ID NO: 5432937 - DNA, 12 bp, Homo sapiens
gtaaccagccag

SEQ ID NO: 5432938 - DNA, 13 bp, Homo sapiens
gtaaccagccaga

SEQ ID NO: 5432939 - DNA, 20 bp, Homo sapiens
gtaaccagccagatcctctt

SEQ ID NO: 5432940 - DNA, 16 bp, Homo sapiens
gtaaccagctcagtgt

SEQ ID NO: 5432941 - DNA, 17 bp, Homo sapiens
gtaaccagctcagtgtt

SEQ ID NO: 5432942 - DNA, 20 bp, Homo sapiens
gtaaccaggccccagcctcc

SEQ ID NO: 5432943 - DNA, 16 bp, Homo sapiens
gtaaccagttataaat

SEQ ID NO: 5432944 - DNA, 19 bp, Homo sapiens
gtaacccattaaaatgaat

SEQ ID NO: 5432945 - DNA, 21 bp, Homo sapiens
gtaaccccatactctcctttt

SEQ ID NO: 5432946 - DNA, 21 bp, Homo sapiens
gtaaccgagccagcagctgaa

SEQ ID NO: 5432947 - DNA, 15 bp, Homo sapiens
gtaaccgtggctggt

SEQ ID NO: 5432948 - DNA, 23 bp, Homo sapiens
gtaacctaccccatgaagatatt

SEQ ID NO: 5432949 - DNA, 17 bp, Homo sapiens
gtaacctcaaactctgg

SEQ ID NO: 5432950 - DNA, 12 bp, Homo sapiens
gtaacctcagct

SEQ ID NO: 5432951 - DNA, 15 bp, Homo sapiens
gtaacctcagctctg

SEQ ID NO: 5432952 - DNA, 17 bp, Homo sapiens
gtaacctcagctctggg

SEQ ID NO: 5432953 - DNA, 19 bp, Homo sapiens
gtaacctcagtatttatgt

SEQ ID NO: 5432954 - DNA, 17 bp, Homo sapiens
gtaacctctacaggcat

SEQ ID NO: 5432955 - DNA, 18 bp, Homo sapiens
gtaacctctacaggcatt

SEQ ID NO: 5432956 - DNA, 18 bp, Homo sapiens
gtaacctgaagttttatg

SEQ ID NO: 5432957 - DNA, 17 bp, Homo sapiens
gtaacctggccactgtc

SEQ ID NO: 5432958 - DNA, 15 bp, Homo sapiens
gtaacctttaaaaat

SEQ ID NO: 5432959 - DNA, 23 bp, Homo sapiens
gtaacgaacccctagaaaggaga

SEQ ID NO: 5432960 - DNA, 21 bp, Homo sapiens
gtaacgagggcaacagggagc

SEQ ID NO: 5432961 - DNA, 14 bp, Homo sapiens
gtaacgtgcactgt

SEQ ID NO: 5432962 - DNA, 22 bp, Homo sapiens
gtaactaaaataattttgtaat

SEQ ID NO: 5432963 - DNA, 17 bp, Homo sapiens
gtaactaactaaaacaa

SEQ ID NO: 5432964 - DNA, 15 bp, Homo sapiens
gtaactaatgttatt

SEQ ID NO: 5432965 - DNA, 15 bp, Homo sapiens
gtaactaattttgtt

SEQ ID NO: 5432966 - DNA, 20 bp, Homo sapiens
gtaactacaaagctttgcta

SEQ ID NO: 5432967 - DNA, 17 bp, Homo sapiens
gtaactactgctaatgt

SEQ ID NO: 5432968 - DNA, 19 bp, Homo sapiens
gtaactactgctaatgttg

SEQ ID NO: 5432969 - DNA, 17 bp, Homo sapiens
gtaactactttttatac

SEQ ID NO: 5432970 - DNA, 19 bp, Homo sapiens
gtaactactttttatactc

SEQ ID NO: 5432971 - DNA, 19 bp, Homo sapiens
gtaactagaccatttttaa

SEQ ID NO: 5432972 - DNA, 14 bp, Homo sapiens
gtaactataacaaa

SEQ ID NO: 5432973 - DNA, 16 bp, Homo sapiens
gtaactataacaaaaa

SEQ ID NO: 5432974 - DNA, 14 bp, Homo sapiens
gtaactattcttca

SEQ ID NO: 5432975 - DNA, 15 bp, Homo sapiens
gtaactattgaattg

SEQ ID NO: 5432976 - DNA, 22 bp, Homo sapiens
gtaactcaccgtgctgtcttct

SEQ ID NO: 5432977 - DNA, 15 bp, Homo sapiens
gtaactcatctgtca

SEQ ID NO: 5432978 - DNA, 13 bp, Homo sapiens
gtaactcatttgg

SEQ ID NO: 5432979 - DNA, 20 bp, Homo sapiens
gtaactcccatatctccttt

SEQ ID NO: 5432980 - DNA, 19 bp, Homo sapiens
gtaactctaattcccattt

SEQ ID NO: 5432981 - DNA, 23 bp, Homo sapiens
gtaactctaattcccattttgca

SEQ ID NO: 5432982 - DNA, 12 bp, Homo sapiens
gtaactctccag

SEQ ID NO: 5432983 - DNA, 12 bp, Homo sapiens
gtaactctttgg

SEQ ID NO: 5432984 - DNA, 19 bp, Homo sapiens
gtaactgaagcataaacat

SEQ ID NO: 5432985 - DNA, 13 bp, Homo sapiens
gtaactgacaact

SEQ ID NO: 5432986 - DNA, 13 bp, Homo sapiens
gtaactgacatga

SEQ ID NO: 5432987 - DNA, 15 bp, Homo sapiens
gtaactgagaatttg

SEQ ID NO: 5432988 - DNA, 21 bp, Homo sapiens
gtaactgaggcttagaaaggt

SEQ ID NO: 5432989 - DNA, 23 bp, Homo sapiens
gtaactgcacctgggcagctcct

SEQ ID NO: 5432990 - DNA, 12 bp, Homo sapiens
gtaactgccagc

SEQ ID NO: 5432991 - DNA, 22 bp, Homo sapiens
gtaactgccattttttgtctgt

SEQ ID NO: 5432992 - DNA, 13 bp, Homo sapiens
gtaactgcccagc

SEQ ID NO: 5432993 - DNA, 18 bp, Homo sapiens
gtaactgcccagcccctt

SEQ ID NO: 5432994 - DNA, 21 bp, Homo sapiens
gtaactgcccttttaaatggc

SEQ ID NO: 5432995 - DNA, 22 bp, Homo sapiens
gtaactgcccttttaaatggca

SEQ ID NO: 5432996 - DNA, 23 bp, Homo sapiens
gtaactgcccttttaaatggcat

SEQ ID NO: 5432997 - DNA, 16 bp, Homo sapiens
gtaactgcctagaaac

SEQ ID NO: 5432998 - DNA, 22 bp, Homo sapiens
gtaactgctcttgggcaatatt

SEQ ID NO: 5432999 - DNA, 14 bp, Homo sapiens
gtaactgctgagcc

SEQ ID NO: 5433000 - DNA, 17 bp, Homo sapiens
gtaactgctgagccact

SEQ ID NO: 5433001 - DNA, 14 bp, Homo sapiens
gtaactgctttctg

SEQ ID NO: 5433002 - DNA, 12 bp, Homo sapiens
gtaactggaaca

SEQ ID NO: 5433003 - DNA, 13 bp, Homo sapiens
gtaactggctgct

SEQ ID NO: 5433004 - DNA, 15 bp, Homo sapiens
gtaactggctgctcc

SEQ ID NO: 5433005 - DNA, 20 bp, Homo sapiens
gtaactggctttcctgctgg

SEQ ID NO: 5433006 - DNA, 22 bp, Homo sapiens
gtaactggtagtgttcagtaaa

SEQ ID NO: 5433007 - DNA, 15 bp, Homo sapiens
gtaactggttgctgt

SEQ ID NO: 5433008 - DNA, 18 bp, Homo sapiens
gtaactgtcaagtcatga

SEQ ID NO: 5433009 - DNA, 19 bp, Homo sapiens
gtaactgtccctgctttct

SEQ ID NO: 5433010 - DNA, 14 bp, Homo sapiens
gtaactgtgtcatg

SEQ ID NO: 5433011 - DNA, 22 bp, Homo sapiens
gtaactgttaaattgctgtgta

SEQ ID NO: 5433012 - DNA, 19 bp, Homo sapiens
gtaactgttctttgcagtg

SEQ ID NO: 5433013 - DNA, 16 bp, Homo sapiens
gtaactgttttttaag

SEQ ID NO: 5433014 - DNA, 12 bp, Homo sapiens
gtaacttaaata

SEQ ID NO: 5433015 - DNA, 16 bp, Homo sapiens
gtaacttaaccagcac

SEQ ID NO: 5433016 - DNA, 22 bp, Homo sapiens
gtaacttaattataagctatgt

SEQ ID NO: 5433017 - DNA, 23 bp, Homo sapiens
gtaacttaattttgtgaccacag

SEQ ID NO: 5433018 - DNA, 15 bp, Homo sapiens
gtaacttacacctgg

SEQ ID NO: 5433019 - DNA, 14 bp, Homo sapiens
gtaacttagaaaag

SEQ ID NO: 5433020 - DNA, 14 bp, Homo sapiens
gtaacttagcttta

SEQ ID NO: 5433021 - DNA, 14 bp, Homo sapiens
gtaacttatattga

SEQ ID NO: 5433022 - DNA, 19 bp, Homo sapiens
gtaacttatattgaagaca

SEQ ID NO: 5433023 - DNA, 15 bp, Homo sapiens
gtaacttatgtagat

SEQ ID NO: 5433024 - DNA, 13 bp, Homo sapiens
gtaacttatttga

SEQ ID NO: 5433025 - DNA, 11 bp, Homo sapiens
gtaacttcaaa

SEQ ID NO: 5433026 - DNA, 20 bp, Homo sapiens
gtaacttcacattaaaaaat

SEQ ID NO: 5433027 - DNA, 18 bp, Homo sapiens
gtaacttcagatgtttcc

SEQ ID NO: 5433028 - DNA, 18 bp, Homo sapiens
gtaacttccaaataaata

SEQ ID NO: 5433029 - DNA, 12 bp, Homo sapiens
gtaacttcctgc

SEQ ID NO: 5433030 - DNA, 14 bp, Homo sapiens
gtaacttcctgctg

SEQ ID NO: 5433031 - DNA, 15 bp, Homo sapiens
gtaacttcctgctgc

SEQ ID NO: 5433032 - DNA, 19 bp, Homo sapiens
gtaacttgctgtgaaatga

SEQ ID NO: 5433033 - DNA, 20 bp, Homo sapiens
gtaacttgcttaaatttctt

SEQ ID NO: 5433034 - DNA, 18 bp, Homo sapiens
gtaacttggatgtagcca

SEQ ID NO: 5433035 - DNA, 19 bp, Homo sapiens
gtaacttgggctgtaaagc

SEQ ID NO: 5433036 - DNA, 16 bp, Homo sapiens
gtaacttggttataca

SEQ ID NO: 5433037 - DNA, 14 bp, Homo sapiens
gtaactttaaacat

SEQ ID NO: 5433038 - DNA, 15 bp, Homo sapiens
gtaactttaaacatc

SEQ ID NO: 5433039 - DNA, 11 bp, Homo sapiens
gtaactttatg

SEQ ID NO: 5433040 - DNA, 21 bp, Homo sapiens
gtaactttattggtcttgccc

SEQ ID NO: 5433041 - DNA, 14 bp, Homo sapiens
gtaactttctctta

SEQ ID NO: 5433042 - DNA, 13 bp, Homo sapiens
gtaacttttaaaa

SEQ ID NO: 5433043 - DNA, 18 bp, Homo sapiens
gtaacttttacaaaacat

SEQ ID NO: 5433044 - DNA, 12 bp, Homo sapiens
gtaacttttagt

SEQ ID NO: 5433045 - DNA, 19 bp, Homo sapiens
gtaacttttgtaaatacac

SEQ ID NO: 5433046 - DNA, 17 bp, Homo sapiens
gtaacttttgtaagaca

SEQ ID NO: 5433047 - DNA, 20 bp, Homo sapiens
gtaactttttacattacaga

SEQ ID NO: 5433048 - DNA, 19 bp, Homo sapiens
gtaacttttttattttaag

SEQ ID NO: 5433049 - DNA, 16 bp, Homo sapiens
gtaactttttttcagt

SEQ ID NO: 5433050 - DNA, 18 bp, Homo sapiens
gtaactttttttcagttc

SEQ ID NO: 5433051 - DNA, 13 bp, Homo sapiens
gtaagaaaaccaa

SEQ ID NO: 5433052 - DNA, 18 bp, Homo sapiens
gtaagaaaccgaggcgat

SEQ ID NO: 5433053 - DNA, 17 bp, Homo sapiens
gtaagaaagaaggcaaa

SEQ ID NO: 5433054 - DNA, 20 bp, Homo sapiens
gtaagaaagtgaagcaaatc

SEQ ID NO: 5433055 - DNA, 14 bp, Homo sapiens
gtaagaaatgtata

SEQ ID NO: 5433056 - DNA, 16 bp, Homo sapiens
gtaagaaatttctagt

SEQ ID NO: 5433057 - DNA, 20 bp, Homo sapiens
gtaagaacatccctgtctta

SEQ ID NO: 5433058 - DNA, 21 bp, Homo sapiens
gtaagaacgtgcttgtggaag

SEQ ID NO: 5433059 - DNA, 13 bp, Homo sapiens
gtaagaactgtac

SEQ ID NO: 5433060 - DNA, 16 bp, Homo sapiens
gtaagaactgtacatt

SEQ ID NO: 5433061 - DNA, 11 bp, Homo sapiens
gtaagaagaaa

SEQ ID NO: 5433062 - DNA, 16 bp, Homo sapiens
gtaagaagaaactgct

SEQ ID NO: 5433063 - DNA, 14 bp, Homo sapiens
gtaagaagaaagca

SEQ ID NO: 5433064 - DNA, 16 bp, Homo sapiens
gtaagaagacaaactg

SEQ ID NO: 5433065 - DNA, 13 bp, Homo sapiens
gtaagaagagact

SEQ ID NO: 5433066 - DNA, 15 bp, Homo sapiens
gtaagaagaggagcc

SEQ ID NO: 5433067 - DNA, 18 bp, Homo sapiens
gtaagaagaggagcctca

SEQ ID NO: 5433068 - DNA, 22 bp, Homo sapiens
gtatagattataaaattatttt

SEQ ID NO: 5433069 - DNA, 18 bp, Homo sapiens
gtatagcatgcatctgtt

SEQ ID NO: 5433070 - DNA, 20 bp, Homo sapiens
gtatagcatgcatctgttta

SEQ ID NO: 5433071 - DNA, 18 bp, Homo sapiens
gtatagctgcttccagtg

SEQ ID NO: 5433072 - DNA, 16 bp, Homo sapiens
gtataggaatttgtat

SEQ ID NO: 5433073 - DNA, 18 bp, Homo sapiens
gtatagggaattttcatt

SEQ ID NO: 5433074 - DNA, 22 bp, Homo sapiens
gtatagggaattttcattttca

SEQ ID NO: 5433075 - DNA, 20 bp, Homo sapiens
gtataggggaaaatattatt

SEQ ID NO: 5433076 - DNA, 18 bp, Homo sapiens
gtataggtagatccagat

SEQ ID NO: 5433077 - DNA, 21 bp, Homo sapiens
gtataggtctcaatatttatt

SEQ ID NO: 5433078 - DNA, 14 bp, Homo sapiens
gtatagtaatcatt

SEQ ID NO: 5433079 - DNA, 19 bp, Homo sapiens
gtatagtactggcatggta

SEQ ID NO: 5433080 - DNA, 14 bp, Homo sapiens
gtatagtagaaaga

SEQ ID NO: 5433081 - DNA, 13 bp, Homo sapiens
gtatagtgtaaaa

SEQ ID NO: 5433082 - DNA, 21 bp, Homo sapiens
gtatagtgtctattatcacat

SEQ ID NO: 5433083 - DNA, 16 bp, Homo sapiens
gtatagtgttcacaaa

SEQ ID NO: 5433084 - DNA, 18 bp, Homo sapiens
gtatagtgttcacaaact

SEQ ID NO: 5433085 - DNA, 20 bp, Homo sapiens
gtatagttcacttactctta

SEQ ID NO: 5433086 - DNA, 13 bp, Homo sapiens
gtatataaaatgt

SEQ ID NO: 5433087 - DNA, 21 bp, Homo sapiens
gtatataaatacatgcacaca

SEQ ID NO: 5433088 - DNA, 13 bp, Homo sapiens
gtatataaatggg

SEQ ID NO: 5433089 - DNA, 13 bp, Homo sapiens
gtatataagctgt

SEQ ID NO: 5433090 - DNA, 14 bp, Homo sapiens
gtatataagctgtt

SEQ ID NO: 5433091 - DNA, 19 bp, Homo sapiens
gtatataatactaaagtgt

SEQ ID NO: 5433092 - DNA, 21 bp, Homo sapiens
gtatataatactaaagtgtct

SEQ ID NO: 5433093 - DNA, 12 bp, Homo sapiens
gtatataatttt

SEQ ID NO: 5433094 - DNA, 14 bp, Homo sapiens
gtatatacacacat

SEQ ID NO: 5433095 - DNA, 13 bp, Homo sapiens
gtatatacacata

SEQ ID NO: 5433096 - DNA, 15 bp, Homo sapiens
gtatatacacatata

SEQ ID NO: 5433097 - DNA, 23 bp, Homo sapiens
gtatatacacccaagatgggcat

SEQ ID NO: 5433098 - DNA, 21 bp, Homo sapiens
gtatatacagagcctgtttta

SEQ ID NO: 5433099 - DNA, 16 bp, Homo sapiens
gtatatacagttattt

SEQ ID NO: 5433100 - DNA, 18 bp, Homo sapiens
gtatatacagttattttg

SEQ ID NO: 5433101 - DNA, 16 bp, Homo sapiens
gtatatacgcatctat

SEQ ID NO: 5433102 - DNA, 20 bp, Homo sapiens
gtatatactatacaacaatg

SEQ ID NO: 5433103 - DNA, 19 bp, Homo sapiens
gtatatacttaagaataca

SEQ ID NO: 5433104 - DNA, 16 bp, Homo sapiens
gtatatacttcactca

SEQ ID NO: 5433105 - DNA, 17 bp, Homo sapiens
gtatatactttgccact

SEQ ID NO: 5433106 - DNA, 18 bp, Homo sapiens
gtatatactttgccactg

SEQ ID NO: 5433107 - DNA, 20 bp, Homo sapiens
gtatatactttgccactgct

SEQ ID NO: 5433108 - DNA, 14 bp, Homo sapiens
gtatatagatgtgc

SEQ ID NO: 5433109 - DNA, 16 bp, Homo sapiens
gtatatagtatattta

SEQ ID NO: 5433110 - DNA, 20 bp, Homo sapiens
gtatatagtatatttatact

SEQ ID NO: 5433111 - DNA, 22 bp, Homo sapiens
gtatatagtatatttatactct

SEQ ID NO: 5433112 - DNA, 23 bp, Homo sapiens
gtatatataaacagaactccctt

SEQ ID NO: 5433113 - DNA, 11 bp, Homo sapiens
gtatatataca

SEQ ID NO: 5433114 - DNA, 13 bp, Homo sapiens
gtatatatacata

SEQ ID NO: 5433115 - DNA, 14 bp, Homo sapiens
gtatatatacataa

SEQ ID NO: 5433116 - DNA, 17 bp, Homo sapiens
gtatatatacataacag

SEQ ID NO: 5433117 - DNA, 17 bp, Homo sapiens
gtatatatatatgtgtg

SEQ ID NO: 5433118 - DNA, 21 bp, Homo sapiens
gtatatatatgccatgatgga

SEQ ID NO: 5433119 - DNA, 15 bp, Homo sapiens
gtatatatattctca

SEQ ID NO: 5433120 - DNA, 12 bp, Homo sapiens
gtatatatcagg

SEQ ID NO: 5433121 - DNA, 18 bp, Homo sapiens
gtatatatcaggtaaaat

SEQ ID NO: 5433122 - DNA, 21 bp, Homo sapiens
gtatatatctattattcaaaa

SEQ ID NO: 5433123 - DNA, 19 bp, Homo sapiens
gtatatatcttataactgt

SEQ ID NO: 5433124 - DNA, 16 bp, Homo sapiens
gtatatatgtgtatat

SEQ ID NO: 5433125 - DNA, 13 bp, Homo sapiens
gtatatatgtgtg

SEQ ID NO: 5433126 - DNA, 19 bp, Homo sapiens
gtatatattatatatacat

SEQ ID NO: 5433127 - DNA, 20 bp, Homo sapiens
gtatatattatatatacatt

SEQ ID NO: 5433128 - DNA, 13 bp, Homo sapiens
gtatatattccca

SEQ ID NO: 5433129 - DNA, 11 bp, Homo sapiens
gtatatattta

SEQ ID NO: 5433130 - DNA, 14 bp, Homo sapiens
gtatatatttatta

SEQ ID NO: 5433131 - DNA, 16 bp, Homo sapiens
gtatatattttatatg

SEQ ID NO: 5433132 - DNA, 14 bp, Homo sapiens
gtatatattttgaa

SEQ ID NO: 5433133 - DNA, 22 bp, Homo sapiens
gtatatattttgtgtgaaattg

SEQ ID NO: 5433134 - DNA, 20 bp, Homo sapiens
gtatatcactaaaagcatga

SEQ ID NO: 5433135 - DNA, 13 bp, Homo sapiens
gtatatcattcta

SEQ ID NO: 5433136 - DNA, 18 bp, Homo sapiens
gtatatcctatataggaa

SEQ ID NO: 5433137 - DNA, 14 bp, Homo sapiens
gtatatccttttct

SEQ ID NO: 5433138 - DNA, 19 bp, Homo sapiens
gtatatctaagactcatcc

SEQ ID NO: 5433139 - DNA, 20 bp, Homo sapiens
gtatatctcttggaaaataa

SEQ ID NO: 5433140 - DNA, 22 bp, Homo sapiens
gtatatctcttggaaaataaga

SEQ ID NO: 5433141 - DNA, 17 bp, Homo sapiens
gtatatctggacaagcc

SEQ ID NO: 5433142 - DNA, 18 bp, Homo sapiens
gtatatctggacaagcca

SEQ ID NO: 5433143 - DNA, 22 bp, Homo sapiens
gtatatgaaaacaagttccaaa

SEQ ID NO: 5433144 - DNA, 19 bp, Homo sapiens
gtatatgactgcatttgtg

SEQ ID NO: 5433145 - DNA, 20 bp, Homo sapiens
gtatatgactgcatttgtgt

SEQ ID NO: 5433146 - DNA, 16 bp, Homo sapiens
gtatatgattctctgt

SEQ ID NO: 5433147 - DNA, 18 bp, Homo sapiens
gtatatgattctctgtgg

SEQ ID NO: 5433148 - DNA, 21 bp, Homo sapiens
gtatatggcttcaagttgtaa

SEQ ID NO: 5433149 - DNA, 19 bp, Homo sapiens
gtatatgggcttttacctg

SEQ ID NO: 5433150 - DNA, 19 bp, Homo sapiens
gtatatggtatatatacat

SEQ ID NO: 5433151 - DNA, 15 bp, Homo sapiens
gtatatggtggtaat

SEQ ID NO: 5433152 - DNA, 15 bp, Homo sapiens
gtatatgtaacagtt

SEQ ID NO: 5433153 - DNA, 18 bp, Homo sapiens
gtatatgtataaattaat

SEQ ID NO: 5433154 - DNA, 14 bp, Homo sapiens
gtatatgtatatat

SEQ ID NO: 5433155 - DNA, 17 bp, Homo sapiens
gtatatgtatatctata

SEQ ID NO: 5433156 - DNA, 16 bp, Homo sapiens
gtatatgtatgtgtgt

SEQ ID NO: 5433157 - DNA, 17 bp, Homo sapiens
gtatatgtatgtgtgta

SEQ ID NO: 5433158 - DNA, 12 bp, Homo sapiens
gtatatgtattc

SEQ ID NO: 5433159 - DNA, 13 bp, Homo sapiens
gtatatgtattcc

SEQ ID NO: 5433160 - DNA, 21 bp, Homo sapiens
gtatatgtattcccttgtatt

SEQ ID NO: 5433161 - DNA, 24 bp, Homo sapiens
gtatatgtatttaagatgtacatt

SEQ ID NO: 5433162 - DNA, 22 bp, Homo sapiens
gtatatgtcaagccataattgt

SEQ ID NO: 5433163 - DNA, 14 bp, Homo sapiens
gtatatgtcattat

SEQ ID NO: 5433164 - DNA, 22 bp, Homo sapiens
gtatatgtcattatttattgtt

SEQ ID NO: 5433165 - DNA, 13 bp, Homo sapiens
gtatatgtctcag

SEQ ID NO: 5433166 - DNA, 15 bp, Homo sapiens
gtatatgtgaaaaaa

SEQ ID NO: 5433167 - DNA, 18 bp, Homo sapiens
gtatatgtgcgtctctct

SEQ ID NO: 5433168 - DNA, 15 bp, Homo sapiens
gtatatgttgtaata

SEQ ID NO: 5433169 - DNA, 17 bp, Homo sapiens
gtatatgttgtaataaa

SEQ ID NO: 5433170 - DNA, 17 bp, Homo sapiens
gtatatgtttatacaca

SEQ ID NO: 5433171 - DNA, 13 bp, Homo sapiens
gtatattaaaaaa

SEQ ID NO: 5433172 - DNA, 19 bp, Homo sapiens
gtatattaaaaaagagaca

SEQ ID NO: 5433173 - DNA, 16 bp, Homo sapiens
gtatattaaaaatggt

SEQ ID NO: 5433174 - DNA, 22 bp, Homo sapiens
gtatattaaaaatggtaaaatt

SEQ ID NO: 5433175 - DNA, 16 bp, Homo sapiens
gtatattaaaatagca

SEQ ID NO: 5433176 - DNA, 15 bp, Homo sapiens
gtatattacaatgat

SEQ ID NO: 5433177 - DNA, 18 bp, Homo sapiens
gtatattacaatgatcac

SEQ ID NO: 5433178 - DNA, 17 bp, Homo sapiens
gtatattacacatttgt

SEQ ID NO: 5433179 - DNA, 22 bp, Homo sapiens
gtatattacacatttgtacaga

SEQ ID NO: 5433180 - DNA, 12 bp, Homo sapiens
gtatattacacc

SEQ ID NO: 5433181 - DNA, 12 bp, Homo sapiens
gtatattataat

SEQ ID NO: 5433182 - DNA, 18 bp, Homo sapiens
gtatattatatggcagga

SEQ ID NO: 5433183 - DNA, 15 bp, Homo sapiens
gtatattatggtgta

SEQ ID NO: 5433184 - DNA, 21 bp, Homo sapiens
gtatattatggtgtaatgcac

SEQ ID NO: 5433185 - DNA, 16 bp, Homo sapiens
gtatattatgtattta

SEQ ID NO: 5433186 - DNA, 22 bp, Homo sapiens
gtatattattgctatatttgct

SEQ ID NO: 5433187 - DNA, 16 bp, Homo sapiens
gtatattattgcttca

SEQ ID NO: 5433188 - DNA, 14 bp, Homo sapiens
gtatattatttggc

SEQ ID NO: 5433189 - DNA, 23 bp, Homo sapiens
gtatattcaaaaattatattttg

SEQ ID NO: 5433190 - DNA, 12 bp, Homo sapiens
gtatattcactt

SEQ ID NO: 5433191 - DNA, 12 bp, Homo sapiens
gtatattcagga

SEQ ID NO: 5433192 - DNA, 20 bp, Homo sapiens
gtatattctcttgtctggct

SEQ ID NO: 5433193 - DNA, 13 bp, Homo sapiens
gtatattctggaa

SEQ ID NO: 5433194 - DNA, 15 bp, Homo sapiens
gtatattctggaaaa

SEQ ID NO: 5433195 - DNA, 16 bp, Homo sapiens
gtatattcttgtaaat

SEQ ID NO: 5433196 - DNA, 23 bp, Homo sapiens
gtatattgaaaagaaaaagaaga

SEQ ID NO: 5433197 - DNA, 13 bp, Homo sapiens
gtatattggtgta

SEQ ID NO: 5433198 - DNA, 21 bp, Homo sapiens
gtatattggtgtatattatat

SEQ ID NO: 5433199 - DNA, 22 bp, Homo sapiens
gtatattgtataggggcaactg

SEQ ID NO: 5433200 - DNA, 14 bp, Homo sapiens
gtatattgtattta

SEQ ID NO: 5433201 - DNA, 13 bp, Homo sapiens
gtatattgtgttt

SEQ ID NO: 5433202 - DNA, 13 bp, Homo sapiens
gtatatttatact

SEQ ID NO: 5433203 - DNA, 16 bp, Homo sapiens
gtatatttatactcta

SEQ ID NO: 5433204 - DNA, 15 bp, Homo sapiens
gtatatttatataat

SEQ ID NO: 5433205 - DNA, 20 bp, Homo sapiens
gtatatttatgaccagagca

SEQ ID NO: 5433206 - DNA, 15 bp, Homo sapiens
gtatatttctgggtt

SEQ ID NO: 5433207 - DNA, 15 bp, Homo sapiens
gtatatttcttttaa

SEQ ID NO: 5433208 - DNA, 23 bp, Homo sapiens
gtatatttgaaataaagttgaat

SEQ ID NO: 5433209 - DNA, 19 bp, Homo sapiens
gtatatttgatttattaac

SEQ ID NO: 5433210 - DNA, 13 bp, Homo sapiens
gtatatttgctgc

SEQ ID NO: 5433211 - DNA, 22 bp, Homo sapiens
gtatatttgctgcaaagagaaa

SEQ ID NO: 5433212 - DNA, 12 bp, Homo sapiens
gtatatttgctt

SEQ ID NO: 5433213 - DNA, 13 bp, Homo sapiens
gtatatttgcttc

SEQ ID NO: 5433214 - DNA, 11 bp, Homo sapiens
gtatatttggt

SEQ ID NO: 5433215 - DNA, 14 bp, Homo sapiens
gtatatttgtaaaa

SEQ ID NO: 5433216 - DNA, 13 bp, Homo sapiens
gtatatttgtaca

SEQ ID NO: 5433217 - DNA, 14 bp, Homo sapiens
gtatatttgtatat

SEQ ID NO: 5433218 - DNA, 22 bp, Homo sapiens
gtatatttgtatttaaatgaaa

SEQ ID NO: 5433219 - DNA, 14 bp, Homo sapiens
gtatatttgtcatg

SEQ ID NO: 5433220 - DNA, 17 bp, Homo sapiens
gtatatttgtcatgaca

SEQ ID NO: 5433221 - DNA, 21 bp, Homo sapiens
gtatatttgtgatagcacttt

SEQ ID NO: 5433222 - DNA, 18 bp, Homo sapiens
gtatatttgttttatgct

SEQ ID NO: 5433223 - DNA, 23 bp, Homo sapiens
gtatatttgttttatgctactga

SEQ ID NO: 5433224 - DNA, 19 bp, Homo sapiens
gtatattttaatagaattt

SEQ ID NO: 5433225 - DNA, 17 bp, Homo sapiens
gtatattttaatgaata

SEQ ID NO: 5433226 - DNA, 16 bp, Homo sapiens
gtatattttgtagtta

SEQ ID NO: 5433227 - DNA, 23 bp, Homo sapiens
gtatatttttatattgtttttgt

SEQ ID NO: 5433228 - DNA, 20 bp, Homo sapiens
gtatatttttgtctgcagct

SEQ ID NO: 5433229 - DNA, 17 bp, Homo sapiens
gtatatttttgtttgtt

SEQ ID NO: 5433230 - DNA, 19 bp, Homo sapiens
gtatatttttttaatttaa

SEQ ID NO: 5433231 - DNA, 21 bp, Homo sapiens
gtatcaaaatagtttaggaaa

SEQ ID NO: 5433232 - DNA, 15 bp, Homo sapiens
gtatcaaacccacga

SEQ ID NO: 5433233 - DNA, 18 bp, Homo sapiens
gtatcaaactcgtctgat

SEQ ID NO: 5433234 - DNA, 19 bp, Homo sapiens
gtatcaaactcgtctgatg

SEQ ID NO: 5433235 - DNA, 13 bp, Homo sapiens
gtatcaaatacat

SEQ ID NO: 5433236 - DNA, 14 bp, Homo sapiens
gtatcaaatacatt

SEQ ID NO: 5433237 - DNA, 19 bp, Homo sapiens
gtatcaaatattagatgtg

SEQ ID NO: 5433238 - DNA, 11 bp, Homo sapiens
gtatcaaatca

SEQ ID NO: 5433239 - DNA, 13 bp, Homo sapiens
gtatcaaatctgt

SEQ ID NO: 5433240 - DNA, 18 bp, Homo sapiens
gtatcaacccagaaacac

SEQ ID NO: 5433241 - DNA, 21 bp, Homo sapiens
gtatcaacttcccagtgatct

SEQ ID NO: 5433242 - DNA, 14 bp, Homo sapiens
gtatcaagcccctg

SEQ ID NO: 5433243 - DNA, 15 bp, Homo sapiens
gtatcaaggctgcct

SEQ ID NO: 5433244 - DNA, 18 bp, Homo sapiens
gtatcaaggctgcctgga

SEQ ID NO: 5433245 - DNA, 19 bp, Homo sapiens
gtatcaagtggcatgtgct

SEQ ID NO: 5433246 - DNA, 22 bp, Homo sapiens
gtatcaataaaattctgtaatt

SEQ ID NO: 5433247 - DNA, 18 bp, Homo sapiens
gtatgtttatcaaagagc

SEQ ID NO: 5433248 - DNA, 16 bp, Homo sapiens
gtatgtttatgttaat

SEQ ID NO: 5433249 - DNA, 18 bp, Homo sapiens
gtatgtttcttctttctt

SEQ ID NO: 5433250 - DNA, 12 bp, Homo sapiens
gtatgtttgtaa

SEQ ID NO: 5433251 - DNA, 15 bp, Homo sapiens
gtatgtttgtaactt

SEQ ID NO: 5433252 - DNA, 14 bp, Homo sapiens
gtatgttttagcat

SEQ ID NO: 5433253 - DNA, 17 bp, Homo sapiens
gtatgttttatatcaaa

SEQ ID NO: 5433254 - DNA, 14 bp, Homo sapiens
gtatgtttttacat

SEQ ID NO: 5433255 - DNA, 23 bp, Homo sapiens
gtatgtttttacattatgcaaat

SEQ ID NO: 5433256 - DNA, 19 bp, Homo sapiens
gtatgtttttgtgtatttg

SEQ ID NO: 5433257 - DNA, 15 bp, Homo sapiens
gtatgttttttatgt

SEQ ID NO: 5433258 - DNA, 15 bp, Homo sapiens
gtattaaaaaaaaca

SEQ ID NO: 5433259 - DNA, 22 bp, Homo sapiens
gtattaaaaaaaacaaaaagaa

SEQ ID NO: 5433260 - DNA, 22 bp, Homo sapiens
gtattaaaaaacaattaactgc

SEQ ID NO: 5433261 - DNA, 20 bp, Homo sapiens
gtattaaaaagcctgcattc

SEQ ID NO: 5433262 - DNA, 24 bp, Homo sapiens
gtattaaaacacattatgtatctt

SEQ ID NO: 5433263 - DNA, 18 bp, Homo sapiens
gtattaaaagttgcattt

SEQ ID NO: 5433264 - DNA, 23 bp, Homo sapiens
gtattaaaatgcatatttctatg

SEQ ID NO: 5433265 - DNA, 17 bp, Homo sapiens
gtattaaaatgtatgca

SEQ ID NO: 5433266 - DNA, 18 bp, Homo sapiens
gtattaaactctcctttg

SEQ ID NO: 5433267 - DNA, 18 bp, Homo sapiens
gtattaaactgtaaatca

SEQ ID NO: 5433268 - DNA, 14 bp, Homo sapiens
gtattaaagatgca

SEQ ID NO: 5433269 - DNA, 15 bp, Homo sapiens
gtattaaagatgtgt

SEQ ID NO: 5433270 - DNA, 16 bp, Homo sapiens
gtattaaagatgtgtt

SEQ ID NO: 5433271 - DNA, 14 bp, Homo sapiens
gtattaaagggggg

SEQ ID NO: 5433272 - DNA, 17 bp, Homo sapiens
gtattaaaggttaaatt

SEQ ID NO: 5433273 - DNA, 12 bp, Homo sapiens
gtattaaatatt

SEQ ID NO: 5433274 - DNA, 13 bp, Homo sapiens
gtattaaatctta

SEQ ID NO: 5433275 - DNA, 17 bp, Homo sapiens
gtattaaatcttaaaca

SEQ ID NO: 5433276 - DNA, 15 bp, Homo sapiens
gtattaacatgcaat

SEQ ID NO: 5433277 - DNA, 15 bp, Homo sapiens
gtattaacctacctg

SEQ ID NO: 5433278 - DNA, 18 bp, Homo sapiens
gtattaacctacctgtga

SEQ ID NO: 5433279 - DNA, 14 bp, Homo sapiens
gtattaactgggta

SEQ ID NO: 5433280 - DNA, 22 bp, Homo sapiens
gtattaactttatacacttgga

SEQ ID NO: 5433281 - DNA, 19 bp, Homo sapiens
gtattaacttttttagaat

SEQ ID NO: 5433282 - DNA, 12 bp, Homo sapiens
gtattaagaaag

SEQ ID NO: 5433283 - DNA, 16 bp, Homo sapiens
gtattaagaaaggaag

SEQ ID NO: 5433284 - DNA, 15 bp, Homo sapiens
gtattaagcagttca

SEQ ID NO: 5433285 - DNA, 17 bp, Homo sapiens
gtattaagcatatattt

SEQ ID NO: 5433286 - DNA, 18 bp, Homo sapiens
gtattaagcatatatttt

SEQ ID NO: 5433287 - DNA, 13 bp, Homo sapiens
gtattaagccaat

SEQ ID NO: 5433288 - DNA, 21 bp, Homo sapiens
gtattaagcccacagtatatt

SEQ ID NO: 5433289 - DNA, 22 bp, Homo sapiens
gtattaagcctaccgtatttca

SEQ ID NO: 5433290 - DNA, 23 bp, Homo sapiens
gtattaagggtaggatgttgctt

SEQ ID NO: 5433291 - DNA, 18 bp, Homo sapiens
gtattaagtcaagaatat

SEQ ID NO: 5433292 - DNA, 16 bp, Homo sapiens
gtattaagtgaaattt

SEQ ID NO: 5433293 - DNA, 22 bp, Homo sapiens
gtattaagtgaaattttaaatg

SEQ ID NO: 5433294 - DNA, 12 bp, Homo sapiens
gtattaataaaa

SEQ ID NO: 5433295 - DNA, 14 bp, Homo sapiens
gtattaataaagca

SEQ ID NO: 5433296 - DNA, 21 bp, Homo sapiens
gtattaataaagcattcttta

SEQ ID NO: 5433297 - DNA, 14 bp, Homo sapiens
gtattaatactaaa

SEQ ID NO: 5433298 - DNA, 15 bp, Homo sapiens
gtattaatactaaaa

SEQ ID NO: 5433299 - DNA, 14 bp, Homo sapiens
gtattaatattcat

SEQ ID NO: 5433300 - DNA, 20 bp, Homo sapiens
gtattaatctctgtgtgttt

SEQ ID NO: 5433301 - DNA, 17 bp, Homo sapiens
gtattaatctgtttgtg

SEQ ID NO: 5433302 - DNA, 18 bp, Homo sapiens
gtattaatcttattgttt

SEQ ID NO: 5433303 - DNA, 16 bp, Homo sapiens
gtattaatcttggata

SEQ ID NO: 5433304 - DNA, 15 bp, Homo sapiens
gtattaattatctga

SEQ ID NO: 5433305 - DNA, 16 bp, Homo sapiens
gtattaattatctgat

SEQ ID NO: 5433306 - DNA, 14 bp, Homo sapiens
gtattacaaacaag

SEQ ID NO: 5433307 - DNA, 23 bp, Homo sapiens
gtattacaagagaaacaaataaa

SEQ ID NO: 5433308 - DNA, 13 bp, Homo sapiens
gtattacactgta

SEQ ID NO: 5433309 - DNA, 16 bp, Homo sapiens
gtattacatgactgtt

SEQ ID NO: 5433310 - DNA, 13 bp, Homo sapiens
gtattaccaaagc

SEQ ID NO: 5433311 - DNA, 14 bp, Homo sapiens
gtattaccaaagca

SEQ ID NO: 5433312 - DNA, 15 bp, Homo sapiens
gtattaccagccccc

SEQ ID NO: 5433313 - DNA, 15 bp, Homo sapiens
gtattaccatgtaaa

SEQ ID NO: 5433314 - DNA, 16 bp, Homo sapiens
gtattaccatgtaaat

SEQ ID NO: 5433315 - DNA, 18 bp, Homo sapiens
gtattaccatgtaaataa

SEQ ID NO: 5433316 - DNA, 22 bp, Homo sapiens
gtattaccatgtaaataatctg

SEQ ID NO: 5433317 - DNA, 20 bp, Homo sapiens
gtattactgctgctgtgctt

SEQ ID NO: 5433318 - DNA, 15 bp, Homo sapiens
gtattacttctgcta

SEQ ID NO: 5433319 - DNA, 14 bp, Homo sapiens
gtattactttctgc

SEQ ID NO: 5433320 - DNA, 21 bp, Homo sapiens
gtattagagtttcaaccatga

SEQ ID NO: 5433321 - DNA, 12 bp, Homo sapiens
gtattagatgtt

SEQ ID NO: 5433322 - DNA, 13 bp, Homo sapiens
gtattagatgttc

SEQ ID NO: 5433323 - DNA, 13 bp, Homo sapiens
gtattagcaaagc

SEQ ID NO: 5433324 - DNA, 20 bp, Homo sapiens
gtattagcatgagctttcca

SEQ ID NO: 5433325 - DNA, 21 bp, Homo sapiens
gtattagcatgagctttccag

SEQ ID NO: 5433326 - DNA, 21 bp, Homo sapiens
gtattagtgatatttctctag

SEQ ID NO: 5433327 - DNA, 18 bp, Homo sapiens
gtattagtggaaagtgat

SEQ ID NO: 5433328 - DNA, 17 bp, Homo sapiens
gtattagtgtttgaaaa

SEQ ID NO: 5433329 - DNA, 17 bp, Homo sapiens
gtattagttaaaacaca

SEQ ID NO: 5433330 - DNA, 16 bp, Homo sapiens
gtattagttgccaata

SEQ ID NO: 5433331 - DNA, 20 bp, Homo sapiens
gtattagttgccaatatgcc

SEQ ID NO: 5433332 - DNA, 23 bp, Homo sapiens
gtattataaaagctcagatgaca

SEQ ID NO: 5433333 - DNA, 19 bp, Homo sapiens
gtattataaattatgttta

SEQ ID NO: 5433334 - DNA, 14 bp, Homo sapiens
gtattatacctttt

SEQ ID NO: 5433335 - DNA, 21 bp, Homo sapiens
gtattatagtactgctttact

SEQ ID NO: 5433336 - DNA, 23 bp, Homo sapiens
gtattatagtactgctttactgt

SEQ ID NO: 5433337 - DNA, 16 bp, Homo sapiens
gtattatatctctgta

SEQ ID NO: 5433338 - DNA, 14 bp, Homo sapiens
gtattatattttat

SEQ ID NO: 5433339 - DNA, 16 bp, Homo sapiens
gtattatcacatcaag

SEQ ID NO: 5433340 - DNA, 14 bp, Homo sapiens
gtattatcataagt

SEQ ID NO: 5433341 - DNA, 17 bp, Homo sapiens
gtattatcatatatgct

SEQ ID NO: 5433342 - DNA, 17 bp, Homo sapiens
gtattatctgtgttaaa

SEQ ID NO: 5433343 - DNA, 20 bp, Homo sapiens
gtattatcttaaacccacat

SEQ ID NO: 5433344 - DNA, 14 bp, Homo sapiens
gtattatgcaaagt

SEQ ID NO: 5433345 - DNA, 13 bp, Homo sapiens
gtattatgcaaca

SEQ ID NO: 5433346 - DNA, 12 bp, Homo sapiens
gtattatgcttc

SEQ ID NO: 5433347 - DNA, 21 bp, Homo sapiens
gtattatgtactctactgata

SEQ ID NO: 5433348 - DNA, 18 bp, Homo sapiens
gtattatgtgcctaattt

SEQ ID NO: 5433349 - DNA, 23 bp, Homo sapiens
gtattattattaaagaaaaatgc

SEQ ID NO: 5433350 - DNA, 15 bp, Homo sapiens
gtattattctgtttt

SEQ ID NO: 5433351 - DNA, 17 bp, Homo sapiens
gtattattctgttttgc

SEQ ID NO: 5433352 - DNA, 12 bp, Homo sapiens
gtattattgcaa

SEQ ID NO: 5433353 - DNA, 20 bp, Homo sapiens
gtattattgctgttgcttga

SEQ ID NO: 5433354 - DNA, 17 bp, Homo sapiens
gtattatttagtaaaat

SEQ ID NO: 5433355 - DNA, 19 bp, Homo sapiens
gtattatttagtaaaatta

SEQ ID NO: 5433356 - DNA, 12 bp, Homo sapiens
gtattatttata

SEQ ID NO: 5433357 - DNA, 17 bp, Homo sapiens
gtattatttcaccagca

SEQ ID NO: 5433358 - DNA, 20 bp, Homo sapiens
gtattatttcaccagcagca

SEQ ID NO: 5433359 - DNA, 21 bp, Homo sapiens
gtattatttctggctttttga

SEQ ID NO: 5433360 - DNA, 14 bp, Homo sapiens
gtattattttccaa

SEQ ID NO: 5433361 - DNA, 18 bp, Homo sapiens
gtattattttttaataaa

SEQ ID NO: 5433362 - DNA, 17 bp, Homo sapiens
gtattcaagaaagccag

SEQ ID NO: 5433363 - DNA, 18 bp, Homo sapiens
gtattcaagaaagccagt

SEQ ID NO: 5433364 - DNA, 18 bp, Homo sapiens
gtattcaagcaaacatca

SEQ ID NO: 5433365 - DNA, 23 bp, Homo sapiens
gtattcaataccgctcagtattt

SEQ ID NO: 5433366 - DNA, 22 bp, Homo sapiens
gtattcaattaaagaaataatt

SEQ ID NO: 5433367 - DNA, 16 bp, Homo sapiens
gtattcagaaattaaa

SEQ ID NO: 5433368 - DNA, 20 bp, Homo sapiens
gtattcagaaattaaaatat

SEQ ID NO: 5433369 - DNA, 21 bp, Homo sapiens
gtattcagatcgtattaatta

SEQ ID NO: 5433370 - DNA, 13 bp, Homo sapiens
gtattcaggaccc

SEQ ID NO: 5433371 - DNA, 22 bp, Homo sapiens
gtattcagtgagggtcttctta

SEQ ID NO: 5433372 - DNA, 21 bp, Homo sapiens
gtattcatattaccagaaaat

SEQ ID NO: 5433373 - DNA, 22 bp, Homo sapiens
gtattcatattaccagaaaatg

SEQ ID NO: 5433374 - DNA, 17 bp, Homo sapiens
gtattcatatttgtact

SEQ ID NO: 5433375 - DNA, 22 bp, Homo sapiens
gtattcatccaagttaaatgta

SEQ ID NO: 5433376 - DNA, 21 bp, Homo sapiens
gtattcatgaaaactgttttt

SEQ ID NO: 5433377 - DNA, 22 bp, Homo sapiens
gtattccaccttaaattaaaca

SEQ ID NO: 5433378 - DNA, 18 bp, Homo sapiens
gtattccatgagctgctc

SEQ ID NO: 5433379 - DNA, 23 bp, Homo sapiens
gtattccatttttactaaagcag

SEQ ID NO: 5433380 - DNA, 21 bp, Homo sapiens
gtattcccaaaaattactttg

SEQ ID NO: 5433381 - DNA, 15 bp, Homo sapiens
gtattcccactcacc

SEQ ID NO: 5433382 - DNA, 13 bp, Homo sapiens
gtattcccactct

SEQ ID NO: 5433383 - DNA, 13 bp, Homo sapiens
gtattcccagcta

SEQ ID NO: 5433384 - DNA, 22 bp, Homo sapiens
gtattcctgaaaagctgcattt

SEQ ID NO: 5433385 - DNA, 13 bp, Homo sapiens
gtattcctgttgc

SEQ ID NO: 5433386 - DNA, 17 bp, Homo sapiens
gtattcctttatgtatc

SEQ ID NO: 5433387 - DNA, 18 bp, Homo sapiens
gtattcgaaacctgtgat

SEQ ID NO: 5433388 - DNA, 22 bp, Homo sapiens
gtattcgtgcagcatatgagga

SEQ ID NO: 5433389 - DNA, 16 bp, Homo sapiens
gtattcgttatctaat

SEQ ID NO: 5433390 - DNA, 18 bp, Homo sapiens
gtattctaaagctttctg

SEQ ID NO: 5433391 - DNA, 14 bp, Homo sapiens
gtattctcaaagat

SEQ ID NO: 5433392 - DNA, 12 bp, Homo sapiens
gtattctcagag

SEQ ID NO: 5433393 - DNA, 13 bp, Homo sapiens
gtattctcagagc

SEQ ID NO: 5433394 - DNA, 22 bp, Homo sapiens
gtattctcagagcatgtgtcag

SEQ ID NO: 5433395 - DNA, 18 bp, Homo sapiens
gtattctcataggagact

SEQ ID NO: 5433396 - DNA, 18 bp, Homo sapiens
gtattctctcctgtacct

SEQ ID NO: 5433397 - DNA, 13 bp, Homo sapiens
gtattctctgagc

SEQ ID NO: 5433398 - DNA, 21 bp, Homo sapiens
gtattctctttaccttctaaa

SEQ ID NO: 5433399 - DNA, 22 bp, Homo sapiens
gtattctctttaccttctaaaa

SEQ ID NO: 5433400 - DNA, 15 bp, Homo sapiens
gtattctctttgcct

SEQ ID NO: 5433401 - DNA, 12 bp, Homo sapiens
gtattctctttt

SEQ ID NO: 5433402 - DNA, 16 bp, Homo sapiens
gtattctgacatgtaa

SEQ ID NO: 5433403 - DNA, 16 bp, Homo sapiens
gtattctgaggatgtt

SEQ ID NO: 5433404 - DNA, 12 bp, Homo sapiens
gtattctgcttc

SEQ ID NO: 5433405 - DNA, 12 bp, Homo sapiens
gtattctgtcat

SEQ ID NO: 5433406 - DNA, 19 bp, Homo sapiens
gtattctgtggattctata

SEQ ID NO: 5433407 - DNA, 15 bp, Homo sapiens
gtattcttatttaat

SEQ ID NO: 5433408 - DNA, 15 bp, Homo sapiens
gtattcttctgtatt

SEQ ID NO: 5433409 - DNA, 15 bp, Homo sapiens
gtattcttgtttgaa

SEQ ID NO: 5433410 - DNA, 21 bp, Homo sapiens
gtattctttgatgttaacaca

SEQ ID NO: 5433411 - DNA, 14 bp, Homo sapiens
gtattgaaaacttc

SEQ ID NO: 5433412 - DNA, 17 bp, Homo sapiens
gtattgaaaacttcaaa

SEQ ID NO: 5433413 - DNA, 18 bp, Homo sapiens
gtattgaaaacttcaaag

SEQ ID NO: 5433414 - DNA, 14 bp, Homo sapiens
gtattgaaagccaa

SEQ ID NO: 5433415 - DNA, 13 bp, Homo sapiens
gtattgaagcatt

SEQ ID NO: 5433416 - DNA, 18 bp, Homo sapiens
gtattgaagcattttata

SEQ ID NO: 5433417 - DNA, 16 bp, Homo sapiens
gtattgaagttaactg

SEQ ID NO: 5433418 - DNA, 15 bp, Homo sapiens
gtattgacaaaatgt

SEQ ID NO: 5433419 - DNA, 17 bp, Homo sapiens
gtattgacaaaatgtta

SEQ ID NO: 5433420 - DNA, 23 bp, Homo sapiens
gtattgacaataagaaacagttt

SEQ ID NO: 5433421 - DNA, 21 bp, Homo sapiens
gtattgactgtaccacagaca

SEQ ID NO: 5433422 - DNA, 23 bp, Homo sapiens
gtattgacttctttttggcatta

SEQ ID NO: 5433423 - DNA, 13 bp, Homo sapiens
gtattgactttat

SEQ ID NO: 5433424 - DNA, 18 bp, Homo sapiens
gtattgagacactgtcaa

SEQ ID NO: 5433425 - DNA, 23 bp, Homo sapiens
gtattgagatactttttcttttg

SEQ ID NO: 5433426 - DNA, 19 bp, Homo sapiens
gtcaactgctgttttatgt

SEQ ID NO: 5433427 - DNA, 20 bp, Homo sapiens
gtcaactggagcaagaagga

SEQ ID NO: 5433428 - DNA, 18 bp, Homo sapiens
gtcaactggcgaagcctg

SEQ ID NO: 5433429 - DNA, 22 bp, Homo sapiens
gtcaactggcgaagcctgagca

SEQ ID NO: 5433430 - DNA, 18 bp, Homo sapiens
gtcaactggggaaaagga

SEQ ID NO: 5433431 - DNA, 17 bp, Homo sapiens
gtcaacttgacaccact

SEQ ID NO: 5433432 - DNA, 17 bp, Homo sapiens
gtcaacttgagcatgtt

SEQ ID NO: 5433433 - DNA, 13 bp, Homo sapiens
gtcaactttatgc

SEQ ID NO: 5433434 - DNA, 16 bp, Homo sapiens
gtcaactttcatttga

SEQ ID NO: 5433435 - DNA, 18 bp, Homo sapiens
gtcaactttcatttgaaa

SEQ ID NO: 5433436 - DNA, 21 bp, Homo sapiens
gtcaagaaaggaggggagaac

SEQ ID NO: 5433437 - DNA, 17 bp, Homo sapiens
gtcaagaagaagatgga

SEQ ID NO: 5433438 - DNA, 20 bp, Homo sapiens
gtcaagacagggaaggatga

SEQ ID NO: 5433439 - DNA, 19 bp, Homo sapiens
gtcaagaggtttttctccc

SEQ ID NO: 5433440 - DNA, 20 bp, Homo sapiens
gtcaagattaagttatacca

SEQ ID NO: 5433441 - DNA, 15 bp, Homo sapiens
gtcaagattcagcta

SEQ ID NO: 5433442 - DNA, 19 bp, Homo sapiens
gtcaagattcagctagtgg

SEQ ID NO: 5433443 - DNA, 14 bp, Homo sapiens
gtcaagcacatgta

SEQ ID NO: 5433444 - DNA, 23 bp, Homo sapiens
gtcaagcacatgtaataaattca

SEQ ID NO: 5433445 - DNA, 20 bp, Homo sapiens
gtcaagcctgcagcgagctg

SEQ ID NO: 5433446 - DNA, 23 bp, Homo sapiens
gtcaagcctgtggatgatttttt

SEQ ID NO: 5433447 - DNA, 13 bp, Homo sapiens
gtcaagctcctcc

SEQ ID NO: 5433448 - DNA, 17 bp, Homo sapiens
gtcaagctcctcctccc

SEQ ID NO: 5433449 - DNA, 20 bp, Homo sapiens
gtcaagctcctcctccctgc

SEQ ID NO: 5433450 - DNA, 21 bp, Homo sapiens
gtcaagctgagctggcttcgg

SEQ ID NO: 5433451 - DNA, 12 bp, Homo sapiens
gtcaagctgctc

SEQ ID NO: 5433452 - DNA, 13 bp, Homo sapiens
gtcaagctgctct

SEQ ID NO: 5433453 - DNA, 14 bp, Homo sapiens
gtcaagctgctctg

SEQ ID NO: 5433454 - DNA, 22 bp, Homo sapiens
gtcaagctgctctgagccacag

SEQ ID NO: 5433455 - DNA, 23 bp, Homo sapiens
gtcaagctgctctgagccacagt

SEQ ID NO: 5433456 - DNA, 14 bp, Homo sapiens
gtcaagctggtgct

SEQ ID NO: 5433457 - DNA, 15 bp, Homo sapiens
gtcaagcttctctgt

SEQ ID NO: 5433458 - DNA, 20 bp, Homo sapiens
gtcaaggaaaggatgcacca

SEQ ID NO: 5433459 - DNA, 21 bp, Homo sapiens
gtcaaggaaagggcagtggac

SEQ ID NO: 5433460 - DNA, 16 bp, Homo sapiens
gtcaaggacagggctg

SEQ ID NO: 5433461 - DNA, 19 bp, Homo sapiens
gtcaaggacagggctgagc

SEQ ID NO: 5433462 - DNA, 14 bp, Homo sapiens
gtcaaggccacctc

SEQ ID NO: 5433463 - DNA, 15 bp, Homo sapiens
gtcaaggccacctct

SEQ ID NO: 5433464 - DNA, 19 bp, Homo sapiens
gtcaaggccacctctgcct

SEQ ID NO: 5433465 - DNA, 11 bp, Homo sapiens
gtcaaggccag

SEQ ID NO: 5433466 - DNA, 18 bp, Homo sapiens
gtcaaggccgagggccag

SEQ ID NO: 5433467 - DNA, 20 bp, Homo sapiens
gtcaaggccgagggccaggc

SEQ ID NO: 5433468 - DNA, 21 bp, Homo sapiens
gtcaaggcctgtccctggcca

SEQ ID NO: 5433469 - DNA, 18 bp, Homo sapiens
gtcaaggcttagaccctc

SEQ ID NO: 5433470 - DNA, 14 bp, Homo sapiens
gtcaagggaaaacc

SEQ ID NO: 5433471 - DNA, 14 bp, Homo sapiens
gtcaagggctgggg

SEQ ID NO: 5433472 - DNA, 22 bp, Homo sapiens
gtcaagggctgtcattgcacat

SEQ ID NO: 5433473 - DNA, 15 bp, Homo sapiens
gtcaaggggccctag

SEQ ID NO: 5433474 - DNA, 14 bp, Homo sapiens
gtcaaggtaaatgt

SEQ ID NO: 5433475 - DNA, 14 bp, Homo sapiens
gtcaaggtgctcaa

SEQ ID NO: 5433476 - DNA, 14 bp, Homo sapiens
gtcaaggtgtggaa

SEQ ID NO: 5433477 - DNA, 14 bp, Homo sapiens
gtcaagtaagaaga

SEQ ID NO: 5433478 - DNA, 17 bp, Homo sapiens
gtcaagtaatggaggtc

SEQ ID NO: 5433479 - DNA, 16 bp, Homo sapiens
gtcaagtgaaaaagga

SEQ ID NO: 5433480 - DNA, 18 bp, Homo sapiens
gtcaagtgaaaaaggagg

SEQ ID NO: 5433481 - DNA, 19 bp, Homo sapiens
gtcaagtgaaaaaggagga

SEQ ID NO: 5433482 - DNA, 17 bp, Homo sapiens
gtcaagtgcctgcacca

SEQ ID NO: 5433483 - DNA, 22 bp, Homo sapiens
gtcaagtggcaaagctgttctt

SEQ ID NO: 5433484 - DNA, 15 bp, Homo sapiens
gtcaagtgtgcctgc

SEQ ID NO: 5433485 - DNA, 16 bp, Homo sapiens
gtcaagtgtgcctgct

SEQ ID NO: 5433486 - DNA, 17 bp, Homo sapiens
gtcaagtgtgcctgcta

SEQ ID NO: 5433487 - DNA, 17 bp, Homo sapiens
gtcaagttaacaaggaa

SEQ ID NO: 5433488 - DNA, 21 bp, Homo sapiens
gtcaagttcatagtttctgta

SEQ ID NO: 5433489 - DNA, 17 bp, Homo sapiens
gtcaagttccgtctcct

SEQ ID NO: 5433490 - DNA, 15 bp, Homo sapiens
gtcaagttgtcaggt

SEQ ID NO: 5433491 - DNA, 18 bp, Homo sapiens
gtcaagttgtcaggttat

SEQ ID NO: 5433492 - DNA, 13 bp, Homo sapiens
gtcaagtttttat

SEQ ID NO: 5433493 - DNA, 19 bp, Homo sapiens
gtcaataaaaataaatcta

SEQ ID NO: 5433494 - DNA, 15 bp, Homo sapiens
gtcaataaaatccat

SEQ ID NO: 5433495 - DNA, 22 bp, Homo sapiens
gtcaataaaatccatacatttg

SEQ ID NO: 5433496 - DNA, 15 bp, Homo sapiens
gtcaataaagcagag

SEQ ID NO: 5433497 - DNA, 17 bp, Homo sapiens
gtcaataaagcagagcc

SEQ ID NO: 5433498 - DNA, 23 bp, Homo sapiens
gtcaataaagcagagccaaggcc

SEQ ID NO: 5433499 - DNA, 20 bp, Homo sapiens
gtcaataaatgacacccaga

SEQ ID NO: 5433500 - DNA, 17 bp, Homo sapiens
gtcaataaatgttgaaa

SEQ ID NO: 5433501 - DNA, 13 bp, Homo sapiens
gtcaataactctg

SEQ ID NO: 5433502 - DNA, 16 bp, Homo sapiens
gtcaataactctgatt

SEQ ID NO: 5433503 - DNA, 17 bp, Homo sapiens
gtcaataactctgattt

SEQ ID NO: 5433504 - DNA, 16 bp, Homo sapiens
gtcaataactttatat

SEQ ID NO: 5433505 - DNA, 15 bp, Homo sapiens
gtcaatactgagcca

SEQ ID NO: 5433506 - DNA, 19 bp, Homo sapiens
gtcaatatcgtacctgtcc

SEQ ID NO: 5433507 - DNA, 22 bp, Homo sapiens
gtcaatatcgtacctgtccctc

SEQ ID NO: 5433508 - DNA, 13 bp, Homo sapiens
gtcaatatttaaa

SEQ ID NO: 5433509 - DNA, 19 bp, Homo sapiens
gtcaatatttagtaaagct

SEQ ID NO: 5433510 - DNA, 18 bp, Homo sapiens
gtcaatcaagtctgttta

SEQ ID NO: 5433511 - DNA, 15 bp, Homo sapiens
gtcaatcatttctca

SEQ ID NO: 5433512 - DNA, 15 bp, Homo sapiens
gtcaatccatcagca

SEQ ID NO: 5433513 - DNA, 22 bp, Homo sapiens
gtcaatcccctcattcaggaaa

SEQ ID NO: 5433514 - DNA, 18 bp, Homo sapiens
gtcaatgaacaagcattc

SEQ ID NO: 5433515 - DNA, 14 bp, Homo sapiens
gtcaatgcagttgt

SEQ ID NO: 5433516 - DNA, 21 bp, Homo sapiens
gtcaatgccaggatttctcat

SEQ ID NO: 5433517 - DNA, 21 bp, Homo sapiens
gtcaatggcttgttcatcatc

SEQ ID NO: 5433518 - DNA, 17 bp, Homo sapiens
gtcaatgggacctgtgg

SEQ ID NO: 5433519 - DNA, 19 bp, Homo sapiens
gtcaatgtcataaatgtca

SEQ ID NO: 5433520 - DNA, 14 bp, Homo sapiens
gtcaatgtgtgcac

SEQ ID NO: 5433521 - DNA, 22 bp, Homo sapiens
gtcaattaaaatgcccatttgt

SEQ ID NO: 5433522 - DNA, 22 bp, Homo sapiens
gtcaattaaacagctggtcctc

SEQ ID NO: 5433523 - DNA, 22 bp, Homo sapiens
gtcaattacaggaagtactgga

SEQ ID NO: 5433524 - DNA, 17 bp, Homo sapiens
gtcaattcagtgatggc

SEQ ID NO: 5433525 - DNA, 13 bp, Homo sapiens
gtcaattcatcta

SEQ ID NO: 5433526 - DNA, 20 bp, Homo sapiens
gtcaattctgatgttactga

SEQ ID NO: 5433527 - DNA, 19 bp, Homo sapiens
gtcaattgatatttctgtg

SEQ ID NO: 5433528 - DNA, 16 bp, Homo sapiens
gtcaattgcttgagca

SEQ ID NO: 5433529 - DNA, 19 bp, Homo sapiens
gtcaattgtacgcgccacc

SEQ ID NO: 5433530 - DNA, 15 bp, Homo sapiens
gtcaatttgctgaaa

SEQ ID NO: 5433531 - DNA, 15 bp, Homo sapiens
gtcacaaaccagcct

SEQ ID NO: 5433532 - DNA, 18 bp, Homo sapiens
gtcacaaaccagcctggg

SEQ ID NO: 5433533 - DNA, 16 bp, Homo sapiens
gtcacaaactgtggtt

SEQ ID NO: 5433534 - DNA, 14 bp, Homo sapiens
gtcacaaagagttc

SEQ ID NO: 5433535 - DNA, 13 bp, Homo sapiens
gtcacaaattgat

SEQ ID NO: 5433536 - DNA, 18 bp, Homo sapiens
gtcacaacccttctctgt

SEQ ID NO: 5433537 - DNA, 17 bp, Homo sapiens
gtcacaagtagcctctg

SEQ ID NO: 5433538 - DNA, 19 bp, Homo sapiens
gtcacaagtagcctctggg

SEQ ID NO: 5433539 - DNA, 11 bp, Homo sapiens
gtcacaataaa

SEQ ID NO: 5433540 - DNA, 13 bp, Homo sapiens
gtcacaataaagt

SEQ ID NO: 5433541 - DNA, 12 bp, Homo sapiens
gtcacaataaat

SEQ ID NO: 5433542 - DNA, 18 bp, Homo sapiens
gtcacaataaatggccag

SEQ ID NO: 5433543 - DNA, 21 bp, Homo sapiens
gtcacaataaatggccagtgc

SEQ ID NO: 5433544 - DNA, 20 bp, Homo sapiens
gtcacaatgagattgaattt

SEQ ID NO: 5433545 - DNA, 15 bp, Homo sapiens
gtcacaatgttcttt

SEQ ID NO: 5433546 - DNA, 18 bp, Homo sapiens
gtcacacaaaggcatgct

SEQ ID NO: 5433547 - DNA, 17 bp, Homo sapiens
gtcacacaccagcactt

SEQ ID NO: 5433548 - DNA, 13 bp, Homo sapiens
gtcacacactgat

SEQ ID NO: 5433549 - DNA, 16 bp, Homo sapiens
gtcacacactggaccc

SEQ ID NO: 5433550 - DNA, 13 bp, Homo sapiens
gtcacacagacac

SEQ ID NO: 5433551 - DNA, 14 bp, Homo sapiens
gtcacacagacaca

SEQ ID NO: 5433552 - DNA, 19 bp, Homo sapiens
gtcacacagagcgcctcac

SEQ ID NO: 5433553 - DNA, 20 bp, Homo sapiens
gtcacacagtattacttctg

SEQ ID NO: 5433554 - DNA, 17 bp, Homo sapiens
gtcacacccaccccctg

SEQ ID NO: 5433555 - DNA, 22 bp, Homo sapiens
gtcacacccaccccctgcctgg

SEQ ID NO: 5433556 - DNA, 23 bp, Homo sapiens
gtcacacctcactgtcatctgcc

SEQ ID NO: 5433557 - DNA, 13 bp, Homo sapiens
gtcacacctgtgc

SEQ ID NO: 5433558 - DNA, 18 bp, Homo sapiens
gtcacacggccacccgcc

SEQ ID NO: 5433559 - DNA, 20 bp, Homo sapiens
gtcacactggtgctgagtga

SEQ ID NO: 5433560 - DNA, 16 bp, Homo sapiens
gtcacactgtggccag

SEQ ID NO: 5433561 - DNA, 21 bp, Homo sapiens
gtcacactgtgtgaggctgtg

SEQ ID NO: 5433562 - DNA, 22 bp, Homo sapiens
gtcacactgtgtgaggctgtgt

SEQ ID NO: 5433563 - DNA, 22 bp, Homo sapiens
gtcacactgttactccacagcg

SEQ ID NO: 5433564 - DNA, 17 bp, Homo sapiens
gtcacagacccctgggg

SEQ ID NO: 5433565 - DNA, 18 bp, Homo sapiens
gtcacagacttctggcct

SEQ ID NO: 5433566 - DNA, 19 bp, Homo sapiens
gtcacagagaactagtggt

SEQ ID NO: 5433567 - DNA, 15 bp, Homo sapiens
gtcacagaggcagtg

SEQ ID NO: 5433568 - DNA, 20 bp, Homo sapiens
gtcacagaggcagtggcagc

SEQ ID NO: 5433569 - DNA, 13 bp, Homo sapiens
gtcacagaggcat

SEQ ID NO: 5433570 - DNA, 20 bp, Homo sapiens
gtcacagcagtacttgctca

SEQ ID NO: 5433571 - DNA, 17 bp, Homo sapiens
gtcacagcatggaggag

SEQ ID NO: 5433572 - DNA, 12 bp, Homo sapiens
gtcacagccacc

SEQ ID NO: 5433573 - DNA, 13 bp, Homo sapiens
gtcacagccaggc

SEQ ID NO: 5433574 - DNA, 16 bp, Homo sapiens
gtcacagccatttcaa

SEQ ID NO: 5433575 - DNA, 12 bp, Homo sapiens
gtcacagcctca

SEQ ID NO: 5433576 - DNA, 12 bp, Homo sapiens
gtcacagctgca

SEQ ID NO: 5433577 - DNA, 14 bp, Homo sapiens
gtcacagctgcagc

SEQ ID NO: 5433578 - DNA, 15 bp, Homo sapiens
gtcacagctgcagct

SEQ ID NO: 5433579 - DNA, 16 bp, Homo sapiens
gtcacagctgcagctg

SEQ ID NO: 5433580 - DNA, 18 bp, Homo sapiens
gtcacagctgcagctggg

SEQ ID NO: 5433581 - DNA, 19 bp, Homo sapiens
gtcacagctgcagctgggc

SEQ ID NO: 5433582 - DNA, 11 bp, Homo sapiens
gtcacagctgg

SEQ ID NO: 5433583 - DNA, 16 bp, Homo sapiens
gtcacaggaaggaaac

SEQ ID NO: 5433584 - DNA, 16 bp, Homo sapiens
gtcacaggagggaggg

SEQ ID NO: 5433585 - DNA, 12 bp, Homo sapiens
gtcacaggcagg

SEQ ID NO: 5433586 - DNA, 15 bp, Homo sapiens
gtcacaggcaggtcc

SEQ ID NO: 5433587 - DNA, 13 bp, Homo sapiens
gtcacaggcccag

SEQ ID NO: 5433588 - DNA, 17 bp, Homo sapiens
gtcacaggcccaggaag

SEQ ID NO: 5433589 - DNA, 12 bp, Homo sapiens
gtcacaggctgg

SEQ ID NO: 5433590 - DNA, 15 bp, Homo sapiens
gtcacaggctgggtc

SEQ ID NO: 5433591 - DNA, 17 bp, Homo sapiens
gtcacaggctgggtcaa

SEQ ID NO: 5433592 - DNA, 11 bp, Homo sapiens
gtcacagggca

SEQ ID NO: 5433593 - DNA, 13 bp, Homo sapiens
gtcacagggcagt

SEQ ID NO: 5433594 - DNA, 23 bp, Homo sapiens
gtcacagggcagtacctgagggt

SEQ ID NO: 5433595 - DNA, 13 bp, Homo sapiens
gtcacagggccaa

SEQ ID NO: 5433596 - DNA, 20 bp, Homo sapiens
gtcacagtaaaaataaaata

SEQ ID NO: 5433597 - DNA, 22 bp, Homo sapiens
gtcacagtaaaaataaaatact

SEQ ID NO: 5433598 - DNA, 20 bp, Homo sapiens
gtcacagtcctatgtacaga

SEQ ID NO: 5433599 - DNA, 23 bp, Homo sapiens
gtcacagtcctatgtacagagct

SEQ ID NO: 5433600 - DNA, 21 bp, Homo sapiens
gtcacagtgtttacactttgg

SEQ ID NO: 5433601 - DNA, 15 bp, Homo sapiens
gtcacataaatggat

SEQ ID NO: 5433602 - DNA, 20 bp, Homo sapiens
gtcacataatgaatgctatt

SEQ ID NO: 5433603 - DNA, 22 bp, Homo sapiens
gtcacatatcagaataggaaga

SEQ ID NO: 5433604 - DNA, 16 bp, Homo sapiens
gtcacatcaagcatca

SEQ ID NO: 5433605 - DNA, 21 bp, Homo sapiens
gtcagggacagcagcctccct

SEQ ID NO: 5433606 - DNA, 18 bp, Homo sapiens
gtcagggacccctgccct

SEQ ID NO: 5433607 - DNA, 17 bp, Homo sapiens
gtcagggacctgctgct

SEQ ID NO: 5433608 - DNA, 19 bp, Homo sapiens
gtcagggacctgctgctca

SEQ ID NO: 5433609 - DNA, 18 bp, Homo sapiens
gtcagggacttggacagg

SEQ ID NO: 5433610 - DNA, 13 bp, Homo sapiens
gtcagggagccct

SEQ ID NO: 5433611 - DNA, 15 bp, Homo sapiens
gtcagggagggccag

SEQ ID NO: 5433612 - DNA, 13 bp, Homo sapiens
gtcagggagtgct

SEQ ID NO: 5433613 - DNA, 11 bp, Homo sapiens
gtcagggcaca

SEQ ID NO: 5433614 - DNA, 14 bp, Homo sapiens
gtcagggcagtggc

SEQ ID NO: 5433615 - DNA, 20 bp, Homo sapiens
gtcagggcagtggccaagcc

SEQ ID NO: 5433616 - DNA, 20 bp, Homo sapiens
gtcagggccagactggaaga

SEQ ID NO: 5433617 - DNA, 21 bp, Homo sapiens
gtcagggcccagaggctgagt

SEQ ID NO: 5433618 - DNA, 14 bp, Homo sapiens
gtcagggcggggct

SEQ ID NO: 5433619 - DNA, 19 bp, Homo sapiens
gtcagggcggggctggcca

SEQ ID NO: 5433620 - DNA, 14 bp, Homo sapiens
gtcagggctcagag

SEQ ID NO: 5433621 - DNA, 15 bp, Homo sapiens
gtcagggctcagagt

SEQ ID NO: 5433622 - DNA, 15 bp, Homo sapiens
gtcagggctgtgctt

SEQ ID NO: 5433623 - DNA, 17 bp, Homo sapiens
gtcaggggcaaggtctc

SEQ ID NO: 5433624 - DNA, 14 bp, Homo sapiens
gtcaggggcagctg

SEQ ID NO: 5433625 - DNA, 15 bp, Homo sapiens
gtcaggggccgggca

SEQ ID NO: 5433626 - DNA, 15 bp, Homo sapiens
gtcaggggctcccta

SEQ ID NO: 5433627 - DNA, 14 bp, Homo sapiens
gtcaggggctctgt

SEQ ID NO: 5433628 - DNA, 18 bp, Homo sapiens
gtcagggggagtctttgc

SEQ ID NO: 5433629 - DNA, 14 bp, Homo sapiens
gtcaggggggagaa

SEQ ID NO: 5433630 - DNA, 15 bp, Homo sapiens
gtcaggggtgacaca

SEQ ID NO: 5433631 - DNA, 18 bp, Homo sapiens
gtcagggtccaggagagc

SEQ ID NO: 5433632 - DNA, 15 bp, Homo sapiens
gtcagggtgagccca

SEQ ID NO: 5433633 - DNA, 14 bp, Homo sapiens
gtcagggttcactt

SEQ ID NO: 5433634 - DNA, 22 bp, Homo sapiens
gtcagggttggtgtgctgaggt

SEQ ID NO: 5433635 - DNA, 23 bp, Homo sapiens
gtcaggtaatatacctggtttac

SEQ ID NO: 5433636 - DNA, 14 bp, Homo sapiens
gtcaggtactcctg

SEQ ID NO: 5433637 - DNA, 17 bp, Homo sapiens
gtcaggtactcctgcca

SEQ ID NO: 5433638 - DNA, 22 bp, Homo sapiens
gtcaggtactcctgccagggaa

SEQ ID NO: 5433639 - DNA, 17 bp, Homo sapiens
gtcaggtgccactgacc

SEQ ID NO: 5433640 - DNA, 12 bp, Homo sapiens
gtcaggtgctca

SEQ ID NO: 5433641 - DNA, 16 bp, Homo sapiens
gtcaggtggaccctgt

SEQ ID NO: 5433642 - DNA, 20 bp, Homo sapiens
gtcaggtggaccctgtaaat

SEQ ID NO: 5433643 - DNA, 18 bp, Homo sapiens
gtcaggtggactctggga

SEQ ID NO: 5433644 - DNA, 15 bp, Homo sapiens
gtcaggtgggaaagc

SEQ ID NO: 5433645 - DNA, 13 bp, Homo sapiens
gtcaggtgggaga

SEQ ID NO: 5433646 - DNA, 16 bp, Homo sapiens
gtcaggtgggcggtgt

SEQ ID NO: 5433647 - DNA, 22 bp, Homo sapiens
gtcaggtggggcagcttgaggg

SEQ ID NO: 5433648 - DNA, 19 bp, Homo sapiens
gtcaggtggttaccaggca

SEQ ID NO: 5433649 - DNA, 18 bp, Homo sapiens
gtcaggtgtcatcatcag

SEQ ID NO: 5433650 - DNA, 18 bp, Homo sapiens
gtcaggtgtcgaggccac

SEQ ID NO: 5433651 - DNA, 16 bp, Homo sapiens
gtcaggttcttgcctt

SEQ ID NO: 5433652 - DNA, 13 bp, Homo sapiens
gtcaggttgacag

SEQ ID NO: 5433653 - DNA, 16 bp, Homo sapiens
gtcaggtttaacattt

SEQ ID NO: 5433654 - DNA, 22 bp, Homo sapiens
gtcagtaaacatttgtaaaaat

SEQ ID NO: 5433655 - DNA, 13 bp, Homo sapiens
gtcagtaatttat

SEQ ID NO: 5433656 - DNA, 20 bp, Homo sapiens
gtcagtaggtccaagggcca

SEQ ID NO: 5433657 - DNA, 21 bp, Homo sapiens
gtcagtaggtccaagggccat

SEQ ID NO: 5433658 - DNA, 20 bp, Homo sapiens
gtcagtagtttaaaagttct

SEQ ID NO: 5433659 - DNA, 16 bp, Homo sapiens
gtcagtatcaggcctg

SEQ ID NO: 5433660 - DNA, 21 bp, Homo sapiens
gtcagtatctgtatctctctc

SEQ ID NO: 5433661 - DNA, 21 bp, Homo sapiens
gtcagtatgtggaagtgtggg

SEQ ID NO: 5433662 - DNA, 21 bp, Homo sapiens
gtcagtatttcaactgctgta

SEQ ID NO: 5433663 - DNA, 23 bp, Homo sapiens
gtcagtcgcctttcagcaggcag

SEQ ID NO: 5433664 - DNA, 17 bp, Homo sapiens
gtcagtctctttctgta

SEQ ID NO: 5433665 - DNA, 13 bp, Homo sapiens
gtcagtctgagtc

SEQ ID NO: 5433666 - DNA, 19 bp, Homo sapiens
gtcagtctgcttagaaata

SEQ ID NO: 5433667 - DNA, 21 bp, Homo sapiens
gtcagtcttcacttgcactgg

SEQ ID NO: 5433668 - DNA, 12 bp, Homo sapiens
gtcagtctttag

SEQ ID NO: 5433669 - DNA, 17 bp, Homo sapiens
gtcagtctttgctcagt

SEQ ID NO: 5433670 - DNA, 18 bp, Homo sapiens
gtcagtgaagcccaggag

SEQ ID NO: 5433671 - DNA, 19 bp, Homo sapiens
gtcagtgaagcccaggagg

SEQ ID NO: 5433672 - DNA, 22 bp, Homo sapiens
gtcagtgagtcagaggcagaac

SEQ ID NO: 5433673 - DNA, 15 bp, Homo sapiens
gtcagtgcatttcaa

SEQ ID NO: 5433674 - DNA, 23 bp, Homo sapiens
gtcagtgccgccgcctcgcccac

SEQ ID NO: 5433675 - DNA, 21 bp, Homo sapiens
gtcagtgctataaatgccaga

SEQ ID NO: 5433676 - DNA, 13 bp, Homo sapiens
gtcagtgctgcct

SEQ ID NO: 5433677 - DNA, 14 bp, Homo sapiens
gtcagtgctgcctg

SEQ ID NO: 5433678 - DNA, 23 bp, Homo sapiens
gtcagtgctgtgctgtgctatgg

SEQ ID NO: 5433679 - DNA, 12 bp, Homo sapiens
gtcagtggaagc

SEQ ID NO: 5433680 - DNA, 17 bp, Homo sapiens
gtcagtggctttgcata

SEQ ID NO: 5433681 - DNA, 18 bp, Homo sapiens
gtcagtggggctctctga

SEQ ID NO: 5433682 - DNA, 13 bp, Homo sapiens
gtcagtgtagaca

SEQ ID NO: 5433683 - DNA, 17 bp, Homo sapiens
gtcagtgtccaaagcag

SEQ ID NO: 5433684 - DNA, 19 bp, Homo sapiens
gtcagtgtgcaaagaaaag

SEQ ID NO: 5433685 - DNA, 20 bp, Homo sapiens
gtcagtgtgtcagtttttcc

SEQ ID NO: 5433686 - DNA, 14 bp, Homo sapiens
gtcagtgttgagat

SEQ ID NO: 5433687 - DNA, 17 bp, Homo sapiens
gtcagtgtttcttttaa

SEQ ID NO: 5433688 - DNA, 16 bp, Homo sapiens
gtcagttactttttta

SEQ ID NO: 5433689 - DNA, 16 bp, Homo sapiens
gtcagttcaactttca

SEQ ID NO: 5433690 - DNA, 20 bp, Homo sapiens
gtcagttcaactttcagaag

SEQ ID NO: 5433691 - DNA, 13 bp, Homo sapiens
gtcagttcagaaa

SEQ ID NO: 5433692 - DNA, 20 bp, Homo sapiens
gtcagttcccggagcacagc

SEQ ID NO: 5433693 - DNA, 21 bp, Homo sapiens
gtcagttcccggagcacagcc

SEQ ID NO: 5433694 - DNA, 15 bp, Homo sapiens
gtcagttcttggtgc

SEQ ID NO: 5433695 - DNA, 19 bp, Homo sapiens
gtcagttcttggtgctctg

SEQ ID NO: 5433696 - DNA, 15 bp, Homo sapiens
gtcagttgttattta

SEQ ID NO: 5433697 - DNA, 16 bp, Homo sapiens
gtcagttgttatttat

SEQ ID NO: 5433698 - DNA, 18 bp, Homo sapiens
gtcagttgttatttattg

SEQ ID NO: 5433699 - DNA, 19 bp, Homo sapiens
gtcagttgttatttattga

SEQ ID NO: 5433700 - DNA, 17 bp, Homo sapiens
gtcagtttatgttttgg

SEQ ID NO: 5433701 - DNA, 16 bp, Homo sapiens
gtcagtttcactccct

SEQ ID NO: 5433702 - DNA, 14 bp, Homo sapiens
gtcagtttgtgaag

SEQ ID NO: 5433703 - DNA, 16 bp, Homo sapiens
gtcagttttcacagag

SEQ ID NO: 5433704 - DNA, 15 bp, Homo sapiens
gtcagtttttcctcc

SEQ ID NO: 5433705 - DNA, 17 bp, Homo sapiens
gtcagtttttcctcccc

SEQ ID NO: 5433706 - DNA, 13 bp, Homo sapiens
gtcataaaatgca

SEQ ID NO: 5433707 - DNA, 19 bp, Homo sapiens
gtcataaaatgcatactgt

SEQ ID NO: 5433708 - DNA, 21 bp, Homo sapiens
gtcataaaatgctattttaaa

SEQ ID NO: 5433709 - DNA, 15 bp, Homo sapiens
gtcataaacagcatt

SEQ ID NO: 5433710 - DNA, 17 bp, Homo sapiens
gtcataaacagcattta

SEQ ID NO: 5433711 - DNA, 18 bp, Homo sapiens
gtcataaacagcatttat

SEQ ID NO: 5433712 - DNA, 16 bp, Homo sapiens
gtcataaatgtcacaa

SEQ ID NO: 5433713 - DNA, 17 bp, Homo sapiens
gtcataaatgtcacaat

SEQ ID NO: 5433714 - DNA, 14 bp, Homo sapiens
gtcataaattacac

SEQ ID NO: 5433715 - DNA, 23 bp, Homo sapiens
gtcataaattacacaataaagca

SEQ ID NO: 5433716 - DNA, 21 bp, Homo sapiens
gtcataaatttgaataagcag

SEQ ID NO: 5433717 - DNA, 17 bp, Homo sapiens
gtcataacatttaaaga

SEQ ID NO: 5433718 - DNA, 22 bp, Homo sapiens
gtcataacggttaagaaagcac

SEQ ID NO: 5433719 - DNA, 17 bp, Homo sapiens
gtcataactagagcacg

SEQ ID NO: 5433720 - DNA, 23 bp, Homo sapiens
gtcataactagattaagatctgt

SEQ ID NO: 5433721 - DNA, 22 bp, Homo sapiens
gtcataagctccagttttcgta

SEQ ID NO: 5433722 - DNA, 19 bp, Homo sapiens
gtcataagtggggagagag

SEQ ID NO: 5433723 - DNA, 11 bp, Homo sapiens
gtcataataaa

SEQ ID NO: 5433724 - DNA, 18 bp, Homo sapiens
gtcataattgcattgact

SEQ ID NO: 5433725 - DNA, 14 bp, Homo sapiens
gtcatacagagaag

SEQ ID NO: 5433726 - DNA, 15 bp, Homo sapiens
gtcatacagagaagt

SEQ ID NO: 5433727 - DNA, 16 bp, Homo sapiens
gtcataccaactttag

SEQ ID NO: 5433728 - DNA, 15 bp, Homo sapiens
gtcataccagaaagc

SEQ ID NO: 5433729 - DNA, 14 bp, Homo sapiens
gtcataccatccat

SEQ ID NO: 5433730 - DNA, 22 bp, Homo sapiens
gtcatacctttttcttaaaaaa

SEQ ID NO: 5433731 - DNA, 20 bp, Homo sapiens
gtcatactatctactctcct

SEQ ID NO: 5433732 - DNA, 19 bp, Homo sapiens
gtcatagactcctttgcta

SEQ ID NO: 5433733 - DNA, 19 bp, Homo sapiens
gtcatagatgtttccttgc

SEQ ID NO: 5433734 - DNA, 21 bp, Homo sapiens
gtcatagcaagcttttgctca

SEQ ID NO: 5433735 - DNA, 23 bp, Homo sapiens
gtcatagccaaagccaggcctga

SEQ ID NO: 5433736 - DNA, 22 bp, Homo sapiens
gtcatagggattgtccctgtgt

SEQ ID NO: 5433737 - DNA, 17 bp, Homo sapiens
gtcatagggctgataat

SEQ ID NO: 5433738 - DNA, 22 bp, Homo sapiens
gtcatagtcttgaaatgaaagg

SEQ ID NO: 5433739 - DNA, 15 bp, Homo sapiens
gtcatagtttcctga

SEQ ID NO: 5433740 - DNA, 15 bp, Homo sapiens
gtcatataaaatata

SEQ ID NO: 5433741 - DNA, 20 bp, Homo sapiens
gtcatatacattagttttaa

SEQ ID NO: 5433742 - DNA, 15 bp, Homo sapiens
gtcatatagtaaaca

SEQ ID NO: 5433743 - DNA, 14 bp, Homo sapiens
gtcatatattcatg

SEQ ID NO: 5433744 - DNA, 20 bp, Homo sapiens
gtcatatattcatgtaataa

SEQ ID NO: 5433745 - DNA, 23 bp, Homo sapiens
gtcatatattcatgtaataaatc

SEQ ID NO: 5433746 - DNA, 14 bp, Homo sapiens
gtcatatcagcttt

SEQ ID NO: 5433747 - DNA, 19 bp, Homo sapiens
gtcatatggaaaaaatgta

SEQ ID NO: 5433748 - DNA, 18 bp, Homo sapiens
gtcatatgtaggtgtctg

SEQ ID NO: 5433749 - DNA, 16 bp, Homo sapiens
gtcatatgttaagcag

SEQ ID NO: 5433750 - DNA, 22 bp, Homo sapiens
gtcatatgttgtgtttggttca

SEQ ID NO: 5433751 - DNA, 19 bp, Homo sapiens
gtcatatgtttattcaaaa

SEQ ID NO: 5433752 - DNA, 20 bp, Homo sapiens
gtcatattcataccttctga

SEQ ID NO: 5433753 - DNA, 17 bp, Homo sapiens
gtcatatttaaacagaa

SEQ ID NO: 5433754 - DNA, 12 bp, Homo sapiens
gtcatattttga

SEQ ID NO: 5433755 - DNA, 14 bp, Homo sapiens
gtcatcaaaaagag

SEQ ID NO: 5433756 - DNA, 20 bp, Homo sapiens
gtcatcaaaacctgcgcagt

SEQ ID NO: 5433757 - DNA, 22 bp, Homo sapiens
gtcatcaaaatctgcacagtca

SEQ ID NO: 5433758 - DNA, 21 bp, Homo sapiens
gtcatcaaacatttgccaagt

SEQ ID NO: 5433759 - DNA, 18 bp, Homo sapiens
gtcatcaacattcttgtg

SEQ ID NO: 5433760 - DNA, 20 bp, Homo sapiens
gtcatcaacattcttgtgtc

SEQ ID NO: 5433761 - DNA, 15 bp, Homo sapiens
gtcatcaagtagtag

SEQ ID NO: 5433762 - DNA, 23 bp, Homo sapiens
gtcatcaatagtgtcctatgcaa

SEQ ID NO: 5433763 - DNA, 17 bp, Homo sapiens
gtcatcaatgtatttgt

SEQ ID NO: 5433764 - DNA, 23 bp, Homo sapiens
gtcatcaattaaaggcaaaggca

SEQ ID NO: 5433765 - DNA, 19 bp, Homo sapiens
gtcatcactccctggatgt

SEQ ID NO: 5433766 - DNA, 15 bp, Homo sapiens
gtcatcacttttcag

SEQ ID NO: 5433767 - DNA, 15 bp, Homo sapiens
gtcatcagatatgct

SEQ ID NO: 5433768 - DNA, 20 bp, Homo sapiens
gtcatcagatgcctgcttga

SEQ ID NO: 5433769 - DNA, 14 bp, Homo sapiens
gtcatcagccacca

SEQ ID NO: 5433770 - DNA, 16 bp, Homo sapiens
gtcatcagccagcaag

SEQ ID NO: 5433771 - DNA, 17 bp, Homo sapiens
gtcatcaggagaaaaag

SEQ ID NO: 5433772 - DNA, 21 bp, Homo sapiens
gtcatcaggtgtgctcagggg

SEQ ID NO: 5433773 - DNA, 16 bp, Homo sapiens
gtcatcagtattgtgt

SEQ ID NO: 5433774 - DNA, 21 bp, Homo sapiens
gtcatcataaaaggtgaccct

SEQ ID NO: 5433775 - DNA, 14 bp, Homo sapiens
gtcatcatcagggc

SEQ ID NO: 5433776 - DNA, 16 bp, Homo sapiens
gtcatcatcagggcct

SEQ ID NO: 5433777 - DNA, 18 bp, Homo sapiens
gtcatcatcagggcctgg

SEQ ID NO: 5433778 - DNA, 17 bp, Homo sapiens
gtcatcatcatggccag

SEQ ID NO: 5433779 - DNA, 14 bp, Homo sapiens
gtcatcatctcttg

SEQ ID NO: 5433780 - DNA, 14 bp, Homo sapiens
gtcatcatgaactg

SEQ ID NO: 5433781 - DNA, 21 bp, Homo sapiens
gtcatcattgtatatatgtgt

SEQ ID NO: 5433782 - DNA, 21 bp, Homo sapiens
gtcatccaacaagaagaaata

SEQ ID NO: 5433783 - DNA, 13 bp, Homo sapiens
gtcatttccccca

SEQ ID NO: 5433784 - DNA, 22 bp, Homo sapiens
gtcatttctatattcctccagc

SEQ ID NO: 5433785 - DNA, 20 bp, Homo sapiens
gtcatttgacaacacatgtg

SEQ ID NO: 5433786 - DNA, 21 bp, Homo sapiens
gtcatttgacaacacatgtgg

SEQ ID NO: 5433787 - DNA, 22 bp, Homo sapiens
gtcatttgacaggggctcagga

SEQ ID NO: 5433788 - DNA, 17 bp, Homo sapiens
gtcatttgagcagggct

SEQ ID NO: 5433789 - DNA, 20 bp, Homo sapiens
gtcatttggtgctctgctaa

SEQ ID NO: 5433790 - DNA, 12 bp, Homo sapiens
gtcatttgtaga

SEQ ID NO: 5433791 - DNA, 16 bp, Homo sapiens
gtcatttgtagatata

SEQ ID NO: 5433792 - DNA, 16 bp, Homo sapiens
gtcattttacaagcat

SEQ ID NO: 5433793 - DNA, 16 bp, Homo sapiens
gtcattttattttgta

SEQ ID NO: 5433794 - DNA, 17 bp, Homo sapiens
gtcattttattttgtaa

SEQ ID NO: 5433795 - DNA, 19 bp, Homo sapiens
gtcattttattttttccct

SEQ ID NO: 5433796 - DNA, 13 bp, Homo sapiens
gtcattttcatta

SEQ ID NO: 5433797 - DNA, 16 bp, Homo sapiens
gtcattttcctttctg

SEQ ID NO: 5433798 - DNA, 17 bp, Homo sapiens
gtcattttcctttctgt

SEQ ID NO: 5433799 - DNA, 15 bp, Homo sapiens
gtcattttctattca

SEQ ID NO: 5433800 - DNA, 17 bp, Homo sapiens
gtcattttgactggctt

SEQ ID NO: 5433801 - DNA, 14 bp, Homo sapiens
gtcattttgcactg

SEQ ID NO: 5433802 - DNA, 18 bp, Homo sapiens
gtcattttggcatctgca

SEQ ID NO: 5433803 - DNA, 22 bp, Homo sapiens
gtcattttggcatctgcaaagg

SEQ ID NO: 5433804 - DNA, 13 bp, Homo sapiens
gtcattttgggtt

SEQ ID NO: 5433805 - DNA, 20 bp, Homo sapiens
gtcattttggtactttggtg

SEQ ID NO: 5433806 - DNA, 22 bp, Homo sapiens
gtcattttgtaatatttgaatt

SEQ ID NO: 5433807 - DNA, 23 bp, Homo sapiens
gtcatttttaatattactgtctt

SEQ ID NO: 5433808 - DNA, 22 bp, Homo sapiens
gtcatttttaatgtatctattt

SEQ ID NO: 5433809 - DNA, 23 bp, Homo sapiens
gtcatttttaatgtatctatttg

SEQ ID NO: 5433810 - DNA, 20 bp, Homo sapiens
gtcatttttacaatgtaatt

SEQ ID NO: 5433811 - DNA, 22 bp, Homo sapiens
gtcatttttacaatgtaattat

SEQ ID NO: 5433812 - DNA, 14 bp, Homo sapiens
gtcatttttccttc

SEQ ID NO: 5433813 - DNA, 12 bp, Homo sapiens
gtcatttttgtt

SEQ ID NO: 5433814 - DNA, 19 bp, Homo sapiens
gtcatttttgtttttggtt

SEQ ID NO: 5433815 - DNA, 20 bp, Homo sapiens
gtccaaaaaaaggaaaaata

SEQ ID NO: 5433816 - DNA, 20 bp, Homo sapiens
gtccaaaaagctcctggggc

SEQ ID NO: 5433817 - DNA, 15 bp, Homo sapiens
gtccaaaaccgccag

SEQ ID NO: 5433818 - DNA, 20 bp, Homo sapiens
gtccaaaaccgccagctctg

SEQ ID NO: 5433819 - DNA, 23 bp, Homo sapiens
gtccaaaaccgccagctctgttc

SEQ ID NO: 5433820 - DNA, 18 bp, Homo sapiens
gtccaaaagattgctgaa

SEQ ID NO: 5433821 - DNA, 20 bp, Homo sapiens
gtccaaaagcgccctcacta

SEQ ID NO: 5433822 - DNA, 17 bp, Homo sapiens
gtccaaaataataacat

SEQ ID NO: 5433823 - DNA, 22 bp, Homo sapiens
gtccaaaatatttgtgatttac

SEQ ID NO: 5433824 - DNA, 18 bp, Homo sapiens
gtccaaacaggtgctggc

SEQ ID NO: 5433825 - DNA, 20 bp, Homo sapiens
gtccaaacaggtgctggccc

SEQ ID NO: 5433826 - DNA, 15 bp, Homo sapiens
gtccaaacatttcat

SEQ ID NO: 5433827 - DNA, 15 bp, Homo sapiens
gtccaaacccactca

SEQ ID NO: 5433828 - DNA, 19 bp, Homo sapiens
gtccaaacccatcttcatg

SEQ ID NO: 5433829 - DNA, 22 bp, Homo sapiens
gtccaaacccttcaactcctgg

SEQ ID NO: 5433830 - DNA, 17 bp, Homo sapiens
gtccaaacgtcctcttt

SEQ ID NO: 5433831 - DNA, 14 bp, Homo sapiens
gtccaaactgccta

SEQ ID NO: 5433832 - DNA, 19 bp, Homo sapiens
gtccaaagctgaaaatgtg

SEQ ID NO: 5433833 - DNA, 16 bp, Homo sapiens
gtccaaaggaggctgg

SEQ ID NO: 5433834 - DNA, 21 bp, Homo sapiens
gtccaaaggagtgcatggcca

SEQ ID NO: 5433835 - DNA, 17 bp, Homo sapiens
gtccaaaggccagcggt

SEQ ID NO: 5433836 - DNA, 20 bp, Homo sapiens
gtccaaataaattcaataaa

SEQ ID NO: 5433837 - DNA, 17 bp, Homo sapiens
gtccaaatactctgaaa

SEQ ID NO: 5433838 - DNA, 20 bp, Homo sapiens
gtccaacaactccaggaaaa

SEQ ID NO: 5433839 - DNA, 16 bp, Homo sapiens
gtccaacaactgtcag

SEQ ID NO: 5433840 - DNA, 15 bp, Homo sapiens
gtccaacaagaatgc

SEQ ID NO: 5433841 - DNA, 15 bp, Homo sapiens
gtccaaccagaaaca

SEQ ID NO: 5433842 - DNA, 22 bp, Homo sapiens
gtccaaccagactttgagcctg

SEQ ID NO: 5433843 - DNA, 16 bp, Homo sapiens
gtccaacccagcctga

SEQ ID NO: 5433844 - DNA, 14 bp, Homo sapiens
gtccaacccctccc

SEQ ID NO: 5433845 - DNA, 17 bp, Homo sapiens
gtccaacccctccccca

SEQ ID NO: 5433846 - DNA, 15 bp, Homo sapiens
gtccaacctgcctgt

SEQ ID NO: 5433847 - DNA, 16 bp, Homo sapiens
gtccaacgccgccttg

SEQ ID NO: 5433848 - DNA, 20 bp, Homo sapiens
gtccaacgtggggcagcaca

SEQ ID NO: 5433849 - DNA, 14 bp, Homo sapiens
gtccaactactaaa

SEQ ID NO: 5433850 - DNA, 13 bp, Homo sapiens
gtccaactccagt

SEQ ID NO: 5433851 - DNA, 16 bp, Homo sapiens
gtccaactctgtattt

SEQ ID NO: 5433852 - DNA, 22 bp, Homo sapiens
gtccaactcttccacctctggg

SEQ ID NO: 5433853 - DNA, 15 bp, Homo sapiens
gtccaactgcaactc

SEQ ID NO: 5433854 - DNA, 13 bp, Homo sapiens
gtccaagaagccc

SEQ ID NO: 5433855 - DNA, 17 bp, Homo sapiens
gtccaagaagcccagga

SEQ ID NO: 5433856 - DNA, 16 bp, Homo sapiens
gtccaagacacatgct

SEQ ID NO: 5433857 - DNA, 18 bp, Homo sapiens
gtccaagaggggccgctg

SEQ ID NO: 5433858 - DNA, 17 bp, Homo sapiens
gtccaagcaacagcctt

SEQ ID NO: 5433859 - DNA, 14 bp, Homo sapiens
gtccaagcagagtg

SEQ ID NO: 5433860 - DNA, 22 bp, Homo sapiens
gtccaaggaaaccacagctgct

SEQ ID NO: 5433861 - DNA, 22 bp, Homo sapiens
gtccaaggaaacttgaatcaaa

SEQ ID NO: 5433862 - DNA, 15 bp, Homo sapiens
gtccaaggcagttct

SEQ ID NO: 5433863 - DNA, 16 bp, Homo sapiens
gtccaaggcagttctg

SEQ ID NO: 5433864 - DNA, 22 bp, Homo sapiens
gtccaaggctggtcccacactt

SEQ ID NO: 5433865 - DNA, 18 bp, Homo sapiens
gtccaagggacagcccac

SEQ ID NO: 5433866 - DNA, 21 bp, Homo sapiens
gtccaagggccatacttttga

SEQ ID NO: 5433867 - DNA, 20 bp, Homo sapiens
gtccaaggggtcccctccag

SEQ ID NO: 5433868 - DNA, 16 bp, Homo sapiens
gtccaaggtcaaggca

SEQ ID NO: 5433869 - DNA, 20 bp, Homo sapiens
gtccaaggtttaaagagtct

SEQ ID NO: 5433870 - DNA, 14 bp, Homo sapiens
gtccaagtgtttct

SEQ ID NO: 5433871 - DNA, 15 bp, Homo sapiens
gtccaagtgtttctt

SEQ ID NO: 5433872 - DNA, 14 bp, Homo sapiens
gtccaatcagagaa

SEQ ID NO: 5433873 - DNA, 18 bp, Homo sapiens
gtccaatcagagaataaa

SEQ ID NO: 5433874 - DNA, 17 bp, Homo sapiens
gtccaatgagctttctg

SEQ ID NO: 5433875 - DNA, 19 bp, Homo sapiens
gtccaatgagctttctgaa

SEQ ID NO: 5433876 - DNA, 21 bp, Homo sapiens
gtccaatgagctttctgaaca

SEQ ID NO: 5433877 - DNA, 17 bp, Homo sapiens
gtccaatgccacctaga

SEQ ID NO: 5433878 - DNA, 17 bp, Homo sapiens
gtccaatggctgtaaac

SEQ ID NO: 5433879 - DNA, 20 bp, Homo sapiens
gtccaatggctgtaaactat

SEQ ID NO: 5433880 - DNA, 17 bp, Homo sapiens
gtccaattagtttcctt

SEQ ID NO: 5433881 - DNA, 19 bp, Homo sapiens
gtccaatttctattaaagg

SEQ ID NO: 5433882 - DNA, 19 bp, Homo sapiens
gtccaatttgtaaaaacag

SEQ ID NO: 5433883 - DNA, 16 bp, Homo sapiens
gtccaattttaattta

SEQ ID NO: 5433884 - DNA, 13 bp, Homo sapiens
gtccaattttcct

SEQ ID NO: 5433885 - DNA, 20 bp, Homo sapiens
gtccacaaaataaccaatcc

SEQ ID NO: 5433886 - DNA, 20 bp, Homo sapiens
gtccacaaatgtcctcagag

SEQ ID NO: 5433887 - DNA, 22 bp, Homo sapiens
gtccacaagaaggggtgtttat

SEQ ID NO: 5433888 - DNA, 22 bp, Homo sapiens
gtccacaagcttctgtcctgcc

SEQ ID NO: 5433889 - DNA, 20 bp, Homo sapiens
gtccacacaagacagcagag

SEQ ID NO: 5433890 - DNA, 19 bp, Homo sapiens
gtccacacccaattccact

SEQ ID NO: 5433891 - DNA, 15 bp, Homo sapiens
gtccacagatgcctc

SEQ ID NO: 5433892 - DNA, 16 bp, Homo sapiens
gtccacagctgaagag

SEQ ID NO: 5433893 - DNA, 13 bp, Homo sapiens
gtccacagctgga

SEQ ID NO: 5433894 - DNA, 13 bp, Homo sapiens
gtccacaggaagt

SEQ ID NO: 5433895 - DNA, 20 bp, Homo sapiens
gtccacaggggcaggcctgg

SEQ ID NO: 5433896 - DNA, 22 bp, Homo sapiens
gtccacaggggcaggcctggga

SEQ ID NO: 5433897 - DNA, 20 bp, Homo sapiens
gtccacaggggccaccacct

SEQ ID NO: 5433898 - DNA, 18 bp, Homo sapiens
gtccacagtctcccattc

SEQ ID NO: 5433899 - DNA, 14 bp, Homo sapiens
gtccacatccccag

SEQ ID NO: 5433900 - DNA, 17 bp, Homo sapiens
gtccacatccccagagc

SEQ ID NO: 5433901 - DNA, 18 bp, Homo sapiens
gtccacatccccagagcc

SEQ ID NO: 5433902 - DNA, 22 bp, Homo sapiens
gtccacatccccagagcccagc

SEQ ID NO: 5433903 - DNA, 15 bp, Homo sapiens
gtccacattctgctg

SEQ ID NO: 5433904 - DNA, 18 bp, Homo sapiens
gtccaccacttcagggga

SEQ ID NO: 5433905 - DNA, 19 bp, Homo sapiens
gtccaccaggcctcactgg

SEQ ID NO: 5433906 - DNA, 12 bp, Homo sapiens
gtccaccagtgt

SEQ ID NO: 5433907 - DNA, 23 bp, Homo sapiens
gtccaccagtgtgtgggggagat

SEQ ID NO: 5433908 - DNA, 17 bp, Homo sapiens
gtccaccagtttataca

SEQ ID NO: 5433909 - DNA, 18 bp, Homo sapiens
gtccaccatccccagctg

SEQ ID NO: 5433910 - DNA, 15 bp, Homo sapiens
gtccaccatgctctc

SEQ ID NO: 5433911 - DNA, 21 bp, Homo sapiens
gtccaccatggggtcctacca

SEQ ID NO: 5433912 - DNA, 20 bp, Homo sapiens
gtccacccacttagtccact

SEQ ID NO: 5433913 - DNA, 13 bp, Homo sapiens
gtccacccaggag

SEQ ID NO: 5433914 - DNA, 15 bp, Homo sapiens
gtccacccaggagcc

SEQ ID NO: 5433915 - DNA, 16 bp, Homo sapiens
gtccacccaggagccc

SEQ ID NO: 5433916 - DNA, 12 bp, Homo sapiens
gtccacccaggc

SEQ ID NO: 5433917 - DNA, 15 bp, Homo sapiens
gtccacccaggctgc

SEQ ID NO: 5433918 - DNA, 21 bp, Homo sapiens
gtccacccaggctgcactgca

SEQ ID NO: 5433919 - DNA, 17 bp, Homo sapiens
gtccacccccattgtga

SEQ ID NO: 5433920 - DNA, 14 bp, Homo sapiens
gtccaccccccaca

SEQ ID NO: 5433921 - DNA, 19 bp, Homo sapiens
gtccaccccccacacacac

SEQ ID NO: 5433922 - DNA, 21 bp, Homo sapiens
gtccaccccccacacacacta

SEQ ID NO: 5433923 - DNA, 19 bp, Homo sapiens
gtccacccgtttccaagcc

SEQ ID NO: 5433924 - DNA, 22 bp, Homo sapiens
gtccacccgtttccaagcctgg

SEQ ID NO: 5433925 - DNA, 23 bp, Homo sapiens
gtccaccctcatttctgccagcg

SEQ ID NO: 5433926 - DNA, 15 bp, Homo sapiens
gtccaccctgagctc

SEQ ID NO: 5433927 - DNA, 17 bp, Homo sapiens
gtccaccctgagctcgg

SEQ ID NO: 5433928 - DNA, 17 bp, Homo sapiens
gtccaccctgcagccag

SEQ ID NO: 5433929 - DNA, 14 bp, Homo sapiens
gtccaccctgccaa

SEQ ID NO: 5433930 - DNA, 15 bp, Homo sapiens
gtccaccctgcctgc

SEQ ID NO: 5433931 - DNA, 14 bp, Homo sapiens
gtccaccctgtcct

SEQ ID NO: 5433932 - DNA, 15 bp, Homo sapiens
gtccaccctgtccta

SEQ ID NO: 5433933 - DNA, 18 bp, Homo sapiens
gtccaccctgtcctatga

SEQ ID NO: 5433934 - DNA, 15 bp, Homo sapiens
gtccaccggcccctg

SEQ ID NO: 5433935 - DNA, 17 bp, Homo sapiens
gtccaccggcccctggc

SEQ ID NO: 5433936 - DNA, 18 bp, Homo sapiens
gtccaccggcccctggca

SEQ ID NO: 5433937 - DNA, 19 bp, Homo sapiens
gtccaccggcccctggcag

SEQ ID NO: 5433938 - DNA, 22 bp, Homo sapiens
gtccacctgagctgccatccag

SEQ ID NO: 5433939 - DNA, 15 bp, Homo sapiens
gtccacctgcctatc

SEQ ID NO: 5433940 - DNA, 20 bp, Homo sapiens
gtccacctgtgagaaaggaa

SEQ ID NO: 5433941 - DNA, 15 bp, Homo sapiens
gtccacctgtgctgc

SEQ ID NO: 5433942 - DNA, 18 bp, Homo sapiens
gtccacgactgtctccat

SEQ ID NO: 5433943 - DNA, 20 bp, Homo sapiens
gtccacgcctctgctgtagc

SEQ ID NO: 5433944 - DNA, 17 bp, Homo sapiens
gtccacgcggccacctc

SEQ ID NO: 5433945 - DNA, 13 bp, Homo sapiens
gtccacgtactta

SEQ ID NO: 5433946 - DNA, 18 bp, Homo sapiens
gtccacgtacttaattta

SEQ ID NO: 5433947 - DNA, 15 bp, Homo sapiens
gtccactcccaagcc

SEQ ID NO: 5433948 - DNA, 15 bp, Homo sapiens
gtccactccctgctc

SEQ ID NO: 5433949 - DNA, 23 bp, Homo sapiens
gtccactcgggggtggagtgaga

SEQ ID NO: 5433950 - DNA, 18 bp, Homo sapiens
gtccactctcggggccct

SEQ ID NO: 5433951 - DNA, 20 bp, Homo sapiens
gtccactctgctcagggccg

SEQ ID NO: 5433952 - DNA, 19 bp, Homo sapiens
gtccactgagactttcccc

SEQ ID NO: 5433953 - DNA, 20 bp, Homo sapiens
gtccactggggagtgctgga

SEQ ID NO: 5433954 - DNA, 21 bp, Homo sapiens
gtccactggggtggcctgact

SEQ ID NO: 5433955 - DNA, 11 bp, Homo sapiens
gtccactgtgt

SEQ ID NO: 5433956 - DNA, 23 bp, Homo sapiens
gtccactgtgtatagaagtagat

SEQ ID NO: 5433957 - DNA, 17 bp, Homo sapiens
gtccacttaaaatacat

SEQ ID NO: 5433958 - DNA, 20 bp, Homo sapiens
gtccacttaaataatcctct

SEQ ID NO: 5433959 - DNA, 17 bp, Homo sapiens
gtcccagtgaactcggc

SEQ ID NO: 5433960 - DNA, 16 bp, Homo sapiens
gtcccagtgccattgg

SEQ ID NO: 5433961 - DNA, 12 bp, Homo sapiens
gtcccagtgccg

SEQ ID NO: 5433962 - DNA, 15 bp, Homo sapiens
gtcccagtgggaggc

SEQ ID NO: 5433963 - DNA, 17 bp, Homo sapiens
gtcccagtgggaggcgc

SEQ ID NO: 5433964 - DNA, 18 bp, Homo sapiens
gtcccagtgggaggggca

SEQ ID NO: 5433965 - DNA, 22 bp, Homo sapiens
gtcccagtgggaggggcaggct

SEQ ID NO: 5433966 - DNA, 13 bp, Homo sapiens
gtcccagtgtctg

SEQ ID NO: 5433967 - DNA, 16 bp, Homo sapiens
gtcccagtgtctggcc

SEQ ID NO: 5433968 - DNA, 17 bp, Homo sapiens
gtcccagtgtctggccc

SEQ ID NO: 5433969 - DNA, 23 bp, Homo sapiens
gtcccagtgtctggcccagccat

SEQ ID NO: 5433970 - DNA, 17 bp, Homo sapiens
gtcccagttgctgtcac

SEQ ID NO: 5433971 - DNA, 17 bp, Homo sapiens
gtcccagtttcccactc

SEQ ID NO: 5433972 - DNA, 20 bp, Homo sapiens
gtcccataggtcttgtgaaa

SEQ ID NO: 5433973 - DNA, 16 bp, Homo sapiens
gtcccatagtccctgc

SEQ ID NO: 5433974 - DNA, 15 bp, Homo sapiens
gtcccatatcctgcc

SEQ ID NO: 5433975 - DNA, 17 bp, Homo sapiens
gtcccatccagctacca

SEQ ID NO: 5433976 - DNA, 16 bp, Homo sapiens
gtcccatccaggcagt

SEQ ID NO: 5433977 - DNA, 15 bp, Homo sapiens
gtcccatctgccctc

SEQ ID NO: 5433978 - DNA, 16 bp, Homo sapiens
gtcccatcttcactct

SEQ ID NO: 5433979 - DNA, 17 bp, Homo sapiens
gtcccatgacccacccc

SEQ ID NO: 5433980 - DNA, 22 bp, Homo sapiens
gtcccatgacccacccctgtgc

SEQ ID NO: 5433981 - DNA, 14 bp, Homo sapiens
gtcccatgaggtct

SEQ ID NO: 5433982 - DNA, 23 bp, Homo sapiens
gtcccatggacactccagtgcca

SEQ ID NO: 5433983 - DNA, 15 bp, Homo sapiens
gtcccatggcctgct

SEQ ID NO: 5433984 - DNA, 17 bp, Homo sapiens
gtcccatggcctgctgg

SEQ ID NO: 5433985 - DNA, 19 bp, Homo sapiens
gtcccatggcctgctgggc

SEQ ID NO: 5433986 - DNA, 21 bp, Homo sapiens
gtcccatggcctgctgggctt

SEQ ID NO: 5433987 - DNA, 17 bp, Homo sapiens
gtcccatgggctctggc

SEQ ID NO: 5433988 - DNA, 21 bp, Homo sapiens
gtcccatggggaaaccctgga

SEQ ID NO: 5433989 - DNA, 17 bp, Homo sapiens
gtcccatgtgagctgct

SEQ ID NO: 5433990 - DNA, 21 bp, Homo sapiens
gtcccatgtgagctgctgcca

SEQ ID NO: 5433991 - DNA, 16 bp, Homo sapiens
gtcccattctagatcc

SEQ ID NO: 5433992 - DNA, 23 bp, Homo sapiens
gtcccattctccactcactgcat

SEQ ID NO: 5433993 - DNA, 22 bp, Homo sapiens
gtcccattgttggcgctgaggt

SEQ ID NO: 5433994 - DNA, 14 bp, Homo sapiens
gtcccatttccttg

SEQ ID NO: 5433995 - DNA, 21 bp, Homo sapiens
gtcccattttagccaagctta

SEQ ID NO: 5433996 - DNA, 21 bp, Homo sapiens
gtcccattttccccttcctca

SEQ ID NO: 5433997 - DNA, 15 bp, Homo sapiens
gtccccaaaatgtga

SEQ ID NO: 5433998 - DNA, 11 bp, Homo sapiens
gtccccaaagt

SEQ ID NO: 5433999 - DNA, 16 bp, Homo sapiens
gtccccaacagcgccc

SEQ ID NO: 5434000 - DNA, 21 bp, Homo sapiens
gtccccaacccgtgcccctgg

SEQ ID NO: 5434001 - DNA, 16 bp, Homo sapiens
gtccccaacctgcact

SEQ ID NO: 5434002 - DNA, 17 bp, Homo sapiens
gtccccaacctgcactc

SEQ ID NO: 5434003 - DNA, 16 bp, Homo sapiens
gtccccaacgtcccct

SEQ ID NO: 5434004 - DNA, 14 bp, Homo sapiens
gtccccaaggcctc

SEQ ID NO: 5434005 - DNA, 18 bp, Homo sapiens
gtccccaaggcctctctc

SEQ ID NO: 5434006 - DNA, 23 bp, Homo sapiens
gtccccaatgctgtacctggctg

SEQ ID NO: 5434007 - DNA, 14 bp, Homo sapiens
gtccccacagactg

SEQ ID NO: 5434008 - DNA, 15 bp, Homo sapiens
gtccccacagactgc

SEQ ID NO: 5434009 - DNA, 20 bp, Homo sapiens
gtccccacagactgccccag

SEQ ID NO: 5434010 - DNA, 13 bp, Homo sapiens
gtccccacccatg

SEQ ID NO: 5434011 - DNA, 16 bp, Homo sapiens
gtccccaccccatggg

SEQ ID NO: 5434012 - DNA, 15 bp, Homo sapiens
gtccccacccctgcc

SEQ ID NO: 5434013 - DNA, 17 bp, Homo sapiens
gtccccaccgcagacag

SEQ ID NO: 5434014 - DNA, 22 bp, Homo sapiens
gtccccaccgcagacaggacca

SEQ ID NO: 5434015 - DNA, 12 bp, Homo sapiens
gtccccactccc

SEQ ID NO: 5434016 - DNA, 13 bp, Homo sapiens
gtccccactcccg

SEQ ID NO: 5434017 - DNA, 19 bp, Homo sapiens
gtccccagaccaaccctgg

SEQ ID NO: 5434018 - DNA, 22 bp, Homo sapiens
gtccccagaccaaccctgggac

SEQ ID NO: 5434019 - DNA, 23 bp, Homo sapiens
gtccccagagaaagcgcagatgc

SEQ ID NO: 5434020 - DNA, 13 bp, Homo sapiens
gtccccagcagaa

SEQ ID NO: 5434021 - DNA, 13 bp, Homo sapiens
gtccccagcccac

SEQ ID NO: 5434022 - DNA, 15 bp, Homo sapiens
gtccccagcccactg

SEQ ID NO: 5434023 - DNA, 17 bp, Homo sapiens
gtccccagccctgggct

SEQ ID NO: 5434024 - DNA, 17 bp, Homo sapiens
gtccccagccctgtcct

SEQ ID NO: 5434025 - DNA, 18 bp, Homo sapiens
gtccccagccctgtcctg

SEQ ID NO: 5434026 - DNA, 19 bp, Homo sapiens
gtccccagccctgtcctgg

SEQ ID NO: 5434027 - DNA, 13 bp, Homo sapiens
gtccccagctccc

SEQ ID NO: 5434028 - DNA, 12 bp, Homo sapiens
gtccccaggccc

SEQ ID NO: 5434029 - DNA, 19 bp, Homo sapiens
gtccccaggcccagccctc

SEQ ID NO: 5434030 - DNA, 19 bp, Homo sapiens
gtccccaggccccaggaag

SEQ ID NO: 5434031 - DNA, 20 bp, Homo sapiens
gtccccaggccccaggaagc

SEQ ID NO: 5434032 - DNA, 14 bp, Homo sapiens
gtccccaggcctgg

SEQ ID NO: 5434033 - DNA, 13 bp, Homo sapiens
gtccccagggccc

SEQ ID NO: 5434034 - DNA, 12 bp, Homo sapiens
gtccccagggtg

SEQ ID NO: 5434035 - DNA, 19 bp, Homo sapiens
gtccccagggtgcaggcgc

SEQ ID NO: 5434036 - DNA, 12 bp, Homo sapiens
gtccccatcagc

SEQ ID NO: 5434037 - DNA, 17 bp, Homo sapiens
gtccccatcatcccagc

SEQ ID NO: 5434038 - DNA, 19 bp, Homo sapiens
gtccccatcatcccagctg

SEQ ID NO: 5434039 - DNA, 13 bp, Homo sapiens
gtccccatcccat

SEQ ID NO: 5434040 - DNA, 16 bp, Homo sapiens
gtccccatccccacca

SEQ ID NO: 5434041 - DNA, 17 bp, Homo sapiens
gtccccatccccaccag

SEQ ID NO: 5434042 - DNA, 19 bp, Homo sapiens
gtccccatccccaccagct

SEQ ID NO: 5434043 - DNA, 14 bp, Homo sapiens
gtccccatctgtcg

SEQ ID NO: 5434044 - DNA, 12 bp, Homo sapiens
gtccccatggct

SEQ ID NO: 5434045 - DNA, 12 bp, Homo sapiens
gtccccatttct

SEQ ID NO: 5434046 - DNA, 16 bp, Homo sapiens
gtccccatttctgcct

SEQ ID NO: 5434047 - DNA, 20 bp, Homo sapiens
gtcccccaactctgagccca

SEQ ID NO: 5434048 - DNA, 15 bp, Homo sapiens
gtcccccaacttgag

SEQ ID NO: 5434049 - DNA, 16 bp, Homo sapiens
gtcccccaacttgaga

SEQ ID NO: 5434050 - DNA, 14 bp, Homo sapiens
gtcccccacccacc

SEQ ID NO: 5434051 - DNA, 16 bp, Homo sapiens
gtcccccactctctca

SEQ ID NO: 5434052 - DNA, 23 bp, Homo sapiens
gtcccccactctctcacccacca

SEQ ID NO: 5434053 - DNA, 13 bp, Homo sapiens
gtcccccactgct

SEQ ID NO: 5434054 - DNA, 15 bp, Homo sapiens
gtcccccagaacctc

SEQ ID NO: 5434055 - DNA, 21 bp, Homo sapiens
gtcccccagagcatctgcccc

SEQ ID NO: 5434056 - DNA, 22 bp, Homo sapiens
gtcccccagagcatctgcccca

SEQ ID NO: 5434057 - DNA, 23 bp, Homo sapiens
gtcccccagagcatctgccccag

SEQ ID NO: 5434058 - DNA, 24 bp, Homo sapiens
gtcccccagagcatctgccccagg

SEQ ID NO: 5434059 - DNA, 15 bp, Homo sapiens
gtcccccagcagaac

SEQ ID NO: 5434060 - DNA, 18 bp, Homo sapiens
gtcccccagccctcaggc

SEQ ID NO: 5434061 - DNA, 13 bp, Homo sapiens
gtcccccagctct

SEQ ID NO: 5434062 - DNA, 13 bp, Homo sapiens
gtcccccaggagg

SEQ ID NO: 5434063 - DNA, 14 bp, Homo sapiens
gtcccccaggctgg

SEQ ID NO: 5434064 - DNA, 18 bp, Homo sapiens
gtcccccaggctggagtg

SEQ ID NO: 5434065 - DNA, 16 bp, Homo sapiens
gtcccccatgccacca

SEQ ID NO: 5434066 - DNA, 18 bp, Homo sapiens
gtcccccatgccaccacc

SEQ ID NO: 5434067 - DNA, 21 bp, Homo sapiens
gtcccccatgctctgatgcag

SEQ ID NO: 5434068 - DNA, 19 bp, Homo sapiens
gtccccccacagctccagg

SEQ ID NO: 5434069 - DNA, 23 bp, Homo sapiens
gtccccccacagctccaggacac

SEQ ID NO: 5434070 - DNA, 11 bp, Homo sapiens
gtccccccacc

SEQ ID NO: 5434071 - DNA, 12 bp, Homo sapiens
gtccccccaccc

SEQ ID NO: 5434072 - DNA, 13 bp, Homo sapiens
gtccccccacccc

SEQ ID NO: 5434073 - DNA, 14 bp, Homo sapiens
gtccccccacccct

SEQ ID NO: 5434074 - DNA, 15 bp, Homo sapiens
gtccccccacccctc

SEQ ID NO: 5434075 - DNA, 14 bp, Homo sapiens
gtccccccactccc

SEQ ID NO: 5434076 - DNA, 14 bp, Homo sapiens
gtccccccccaggc

SEQ ID NO: 5434077 - DNA, 19 bp, Homo sapiens
gtccccccctaactttctt

SEQ ID NO: 5434078 - DNA, 14 bp, Homo sapiens
gtcccccctccctg

SEQ ID NO: 5434079 - DNA, 13 bp, Homo sapiens
gtcccccctgagt

SEQ ID NO: 5434080 - DNA, 13 bp, Homo sapiens
gtcccccctgtgg

SEQ ID NO: 5434081 - DNA, 18 bp, Homo sapiens
gtcccccctgtggtctgt

SEQ ID NO: 5434082 - DNA, 22 bp, Homo sapiens
gtcccccgaccaatccccagcc

SEQ ID NO: 5434083 - DNA, 23 bp, Homo sapiens
gtcccccgaccaatccccagcct

SEQ ID NO: 5434084 - DNA, 17 bp, Homo sapiens
gtcccccgttgtgcctg

SEQ ID NO: 5434085 - DNA, 13 bp, Homo sapiens
gtccccctaccca

SEQ ID NO: 5434086 - DNA, 17 bp, Homo sapiens
gtccccctacccaccga

SEQ ID NO: 5434087 - DNA, 15 bp, Homo sapiens
gtccccctagagact

SEQ ID NO: 5434088 - DNA, 17 bp, Homo sapiens
gtccccctatccttggc

SEQ ID NO: 5434089 - DNA, 14 bp, Homo sapiens
gtccccctcccact

SEQ ID NO: 5434090 - DNA, 19 bp, Homo sapiens
gtccccctcccctcccagt

SEQ ID NO: 5434091 - DNA, 18 bp, Homo sapiens
gtccccctccctgcccaa

SEQ ID NO: 5434092 - DNA, 16 bp, Homo sapiens
gtccccctcctcagcc

SEQ ID NO: 5434093 - DNA, 19 bp, Homo sapiens
gtccccctctgtccaggca

SEQ ID NO: 5434094 - DNA, 21 bp, Homo sapiens
gtccccctctgtccaggcact

SEQ ID NO: 5434095 - DNA, 12 bp, Homo sapiens
gtccccctgcag

SEQ ID NO: 5434096 - DNA, 14 bp, Homo sapiens
gtccccctgcagct

SEQ ID NO: 5434097 - DNA, 15 bp, Homo sapiens
gtccccctgcagcta

SEQ ID NO: 5434098 - DNA, 20 bp, Homo sapiens
gtccccgagccgagctctcc

SEQ ID NO: 5434099 - DNA, 14 bp, Homo sapiens
gtccccgaggagct

SEQ ID NO: 5434100 - DNA, 19 bp, Homo sapiens
gtccccgaggagctgggcc

SEQ ID NO: 5434101 - DNA, 23 bp, Homo sapiens
gtccccgaggagctgggcccctg

SEQ ID NO: 5434102 - DNA, 18 bp, Homo sapiens
gtccccgccctctctcat

SEQ ID NO: 5434103 - DNA, 15 bp, Homo sapiens
gtccccgccttccct

SEQ ID NO: 5434104 - DNA, 16 bp, Homo sapiens
gtccccgctgctgtgc

SEQ ID NO: 5434105 - DNA, 15 bp, Homo sapiens
gtccccgctggctca

SEQ ID NO: 5434106 - DNA, 19 bp, Homo sapiens
gtccccggacgctggctcg

SEQ ID NO: 5434107 - DNA, 17 bp, Homo sapiens
gtccccggcccctgccc

SEQ ID NO: 5434108 - DNA, 18 bp, Homo sapiens
gtccccgggaaaggccgg

SEQ ID NO: 5434109 - DNA, 14 bp, Homo sapiens
gtccccgggagcac

SEQ ID NO: 5434110 - DNA, 15 bp, Homo sapiens
gtccccggggcccag

SEQ ID NO: 5434111 - DNA, 14 bp, Homo sapiens
gtccccggttgctg

SEQ ID NO: 5434112 - DNA, 19 bp, Homo sapiens
gtccccggttgctggtcag

SEQ ID NO: 5434113 - DNA, 15 bp, Homo sapiens
gtccccgtgccccgc

SEQ ID NO: 5434114 - DNA, 18 bp, Homo sapiens
gtccccgtggccatccct

SEQ ID NO: 5434115 - DNA, 20 bp, Homo sapiens
gtcccctactccctcttcac

SEQ ID NO: 5434116 - DNA, 17 bp, Homo sapiens
gtcccctagagtcccag

SEQ ID NO: 5434117 - DNA, 22 bp, Homo sapiens
gtcccctatgccactaagccaa

SEQ ID NO: 5434118 - DNA, 20 bp, Homo sapiens
gtcccctcacagactcttcc

SEQ ID NO: 5434119 - DNA, 21 bp, Homo sapiens
gtcccctcacagactcttcca

SEQ ID NO: 5434120 - DNA, 23 bp, Homo sapiens
gtcccctcacgtgaccagccccg

SEQ ID NO: 5434121 - DNA, 15 bp, Homo sapiens
gtcccctcactctgt

SEQ ID NO: 5434122 - DNA, 17 bp, Homo sapiens
gtcccctcactctgtca

SEQ ID NO: 5434123 - DNA, 15 bp, Homo sapiens
gtcccctcagctcca

SEQ ID NO: 5434124 - DNA, 14 bp, Homo sapiens
gtcccctccatctg

SEQ ID NO: 5434125 - DNA, 19 bp, Homo sapiens
gtcccctccatctggggat

SEQ ID NO: 5434126 - DNA, 12 bp, Homo sapiens
gtcccctcccag

SEQ ID NO: 5434127 - DNA, 21 bp, Homo sapiens
gtcccctccccagctcccttg

SEQ ID NO: 5434128 - DNA, 16 bp, Homo sapiens
gtcccctccccggccc

SEQ ID NO: 5434129 - DNA, 12 bp, Homo sapiens
gtcccctccctc

SEQ ID NO: 5434130 - DNA, 16 bp, Homo sapiens
gtcccctccctcgtgg

SEQ ID NO: 5434131 - DNA, 12 bp, Homo sapiens
gtcccctccgcc

SEQ ID NO: 5434132 - DNA, 18 bp, Homo sapiens
gtcccctccgccatgggg

SEQ ID NO: 5434133 - DNA, 15 bp, Homo sapiens
gtcccctctcccctc

SEQ ID NO: 5434134 - DNA, 17 bp, Homo sapiens
gtcccctctcccctcat

SEQ ID NO: 5434135 - DNA, 16 bp, Homo sapiens
gtcccctctccccttg

SEQ ID NO: 5434136 - DNA, 14 bp, Homo sapiens
gtcccctctctctg

SEQ ID NO: 5434137 - DNA, 21 bp, Homo sapiens
gtcccctctgccccaccctca

SEQ ID NO: 5434138 - DNA, 23 bp, Homo sapiens
gtcccctctgtcatcactccctg

SEQ ID NO: 5434139 - DNA, 18 bp, Homo sapiens
gtcctctttcagaaaaca

SEQ ID NO: 5434140 - DNA, 14 bp, Homo sapiens
gtcctctttcagct

SEQ ID NO: 5434141 - DNA, 18 bp, Homo sapiens
gtcctctttcagctcctg

SEQ ID NO: 5434142 - DNA, 13 bp, Homo sapiens
gtcctcttttcct

SEQ ID NO: 5434143 - DNA, 18 bp, Homo sapiens
gtcctcttttcctggcag

SEQ ID NO: 5434144 - DNA, 20 bp, Homo sapiens
gtcctgaaccgactgaccct

SEQ ID NO: 5434145 - DNA, 20 bp, Homo sapiens
gtcctgaagaggcgggccag

SEQ ID NO: 5434146 - DNA, 22 bp, Homo sapiens
gtcctgaagaggcgggccagcc

SEQ ID NO: 5434147 - DNA, 23 bp, Homo sapiens
gtcctgaagaggcgggccagcca

SEQ ID NO: 5434148 - DNA, 19 bp, Homo sapiens
gtcctgaagatcaagccag

SEQ ID NO: 5434149 - DNA, 14 bp, Homo sapiens
gtcctgaagctgct

SEQ ID NO: 5434150 - DNA, 17 bp, Homo sapiens
gtcctgaagctgctgga

SEQ ID NO: 5434151 - DNA, 19 bp, Homo sapiens
gtcctgaaggcctgaggtt

SEQ ID NO: 5434152 - DNA, 18 bp, Homo sapiens
gtcctgaatggctttgtc

SEQ ID NO: 5434153 - DNA, 21 bp, Homo sapiens
gtcctgaatgtagcgtgtaag

SEQ ID NO: 5434154 - DNA, 17 bp, Homo sapiens
gtcctgacagcactcct

SEQ ID NO: 5434155 - DNA, 13 bp, Homo sapiens
gtcctgaccaccc

SEQ ID NO: 5434156 - DNA, 15 bp, Homo sapiens
gtcctgaccaccctc

SEQ ID NO: 5434157 - DNA, 21 bp, Homo sapiens
gtcctgaccaccctcccctct

SEQ ID NO: 5434158 - DNA, 16 bp, Homo sapiens
gtcctgacctgtctca

SEQ ID NO: 5434159 - DNA, 16 bp, Homo sapiens
gtcctgacgccctgcg

SEQ ID NO: 5434160 - DNA, 16 bp, Homo sapiens
gtcctgacggcgcccc

SEQ ID NO: 5434161 - DNA, 17 bp, Homo sapiens
gtcctgacttcaggggc

SEQ ID NO: 5434162 - DNA, 20 bp, Homo sapiens
gtcctgacttcaggggctgc

SEQ ID NO: 5434163 - DNA, 21 bp, Homo sapiens
gtcctgacttcaggggctgcc

SEQ ID NO: 5434164 - DNA, 13 bp, Homo sapiens
gtcctgagacctg

SEQ ID NO: 5434165 - DNA, 20 bp, Homo sapiens
gtcctgagcaccacacccag

SEQ ID NO: 5434166 - DNA, 18 bp, Homo sapiens
gtcctgagcactgccagg

SEQ ID NO: 5434167 - DNA, 21 bp, Homo sapiens
gtcctgagcactgccaggagg

SEQ ID NO: 5434168 - DNA, 23 bp, Homo sapiens
gtcctgagcactgccaggaggga

SEQ ID NO: 5434169 - DNA, 20 bp, Homo sapiens
gtcctgagccccctgcaccc

SEQ ID NO: 5434170 - DNA, 21 bp, Homo sapiens
gtcctgagccccctgcaccca

SEQ ID NO: 5434171 - DNA, 12 bp, Homo sapiens
gtcctgaggaat

SEQ ID NO: 5434172 - DNA, 17 bp, Homo sapiens
gtcctgaggagccctga

SEQ ID NO: 5434173 - DNA, 17 bp, Homo sapiens
gtcctgaggagtgtcct

SEQ ID NO: 5434174 - DNA, 23 bp, Homo sapiens
gtcctgaggagtgtcctgtctgc

SEQ ID NO: 5434175 - DNA, 19 bp, Homo sapiens
gtcctgaggcagaacctgg

SEQ ID NO: 5434176 - DNA, 22 bp, Homo sapiens
gtcctgaggcagaacctggtgg

SEQ ID NO: 5434177 - DNA, 15 bp, Homo sapiens
gtcctgaggctgggg

SEQ ID NO: 5434178 - DNA, 17 bp, Homo sapiens
gtcctgaggctggggct

SEQ ID NO: 5434179 - DNA, 19 bp, Homo sapiens
gtcctgagtcttggcctgc

SEQ ID NO: 5434180 - DNA, 20 bp, Homo sapiens
gtcctgatcctaaccctggg

SEQ ID NO: 5434181 - DNA, 15 bp, Homo sapiens
gtcctgatctgtgat

SEQ ID NO: 5434182 - DNA, 17 bp, Homo sapiens
gtcctgatgatttttat

SEQ ID NO: 5434183 - DNA, 20 bp, Homo sapiens
gtcctgatggtcagctccct

SEQ ID NO: 5434184 - DNA, 17 bp, Homo sapiens
gtcctgattctccctgg

SEQ ID NO: 5434185 - DNA, 17 bp, Homo sapiens
gtcctgcaatctccagg

SEQ ID NO: 5434186 - DNA, 15 bp, Homo sapiens
gtcctgcacaccctg

SEQ ID NO: 5434187 - DNA, 20 bp, Homo sapiens
gtcctgcacagattcccagg

SEQ ID NO: 5434188 - DNA, 15 bp, Homo sapiens
gtcctgcaccggggc

SEQ ID NO: 5434189 - DNA, 17 bp, Homo sapiens
gtcctgcagaagaagct

SEQ ID NO: 5434190 - DNA, 16 bp, Homo sapiens
gtcctgcagaggacca

SEQ ID NO: 5434191 - DNA, 20 bp, Homo sapiens
gtcctgcagaggaccacagt

SEQ ID NO: 5434192 - DNA, 18 bp, Homo sapiens
gtcctgcagcctgcagga

SEQ ID NO: 5434193 - DNA, 13 bp, Homo sapiens
gtcctgcaggagt

SEQ ID NO: 5434194 - DNA, 11 bp, Homo sapiens
gtcctgcaggg

SEQ ID NO: 5434195 - DNA, 18 bp, Homo sapiens
gtcctgcagtcccacact

SEQ ID NO: 5434196 - DNA, 15 bp, Homo sapiens
gtcctgcatgtatgc

SEQ ID NO: 5434197 - DNA, 18 bp, Homo sapiens
gtcctgcatgtatgccat

SEQ ID NO: 5434198 - DNA, 17 bp, Homo sapiens
gtcctgccaccaccctg

SEQ ID NO: 5434199 - DNA, 20 bp, Homo sapiens
gtcctgccaccaccctgtct

SEQ ID NO: 5434200 - DNA, 17 bp, Homo sapiens
gtcctgccacccagccc

SEQ ID NO: 5434201 - DNA, 16 bp, Homo sapiens
gtcctgccacctgggg

SEQ ID NO: 5434202 - DNA, 17 bp, Homo sapiens
gtcctgccacctggggc

SEQ ID NO: 5434203 - DNA, 14 bp, Homo sapiens
gtcctgccagctgc

SEQ ID NO: 5434204 - DNA, 15 bp, Homo sapiens
gtcctgcccacccta

SEQ ID NO: 5434205 - DNA, 18 bp, Homo sapiens
gtcctgcccatgccccag

SEQ ID NO: 5434206 - DNA, 13 bp, Homo sapiens
gtcctgcccatgt

SEQ ID NO: 5434207 - DNA, 23 bp, Homo sapiens
gtcctgcccatgtgtcccctcac

SEQ ID NO: 5434208 - DNA, 16 bp, Homo sapiens
gtcctgccctccggag

SEQ ID NO: 5434209 - DNA, 23 bp, Homo sapiens
gtcctgccctccggaggagcagc

SEQ ID NO: 5434210 - DNA, 18 bp, Homo sapiens
gtcctgccctgtggaatg

SEQ ID NO: 5434211 - DNA, 19 bp, Homo sapiens
gtcctgcctaaatttcaca

SEQ ID NO: 5434212 - DNA, 15 bp, Homo sapiens
gtcctgcctcagcct

SEQ ID NO: 5434213 - DNA, 12 bp, Homo sapiens
gtcctgcctcct

SEQ ID NO: 5434214 - DNA, 16 bp, Homo sapiens
gtcctgcctctctgct

SEQ ID NO: 5434215 - DNA, 22 bp, Homo sapiens
gtcctgcctcttgtttctgtgc

SEQ ID NO: 5434216 - DNA, 11 bp, Homo sapiens
gtcctgcctga

SEQ ID NO: 5434217 - DNA, 14 bp, Homo sapiens
gtcctgcctgaaca

SEQ ID NO: 5434218 - DNA, 17 bp, Homo sapiens
gtcctgcctgcaatatt

SEQ ID NO: 5434219 - DNA, 14 bp, Homo sapiens
gtcctgcctgcagt

SEQ ID NO: 5434220 - DNA, 15 bp, Homo sapiens
gtcctgcctggcact

SEQ ID NO: 5434221 - DNA, 15 bp, Homo sapiens
gtcctgcctggccag

SEQ ID NO: 5434222 - DNA, 20 bp, Homo sapiens
gtcctgcctggccaggcaga

SEQ ID NO: 5434223 - DNA, 19 bp, Homo sapiens
gtcctgcctggtcctccct

SEQ ID NO: 5434224 - DNA, 23 bp, Homo sapiens
gtcctgcctggtcctccctccca

SEQ ID NO: 5434225 - DNA, 12 bp, Homo sapiens
gtcctgcctgtc

SEQ ID NO: 5434226 - DNA, 23 bp, Homo sapiens
gtcctgcctgtctgaagccaatg

SEQ ID NO: 5434227 - DNA, 18 bp, Homo sapiens
gtcctgcctgtctgcccc

SEQ ID NO: 5434228 - DNA, 14 bp, Homo sapiens
gtcctgcctgtggc

SEQ ID NO: 5434229 - DNA, 15 bp, Homo sapiens
gtcctgcctgtggcg

SEQ ID NO: 5434230 - DNA, 24 bp, Homo sapiens
gtcctgcgcctgcgcctcctcctg

SEQ ID NO: 5434231 - DNA, 19 bp, Homo sapiens
gtcctgcgtcgaagctttg

SEQ ID NO: 5434232 - DNA, 17 bp, Homo sapiens
gtcctgcgttcagcccc

SEQ ID NO: 5434233 - DNA, 23 bp, Homo sapiens
gtcctgcgttcagcccctgatct

SEQ ID NO: 5434234 - DNA, 16 bp, Homo sapiens
gtcctgctacctttgt

SEQ ID NO: 5434235 - DNA, 14 bp, Homo sapiens
gtcctgctagctgt

SEQ ID NO: 5434236 - DNA, 16 bp, Homo sapiens
gtcctgctagctgtct

SEQ ID NO: 5434237 - DNA, 17 bp, Homo sapiens
gtcctgctagctgtctc

SEQ ID NO: 5434238 - DNA, 18 bp, Homo sapiens
gtcctgctcagatgctgg

SEQ ID NO: 5434239 - DNA, 14 bp, Homo sapiens
gtcctgctccacag

SEQ ID NO: 5434240 - DNA, 19 bp, Homo sapiens
gtcctgctccacagtgttg

SEQ ID NO: 5434241 - DNA, 22 bp, Homo sapiens
gtcctgctccagaatttggaaa

SEQ ID NO: 5434242 - DNA, 22 bp, Homo sapiens
gtcctgctcctttctgcccagc

SEQ ID NO: 5434243 - DNA, 18 bp, Homo sapiens
gtcctgctcgccctgtgc

SEQ ID NO: 5434244 - DNA, 19 bp, Homo sapiens
gtcctgctcgccctgtgcc

SEQ ID NO: 5434245 - DNA, 20 bp, Homo sapiens
gtcctgctgcctctctttca

SEQ ID NO: 5434246 - DNA, 11 bp, Homo sapiens
gtcctgctgct

SEQ ID NO: 5434247 - DNA, 12 bp, Homo sapiens
gtcctgctgctc

SEQ ID NO: 5434248 - DNA, 13 bp, Homo sapiens
gtcctgctgctcg

SEQ ID NO: 5434249 - DNA, 19 bp, Homo sapiens
gtcctgctggagtgattta

SEQ ID NO: 5434250 - DNA, 17 bp, Homo sapiens
gtcctgctggcacctca

SEQ ID NO: 5434251 - DNA, 12 bp, Homo sapiens
gtcctgctggcc

SEQ ID NO: 5434252 - DNA, 14 bp, Homo sapiens
gtcctgctggcctg

SEQ ID NO: 5434253 - DNA, 18 bp, Homo sapiens
gtcctgctggcctgctct

SEQ ID NO: 5434254 - DNA, 17 bp, Homo sapiens
gtcctgctggcttccag

SEQ ID NO: 5434255 - DNA, 21 bp, Homo sapiens
gtcctgctggtgaccggcctg

SEQ ID NO: 5434256 - DNA, 16 bp, Homo sapiens
gtcctgctgtccctgt

SEQ ID NO: 5434257 - DNA, 19 bp, Homo sapiens
gtcctgctgtccctgtcag

SEQ ID NO: 5434258 - DNA, 14 bp, Homo sapiens
gtcctgctgtggaa

SEQ ID NO: 5434259 - DNA, 13 bp, Homo sapiens
gtcctgcttctga

SEQ ID NO: 5434260 - DNA, 22 bp, Homo sapiens
gtcctgcttgaactgctgccaa

SEQ ID NO: 5434261 - DNA, 18 bp, Homo sapiens
gtcctggaagtgtgtgtt

SEQ ID NO: 5434262 - DNA, 22 bp, Homo sapiens
gtcctggaatgaagcatgtagc

SEQ ID NO: 5434263 - DNA, 16 bp, Homo sapiens
gtcctggaatttggac

SEQ ID NO: 5434264 - DNA, 22 bp, Homo sapiens
gtcctggaatttggacaagtgc

SEQ ID NO: 5434265 - DNA, 14 bp, Homo sapiens
gtcctggacacctc

SEQ ID NO: 5434266 - DNA, 15 bp, Homo sapiens
gtcctggacacctcc

SEQ ID NO: 5434267 - DNA, 20 bp, Homo sapiens
gtcctggacacctcccaggg

SEQ ID NO: 5434268 - DNA, 23 bp, Homo sapiens
gtcctggaccctggcctaaagaa

SEQ ID NO: 5434269 - DNA, 19 bp, Homo sapiens
gtcctggatgatactaata

SEQ ID NO: 5434270 - DNA, 21 bp, Homo sapiens
gtcctggcacagaagaggagt

SEQ ID NO: 5434271 - DNA, 13 bp, Homo sapiens
gtcctggcagggc

SEQ ID NO: 5434272 - DNA, 16 bp, Homo sapiens
gtcctggcatgggaat

SEQ ID NO: 5434273 - DNA, 23 bp, Homo sapiens
gtcctggcccgggagccgcaggg

SEQ ID NO: 5434274 - DNA, 22 bp, Homo sapiens
gtcctggcccttcagtctgctc

SEQ ID NO: 5434275 - DNA, 20 bp, Homo sapiens
gtcctggcctggcttctcct

SEQ ID NO: 5434276 - DNA, 19 bp, Homo sapiens
gtcctggctacatcccagc

SEQ ID NO: 5434277 - DNA, 20 bp, Homo sapiens
gtcctggctgcactcttgaa

SEQ ID NO: 5434278 - DNA, 14 bp, Homo sapiens
gtcctggctgctct

SEQ ID NO: 5434279 - DNA, 15 bp, Homo sapiens
gtcctggctggaagg

SEQ ID NO: 5434280 - DNA, 16 bp, Homo sapiens
gtcctggctgtgcaca

SEQ ID NO: 5434281 - DNA, 23 bp, Homo sapiens
gtcctggcttctagatctggaac

SEQ ID NO: 5434282 - DNA, 19 bp, Homo sapiens
gtcctgggaggatcctgag

SEQ ID NO: 5434283 - DNA, 23 bp, Homo sapiens
gtcctgggaggatcctgagctgc

SEQ ID NO: 5434284 - DNA, 22 bp, Homo sapiens
gtcctgggaggctgcagccagg

SEQ ID NO: 5434285 - DNA, 16 bp, Homo sapiens
gtcctgggagtgagct

SEQ ID NO: 5434286 - DNA, 17 bp, Homo sapiens
gtcctgggagtgagctg

SEQ ID NO: 5434287 - DNA, 12 bp, Homo sapiens
gtcctgggcagg

SEQ ID NO: 5434288 - DNA, 13 bp, Homo sapiens
gtcctgggcaggt

SEQ ID NO: 5434289 - DNA, 22 bp, Homo sapiens
gtcctgggcaggtgggagctga

SEQ ID NO: 5434290 - DNA, 22 bp, Homo sapiens
gtcctgggcatgggtccagggc

SEQ ID NO: 5434291 - DNA, 23 bp, Homo sapiens
gtcctgggcatgggtccagggcc

SEQ ID NO: 5434292 - DNA, 17 bp, Homo sapiens
gtcctgggccccctggg

SEQ ID NO: 5434293 - DNA, 12 bp, Homo sapiens
gtcctgggctgg

SEQ ID NO: 5434294 - DNA, 15 bp, Homo sapiens
gtcctggggaggctg

SEQ ID NO: 5434295 - DNA, 15 bp, Homo sapiens
gtcctggggctgggt

SEQ ID NO: 5434296 - DNA, 18 bp, Homo sapiens
gtcctgggggatgcaaat

SEQ ID NO: 5434297 - DNA, 23 bp, Homo sapiens
gtcctggtaattcctctccaggc

SEQ ID NO: 5434298 - DNA, 18 bp, Homo sapiens
gtcctggtacagcagggt

SEQ ID NO: 5434299 - DNA, 23 bp, Homo sapiens
gtcctggtcagttttcacagagg

SEQ ID NO: 5434300 - DNA, 18 bp, Homo sapiens
gtcctggtccctctgagg

SEQ ID NO: 5434301 - DNA, 19 bp, Homo sapiens
gtcctggtccctctgaggc

SEQ ID NO: 5434302 - DNA, 16 bp, Homo sapiens
gtcctggtcctgatgc

SEQ ID NO: 5434303 - DNA, 14 bp, Homo sapiens
gtcctggtcctggc

SEQ ID NO: 5434304 - DNA, 17 bp, Homo sapiens
gtcctggtcctggctgc

SEQ ID NO: 5434305 - DNA, 11 bp, Homo sapiens
gtcctggtgcc

SEQ ID NO: 5434306 - DNA, 20 bp, Homo sapiens
gtcctggtgccctggatgcc

SEQ ID NO: 5434307 - DNA, 17 bp, Homo sapiens
gtcctggtgctctctgc

SEQ ID NO: 5434308 - DNA, 18 bp, Homo sapiens
gtcctggtgctctctgcc

SEQ ID NO: 5434309 - DNA, 23 bp, Homo sapiens
gtcctggtgctgccgagggctgg

SEQ ID NO: 5434310 - DNA, 12 bp, Homo sapiens
gtcctggtggct

SEQ ID NO: 5434311 - DNA, 22 bp, Homo sapiens
gtcctggtggctgggcccagca

SEQ ID NO: 5434312 - DNA, 17 bp, Homo sapiens
gtcctggtggggcagct

SEQ ID NO: 5434313 - DNA, 22 bp, Homo sapiens
gtcctggtggggcagctcctct

SEQ ID NO: 5434314 - DNA, 17 bp, Homo sapiens
gtcctggtggggctgag

SEQ ID NO: 5434315 - DNA, 19 bp, Homo sapiens
gtcctggtgggtcagccca

SEQ ID NO: 5434316 - DNA, 22 bp, Homo sapiens
gtctacagtactgacagaaagc

SEQ ID NO: 5434317 - DNA, 12 bp, Homo sapiens
gtctacatttca

SEQ ID NO: 5434318 - DNA, 16 bp, Homo sapiens
gtctaccagaagccag

SEQ ID NO: 5434319 - DNA, 14 bp, Homo sapiens
gtctaccatctccc

SEQ ID NO: 5434320 - DNA, 20 bp, Homo sapiens
gtctacccagagaagcccct

SEQ ID NO: 5434321 - DNA, 22 bp, Homo sapiens
gtctaccctgggattcaggaaa

SEQ ID NO: 5434322 - DNA, 16 bp, Homo sapiens
gtctaccctgtccttt

SEQ ID NO: 5434323 - DNA, 19 bp, Homo sapiens
gtctaccctgtcctttgca

SEQ ID NO: 5434324 - DNA, 21 bp, Homo sapiens
gtctacctcatctctgaaaat

SEQ ID NO: 5434325 - DNA, 20 bp, Homo sapiens
gtctacctgaggggcctctt

SEQ ID NO: 5434326 - DNA, 16 bp, Homo sapiens
gtctacctgctggaca

SEQ ID NO: 5434327 - DNA, 17 bp, Homo sapiens
gtctacctgctggacag

SEQ ID NO: 5434328 - DNA, 20 bp, Homo sapiens
gtctacctgctggacagcct

SEQ ID NO: 5434329 - DNA, 14 bp, Homo sapiens
gtctacctggcaga

SEQ ID NO: 5434330 - DNA, 16 bp, Homo sapiens
gtctactcatccagac

SEQ ID NO: 5434331 - DNA, 17 bp, Homo sapiens
gtctactcctagaagaa

SEQ ID NO: 5434332 - DNA, 18 bp, Homo sapiens
gtctactcctagaagaac

SEQ ID NO: 5434333 - DNA, 18 bp, Homo sapiens
gtctactcttaagccatc

SEQ ID NO: 5434334 - DNA, 15 bp, Homo sapiens
gtctactgcaagagc

SEQ ID NO: 5434335 - DNA, 14 bp, Homo sapiens
gtctactgtggtga

SEQ ID NO: 5434336 - DNA, 18 bp, Homo sapiens
gtctacttctgtgtctgt

SEQ ID NO: 5434337 - DNA, 21 bp, Homo sapiens
gtctagaaatgcggtctggtc

SEQ ID NO: 5434338 - DNA, 12 bp, Homo sapiens
gtctagaatgtg

SEQ ID NO: 5434339 - DNA, 22 bp, Homo sapiens
gtctagaatgttattgtgtata

SEQ ID NO: 5434340 - DNA, 17 bp, Homo sapiens
gtctagaccagggctgc

SEQ ID NO: 5434341 - DNA, 14 bp, Homo sapiens
gtctagactggcct

SEQ ID NO: 5434342 - DNA, 14 bp, Homo sapiens
gtctagagagaacc

SEQ ID NO: 5434343 - DNA, 22 bp, Homo sapiens
gtctagaggcaacagtgttctg

SEQ ID NO: 5434344 - DNA, 20 bp, Homo sapiens
gtctagagtcatgtgagcct

SEQ ID NO: 5434345 - DNA, 21 bp, Homo sapiens
gtctagataaaaggagagaaa

SEQ ID NO: 5434346 - DNA, 19 bp, Homo sapiens
gtctagatgggttcttagc

SEQ ID NO: 5434347 - DNA, 22 bp, Homo sapiens
gtctagattcaaaggttctagg

SEQ ID NO: 5434348 - DNA, 12 bp, Homo sapiens
gtctagattctc

SEQ ID NO: 5434349 - DNA, 19 bp, Homo sapiens
gtctagatttatcagagta

SEQ ID NO: 5434350 - DNA, 17 bp, Homo sapiens
gtctagattttgaaaaa

SEQ ID NO: 5434351 - DNA, 23 bp, Homo sapiens
gtctagcatgctgagtcatgtct

SEQ ID NO: 5434352 - DNA, 19 bp, Homo sapiens
gtctagccactccctccca

SEQ ID NO: 5434353 - DNA, 20 bp, Homo sapiens
gtctagccactccctcccag

SEQ ID NO: 5434354 - DNA, 15 bp, Homo sapiens
gtctagccgctgccc

SEQ ID NO: 5434355 - DNA, 16 bp, Homo sapiens
gtctagccgctgccct

SEQ ID NO: 5434356 - DNA, 21 bp, Homo sapiens
gtctagccttagtcaataaac

SEQ ID NO: 5434357 - DNA, 15 bp, Homo sapiens
gtctagctggccact

SEQ ID NO: 5434358 - DNA, 23 bp, Homo sapiens
gtctagcttagtttcagagacct

SEQ ID NO: 5434359 - DNA, 20 bp, Homo sapiens
gtctaggactgcagtgtgga

SEQ ID NO: 5434360 - DNA, 18 bp, Homo sapiens
gtctaggagacagagcca

SEQ ID NO: 5434361 - DNA, 21 bp, Homo sapiens
gtctaggagacagagccaagc

SEQ ID NO: 5434362 - DNA, 18 bp, Homo sapiens
gtctaggcactgagcagg

SEQ ID NO: 5434363 - DNA, 20 bp, Homo sapiens
gtctaggcactgagcaggga

SEQ ID NO: 5434364 - DNA, 16 bp, Homo sapiens
gtctaggcaggcaaga

SEQ ID NO: 5434365 - DNA, 22 bp, Homo sapiens
gtctaggctggaagagccaaag

SEQ ID NO: 5434366 - DNA, 14 bp, Homo sapiens
gtctagggagagac

SEQ ID NO: 5434367 - DNA, 22 bp, Homo sapiens
gtctagggcagagtatgttctt

SEQ ID NO: 5434368 - DNA, 17 bp, Homo sapiens
gtctagggtgtgattta

SEQ ID NO: 5434369 - DNA, 22 bp, Homo sapiens
gtctaggtcagtacccacctga

SEQ ID NO: 5434370 - DNA, 12 bp, Homo sapiens
gtctagtagaac

SEQ ID NO: 5434371 - DNA, 16 bp, Homo sapiens
gtctagtcattgtcat

SEQ ID NO: 5434372 - DNA, 13 bp, Homo sapiens
gtctagtcttctg

SEQ ID NO: 5434373 - DNA, 21 bp, Homo sapiens
gtctagtgaagatgttgtcat

SEQ ID NO: 5434374 - DNA, 22 bp, Homo sapiens
gtctagttcctgatgacccagg

SEQ ID NO: 5434375 - DNA, 14 bp, Homo sapiens
gtctagtttctagt

SEQ ID NO: 5434376 - DNA, 18 bp, Homo sapiens
gtctataaaataaacttc

SEQ ID NO: 5434377 - DNA, 19 bp, Homo sapiens
gtctataagtatataaata

SEQ ID NO: 5434378 - DNA, 20 bp, Homo sapiens
gtctataagtatataaatac

SEQ ID NO: 5434379 - DNA, 18 bp, Homo sapiens
gtctataatggaaacatt

SEQ ID NO: 5434380 - DNA, 22 bp, Homo sapiens
gtctataatggaaacatttaca

SEQ ID NO: 5434381 - DNA, 14 bp, Homo sapiens
gtctatacattcct

SEQ ID NO: 5434382 - DNA, 17 bp, Homo sapiens
gtctatacattcctgag

SEQ ID NO: 5434383 - DNA, 18 bp, Homo sapiens
gtctatagagaaaaactt

SEQ ID NO: 5434384 - DNA, 18 bp, Homo sapiens
gtctatataaccacattt

SEQ ID NO: 5434385 - DNA, 12 bp, Homo sapiens
gtctatatatat

SEQ ID NO: 5434386 - DNA, 18 bp, Homo sapiens
gtctatatcataactata

SEQ ID NO: 5434387 - DNA, 14 bp, Homo sapiens
gtctatcaaatgaa

SEQ ID NO: 5434388 - DNA, 15 bp, Homo sapiens
gtctatccacagaga

SEQ ID NO: 5434389 - DNA, 17 bp, Homo sapiens
gtctatctctaataaaa

SEQ ID NO: 5434390 - DNA, 22 bp, Homo sapiens
gtctatctggtattaaatgcca

SEQ ID NO: 5434391 - DNA, 23 bp, Homo sapiens
gtctatgaactagagactctgtg

SEQ ID NO: 5434392 - DNA, 18 bp, Homo sapiens
gtctatgaagttgctgtt

SEQ ID NO: 5434393 - DNA, 22 bp, Homo sapiens
gtctatgaagttgctgtttatt

SEQ ID NO: 5434394 - DNA, 21 bp, Homo sapiens
gtctatgacttatttccttca

SEQ ID NO: 5434395 - DNA, 21 bp, Homo sapiens
gtctatgatgtccaaacttaa

SEQ ID NO: 5434396 - DNA, 17 bp, Homo sapiens
gtctatgattgtacttt

SEQ ID NO: 5434397 - DNA, 20 bp, Homo sapiens
gtctatgcaattgtacaaaa

SEQ ID NO: 5434398 - DNA, 15 bp, Homo sapiens
gtctatgcagcctgc

SEQ ID NO: 5434399 - DNA, 16 bp, Homo sapiens
gtctatgcagcctgct

SEQ ID NO: 5434400 - DNA, 19 bp, Homo sapiens
gtctatgctgtgtgcagag

SEQ ID NO: 5434401 - DNA, 15 bp, Homo sapiens
gtctatgcttaaaaa

SEQ ID NO: 5434402 - DNA, 21 bp, Homo sapiens
gtctatgtaggcccctggtct

SEQ ID NO: 5434403 - DNA, 21 bp, Homo sapiens
gtctatgtgtatatattatat

SEQ ID NO: 5434404 - DNA, 16 bp, Homo sapiens
gtctatgttcaaagac

SEQ ID NO: 5434405 - DNA, 17 bp, Homo sapiens
gtctatgttcaaagact

SEQ ID NO: 5434406 - DNA, 15 bp, Homo sapiens
gtctatgttccgaat

SEQ ID NO: 5434407 - DNA, 22 bp, Homo sapiens
gtctatgttccgaattgagcac

SEQ ID NO: 5434408 - DNA, 21 bp, Homo sapiens
gtctattaaaattctgatgtt

SEQ ID NO: 5434409 - DNA, 19 bp, Homo sapiens
gtctattagttttctttgt

SEQ ID NO: 5434410 - DNA, 12 bp, Homo sapiens
gtctattcatta

SEQ ID NO: 5434411 - DNA, 12 bp, Homo sapiens
gtctattccagc

SEQ ID NO: 5434412 - DNA, 13 bp, Homo sapiens
gtctattccagct

SEQ ID NO: 5434413 - DNA, 15 bp, Homo sapiens
gtctattccattccc

SEQ ID NO: 5434414 - DNA, 14 bp, Homo sapiens
gtctattctgagcc

SEQ ID NO: 5434415 - DNA, 18 bp, Homo sapiens
gtctattctgagccttga

SEQ ID NO: 5434416 - DNA, 11 bp, Homo sapiens
gtctattgtct

SEQ ID NO: 5434417 - DNA, 23 bp, Homo sapiens
gtctatttaaaaaaaaagtcaga

SEQ ID NO: 5434418 - DNA, 22 bp, Homo sapiens
gtctatttccactgaacaaaac

SEQ ID NO: 5434419 - DNA, 14 bp, Homo sapiens
gtctatttctgaaa

SEQ ID NO: 5434420 - DNA, 13 bp, Homo sapiens
gtctatttctgct

SEQ ID NO: 5434421 - DNA, 12 bp, Homo sapiens
gtctattttatt

SEQ ID NO: 5434422 - DNA, 23 bp, Homo sapiens
gtctattttcttgaggaaaatat

SEQ ID NO: 5434423 - DNA, 18 bp, Homo sapiens
gtctattttgtctatagg

SEQ ID NO: 5434424 - DNA, 19 bp, Homo sapiens
gtctatttttttaactgaa

SEQ ID NO: 5434425 - DNA, 22 bp, Homo sapiens
gtctatttttttaactgaaaat

SEQ ID NO: 5434426 - DNA, 16 bp, Homo sapiens
gtctcaaaaatacaaa

SEQ ID NO: 5434427 - DNA, 17 bp, Homo sapiens
gtctcaaaaatacaaaa

SEQ ID NO: 5434428 - DNA, 15 bp, Homo sapiens
gtctcaaaataaaac

SEQ ID NO: 5434429 - DNA, 18 bp, Homo sapiens
gtctcaaaataaagcaat

SEQ ID NO: 5434430 - DNA, 22 bp, Homo sapiens
gtctcaaaatcaactctcttat

SEQ ID NO: 5434431 - DNA, 13 bp, Homo sapiens
gtctcaaacaagg

SEQ ID NO: 5434432 - DNA, 16 bp, Homo sapiens
gtctcaaaccctggct

SEQ ID NO: 5434433 - DNA, 15 bp, Homo sapiens
gtctcaaactcctga

SEQ ID NO: 5434434 - DNA, 17 bp, Homo sapiens
gtctcaacatgtgtttc

SEQ ID NO: 5434435 - DNA, 18 bp, Homo sapiens
gtctcaacgcctccccct

SEQ ID NO: 5434436 - DNA, 21 bp, Homo sapiens
gtctcaactctgtccccagga

SEQ ID NO: 5434437 - DNA, 15 bp, Homo sapiens
gtctcaagactgaaa

SEQ ID NO: 5434438 - DNA, 17 bp, Homo sapiens
gtctcaagagggcactg

SEQ ID NO: 5434439 - DNA, 19 bp, Homo sapiens
gtctcaagggctagcatcc

SEQ ID NO: 5434440 - DNA, 21 bp, Homo sapiens
gtctcaatagctccaagctgt

SEQ ID NO: 5434441 - DNA, 19 bp, Homo sapiens
gtctcacaatagcgtgagc

SEQ ID NO: 5434442 - DNA, 12 bp, Homo sapiens
gtctcacactcc

SEQ ID NO: 5434443 - DNA, 15 bp, Homo sapiens
gtctcacactcctcc

SEQ ID NO: 5434444 - DNA, 20 bp, Homo sapiens
gtctcacactcctcctgcca

SEQ ID NO: 5434445 - DNA, 14 bp, Homo sapiens
gtctcacagagaag

SEQ ID NO: 5434446 - DNA, 19 bp, Homo sapiens
gtctcacagagaagctcct

SEQ ID NO: 5434447 - DNA, 23 bp, Homo sapiens
gtctcacagagaagctcctgcta

SEQ ID NO: 5434448 - DNA, 13 bp, Homo sapiens
gtctcacagaggc

SEQ ID NO: 5434449 - DNA, 23 bp, Homo sapiens
gtctcacagtgttgcccaggctg

SEQ ID NO: 5434450 - DNA, 15 bp, Homo sapiens
gtctcacatttttac

SEQ ID NO: 5434451 - DNA, 14 bp, Homo sapiens
gtctcaccagctca

SEQ ID NO: 5434452 - DNA, 18 bp, Homo sapiens
gtctcaccagctcagccc

SEQ ID NO: 5434453 - DNA, 19 bp, Homo sapiens
gtctcaccagctcagcccc

SEQ ID NO: 5434454 - DNA, 18 bp, Homo sapiens
gtctcaccatttccccag

SEQ ID NO: 5434455 - DNA, 22 bp, Homo sapiens
gtctcaccatttccccagggca

SEQ ID NO: 5434456 - DNA, 13 bp, Homo sapiens
gtctcacccatgc

SEQ ID NO: 5434457 - DNA, 21 bp, Homo sapiens
gtctcacccattatctggaat

SEQ ID NO: 5434458 - DNA, 18 bp, Homo sapiens
gtctcaccggctctcacc

SEQ ID NO: 5434459 - DNA, 18 bp, Homo sapiens
gtctcacctgccggctct

SEQ ID NO: 5434460 - DNA, 21 bp, Homo sapiens
gtctcacctgccggctctggg

SEQ ID NO: 5434461 - DNA, 22 bp, Homo sapiens
gtctcacctgccggctctgggc

SEQ ID NO: 5434462 - DNA, 15 bp, Homo sapiens
gtctcacgattccag

SEQ ID NO: 5434463 - DNA, 18 bp, Homo sapiens
gtctcactagtttttcct

SEQ ID NO: 5434464 - DNA, 12 bp, Homo sapiens
gtctcactatgt

SEQ ID NO: 5434465 - DNA, 14 bp, Homo sapiens
gtctcactcctgag

SEQ ID NO: 5434466 - DNA, 22 bp, Homo sapiens
gtctcactctgtcgctcaggct

SEQ ID NO: 5434467 - DNA, 16 bp, Homo sapiens
gtctcactctgttgcc

SEQ ID NO: 5434468 - DNA, 22 bp, Homo sapiens
gtctcactcttgtcacccaggc

SEQ ID NO: 5434469 - DNA, 16 bp, Homo sapiens
gtctcactctttcttc

SEQ ID NO: 5434470 - DNA, 16 bp, Homo sapiens
gtctcactgacacagg

SEQ ID NO: 5434471 - DNA, 14 bp, Homo sapiens
gtctcactgtgtgt

SEQ ID NO: 5434472 - DNA, 22 bp, Homo sapiens
gtctcactgtgttgcccaggct

SEQ ID NO: 5434473 - DNA, 13 bp, Homo sapiens
gtctcactgttct

SEQ ID NO: 5434474 - DNA, 21 bp, Homo sapiens
gtctcactgttgcccaggctg

SEQ ID NO: 5434475 - DNA, 22 bp, Homo sapiens
gtctcactgttgcccaggctgg

SEQ ID NO: 5434476 - DNA, 23 bp, Homo sapiens
gtctcactgttgcccaggctggc

SEQ ID NO: 5434477 - DNA, 18 bp, Homo sapiens
gtctcactttactttcaa

SEQ ID NO: 5434478 - DNA, 19 bp, Homo sapiens
gtctcactttactttcaag

SEQ ID NO: 5434479 - DNA, 22 bp, Homo sapiens
gtctcactttttacccagaaca

SEQ ID NO: 5434480 - DNA, 11 bp, Homo sapiens
gtctcagaaga

SEQ ID NO: 5434481 - DNA, 14 bp, Homo sapiens
gtctcagaagaggt

SEQ ID NO: 5434482 - DNA, 21 bp, Homo sapiens
gtctcagacactaaatgcaga

SEQ ID NO: 5434483 - DNA, 23 bp, Homo sapiens
gtctcagacactaaatgcagaca

SEQ ID NO: 5434484 - DNA, 20 bp, Homo sapiens
gtctcagacgactagcccag

SEQ ID NO: 5434485 - DNA, 15 bp, Homo sapiens
gtctcagagccttcc

SEQ ID NO: 5434486 - DNA, 18 bp, Homo sapiens
gtctcagatatcatactg

SEQ ID NO: 5434487 - DNA, 18 bp, Homo sapiens
gtctcagatggtgtgtcc

SEQ ID NO: 5434488 - DNA, 22 bp, Homo sapiens
gtctcagatggtgtgtccagca

SEQ ID NO: 5434489 - DNA, 14 bp, Homo sapiens
gtctcagattttat

SEQ ID NO: 5434490 - DNA, 16 bp, Homo sapiens
gtctcagattttatta

SEQ ID NO: 5434491 - DNA, 13 bp, Homo sapiens
gtctcagcagtgg

SEQ ID NO: 5434492 - DNA, 16 bp, Homo sapiens
gtctctggattcctgt

SEQ ID NO: 5434493 - DNA, 21 bp, Homo sapiens
gtctctggcagagaaggatgt

SEQ ID NO: 5434494 - DNA, 16 bp, Homo sapiens
gtctctggcagttctg

SEQ ID NO: 5434495 - DNA, 13 bp, Homo sapiens
gtctctggcccct

SEQ ID NO: 5434496 - DNA, 12 bp, Homo sapiens
gtctctggcctg

SEQ ID NO: 5434497 - DNA, 14 bp, Homo sapiens
gtctctggctactc

SEQ ID NO: 5434498 - DNA, 17 bp, Homo sapiens
gtctctggctcagctgt

SEQ ID NO: 5434499 - DNA, 19 bp, Homo sapiens
gtctctggctcagctgtgg

SEQ ID NO: 5434500 - DNA, 21 bp, Homo sapiens
gtctctggctcagctgtggtc

SEQ ID NO: 5434501 - DNA, 13 bp, Homo sapiens
gtctctgggagcc

SEQ ID NO: 5434502 - DNA, 15 bp, Homo sapiens
gtctctgggcacagt

SEQ ID NO: 5434503 - DNA, 13 bp, Homo sapiens
gtctctgggccac

SEQ ID NO: 5434504 - DNA, 20 bp, Homo sapiens
gtctctgggccacttggagt

SEQ ID NO: 5434505 - DNA, 18 bp, Homo sapiens
gtctctgggccccaggca

SEQ ID NO: 5434506 - DNA, 15 bp, Homo sapiens
gtctctgggcctgtg

SEQ ID NO: 5434507 - DNA, 17 bp, Homo sapiens
gtctctgggcctgtgtg

SEQ ID NO: 5434508 - DNA, 17 bp, Homo sapiens
gtctctgggctgaggaa

SEQ ID NO: 5434509 - DNA, 17 bp, Homo sapiens
gtctctggtagcctgca

SEQ ID NO: 5434510 - DNA, 17 bp, Homo sapiens
gtctctggttcctcccc

SEQ ID NO: 5434511 - DNA, 23 bp, Homo sapiens
gtctctgtcccggttcaccttgc

SEQ ID NO: 5434512 - DNA, 22 bp, Homo sapiens
gtctctgtccctcactgccttc

SEQ ID NO: 5434513 - DNA, 20 bp, Homo sapiens
gtctctgtcgtggagccatt

SEQ ID NO: 5434514 - DNA, 22 bp, Homo sapiens
gtctctgtgtaaccagctcagt

SEQ ID NO: 5434515 - DNA, 19 bp, Homo sapiens
gtctctgtgtttgaagttt

SEQ ID NO: 5434516 - DNA, 22 bp, Homo sapiens
gtctctgttaacatctagccta

SEQ ID NO: 5434517 - DNA, 21 bp, Homo sapiens
gtctctgttggtccactgtgt

SEQ ID NO: 5434518 - DNA, 22 bp, Homo sapiens
gtctctgttttacaagttggag

SEQ ID NO: 5434519 - DNA, 17 bp, Homo sapiens
gtctcttaaaaaaataa

SEQ ID NO: 5434520 - DNA, 15 bp, Homo sapiens
gtctcttacatgtag

SEQ ID NO: 5434521 - DNA, 22 bp, Homo sapiens
gtctcttatggatgtccccagc

SEQ ID NO: 5434522 - DNA, 22 bp, Homo sapiens
gtctcttcaagcatcctcagaa

SEQ ID NO: 5434523 - DNA, 18 bp, Homo sapiens
gtctcttccacaggaagt

SEQ ID NO: 5434524 - DNA, 13 bp, Homo sapiens
gtctcttcccctc

SEQ ID NO: 5434525 - DNA, 13 bp, Homo sapiens
gtctcttcctctg

SEQ ID NO: 5434526 - DNA, 22 bp, Homo sapiens
gtctcttccttcggtcttttgt

SEQ ID NO: 5434527 - DNA, 11 bp, Homo sapiens
gtctcttctcc

SEQ ID NO: 5434528 - DNA, 14 bp, Homo sapiens
gtctcttctcccag

SEQ ID NO: 5434529 - DNA, 15 bp, Homo sapiens
gtctcttctcccaga

SEQ ID NO: 5434530 - DNA, 16 bp, Homo sapiens
gtctcttctcccagaa

SEQ ID NO: 5434531 - DNA, 19 bp, Homo sapiens
gtctcttctgggcaccctc

SEQ ID NO: 5434532 - DNA, 22 bp, Homo sapiens
gtctcttctgggcgtctgagct

SEQ ID NO: 5434533 - DNA, 22 bp, Homo sapiens
gtctcttcttaaccctgaacaa

SEQ ID NO: 5434534 - DNA, 20 bp, Homo sapiens
gtctcttcttggggcccagt

SEQ ID NO: 5434535 - DNA, 20 bp, Homo sapiens
gtctcttgagcatcaatctt

SEQ ID NO: 5434536 - DNA, 23 bp, Homo sapiens
gtctcttgagggagcttagccaa

SEQ ID NO: 5434537 - DNA, 20 bp, Homo sapiens
gtctcttgcataagcctcag

SEQ ID NO: 5434538 - DNA, 23 bp, Homo sapiens
gtctcttgcataagcctcaggcc

SEQ ID NO: 5434539 - DNA, 20 bp, Homo sapiens
gtctcttgtagaagatggac

SEQ ID NO: 5434540 - DNA, 19 bp, Homo sapiens
gtctcttgtattaaactct

SEQ ID NO: 5434541 - DNA, 13 bp, Homo sapiens
gtctctttaagtt

SEQ ID NO: 5434542 - DNA, 18 bp, Homo sapiens
gtctctttaagttttgat

SEQ ID NO: 5434543 - DNA, 20 bp, Homo sapiens
gtctctttaatgtcacaggc

SEQ ID NO: 5434544 - DNA, 17 bp, Homo sapiens
gtctctttattcctagt

SEQ ID NO: 5434545 - DNA, 11 bp, Homo sapiens
gtctctttcca

SEQ ID NO: 5434546 - DNA, 17 bp, Homo sapiens
gtctctttctttccaaa

SEQ ID NO: 5434547 - DNA, 19 bp, Homo sapiens
gtctctttggggagagctg

SEQ ID NO: 5434548 - DNA, 21 bp, Homo sapiens
gtctctttggggagagctggc

SEQ ID NO: 5434549 - DNA, 12 bp, Homo sapiens
gtctctttgttc

SEQ ID NO: 5434550 - DNA, 14 bp, Homo sapiens
gtctctttgttcaa

SEQ ID NO: 5434551 - DNA, 21 bp, Homo sapiens
gtctcttttaccctggcccct

SEQ ID NO: 5434552 - DNA, 13 bp, Homo sapiens
gtctcttttctct

SEQ ID NO: 5434553 - DNA, 23 bp, Homo sapiens
gtctcttttctttagagcattgc

SEQ ID NO: 5434554 - DNA, 17 bp, Homo sapiens
gtctcttttgtaaatta

SEQ ID NO: 5434555 - DNA, 14 bp, Homo sapiens
gtctcttttgttcc

SEQ ID NO: 5434556 - DNA, 16 bp, Homo sapiens
gtctctttttcttcct

SEQ ID NO: 5434557 - DNA, 16 bp, Homo sapiens
gtctcttttttacaaa

SEQ ID NO: 5434558 - DNA, 22 bp, Homo sapiens
gtctcttttttattctgttttc

SEQ ID NO: 5434559 - DNA, 21 bp, Homo sapiens
gtctgaaaaatgcctgctgct

SEQ ID NO: 5434560 - DNA, 22 bp, Homo sapiens
gtctgaaaaatgcctgctgctg

SEQ ID NO: 5434561 - DNA, 16 bp, Homo sapiens
gtctgaaacagagaac

SEQ ID NO: 5434562 - DNA, 16 bp, Homo sapiens
gtctgaaaccagaaga

SEQ ID NO: 5434563 - DNA, 21 bp, Homo sapiens
gtctgaaaccagaagactgga

SEQ ID NO: 5434564 - DNA, 22 bp, Homo sapiens
gtctgaaactggcttccccact

SEQ ID NO: 5434565 - DNA, 15 bp, Homo sapiens
gtctgaaaggaaaag

SEQ ID NO: 5434566 - DNA, 17 bp, Homo sapiens
gtctgaaattttctaga

SEQ ID NO: 5434567 - DNA, 23 bp, Homo sapiens
gtctgaaccaatagaaagcaaac

SEQ ID NO: 5434568 - DNA, 20 bp, Homo sapiens
gtctgaaccaccctggaaat

SEQ ID NO: 5434569 - DNA, 14 bp, Homo sapiens
gtctgaacccaggc

SEQ ID NO: 5434570 - DNA, 17 bp, Homo sapiens
gtctgaacccaggcagc

SEQ ID NO: 5434571 - DNA, 18 bp, Homo sapiens
gtctgaacccaggcagct

SEQ ID NO: 5434572 - DNA, 13 bp, Homo sapiens
gtctgaacccttg

SEQ ID NO: 5434573 - DNA, 18 bp, Homo sapiens
gtctgaacccttgtgctt

SEQ ID NO: 5434574 - DNA, 19 bp, Homo sapiens
gtctgaacccttgtgcttg

SEQ ID NO: 5434575 - DNA, 16 bp, Homo sapiens
gtctgaactttgggaa

SEQ ID NO: 5434576 - DNA, 14 bp, Homo sapiens
gtctgaagcagatg

SEQ ID NO: 5434577 - DNA, 16 bp, Homo sapiens
gtctgaagcccaaagc

SEQ ID NO: 5434578 - DNA, 16 bp, Homo sapiens
gtctgaagcctgcagg

SEQ ID NO: 5434579 - DNA, 17 bp, Homo sapiens
gtctgaagcctgcaggt

SEQ ID NO: 5434580 - DNA, 15 bp, Homo sapiens
gtctgaagctcgcat

SEQ ID NO: 5434581 - DNA, 19 bp, Homo sapiens
gtctgaaggaatagccaga

SEQ ID NO: 5434582 - DNA, 20 bp, Homo sapiens
gtctgaaggacacttcctgc

SEQ ID NO: 5434583 - DNA, 14 bp, Homo sapiens
gtctgaaggcctcc

SEQ ID NO: 5434584 - DNA, 19 bp, Homo sapiens
gtctgaagtacaaacatga

SEQ ID NO: 5434585 - DNA, 16 bp, Homo sapiens
gtctgaagtcactgca

SEQ ID NO: 5434586 - DNA, 16 bp, Homo sapiens
gtctgaagtggttgtt

SEQ ID NO: 5434587 - DNA, 13 bp, Homo sapiens
gtctgaatatttt

SEQ ID NO: 5434588 - DNA, 17 bp, Homo sapiens
gtctgaatcatgtctgt

SEQ ID NO: 5434589 - DNA, 24 bp, Homo sapiens
gtctgaatcatgtctgtatcccca

SEQ ID NO: 5434590 - DNA, 14 bp, Homo sapiens
gtctgaatgtattt

SEQ ID NO: 5434591 - DNA, 15 bp, Homo sapiens
gtctgaatgttctga

SEQ ID NO: 5434592 - DNA, 18 bp, Homo sapiens
gtctgaatgttctgacat

SEQ ID NO: 5434593 - DNA, 14 bp, Homo sapiens
gtctgaattgagaa

SEQ ID NO: 5434594 - DNA, 14 bp, Homo sapiens
gtctgaatttattt

SEQ ID NO: 5434595 - DNA, 22 bp, Homo sapiens
gtctgacacgcaagtgtgtgag

SEQ ID NO: 5434596 - DNA, 13 bp, Homo sapiens
gtctgacaggcaa

SEQ ID NO: 5434597 - DNA, 14 bp, Homo sapiens
gtctgacaggcaat

SEQ ID NO: 5434598 - DNA, 21 bp, Homo sapiens
gtctgacaggcaatgctggct

SEQ ID NO: 5434599 - DNA, 22 bp, Homo sapiens
gtctgacaggcaatgctggctg

SEQ ID NO: 5434600 - DNA, 17 bp, Homo sapiens
gtctgacatcctgacct

SEQ ID NO: 5434601 - DNA, 20 bp, Homo sapiens
gtctgacatcctgacctcct

SEQ ID NO: 5434602 - DNA, 17 bp, Homo sapiens
gtctgaccagagaatgc

SEQ ID NO: 5434603 - DNA, 14 bp, Homo sapiens
gtctgacccactgc

SEQ ID NO: 5434604 - DNA, 14 bp, Homo sapiens
gtctgaccccagcc

SEQ ID NO: 5434605 - DNA, 15 bp, Homo sapiens
gtctgaccccagccc

SEQ ID NO: 5434606 - DNA, 18 bp, Homo sapiens
gtctgaccccagcccaga

SEQ ID NO: 5434607 - DNA, 22 bp, Homo sapiens
gtctgaccccagcccagacagc

SEQ ID NO: 5434608 - DNA, 23 bp, Homo sapiens
gtctgaccccagcccagacagca

SEQ ID NO: 5434609 - DNA, 14 bp, Homo sapiens
gtctgaccctctgc

SEQ ID NO: 5434610 - DNA, 19 bp, Homo sapiens
gtctgaccctctgcggcca

SEQ ID NO: 5434611 - DNA, 22 bp, Homo sapiens
gtctgaccgacgatccctcgac

SEQ ID NO: 5434612 - DNA, 19 bp, Homo sapiens
gtctgacctggtgggagca

SEQ ID NO: 5434613 - DNA, 15 bp, Homo sapiens
gtctgactccagagt

SEQ ID NO: 5434614 - DNA, 20 bp, Homo sapiens
gtctgactccagagtctgag

SEQ ID NO: 5434615 - DNA, 21 bp, Homo sapiens
gtctgactccctccccaccca

SEQ ID NO: 5434616 - DNA, 12 bp, Homo sapiens
gtctgactcctt

SEQ ID NO: 5434617 - DNA, 22 bp, Homo sapiens
gtctgagaaataggtatcaaaa

SEQ ID NO: 5434618 - DNA, 12 bp, Homo sapiens
gtctgagaaatt

SEQ ID NO: 5434619 - DNA, 21 bp, Homo sapiens
gtctgagaaggctaaagaaga

SEQ ID NO: 5434620 - DNA, 16 bp, Homo sapiens
gtctgagacaggtgcc

SEQ ID NO: 5434621 - DNA, 22 bp, Homo sapiens
gtctgagactcacaggaaggag

SEQ ID NO: 5434622 - DNA, 14 bp, Homo sapiens
gtctgagagaggcc

SEQ ID NO: 5434623 - DNA, 15 bp, Homo sapiens
gtctgagcaccccct

SEQ ID NO: 5434624 - DNA, 22 bp, Homo sapiens
gtctgagcaccccctcattccc

SEQ ID NO: 5434625 - DNA, 22 bp, Homo sapiens
gtctgagccacagcagcatttt

SEQ ID NO: 5434626 - DNA, 15 bp, Homo sapiens
gtctgagcccatttc

SEQ ID NO: 5434627 - DNA, 16 bp, Homo sapiens
gtctgagccctgccct

SEQ ID NO: 5434628 - DNA, 15 bp, Homo sapiens
gtctgagccctggtg

SEQ ID NO: 5434629 - DNA, 16 bp, Homo sapiens
gtctgagcggccgcct

SEQ ID NO: 5434630 - DNA, 19 bp, Homo sapiens
gtctgagcggccgcctgtc

SEQ ID NO: 5434631 - DNA, 14 bp, Homo sapiens
gtctgagctggggt

SEQ ID NO: 5434632 - DNA, 15 bp, Homo sapiens
gtctgagctgtccca

SEQ ID NO: 5434633 - DNA, 14 bp, Homo sapiens
gtctgaggactgtc

SEQ ID NO: 5434634 - DNA, 15 bp, Homo sapiens
gtctgaggccccagg

SEQ ID NO: 5434635 - DNA, 16 bp, Homo sapiens
gtctgaggcccctgcc

SEQ ID NO: 5434636 - DNA, 22 bp, Homo sapiens
gtctgaggccgttgctgactta

SEQ ID NO: 5434637 - DNA, 13 bp, Homo sapiens
gtctgaggcctca

SEQ ID NO: 5434638 - DNA, 14 bp, Homo sapiens
gtctgaggcctcat

SEQ ID NO: 5434639 - DNA, 17 bp, Homo sapiens
gtctgaggcctgccccc

SEQ ID NO: 5434640 - DNA, 14 bp, Homo sapiens
gtctgaggtcctga

SEQ ID NO: 5434641 - DNA, 15 bp, Homo sapiens
gtctgaggtcctgag

SEQ ID NO: 5434642 - DNA, 17 bp, Homo sapiens
gtctgaggtcctgagca

SEQ ID NO: 5434643 - DNA, 19 bp, Homo sapiens
gtctgaggtcctgagcact

SEQ ID NO: 5434644 - DNA, 17 bp, Homo sapiens
gtctgaggttgggagag

SEQ ID NO: 5434645 - DNA, 14 bp, Homo sapiens
gtctgagtaagaaa

SEQ ID NO: 5434646 - DNA, 22 bp, Homo sapiens
gtctgagtagtggccactgggg

SEQ ID NO: 5434647 - DNA, 15 bp, Homo sapiens
gtctgagtagttatg

SEQ ID NO: 5434648 - DNA, 14 bp, Homo sapiens
gtctgagtcatggc

SEQ ID NO: 5434649 - DNA, 17 bp, Homo sapiens
gtctgagtcctgtctct

SEQ ID NO: 5434650 - DNA, 18 bp, Homo sapiens
gtctgagtcctgtctctg

SEQ ID NO: 5434651 - DNA, 21 bp, Homo sapiens
gtctgagtcctgtctctgcct

SEQ ID NO: 5434652 - DNA, 14 bp, Homo sapiens
gtctgagtgaacct

SEQ ID NO: 5434653 - DNA, 23 bp, Homo sapiens
gtctgagtggcttcactcctgct

SEQ ID NO: 5434654 - DNA, 24 bp, Homo sapiens
gtctgatagagtttaacagatatt

SEQ ID NO: 5434655 - DNA, 14 bp, Homo sapiens
gtctgatattcaaa

SEQ ID NO: 5434656 - DNA, 13 bp, Homo sapiens
gtctgatccatat

SEQ ID NO: 5434657 - DNA, 19 bp, Homo sapiens
gtctgatccatccatctct

SEQ ID NO: 5434658 - DNA, 20 bp, Homo sapiens
gtctgatcgtgacgctgaat

SEQ ID NO: 5434659 - DNA, 21 bp, Homo sapiens
gtctgatcgtgacgctgaata

SEQ ID NO: 5434660 - DNA, 15 bp, Homo sapiens
gtctgatctgtgctt

SEQ ID NO: 5434661 - DNA, 17 bp, Homo sapiens
gtctgatctgtgctttc

SEQ ID NO: 5434662 - DNA, 22 bp, Homo sapiens
gtctgatctgtgctttccagct

SEQ ID NO: 5434663 - DNA, 24 bp, Homo sapiens
gtctgatctgtgctttccagctca

SEQ ID NO: 5434664 - DNA, 19 bp, Homo sapiens
gtctgatgccaaagctgct

SEQ ID NO: 5434665 - DNA, 20 bp, Homo sapiens
gtctgatgccaaagctgctt

SEQ ID NO: 5434666 - DNA, 22 bp, Homo sapiens
gtctgatgccaaagctgctttc

SEQ ID NO: 5434667 - DNA, 23 bp, Homo sapiens
gtctgatgccaaagctgctttct

SEQ ID NO: 5434668 - DNA, 20 bp, Homo sapiens
gtctgatggaactgtgtatt

SEQ ID NO: 5434669 - DNA, 13 bp, Homo sapiens
gtctgtgtataca

SEQ ID NO: 5434670 - DNA, 14 bp, Homo sapiens
gtctgtgtatacat

SEQ ID NO: 5434671 - DNA, 21 bp, Homo sapiens
gtctgtgtatacatatgtatg

SEQ ID NO: 5434672 - DNA, 18 bp, Homo sapiens
gtctgtgtcccagccacg

SEQ ID NO: 5434673 - DNA, 13 bp, Homo sapiens
gtctgtgtgaatg

SEQ ID NO: 5434674 - DNA, 14 bp, Homo sapiens
gtctgtgtgctact

SEQ ID NO: 5434675 - DNA, 15 bp, Homo sapiens
gtctgtgtgctacta

SEQ ID NO: 5434676 - DNA, 15 bp, Homo sapiens
gtctgtgtgctgtgg

SEQ ID NO: 5434677 - DNA, 22 bp, Homo sapiens
gtctgtgtggccagcagcctct

SEQ ID NO: 5434678 - DNA, 15 bp, Homo sapiens
gtctgtgtggtggga

SEQ ID NO: 5434679 - DNA, 21 bp, Homo sapiens
gtctgtgtgtgacccctcctg

SEQ ID NO: 5434680 - DNA, 17 bp, Homo sapiens
gtctgtgtgtgcctgtg

SEQ ID NO: 5434681 - DNA, 16 bp, Homo sapiens
gtctgtgtgtgttctt

SEQ ID NO: 5434682 - DNA, 15 bp, Homo sapiens
gtctgtgttcaatcc

SEQ ID NO: 5434683 - DNA, 20 bp, Homo sapiens
gtctgtgttccaaccactga

SEQ ID NO: 5434684 - DNA, 18 bp, Homo sapiens
gtctgtgttctcaacaca

SEQ ID NO: 5434685 - DNA, 22 bp, Homo sapiens
gtctgtgttgcgtgtcgtgggt

SEQ ID NO: 5434686 - DNA, 14 bp, Homo sapiens
gtctgtgttgctgt

SEQ ID NO: 5434687 - DNA, 16 bp, Homo sapiens
gtctgtgttgctgttt

SEQ ID NO: 5434688 - DNA, 20 bp, Homo sapiens
gtctgtgttgtgtcctgaca

SEQ ID NO: 5434689 - DNA, 21 bp, Homo sapiens
gtctgttaccataagtctgat

SEQ ID NO: 5434690 - DNA, 15 bp, Homo sapiens
gtctgttaccatgtc

SEQ ID NO: 5434691 - DNA, 20 bp, Homo sapiens
gtctgttaccatgtcactgt

SEQ ID NO: 5434692 - DNA, 19 bp, Homo sapiens
gtctgttaccttgttaata

SEQ ID NO: 5434693 - DNA, 16 bp, Homo sapiens
gtctgttatgctgtga

SEQ ID NO: 5434694 - DNA, 15 bp, Homo sapiens
gtctgttattgtttt

SEQ ID NO: 5434695 - DNA, 15 bp, Homo sapiens
gtctgttcagcaaac

SEQ ID NO: 5434696 - DNA, 16 bp, Homo sapiens
gtctgttcccagcccc

SEQ ID NO: 5434697 - DNA, 17 bp, Homo sapiens
gtctgttcccagcccct

SEQ ID NO: 5434698 - DNA, 20 bp, Homo sapiens
gtctgttcccagcccctgca

SEQ ID NO: 5434699 - DNA, 22 bp, Homo sapiens
gtctgttccttttctctcctgt

SEQ ID NO: 5434700 - DNA, 19 bp, Homo sapiens
gtctgttctgcacaataaa

SEQ ID NO: 5434701 - DNA, 14 bp, Homo sapiens
gtctgttctgcagt

SEQ ID NO: 5434702 - DNA, 19 bp, Homo sapiens
gtctgttgaaataaaacat

SEQ ID NO: 5434703 - DNA, 20 bp, Homo sapiens
gtctgttggcaaatttgtga

SEQ ID NO: 5434704 - DNA, 14 bp, Homo sapiens
gtctgttggcaggc

SEQ ID NO: 5434705 - DNA, 21 bp, Homo sapiens
gtctgttggcaggctggccag

SEQ ID NO: 5434706 - DNA, 22 bp, Homo sapiens
gtctgttggcaggctggccagt

SEQ ID NO: 5434707 - DNA, 13 bp, Homo sapiens
gtctgtttaaagt

SEQ ID NO: 5434708 - DNA, 17 bp, Homo sapiens
gtctgtttaaagtggca

SEQ ID NO: 5434709 - DNA, 16 bp, Homo sapiens
gtctgtttaagaaaag

SEQ ID NO: 5434710 - DNA, 17 bp, Homo sapiens
gtctgtttataaacatt

SEQ ID NO: 5434711 - DNA, 22 bp, Homo sapiens
gtctgtttcaatgacctgtatt

SEQ ID NO: 5434712 - DNA, 14 bp, Homo sapiens
gtctgtttcattac

SEQ ID NO: 5434713 - DNA, 11 bp, Homo sapiens
gtctgtttctg

SEQ ID NO: 5434714 - DNA, 23 bp, Homo sapiens
gtctgtttgtttcaagaacctgg

SEQ ID NO: 5434715 - DNA, 20 bp, Homo sapiens
gtctgttttaaaaacctgtt

SEQ ID NO: 5434716 - DNA, 19 bp, Homo sapiens
gtctgttttagttggaatg

SEQ ID NO: 5434717 - DNA, 13 bp, Homo sapiens
gtctgttttatga

SEQ ID NO: 5434718 - DNA, 12 bp, Homo sapiens
gtctgttttcct

SEQ ID NO: 5434719 - DNA, 14 bp, Homo sapiens
gtctgttttgtaaa

SEQ ID NO: 5434720 - DNA, 14 bp, Homo sapiens
gtcttaaaaaatgt

SEQ ID NO: 5434721 - DNA, 21 bp, Homo sapiens
gtcttaaaaagtggaaaaata

SEQ ID NO: 5434722 - DNA, 14 bp, Homo sapiens
gtcttaaaaattta

SEQ ID NO: 5434723 - DNA, 18 bp, Homo sapiens
gtcttaaaaatttataca

SEQ ID NO: 5434724 - DNA, 13 bp, Homo sapiens
gtcttaaaaccag

SEQ ID NO: 5434725 - DNA, 22 bp, Homo sapiens
gtcttaaaataacttatatcat

SEQ ID NO: 5434726 - DNA, 14 bp, Homo sapiens
gtcttaaactaggt

SEQ ID NO: 5434727 - DNA, 21 bp, Homo sapiens
gtcttaaaggggcctgcgcag

SEQ ID NO: 5434728 - DNA, 13 bp, Homo sapiens
gtcttaaataaaa

SEQ ID NO: 5434729 - DNA, 16 bp, Homo sapiens
gtcttaaataaaacta

SEQ ID NO: 5434730 - DNA, 16 bp, Homo sapiens
gtcttaaataaaagaa

SEQ ID NO: 5434731 - DNA, 15 bp, Homo sapiens
gtcttaaataaatca

SEQ ID NO: 5434732 - DNA, 12 bp, Homo sapiens
gtcttaaatgct

SEQ ID NO: 5434733 - DNA, 18 bp, Homo sapiens
gtcttaaatgctcatttt

SEQ ID NO: 5434734 - DNA, 20 bp, Homo sapiens
gtcttaaatgctcattttct

SEQ ID NO: 5434735 - DNA, 20 bp, Homo sapiens
gtcttaacgaataaaggtcc

SEQ ID NO: 5434736 - DNA, 17 bp, Homo sapiens
gtcttaagaaatgtata

SEQ ID NO: 5434737 - DNA, 13 bp, Homo sapiens
gtcttaaggacaa

SEQ ID NO: 5434738 - DNA, 13 bp, Homo sapiens
gtcttaagggtca

SEQ ID NO: 5434739 - DNA, 13 bp, Homo sapiens
gtcttaagtgttt

SEQ ID NO: 5434740 - DNA, 14 bp, Homo sapiens
gtcttaatgaagtt

SEQ ID NO: 5434741 - DNA, 17 bp, Homo sapiens
gtcttaatgaagtttga

SEQ ID NO: 5434742 - DNA, 19 bp, Homo sapiens
gtcttaatgaagtttgaat

SEQ ID NO: 5434743 - DNA, 21 bp, Homo sapiens
gtcttaatggtatcctactga

SEQ ID NO: 5434744 - DNA, 13 bp, Homo sapiens
gtcttaatgttga

SEQ ID NO: 5434745 - DNA, 19 bp, Homo sapiens
gtcttaattaaaagaatat

SEQ ID NO: 5434746 - DNA, 22 bp, Homo sapiens
gtcttaattaaaagaatatttt

SEQ ID NO: 5434747 - DNA, 13 bp, Homo sapiens
gtcttaattaagt

SEQ ID NO: 5434748 - DNA, 15 bp, Homo sapiens
gtcttaattaagtaa

SEQ ID NO: 5434749 - DNA, 18 bp, Homo sapiens
gtcttaattattatttgt

SEQ ID NO: 5434750 - DNA, 13 bp, Homo sapiens
gtcttaattttct

SEQ ID NO: 5434751 - DNA, 22 bp, Homo sapiens
gtcttacattggctttttaaat

SEQ ID NO: 5434752 - DNA, 15 bp, Homo sapiens
gtcttacctctctgg

SEQ ID NO: 5434753 - DNA, 22 bp, Homo sapiens
gtcttactaataggtctggaag

SEQ ID NO: 5434754 - DNA, 20 bp, Homo sapiens
gtcttactacagaaatgagg

SEQ ID NO: 5434755 - DNA, 15 bp, Homo sapiens
gtcttactactttaa

SEQ ID NO: 5434756 - DNA, 16 bp, Homo sapiens
gtcttactactttaaa

SEQ ID NO: 5434757 - DNA, 15 bp, Homo sapiens
gtcttactctgtctc

SEQ ID NO: 5434758 - DNA, 13 bp, Homo sapiens
gtcttactttgtt

SEQ ID NO: 5434759 - DNA, 14 bp, Homo sapiens
gtcttactttgtta

SEQ ID NO: 5434760 - DNA, 17 bp, Homo sapiens
gtcttactttgttaatt

SEQ ID NO: 5434761 - DNA, 18 bp, Homo sapiens
gtcttagacttgaaatac

SEQ ID NO: 5434762 - DNA, 15 bp, Homo sapiens
gtcttagagcctttt

SEQ ID NO: 5434763 - DNA, 18 bp, Homo sapiens
gtcttagatcatagtttt

SEQ ID NO: 5434764 - DNA, 21 bp, Homo sapiens
gtcttagatgcagcgactgtt

SEQ ID NO: 5434765 - DNA, 15 bp, Homo sapiens
gtcttagatgtatat

SEQ ID NO: 5434766 - DNA, 16 bp, Homo sapiens
gtcttagcagtgattt

SEQ ID NO: 5434767 - DNA, 13 bp, Homo sapiens
gtcttagctttac

SEQ ID NO: 5434768 - DNA, 18 bp, Homo sapiens
gtcttaggatgtctgtaa

SEQ ID NO: 5434769 - DNA, 17 bp, Homo sapiens
gtcttaggctgatgcca

SEQ ID NO: 5434770 - DNA, 22 bp, Homo sapiens
gtcttagggtacagcccaggcg

SEQ ID NO: 5434771 - DNA, 21 bp, Homo sapiens
gtcttaggtcaggagttgtgt

SEQ ID NO: 5434772 - DNA, 18 bp, Homo sapiens
gtcttaggtcttcctgtg

SEQ ID NO: 5434773 - DNA, 19 bp, Homo sapiens
gtcttaggtcttcctgtgg

SEQ ID NO: 5434774 - DNA, 17 bp, Homo sapiens
gtcttaggtggcagggc

SEQ ID NO: 5434775 - DNA, 16 bp, Homo sapiens
gtcttaggtttccacg

SEQ ID NO: 5434776 - DNA, 15 bp, Homo sapiens
gtcttagttgatatt

SEQ ID NO: 5434777 - DNA, 15 bp, Homo sapiens
gtcttagttgtacaa

SEQ ID NO: 5434778 - DNA, 17 bp, Homo sapiens
gtcttatatagcagcaa

SEQ ID NO: 5434779 - DNA, 22 bp, Homo sapiens
gtcttatctgagctgagccagg

SEQ ID NO: 5434780 - DNA, 18 bp, Homo sapiens
gtcttatctgttcagtgt

SEQ ID NO: 5434781 - DNA, 20 bp, Homo sapiens
gtcttatgattttattacag

SEQ ID NO: 5434782 - DNA, 14 bp, Homo sapiens
gtcttatgcttcca

SEQ ID NO: 5434783 - DNA, 15 bp, Homo sapiens
gtcttatgcttccag

SEQ ID NO: 5434784 - DNA, 21 bp, Homo sapiens
gtcttatgcttccagaaacac

SEQ ID NO: 5434785 - DNA, 17 bp, Homo sapiens
gtcttatggtccagaaa

SEQ ID NO: 5434786 - DNA, 18 bp, Homo sapiens
gtcttatggtcttgatcc

SEQ ID NO: 5434787 - DNA, 16 bp, Homo sapiens
gtcttatgtaaagtat

SEQ ID NO: 5434788 - DNA, 19 bp, Homo sapiens
gtcttatgtgaaaaattaa

SEQ ID NO: 5434789 - DNA, 20 bp, Homo sapiens
gtcttatgtgaaaaattaac

SEQ ID NO: 5434790 - DNA, 13 bp, Homo sapiens
gtcttattcttaa

SEQ ID NO: 5434791 - DNA, 14 bp, Homo sapiens
gtcttattcttaag

SEQ ID NO: 5434792 - DNA, 21 bp, Homo sapiens
gtcttattcttgtgcacttta

SEQ ID NO: 5434793 - DNA, 13 bp, Homo sapiens
gtcttattttatt

SEQ ID NO: 5434794 - DNA, 14 bp, Homo sapiens
gtcttatttttaga

SEQ ID NO: 5434795 - DNA, 15 bp, Homo sapiens
gtcttcaaatttttt

SEQ ID NO: 5434796 - DNA, 19 bp, Homo sapiens
gtcttcaacagctccccat

SEQ ID NO: 5434797 - DNA, 15 bp, Homo sapiens
gtcttcaaccctgcc

SEQ ID NO: 5434798 - DNA, 21 bp, Homo sapiens
gtcttcaactggttagtgtga

SEQ ID NO: 5434799 - DNA, 17 bp, Homo sapiens
gtcttcaagcctggccc

SEQ ID NO: 5434800 - DNA, 15 bp, Homo sapiens
gtcttcaagggctgc

SEQ ID NO: 5434801 - DNA, 14 bp, Homo sapiens
gtcttcaatctctg

SEQ ID NO: 5434802 - DNA, 20 bp, Homo sapiens
gtcttcaatctctgttctgc

SEQ ID NO: 5434803 - DNA, 15 bp, Homo sapiens
gtcttcaattaaaag

SEQ ID NO: 5434804 - DNA, 14 bp, Homo sapiens
gtcttcacactgcg

SEQ ID NO: 5434805 - DNA, 16 bp, Homo sapiens
gtcttcacagctctgt

SEQ ID NO: 5434806 - DNA, 13 bp, Homo sapiens
gtcttcacctgcc

SEQ ID NO: 5434807 - DNA, 18 bp, Homo sapiens
gtcttcacctgccaccac

SEQ ID NO: 5434808 - DNA, 21 bp, Homo sapiens
gtcttcacctgccaccacaca

SEQ ID NO: 5434809 - DNA, 12 bp, Homo sapiens
gtcttcactctt

SEQ ID NO: 5434810 - DNA, 14 bp, Homo sapiens
gtcttcactgccca

SEQ ID NO: 5434811 - DNA, 16 bp, Homo sapiens
gtcttcactgcccagg

SEQ ID NO: 5434812 - DNA, 18 bp, Homo sapiens
gtcttcactttcctcagt

SEQ ID NO: 5434813 - DNA, 20 bp, Homo sapiens
gtcttcactttcctcagttg

SEQ ID NO: 5434814 - DNA, 18 bp, Homo sapiens
gtcttcagacccagagaa

SEQ ID NO: 5434815 - DNA, 19 bp, Homo sapiens
gtcttcagacccagagaag

SEQ ID NO: 5434816 - DNA, 18 bp, Homo sapiens
gtcttcagatcctgctgc

SEQ ID NO: 5434817 - DNA, 18 bp, Homo sapiens
gtcttcagattattaaaa

SEQ ID NO: 5434818 - DNA, 16 bp, Homo sapiens
gtcttcagcctccctc

SEQ ID NO: 5434819 - DNA, 18 bp, Homo sapiens
gtcttcagcctccctcag

SEQ ID NO: 5434820 - DNA, 22 bp, Homo sapiens
gtcttcagcctctttctgtccc

SEQ ID NO: 5434821 - DNA, 23 bp, Homo sapiens
gtcttcagcctctttctgtccct

SEQ ID NO: 5434822 - DNA, 21 bp, Homo sapiens
gtcttcagctgcatttcacat

SEQ ID NO: 5434823 - DNA, 16 bp, Homo sapiens
gtcttcagctttatcc

SEQ ID NO: 5434824 - DNA, 23 bp, Homo sapiens
gtcttcagtttcattttcctgtg

SEQ ID NO: 5434825 - DNA, 16 bp, Homo sapiens
gtcttcatctccctgc

SEQ ID NO: 5434826 - DNA, 17 bp, Homo sapiens
gtcttcatctccctgcc

SEQ ID NO: 5434827 - DNA, 17 bp, Homo sapiens
gtcttcatgttcccact

SEQ ID NO: 5434828 - DNA, 16 bp, Homo sapiens
gtcttcatttcattgt

SEQ ID NO: 5434829 - DNA, 13 bp, Homo sapiens
gtcttccaacccc

SEQ ID NO: 5434830 - DNA, 19 bp, Homo sapiens
gtcttccaaccccagctgg

SEQ ID NO: 5434831 - DNA, 13 bp, Homo sapiens
gtcttccaaggag

SEQ ID NO: 5434832 - DNA, 19 bp, Homo sapiens
gtcttccaaggagaccaag

SEQ ID NO: 5434833 - DNA, 15 bp, Homo sapiens
gtcttccacaaagaa

SEQ ID NO: 5434834 - DNA, 19 bp, Homo sapiens
gtcttccacaaagaaaatt

SEQ ID NO: 5434835 - DNA, 13 bp, Homo sapiens
gtcttccagacct

SEQ ID NO: 5434836 - DNA, 14 bp, Homo sapiens
gtcttccaggccca

SEQ ID NO: 5434837 - DNA, 19 bp, Homo sapiens
gtcttccaggtccaaaccc

SEQ ID NO: 5434838 - DNA, 13 bp, Homo sapiens
gtcttcccaccca

SEQ ID NO: 5434839 - DNA, 16 bp, Homo sapiens
gtcttccccaccttcc

SEQ ID NO: 5434840 - DNA, 16 bp, Homo sapiens
gtcttcccccctctcc

SEQ ID NO: 5434841 - DNA, 13 bp, Homo sapiens
gtcttcccctgag

SEQ ID NO: 5434842 - DNA, 22 bp, Homo sapiens
gtcttcccctgagagtttcctc

SEQ ID NO: 5434843 - DNA, 16 bp, Homo sapiens
gtcttccctacctcag

SEQ ID NO: 5434844 - DNA, 18 bp, Homo sapiens
gtcttccctacctcaggc

SEQ ID NO: 5434845 - DNA, 16 bp, Homo sapiens
gtcttccctagggctg

SEQ ID NO: 5434846 - DNA, 18 bp, Homo sapiens
gtcttccctagggctggg

SEQ ID NO: 5434847 - DNA, 14 bp, Homo sapiens
gtcttccctgcctg

SEQ ID NO: 5434848 - DNA, 11 bp, Homo sapiens
gtcttccctgg

SEQ ID NO: 5434849 - DNA, 18 bp, Homo sapiens
gtgaagttgaggcttata

SEQ ID NO: 5434850 - DNA, 13 bp, Homo sapiens
gtgaagttgctgc

SEQ ID NO: 5434851 - DNA, 23 bp, Homo sapiens
gtgaagttgctgcttctcccagg

SEQ ID NO: 5434852 - DNA, 14 bp, Homo sapiens
gtgaagttgtgcaa

SEQ ID NO: 5434853 - DNA, 19 bp, Homo sapiens
gtgaagtttaattgtctca

SEQ ID NO: 5434854 - DNA, 23 bp, Homo sapiens
gtgaagttttccttgctatttca

SEQ ID NO: 5434855 - DNA, 13 bp, Homo sapiens
gtgaataaaaacc

SEQ ID NO: 5434856 - DNA, 18 bp, Homo sapiens
gtgaataaaaagaaagat

SEQ ID NO: 5434857 - DNA, 22 bp, Homo sapiens
gtgaataaaaagaaagatttta

SEQ ID NO: 5434858 - DNA, 18 bp, Homo sapiens
gtgaataaacttcagcac

SEQ ID NO: 5434859 - DNA, 13 bp, Homo sapiens
gtgaataaaggat

SEQ ID NO: 5434860 - DNA, 14 bp, Homo sapiens
gtgaataaagtgct

SEQ ID NO: 5434861 - DNA, 19 bp, Homo sapiens
gtgaataaatattttagga

SEQ ID NO: 5434862 - DNA, 23 bp, Homo sapiens
gtgaataataaaatcaaaaactt

SEQ ID NO: 5434863 - DNA, 16 bp, Homo sapiens
gtgaataataaataca

SEQ ID NO: 5434864 - DNA, 24 bp, Homo sapiens
gtgaataataaatacacaatgaat

SEQ ID NO: 5434865 - DNA, 14 bp, Homo sapiens
gtgaataatgattt

SEQ ID NO: 5434866 - DNA, 13 bp, Homo sapiens
gtgaatacaatta

SEQ ID NO: 5434867 - DNA, 22 bp, Homo sapiens
gtgaatacttattttcagtgca

SEQ ID NO: 5434868 - DNA, 12 bp, Homo sapiens
gtgaatagcagt

SEQ ID NO: 5434869 - DNA, 18 bp, Homo sapiens
gtgaatagccatatttgt

SEQ ID NO: 5434870 - DNA, 19 bp, Homo sapiens
gtgaatagccatatttgta

SEQ ID NO: 5434871 - DNA, 23 bp, Homo sapiens
gtgaatagccatatttgtaaaat

SEQ ID NO: 5434872 - DNA, 17 bp, Homo sapiens
gtgaataggttatatgc

SEQ ID NO: 5434873 - DNA, 17 bp, Homo sapiens
gtgaatagtcatctcct

SEQ ID NO: 5434874 - DNA, 15 bp, Homo sapiens
gtgaatatatggtct

SEQ ID NO: 5434875 - DNA, 12 bp, Homo sapiens
gtgaatatgtgt

SEQ ID NO: 5434876 - DNA, 13 bp, Homo sapiens
gtgaatattgctt

SEQ ID NO: 5434877 - DNA, 19 bp, Homo sapiens
gtgaatattgtggctccct

SEQ ID NO: 5434878 - DNA, 22 bp, Homo sapiens
gtgaatatttccatatggattt

SEQ ID NO: 5434879 - DNA, 13 bp, Homo sapiens
gtgaatcaagggt

SEQ ID NO: 5434880 - DNA, 15 bp, Homo sapiens
gtgaatcaagggtca

SEQ ID NO: 5434881 - DNA, 16 bp, Homo sapiens
gtgaatcacgtaaagc

SEQ ID NO: 5434882 - DNA, 18 bp, Homo sapiens
gtgaatcacgtaaagcta

SEQ ID NO: 5434883 - DNA, 14 bp, Homo sapiens
gtgaatcagagcac

SEQ ID NO: 5434884 - DNA, 14 bp, Homo sapiens
gtgaatcaggcaaa

SEQ ID NO: 5434885 - DNA, 18 bp, Homo sapiens
gtgaatccatgggtctgg

SEQ ID NO: 5434886 - DNA, 20 bp, Homo sapiens
gtgaatccatgggtctggct

SEQ ID NO: 5434887 - DNA, 21 bp, Homo sapiens
gtgaatccatgggtctggcta

SEQ ID NO: 5434888 - DNA, 15 bp, Homo sapiens
gtgaatccctgggag

SEQ ID NO: 5434889 - DNA, 14 bp, Homo sapiens
gtgaatctgctttt

SEQ ID NO: 5434890 - DNA, 21 bp, Homo sapiens
gtgaatctgcttttcctctgc

SEQ ID NO: 5434891 - DNA, 22 bp, Homo sapiens
gtgaatcttatggtggaagagg

SEQ ID NO: 5434892 - DNA, 17 bp, Homo sapiens
gtgaatctttctcctgg

SEQ ID NO: 5434893 - DNA, 18 bp, Homo sapiens
gtgaatctttctcctggt

SEQ ID NO: 5434894 - DNA, 18 bp, Homo sapiens
gtgaatgaaagattaaac

SEQ ID NO: 5434895 - DNA, 15 bp, Homo sapiens
gtgaatgaatacaca

SEQ ID NO: 5434896 - DNA, 19 bp, Homo sapiens
gtgaatgagtaaataaact

SEQ ID NO: 5434897 - DNA, 19 bp, Homo sapiens
gtgaatgattcatgttata

SEQ ID NO: 5434898 - DNA, 22 bp, Homo sapiens
gtgaatgccatttagaatctag

SEQ ID NO: 5434899 - DNA, 16 bp, Homo sapiens
gtgaatgctagacaga

SEQ ID NO: 5434900 - DNA, 15 bp, Homo sapiens
gtgaatgctgggact

SEQ ID NO: 5434901 - DNA, 13 bp, Homo sapiens
gtgaatgctgggc

SEQ ID NO: 5434902 - DNA, 13 bp, Homo sapiens
gtgaatggaagca

SEQ ID NO: 5434903 - DNA, 17 bp, Homo sapiens
gtgaatggaggcagaga

SEQ ID NO: 5434904 - DNA, 15 bp, Homo sapiens
gtgaatggattggat

SEQ ID NO: 5434905 - DNA, 14 bp, Homo sapiens
gtgaatgggaaagg

SEQ ID NO: 5434906 - DNA, 9 bp, Homo sapiens
gtgaatgta

SEQ ID NO: 5434907 - DNA, 10 bp, Homo sapiens
gtgaatgtag

SEQ ID NO: 5434908 - DNA, 19 bp, Homo sapiens
gtgaatgtatgtttctgca

SEQ ID NO: 5434909 - DNA, 14 bp, Homo sapiens
gtgaatgtcttcct

SEQ ID NO: 5434910 - DNA, 20 bp, Homo sapiens
gtgaatgtcttccttttctt

SEQ ID NO: 5434911 - DNA, 13 bp, Homo sapiens
gtgaatgtggcag

SEQ ID NO: 5434912 - DNA, 14 bp, Homo sapiens
gtgaatgtgggcac

SEQ ID NO: 5434913 - DNA, 19 bp, Homo sapiens
gtgaatgtgtgaaggtctt

SEQ ID NO: 5434914 - DNA, 17 bp, Homo sapiens
gtgaatgtgtgagaaaa

SEQ ID NO: 5434915 - DNA, 21 bp, Homo sapiens
gtgaatgtgtgagaaaaacta

SEQ ID NO: 5434916 - DNA, 15 bp, Homo sapiens
gtgaatgttaacatg

SEQ ID NO: 5434917 - DNA, 19 bp, Homo sapiens
gtgaatgttccccaccgct

SEQ ID NO: 5434918 - DNA, 12 bp, Homo sapiens
gtgaattaaaaa

SEQ ID NO: 5434919 - DNA, 22 bp, Homo sapiens
gtgaattaggctgtaactactt

SEQ ID NO: 5434920 - DNA, 16 bp, Homo sapiens
gtgaattagttttaaa

SEQ ID NO: 5434921 - DNA, 23 bp, Homo sapiens
gtgaattcattctggaggggcag

SEQ ID NO: 5434922 - DNA, 14 bp, Homo sapiens
gtgaattgaagtca

SEQ ID NO: 5434923 - DNA, 13 bp, Homo sapiens
gtgaattgataat

SEQ ID NO: 5434924 - DNA, 17 bp, Homo sapiens
gtgaattgcctgccatg

SEQ ID NO: 5434925 - DNA, 19 bp, Homo sapiens
gtgaattgtacctatttct

SEQ ID NO: 5434926 - DNA, 22 bp, Homo sapiens
gtgaattgtacctatttctgat

SEQ ID NO: 5434927 - DNA, 15 bp, Homo sapiens
gtgaattgtctttta

SEQ ID NO: 5434928 - DNA, 18 bp, Homo sapiens
gtgaattgttagtttctg

SEQ ID NO: 5434929 - DNA, 14 bp, Homo sapiens
gtgaattgtttgaa

SEQ ID NO: 5434930 - DNA, 17 bp, Homo sapiens
gtgaatttcaacttttg

SEQ ID NO: 5434931 - DNA, 16 bp, Homo sapiens
gtgaatttctaaatgt

SEQ ID NO: 5434932 - DNA, 19 bp, Homo sapiens
gtgaatttctgaaagatga

SEQ ID NO: 5434933 - DNA, 20 bp, Homo sapiens
gtgaatttgccagaggacca

SEQ ID NO: 5434934 - DNA, 17 bp, Homo sapiens
gtgaattttaaaatgta

SEQ ID NO: 5434935 - DNA, 18 bp, Homo sapiens
gtgaattttcaaggcctt

SEQ ID NO: 5434936 - DNA, 22 bp, Homo sapiens
gtgaattttcaaggccttcagt

SEQ ID NO: 5434937 - DNA, 11 bp, Homo sapiens
gtgaattttta

SEQ ID NO: 5434938 - DNA, 17 bp, Homo sapiens
gtgaatttttaagctgc

SEQ ID NO: 5434939 - DNA, 15 bp, Homo sapiens
gtgaatttttattgt

SEQ ID NO: 5434940 - DNA, 16 bp, Homo sapiens
gtgaatttttattgtt

SEQ ID NO: 5434941 - DNA, 13 bp, Homo sapiens
gtgaatttttgca

SEQ ID NO: 5434942 - DNA, 19 bp, Homo sapiens
gtgacaaaaggctcggaat

SEQ ID NO: 5434943 - DNA, 18 bp, Homo sapiens
gtgacaaaattttataag

SEQ ID NO: 5434944 - DNA, 16 bp, Homo sapiens
gtgacaaaccatccag

SEQ ID NO: 5434945 - DNA, 23 bp, Homo sapiens
gtgacaaagactcctctgggcct

SEQ ID NO: 5434946 - DNA, 14 bp, Homo sapiens
gtgacaaaggatga

SEQ ID NO: 5434947 - DNA, 18 bp, Homo sapiens
gtgacaaaggatgaagaa

SEQ ID NO: 5434948 - DNA, 20 bp, Homo sapiens
gtgacaaagttatatattta

SEQ ID NO: 5434949 - DNA, 20 bp, Homo sapiens
gtgacaaataagattaataa

SEQ ID NO: 5434950 - DNA, 19 bp, Homo sapiens
gtgacaaatgttgaccttt

SEQ ID NO: 5434951 - DNA, 20 bp, Homo sapiens
gtgacaacatttttgtacat

SEQ ID NO: 5434952 - DNA, 22 bp, Homo sapiens
gtgacaacatttttgtacatta

SEQ ID NO: 5434953 - DNA, 19 bp, Homo sapiens
gtgacaacctttgtgtaat

SEQ ID NO: 5434954 - DNA, 13 bp, Homo sapiens
gtgacaagcgtca

SEQ ID NO: 5434955 - DNA, 18 bp, Homo sapiens
gtgacaagcgtcacttct

SEQ ID NO: 5434956 - DNA, 17 bp, Homo sapiens
gtgacaaggccccagag

SEQ ID NO: 5434957 - DNA, 17 bp, Homo sapiens
gtgacaagtggaggggg

SEQ ID NO: 5434958 - DNA, 13 bp, Homo sapiens
gtgacaagtgtgt

SEQ ID NO: 5434959 - DNA, 12 bp, Homo sapiens
gtgacaataaaa

SEQ ID NO: 5434960 - DNA, 21 bp, Homo sapiens
gtgacaataatattgttgtat

SEQ ID NO: 5434961 - DNA, 21 bp, Homo sapiens
gtgacaatgcttatggaaagc

SEQ ID NO: 5434962 - DNA, 19 bp, Homo sapiens
gtgacaattctgtttttaa

SEQ ID NO: 5434963 - DNA, 16 bp, Homo sapiens
gtgacaattttgtaca

SEQ ID NO: 5434964 - DNA, 18 bp, Homo sapiens
gtgacacactacaccaca

SEQ ID NO: 5434965 - DNA, 21 bp, Homo sapiens
gtgacacactacaccacacac

SEQ ID NO: 5434966 - DNA, 22 bp, Homo sapiens
gtgacacagcagcttcaccaga

SEQ ID NO: 5434967 - DNA, 18 bp, Homo sapiens
gtgacacaggtcagggct

SEQ ID NO: 5434968 - DNA, 19 bp, Homo sapiens
gtgacacatcgttttgggg

SEQ ID NO: 5434969 - DNA, 15 bp, Homo sapiens
gtgacaccaataaat

SEQ ID NO: 5434970 - DNA, 20 bp, Homo sapiens
gtgacaccaataaatgtttg

SEQ ID NO: 5434971 - DNA, 23 bp, Homo sapiens
gtgacaccaataaatgtttgtta

SEQ ID NO: 5434972 - DNA, 16 bp, Homo sapiens
gtgacaccaccactgt

SEQ ID NO: 5434973 - DNA, 21 bp, Homo sapiens
gtgacaccaccactgtgtccc

SEQ ID NO: 5434974 - DNA, 19 bp, Homo sapiens
gtgacaccccccttctgaa

SEQ ID NO: 5434975 - DNA, 15 bp, Homo sapiens
gtgacacctccccct

SEQ ID NO: 5434976 - DNA, 14 bp, Homo sapiens
gtgacacctggtgc

SEQ ID NO: 5434977 - DNA, 17 bp, Homo sapiens
gtgacacgcttctgagc

SEQ ID NO: 5434978 - DNA, 20 bp, Homo sapiens
gtgacacgcttctgagcagg

SEQ ID NO: 5434979 - DNA, 14 bp, Homo sapiens
gtgacactggacca

SEQ ID NO: 5434980 - DNA, 20 bp, Homo sapiens
gtgacacttcagagagctgg

SEQ ID NO: 5434981 - DNA, 21 bp, Homo sapiens
gtgacacttcagagagctggt

SEQ ID NO: 5434982 - DNA, 22 bp, Homo sapiens
gtgacactttgaactcctcaag

SEQ ID NO: 5434983 - DNA, 21 bp, Homo sapiens
gtgacagacattttcaataat

SEQ ID NO: 5434984 - DNA, 16 bp, Homo sapiens
gtgacagactcctgag

SEQ ID NO: 5434985 - DNA, 20 bp, Homo sapiens
gtgacagactggattaaaaa

SEQ ID NO: 5434986 - DNA, 19 bp, Homo sapiens
gtgacagactttggacagt

SEQ ID NO: 5434987 - DNA, 14 bp, Homo sapiens
gtgacagagccatg

SEQ ID NO: 5434988 - DNA, 18 bp, Homo sapiens
gtgacagaggcagcccca

SEQ ID NO: 5434989 - DNA, 23 bp, Homo sapiens
gtgacagaggcagccccattctg

SEQ ID NO: 5434990 - DNA, 12 bp, Homo sapiens
gtgacagagtga

SEQ ID NO: 5434991 - DNA, 20 bp, Homo sapiens
gtgacagagtgagactctgt

SEQ ID NO: 5434992 - DNA, 21 bp, Homo sapiens
gtgacagatgccaacttccca

SEQ ID NO: 5434993 - DNA, 21 bp, Homo sapiens
gtgacagcctctgactcacca

SEQ ID NO: 5434994 - DNA, 23 bp, Homo sapiens
gtgacagccttgggcctttcagt

SEQ ID NO: 5434995 - DNA, 22 bp, Homo sapiens
gtgacagctctttttgtgaagt

SEQ ID NO: 5434996 - DNA, 21 bp, Homo sapiens
gtgacagctgcaagccaggga

SEQ ID NO: 5434997 - DNA, 12 bp, Homo sapiens
gtgacagctttc

SEQ ID NO: 5434998 - DNA, 14 bp, Homo sapiens
gtgacaggaaagat

SEQ ID NO: 5434999 - DNA, 15 bp, Homo sapiens
gtgacaggaaagatt

SEQ ID NO: 5435000 - DNA, 17 bp, Homo sapiens
gtgacaggaaagccctc

SEQ ID NO: 5435001 - DNA, 16 bp, Homo sapiens
gtgacaggcagcagag

SEQ ID NO: 5435002 - DNA, 18 bp, Homo sapiens
gtgacaggctcgtcagcc

SEQ ID NO: 5435003 - DNA, 21 bp, Homo sapiens
gtgacaggctcgtcagccacc

SEQ ID NO: 5435004 - DNA, 13 bp, Homo sapiens
gtgacagggaagc

SEQ ID NO: 5435005 - DNA, 16 bp, Homo sapiens
gtgacagggaagctac

SEQ ID NO: 5435006 - DNA, 22 bp, Homo sapiens
gtgacagggaagctacaggtta

SEQ ID NO: 5435007 - DNA, 19 bp, Homo sapiens
gtgacagggcgggggtggc

SEQ ID NO: 5435008 - DNA, 19 bp, Homo sapiens
gtgacagtattttggttct

SEQ ID NO: 5435009 - DNA, 16 bp, Homo sapiens
gtgacagtcataaata

SEQ ID NO: 5435010 - DNA, 16 bp, Homo sapiens
gtgacagtcatcatca

SEQ ID NO: 5435011 - DNA, 18 bp, Homo sapiens
gtgacagtcatcatcagg

SEQ ID NO: 5435012 - DNA, 20 bp, Homo sapiens
gtgacagtcatcatcagggc

SEQ ID NO: 5435013 - DNA, 12 bp, Homo sapiens
gtgacagtgaag

SEQ ID NO: 5435014 - DNA, 23 bp, Homo sapiens
gtgacagtgcctgggaatgtatt

SEQ ID NO: 5435015 - DNA, 17 bp, Homo sapiens
gtgacagtggctgctct

SEQ ID NO: 5435016 - DNA, 15 bp, Homo sapiens
gtgacagtttccaaa

SEQ ID NO: 5435017 - DNA, 23 bp, Homo sapiens
gtgacagtttccagatgctatca

SEQ ID NO: 5435018 - DNA, 18 bp, Homo sapiens
gtgacatcaaagcctggc

SEQ ID NO: 5435019 - DNA, 22 bp, Homo sapiens
gtgacatcccaggaggggcctc

SEQ ID NO: 5435020 - DNA, 18 bp, Homo sapiens
gtgacatcgacaaccacg

SEQ ID NO: 5435021 - DNA, 14 bp, Homo sapiens
gtgacatctcttac

SEQ ID NO: 5435022 - DNA, 13 bp, Homo sapiens
gtgacatgaagca

SEQ ID NO: 5435023 - DNA, 19 bp, Homo sapiens
gtgacatgattctgaactt

SEQ ID NO: 5435024 - DNA, 21 bp, Homo sapiens
gtgacatgcagttatatattt

SEQ ID NO: 5435025 - DNA, 17 bp, Homo sapiens
gtgacatgcccaaggcc

SEQ ID NO: 5435026 - DNA, 20 bp, Homo sapiens
gtgagtgtgaatataaatgt

SEQ ID NO: 5435027 - DNA, 13 bp, Homo sapiens
gtgagtgtgacag

SEQ ID NO: 5435028 - DNA, 18 bp, Homo sapiens
gtgagtgtgactttttga

SEQ ID NO: 5435029 - DNA, 16 bp, Homo sapiens
gtgagtgtggctcccc

SEQ ID NO: 5435030 - DNA, 18 bp, Homo sapiens
gtgagtgtgtatgtcagt

SEQ ID NO: 5435031 - DNA, 22 bp, Homo sapiens
gtgagtgtgtccaagtgtgtgt

SEQ ID NO: 5435032 - DNA, 22 bp, Homo sapiens
gtgagtgtgtgagcgcttctgc

SEQ ID NO: 5435033 - DNA, 22 bp, Homo sapiens
gtgagtgtgtgtgatgggatct

SEQ ID NO: 5435034 - DNA, 14 bp, Homo sapiens
gtgagtgtgtgtgc

SEQ ID NO: 5435035 - DNA, 16 bp, Homo sapiens
gtgagtgtttctatga

SEQ ID NO: 5435036 - DNA, 20 bp, Homo sapiens
gtgagttcagcctttaagat

SEQ ID NO: 5435037 - DNA, 14 bp, Homo sapiens
gtgagttctcacta

SEQ ID NO: 5435038 - DNA, 14 bp, Homo sapiens
gtgagttctcaggg

SEQ ID NO: 5435039 - DNA, 18 bp, Homo sapiens
gtgagttctcagggctcc

SEQ ID NO: 5435040 - DNA, 15 bp, Homo sapiens
gtgagttctgttgtg

SEQ ID NO: 5435041 - DNA, 17 bp, Homo sapiens
gtgagttgatagcacag

SEQ ID NO: 5435042 - DNA, 15 bp, Homo sapiens
gtgagttgcatgttt

SEQ ID NO: 5435043 - DNA, 16 bp, Homo sapiens
gtgagttgcatgtttt

SEQ ID NO: 5435044 - DNA, 22 bp, Homo sapiens
gtgagttgcatgtttttgaaaa

SEQ ID NO: 5435045 - DNA, 16 bp, Homo sapiens
gtgagttggcttacct

SEQ ID NO: 5435046 - DNA, 19 bp, Homo sapiens
gtgagtttaggcagcttct

SEQ ID NO: 5435047 - DNA, 20 bp, Homo sapiens
gtgagtttagtaaggctgtg

SEQ ID NO: 5435048 - DNA, 15 bp, Homo sapiens
gtgagtttcctgcta

SEQ ID NO: 5435049 - DNA, 17 bp, Homo sapiens
gtgagtttgctggttgt

SEQ ID NO: 5435050 - DNA, 21 bp, Homo sapiens
gtgataactcctaagaggagc

SEQ ID NO: 5435051 - DNA, 22 bp, Homo sapiens
gtgataaggggccttgctctga

SEQ ID NO: 5435052 - DNA, 21 bp, Homo sapiens
gtgataatcgtcttcaaatta

SEQ ID NO: 5435053 - DNA, 21 bp, Homo sapiens
gtgataatgcagataaataca

SEQ ID NO: 5435054 - DNA, 17 bp, Homo sapiens
gtgataattgtaaaggt

SEQ ID NO: 5435055 - DNA, 22 bp, Homo sapiens
gtgataattttatttataaact

SEQ ID NO: 5435056 - DNA, 21 bp, Homo sapiens
gtgatacaactgagtctcgag

SEQ ID NO: 5435057 - DNA, 15 bp, Homo sapiens
gtgatacaatgctgt

SEQ ID NO: 5435058 - DNA, 17 bp, Homo sapiens
gtgatacactgtatcta

SEQ ID NO: 5435059 - DNA, 21 bp, Homo sapiens
gtgatacagaactcttaaaaa

SEQ ID NO: 5435060 - DNA, 14 bp, Homo sapiens
gtgatacagttttg

SEQ ID NO: 5435061 - DNA, 14 bp, Homo sapiens
gtgatacatttctg

SEQ ID NO: 5435062 - DNA, 16 bp, Homo sapiens
gtgatacatttctgaa

SEQ ID NO: 5435063 - DNA, 15 bp, Homo sapiens
gtgatacatttttta

SEQ ID NO: 5435064 - DNA, 16 bp, Homo sapiens
gtgatacgtacagcca

SEQ ID NO: 5435065 - DNA, 13 bp, Homo sapiens
gtgatactccaag

SEQ ID NO: 5435066 - DNA, 17 bp, Homo sapiens
gtgatagagcctttgat

SEQ ID NO: 5435067 - DNA, 17 bp, Homo sapiens
gtgataggcaaggatga

SEQ ID NO: 5435068 - DNA, 20 bp, Homo sapiens
gtgataggcccaaggtcccc

SEQ ID NO: 5435069 - DNA, 16 bp, Homo sapiens
gtgatatatgtattaa

SEQ ID NO: 5435070 - DNA, 21 bp, Homo sapiens
gtgatatatgtatttattgtc

SEQ ID NO: 5435071 - DNA, 21 bp, Homo sapiens
gtgatatcacctctcttcagc

SEQ ID NO: 5435072 - DNA, 12 bp, Homo sapiens
gtgatatgctgc

SEQ ID NO: 5435073 - DNA, 18 bp, Homo sapiens
gtgatatgctgcttgtga

SEQ ID NO: 5435074 - DNA, 16 bp, Homo sapiens
gtgatatggcagaaga

SEQ ID NO: 5435075 - DNA, 19 bp, Homo sapiens
gtgatatggtgaagggaag

SEQ ID NO: 5435076 - DNA, 20 bp, Homo sapiens
gtgatatgtgtaatatcatt

SEQ ID NO: 5435077 - DNA, 13 bp, Homo sapiens
gtgatattctaag

SEQ ID NO: 5435078 - DNA, 15 bp, Homo sapiens
gtgatatttctctag

SEQ ID NO: 5435079 - DNA, 18 bp, Homo sapiens
gtgatatttttatgtgca

SEQ ID NO: 5435080 - DNA, 19 bp, Homo sapiens
gtgatatttttatgtgcag

SEQ ID NO: 5435081 - DNA, 14 bp, Homo sapiens
gtgatatttttctt

SEQ ID NO: 5435082 - DNA, 13 bp, Homo sapiens
gtgatcaaagcca

SEQ ID NO: 5435083 - DNA, 17 bp, Homo sapiens
gtgatcaccacatcttt

SEQ ID NO: 5435084 - DNA, 16 bp, Homo sapiens
gtgatcacgatccagt

SEQ ID NO: 5435085 - DNA, 20 bp, Homo sapiens
gtgatcacgatccagtctgc

SEQ ID NO: 5435086 - DNA, 23 bp, Homo sapiens
gtgatcactttctgaaattcaca

SEQ ID NO: 5435087 - DNA, 14 bp, Homo sapiens
gtgatcagcaatga

SEQ ID NO: 5435088 - DNA, 14 bp, Homo sapiens
gtgatcagcagaga

SEQ ID NO: 5435089 - DNA, 16 bp, Homo sapiens
gtgatcagcattgtga

SEQ ID NO: 5435090 - DNA, 14 bp, Homo sapiens
gtgatcaggcccca

SEQ ID NO: 5435091 - DNA, 15 bp, Homo sapiens
gtgatcaggccccac

SEQ ID NO: 5435092 - DNA, 19 bp, Homo sapiens
gtgatcagtatgctgtttt

SEQ ID NO: 5435093 - DNA, 19 bp, Homo sapiens
gtgatcagtgattttcaaa

SEQ ID NO: 5435094 - DNA, 15 bp, Homo sapiens
gtgatcatttaaaaa

SEQ ID NO: 5435095 - DNA, 22 bp, Homo sapiens
gtgatccacccacctcagcctc

SEQ ID NO: 5435096 - DNA, 23 bp, Homo sapiens
gtgatccacccacctcagcctcc

SEQ ID NO: 5435097 - DNA, 22 bp, Homo sapiens
gtgatccacccaccttggcctc

SEQ ID NO: 5435098 - DNA, 21 bp, Homo sapiens
gtgatccaccggcctcggcct

SEQ ID NO: 5435099 - DNA, 14 bp, Homo sapiens
gtgatccacctgcc

SEQ ID NO: 5435100 - DNA, 14 bp, Homo sapiens
gtgatccagccctg

SEQ ID NO: 5435101 - DNA, 19 bp, Homo sapiens
gtgatccagggtatgacct

SEQ ID NO: 5435102 - DNA, 12 bp, Homo sapiens
gtgatcccagct

SEQ ID NO: 5435103 - DNA, 17 bp, Homo sapiens
gtgatcccagctcactg

SEQ ID NO: 5435104 - DNA, 23 bp, Homo sapiens
gtgatcccagctcactgcagcct

SEQ ID NO: 5435105 - DNA, 18 bp, Homo sapiens
gtgatcccccaaacagca

SEQ ID NO: 5435106 - DNA, 15 bp, Homo sapiens
gtgatccgcctgcct

SEQ ID NO: 5435107 - DNA, 15 bp, Homo sapiens
gtgatcctctatttt

SEQ ID NO: 5435108 - DNA, 21 bp, Homo sapiens
gtgatcctctattttgtgatg

SEQ ID NO: 5435109 - DNA, 19 bp, Homo sapiens
gtgatcctgttctgcgctg

SEQ ID NO: 5435110 - DNA, 17 bp, Homo sapiens
gtgatccttggtgctgt

SEQ ID NO: 5435111 - DNA, 19 bp, Homo sapiens
gtgatccttttatgttatt

SEQ ID NO: 5435112 - DNA, 13 bp, Homo sapiens
gtgatccttttgt

SEQ ID NO: 5435113 - DNA, 22 bp, Homo sapiens
gtgatcgatgattcaggtgcag

SEQ ID NO: 5435114 - DNA, 15 bp, Homo sapiens
gtgatcgcacaagga

SEQ ID NO: 5435115 - DNA, 15 bp, Homo sapiens
gtgatctaagcagtt

SEQ ID NO: 5435116 - DNA, 21 bp, Homo sapiens
gtgatctaagcagttgcaatg

SEQ ID NO: 5435117 - DNA, 12 bp, Homo sapiens
gtgatctatgtt

SEQ ID NO: 5435118 - DNA, 16 bp, Homo sapiens
gtgatctcagggcaga

SEQ ID NO: 5435119 - DNA, 14 bp, Homo sapiens
gtgatctcatttaa

SEQ ID NO: 5435120 - DNA, 16 bp, Homo sapiens
gtgatctcgactcccc

SEQ ID NO: 5435121 - DNA, 13 bp, Homo sapiens
gtgatctctgctg

SEQ ID NO: 5435122 - DNA, 14 bp, Homo sapiens
gtgatctgctgctg

SEQ ID NO: 5435123 - DNA, 22 bp, Homo sapiens
gtgatctgggcattttcctcct

SEQ ID NO: 5435124 - DNA, 18 bp, Homo sapiens
gtgatctgggtctctaat

SEQ ID NO: 5435125 - DNA, 19 bp, Homo sapiens
gtgatctgtcccctctccc

SEQ ID NO: 5435126 - DNA, 14 bp, Homo sapiens
gtgatctgtccttc

SEQ ID NO: 5435127 - DNA, 15 bp, Homo sapiens
gtgatctgtcttgta

SEQ ID NO: 5435128 - DNA, 18 bp, Homo sapiens
gtgatctgtgtacaattt

SEQ ID NO: 5435129 - DNA, 22 bp, Homo sapiens
gtgatcttaattactttcagaa

SEQ ID NO: 5435130 - DNA, 17 bp, Homo sapiens
gtgatcttaggtttgtt

SEQ ID NO: 5435131 - DNA, 16 bp, Homo sapiens
gtgatcttattgcttg

SEQ ID NO: 5435132 - DNA, 20 bp, Homo sapiens
gtgatcttcccacaccagcc

SEQ ID NO: 5435133 - DNA, 15 bp, Homo sapiens
gtgatcttcccacgt

SEQ ID NO: 5435134 - DNA, 19 bp, Homo sapiens
gtgatcttggctcactaca

SEQ ID NO: 5435135 - DNA, 20 bp, Homo sapiens
gtgatcttttgttcccatcc

SEQ ID NO: 5435136 - DNA, 15 bp, Homo sapiens
gtgatgaaatatgaa

SEQ ID NO: 5435137 - DNA, 17 bp, Homo sapiens
gtgatgaaattataagt

SEQ ID NO: 5435138 - DNA, 17 bp, Homo sapiens
gtgatgaacatattcat

SEQ ID NO: 5435139 - DNA, 16 bp, Homo sapiens
gtgatgaagctgaggc

SEQ ID NO: 5435140 - DNA, 23 bp, Homo sapiens
gtgatgaatcaatgaaaaatgta

SEQ ID NO: 5435141 - DNA, 18 bp, Homo sapiens
gtgatgaatctacatttg

SEQ ID NO: 5435142 - DNA, 16 bp, Homo sapiens
gtgatgaatttaccat

SEQ ID NO: 5435143 - DNA, 23 bp, Homo sapiens
gtgatgaatttaccatcaaacaa

SEQ ID NO: 5435144 - DNA, 13 bp, Homo sapiens
gtgatgacatatt

SEQ ID NO: 5435145 - DNA, 21 bp, Homo sapiens
gtgatgaccccatagacctaa

SEQ ID NO: 5435146 - DNA, 14 bp, Homo sapiens
gtgatgactcttgt

SEQ ID NO: 5435147 - DNA, 18 bp, Homo sapiens
gtgatgagggcagcagcc

SEQ ID NO: 5435148 - DNA, 21 bp, Homo sapiens
gtgatgagggcagcagccagc

SEQ ID NO: 5435149 - DNA, 22 bp, Homo sapiens
gtgatgagggcagcagccagcc

SEQ ID NO: 5435150 - DNA, 23 bp, Homo sapiens
gtgatgagggcagcagccagccc

SEQ ID NO: 5435151 - DNA, 22 bp, Homo sapiens
gtgatgatcagctgtttgtcat

SEQ ID NO: 5435152 - DNA, 12 bp, Homo sapiens
gtgatgatgctg

SEQ ID NO: 5435153 - DNA, 14 bp, Homo sapiens
gtgatgatgctgtg

SEQ ID NO: 5435154 - DNA, 15 bp, Homo sapiens
gtgatgatgtaattg

SEQ ID NO: 5435155 - DNA, 11 bp, Homo sapiens
gtgatgcaagt

SEQ ID NO: 5435156 - DNA, 15 bp, Homo sapiens
gtgatgcaagtcact

SEQ ID NO: 5435157 - DNA, 22 bp, Homo sapiens
gtgatgcattaattaatggctt

SEQ ID NO: 5435158 - DNA, 18 bp, Homo sapiens
gtgatgccaggttctatt

SEQ ID NO: 5435159 - DNA, 16 bp, Homo sapiens
gtgatgccgtcctgct

SEQ ID NO: 5435160 - DNA, 18 bp, Homo sapiens
gtgatgccgtcctgctgg

SEQ ID NO: 5435161 - DNA, 22 bp, Homo sapiens
gtgatgccttccgacaccactg

SEQ ID NO: 5435162 - DNA, 23 bp, Homo sapiens
gtgatgccttccgacaccactgg

SEQ ID NO: 5435163 - DNA, 16 bp, Homo sapiens
gtgatgctcaggcttg

SEQ ID NO: 5435164 - DNA, 19 bp, Homo sapiens
gtgatgctctggcttgccc

SEQ ID NO: 5435165 - DNA, 20 bp, Homo sapiens
gtgatgctgacaccagcggc

SEQ ID NO: 5435166 - DNA, 21 bp, Homo sapiens
gtgatgctggtaccactggaa

SEQ ID NO: 5435167 - DNA, 13 bp, Homo sapiens
gtgatgctgtgat

SEQ ID NO: 5435168 - DNA, 18 bp, Homo sapiens
gtgatgctttcattatgt

SEQ ID NO: 5435169 - DNA, 12 bp, Homo sapiens
gtgatgcttttg

SEQ ID NO: 5435170 - DNA, 18 bp, Homo sapiens
gtgatgcttttgctgctg

SEQ ID NO: 5435171 - DNA, 19 bp, Homo sapiens
gtgatgcttttgctgctgc

SEQ ID NO: 5435172 - DNA, 20 bp, Homo sapiens
gtgatgcttttgctgctgct

SEQ ID NO: 5435173 - DNA, 14 bp, Homo sapiens
gtgatggaccaaag

SEQ ID NO: 5435174 - DNA, 16 bp, Homo sapiens
gtgatggaccaaagcc

SEQ ID NO: 5435175 - DNA, 17 bp, Homo sapiens
gtgatggagaggacaga

SEQ ID NO: 5435176 - DNA, 17 bp, Homo sapiens
gtgatggaggggagagg

SEQ ID NO: 5435177 - DNA, 16 bp, Homo sapiens
gtgatggagtgctgtt

SEQ ID NO: 5435178 - DNA, 23 bp, Homo sapiens
gtgatggagtgctgttttgttat

SEQ ID NO: 5435179 - DNA, 22 bp, Homo sapiens
gtgatggagtgtgcgtgtgtgc

SEQ ID NO: 5435180 - DNA, 22 bp, Homo sapiens
gtgatggatggacacaaaaaaa

SEQ ID NO: 5435181 - DNA, 12 bp, Homo sapiens
gtgatggcatta

SEQ ID NO: 5435182 - DNA, 20 bp, Homo sapiens
gtgatggcgcgggaggcacc

SEQ ID NO: 5435183 - DNA, 21 bp, Homo sapiens
gtgatggcgcgggaggcacca

SEQ ID NO: 5435184 - DNA, 17 bp, Homo sapiens
gtgatgggaaagcattg

SEQ ID NO: 5435185 - DNA, 19 bp, Homo sapiens
gtgatgggaaggtttttaa

SEQ ID NO: 5435186 - DNA, 20 bp, Homo sapiens
gtgatgggactcattgtaga

SEQ ID NO: 5435187 - DNA, 18 bp, Homo sapiens
gtgatgggcaaggggcca

SEQ ID NO: 5435188 - DNA, 21 bp, Homo sapiens
gtgatgggcccgcctcggcct

SEQ ID NO: 5435189 - DNA, 22 bp, Homo sapiens
gtgatgggcgagtcccggagcc

SEQ ID NO: 5435190 - DNA, 16 bp, Homo sapiens
gtgatgggctaggcct

SEQ ID NO: 5435191 - DNA, 17 bp, Homo sapiens
gtgatgggctaggcctc

SEQ ID NO: 5435192 - DNA, 14 bp, Homo sapiens
gtgatggggcaagg

SEQ ID NO: 5435193 - DNA, 18 bp, Homo sapiens
gtgatggggctcagatgg

SEQ ID NO: 5435194 - DNA, 16 bp, Homo sapiens
gtgatgggggagaggg

SEQ ID NO: 5435195 - DNA, 14 bp, Homo sapiens
gtgatggggtgggc

SEQ ID NO: 5435196 - DNA, 18 bp, Homo sapiens
gtgatggggtgggcaggg

SEQ ID NO: 5435197 - DNA, 20 bp, Homo sapiens
gtgatggggtgggcagggct

SEQ ID NO: 5435198 - DNA, 16 bp, Homo sapiens
gtgatggtgtagccct

SEQ ID NO: 5435199 - DNA, 19 bp, Homo sapiens
gtgatggtgtccttccctg

SEQ ID NO: 5435200 - DNA, 16 bp, Homo sapiens
gtgatgtaaaaatgct

SEQ ID NO: 5435201 - DNA, 15 bp, Homo sapiens
gtgatgtaccagttt

SEQ ID NO: 5435202 - DNA, 19 bp, Homo sapiens
gtgatgtatattcctttga

SEQ ID NO: 5435203 - DNA, 18 bp, Homo sapiens
gtgcagtaaccatttaat

SEQ ID NO: 5435204 - DNA, 18 bp, Homo sapiens
gtgcagtaacttgggagt

SEQ ID NO: 5435205 - DNA, 19 bp, Homo sapiens
gtgcagtagagagcctttc

SEQ ID NO: 5435206 - DNA, 15 bp, Homo sapiens
gtgcagtagtgtcac

SEQ ID NO: 5435207 - DNA, 19 bp, Homo sapiens
gtgcagtataattttctaa

SEQ ID NO: 5435208 - DNA, 22 bp, Homo sapiens
gtgcagtatcatgccctgtgca

SEQ ID NO: 5435209 - DNA, 16 bp, Homo sapiens
gtgcagtatctcaaga

SEQ ID NO: 5435210 - DNA, 17 bp, Homo sapiens
gtgcagtcccgtggagg

SEQ ID NO: 5435211 - DNA, 16 bp, Homo sapiens
gtgcagtcctgatcag

SEQ ID NO: 5435212 - DNA, 22 bp, Homo sapiens
gtgcagtcctgggatgtggctg

SEQ ID NO: 5435213 - DNA, 14 bp, Homo sapiens
gtgcagtcctgggt

SEQ ID NO: 5435214 - DNA, 15 bp, Homo sapiens
gtgcagtcctgggtc

SEQ ID NO: 5435215 - DNA, 18 bp, Homo sapiens
gtgcagtggagggggcaa

SEQ ID NO: 5435216 - DNA, 19 bp, Homo sapiens
gtgcagtggagggggcaag

SEQ ID NO: 5435217 - DNA, 23 bp, Homo sapiens
gtgcagtggtgcgatctgggttc

SEQ ID NO: 5435218 - DNA, 15 bp, Homo sapiens
gtgcagtgtgcctgt

SEQ ID NO: 5435219 - DNA, 23 bp, Homo sapiens
gtgcagtgtgtgaaaattcaggt

SEQ ID NO: 5435220 - DNA, 17 bp, Homo sapiens
gtgcagtgtttttcctg

SEQ ID NO: 5435221 - DNA, 20 bp, Homo sapiens
gtgcagttctagtttgcatt

SEQ ID NO: 5435222 - DNA, 19 bp, Homo sapiens
gtgcagttgacagcaggtg

SEQ ID NO: 5435223 - DNA, 19 bp, Homo sapiens
gtgcagtttcttttcacat

SEQ ID NO: 5435224 - DNA, 15 bp, Homo sapiens
gtgcataatgctttg

SEQ ID NO: 5435225 - DNA, 14 bp, Homo sapiens
gtgcataccacttt

SEQ ID NO: 5435226 - DNA, 16 bp, Homo sapiens
gtgcatagaattctag

SEQ ID NO: 5435227 - DNA, 20 bp, Homo sapiens
gtgcatagaattctagcttt

SEQ ID NO: 5435228 - DNA, 14 bp, Homo sapiens
gtgcatagcgtcct

SEQ ID NO: 5435229 - DNA, 21 bp, Homo sapiens
gtgcatagcgtcctgccctgc

SEQ ID NO: 5435230 - DNA, 15 bp, Homo sapiens
gtgcatagtttcttt

SEQ ID NO: 5435231 - DNA, 23 bp, Homo sapiens
gtgcatataaaggttatgaaaca

SEQ ID NO: 5435232 - DNA, 22 bp, Homo sapiens
gtgcatatggcaacgttcatgt

SEQ ID NO: 5435233 - DNA, 15 bp, Homo sapiens
gtgcatattgtacac

SEQ ID NO: 5435234 - DNA, 20 bp, Homo sapiens
gtgcatattgtacacttttt

SEQ ID NO: 5435235 - DNA, 12 bp, Homo sapiens
gtgcatcattac

SEQ ID NO: 5435236 - DNA, 17 bp, Homo sapiens
gtgcatcattactgttc

SEQ ID NO: 5435237 - DNA, 12 bp, Homo sapiens
gtgcatccaaag

SEQ ID NO: 5435238 - DNA, 20 bp, Homo sapiens
gtgcatccacgcacacatgg

SEQ ID NO: 5435239 - DNA, 20 bp, Homo sapiens
gtgcatcctcctcagccccc

SEQ ID NO: 5435240 - DNA, 14 bp, Homo sapiens
gtgcatccttgtaa

SEQ ID NO: 5435241 - DNA, 16 bp, Homo sapiens
gtgcatctagaaagct

SEQ ID NO: 5435242 - DNA, 14 bp, Homo sapiens
gtgcatctcctccc

SEQ ID NO: 5435243 - DNA, 22 bp, Homo sapiens
gtgcatctcctcccgcccttcc

SEQ ID NO: 5435244 - DNA, 14 bp, Homo sapiens
gtgcatctccttga

SEQ ID NO: 5435245 - DNA, 13 bp, Homo sapiens
gtgcatctgcagg

SEQ ID NO: 5435246 - DNA, 22 bp, Homo sapiens
gtgcatctggcacgtggccagg

SEQ ID NO: 5435247 - DNA, 22 bp, Homo sapiens
gtgcatctggcctatgaccctg

SEQ ID NO: 5435248 - DNA, 15 bp, Homo sapiens
gtgcatctggcctgg

SEQ ID NO: 5435249 - DNA, 20 bp, Homo sapiens
gtgcatgacgtttaaggcca

SEQ ID NO: 5435250 - DNA, 19 bp, Homo sapiens
gtgcatgagaatgtcattt

SEQ ID NO: 5435251 - DNA, 14 bp, Homo sapiens
gtgcatgatggtga

SEQ ID NO: 5435252 - DNA, 15 bp, Homo sapiens
gtgcatgcactgtct

SEQ ID NO: 5435253 - DNA, 18 bp, Homo sapiens
gtgcatgcagcatctaag

SEQ ID NO: 5435254 - DNA, 17 bp, Homo sapiens
gtgcatgcatgccctct

SEQ ID NO: 5435255 - DNA, 12 bp, Homo sapiens
gtgcatgcatgt

SEQ ID NO: 5435256 - DNA, 17 bp, Homo sapiens
gtgcatgcattgagctg

SEQ ID NO: 5435257 - DNA, 20 bp, Homo sapiens
gtgcatgctagtgttgtatt

SEQ ID NO: 5435258 - DNA, 16 bp, Homo sapiens
gtgcatgctctctgca

SEQ ID NO: 5435259 - DNA, 18 bp, Homo sapiens
gtgcatgctctctgcagc

SEQ ID NO: 5435260 - DNA, 21 bp, Homo sapiens
gtgcatgctctctgcagccag

SEQ ID NO: 5435261 - DNA, 17 bp, Homo sapiens
gtgcatggaagttgggg

SEQ ID NO: 5435262 - DNA, 18 bp, Homo sapiens
gtgcatggaagttggggc

SEQ ID NO: 5435263 - DNA, 16 bp, Homo sapiens
gtgcatggctcctgtc

SEQ ID NO: 5435264 - DNA, 19 bp, Homo sapiens
gtgcatggcttggggagca

SEQ ID NO: 5435265 - DNA, 20 bp, Homo sapiens
gtgcatggcttggggagcag

SEQ ID NO: 5435266 - DNA, 14 bp, Homo sapiens
gtgcatggtggcac

SEQ ID NO: 5435267 - DNA, 16 bp, Homo sapiens
gtgcatgtatgtcttg

SEQ ID NO: 5435268 - DNA, 22 bp, Homo sapiens
gtgcatgtatgtgcacatgtgt

SEQ ID NO: 5435269 - DNA, 11 bp, Homo sapiens
gtgcatgtcac

SEQ ID NO: 5435270 - DNA, 23 bp, Homo sapiens
gtgcatgtcacatgacatccaca

SEQ ID NO: 5435271 - DNA, 17 bp, Homo sapiens
gtgcatgtcacatgcca

SEQ ID NO: 5435272 - DNA, 17 bp, Homo sapiens
gtgcatgtctgttcttc

SEQ ID NO: 5435273 - DNA, 12 bp, Homo sapiens
gtgcatgtgcag

SEQ ID NO: 5435274 - DNA, 13 bp, Homo sapiens
gtgcatgtgcatg

SEQ ID NO: 5435275 - DNA, 16 bp, Homo sapiens
gtgcatgtgccgaggt

SEQ ID NO: 5435276 - DNA, 17 bp, Homo sapiens
gtgcatgtgcgtggaag

SEQ ID NO: 5435277 - DNA, 17 bp, Homo sapiens
gtgcatgtgctgtgtga

SEQ ID NO: 5435278 - DNA, 18 bp, Homo sapiens
gtgcatgtgctgtgtgag

SEQ ID NO: 5435279 - DNA, 13 bp, Homo sapiens
gtgcatgtgtgtg

SEQ ID NO: 5435280 - DNA, 19 bp, Homo sapiens
gtgcatgtgtgttcatgca

SEQ ID NO: 5435281 - DNA, 21 bp, Homo sapiens
gtgcatgttgccatgaggcct

SEQ ID NO: 5435282 - DNA, 15 bp, Homo sapiens
gtgcattatctagat

SEQ ID NO: 5435283 - DNA, 10 bp, Homo sapiens
gtgcattcaa

SEQ ID NO: 5435284 - DNA, 17 bp, Homo sapiens
gtgcattcatgcaagag

SEQ ID NO: 5435285 - DNA, 23 bp, Homo sapiens
gtgcattcatgcaagagtttctt

SEQ ID NO: 5435286 - DNA, 16 bp, Homo sapiens
gtgcattctttggtaa

SEQ ID NO: 5435287 - DNA, 14 bp, Homo sapiens
gtgcattgctgtgt

SEQ ID NO: 5435288 - DNA, 19 bp, Homo sapiens
gtgcattgtttctgtgggc

SEQ ID NO: 5435289 - DNA, 17 bp, Homo sapiens
gtgcatttaaaatggac

SEQ ID NO: 5435290 - DNA, 18 bp, Homo sapiens
gtgcatttaaaatggact

SEQ ID NO: 5435291 - DNA, 14 bp, Homo sapiens
gtgcatttaattag

SEQ ID NO: 5435292 - DNA, 17 bp, Homo sapiens
gtgcatttatgagctct

SEQ ID NO: 5435293 - DNA, 22 bp, Homo sapiens
gtgcatttcacctgtgacaaag

SEQ ID NO: 5435294 - DNA, 19 bp, Homo sapiens
gtgcatttctgggccttat

SEQ ID NO: 5435295 - DNA, 15 bp, Homo sapiens
gtgcatttgaggggc

SEQ ID NO: 5435296 - DNA, 17 bp, Homo sapiens
gtgcatttgaggtctgt

SEQ ID NO: 5435297 - DNA, 19 bp, Homo sapiens
gtgcatttgaggtctgttc

SEQ ID NO: 5435298 - DNA, 20 bp, Homo sapiens
gtgcatttgaggtctgttct

SEQ ID NO: 5435299 - DNA, 22 bp, Homo sapiens
gtgcatttgaggtctgttcttt

SEQ ID NO: 5435300 - DNA, 15 bp, Homo sapiens
gtgcatttggtggtt

SEQ ID NO: 5435301 - DNA, 21 bp, Homo sapiens
gtgcatttggtggtttcagaa

SEQ ID NO: 5435302 - DNA, 23 bp, Homo sapiens
gtgcatttgtgctagaaattttc

SEQ ID NO: 5435303 - DNA, 17 bp, Homo sapiens
gtgcattttcccagata

SEQ ID NO: 5435304 - DNA, 20 bp, Homo sapiens
gtgcatttttggatcatttt

SEQ ID NO: 5435305 - DNA, 18 bp, Homo sapiens
gtgccaaaaccaggcctc

SEQ ID NO: 5435306 - DNA, 19 bp, Homo sapiens
gtgccaaaaccaggcctct

SEQ ID NO: 5435307 - DNA, 18 bp, Homo sapiens
gtgccaaacccagcccct

SEQ ID NO: 5435308 - DNA, 11 bp, Homo sapiens
gtgccaaagaa

SEQ ID NO: 5435309 - DNA, 14 bp, Homo sapiens
gtgccaaagaaagt

SEQ ID NO: 5435310 - DNA, 16 bp, Homo sapiens
gtgccaaagcaggtca

SEQ ID NO: 5435311 - DNA, 17 bp, Homo sapiens
gtgccaaatcctgggca

SEQ ID NO: 5435312 - DNA, 13 bp, Homo sapiens
gtgccaacactca

SEQ ID NO: 5435313 - DNA, 18 bp, Homo sapiens
gtgccaacactcaagaag

SEQ ID NO: 5435314 - DNA, 21 bp, Homo sapiens
gtgccaacagtgttaggcctg

SEQ ID NO: 5435315 - DNA, 23 bp, Homo sapiens
gtgccaaccacctctggccctgt

SEQ ID NO: 5435316 - DNA, 18 bp, Homo sapiens
gtgccaaccccacccagc

SEQ ID NO: 5435317 - DNA, 21 bp, Homo sapiens
gtgccaaccccacccagctcc

SEQ ID NO: 5435318 - DNA, 13 bp, Homo sapiens
gtgccaacctctt

SEQ ID NO: 5435319 - DNA, 16 bp, Homo sapiens
gtgccaacttcccctc

SEQ ID NO: 5435320 - DNA, 18 bp, Homo sapiens
gtgccaagcacagtgcct

SEQ ID NO: 5435321 - DNA, 17 bp, Homo sapiens
gtgccaagccctggccc

SEQ ID NO: 5435322 - DNA, 13 bp, Homo sapiens
gtgccaagccttc

SEQ ID NO: 5435323 - DNA, 15 bp, Homo sapiens
gtgccaagccttctg

SEQ ID NO: 5435324 - DNA, 18 bp, Homo sapiens
gtgccaagccttctgtga

SEQ ID NO: 5435325 - DNA, 11 bp, Homo sapiens
gtgccaaggac

SEQ ID NO: 5435326 - DNA, 18 bp, Homo sapiens
gtgccaagggccccaggg

SEQ ID NO: 5435327 - DNA, 16 bp, Homo sapiens
gtgccaagtcctagct

SEQ ID NO: 5435328 - DNA, 14 bp, Homo sapiens
gtgccaataaccaa

SEQ ID NO: 5435329 - DNA, 15 bp, Homo sapiens
gtgccaataaccaag

SEQ ID NO: 5435330 - DNA, 21 bp, Homo sapiens
gtgccaatatgtattgtaaac

SEQ ID NO: 5435331 - DNA, 17 bp, Homo sapiens
gtgccaatgatgtgacc

SEQ ID NO: 5435332 - DNA, 22 bp, Homo sapiens
gtgccaatggaacctcctttct

SEQ ID NO: 5435333 - DNA, 18 bp, Homo sapiens
gtgccaatgtgacaacat

SEQ ID NO: 5435334 - DNA, 18 bp, Homo sapiens
gtgccaatgttgtgtgtt

SEQ ID NO: 5435335 - DNA, 14 bp, Homo sapiens
gtgccacaaagctc

SEQ ID NO: 5435336 - DNA, 18 bp, Homo sapiens
gtgccacacgcatgggca

SEQ ID NO: 5435337 - DNA, 19 bp, Homo sapiens
gtgccacagaggccccacc

SEQ ID NO: 5435338 - DNA, 22 bp, Homo sapiens
gtgccacagaggccccacctga

SEQ ID NO: 5435339 - DNA, 18 bp, Homo sapiens
gtgccacagcctgctggc

SEQ ID NO: 5435340 - DNA, 19 bp, Homo sapiens
gtgccacagcctgctggca

SEQ ID NO: 5435341 - DNA, 22 bp, Homo sapiens
gtgccacatactgcggaccaag

SEQ ID NO: 5435342 - DNA, 21 bp, Homo sapiens
gtgccaccaataaaaatccta

SEQ ID NO: 5435343 - DNA, 18 bp, Homo sapiens
gtgccaccacccctccct

SEQ ID NO: 5435344 - DNA, 21 bp, Homo sapiens
gtgccaccacccctccctctg

SEQ ID NO: 5435345 - DNA, 19 bp, Homo sapiens
gtgccacccacctttgcca

SEQ ID NO: 5435346 - DNA, 20 bp, Homo sapiens
gtgccacccccagccctggc

SEQ ID NO: 5435347 - DNA, 14 bp, Homo sapiens
gtgccaccccttcc

SEQ ID NO: 5435348 - DNA, 12 bp, Homo sapiens
gtgccacccgca

SEQ ID NO: 5435349 - DNA, 18 bp, Homo sapiens
gtgccaccctctgcaggg

SEQ ID NO: 5435350 - DNA, 21 bp, Homo sapiens
gtgccaccctctgcagggcag

SEQ ID NO: 5435351 - DNA, 22 bp, Homo sapiens
gtgccaccctctgcagggcagc

SEQ ID NO: 5435352 - DNA, 14 bp, Homo sapiens
gtgccaccctgggc

SEQ ID NO: 5435353 - DNA, 21 bp, Homo sapiens
gtgccaccctgggctctgtgg

SEQ ID NO: 5435354 - DNA, 12 bp, Homo sapiens
gtgccacctgca

SEQ ID NO: 5435355 - DNA, 13 bp, Homo sapiens
gtgccacctgtcc

SEQ ID NO: 5435356 - DNA, 21 bp, Homo sapiens
gtgccacctgtccggcccagt

SEQ ID NO: 5435357 - DNA, 20 bp, Homo sapiens
gtgccaccttgtgtgtttaa

SEQ ID NO: 5435358 - DNA, 17 bp, Homo sapiens
gtgccacgtggccgctg

SEQ ID NO: 5435359 - DNA, 22 bp, Homo sapiens
gtgccactcaccgaagccactt

SEQ ID NO: 5435360 - DNA, 17 bp, Homo sapiens
gtgccactccctgagct

SEQ ID NO: 5435361 - DNA, 12 bp, Homo sapiens
gtgccactgccc

SEQ ID NO: 5435362 - DNA, 13 bp, Homo sapiens
gtgccactgcggg

SEQ ID NO: 5435363 - DNA, 19 bp, Homo sapiens
gtgccactgcgggagctct

SEQ ID NO: 5435364 - DNA, 18 bp, Homo sapiens
gtgccacttgacattcct

SEQ ID NO: 5435365 - DNA, 23 bp, Homo sapiens
gtgccactttacccacctagaac

SEQ ID NO: 5435366 - DNA, 22 bp, Homo sapiens
gtgccactttgactcagaggct

SEQ ID NO: 5435367 - DNA, 20 bp, Homo sapiens
gtgccagaaacagtgggagc

SEQ ID NO: 5435368 - DNA, 20 bp, Homo sapiens
gtgccagacaaataggagtg

SEQ ID NO: 5435369 - DNA, 15 bp, Homo sapiens
gtgccagagcctggg

SEQ ID NO: 5435370 - DNA, 17 bp, Homo sapiens
gtgccagagcctggggc

SEQ ID NO: 5435371 - DNA, 21 bp, Homo sapiens
gtgccagaggaatcctggcag

SEQ ID NO: 5435372 - DNA, 14 bp, Homo sapiens
gtgccagaggtggg

SEQ ID NO: 5435373 - DNA, 22 bp, Homo sapiens
gtgccagaggtgggcaggtggt

SEQ ID NO: 5435374 - DNA, 13 bp, Homo sapiens
gtgccagatcaaa

SEQ ID NO: 5435375 - DNA, 17 bp, Homo sapiens
gtgccagcaaagcccca

SEQ ID NO: 5435376 - DNA, 16 bp, Homo sapiens
gtgccagcaactgaat

SEQ ID NO: 5435377 - DNA, 20 bp, Homo sapiens
gtgccagcaagtccttaggc

SEQ ID NO: 5435378 - DNA, 11 bp, Homo sapiens
gtgccagcagc

SEQ ID NO: 5435379 - DNA, 20 bp, Homo sapiens
gtgccagcagcccttgttta

SEQ ID NO: 5435380 - DNA, 20 bp, Homo sapiens
gtgctagtcaactggggaaa

SEQ ID NO: 5435381 - DNA, 17 bp, Homo sapiens
gtgctagtcactggcag

SEQ ID NO: 5435382 - DNA, 18 bp, Homo sapiens
gtgctataaatgccagag

SEQ ID NO: 5435383 - DNA, 17 bp, Homo sapiens
gtgctataacattctga

SEQ ID NO: 5435384 - DNA, 21 bp, Homo sapiens
gtgctatactgcatacttttt

SEQ ID NO: 5435385 - DNA, 16 bp, Homo sapiens
gtgctataggctggag

SEQ ID NO: 5435386 - DNA, 18 bp, Homo sapiens
gtgctataggctggagaa

SEQ ID NO: 5435387 - DNA, 19 bp, Homo sapiens
gtgctataggctggagaag

SEQ ID NO: 5435388 - DNA, 21 bp, Homo sapiens
gtgctataggctggagaagct

SEQ ID NO: 5435389 - DNA, 14 bp, Homo sapiens
gtgctatagtattt

SEQ ID NO: 5435390 - DNA, 16 bp, Homo sapiens
gtgctatataattgtg

SEQ ID NO: 5435391 - DNA, 13 bp, Homo sapiens
gtgctatatatat

SEQ ID NO: 5435392 - DNA, 20 bp, Homo sapiens
gtgctatatatataaatatt

SEQ ID NO: 5435393 - DNA, 20 bp, Homo sapiens
gtgctatatccagttcctgc

SEQ ID NO: 5435394 - DNA, 20 bp, Homo sapiens
gtgctatatttttaaagaag

SEQ ID NO: 5435395 - DNA, 23 bp, Homo sapiens
gtgctatatttttaaagaaggag

SEQ ID NO: 5435396 - DNA, 21 bp, Homo sapiens
gtgctatgaagccaactgaca

SEQ ID NO: 5435397 - DNA, 13 bp, Homo sapiens
gtgctatgcaaaa

SEQ ID NO: 5435398 - DNA, 19 bp, Homo sapiens
gtgctatgcaaaatagaca

SEQ ID NO: 5435399 - DNA, 22 bp, Homo sapiens
gtgctatgcggaggaaagcaag

SEQ ID NO: 5435400 - DNA, 14 bp, Homo sapiens
gtgctatggagagg

SEQ ID NO: 5435401 - DNA, 16 bp, Homo sapiens
gtgctatggagaggac

SEQ ID NO: 5435402 - DNA, 16 bp, Homo sapiens
gtgctatggtgctctg

SEQ ID NO: 5435403 - DNA, 17 bp, Homo sapiens
gtgctatgtcccaagag

SEQ ID NO: 5435404 - DNA, 12 bp, Homo sapiens
gtgctatgttct

SEQ ID NO: 5435405 - DNA, 13 bp, Homo sapiens
gtgctattaatat

SEQ ID NO: 5435406 - DNA, 15 bp, Homo sapiens
gtgctattctgtgtt

SEQ ID NO: 5435407 - DNA, 14 bp, Homo sapiens
gtgctattgaactg

SEQ ID NO: 5435408 - DNA, 17 bp, Homo sapiens
gtgctattgaactgagc

SEQ ID NO: 5435409 - DNA, 17 bp, Homo sapiens
gtgctatttaacatttt

SEQ ID NO: 5435410 - DNA, 14 bp, Homo sapiens
gtgctatttctatt

SEQ ID NO: 5435411 - DNA, 20 bp, Homo sapiens
gtgctatttctattccttat

SEQ ID NO: 5435412 - DNA, 13 bp, Homo sapiens
gtgctatttgaag

SEQ ID NO: 5435413 - DNA, 15 bp, Homo sapiens
gtgctatttgaagaa

SEQ ID NO: 5435414 - DNA, 14 bp, Homo sapiens
gtgctatttgtaca

SEQ ID NO: 5435415 - DNA, 16 bp, Homo sapiens
gtgctatttgtcatct

SEQ ID NO: 5435416 - DNA, 23 bp, Homo sapiens
gtgctattttttatcattgaaac

SEQ ID NO: 5435417 - DNA, 13 bp, Homo sapiens
gtgctcaaagatg

SEQ ID NO: 5435418 - DNA, 21 bp, Homo sapiens
gtgctcaagcagcaaaatcct

SEQ ID NO: 5435419 - DNA, 23 bp, Homo sapiens
gtgctcaataaagaagcccatgg

SEQ ID NO: 5435420 - DNA, 16 bp, Homo sapiens
gtgctcaatagcttga

SEQ ID NO: 5435421 - DNA, 20 bp, Homo sapiens
gtgctcacaatgttctggca

SEQ ID NO: 5435422 - DNA, 20 bp, Homo sapiens
gtgctcacagtagcttccta

SEQ ID NO: 5435423 - DNA, 19 bp, Homo sapiens
gtgctcaccatgcttccag

SEQ ID NO: 5435424 - DNA, 15 bp, Homo sapiens
gtgctcaccctctct

SEQ ID NO: 5435425 - DNA, 20 bp, Homo sapiens
gtgctcacgactcttcctgc

SEQ ID NO: 5435426 - DNA, 14 bp, Homo sapiens
gtgctcacgctccc

SEQ ID NO: 5435427 - DNA, 21 bp, Homo sapiens
gtgctcacgctcccccgcagt

SEQ ID NO: 5435428 - DNA, 15 bp, Homo sapiens
gtgctcagaagagga

SEQ ID NO: 5435429 - DNA, 20 bp, Homo sapiens
gtgctcagagacctgaagtg

SEQ ID NO: 5435430 - DNA, 20 bp, Homo sapiens
gtgctcagatacacaagtga

SEQ ID NO: 5435431 - DNA, 12 bp, Homo sapiens
gtgctcagccaa

SEQ ID NO: 5435432 - DNA, 15 bp, Homo sapiens
gtgctcagccaaatt

SEQ ID NO: 5435433 - DNA, 20 bp, Homo sapiens
gtgctcagccaaatttcctg

SEQ ID NO: 5435434 - DNA, 18 bp, Homo sapiens
gtgctcagcccaggcaca

SEQ ID NO: 5435435 - DNA, 19 bp, Homo sapiens
gtgctcagccccagacctg

SEQ ID NO: 5435436 - DNA, 16 bp, Homo sapiens
gtgctcagctgtggct

SEQ ID NO: 5435437 - DNA, 22 bp, Homo sapiens
gtgctcaggactcagaagcctc

SEQ ID NO: 5435438 - DNA, 22 bp, Homo sapiens
gtgctcagggaaatggccttcc

SEQ ID NO: 5435439 - DNA, 13 bp, Homo sapiens
gtgctcagggcat

SEQ ID NO: 5435440 - DNA, 14 bp, Homo sapiens
gtgctcagggcatg

SEQ ID NO: 5435441 - DNA, 18 bp, Homo sapiens
gtgctcagggcatgctta

SEQ ID NO: 5435442 - DNA, 13 bp, Homo sapiens
gtgctcagttgta

SEQ ID NO: 5435443 - DNA, 15 bp, Homo sapiens
gtgctcagttgtact

SEQ ID NO: 5435444 - DNA, 22 bp, Homo sapiens
gtgctcagttgtagaatgtatt

SEQ ID NO: 5435445 - DNA, 16 bp, Homo sapiens
gtgctcattgtaacca

SEQ ID NO: 5435446 - DNA, 20 bp, Homo sapiens
gtgctcattgtaaccatttc

SEQ ID NO: 5435447 - DNA, 13 bp, Homo sapiens
gtgctcatttaag

SEQ ID NO: 5435448 - DNA, 14 bp, Homo sapiens
gtgctcattttgca

SEQ ID NO: 5435449 - DNA, 23 bp, Homo sapiens
gtgctccagcagtgctgggccca

SEQ ID NO: 5435450 - DNA, 16 bp, Homo sapiens
gtgctccaggcttcct

SEQ ID NO: 5435451 - DNA, 17 bp, Homo sapiens
gtgctccaggcttcctg

SEQ ID NO: 5435452 - DNA, 20 bp, Homo sapiens
gtgctccaggcttcctgccc

SEQ ID NO: 5435453 - DNA, 24 bp, Homo sapiens
gtgctccaggcttcctgccctagc

SEQ ID NO: 5435454 - DNA, 14 bp, Homo sapiens
gtgctccagtgttt

SEQ ID NO: 5435455 - DNA, 16 bp, Homo sapiens
gtgctccagtgttttc

SEQ ID NO: 5435456 - DNA, 20 bp, Homo sapiens
gtgctcccaaaacattttaa

SEQ ID NO: 5435457 - DNA, 14 bp, Homo sapiens
gtgctcccctgcca

SEQ ID NO: 5435458 - DNA, 16 bp, Homo sapiens
gtgctcccctgccaca

SEQ ID NO: 5435459 - DNA, 20 bp, Homo sapiens
gtgctcccctgccacactga

SEQ ID NO: 5435460 - DNA, 21 bp, Homo sapiens
gtgctcccctgccacactgat

SEQ ID NO: 5435461 - DNA, 18 bp, Homo sapiens
gtgctccctaccacctcc

SEQ ID NO: 5435462 - DNA, 17 bp, Homo sapiens
gtgctccctcctcagtc

SEQ ID NO: 5435463 - DNA, 15 bp, Homo sapiens
gtgctccgcagggcg

SEQ ID NO: 5435464 - DNA, 20 bp, Homo sapiens
gtgctccgtagctctgctgc

SEQ ID NO: 5435465 - DNA, 22 bp, Homo sapiens
gtgctccgtgcctccaccacca

SEQ ID NO: 5435466 - DNA, 12 bp, Homo sapiens
gtgctcctctcc

SEQ ID NO: 5435467 - DNA, 14 bp, Homo sapiens
gtgctcctctcctt

SEQ ID NO: 5435468 - DNA, 21 bp, Homo sapiens
gtgctcctctcgcacaatgca

SEQ ID NO: 5435469 - DNA, 22 bp, Homo sapiens
gtgctcctctcgcacaatgcat

SEQ ID NO: 5435470 - DNA, 19 bp, Homo sapiens
gtgctcctcttgattcctg

SEQ ID NO: 5435471 - DNA, 14 bp, Homo sapiens
gtgctcctgcccag

SEQ ID NO: 5435472 - DNA, 16 bp, Homo sapiens
gtgctcctgtccctcc

SEQ ID NO: 5435473 - DNA, 20 bp, Homo sapiens
gtgctcgagtcacattctgc

SEQ ID NO: 5435474 - DNA, 21 bp, Homo sapiens
gtgctcgagtcacattctgct

SEQ ID NO: 5435475 - DNA, 15 bp, Homo sapiens
gtgctcgcagcctgg

SEQ ID NO: 5435476 - DNA, 18 bp, Homo sapiens
gtgctcgcagcctggcgg

SEQ ID NO: 5435477 - DNA, 19 bp, Homo sapiens
gtgctcgcctctgcccagc

SEQ ID NO: 5435478 - DNA, 20 bp, Homo sapiens
gtgctcgccttcggcctctc

SEQ ID NO: 5435479 - DNA, 15 bp, Homo sapiens
gtgctcgctgttgct

SEQ ID NO: 5435480 - DNA, 19 bp, Homo sapiens
gtgctcgctgttgctgaat

SEQ ID NO: 5435481 - DNA, 22 bp, Homo sapiens
gtgctcgctgttgctgaatagg

SEQ ID NO: 5435482 - DNA, 19 bp, Homo sapiens
gtgctcgcttctcctccag

SEQ ID NO: 5435483 - DNA, 13 bp, Homo sapiens
gtgctcggacaca

SEQ ID NO: 5435484 - DNA, 15 bp, Homo sapiens
gtgctcggcagtcat

SEQ ID NO: 5435485 - DNA, 16 bp, Homo sapiens
gtgctcgggaagggag

SEQ ID NO: 5435486 - DNA, 18 bp, Homo sapiens
gtgctcgggtgctgccag

SEQ ID NO: 5435487 - DNA, 22 bp, Homo sapiens
gtgctctccattctgctccttc

SEQ ID NO: 5435488 - DNA, 13 bp, Homo sapiens
gtgctctctgtgg

SEQ ID NO: 5435489 - DNA, 13 bp, Homo sapiens
gtgctctctttct

SEQ ID NO: 5435490 - DNA, 16 bp, Homo sapiens
gtgctctctttctgtc

SEQ ID NO: 5435491 - DNA, 19 bp, Homo sapiens
gtgctctgaggcctcacta

SEQ ID NO: 5435492 - DNA, 12 bp, Homo sapiens
gtgctctgcctc

SEQ ID NO: 5435493 - DNA, 13 bp, Homo sapiens
gtgctctgcctca

SEQ ID NO: 5435494 - DNA, 14 bp, Homo sapiens
gtgctctgcctcag

SEQ ID NO: 5435495 - DNA, 17 bp, Homo sapiens
gtgctctggacaggcat

SEQ ID NO: 5435496 - DNA, 22 bp, Homo sapiens
gtgctctggcaccatcagcctg

SEQ ID NO: 5435497 - DNA, 14 bp, Homo sapiens
gtgctctggcggct

SEQ ID NO: 5435498 - DNA, 22 bp, Homo sapiens
gtgctctggcggcttcctgtcc

SEQ ID NO: 5435499 - DNA, 14 bp, Homo sapiens
gtgctctggctgga

SEQ ID NO: 5435500 - DNA, 21 bp, Homo sapiens
gtgctctggggatttctggga

SEQ ID NO: 5435501 - DNA, 15 bp, Homo sapiens
gtgctctgggggtcc

SEQ ID NO: 5435502 - DNA, 18 bp, Homo sapiens
gtgctcttatccccagct

SEQ ID NO: 5435503 - DNA, 21 bp, Homo sapiens
gtgctcttatccccagctgtt

SEQ ID NO: 5435504 - DNA, 13 bp, Homo sapiens
gtgctcttcccac

SEQ ID NO: 5435505 - DNA, 14 bp, Homo sapiens
gtgctcttcctcat

SEQ ID NO: 5435506 - DNA, 14 bp, Homo sapiens
gtgctcttctcatt

SEQ ID NO: 5435507 - DNA, 18 bp, Homo sapiens
gtgctcttctgttctcaa

SEQ ID NO: 5435508 - DNA, 20 bp, Homo sapiens
gtgctcttggctgacccctc

SEQ ID NO: 5435509 - DNA, 22 bp, Homo sapiens
gtgctcttggctgacccctctg

SEQ ID NO: 5435510 - DNA, 19 bp, Homo sapiens
gtgctctttgttcatcatt

SEQ ID NO: 5435511 - DNA, 22 bp, Homo sapiens
gtgctctttgttttgtgtctct

SEQ ID NO: 5435512 - DNA, 18 bp, Homo sapiens
gtgctgaacgacagtccc

SEQ ID NO: 5435513 - DNA, 18 bp, Homo sapiens
gtgctgaactgtgcatca

SEQ ID NO: 5435514 - DNA, 19 bp, Homo sapiens
gtgctgaatggttttcaaa

SEQ ID NO: 5435515 - DNA, 20 bp, Homo sapiens
gtgctgaatggttttcaaaa

SEQ ID NO: 5435516 - DNA, 22 bp, Homo sapiens
gtgctgacaacttagctcaggt

SEQ ID NO: 5435517 - DNA, 16 bp, Homo sapiens
gtgctgacagctgctc

SEQ ID NO: 5435518 - DNA, 18 bp, Homo sapiens
gtgctgaccccaggaagt

SEQ ID NO: 5435519 - DNA, 16 bp, Homo sapiens
gtgctgaccctcctgt

SEQ ID NO: 5435520 - DNA, 18 bp, Homo sapiens
gtgctgaccctcctgttg

SEQ ID NO: 5435521 - DNA, 14 bp, Homo sapiens
gtgctgacctctgg

SEQ ID NO: 5435522 - DNA, 15 bp, Homo sapiens
gtgctgacggccagg

SEQ ID NO: 5435523 - DNA, 16 bp, Homo sapiens
gtgctgacggccaggg

SEQ ID NO: 5435524 - DNA, 23 bp, Homo sapiens
gtgctgacggccagggagaagct

SEQ ID NO: 5435525 - DNA, 22 bp, Homo sapiens
gtgctgacgggacccacatgct

SEQ ID NO: 5435526 - DNA, 16 bp, Homo sapiens
gtgctgactgaacatt

SEQ ID NO: 5435527 - DNA, 15 bp, Homo sapiens
gtgctgactgaggcc

SEQ ID NO: 5435528 - DNA, 16 bp, Homo sapiens
gtgctgactgaggcct

SEQ ID NO: 5435529 - DNA, 19 bp, Homo sapiens
gtgctgaggatacagctct

SEQ ID NO: 5435530 - DNA, 14 bp, Homo sapiens
gtgctgaggtgggc

SEQ ID NO: 5435531 - DNA, 22 bp, Homo sapiens
gtgctgagtgaccgggggctgc

SEQ ID NO: 5435532 - DNA, 12 bp, Homo sapiens
gtgctgagtgct

SEQ ID NO: 5435533 - DNA, 23 bp, Homo sapiens
gtgctgataattgtgtattttct

SEQ ID NO: 5435534 - DNA, 16 bp, Homo sapiens
gtgctgatagggtaag

SEQ ID NO: 5435535 - DNA, 19 bp, Homo sapiens
gtgctgatccggctgctcc

SEQ ID NO: 5435536 - DNA, 21 bp, Homo sapiens
gtgctgatccggctgctcctc

SEQ ID NO: 5435537 - DNA, 21 bp, Homo sapiens
gtgctgatcctgctgacctca

SEQ ID NO: 5435538 - DNA, 15 bp, Homo sapiens
gtgctgatccttgca

SEQ ID NO: 5435539 - DNA, 22 bp, Homo sapiens
gtgctgatcgtgctaaattttc

SEQ ID NO: 5435540 - DNA, 20 bp, Homo sapiens
gtgctgatgagggcacctct

SEQ ID NO: 5435541 - DNA, 15 bp, Homo sapiens
gtgctgatgtagtga

SEQ ID NO: 5435542 - DNA, 15 bp, Homo sapiens
gtgctgattcagcct

SEQ ID NO: 5435543 - DNA, 17 bp, Homo sapiens
gtgctgcacaaaagcag

SEQ ID NO: 5435544 - DNA, 15 bp, Homo sapiens
gtgctgcacccctgg

SEQ ID NO: 5435545 - DNA, 16 bp, Homo sapiens
gtgctgcacccctggt

SEQ ID NO: 5435546 - DNA, 19 bp, Homo sapiens
gtgctgcagcccctgggac

SEQ ID NO: 5435547 - DNA, 12 bp, Homo sapiens
gtgctgcaggag

SEQ ID NO: 5435548 - DNA, 16 bp, Homo sapiens
gtgctgcaggcaaagt

SEQ ID NO: 5435549 - DNA, 18 bp, Homo sapiens
gtgctgcaggtggcagag

SEQ ID NO: 5435550 - DNA, 16 bp, Homo sapiens
gtgctgcatccctgtg

SEQ ID NO: 5435551 - DNA, 14 bp, Homo sapiens
gtgctgcatgcgat

SEQ ID NO: 5435552 - DNA, 19 bp, Homo sapiens
gtgctgcatttaaaagata

SEQ ID NO: 5435553 - DNA, 15 bp, Homo sapiens
gtgctgccatccagg

SEQ ID NO: 5435554 - DNA, 18 bp, Homo sapiens
gtgctgccatccaggttc

SEQ ID NO: 5435555 - DNA, 19 bp, Homo sapiens
gtgctgccatccaggttca

SEQ ID NO: 5435556 - DNA, 14 bp, Homo sapiens
gtgctgccatgcca

SEQ ID NO: 5435557 - DNA, 17 bp, Homo sapiens
gtgctgccatgccactg

SEQ ID NO: 5435558 - DNA, 18 bp, Homo sapiens
gtggacgtgcactgacag

SEQ ID NO: 5435559 - DNA, 22 bp, Homo sapiens
gtggactacaggacaaggggca

SEQ ID NO: 5435560 - DNA, 20 bp, Homo sapiens
gtggactaggccctacacac

SEQ ID NO: 5435561 - DNA, 16 bp, Homo sapiens
gtggactccagctcta

SEQ ID NO: 5435562 - DNA, 14 bp, Homo sapiens
gtggactctgcaca

SEQ ID NO: 5435563 - DNA, 22 bp, Homo sapiens
gtggactctgctagactcctca

SEQ ID NO: 5435564 - DNA, 15 bp, Homo sapiens
gtggactctgtgctc

SEQ ID NO: 5435565 - DNA, 16 bp, Homo sapiens
gtggactctgtgctca

SEQ ID NO: 5435566 - DNA, 14 bp, Homo sapiens
gtggactcttccct

SEQ ID NO: 5435567 - DNA, 18 bp, Homo sapiens
gtggactctttggtggct

SEQ ID NO: 5435568 - DNA, 20 bp, Homo sapiens
gtggactgaccttgtaaaag

SEQ ID NO: 5435569 - DNA, 18 bp, Homo sapiens
gtggactgagcgaggaaa

SEQ ID NO: 5435570 - DNA, 21 bp, Homo sapiens
gtggactgagcgaggaaaaac

SEQ ID NO: 5435571 - DNA, 20 bp, Homo sapiens
gtggactgagtgggaagccc

SEQ ID NO: 5435572 - DNA, 13 bp, Homo sapiens
gtggactggaagg

SEQ ID NO: 5435573 - DNA, 16 bp, Homo sapiens
gtggactggcccctgg

SEQ ID NO: 5435574 - DNA, 13 bp, Homo sapiens
gtggactggctca

SEQ ID NO: 5435575 - DNA, 21 bp, Homo sapiens
gtggactgggaccgtgcgagc

SEQ ID NO: 5435576 - DNA, 11 bp, Homo sapiens
gtggactggtg

SEQ ID NO: 5435577 - DNA, 21 bp, Homo sapiens
gtggactggtgtcataaactt

SEQ ID NO: 5435578 - DNA, 21 bp, Homo sapiens
gtggactgtgcctcaggccag

SEQ ID NO: 5435579 - DNA, 16 bp, Homo sapiens
gtggacttagaaagca

SEQ ID NO: 5435580 - DNA, 16 bp, Homo sapiens
gtggacttagctctga

SEQ ID NO: 5435581 - DNA, 15 bp, Homo sapiens
gtggacttggagctg

SEQ ID NO: 5435582 - DNA, 17 bp, Homo sapiens
gtggacttgttttaatt

SEQ ID NO: 5435583 - DNA, 18 bp, Homo sapiens
gtggacttgttttaattt

SEQ ID NO: 5435584 - DNA, 17 bp, Homo sapiens
gtggactttatttaatt

SEQ ID NO: 5435585 - DNA, 22 bp, Homo sapiens
gtggactttccaccccctccct

SEQ ID NO: 5435586 - DNA, 15 bp, Homo sapiens
gtggagaaaatcaaa

SEQ ID NO: 5435587 - DNA, 22 bp, Homo sapiens
gtggagaaaatcaaaccgagca

SEQ ID NO: 5435588 - DNA, 13 bp, Homo sapiens
gtggagaaacaag

SEQ ID NO: 5435589 - DNA, 21 bp, Homo sapiens
gtggagaaactgtagtctcag

SEQ ID NO: 5435590 - DNA, 20 bp, Homo sapiens
gtggagaaagcactgacctg

SEQ ID NO: 5435591 - DNA, 22 bp, Homo sapiens
gtggagaaataaaaatacctct

SEQ ID NO: 5435592 - DNA, 23 bp, Homo sapiens
gtggagaaataaaaatacctctt

SEQ ID NO: 5435593 - DNA, 24 bp, Homo sapiens
gtggagaagcacactctggtcttg

SEQ ID NO: 5435594 - DNA, 17 bp, Homo sapiens
gtggagaagccacaggc

SEQ ID NO: 5435595 - DNA, 22 bp, Homo sapiens
gtggagaagccacaggcctgag

SEQ ID NO: 5435596 - DNA, 14 bp, Homo sapiens
gtggagaagccatt

SEQ ID NO: 5435597 - DNA, 15 bp, Homo sapiens
gtggagaagccattg

SEQ ID NO: 5435598 - DNA, 16 bp, Homo sapiens
gtggagaagcccctgg

SEQ ID NO: 5435599 - DNA, 23 bp, Homo sapiens
gtggagaagggagggtggccagc

SEQ ID NO: 5435600 - DNA, 20 bp, Homo sapiens
gtggagaatcacaggctggg

SEQ ID NO: 5435601 - DNA, 17 bp, Homo sapiens
gtggagacactgagtca

SEQ ID NO: 5435602 - DNA, 16 bp, Homo sapiens
gtggagacagccctgc

SEQ ID NO: 5435603 - DNA, 13 bp, Homo sapiens
gtggagacagggc

SEQ ID NO: 5435604 - DNA, 15 bp, Homo sapiens
gtggagaccctgcca

SEQ ID NO: 5435605 - DNA, 18 bp, Homo sapiens
gtggagaccctgccacag

SEQ ID NO: 5435606 - DNA, 22 bp, Homo sapiens
gtggagaccctgccacagccag

SEQ ID NO: 5435607 - DNA, 19 bp, Homo sapiens
gtggagactgcaagtaagg

SEQ ID NO: 5435608 - DNA, 18 bp, Homo sapiens
gtggagactgcttcccat

SEQ ID NO: 5435609 - DNA, 13 bp, Homo sapiens
gtggagactggca

SEQ ID NO: 5435610 - DNA, 17 bp, Homo sapiens
gtggagactggcaggcg

SEQ ID NO: 5435611 - DNA, 21 bp, Homo sapiens
gtggagacttggatgtcatat

SEQ ID NO: 5435612 - DNA, 15 bp, Homo sapiens
gtggagagaagtgag

SEQ ID NO: 5435613 - DNA, 17 bp, Homo sapiens
gtggagagaagtgagca

SEQ ID NO: 5435614 - DNA, 19 bp, Homo sapiens
gtggagagaagttgccctc

SEQ ID NO: 5435615 - DNA, 20 bp, Homo sapiens
gtggagagaccagcctttct

SEQ ID NO: 5435616 - DNA, 12 bp, Homo sapiens
gtggagagctgg

SEQ ID NO: 5435617 - DNA, 18 bp, Homo sapiens
gtggagaggagagaatga

SEQ ID NO: 5435618 - DNA, 15 bp, Homo sapiens
gtggagagggaatgt

SEQ ID NO: 5435619 - DNA, 21 bp, Homo sapiens
gtggagagggagactcctggg

SEQ ID NO: 5435620 - DNA, 23 bp, Homo sapiens
gtggagagtgagaataattgtgt

SEQ ID NO: 5435621 - DNA, 20 bp, Homo sapiens
gtggagagtggaaggactgt

SEQ ID NO: 5435622 - DNA, 21 bp, Homo sapiens
gtggagatagtgccaggtggc

SEQ ID NO: 5435623 - DNA, 16 bp, Homo sapiens
gtggagatcacagccc

SEQ ID NO: 5435624 - DNA, 20 bp, Homo sapiens
gtggagatcgcttttctcag

SEQ ID NO: 5435625 - DNA, 14 bp, Homo sapiens
gtggagatgctgtg

SEQ ID NO: 5435626 - DNA, 15 bp, Homo sapiens
gtggagatgtcttcg

SEQ ID NO: 5435627 - DNA, 17 bp, Homo sapiens
gtggagcaaaaggcagc

SEQ ID NO: 5435628 - DNA, 15 bp, Homo sapiens
gtggagcagcagcca

SEQ ID NO: 5435629 - DNA, 14 bp, Homo sapiens
gtggagcagccaga

SEQ ID NO: 5435630 - DNA, 17 bp, Homo sapiens
gtggagcagccagagct

SEQ ID NO: 5435631 - DNA, 16 bp, Homo sapiens
gtggagcaggactccc

SEQ ID NO: 5435632 - DNA, 16 bp, Homo sapiens
gtggagccacaggcag

SEQ ID NO: 5435633 - DNA, 20 bp, Homo sapiens
gtggagccacaggcagacga

SEQ ID NO: 5435634 - DNA, 13 bp, Homo sapiens
gtggagccaggcg

SEQ ID NO: 5435635 - DNA, 14 bp, Homo sapiens
gtggagccagggcc

SEQ ID NO: 5435636 - DNA, 12 bp, Homo sapiens
gtggagccaggt

SEQ ID NO: 5435637 - DNA, 17 bp, Homo sapiens
gtggagcccagggtgct

SEQ ID NO: 5435638 - DNA, 14 bp, Homo sapiens
gtggagccccacac

SEQ ID NO: 5435639 - DNA, 22 bp, Homo sapiens
gtggagcctgacagccagaact

SEQ ID NO: 5435640 - DNA, 20 bp, Homo sapiens
gtggagcctgccgcccccgc

SEQ ID NO: 5435641 - DNA, 15 bp, Homo sapiens
gtggaggaagagcca

SEQ ID NO: 5435642 - DNA, 15 bp, Homo sapiens
gtggaggaaggattg

SEQ ID NO: 5435643 - DNA, 19 bp, Homo sapiens
gtggaggaagggctgggcc

SEQ ID NO: 5435644 - DNA, 16 bp, Homo sapiens
gtggaggaaggtgctg

SEQ ID NO: 5435645 - DNA, 16 bp, Homo sapiens
gtggaggacagacggc

SEQ ID NO: 5435646 - DNA, 15 bp, Homo sapiens
gtggaggagcagtgc

SEQ ID NO: 5435647 - DNA, 19 bp, Homo sapiens
gtggaggagctgagggagg

SEQ ID NO: 5435648 - DNA, 19 bp, Homo sapiens
gtggaggaggaaggcaaga

SEQ ID NO: 5435649 - DNA, 14 bp, Homo sapiens
gtggaggaggaggg

SEQ ID NO: 5435650 - DNA, 17 bp, Homo sapiens
gtggaggaggagggagg

SEQ ID NO: 5435651 - DNA, 18 bp, Homo sapiens
gtggaggaggagggaggc

SEQ ID NO: 5435652 - DNA, 14 bp, Homo sapiens
gtggaggaggtgaa

SEQ ID NO: 5435653 - DNA, 19 bp, Homo sapiens
gtggaggattgctgccaga

SEQ ID NO: 5435654 - DNA, 22 bp, Homo sapiens
gtggaggattgctgccagagaa

SEQ ID NO: 5435655 - DNA, 14 bp, Homo sapiens
gtggaggcacttta

SEQ ID NO: 5435656 - DNA, 15 bp, Homo sapiens
gtggaggcattgttt

SEQ ID NO: 5435657 - DNA, 21 bp, Homo sapiens
gtggaggccgagtctgtcctg

SEQ ID NO: 5435658 - DNA, 13 bp, Homo sapiens
gtggaggcctcag

SEQ ID NO: 5435659 - DNA, 14 bp, Homo sapiens
gtggaggctcctgt

SEQ ID NO: 5435660 - DNA, 12 bp, Homo sapiens
gtggaggctgct

SEQ ID NO: 5435661 - DNA, 15 bp, Homo sapiens
gtggaggctgctgtg

SEQ ID NO: 5435662 - DNA, 14 bp, Homo sapiens
gtggaggcttcctg

SEQ ID NO: 5435663 - DNA, 23 bp, Homo sapiens
gtggagggaaggataaagccact

SEQ ID NO: 5435664 - DNA, 23 bp, Homo sapiens
gtggagggacaagtggactcagg

SEQ ID NO: 5435665 - DNA, 20 bp, Homo sapiens
gtggagggagtgagccagca

SEQ ID NO: 5435666 - DNA, 23 bp, Homo sapiens
gtggagggcacattccttgcctg

SEQ ID NO: 5435667 - DNA, 13 bp, Homo sapiens
gtggagggcactt

SEQ ID NO: 5435668 - DNA, 15 bp, Homo sapiens
gtggagggcacttca

SEQ ID NO: 5435669 - DNA, 19 bp, Homo sapiens
gtggagggcacttcaggtc

SEQ ID NO: 5435670 - DNA, 20 bp, Homo sapiens
gtggagggcacttcaggtcc

SEQ ID NO: 5435671 - DNA, 16 bp, Homo sapiens
gtggagggcgtggagg

SEQ ID NO: 5435672 - DNA, 15 bp, Homo sapiens
gtggaggggagctgc

SEQ ID NO: 5435673 - DNA, 14 bp, Homo sapiens
gtggaggggcgccc

SEQ ID NO: 5435674 - DNA, 13 bp, Homo sapiens
gtggaggggtcag

SEQ ID NO: 5435675 - DNA, 20 bp, Homo sapiens
gtggagggtggcgccctgcg

SEQ ID NO: 5435676 - DNA, 21 bp, Homo sapiens
gtggagggtttgcactccaca

SEQ ID NO: 5435677 - DNA, 12 bp, Homo sapiens
gtggaggtggct

SEQ ID NO: 5435678 - DNA, 22 bp, Homo sapiens
gtggaggttgcagtgagctgag

SEQ ID NO: 5435679 - DNA, 20 bp, Homo sapiens
gtggaggttgctggtacaca

SEQ ID NO: 5435680 - DNA, 15 bp, Homo sapiens
gtggagtcattctca

SEQ ID NO: 5435681 - DNA, 20 bp, Homo sapiens
gtggagtccgccaaaggccc

SEQ ID NO: 5435682 - DNA, 15 bp, Homo sapiens
gtggagtcgagctgg

SEQ ID NO: 5435683 - DNA, 21 bp, Homo sapiens
gtggagtcggagtggacaccg

SEQ ID NO: 5435684 - DNA, 17 bp, Homo sapiens
gtggagtctgccaccca

SEQ ID NO: 5435685 - DNA, 15 bp, Homo sapiens
gtggagtgagactga

SEQ ID NO: 5435686 - DNA, 12 bp, Homo sapiens
gtggagttcacc

SEQ ID NO: 5435687 - DNA, 21 bp, Homo sapiens
gtggagttctctgttctagag

SEQ ID NO: 5435688 - DNA, 14 bp, Homo sapiens
gtggagttggggct

SEQ ID NO: 5435689 - DNA, 16 bp, Homo sapiens
gtggagttggggctgc

SEQ ID NO: 5435690 - DNA, 15 bp, Homo sapiens
gtggagtttgtattt

SEQ ID NO: 5435691 - DNA, 20 bp, Homo sapiens
gtggagttttataaattaaa

SEQ ID NO: 5435692 - DNA, 13 bp, Homo sapiens
gtggataaaacat

SEQ ID NO: 5435693 - DNA, 13 bp, Homo sapiens
gtggataagaaaa

SEQ ID NO: 5435694 - DNA, 14 bp, Homo sapiens
gtggatacagtcat

SEQ ID NO: 5435695 - DNA, 14 bp, Homo sapiens
gtggatacagtgcc

SEQ ID NO: 5435696 - DNA, 18 bp, Homo sapiens
gtggatacagtgcccacc

SEQ ID NO: 5435697 - DNA, 20 bp, Homo sapiens
gtggatactggggggcaggc

SEQ ID NO: 5435698 - DNA, 14 bp, Homo sapiens
gtggatagatgccc

SEQ ID NO: 5435699 - DNA, 20 bp, Homo sapiens
gtggatagatgccctgctag

SEQ ID NO: 5435700 - DNA, 17 bp, Homo sapiens
gtggatataaaatgtgc

SEQ ID NO: 5435701 - DNA, 15 bp, Homo sapiens
gtggatatcagggta

SEQ ID NO: 5435702 - DNA, 21 bp, Homo sapiens
gtggatcacacctcagtggga

SEQ ID NO: 5435703 - DNA, 15 bp, Homo sapiens
gtggatcacagaggc

SEQ ID NO: 5435704 - DNA, 19 bp, Homo sapiens
gtggatcacctgaggtcag

SEQ ID NO: 5435705 - DNA, 21 bp, Homo sapiens
gtggatcacgaggtcaggaga

SEQ ID NO: 5435706 - DNA, 21 bp, Homo sapiens
gtggatcagagatgcaccacc

SEQ ID NO: 5435707 - DNA, 19 bp, Homo sapiens
gtggatccaatgttagaga

SEQ ID NO: 5435708 - DNA, 15 bp, Homo sapiens
gtggatccactgtgc

SEQ ID NO: 5435709 - DNA, 15 bp, Homo sapiens
gtggatcccctgcgg

SEQ ID NO: 5435710 - DNA, 16 bp, Homo sapiens
gtggatcctgtaggct

SEQ ID NO: 5435711 - DNA, 20 bp, Homo sapiens
gtggatcgagtgtagctgtg

SEQ ID NO: 5435712 - DNA, 22 bp, Homo sapiens
gtggatcgagtgtagctgtgaa

SEQ ID NO: 5435713 - DNA, 19 bp, Homo sapiens
gtggatctccaaggaccag

SEQ ID NO: 5435714 - DNA, 13 bp, Homo sapiens
gtggatctccccc

SEQ ID NO: 5435715 - DNA, 22 bp, Homo sapiens
gtggatctccttcccttctctt

SEQ ID NO: 5435716 - DNA, 13 bp, Homo sapiens
gtggatcttcaga

SEQ ID NO: 5435717 - DNA, 14 bp, Homo sapiens
gtggatcttcagaa

SEQ ID NO: 5435718 - DNA, 20 bp, Homo sapiens
gtggatgaaaaaaagggaaa

SEQ ID NO: 5435719 - DNA, 16 bp, Homo sapiens
gtggatgacagggcag

SEQ ID NO: 5435720 - DNA, 21 bp, Homo sapiens
gtggatgaggcttcttcctgg

SEQ ID NO: 5435721 - DNA, 14 bp, Homo sapiens
gtggatgagggcca

SEQ ID NO: 5435722 - DNA, 15 bp, Homo sapiens
gtggatgcaaataga

SEQ ID NO: 5435723 - DNA, 16 bp, Homo sapiens
gtggatgcctggtggc

SEQ ID NO: 5435724 - DNA, 21 bp, Homo sapiens
gtggatgcctggtggcagctg

SEQ ID NO: 5435725 - DNA, 18 bp, Homo sapiens
gtggatgctccagggcag

SEQ ID NO: 5435726 - DNA, 19 bp, Homo sapiens
gtggatgctccagggcagc

SEQ ID NO: 5435727 - DNA, 19 bp, Homo sapiens
gtggatgctctcaggctga

SEQ ID NO: 5435728 - DNA, 14 bp, Homo sapiens
gtggatgctgtgct

SEQ ID NO: 5435729 - DNA, 21 bp, Homo sapiens
gtggatggaaggggctgacag

SEQ ID NO: 5435730 - DNA, 15 bp, Homo sapiens
gtggatggacagatg

SEQ ID NO: 5435731 - DNA, 17 bp, Homo sapiens
gtggatggacagatgga

SEQ ID NO: 5435732 - DNA, 15 bp, Homo sapiens
gtggatggatggaca

SEQ ID NO: 5435733 - DNA, 21 bp, Homo sapiens
gtggatggatggacagaatga

SEQ ID NO: 5435734 - DNA, 21 bp, Homo sapiens
gtggatggcccagcaggcagg

SEQ ID NO: 5435735 - DNA, 15 bp, Homo sapiens
gtggatgggaatttg

SEQ ID NO: 5435736 - DNA, 20 bp, Homo sapiens
gtggcgcgatctcggctcag

SEQ ID NO: 5435737 - DNA, 15 bp, Homo sapiens
gtggcgcgcctgcct

SEQ ID NO: 5435738 - DNA, 19 bp, Homo sapiens
gtggcgctggtgcattctg

SEQ ID NO: 5435739 - DNA, 23 bp, Homo sapiens
gtggcgctgtcggtgtttggagg

SEQ ID NO: 5435740 - DNA, 15 bp, Homo sapiens
gtggcggcacgtcct

SEQ ID NO: 5435741 - DNA, 23 bp, Homo sapiens
gtggcgggaagggtgggccctgg

SEQ ID NO: 5435742 - DNA, 14 bp, Homo sapiens
gtggcgggcacctg

SEQ ID NO: 5435743 - DNA, 14 bp, Homo sapiens
gtggcggggcccct

SEQ ID NO: 5435744 - DNA, 21 bp, Homo sapiens
gtggcggggtggggtgggggt

SEQ ID NO: 5435745 - DNA, 19 bp, Homo sapiens
gtggcgggtcccagctact

SEQ ID NO: 5435746 - DNA, 14 bp, Homo sapiens
gtggcggtgcagtg

SEQ ID NO: 5435747 - DNA, 15 bp, Homo sapiens
gtggcggtgcagtgg

SEQ ID NO: 5435748 - DNA, 17 bp, Homo sapiens
gtggcggtgcctgggtg

SEQ ID NO: 5435749 - DNA, 16 bp, Homo sapiens
gtggcgtgagaggcaa

SEQ ID NO: 5435750 - DNA, 23 bp, Homo sapiens
gtggcgtgatctcggctcactgc

SEQ ID NO: 5435751 - DNA, 15 bp, Homo sapiens
gtggcgtggcctccc

SEQ ID NO: 5435752 - DNA, 16 bp, Homo sapiens
gtggcgttatggcagc

SEQ ID NO: 5435753 - DNA, 22 bp, Homo sapiens
gtggcgttatggcagcccggct

SEQ ID NO: 5435754 - DNA, 21 bp, Homo sapiens
gtggcgttctgctgcccctgc

SEQ ID NO: 5435755 - DNA, 21 bp, Homo sapiens
gtggctaaaggtcccaaggca

SEQ ID NO: 5435756 - DNA, 20 bp, Homo sapiens
gtggctaaagtgctctattt

SEQ ID NO: 5435757 - DNA, 14 bp, Homo sapiens
gtggctaacatcct

SEQ ID NO: 5435758 - DNA, 17 bp, Homo sapiens
gtggctaacttgggtta

SEQ ID NO: 5435759 - DNA, 23 bp, Homo sapiens
gtggctaaggtaagaacgtgctt

SEQ ID NO: 5435760 - DNA, 16 bp, Homo sapiens
gtggctaatggtgtaa

SEQ ID NO: 5435761 - DNA, 20 bp, Homo sapiens
gtggctaccattgtcactcg

SEQ ID NO: 5435762 - DNA, 18 bp, Homo sapiens
gtggctactctgtgccag

SEQ ID NO: 5435763 - DNA, 21 bp, Homo sapiens
gtggctactctgtgccagagc

SEQ ID NO: 5435764 - DNA, 22 bp, Homo sapiens
gtggctagcaaattagaaacac

SEQ ID NO: 5435765 - DNA, 18 bp, Homo sapiens
gtggctagtcaagctcct

SEQ ID NO: 5435766 - DNA, 17 bp, Homo sapiens
gtggctagtcagagaga

SEQ ID NO: 5435767 - DNA, 16 bp, Homo sapiens
gtggctatgggaatca

SEQ ID NO: 5435768 - DNA, 19 bp, Homo sapiens
gtggctattaaaactcttt

SEQ ID NO: 5435769 - DNA, 23 bp, Homo sapiens
gtggctcaatgcaacctctgccc

SEQ ID NO: 5435770 - DNA, 14 bp, Homo sapiens
gtggctcacgcctg

SEQ ID NO: 5435771 - DNA, 22 bp, Homo sapiens
gtggctcactcagcacttggcc

SEQ ID NO: 5435772 - DNA, 16 bp, Homo sapiens
gtggctcactggctgg

SEQ ID NO: 5435773 - DNA, 19 bp, Homo sapiens
gtggctcactggctgggag

SEQ ID NO: 5435774 - DNA, 19 bp, Homo sapiens
gtggctcagacccctcagc

SEQ ID NO: 5435775 - DNA, 15 bp, Homo sapiens
gtggctcagccagca

SEQ ID NO: 5435776 - DNA, 16 bp, Homo sapiens
gtggctcatcggtgga

SEQ ID NO: 5435777 - DNA, 13 bp, Homo sapiens
gtggctcatgcct

SEQ ID NO: 5435778 - DNA, 19 bp, Homo sapiens
gtggctcatgcctgtaatc

SEQ ID NO: 5435779 - DNA, 16 bp, Homo sapiens
gtggctcatgcctgtg

SEQ ID NO: 5435780 - DNA, 17 bp, Homo sapiens
gtggctcattcttttca

SEQ ID NO: 5435781 - DNA, 22 bp, Homo sapiens
gtggctccagaatgtgctgcct

SEQ ID NO: 5435782 - DNA, 15 bp, Homo sapiens
gtggctccaggagca

SEQ ID NO: 5435783 - DNA, 15 bp, Homo sapiens
gtggctccccacctg

SEQ ID NO: 5435784 - DNA, 16 bp, Homo sapiens
gtggctccccacctgg

SEQ ID NO: 5435785 - DNA, 19 bp, Homo sapiens
gtggctccccacctggaca

SEQ ID NO: 5435786 - DNA, 15 bp, Homo sapiens
gtggctccccctctg

SEQ ID NO: 5435787 - DNA, 16 bp, Homo sapiens
gtggctccccctctgc

SEQ ID NO: 5435788 - DNA, 21 bp, Homo sapiens
gtggctccccctctgcttctc

SEQ ID NO: 5435789 - DNA, 14 bp, Homo sapiens
gtggctcccctgcc

SEQ ID NO: 5435790 - DNA, 20 bp, Homo sapiens
gtggctccctctctcctgga

SEQ ID NO: 5435791 - DNA, 18 bp, Homo sapiens
gtggctcctatctgtgtt

SEQ ID NO: 5435792 - DNA, 20 bp, Homo sapiens
gtggctcctatctgtgtttt

SEQ ID NO: 5435793 - DNA, 15 bp, Homo sapiens
gtggctcctcctagg

SEQ ID NO: 5435794 - DNA, 13 bp, Homo sapiens
gtggctcctgcca

SEQ ID NO: 5435795 - DNA, 14 bp, Homo sapiens
gtggctcctgccac

SEQ ID NO: 5435796 - DNA, 15 bp, Homo sapiens
gtggctcctgccttg

SEQ ID NO: 5435797 - DNA, 16 bp, Homo sapiens
gtggctcctgccttga

SEQ ID NO: 5435798 - DNA, 15 bp, Homo sapiens
gtggctcctggtaac

SEQ ID NO: 5435799 - DNA, 15 bp, Homo sapiens
gtggctcgctccctg

SEQ ID NO: 5435800 - DNA, 20 bp, Homo sapiens
gtggctcgtgtttcacagtg

SEQ ID NO: 5435801 - DNA, 18 bp, Homo sapiens
gtggctctcagagcagca

SEQ ID NO: 5435802 - DNA, 16 bp, Homo sapiens
gtggctctgagaaggg

SEQ ID NO: 5435803 - DNA, 21 bp, Homo sapiens
gtggctctgaggtgcctgtcc

SEQ ID NO: 5435804 - DNA, 15 bp, Homo sapiens
gtggctctgctggcc

SEQ ID NO: 5435805 - DNA, 12 bp, Homo sapiens
gtggctctggga

SEQ ID NO: 5435806 - DNA, 13 bp, Homo sapiens
gtggctctgggtg

SEQ ID NO: 5435807 - DNA, 16 bp, Homo sapiens
gtggctctgggtgggc

SEQ ID NO: 5435808 - DNA, 14 bp, Homo sapiens
gtggctcttgggac

SEQ ID NO: 5435809 - DNA, 15 bp, Homo sapiens
gtggctcttgggaca

SEQ ID NO: 5435810 - DNA, 18 bp, Homo sapiens
gtggctcttgggacaacg

SEQ ID NO: 5435811 - DNA, 22 bp, Homo sapiens
gtggctgacagagcaggtctgc

SEQ ID NO: 5435812 - DNA, 16 bp, Homo sapiens
gtggctgaccaggccc

SEQ ID NO: 5435813 - DNA, 17 bp, Homo sapiens
gtggctgaccaggccct

SEQ ID NO: 5435814 - DNA, 18 bp, Homo sapiens
gtggctgaccaggccctg

SEQ ID NO: 5435815 - DNA, 22 bp, Homo sapiens
gtggctgaccaggccctgctca

SEQ ID NO: 5435816 - DNA, 14 bp, Homo sapiens
gtggctgacccagt

SEQ ID NO: 5435817 - DNA, 16 bp, Homo sapiens
gtggctgacccccctc

SEQ ID NO: 5435818 - DNA, 15 bp, Homo sapiens
gtggctgagcccctg

SEQ ID NO: 5435819 - DNA, 17 bp, Homo sapiens
gtggctgagcccctgtc

SEQ ID NO: 5435820 - DNA, 16 bp, Homo sapiens
gtggctgagcttggcc

SEQ ID NO: 5435821 - DNA, 18 bp, Homo sapiens
gtggctgaggaggcctcc

SEQ ID NO: 5435822 - DNA, 17 bp, Homo sapiens
gtggctgaggccaccca

SEQ ID NO: 5435823 - DNA, 21 bp, Homo sapiens
gtggctgatttcaaatgcagt

SEQ ID NO: 5435824 - DNA, 15 bp, Homo sapiens
gtggctgcagcctca

SEQ ID NO: 5435825 - DNA, 19 bp, Homo sapiens
gtggctgccacacccaggg

SEQ ID NO: 5435826 - DNA, 14 bp, Homo sapiens
gtggctgccagccc

SEQ ID NO: 5435827 - DNA, 16 bp, Homo sapiens
gtggctgcccacacac

SEQ ID NO: 5435828 - DNA, 20 bp, Homo sapiens
gtggctgccccacctgccgc

SEQ ID NO: 5435829 - DNA, 12 bp, Homo sapiens
gtggctgccctc

SEQ ID NO: 5435830 - DNA, 20 bp, Homo sapiens
gtggctgcgcccccagcttc

SEQ ID NO: 5435831 - DNA, 20 bp, Homo sapiens
gtggctgcgtgcccctgctg

SEQ ID NO: 5435832 - DNA, 19 bp, Homo sapiens
gtggctgctcccagcctct

SEQ ID NO: 5435833 - DNA, 13 bp, Homo sapiens
gtggctgctctgg

SEQ ID NO: 5435834 - DNA, 14 bp, Homo sapiens
gtggctgctctggg

SEQ ID NO: 5435835 - DNA, 12 bp, Homo sapiens
gtggctgctgcc

SEQ ID NO: 5435836 - DNA, 15 bp, Homo sapiens
gtggctgctgtggga

SEQ ID NO: 5435837 - DNA, 15 bp, Homo sapiens
gtggctgcttcaagg

SEQ ID NO: 5435838 - DNA, 22 bp, Homo sapiens
gtggctgcttcaaggatcctga

SEQ ID NO: 5435839 - DNA, 23 bp, Homo sapiens
gtggctggaggagctggcctgtg

SEQ ID NO: 5435840 - DNA, 21 bp, Homo sapiens
gtggctggcctttcaggtcca

SEQ ID NO: 5435841 - DNA, 22 bp, Homo sapiens
gtggctggcctttcaggtccag

SEQ ID NO: 5435842 - DNA, 12 bp, Homo sapiens
gtggctggctct

SEQ ID NO: 5435843 - DNA, 16 bp, Homo sapiens
gtggctggctctacct

SEQ ID NO: 5435844 - DNA, 22 bp, Homo sapiens
gtggctgggaagggaaggaagc

SEQ ID NO: 5435845 - DNA, 15 bp, Homo sapiens
gtggctgggactcct

SEQ ID NO: 5435846 - DNA, 12 bp, Homo sapiens
gtggctgggcag

SEQ ID NO: 5435847 - DNA, 18 bp, Homo sapiens
gtggctgggctgctcctg

SEQ ID NO: 5435848 - DNA, 14 bp, Homo sapiens
gtggctggggctgg

SEQ ID NO: 5435849 - DNA, 18 bp, Homo sapiens
gtggctggggctggcacg

SEQ ID NO: 5435850 - DNA, 11 bp, Homo sapiens
gtggctggggg

SEQ ID NO: 5435851 - DNA, 23 bp, Homo sapiens
gtggctggggggatgacggccag

SEQ ID NO: 5435852 - DNA, 21 bp, Homo sapiens
gtggctgggtccaggggatgg

SEQ ID NO: 5435853 - DNA, 22 bp, Homo sapiens
gtggctgggtgggcccagaact

SEQ ID NO: 5435854 - DNA, 16 bp, Homo sapiens
gtggctggtagaaaaa

SEQ ID NO: 5435855 - DNA, 20 bp, Homo sapiens
gtggctggtctggagtccca

SEQ ID NO: 5435856 - DNA, 18 bp, Homo sapiens
gtggctggtgagaccccg

SEQ ID NO: 5435857 - DNA, 16 bp, Homo sapiens
gtggctggtgagccgg

SEQ ID NO: 5435858 - DNA, 13 bp, Homo sapiens
gtggctggtgccc

SEQ ID NO: 5435859 - DNA, 14 bp, Homo sapiens
gtggctggtgtccc

SEQ ID NO: 5435860 - DNA, 15 bp, Homo sapiens
gtggctggtgtcccc

SEQ ID NO: 5435861 - DNA, 19 bp, Homo sapiens
gtggctggtgtccccttcc

SEQ ID NO: 5435862 - DNA, 19 bp, Homo sapiens
gtggctgtcaaatccatgt

SEQ ID NO: 5435863 - DNA, 22 bp, Homo sapiens
gtggctgtcaatgggacctgtg

SEQ ID NO: 5435864 - DNA, 15 bp, Homo sapiens
gtggctgtcagcagg

SEQ ID NO: 5435865 - DNA, 16 bp, Homo sapiens
gtggctgtggcacaga

SEQ ID NO: 5435866 - DNA, 19 bp, Homo sapiens
gtggctgttaaccacccgc

SEQ ID NO: 5435867 - DNA, 11 bp, Homo sapiens
gtggctgttca

SEQ ID NO: 5435868 - DNA, 18 bp, Homo sapiens
gtggctgttcatgctcca

SEQ ID NO: 5435869 - DNA, 22 bp, Homo sapiens
gtggcttaaaacaacactcaca

SEQ ID NO: 5435870 - DNA, 22 bp, Homo sapiens
gtggcttaagtgagcagaacag

SEQ ID NO: 5435871 - DNA, 17 bp, Homo sapiens
gtggcttcactcctgct

SEQ ID NO: 5435872 - DNA, 18 bp, Homo sapiens
gtggcttcagaggcctgg

SEQ ID NO: 5435873 - DNA, 15 bp, Homo sapiens
gtggcttcagctcca

SEQ ID NO: 5435874 - DNA, 19 bp, Homo sapiens
gtggcttcagctccagccc

SEQ ID NO: 5435875 - DNA, 19 bp, Homo sapiens
gtggcttcattagagcagg

SEQ ID NO: 5435876 - DNA, 13 bp, Homo sapiens
gtggcttcccagc

SEQ ID NO: 5435877 - DNA, 19 bp, Homo sapiens
gtggcttcccgctcagccc

SEQ ID NO: 5435878 - DNA, 13 bp, Homo sapiens
gtggcttcctccg

SEQ ID NO: 5435879 - DNA, 16 bp, Homo sapiens
gtggcttcggcctgct

SEQ ID NO: 5435880 - DNA, 14 bp, Homo sapiens
gtggcttctcccaa

SEQ ID NO: 5435881 - DNA, 22 bp, Homo sapiens
gtggcttctctgtctctgtgga

SEQ ID NO: 5435882 - DNA, 13 bp, Homo sapiens
gtggcttctgatg

SEQ ID NO: 5435883 - DNA, 14 bp, Homo sapiens
gtggcttctttcca

SEQ ID NO: 5435884 - DNA, 18 bp, Homo sapiens
gtggcttcttttgaactg

SEQ ID NO: 5435885 - DNA, 18 bp, Homo sapiens
gtggcttggaacatttgg

SEQ ID NO: 5435886 - DNA, 18 bp, Homo sapiens
gtggcttggagcagaggt

SEQ ID NO: 5435887 - DNA, 14 bp, Homo sapiens
gtggcttggagtgg

SEQ ID NO: 5435888 - DNA, 20 bp, Homo sapiens
gtggcttgtgattctgggat

SEQ ID NO: 5435889 - DNA, 18 bp, Homo sapiens
gtggctttcaaggctggg

SEQ ID NO: 5435890 - DNA, 20 bp, Homo sapiens
gtggctttcaaggctggggc

SEQ ID NO: 5435891 - DNA, 16 bp, Homo sapiens
gtggctttcagcctct

SEQ ID NO: 5435892 - DNA, 16 bp, Homo sapiens
gtggctttccaggcac

SEQ ID NO: 5435893 - DNA, 21 bp, Homo sapiens
gtggctttgcatttcttgtgt

SEQ ID NO: 5435894 - DNA, 22 bp, Homo sapiens
gtggctttgcattttaaaaatg

SEQ ID NO: 5435895 - DNA, 16 bp, Homo sapiens
gtggctttggcagtgt

SEQ ID NO: 5435896 - DNA, 19 bp, Homo sapiens
gtggctttggcagtgtttt

SEQ ID NO: 5435897 - DNA, 16 bp, Homo sapiens
gtggctttgttttctt

SEQ ID NO: 5435898 - DNA, 12 bp, Homo sapiens
gtgggaaaacac

SEQ ID NO: 5435899 - DNA, 22 bp, Homo sapiens
gtgggaaacctcattgttctgt

SEQ ID NO: 5435900 - DNA, 23 bp, Homo sapiens
gtgggaaagattactttttcttt

SEQ ID NO: 5435901 - DNA, 12 bp, Homo sapiens
gtgggaacattc

SEQ ID NO: 5435902 - DNA, 17 bp, Homo sapiens
gtgggaacgactgggca

SEQ ID NO: 5435903 - DNA, 23 bp, Homo sapiens
gtgggaacgactgggcactgcca

SEQ ID NO: 5435904 - DNA, 20 bp, Homo sapiens
gtgggaacgagaggggaaga

SEQ ID NO: 5435905 - DNA, 17 bp, Homo sapiens
gtgggaactcactttcc

SEQ ID NO: 5435906 - DNA, 24 bp, Homo sapiens
gtgggaactcgaacttgaagcaca

SEQ ID NO: 5435907 - DNA, 14 bp, Homo sapiens
gtgggaactggagg

SEQ ID NO: 5435908 - DNA, 21 bp, Homo sapiens
gtgggaagaaacaaacccgtt

SEQ ID NO: 5435909 - DNA, 12 bp, Homo sapiens
gtgggaagagaa

SEQ ID NO: 5435910 - DNA, 14 bp, Homo sapiens
gtgggaagagctgg

SEQ ID NO: 5435911 - DNA, 17 bp, Homo sapiens
gtgggaagagggcaggg

SEQ ID NO: 5435912 - DNA, 21 bp, Homo sapiens
gtgggaagagggggctggcca

SEQ ID NO: 5435913 - DNA, 22 bp, Homo sapiens
gtgggaagagggggctggccat

SEQ ID NO: 5435914 - DNA, 13 bp, Homo sapiens
gtgggcctggcct

SEQ ID NO: 5435915 - DNA, 18 bp, Homo sapiens
gtgggcctggcctgagct

SEQ ID NO: 5435916 - DNA, 17 bp, Homo sapiens
gtgggcctggcggcctg

SEQ ID NO: 5435917 - DNA, 23 bp, Homo sapiens
gtgggcctgggataatgcccatg

SEQ ID NO: 5435918 - DNA, 18 bp, Homo sapiens
gtgggcctgggctcctgg

SEQ ID NO: 5435919 - DNA, 22 bp, Homo sapiens
gtgggcgcctgtcgggcccgca

SEQ ID NO: 5435920 - DNA, 23 bp, Homo sapiens
gtgggcggacaaaagggccaggt

SEQ ID NO: 5435921 - DNA, 20 bp, Homo sapiens
gtgggcggatcacaaggtca

SEQ ID NO: 5435922 - DNA, 18 bp, Homo sapiens
gtgggcggcttccctgcg

SEQ ID NO: 5435923 - DNA, 12 bp, Homo sapiens
gtgggcggggag

SEQ ID NO: 5435924 - DNA, 15 bp, Homo sapiens
gtgggcggggagaag

SEQ ID NO: 5435925 - DNA, 12 bp, Homo sapiens
gtgggctcacac

SEQ ID NO: 5435926 - DNA, 16 bp, Homo sapiens
gtgggctcagatcctg

SEQ ID NO: 5435927 - DNA, 15 bp, Homo sapiens
gtgggctcccctctt

SEQ ID NO: 5435928 - DNA, 19 bp, Homo sapiens
gtgggctcccctcttcctc

SEQ ID NO: 5435929 - DNA, 15 bp, Homo sapiens
gtgggctccctgact

SEQ ID NO: 5435930 - DNA, 15 bp, Homo sapiens
gtgggctccctggcc

SEQ ID NO: 5435931 - DNA, 10 bp, Homo sapiens
gtgggctcct

SEQ ID NO: 5435932 - DNA, 14 bp, Homo sapiens
gtgggctctgagca

SEQ ID NO: 5435933 - DNA, 14 bp, Homo sapiens
gtgggctctggctc

SEQ ID NO: 5435934 - DNA, 18 bp, Homo sapiens
gtgggctctgtgcagtca

SEQ ID NO: 5435935 - DNA, 14 bp, Homo sapiens
gtgggctgagccct

SEQ ID NO: 5435936 - DNA, 20 bp, Homo sapiens
gtgggctgcactctgtgccc

SEQ ID NO: 5435937 - DNA, 16 bp, Homo sapiens
gtgggctgcccctcgc

SEQ ID NO: 5435938 - DNA, 13 bp, Homo sapiens
gtgggctgcctgc

SEQ ID NO: 5435939 - DNA, 18 bp, Homo sapiens
gtgggctgctggccatga

SEQ ID NO: 5435940 - DNA, 19 bp, Homo sapiens
gtgggctggacttctacct

SEQ ID NO: 5435941 - DNA, 14 bp, Homo sapiens
gtgggctggcccag

SEQ ID NO: 5435942 - DNA, 15 bp, Homo sapiens
gtgggctggccgctg

SEQ ID NO: 5435943 - DNA, 22 bp, Homo sapiens
gtgggctggccgctgtgccagg

SEQ ID NO: 5435944 - DNA, 13 bp, Homo sapiens
gtgggctggggac

SEQ ID NO: 5435945 - DNA, 18 bp, Homo sapiens
gtgggctggggactctgg

SEQ ID NO: 5435946 - DNA, 20 bp, Homo sapiens
gtgggctggggactctggca

SEQ ID NO: 5435947 - DNA, 19 bp, Homo sapiens
gtgggctggggctgctccc

SEQ ID NO: 5435948 - DNA, 20 bp, Homo sapiens
gtgggcttatgtctctgcct

SEQ ID NO: 5435949 - DNA, 14 bp, Homo sapiens
gtgggcttcctgcc

SEQ ID NO: 5435950 - DNA, 21 bp, Homo sapiens
gtgggcttcggagtgaatgtg

SEQ ID NO: 5435951 - DNA, 18 bp, Homo sapiens
gtgggcttgtgctcggga

SEQ ID NO: 5435952 - DNA, 21 bp, Homo sapiens
gtgggcttgtggtggctgctc

SEQ ID NO: 5435953 - DNA, 21 bp, Homo sapiens
gtgggctttctccggggtctg

SEQ ID NO: 5435954 - DNA, 15 bp, Homo sapiens
gtgggctttggtggc

SEQ ID NO: 5435955 - DNA, 22 bp, Homo sapiens
gtgggctttgttgtgagaatgg

SEQ ID NO: 5435956 - DNA, 16 bp, Homo sapiens
gtggggaacaggtccc

SEQ ID NO: 5435957 - DNA, 17 bp, Homo sapiens
gtggggaacggaggagg

SEQ ID NO: 5435958 - DNA, 19 bp, Homo sapiens
gtggggaacggaggaggac

SEQ ID NO: 5435959 - DNA, 22 bp, Homo sapiens
gtggggaagagaaatacaagat

SEQ ID NO: 5435960 - DNA, 19 bp, Homo sapiens
gtggggaaggagggacttg

SEQ ID NO: 5435961 - DNA, 17 bp, Homo sapiens
gtggggaagtgatcttt

SEQ ID NO: 5435962 - DNA, 13 bp, Homo sapiens
gtggggacacagc

SEQ ID NO: 5435963 - DNA, 17 bp, Homo sapiens
gtggggacagaccagcc

SEQ ID NO: 5435964 - DNA, 12 bp, Homo sapiens
gtggggacagat

SEQ ID NO: 5435965 - DNA, 16 bp, Homo sapiens
gtggggacagggaggg

SEQ ID NO: 5435966 - DNA, 19 bp, Homo sapiens
gtggggacagggaggggga

SEQ ID NO: 5435967 - DNA, 23 bp, Homo sapiens
gtggggacaggtaagtggcagga

SEQ ID NO: 5435968 - DNA, 13 bp, Homo sapiens
gtggggacccagg

SEQ ID NO: 5435969 - DNA, 21 bp, Homo sapiens
gtggggacccaggctccgccc

SEQ ID NO: 5435970 - DNA, 15 bp, Homo sapiens
gtggggacctcagcc

SEQ ID NO: 5435971 - DNA, 23 bp, Homo sapiens
gtggggagaaaagacaaatgtgc

SEQ ID NO: 5435972 - DNA, 18 bp, Homo sapiens
gtggggagaggcacttaa

SEQ ID NO: 5435973 - DNA, 21 bp, Homo sapiens
gtggggagcagttttcccctg

SEQ ID NO: 5435974 - DNA, 20 bp, Homo sapiens
gtggggagcgggagcaagag

SEQ ID NO: 5435975 - DNA, 13 bp, Homo sapiens
gtggggagctaga

SEQ ID NO: 5435976 - DNA, 22 bp, Homo sapiens
gtggggaggccctgcctgaccc

SEQ ID NO: 5435977 - DNA, 18 bp, Homo sapiens
gtggggaggctgcactgg

SEQ ID NO: 5435978 - DNA, 22 bp, Homo sapiens
gtggggagggacaagggattct

SEQ ID NO: 5435979 - DNA, 12 bp, Homo sapiens
gtggggagggag

SEQ ID NO: 5435980 - DNA, 13 bp, Homo sapiens
gtggggagggaga

SEQ ID NO: 5435981 - DNA, 13 bp, Homo sapiens
gtggggaggggcg

SEQ ID NO: 5435982 - DNA, 14 bp, Homo sapiens
gtggggaggggctg

SEQ ID NO: 5435983 - DNA, 15 bp, Homo sapiens
gtggggagggtgggc

SEQ ID NO: 5435984 - DNA, 16 bp, Homo sapiens
gtggggataaagacag

SEQ ID NO: 5435985 - DNA, 18 bp, Homo sapiens
gtggggcaagattttcct

SEQ ID NO: 5435986 - DNA, 17 bp, Homo sapiens
gtggggcacagatgcct

SEQ ID NO: 5435987 - DNA, 17 bp, Homo sapiens
gtggggcagaaaggctg

SEQ ID NO: 5435988 - DNA, 15 bp, Homo sapiens
gtggggcagagcctc

SEQ ID NO: 5435989 - DNA, 21 bp, Homo sapiens
gtggggcagcacacctctggg

SEQ ID NO: 5435990 - DNA, 19 bp, Homo sapiens
gtggggcagcacagagagg

SEQ ID NO: 5435991 - DNA, 17 bp, Homo sapiens
gtggggcagcttgaggg

SEQ ID NO: 5435992 - DNA, 23 bp, Homo sapiens
gtggggcagtgcttggcccagga

SEQ ID NO: 5435993 - DNA, 12 bp, Homo sapiens
gtggggccacac

SEQ ID NO: 5435994 - DNA, 12 bp, Homo sapiens
gtggggccaggc

SEQ ID NO: 5435995 - DNA, 19 bp, Homo sapiens
gtggggccaggccaggacc

SEQ ID NO: 5435996 - DNA, 22 bp, Homo sapiens
gtggggccataaacggttcctg

SEQ ID NO: 5435997 - DNA, 23 bp, Homo sapiens
gtggggccataaacggttcctgg

SEQ ID NO: 5435998 - DNA, 21 bp, Homo sapiens
gtggggccatgcctcctcagg

SEQ ID NO: 5435999 - DNA, 24 bp, Homo sapiens
gtggggcccagacaccagcctagc

SEQ ID NO: 5436000 - DNA, 18 bp, Homo sapiens
gtggggcccatggaggag

SEQ ID NO: 5436001 - DNA, 13 bp, Homo sapiens
gtggggccccaga

SEQ ID NO: 5436002 - DNA, 17 bp, Homo sapiens
gtggggccccagagagg

SEQ ID NO: 5436003 - DNA, 15 bp, Homo sapiens
gtggggcccccagca

SEQ ID NO: 5436004 - DNA, 21 bp, Homo sapiens
gtggggccccggctcccaccg

SEQ ID NO: 5436005 - DNA, 13 bp, Homo sapiens
gtggggccctgcc

SEQ ID NO: 5436006 - DNA, 15 bp, Homo sapiens
gtggggccctgcccc

SEQ ID NO: 5436007 - DNA, 18 bp, Homo sapiens
gtggggcctcagcctggg

SEQ ID NO: 5436008 - DNA, 18 bp, Homo sapiens
gtggggcctcaggctccg

SEQ ID NO: 5436009 - DNA, 11 bp, Homo sapiens
gtggggcctgg

SEQ ID NO: 5436010 - DNA, 19 bp, Homo sapiens
gtggggcctgtggaatgag

SEQ ID NO: 5436011 - DNA, 13 bp, Homo sapiens
gtggggcctttgc

SEQ ID NO: 5436012 - DNA, 23 bp, Homo sapiens
gtggggctagactgggctggctg

SEQ ID NO: 5436013 - DNA, 20 bp, Homo sapiens
gtggggctaggggctggggc

SEQ ID NO: 5436014 - DNA, 15 bp, Homo sapiens
gtggggctcccgcct

SEQ ID NO: 5436015 - DNA, 13 bp, Homo sapiens
gtggggctcccgg

SEQ ID NO: 5436016 - DNA, 20 bp, Homo sapiens
gtggggctccggaggggacc

SEQ ID NO: 5436017 - DNA, 15 bp, Homo sapiens
gtggggctcctacct

SEQ ID NO: 5436018 - DNA, 17 bp, Homo sapiens
gtggggctcgccatgcc

SEQ ID NO: 5436019 - DNA, 13 bp, Homo sapiens
gtggggctgagcc

SEQ ID NO: 5436020 - DNA, 15 bp, Homo sapiens
gtggggctgagctgg

SEQ ID NO: 5436021 - DNA, 14 bp, Homo sapiens
gtggggctgctcct

SEQ ID NO: 5436022 - DNA, 17 bp, Homo sapiens
gtggggctgctcctcca

SEQ ID NO: 5436023 - DNA, 13 bp, Homo sapiens
gtggggctgggca

SEQ ID NO: 5436024 - DNA, 15 bp, Homo sapiens
gtggggctggtgggt

SEQ ID NO: 5436025 - DNA, 14 bp, Homo sapiens
gtggggctgtcctg

SEQ ID NO: 5436026 - DNA, 19 bp, Homo sapiens
gtggggcttctcctgaaat

SEQ ID NO: 5436027 - DNA, 15 bp, Homo sapiens
gtggggcttctctgg

SEQ ID NO: 5436028 - DNA, 12 bp, Homo sapiens
gtggggcttggg

SEQ ID NO: 5436029 - DNA, 21 bp, Homo sapiens
gtgggggaacactgagaaaga

SEQ ID NO: 5436030 - DNA, 14 bp, Homo sapiens
gtgggggaactgac

SEQ ID NO: 5436031 - DNA, 21 bp, Homo sapiens
gtgggggaagagcacagccct

SEQ ID NO: 5436032 - DNA, 22 bp, Homo sapiens
gtgggggaagagcacagccctc

SEQ ID NO: 5436033 - DNA, 17 bp, Homo sapiens
gtgggggagattctggg

SEQ ID NO: 5436034 - DNA, 22 bp, Homo sapiens
gtgggggagattctgggtttgc

SEQ ID NO: 5436035 - DNA, 14 bp, Homo sapiens
gtgggggaggagcc

SEQ ID NO: 5436036 - DNA, 11 bp, Homo sapiens
gtgggggaggg

SEQ ID NO: 5436037 - DNA, 18 bp, Homo sapiens
gtgggggcagagggcaga

SEQ ID NO: 5436038 - DNA, 22 bp, Homo sapiens
gtgggggcagagggcagaggct

SEQ ID NO: 5436039 - DNA, 15 bp, Homo sapiens
gtgggggccaggcct

SEQ ID NO: 5436040 - DNA, 17 bp, Homo sapiens
gtgggggccgctggccc

SEQ ID NO: 5436041 - DNA, 19 bp, Homo sapiens
gtgggggccgctggcccag

SEQ ID NO: 5436042 - DNA, 14 bp, Homo sapiens
gtgggggctcctgg

SEQ ID NO: 5436043 - DNA, 15 bp, Homo sapiens
gtgggggctggaggt

SEQ ID NO: 5436044 - DNA, 14 bp, Homo sapiens
gtgggggctgtcct

SEQ ID NO: 5436045 - DNA, 17 bp, Homo sapiens
gtgggggctgtcctgct

SEQ ID NO: 5436046 - DNA, 19 bp, Homo sapiens
gtgggggctgtggccctgc

SEQ ID NO: 5436047 - DNA, 13 bp, Homo sapiens
gtgggggcttcat

SEQ ID NO: 5436048 - DNA, 16 bp, Homo sapiens
gtggggggacagacag

SEQ ID NO: 5436049 - DNA, 12 bp, Homo sapiens
gtggggggaggc

SEQ ID NO: 5436050 - DNA, 15 bp, Homo sapiens
gtggggggcttcata

SEQ ID NO: 5436051 - DNA, 16 bp, Homo sapiens
gtggggggcttcatac

SEQ ID NO: 5436052 - DNA, 21 bp, Homo sapiens
gtgggggggagaaggcctccc

SEQ ID NO: 5436053 - DNA, 23 bp, Homo sapiens
gtggggggggggcgcggctggga

SEQ ID NO: 5436054 - DNA, 18 bp, Homo sapiens
gtggggggggtgctgggc

SEQ ID NO: 5436055 - DNA, 16 bp, Homo sapiens
gtggggggtccagtct

SEQ ID NO: 5436056 - DNA, 15 bp, Homo sapiens
gtggggggtgcccca

SEQ ID NO: 5436057 - DNA, 17 bp, Homo sapiens
gtggggggtgccccaca

SEQ ID NO: 5436058 - DNA, 18 bp, Homo sapiens
gtggggggtggacacaga

SEQ ID NO: 5436059 - DNA, 22 bp, Homo sapiens
gtgggggtagggggctggagga

SEQ ID NO: 5436060 - DNA, 24 bp, Homo sapiens
gtgggggtcaggctacaggtgccc

SEQ ID NO: 5436061 - DNA, 14 bp, Homo sapiens
gtgggggtctggga

SEQ ID NO: 5436062 - DNA, 19 bp, Homo sapiens
gtgggggtctgggaggcag

SEQ ID NO: 5436063 - DNA, 22 bp, Homo sapiens
gtgggggtggaataaaatacta

SEQ ID NO: 5436064 - DNA, 20 bp, Homo sapiens
gtgggggtggaggcttcctg

SEQ ID NO: 5436065 - DNA, 12 bp, Homo sapiens
gtgggggtggcc

SEQ ID NO: 5436066 - DNA, 18 bp, Homo sapiens
gtgggggtggccactcct

SEQ ID NO: 5436067 - DNA, 21 bp, Homo sapiens
gtgggggtggccatccctggg

SEQ ID NO: 5436068 - DNA, 21 bp, Homo sapiens
gtgggggtgtcacagaggcag

SEQ ID NO: 5436069 - DNA, 16 bp, Homo sapiens
gtgggggttctggcag

SEQ ID NO: 5436070 - DNA, 18 bp, Homo sapiens
gtgggggttctggcagga

SEQ ID NO: 5436071 - DNA, 18 bp, Homo sapiens
gtgggggttgctgtataa

SEQ ID NO: 5436072 - DNA, 16 bp, Homo sapiens
gtgggggttggctggg

SEQ ID NO: 5436073 - DNA, 20 bp, Homo sapiens
gtgggggttttggggtgggc

SEQ ID NO: 5436074 - DNA, 16 bp, Homo sapiens
gtggggtacaggcagt

SEQ ID NO: 5436075 - DNA, 23 bp, Homo sapiens
gtggggtacagtaaagaggcttc

SEQ ID NO: 5436076 - DNA, 22 bp, Homo sapiens
gtggggtacatttctctgagca

SEQ ID NO: 5436077 - DNA, 21 bp, Homo sapiens
gtggggtaggctgctgccctg

SEQ ID NO: 5436078 - DNA, 22 bp, Homo sapiens
gtggggtatacagcattgactc

SEQ ID NO: 5436079 - DNA, 14 bp, Homo sapiens
gtggggtctccctc

SEQ ID NO: 5436080 - DNA, 22 bp, Homo sapiens
gtggggtctccctctcctgcct

SEQ ID NO: 5436081 - DNA, 14 bp, Homo sapiens
gtggggtctggctg

SEQ ID NO: 5436082 - DNA, 17 bp, Homo sapiens
gtggggtgaacagctgg

SEQ ID NO: 5436083 - DNA, 19 bp, Homo sapiens
gtggggtgcctgagcccga

SEQ ID NO: 5436084 - DNA, 15 bp, Homo sapiens
gtggggtgctctggt

SEQ ID NO: 5436085 - DNA, 15 bp, Homo sapiens
gtggggtgctggggc

SEQ ID NO: 5436086 - DNA, 16 bp, Homo sapiens
gtggggtggggagaaa

SEQ ID NO: 5436087 - DNA, 12 bp, Homo sapiens
gtggggtggggt

SEQ ID NO: 5436088 - DNA, 21 bp, Homo sapiens
gtggggttatgtgagggtatg

SEQ ID NO: 5436089 - DNA, 15 bp, Homo sapiens
gtggggttctaggca

SEQ ID NO: 5436090 - DNA, 15 bp, Homo sapiens
gtggggttgctgaag

SEQ ID NO: 5436091 - DNA, 23 bp, Homo sapiens
gtggggttggggcaaagcctcct

SEQ ID NO: 5436092 - DNA, 22 bp, Homo sapiens
gtgtaaatatatgtctgataat

SEQ ID NO: 5436093 - DNA, 14 bp, Homo sapiens
gtgtaaatcttgcc

SEQ ID NO: 5436094 - DNA, 18 bp, Homo sapiens
gtgtaaatgaagatcttt

SEQ ID NO: 5436095 - DNA, 17 bp, Homo sapiens
gtgtaaatgctccagca

SEQ ID NO: 5436096 - DNA, 21 bp, Homo sapiens
gtgtaaatggttttgttttgc

SEQ ID NO: 5436097 - DNA, 17 bp, Homo sapiens
gtgtaaatgtggacaca

SEQ ID NO: 5436098 - DNA, 21 bp, Homo sapiens
gtgtaaattaattacatacat

SEQ ID NO: 5436099 - DNA, 13 bp, Homo sapiens
gtgtaaattatgt

SEQ ID NO: 5436100 - DNA, 22 bp, Homo sapiens
gtgtaaattatgtaatgcaaaa

SEQ ID NO: 5436101 - DNA, 13 bp, Homo sapiens
gtgtaaatttgta

SEQ ID NO: 5436102 - DNA, 23 bp, Homo sapiens
gtgtaacactgcaagaagtcttg

SEQ ID NO: 5436103 - DNA, 19 bp, Homo sapiens
gtgtaacagagttgaggtt

SEQ ID NO: 5436104 - DNA, 13 bp, Homo sapiens
gtgtaacagctcc

SEQ ID NO: 5436105 - DNA, 23 bp, Homo sapiens
gtgtaacagctccttgggaggaa

SEQ ID NO: 5436106 - DNA, 15 bp, Homo sapiens
gtgtaacagctgagg

SEQ ID NO: 5436107 - DNA, 17 bp, Homo sapiens
gtgtaacaggtctcctc

SEQ ID NO: 5436108 - DNA, 19 bp, Homo sapiens
gtgtaacagttagccactg

SEQ ID NO: 5436109 - DNA, 15 bp, Homo sapiens
gtgtaacatatgcaa

SEQ ID NO: 5436110 - DNA, 18 bp, Homo sapiens
gtgtaacatccaagccag

SEQ ID NO: 5436111 - DNA, 19 bp, Homo sapiens
gtgtaacatccaagccaga

SEQ ID NO: 5436112 - DNA, 16 bp, Homo sapiens
gtgtaaccagctcagt

SEQ ID NO: 5436113 - DNA, 21 bp, Homo sapiens
gtgtaacctgagatggccctc

SEQ ID NO: 5436114 - DNA, 23 bp, Homo sapiens
gtgtaactcaccagcctctgctc

SEQ ID NO: 5436115 - DNA, 16 bp, Homo sapiens
gtgtaactcccagtga

SEQ ID NO: 5436116 - DNA, 13 bp, Homo sapiens
gtgtaactggctg

SEQ ID NO: 5436117 - DNA, 17 bp, Homo sapiens
gtgtaactggctgctcc

SEQ ID NO: 5436118 - DNA, 21 bp, Homo sapiens
gtgtaactggctgctccctgc

SEQ ID NO: 5436119 - DNA, 22 bp, Homo sapiens
gtgtaactggctgctccctgct

SEQ ID NO: 5436120 - DNA, 23 bp, Homo sapiens
gtgtaactgtcagccgggccctg

SEQ ID NO: 5436121 - DNA, 15 bp, Homo sapiens
gtgtaactgttcttt

SEQ ID NO: 5436122 - DNA, 20 bp, Homo sapiens
gtgtaactgttctttgcagt

SEQ ID NO: 5436123 - DNA, 13 bp, Homo sapiens
gtgtaacttcctg

SEQ ID NO: 5436124 - DNA, 20 bp, Homo sapiens
gtgtaactttcataccactt

SEQ ID NO: 5436125 - DNA, 23 bp, Homo sapiens
gtgtaacttttttttagtatttg

SEQ ID NO: 5436126 - DNA, 14 bp, Homo sapiens
gtgtaagaaaacaa

SEQ ID NO: 5436127 - DNA, 18 bp, Homo sapiens
gtgtaagaaatacagact

SEQ ID NO: 5436128 - DNA, 20 bp, Homo sapiens
gtgtaagaacaatgccaggg

SEQ ID NO: 5436129 - DNA, 23 bp, Homo sapiens
gtgtaagacttcagatttcaaat

SEQ ID NO: 5436130 - DNA, 12 bp, Homo sapiens
gtgtaagagaat

SEQ ID NO: 5436131 - DNA, 22 bp, Homo sapiens
gtgtaataaagtgttttcagag

SEQ ID NO: 5436132 - DNA, 12 bp, Homo sapiens
gtgtaataagac

SEQ ID NO: 5436133 - DNA, 22 bp, Homo sapiens
gtgtaataagacttagattgtg

SEQ ID NO: 5436134 - DNA, 19 bp, Homo sapiens
gtgtaataatgtaacatga

SEQ ID NO: 5436135 - DNA, 14 bp, Homo sapiens
gtgtaatatcattt

SEQ ID NO: 5436136 - DNA, 16 bp, Homo sapiens
gtgtaatatcatttca

SEQ ID NO: 5436137 - DNA, 14 bp, Homo sapiens
gtgtaatatgaaat

SEQ ID NO: 5436138 - DNA, 12 bp, Homo sapiens
gtgtaatattac

SEQ ID NO: 5436139 - DNA, 23 bp, Homo sapiens
gtgtaatcatttcttgggccctc

SEQ ID NO: 5436140 - DNA, 16 bp, Homo sapiens
gtgtaatgcacaattt

SEQ ID NO: 5436141 - DNA, 21 bp, Homo sapiens
gtgtaatgcacaatttagaaa

SEQ ID NO: 5436142 - DNA, 13 bp, Homo sapiens
gtgtaattcaaaa

SEQ ID NO: 5436143 - DNA, 20 bp, Homo sapiens
gtgtaattgttttggaataa

SEQ ID NO: 5436144 - DNA, 22 bp, Homo sapiens
gtgtaatttaaaattgtgatgt

SEQ ID NO: 5436145 - DNA, 17 bp, Homo sapiens
gtgtaatttataaaatt

SEQ ID NO: 5436146 - DNA, 13 bp, Homo sapiens
gtgtaatttcttt

SEQ ID NO: 5436147 - DNA, 21 bp, Homo sapiens
gtgtaattttaatggctgcaa

SEQ ID NO: 5436148 - DNA, 15 bp, Homo sapiens
gtgtaatttttctgt

SEQ ID NO: 5436149 - DNA, 14 bp, Homo sapiens
gtgtacaaaactgt

SEQ ID NO: 5436150 - DNA, 13 bp, Homo sapiens
gtgtacaaagtag

SEQ ID NO: 5436151 - DNA, 19 bp, Homo sapiens
gtgtacaaagtagagaagt

SEQ ID NO: 5436152 - DNA, 18 bp, Homo sapiens
gtgtacaaatacatgtgt

SEQ ID NO: 5436153 - DNA, 18 bp, Homo sapiens
gtgtacaagttgctttgt

SEQ ID NO: 5436154 - DNA, 22 bp, Homo sapiens
gtgtacaagttgctttgttaca

SEQ ID NO: 5436155 - DNA, 14 bp, Homo sapiens
gtgtacaatgtaca

SEQ ID NO: 5436156 - DNA, 19 bp, Homo sapiens
gtgtacacaaaggatttga

SEQ ID NO: 5436157 - DNA, 19 bp, Homo sapiens
gtgtacactgacacctttg

SEQ ID NO: 5436158 - DNA, 17 bp, Homo sapiens
gtgtacagacccctgcc

SEQ ID NO: 5436159 - DNA, 22 bp, Homo sapiens
gtgtacagtaaacggtgtatat

SEQ ID NO: 5436160 - DNA, 22 bp, Homo sapiens
gtgtacagtcttgtattaagtt

SEQ ID NO: 5436161 - DNA, 21 bp, Homo sapiens
gtgtacagtgaattgtctttt

SEQ ID NO: 5436162 - DNA, 14 bp, Homo sapiens
gtgtacataactga

SEQ ID NO: 5436163 - DNA, 20 bp, Homo sapiens
gtgtacatagagcaatgttg

SEQ ID NO: 5436164 - DNA, 16 bp, Homo sapiens
gtgtacatatatgtat

SEQ ID NO: 5436165 - DNA, 17 bp, Homo sapiens
gtgtacatcatgttatt

SEQ ID NO: 5436166 - DNA, 21 bp, Homo sapiens
gtgtacatgtgtgcagagcag

SEQ ID NO: 5436167 - DNA, 17 bp, Homo sapiens
gtgtacatttatgtgtg

SEQ ID NO: 5436168 - DNA, 18 bp, Homo sapiens
gtgtacatttatgtgtga

SEQ ID NO: 5436169 - DNA, 18 bp, Homo sapiens
gtgtacatttatgttcct

SEQ ID NO: 5436170 - DNA, 21 bp, Homo sapiens
gtgtaccacccatccctgtgg

SEQ ID NO: 5436171 - DNA, 20 bp, Homo sapiens
gtgtaccacctaatgtttat

SEQ ID NO: 5436172 - DNA, 21 bp, Homo sapiens
gtgtaccacttctgtgggcat

SEQ ID NO: 5436173 - DNA, 23 bp, Homo sapiens
gtgtacccatctttaatttatat

SEQ ID NO: 5436174 - DNA, 17 bp, Homo sapiens
gtgtacccccgcccagg

SEQ ID NO: 5436175 - DNA, 19 bp, Homo sapiens
gtgtacccccgcccaggct

SEQ ID NO: 5436176 - DNA, 16 bp, Homo sapiens
gtgtacgtggagaggg

SEQ ID NO: 5436177 - DNA, 15 bp, Homo sapiens
gtgtactctggcctc

SEQ ID NO: 5436178 - DNA, 16 bp, Homo sapiens
gtgtactctggcctct

SEQ ID NO: 5436179 - DNA, 18 bp, Homo sapiens
gtgtactctggcctctgt

SEQ ID NO: 5436180 - DNA, 19 bp, Homo sapiens
gtgtactctggcctctgtc

SEQ ID NO: 5436181 - DNA, 23 bp, Homo sapiens
gtgtactgattcaagaacaagca

SEQ ID NO: 5436182 - DNA, 14 bp, Homo sapiens
gtgtactgctttca

SEQ ID NO: 5436183 - DNA, 22 bp, Homo sapiens
gtgtactgtgcctggtttgatt

SEQ ID NO: 5436184 - DNA, 15 bp, Homo sapiens
gtgtacttaactatt

SEQ ID NO: 5436185 - DNA, 16 bp, Homo sapiens
gtgtacttttcctttg

SEQ ID NO: 5436186 - DNA, 11 bp, Homo sapiens
gtgtagaaaaa

SEQ ID NO: 5436187 - DNA, 13 bp, Homo sapiens
gtgtagaaactgg

SEQ ID NO: 5436188 - DNA, 15 bp, Homo sapiens
gtgtagaacactaat

SEQ ID NO: 5436189 - DNA, 19 bp, Homo sapiens
gtgtagaacactaattcat

SEQ ID NO: 5436190 - DNA, 23 bp, Homo sapiens
gtgtagactggccatgcaagtgg

SEQ ID NO: 5436191 - DNA, 15 bp, Homo sapiens
gtgtagagttaagaa

SEQ ID NO: 5436192 - DNA, 17 bp, Homo sapiens
gtgtagagttaagaagc

SEQ ID NO: 5436193 - DNA, 18 bp, Homo sapiens
gtgtagagttaagaagct

SEQ ID NO: 5436194 - DNA, 15 bp, Homo sapiens
gtgtagatattatgt

SEQ ID NO: 5436195 - DNA, 16 bp, Homo sapiens
gtgtagatttctgaca

SEQ ID NO: 5436196 - DNA, 15 bp, Homo sapiens
gtgtagatttgaaaa

SEQ ID NO: 5436197 - DNA, 20 bp, Homo sapiens
gtgtagattttatagtgtgt

SEQ ID NO: 5436198 - DNA, 14 bp, Homo sapiens
gtgtagccaaggtc

SEQ ID NO: 5436199 - DNA, 14 bp, Homo sapiens
gtgtagccaggaag

SEQ ID NO: 5436200 - DNA, 20 bp, Homo sapiens
gtgtagccccaagaaggctg

SEQ ID NO: 5436201 - DNA, 16 bp, Homo sapiens
gtgtagccccttttct

SEQ ID NO: 5436202 - DNA, 15 bp, Homo sapiens
gtgtagccgccctga

SEQ ID NO: 5436203 - DNA, 16 bp, Homo sapiens
gtgtagcctaaagggc

SEQ ID NO: 5436204 - DNA, 16 bp, Homo sapiens
gtgtagccttgcccgg

SEQ ID NO: 5436205 - DNA, 11 bp, Homo sapiens
gtgtagccttt

SEQ ID NO: 5436206 - DNA, 12 bp, Homo sapiens
gtgtagcctttt

SEQ ID NO: 5436207 - DNA, 13 bp, Homo sapiens
gtgtagccttttt

SEQ ID NO: 5436208 - DNA, 14 bp, Homo sapiens
gtgtagcgggagga

SEQ ID NO: 5436209 - DNA, 17 bp, Homo sapiens
gtgtagcgtcctgagga

SEQ ID NO: 5436210 - DNA, 20 bp, Homo sapiens
gtgtagctacagagaaacca

SEQ ID NO: 5436211 - DNA, 22 bp, Homo sapiens
gtgtagctacagagaaaccagc

SEQ ID NO: 5436212 - DNA, 15 bp, Homo sapiens
gtgtagctctgtcca

SEQ ID NO: 5436213 - DNA, 16 bp, Homo sapiens
gtgtagctgagctgtg

SEQ ID NO: 5436214 - DNA, 18 bp, Homo sapiens
gtgtagctgtgacctgct

SEQ ID NO: 5436215 - DNA, 22 bp, Homo sapiens
gtgtagctgtgacctgctgagc

SEQ ID NO: 5436216 - DNA, 15 bp, Homo sapiens
gtgtagctgtgtggc

SEQ ID NO: 5436217 - DNA, 16 bp, Homo sapiens
gtgtaggaaatctgaa

SEQ ID NO: 5436218 - DNA, 19 bp, Homo sapiens
gtgtaggaagaggccgctg

SEQ ID NO: 5436219 - DNA, 20 bp, Homo sapiens
gtgtaggctttacttagctt

SEQ ID NO: 5436220 - DNA, 17 bp, Homo sapiens
gtgtagggctgagggct

SEQ ID NO: 5436221 - DNA, 15 bp, Homo sapiens
gtgtaggggcaggga

SEQ ID NO: 5436222 - DNA, 20 bp, Homo sapiens
gtgtagtcccggaggccttc

SEQ ID NO: 5436223 - DNA, 23 bp, Homo sapiens
gtgtagtgcttttaaaaattttg

SEQ ID NO: 5436224 - DNA, 20 bp, Homo sapiens
gtgtagtggaagagcagcct

SEQ ID NO: 5436225 - DNA, 21 bp, Homo sapiens
gtgtagtgttaaagtgaatct

SEQ ID NO: 5436226 - DNA, 15 bp, Homo sapiens
gtgtagttgaactga

SEQ ID NO: 5436227 - DNA, 12 bp, Homo sapiens
gtgtataaaaat

SEQ ID NO: 5436228 - DNA, 14 bp, Homo sapiens
gtgtataaaaataa

SEQ ID NO: 5436229 - DNA, 14 bp, Homo sapiens
gtgtataaaacatt

SEQ ID NO: 5436230 - DNA, 14 bp, Homo sapiens
gtgtataaatgtac

SEQ ID NO: 5436231 - DNA, 14 bp, Homo sapiens
gtgtataatataaa

SEQ ID NO: 5436232 - DNA, 17 bp, Homo sapiens
gtgtataatgttggtgt

SEQ ID NO: 5436233 - DNA, 13 bp, Homo sapiens
gtgtatacagaaa

SEQ ID NO: 5436234 - DNA, 18 bp, Homo sapiens
gtgtatacatatgtatgt

SEQ ID NO: 5436235 - DNA, 22 bp, Homo sapiens
gtgtatacatgtgtgggtgctg

SEQ ID NO: 5436236 - DNA, 13 bp, Homo sapiens
gtgtatactgtaa

SEQ ID NO: 5436237 - DNA, 22 bp, Homo sapiens
gtgtatagaagcgatttaagtt

SEQ ID NO: 5436238 - DNA, 18 bp, Homo sapiens
gtgtatagaagtagatta

SEQ ID NO: 5436239 - DNA, 13 bp, Homo sapiens
gtgtataggaatt

SEQ ID NO: 5436240 - DNA, 21 bp, Homo sapiens
gtgtatagtgttcacaaactg

SEQ ID NO: 5436241 - DNA, 15 bp, Homo sapiens
gtgtatataatttta

SEQ ID NO: 5436242 - DNA, 15 bp, Homo sapiens
gtgtatataattttt

SEQ ID NO: 5436243 - DNA, 13 bp, Homo sapiens
gtgtatatataca

SEQ ID NO: 5436244 - DNA, 14 bp, Homo sapiens
gtgtatatatacat

SEQ ID NO: 5436245 - DNA, 12 bp, Homo sapiens
gtgtatatatat

SEQ ID NO: 5436246 - DNA, 18 bp, Homo sapiens
gtgtatatatgtgtatat

SEQ ID NO: 5436247 - DNA, 22 bp, Homo sapiens
gtgtatatatgtgtatatatac

SEQ ID NO: 5436248 - DNA, 21 bp, Homo sapiens
gtgtatatatgtgtgccctgg

SEQ ID NO: 5436249 - DNA, 13 bp, Homo sapiens
gtgtatatcagaa

SEQ ID NO: 5436250 - DNA, 22 bp, Homo sapiens
gtgtatatgaggatgtatgtgt

SEQ ID NO: 5436251 - DNA, 21 bp, Homo sapiens
gtgtatattatataactcttt

SEQ ID NO: 5436252 - DNA, 21 bp, Homo sapiens
gtgtatattatcttctggtgc

SEQ ID NO: 5436253 - DNA, 16 bp, Homo sapiens
gtgtatattatttggc

SEQ ID NO: 5436254 - DNA, 15 bp, Homo sapiens
gtgtatattcctttt

SEQ ID NO: 5436255 - DNA, 21 bp, Homo sapiens
gtgtatattccttttaaagaa

SEQ ID NO: 5436256 - DNA, 14 bp, Homo sapiens
gtgtatatttgatt

SEQ ID NO: 5436257 - DNA, 17 bp, Homo sapiens
gtgtatatttgatttat

SEQ ID NO: 5436258 - DNA, 14 bp, Homo sapiens
gtgtatatttgctt

SEQ ID NO: 5436259 - DNA, 14 bp, Homo sapiens
gtgtatattttaat

SEQ ID NO: 5436260 - DNA, 22 bp, Homo sapiens
gtgtatcaggtcagggacttgg

SEQ ID NO: 5436261 - DNA, 14 bp, Homo sapiens
gtgtatcagtgttt

SEQ ID NO: 5436262 - DNA, 19 bp, Homo sapiens
gtgtatcagtgtttatgtg

SEQ ID NO: 5436263 - DNA, 15 bp, Homo sapiens
gtgtatcattaaaat

SEQ ID NO: 5436264 - DNA, 20 bp, Homo sapiens
gtgtatcctggccctggggg

SEQ ID NO: 5436265 - DNA, 15 bp, Homo sapiens
gtgtatcctggggct

SEQ ID NO: 5436266 - DNA, 18 bp, Homo sapiens
gtgtatgagagagagaaa

SEQ ID NO: 5436267 - DNA, 14 bp, Homo sapiens
gtgtatgatccaag

SEQ ID NO: 5436268 - DNA, 22 bp, Homo sapiens
gtgtatgcaagtgggagatgaa

SEQ ID NO: 5436269 - DNA, 13 bp, Homo sapiens
gtgtatgcacagg

SEQ ID NO: 5436270 - DNA, 16 bp, Homo sapiens
gtgtgctttttttgtg

SEQ ID NO: 5436271 - DNA, 19 bp, Homo sapiens
gtgtggaaattaagaagaa

SEQ ID NO: 5436272 - DNA, 18 bp, Homo sapiens
gtgtggaaccacctgatg

SEQ ID NO: 5436273 - DNA, 13 bp, Homo sapiens
gtgtggaatcacc

SEQ ID NO: 5436274 - DNA, 16 bp, Homo sapiens
gtgtggacccccaccc

SEQ ID NO: 5436275 - DNA, 20 bp, Homo sapiens
gtgtggacccccaccctgca

SEQ ID NO: 5436276 - DNA, 18 bp, Homo sapiens
gtgtggaccggccgcagc

SEQ ID NO: 5436277 - DNA, 22 bp, Homo sapiens
gtgtggaccggccgcagccccc

SEQ ID NO: 5436278 - DNA, 21 bp, Homo sapiens
gtgtggactgtggcacttgcc

SEQ ID NO: 5436279 - DNA, 23 bp, Homo sapiens
gtgtggagaagccacaggcctga

SEQ ID NO: 5436280 - DNA, 13 bp, Homo sapiens
gtgtggagaagcg

SEQ ID NO: 5436281 - DNA, 18 bp, Homo sapiens
gtgtggagaagtgtgttc

SEQ ID NO: 5436282 - DNA, 19 bp, Homo sapiens
gtgtggagaccaggctcct

SEQ ID NO: 5436283 - DNA, 18 bp, Homo sapiens
gtgtggagagggaatgtg

SEQ ID NO: 5436284 - DNA, 18 bp, Homo sapiens
gtgtggaggcctcaggga

SEQ ID NO: 5436285 - DNA, 16 bp, Homo sapiens
gtgtggaggctcctgt

SEQ ID NO: 5436286 - DNA, 22 bp, Homo sapiens
gtgtggagggagtgagccagca

SEQ ID NO: 5436287 - DNA, 13 bp, Homo sapiens
gtgtggagtattt

SEQ ID NO: 5436288 - DNA, 17 bp, Homo sapiens
gtgtggagtcatttctg

SEQ ID NO: 5436289 - DNA, 17 bp, Homo sapiens
gtgtggagtggaggggt

SEQ ID NO: 5436290 - DNA, 18 bp, Homo sapiens
gtgtggatccaatgttag

SEQ ID NO: 5436291 - DNA, 22 bp, Homo sapiens
gtgtggatcttgccacatttct

SEQ ID NO: 5436292 - DNA, 19 bp, Homo sapiens
gtgtggattgcctctgaaa

SEQ ID NO: 5436293 - DNA, 14 bp, Homo sapiens
gtgtggcaaacatt

SEQ ID NO: 5436294 - DNA, 15 bp, Homo sapiens
gtgtggcaaacattt

SEQ ID NO: 5436295 - DNA, 15 bp, Homo sapiens
gtgtggcagagagag

SEQ ID NO: 5436296 - DNA, 13 bp, Homo sapiens
gtgtggcagcagg

SEQ ID NO: 5436297 - DNA, 14 bp, Homo sapiens
gtgtggcagcaggc

SEQ ID NO: 5436298 - DNA, 13 bp, Homo sapiens
gtgtggcatttgg

SEQ ID NO: 5436299 - DNA, 17 bp, Homo sapiens
gtgtggccaaccaggac

SEQ ID NO: 5436300 - DNA, 18 bp, Homo sapiens
gtgtggccaaccaggacc

SEQ ID NO: 5436301 - DNA, 22 bp, Homo sapiens
gtgtggccaaccaggacccagg

SEQ ID NO: 5436302 - DNA, 15 bp, Homo sapiens
gtgtggccagcagcc

SEQ ID NO: 5436303 - DNA, 13 bp, Homo sapiens
gtgtggccaggct

SEQ ID NO: 5436304 - DNA, 20 bp, Homo sapiens
gtgtggccatcactcagccc

SEQ ID NO: 5436305 - DNA, 19 bp, Homo sapiens
gtgtggccccgcccgagcc

SEQ ID NO: 5436306 - DNA, 15 bp, Homo sapiens
gtgtggccccttcac

SEQ ID NO: 5436307 - DNA, 15 bp, Homo sapiens
gtgtggcccgtggcc

SEQ ID NO: 5436308 - DNA, 18 bp, Homo sapiens
gtgtggccgcctggcagg

SEQ ID NO: 5436309 - DNA, 19 bp, Homo sapiens
gtgtggccgcctggcaggt

SEQ ID NO: 5436310 - DNA, 20 bp, Homo sapiens
gtgtggccgcctggcaggtg

SEQ ID NO: 5436311 - DNA, 20 bp, Homo sapiens
gtgtggcctaatccacctgg

SEQ ID NO: 5436312 - DNA, 12 bp, Homo sapiens
gtgtggcctcag

SEQ ID NO: 5436313 - DNA, 13 bp, Homo sapiens
gtgtggcctcagc

SEQ ID NO: 5436314 - DNA, 16 bp, Homo sapiens
gtgtggcctcagccct

SEQ ID NO: 5436315 - DNA, 21 bp, Homo sapiens
gtgtggcctcagccctcagaa

SEQ ID NO: 5436316 - DNA, 17 bp, Homo sapiens
gtgtggcctccgtcctg

SEQ ID NO: 5436317 - DNA, 13 bp, Homo sapiens
gtgtggcctgggt

SEQ ID NO: 5436318 - DNA, 18 bp, Homo sapiens
gtgtggcctggtgggtca

SEQ ID NO: 5436319 - DNA, 22 bp, Homo sapiens
gtgtggcgggaagggtgggccc

SEQ ID NO: 5436320 - DNA, 15 bp, Homo sapiens
gtgtggcgtggcccg

SEQ ID NO: 5436321 - DNA, 15 bp, Homo sapiens
gtgtggctcccacag

SEQ ID NO: 5436322 - DNA, 16 bp, Homo sapiens
gtgtggctcccacagg

SEQ ID NO: 5436323 - DNA, 11 bp, Homo sapiens
gtgtggctcct

SEQ ID NO: 5436324 - DNA, 14 bp, Homo sapiens
gtgtggctcctggt

SEQ ID NO: 5436325 - DNA, 14 bp, Homo sapiens
gtgtggctccttcc

SEQ ID NO: 5436326 - DNA, 14 bp, Homo sapiens
gtgtggctgggacc

SEQ ID NO: 5436327 - DNA, 15 bp, Homo sapiens
gtgtggctgggacct

SEQ ID NO: 5436328 - DNA, 13 bp, Homo sapiens
gtgtggctggtgt

SEQ ID NO: 5436329 - DNA, 14 bp, Homo sapiens
gtgtggctgtattc

SEQ ID NO: 5436330 - DNA, 15 bp, Homo sapiens
gtgtggctgtattca

SEQ ID NO: 5436331 - DNA, 13 bp, Homo sapiens
gtgtggctgtgcc

SEQ ID NO: 5436332 - DNA, 17 bp, Homo sapiens
gtgtggcttaaacattt

SEQ ID NO: 5436333 - DNA, 11 bp, Homo sapiens
gtgtggctttc

SEQ ID NO: 5436334 - DNA, 12 bp, Homo sapiens
gtgtgggaaagc

SEQ ID NO: 5436335 - DNA, 16 bp, Homo sapiens
gtgtgggaaagggacc

SEQ ID NO: 5436336 - DNA, 16 bp, Homo sapiens
gtgtgggaagggagag

SEQ ID NO: 5436337 - DNA, 18 bp, Homo sapiens
gtgtgggacacctgggag

SEQ ID NO: 5436338 - DNA, 14 bp, Homo sapiens
gtgtgggacaggct

SEQ ID NO: 5436339 - DNA, 20 bp, Homo sapiens
gtgtgggacaggctcttctt

SEQ ID NO: 5436340 - DNA, 15 bp, Homo sapiens
gtgtgggactgtaca

SEQ ID NO: 5436341 - DNA, 12 bp, Homo sapiens
gtgtgggagggc

SEQ ID NO: 5436342 - DNA, 13 bp, Homo sapiens
gtgtgggagggcg

SEQ ID NO: 5436343 - DNA, 20 bp, Homo sapiens
gtgtgggagggcgaggcggg

SEQ ID NO: 5436344 - DNA, 15 bp, Homo sapiens
gtgtgggatacttag

SEQ ID NO: 5436345 - DNA, 22 bp, Homo sapiens
gtgtgggccaccgtgcctggct

SEQ ID NO: 5436346 - DNA, 21 bp, Homo sapiens
gtgtgggccgtggcttgggct

SEQ ID NO: 5436347 - DNA, 13 bp, Homo sapiens
gtgtgggctgcag

SEQ ID NO: 5436348 - DNA, 22 bp, Homo sapiens
gtgtgggctgcccttgttgcct

SEQ ID NO: 5436349 - DNA, 15 bp, Homo sapiens
gtgtggggagggtgg

SEQ ID NO: 5436350 - DNA, 13 bp, Homo sapiens
gtgtgggggagat

SEQ ID NO: 5436351 - DNA, 20 bp, Homo sapiens
gtgtgggggagattctgggt

SEQ ID NO: 5436352 - DNA, 19 bp, Homo sapiens
gtgtgggggccccgtctca

SEQ ID NO: 5436353 - DNA, 16 bp, Homo sapiens
gtgtgggggctgcagc

SEQ ID NO: 5436354 - DNA, 18 bp, Homo sapiens
gtgtggggggacagacag

SEQ ID NO: 5436355 - DNA, 17 bp, Homo sapiens
gtgtggggggctggggg

SEQ ID NO: 5436356 - DNA, 17 bp, Homo sapiens
gtgtgggggtctgggag

SEQ ID NO: 5436357 - DNA, 21 bp, Homo sapiens
gtgtgggggtctgggaggcag

SEQ ID NO: 5436358 - DNA, 14 bp, Homo sapiens
gtgtggggtggggt

SEQ ID NO: 5436359 - DNA, 16 bp, Homo sapiens
gtgtgggtacctgtat

SEQ ID NO: 5436360 - DNA, 17 bp, Homo sapiens
gtgtgggtacctgtatt

SEQ ID NO: 5436361 - DNA, 18 bp, Homo sapiens
gtgtgggtctggggaggg

SEQ ID NO: 5436362 - DNA, 14 bp, Homo sapiens
gtgtgggtctgtgt

SEQ ID NO: 5436363 - DNA, 23 bp, Homo sapiens
gtgtgggtgatgggactcattgt

SEQ ID NO: 5436364 - DNA, 23 bp, Homo sapiens
gtgtgggtgccagtcctcctcag

SEQ ID NO: 5436365 - DNA, 16 bp, Homo sapiens
gtgtgggtgccctgtt

SEQ ID NO: 5436366 - DNA, 14 bp, Homo sapiens
gtgtgggtgtcctg

SEQ ID NO: 5436367 - DNA, 13 bp, Homo sapiens
gtgtgggtgtgtg

SEQ ID NO: 5436368 - DNA, 14 bp, Homo sapiens
gtgtgggtgtgtgc

SEQ ID NO: 5436369 - DNA, 21 bp, Homo sapiens
gtgtggtaccttcagccctgg

SEQ ID NO: 5436370 - DNA, 20 bp, Homo sapiens
gtgtggtatgagggggtggt

SEQ ID NO: 5436371 - DNA, 14 bp, Homo sapiens
gtgtggtccatgcc

SEQ ID NO: 5436372 - DNA, 15 bp, Homo sapiens
gtgtggtccatgccc

SEQ ID NO: 5436373 - DNA, 20 bp, Homo sapiens
gtgtggtccatgcccactgc

SEQ ID NO: 5436374 - DNA, 13 bp, Homo sapiens
gtgtggtccctcc

SEQ ID NO: 5436375 - DNA, 23 bp, Homo sapiens
gtgtggtctctgccccagcctgt

SEQ ID NO: 5436376 - DNA, 20 bp, Homo sapiens
gtgtggtggagccagggcct

SEQ ID NO: 5436377 - DNA, 12 bp, Homo sapiens
gtgtggtggcct

SEQ ID NO: 5436378 - DNA, 15 bp, Homo sapiens
gtgtggtggcctcag

SEQ ID NO: 5436379 - DNA, 16 bp, Homo sapiens
gtgtggtggcctcagc

SEQ ID NO: 5436380 - DNA, 23 bp, Homo sapiens
gtgtggtggcgttatggcagccc

SEQ ID NO: 5436381 - DNA, 22 bp, Homo sapiens
gtgtggtgtcaccagcctgttt

SEQ ID NO: 5436382 - DNA, 21 bp, Homo sapiens
gtgtggtgttagggtgcagcc

SEQ ID NO: 5436383 - DNA, 15 bp, Homo sapiens
gtgtggtgtttcctg

SEQ ID NO: 5436384 - DNA, 15 bp, Homo sapiens
gtgtggttatgaact

SEQ ID NO: 5436385 - DNA, 18 bp, Homo sapiens
gtgtggttgctcacagct

SEQ ID NO: 5436386 - DNA, 14 bp, Homo sapiens
gtgtggttggaaaa

SEQ ID NO: 5436387 - DNA, 17 bp, Homo sapiens
gtgtggtttagtgtaaa

SEQ ID NO: 5436388 - DNA, 13 bp, Homo sapiens
gtgtgtaaagtaa

SEQ ID NO: 5436389 - DNA, 11 bp, Homo sapiens
gtgtgtaaata

SEQ ID NO: 5436390 - DNA, 15 bp, Homo sapiens
gtgtgtaagctgact

SEQ ID NO: 5436391 - DNA, 20 bp, Homo sapiens
gtgtgtacaaatacatgtgt

SEQ ID NO: 5436392 - DNA, 16 bp, Homo sapiens
gtgtgtaccacaccct

SEQ ID NO: 5436393 - DNA, 17 bp, Homo sapiens
gtgtgtaccacaccctg

SEQ ID NO: 5436394 - DNA, 19 bp, Homo sapiens
gtgtgtagacaaatatttg

SEQ ID NO: 5436395 - DNA, 13 bp, Homo sapiens
gtgtgtagagtta

SEQ ID NO: 5436396 - DNA, 16 bp, Homo sapiens
gtgtgtagatagtatg

SEQ ID NO: 5436397 - DNA, 16 bp, Homo sapiens
gtgtgtagccaggaag

SEQ ID NO: 5436398 - DNA, 13 bp, Homo sapiens
gtgtgtatatatt

SEQ ID NO: 5436399 - DNA, 20 bp, Homo sapiens
gtgtgtatatttgtaatata

SEQ ID NO: 5436400 - DNA, 18 bp, Homo sapiens
gtgtgtatcaccctcagc

SEQ ID NO: 5436401 - DNA, 21 bp, Homo sapiens
gtgtgtatgactaaagagaga

SEQ ID NO: 5436402 - DNA, 18 bp, Homo sapiens
gtgtgtatgcgtgtgtgt

SEQ ID NO: 5436403 - DNA, 15 bp, Homo sapiens
gtgtgtatgctgctt

SEQ ID NO: 5436404 - DNA, 23 bp, Homo sapiens
gtgtgtatgtctatgtgtatata

SEQ ID NO: 5436405 - DNA, 23 bp, Homo sapiens
gtgtgtatgtgtgtttctgtcct

SEQ ID NO: 5436406 - DNA, 22 bp, Homo sapiens
gtgtgtattcagaggcagtgat

SEQ ID NO: 5436407 - DNA, 14 bp, Homo sapiens
gtgtgtattcttaa

SEQ ID NO: 5436408 - DNA, 15 bp, Homo sapiens
gtgtgtattgttccc

SEQ ID NO: 5436409 - DNA, 14 bp, Homo sapiens
gtgtgtatttctaa

SEQ ID NO: 5436410 - DNA, 15 bp, Homo sapiens
gtgtgtatttctaag

SEQ ID NO: 5436411 - DNA, 15 bp, Homo sapiens
gtgtgtatttgctaa

SEQ ID NO: 5436412 - DNA, 12 bp, Homo sapiens
gtgtgtatttgt

SEQ ID NO: 5436413 - DNA, 21 bp, Homo sapiens
gtgtgtcacaaagctaaatac

SEQ ID NO: 5436414 - DNA, 18 bp, Homo sapiens
gtgtgtcacactgagctg

SEQ ID NO: 5436415 - DNA, 20 bp, Homo sapiens
gtgtgtcagacgagcagtga

SEQ ID NO: 5436416 - DNA, 13 bp, Homo sapiens
gtgtgtcagagcc

SEQ ID NO: 5436417 - DNA, 17 bp, Homo sapiens
gtgtgtcagagcccagg

SEQ ID NO: 5436418 - DNA, 20 bp, Homo sapiens
gtgtgtcagagcccagggga

SEQ ID NO: 5436419 - DNA, 20 bp, Homo sapiens
gtgtgtcagcccatgtcaat

SEQ ID NO: 5436420 - DNA, 14 bp, Homo sapiens
gtgtgtcaggccct

SEQ ID NO: 5436421 - DNA, 18 bp, Homo sapiens
gtgtgtcaggccctctgc

SEQ ID NO: 5436422 - DNA, 21 bp, Homo sapiens
gtgtgtcaggccctctgcctg

SEQ ID NO: 5436423 - DNA, 22 bp, Homo sapiens
gtgtgtcaggccctctgcctgc

SEQ ID NO: 5436424 - DNA, 16 bp, Homo sapiens
gtgtgtcagggatgag

SEQ ID NO: 5436425 - DNA, 18 bp, Homo sapiens
gtgtgtccaaaactgcct

SEQ ID NO: 5436426 - DNA, 20 bp, Homo sapiens
gtgtgtccacgactgtctcc

SEQ ID NO: 5436427 - DNA, 17 bp, Homo sapiens
gtgtgtccaggctctgg

SEQ ID NO: 5436428 - DNA, 22 bp, Homo sapiens
gtgtgtccaggctctgggcaca

SEQ ID NO: 5436429 - DNA, 23 bp, Homo sapiens
gtgtgtccaggctctgggcacag

SEQ ID NO: 5436430 - DNA, 14 bp, Homo sapiens
gtgtgtcccaggca

SEQ ID NO: 5436431 - DNA, 18 bp, Homo sapiens
gtgtgtccctggacacag

SEQ ID NO: 5436432 - DNA, 23 bp, Homo sapiens
gtgtgtccctggacacagctctt

SEQ ID NO: 5436433 - DNA, 11 bp, Homo sapiens
gtgtgtccttg

SEQ ID NO: 5436434 - DNA, 20 bp, Homo sapiens
gtgtgtccttggggcacagt

SEQ ID NO: 5436435 - DNA, 18 bp, Homo sapiens
gtgtgtccttgtgcatga

SEQ ID NO: 5436436 - DNA, 22 bp, Homo sapiens
gtgtgtctccatgcacatgcac

SEQ ID NO: 5436437 - DNA, 13 bp, Homo sapiens
gtgtgtctgctga

SEQ ID NO: 5436438 - DNA, 13 bp, Homo sapiens
gtgtgtctgggat

SEQ ID NO: 5436439 - DNA, 14 bp, Homo sapiens
gtgtgtctggtggg

SEQ ID NO: 5436440 - DNA, 17 bp, Homo sapiens
gtgtgtctgtctttgtg

SEQ ID NO: 5436441 - DNA, 18 bp, Homo sapiens
gtgtgtctgtctttgtgg

SEQ ID NO: 5436442 - DNA, 19 bp, Homo sapiens
gtgtgtctgtgcgtctgtg

SEQ ID NO: 5436443 - DNA, 18 bp, Homo sapiens
gtgtgtctgttgagtgca

SEQ ID NO: 5436444 - DNA, 21 bp, Homo sapiens
gtgtgtcttaattattatttg

SEQ ID NO: 5436445 - DNA, 14 bp, Homo sapiens
gtgtgtgaaaggaa

SEQ ID NO: 5436446 - DNA, 17 bp, Homo sapiens
gtgtgtgaatgaacact

SEQ ID NO: 5436447 - DNA, 21 bp, Homo sapiens
gtgtgtgagtgggaggagagg

SEQ ID NO: 5436448 - DNA, 22 bp, Homo sapiens
gtgtgtgagtgtgagtgtgaga

SEQ ID NO: 5436449 - DNA, 11 bp, Homo sapiens
gtgttttgctt

SEQ ID NO: 5436450 - DNA, 13 bp, Homo sapiens
gtgttttgctttt

SEQ ID NO: 5436451 - DNA, 13 bp, Homo sapiens
gtgttttgggttt

SEQ ID NO: 5436452 - DNA, 12 bp, Homo sapiens
gtgttttggtcc

SEQ ID NO: 5436453 - DNA, 14 bp, Homo sapiens
gtgttttgtaccag

SEQ ID NO: 5436454 - DNA, 14 bp, Homo sapiens
gtgttttgtccaaa

SEQ ID NO: 5436455 - DNA, 19 bp, Homo sapiens
gtgttttgtcctgcctctt

SEQ ID NO: 5436456 - DNA, 21 bp, Homo sapiens
gtgttttgttcaccattataa

SEQ ID NO: 5436457 - DNA, 16 bp, Homo sapiens
gtgttttgtttattaa

SEQ ID NO: 5436458 - DNA, 18 bp, Homo sapiens
gtgttttgttttttaagg

SEQ ID NO: 5436459 - DNA, 17 bp, Homo sapiens
gtgtttttaaattttgt

SEQ ID NO: 5436460 - DNA, 15 bp, Homo sapiens
gtgtttttaactcaa

SEQ ID NO: 5436461 - DNA, 15 bp, Homo sapiens
gtgtttttcatttct

SEQ ID NO: 5436462 - DNA, 14 bp, Homo sapiens
gtgtttttctatta

SEQ ID NO: 5436463 - DNA, 19 bp, Homo sapiens
gtgtttttctattaaaaga

SEQ ID NO: 5436464 - DNA, 13 bp, Homo sapiens
gtgtttttctcca

SEQ ID NO: 5436465 - DNA, 21 bp, Homo sapiens
gtgtttttctctctggaccct

SEQ ID NO: 5436466 - DNA, 20 bp, Homo sapiens
gtgtttttgaaacccacagt

SEQ ID NO: 5436467 - DNA, 14 bp, Homo sapiens
gtgtttttgggaag

SEQ ID NO: 5436468 - DNA, 19 bp, Homo sapiens
gtgtttttggttttctcct

SEQ ID NO: 5436469 - DNA, 21 bp, Homo sapiens
gtgtttttgtaaagtgtggtc

SEQ ID NO: 5436470 - DNA, 17 bp, Homo sapiens
gtgttttttaaaaaagc

SEQ ID NO: 5436471 - DNA, 13 bp, Homo sapiens
gtgttttttaaga

SEQ ID NO: 5436472 - DNA, 14 bp, Homo sapiens
gtgttttttaagat

SEQ ID NO: 5436473 - DNA, 23 bp, Homo sapiens
gtgttttttctttttttttaagt

SEQ ID NO: 5436474 - DNA, 15 bp, Homo sapiens
gtgttttttgttact

SEQ ID NO: 5436475 - DNA, 16 bp, Homo sapiens
gtgttttttgttactg

SEQ ID NO: 5436476 - DNA, 17 bp, Homo sapiens
gtgttttttgttactgt

SEQ ID NO: 5436477 - DNA, 19 bp, Homo sapiens
gtgtttttttaatttctaa

SEQ ID NO: 5436478 - DNA, 19 bp, Homo sapiens
gtgttttttttaagggcat

SEQ ID NO: 5436479 - DNA, 21 bp, Homo sapiens
gtgttttttttcctttgccgt

SEQ ID NO: 5436480 - DNA, 21 bp, Homo sapiens
gttaaaaaaaaaaaaaggaaa

SEQ ID NO: 5436481 - DNA, 19 bp, Homo sapiens
gttaaaaaaaataataaat

SEQ ID NO: 5436482 - DNA, 13 bp, Homo sapiens
gttaaaaaaataa

SEQ ID NO: 5436483 - DNA, 22 bp, Homo sapiens
gttaaaaaagaaatctgtttca

SEQ ID NO: 5436484 - DNA, 14 bp, Homo sapiens
gttaaaaacctgcc

SEQ ID NO: 5436485 - DNA, 14 bp, Homo sapiens
gttaaaaagaaaag

SEQ ID NO: 5436486 - DNA, 14 bp, Homo sapiens
gttaaaaaggccaa

SEQ ID NO: 5436487 - DNA, 15 bp, Homo sapiens
gttaaaaaggccaaa

SEQ ID NO: 5436488 - DNA, 23 bp, Homo sapiens
gttaaaaataaaaactaatttca

SEQ ID NO: 5436489 - DNA, 17 bp, Homo sapiens
gttaaaaatcagctggg

SEQ ID NO: 5436490 - DNA, 20 bp, Homo sapiens
gttaaaacaaattaaaaaca

SEQ ID NO: 5436491 - DNA, 23 bp, Homo sapiens
gttaaaacaaccagttaaagcca

SEQ ID NO: 5436492 - DNA, 17 bp, Homo sapiens
gttaaaacataaacaca

SEQ ID NO: 5436493 - DNA, 15 bp, Homo sapiens
gttaaaacatcaaaa

SEQ ID NO: 5436494 - DNA, 20 bp, Homo sapiens
gttaaaagactgcagctgct

SEQ ID NO: 5436495 - DNA, 14 bp, Homo sapiens
gttaaaagatgaaa

SEQ ID NO: 5436496 - DNA, 16 bp, Homo sapiens
gttaaaagatgaaaat

SEQ ID NO: 5436497 - DNA, 17 bp, Homo sapiens
gttaaaagatggttgta

SEQ ID NO: 5436498 - DNA, 23 bp, Homo sapiens
gttaaaagggaacacaaaacatt

SEQ ID NO: 5436499 - DNA, 15 bp, Homo sapiens
gttaaaagtgtacaa

SEQ ID NO: 5436500 - DNA, 13 bp, Homo sapiens
gttaaaataaagc

SEQ ID NO: 5436501 - DNA, 15 bp, Homo sapiens
gttaaaataaagcct

SEQ ID NO: 5436502 - DNA, 21 bp, Homo sapiens
gttaaaataactagtgttgct

SEQ ID NO: 5436503 - DNA, 19 bp, Homo sapiens
gttaaaatgtgaggaagaa

SEQ ID NO: 5436504 - DNA, 14 bp, Homo sapiens
gttaaaatgtttac

SEQ ID NO: 5436505 - DNA, 13 bp, Homo sapiens
gttaaaattatac

SEQ ID NO: 5436506 - DNA, 17 bp, Homo sapiens
gttaaacaaaatgaaaa

SEQ ID NO: 5436507 - DNA, 18 bp, Homo sapiens
gttaaacaaatgatttcc

SEQ ID NO: 5436508 - DNA, 12 bp, Homo sapiens
gttaaacagaga

SEQ ID NO: 5436509 - DNA, 12 bp, Homo sapiens
gttaaacagtag

SEQ ID NO: 5436510 - DNA, 23 bp, Homo sapiens
gttaaacagtagttgtattcttc

SEQ ID NO: 5436511 - DNA, 23 bp, Homo sapiens
gttaaacggtgcccatcctgcca

SEQ ID NO: 5436512 - DNA, 19 bp, Homo sapiens
gttaaactagcatatctgc

SEQ ID NO: 5436513 - DNA, 19 bp, Homo sapiens
gttaaactattagagtatt

SEQ ID NO: 5436514 - DNA, 15 bp, Homo sapiens
gttaaactgattagt

SEQ ID NO: 5436515 - DNA, 15 bp, Homo sapiens
gttaaagaaaggaaa

SEQ ID NO: 5436516 - DNA, 17 bp, Homo sapiens
gttaaagagacaaatag

SEQ ID NO: 5436517 - DNA, 21 bp, Homo sapiens
gttaaagaggagaaggaaaac

SEQ ID NO: 5436518 - DNA, 16 bp, Homo sapiens
gttaaagatgtagcaa

SEQ ID NO: 5436519 - DNA, 14 bp, Homo sapiens
gttaaagctaaact

SEQ ID NO: 5436520 - DNA, 15 bp, Homo sapiens
gttaaagctgccggc

SEQ ID NO: 5436521 - DNA, 20 bp, Homo sapiens
gttaaagctggaacatttga

SEQ ID NO: 5436522 - DNA, 15 bp, Homo sapiens
gttaaagctgtacac

SEQ ID NO: 5436523 - DNA, 20 bp, Homo sapiens
gttaaagcttatttttatgt

SEQ ID NO: 5436524 - DNA, 13 bp, Homo sapiens
gttaaaggaaaaa

SEQ ID NO: 5436525 - DNA, 19 bp, Homo sapiens
gttaaaggcagtccagagc

SEQ ID NO: 5436526 - DNA, 21 bp, Homo sapiens
gttaaagggaagaaaacactg

SEQ ID NO: 5436527 - DNA, 18 bp, Homo sapiens
gttaaataaatagaaaga

SEQ ID NO: 5436528 - DNA, 13 bp, Homo sapiens
gttaaataaattg

SEQ ID NO: 5436529 - DNA, 20 bp, Homo sapiens
gttaaataagcaaataaaca

SEQ ID NO: 5436530 - DNA, 16 bp, Homo sapiens
gttaaatacaggaaac

SEQ ID NO: 5436531 - DNA, 15 bp, Homo sapiens
gttaaatactgtgca

SEQ ID NO: 5436532 - DNA, 17 bp, Homo sapiens
gttaaatactgtgcaga

SEQ ID NO: 5436533 - DNA, 20 bp, Homo sapiens
gttaaatactgtgtggaact

SEQ ID NO: 5436534 - DNA, 19 bp, Homo sapiens
gttaaatagagtatatgca

SEQ ID NO: 5436535 - DNA, 20 bp, Homo sapiens
gttaaatagagtatatgcac

SEQ ID NO: 5436536 - DNA, 21 bp, Homo sapiens
gttaaatagagtatatgcact

SEQ ID NO: 5436537 - DNA, 16 bp, Homo sapiens
gttaaatatataaaca

SEQ ID NO: 5436538 - DNA, 15 bp, Homo sapiens
gttaaatatgtagat

SEQ ID NO: 5436539 - DNA, 17 bp, Homo sapiens
gttaaatattttgctaa

SEQ ID NO: 5436540 - DNA, 13 bp, Homo sapiens
gttaaatcatttg

SEQ ID NO: 5436541 - DNA, 21 bp, Homo sapiens
gttaaatgacttgattgtact

SEQ ID NO: 5436542 - DNA, 16 bp, Homo sapiens
gttaaatgctatggaa

SEQ ID NO: 5436543 - DNA, 18 bp, Homo sapiens
gttaaatgctatggaaat

SEQ ID NO: 5436544 - DNA, 23 bp, Homo sapiens
gttaaatgctatggaaatacatt

SEQ ID NO: 5436545 - DNA, 18 bp, Homo sapiens
gttaaatgtaatataatg

SEQ ID NO: 5436546 - DNA, 12 bp, Homo sapiens
gttaaatgtaga

SEQ ID NO: 5436547 - DNA, 18 bp, Homo sapiens
gttaaatgtttacaagta

SEQ ID NO: 5436548 - DNA, 13 bp, Homo sapiens
gttaaatgttttg

SEQ ID NO: 5436549 - DNA, 23 bp, Homo sapiens
gttaaatgttttgtaaactttga

SEQ ID NO: 5436550 - DNA, 14 bp, Homo sapiens
gttaaattcagtaa

SEQ ID NO: 5436551 - DNA, 15 bp, Homo sapiens
gttaaatttgtaagt

SEQ ID NO: 5436552 - DNA, 22 bp, Homo sapiens
gttaaattttctctaaactgtt

SEQ ID NO: 5436553 - DNA, 12 bp, Homo sapiens
gttaacaaatga

SEQ ID NO: 5436554 - DNA, 13 bp, Homo sapiens
gttaacaaatgag

SEQ ID NO: 5436555 - DNA, 14 bp, Homo sapiens
gttaacaaatgagc

SEQ ID NO: 5436556 - DNA, 23 bp, Homo sapiens
gttaacaaggaatgcctgtgcca

SEQ ID NO: 5436557 - DNA, 18 bp, Homo sapiens
gttaacaataaagtgaca

SEQ ID NO: 5436558 - DNA, 19 bp, Homo sapiens
gttaacaatgcctattgta

SEQ ID NO: 5436559 - DNA, 21 bp, Homo sapiens
gttaacacactaccgaatgtg

SEQ ID NO: 5436560 - DNA, 22 bp, Homo sapiens
gttaacacatcaaatatttctt

SEQ ID NO: 5436561 - DNA, 19 bp, Homo sapiens
gttaacacatggcttccta

SEQ ID NO: 5436562 - DNA, 15 bp, Homo sapiens
gttaacacattttgt

SEQ ID NO: 5436563 - DNA, 22 bp, Homo sapiens
gttaacactgctaatgaaagaa

SEQ ID NO: 5436564 - DNA, 20 bp, Homo sapiens
gttaacagaagggagggcag

SEQ ID NO: 5436565 - DNA, 23 bp, Homo sapiens
gttaacagaagggagggcagagc

SEQ ID NO: 5436566 - DNA, 13 bp, Homo sapiens
gttaacagagcaa

SEQ ID NO: 5436567 - DNA, 12 bp, Homo sapiens
gttaacagattt

SEQ ID NO: 5436568 - DNA, 14 bp, Homo sapiens
gttaacaggacagt

SEQ ID NO: 5436569 - DNA, 15 bp, Homo sapiens
gttaacatcagtttt

SEQ ID NO: 5436570 - DNA, 19 bp, Homo sapiens
gttaacattttttttgttt

SEQ ID NO: 5436571 - DNA, 15 bp, Homo sapiens
gttaaccatttaagt

SEQ ID NO: 5436572 - DNA, 17 bp, Homo sapiens
gttaacccattccagta

SEQ ID NO: 5436573 - DNA, 23 bp, Homo sapiens
gttaacccatttttgagccaagc

SEQ ID NO: 5436574 - DNA, 18 bp, Homo sapiens
gttaaccgggactacaga

SEQ ID NO: 5436575 - DNA, 17 bp, Homo sapiens
gttaacctcagtgtcat

SEQ ID NO: 5436576 - DNA, 23 bp, Homo sapiens
gttaacctcttatcactaagaaa

SEQ ID NO: 5436577 - DNA, 17 bp, Homo sapiens
gttaacctgcagaaaca

SEQ ID NO: 5436578 - DNA, 16 bp, Homo sapiens
gttaaccttaaataca

SEQ ID NO: 5436579 - DNA, 21 bp, Homo sapiens
gttaaccttgaagtgactgtt

SEQ ID NO: 5436580 - DNA, 20 bp, Homo sapiens
gttaacgtattagttgccaa

SEQ ID NO: 5436581 - DNA, 17 bp, Homo sapiens
gttaactatgacagata

SEQ ID NO: 5436582 - DNA, 18 bp, Homo sapiens
gttaactatgtacaatat

SEQ ID NO: 5436583 - DNA, 21 bp, Homo sapiens
gttaactattttattttctaa

SEQ ID NO: 5436584 - DNA, 20 bp, Homo sapiens
gttaactgaataccactctg

SEQ ID NO: 5436585 - DNA, 23 bp, Homo sapiens
gttaactgaataccactctgtaa

SEQ ID NO: 5436586 - DNA, 18 bp, Homo sapiens
gttaactgtgaaatacca

SEQ ID NO: 5436587 - DNA, 15 bp, Homo sapiens
gttaacttgcctcca

SEQ ID NO: 5436588 - DNA, 15 bp, Homo sapiens
gttaacttggtcaga

SEQ ID NO: 5436589 - DNA, 16 bp, Homo sapiens
gttaacttggtcagag

SEQ ID NO: 5436590 - DNA, 19 bp, Homo sapiens
gttaacttggtcagagcca

SEQ ID NO: 5436591 - DNA, 13 bp, Homo sapiens
gttaactttgggt

SEQ ID NO: 5436592 - DNA, 22 bp, Homo sapiens
gttaactttgtggtctaaagtg

SEQ ID NO: 5436593 - DNA, 16 bp, Homo sapiens
gttaactttttgtagg

SEQ ID NO: 5436594 - DNA, 15 bp, Homo sapiens
gttaagaaagcactt

SEQ ID NO: 5436595 - DNA, 12 bp, Homo sapiens
gttaagaaagga

SEQ ID NO: 5436596 - DNA, 21 bp, Homo sapiens
gttaagaaaggatataaaagg

SEQ ID NO: 5436597 - DNA, 15 bp, Homo sapiens
gttaagaaatttcac

SEQ ID NO: 5436598 - DNA, 17 bp, Homo sapiens
gttaagaagctgttgta

SEQ ID NO: 5436599 - DNA, 19 bp, Homo sapiens
gttaagaagctgttgtaca

SEQ ID NO: 5436600 - DNA, 20 bp, Homo sapiens
gttaagaagctgttgtacat

SEQ ID NO: 5436601 - DNA, 21 bp, Homo sapiens
gttaagaagctgttgtacatt

SEQ ID NO: 5436602 - DNA, 17 bp, Homo sapiens
gttaagaagtttgttat

SEQ ID NO: 5436603 - DNA, 12 bp, Homo sapiens
gttaagaataac

SEQ ID NO: 5436604 - DNA, 14 bp, Homo sapiens
gttaagaataataa

SEQ ID NO: 5436605 - DNA, 21 bp, Homo sapiens
gttaagaataataaaatactt

SEQ ID NO: 5436606 - DNA, 15 bp, Homo sapiens
gttaagaatgtcgat

SEQ ID NO: 5436607 - DNA, 17 bp, Homo sapiens
gttaagacaacaggcat

SEQ ID NO: 5436608 - DNA, 19 bp, Homo sapiens
gttaagacatgatttcctt

SEQ ID NO: 5436609 - DNA, 22 bp, Homo sapiens
gttaagacatgatttccttgaa

SEQ ID NO: 5436610 - DNA, 14 bp, Homo sapiens
gttaagacctggca

SEQ ID NO: 5436611 - DNA, 16 bp, Homo sapiens
gttaagacttgacagt

SEQ ID NO: 5436612 - DNA, 17 bp, Homo sapiens
gttaagacttgacagtg

SEQ ID NO: 5436613 - DNA, 11 bp, Homo sapiens
gttaagagaaa

SEQ ID NO: 5436614 - DNA, 12 bp, Homo sapiens
gttaagagaaac

SEQ ID NO: 5436615 - DNA, 15 bp, Homo sapiens
gttaagagaaacttt

SEQ ID NO: 5436616 - DNA, 22 bp, Homo sapiens
gttaagagaaactttatacatt

SEQ ID NO: 5436617 - DNA, 18 bp, Homo sapiens
gttaagagaaatgagctt

SEQ ID NO: 5436618 - DNA, 15 bp, Homo sapiens
gttaagataacttac

SEQ ID NO: 5436619 - DNA, 14 bp, Homo sapiens
gttaagattcctaa

SEQ ID NO: 5436620 - DNA, 18 bp, Homo sapiens
gttaagcattaccactca

SEQ ID NO: 5436621 - DNA, 19 bp, Homo sapiens
gttaagccccctcctcacc

SEQ ID NO: 5436622 - DNA, 13 bp, Homo sapiens
gttaagctttatt

SEQ ID NO: 5436623 - DNA, 14 bp, Homo sapiens
gttaaggaaactct

SEQ ID NO: 5436624 - DNA, 19 bp, Homo sapiens
gttaaggaaactcttatct

SEQ ID NO: 5436625 - DNA, 22 bp, Homo sapiens
gttaaggaaatgttgagggcaa

SEQ ID NO: 5436626 - DNA, 21 bp, Homo sapiens
gttaaggaagatcctgaagca

SEQ ID NO: 5436627 - DNA, 16 bp, Homo sapiens
gttaggcctggcacag

SEQ ID NO: 5436628 - DNA, 13 bp, Homo sapiens
gttaggcctggct

SEQ ID NO: 5436629 - DNA, 16 bp, Homo sapiens
gttaggctagagacag

SEQ ID NO: 5436630 - DNA, 18 bp, Homo sapiens
gttagggaagagaaacag

SEQ ID NO: 5436631 - DNA, 19 bp, Homo sapiens
gttagggactgaccagcag

SEQ ID NO: 5436632 - DNA, 19 bp, Homo sapiens
gttagggagagagaagcag

SEQ ID NO: 5436633 - DNA, 22 bp, Homo sapiens
gttagggagagagaagcaggca

SEQ ID NO: 5436634 - DNA, 15 bp, Homo sapiens
gttagggcatttttc

SEQ ID NO: 5436635 - DNA, 16 bp, Homo sapiens
gttagggcatttttct

SEQ ID NO: 5436636 - DNA, 20 bp, Homo sapiens
gttagggctgcttttcttaa

SEQ ID NO: 5436637 - DNA, 22 bp, Homo sapiens
gttaggggccttagggcactgg

SEQ ID NO: 5436638 - DNA, 16 bp, Homo sapiens
gttaggggtgggggag

SEQ ID NO: 5436639 - DNA, 17 bp, Homo sapiens
gttagggtcagccattt

SEQ ID NO: 5436640 - DNA, 17 bp, Homo sapiens
gttagggtgtgtgttca

SEQ ID NO: 5436641 - DNA, 21 bp, Homo sapiens
gttagggtgtgtgttcacctt

SEQ ID NO: 5436642 - DNA, 15 bp, Homo sapiens
gttaggtacagagac

SEQ ID NO: 5436643 - DNA, 22 bp, Homo sapiens
gttaggtcctcacttgggggaa

SEQ ID NO: 5436644 - DNA, 17 bp, Homo sapiens
gttaggtgactaaaagg

SEQ ID NO: 5436645 - DNA, 20 bp, Homo sapiens
gttaggtggccgctcctccc

SEQ ID NO: 5436646 - DNA, 16 bp, Homo sapiens
gttaggttataagaaa

SEQ ID NO: 5436647 - DNA, 20 bp, Homo sapiens
gttaggtttaacataaaggt

SEQ ID NO: 5436648 - DNA, 17 bp, Homo sapiens
gttagtaacttttagtg

SEQ ID NO: 5436649 - DNA, 22 bp, Homo sapiens
gttagtaacttttagtggttct

SEQ ID NO: 5436650 - DNA, 13 bp, Homo sapiens
gttagtaatctgt

SEQ ID NO: 5436651 - DNA, 17 bp, Homo sapiens
gttagtaatggcagagc

SEQ ID NO: 5436652 - DNA, 16 bp, Homo sapiens
gttagtataagctttt

SEQ ID NO: 5436653 - DNA, 18 bp, Homo sapiens
gttagtataagcttttca

SEQ ID NO: 5436654 - DNA, 22 bp, Homo sapiens
gttagtatctttattaattttt

SEQ ID NO: 5436655 - DNA, 17 bp, Homo sapiens
gttagtatgaggcattt

SEQ ID NO: 5436656 - DNA, 20 bp, Homo sapiens
gttagtatgaggcatttgtt

SEQ ID NO: 5436657 - DNA, 19 bp, Homo sapiens
gttagtattttaatcctgt

SEQ ID NO: 5436658 - DNA, 22 bp, Homo sapiens
gttagtcatttgctgagcatgt

SEQ ID NO: 5436659 - DNA, 16 bp, Homo sapiens
gttagtctactcttaa

SEQ ID NO: 5436660 - DNA, 22 bp, Homo sapiens
gttagtgacaaaattggccaga

SEQ ID NO: 5436661 - DNA, 17 bp, Homo sapiens
gttagtgacatttaatg

SEQ ID NO: 5436662 - DNA, 12 bp, Homo sapiens
gttagtgcatgt

SEQ ID NO: 5436663 - DNA, 13 bp, Homo sapiens
gttagtgggaaga

SEQ ID NO: 5436664 - DNA, 23 bp, Homo sapiens
gttagtgtctgtccatctgtctg

SEQ ID NO: 5436665 - DNA, 23 bp, Homo sapiens
gttagtgtgtgtgcatgtgtgtg

SEQ ID NO: 5436666 - DNA, 17 bp, Homo sapiens
gttagttaaaagcccat

SEQ ID NO: 5436667 - DNA, 23 bp, Homo sapiens
gttagttaccttatagttactgt

SEQ ID NO: 5436668 - DNA, 21 bp, Homo sapiens
gttagttataaatagccttca

SEQ ID NO: 5436669 - DNA, 17 bp, Homo sapiens
gttagttatagatgtct

SEQ ID NO: 5436670 - DNA, 23 bp, Homo sapiens
gttagttattttaggagacagtc

SEQ ID NO: 5436671 - DNA, 24 bp, Homo sapiens
gttagttcaatcctgattcatatt

SEQ ID NO: 5436672 - DNA, 13 bp, Homo sapiens
gttagttcccaac

SEQ ID NO: 5436673 - DNA, 16 bp, Homo sapiens
gttagtttctccaagc

SEQ ID NO: 5436674 - DNA, 16 bp, Homo sapiens
gttagtttctttggga

SEQ ID NO: 5436675 - DNA, 16 bp, Homo sapiens
gttagtttgtatatat

SEQ ID NO: 5436676 - DNA, 14 bp, Homo sapiens
gttagtttttactt

SEQ ID NO: 5436677 - DNA, 22 bp, Homo sapiens
gttataaaaaatggttcagaat

SEQ ID NO: 5436678 - DNA, 14 bp, Homo sapiens
gttataaaaataca

SEQ ID NO: 5436679 - DNA, 16 bp, Homo sapiens
gttataaaagtgattg

SEQ ID NO: 5436680 - DNA, 18 bp, Homo sapiens
gttataaaataatgtact

SEQ ID NO: 5436681 - DNA, 13 bp, Homo sapiens
gttataaaatctg

SEQ ID NO: 5436682 - DNA, 15 bp, Homo sapiens
gttataaagatacag

SEQ ID NO: 5436683 - DNA, 13 bp, Homo sapiens
gttataaaggaat

SEQ ID NO: 5436684 - DNA, 12 bp, Homo sapiens
gttataaataaa

SEQ ID NO: 5436685 - DNA, 17 bp, Homo sapiens
gttataaatcaatgtca

SEQ ID NO: 5436686 - DNA, 18 bp, Homo sapiens
gttataaatcaatgtcac

SEQ ID NO: 5436687 - DNA, 15 bp, Homo sapiens
gttataaattttgta

SEQ ID NO: 5436688 - DNA, 16 bp, Homo sapiens
gttataacagatgtga

SEQ ID NO: 5436689 - DNA, 17 bp, Homo sapiens
gttataacttaatgaaa

SEQ ID NO: 5436690 - DNA, 14 bp, Homo sapiens
gttataagactctc

SEQ ID NO: 5436691 - DNA, 17 bp, Homo sapiens
gttataataactgaact

SEQ ID NO: 5436692 - DNA, 18 bp, Homo sapiens
gttataataactgaactg

SEQ ID NO: 5436693 - DNA, 17 bp, Homo sapiens
gttataatgaatgactt

SEQ ID NO: 5436694 - DNA, 14 bp, Homo sapiens
gttataatttcaat

SEQ ID NO: 5436695 - DNA, 14 bp, Homo sapiens
gttataattttcct

SEQ ID NO: 5436696 - DNA, 18 bp, Homo sapiens
gttatacaaccttcattt

SEQ ID NO: 5436697 - DNA, 20 bp, Homo sapiens
gttatacaaccttcatttaa

SEQ ID NO: 5436698 - DNA, 12 bp, Homo sapiens
gttatacaataa

SEQ ID NO: 5436699 - DNA, 18 bp, Homo sapiens
gttatacagttataaaat

SEQ ID NO: 5436700 - DNA, 20 bp, Homo sapiens
gttatacagttataaaatta

SEQ ID NO: 5436701 - DNA, 18 bp, Homo sapiens
gttatacatcaatatgta

SEQ ID NO: 5436702 - DNA, 15 bp, Homo sapiens
gttatacatgacact

SEQ ID NO: 5436703 - DNA, 19 bp, Homo sapiens
gttatacatgacactgaaa

SEQ ID NO: 5436704 - DNA, 20 bp, Homo sapiens
gttatacatgacactgaaat

SEQ ID NO: 5436705 - DNA, 13 bp, Homo sapiens
gttatacatttaa

SEQ ID NO: 5436706 - DNA, 16 bp, Homo sapiens
gttataccagcaaaag

SEQ ID NO: 5436707 - DNA, 19 bp, Homo sapiens
gttatactgaaccaggcca

SEQ ID NO: 5436708 - DNA, 20 bp, Homo sapiens
gttatactgaaccaggccag

SEQ ID NO: 5436709 - DNA, 22 bp, Homo sapiens
gttatagaggtaaaatttgcac

SEQ ID NO: 5436710 - DNA, 17 bp, Homo sapiens
gttatagattgtcttaa

SEQ ID NO: 5436711 - DNA, 18 bp, Homo sapiens
gttatagatttagctatt

SEQ ID NO: 5436712 - DNA, 21 bp, Homo sapiens
gttatagccctgccctcccaa

SEQ ID NO: 5436713 - DNA, 18 bp, Homo sapiens
gttataggtcctttagaa

SEQ ID NO: 5436714 - DNA, 18 bp, Homo sapiens
gttatagtgtttaactgg

SEQ ID NO: 5436715 - DNA, 22 bp, Homo sapiens
gttatataaagagaaaattgaa

SEQ ID NO: 5436716 - DNA, 23 bp, Homo sapiens
gttatataaagagaaaattgaat

SEQ ID NO: 5436717 - DNA, 13 bp, Homo sapiens
gttatataaatgg

SEQ ID NO: 5436718 - DNA, 16 bp, Homo sapiens
gttatataattcactc

SEQ ID NO: 5436719 - DNA, 14 bp, Homo sapiens
gttatatagtggat

SEQ ID NO: 5436720 - DNA, 22 bp, Homo sapiens
gttatatattccttactagaaa

SEQ ID NO: 5436721 - DNA, 13 bp, Homo sapiens
gttatatattgta

SEQ ID NO: 5436722 - DNA, 15 bp, Homo sapiens
gttatatcatcaata

SEQ ID NO: 5436723 - DNA, 22 bp, Homo sapiens
gttatatgatattctttaaaca

SEQ ID NO: 5436724 - DNA, 17 bp, Homo sapiens
gttatatgtacagttta

SEQ ID NO: 5436725 - DNA, 14 bp, Homo sapiens
gttatattaaagaa

SEQ ID NO: 5436726 - DNA, 16 bp, Homo sapiens
gttatattaaagaaaa

SEQ ID NO: 5436727 - DNA, 16 bp, Homo sapiens
gttatattccaaggaa

SEQ ID NO: 5436728 - DNA, 17 bp, Homo sapiens
gttatattgaatatatc

SEQ ID NO: 5436729 - DNA, 12 bp, Homo sapiens
gttatattgctt

SEQ ID NO: 5436730 - DNA, 10 bp, Homo sapiens
gttatatttc

SEQ ID NO: 5436731 - DNA, 12 bp, Homo sapiens
gttatatttcag

SEQ ID NO: 5436732 - DNA, 21 bp, Homo sapiens
gttatatttcagatgtaatgt

SEQ ID NO: 5436733 - DNA, 22 bp, Homo sapiens
gttatatttgacttgaaaagaa

SEQ ID NO: 5436734 - DNA, 15 bp, Homo sapiens
gttatatttgctgat

SEQ ID NO: 5436735 - DNA, 17 bp, Homo sapiens
gttatattttgctgttt

SEQ ID NO: 5436736 - DNA, 20 bp, Homo sapiens
gttatatttttgtgttttct

SEQ ID NO: 5436737 - DNA, 17 bp, Homo sapiens
gttatcaaaatagtcta

SEQ ID NO: 5436738 - DNA, 23 bp, Homo sapiens
gttatcaccatagttttgtttaa

SEQ ID NO: 5436739 - DNA, 16 bp, Homo sapiens
gttatcaccttccaaa

SEQ ID NO: 5436740 - DNA, 14 bp, Homo sapiens
gttatcactgtgca

SEQ ID NO: 5436741 - DNA, 16 bp, Homo sapiens
gttatcactttaagtt

SEQ ID NO: 5436742 - DNA, 18 bp, Homo sapiens
gttatcagtaatgctaaa

SEQ ID NO: 5436743 - DNA, 22 bp, Homo sapiens
gttatcagtacaattctttgtt

SEQ ID NO: 5436744 - DNA, 13 bp, Homo sapiens
gttatcagtgctt

SEQ ID NO: 5436745 - DNA, 16 bp, Homo sapiens
gttatcagttaacatt

SEQ ID NO: 5436746 - DNA, 18 bp, Homo sapiens
gttatcatcctattgtct

SEQ ID NO: 5436747 - DNA, 13 bp, Homo sapiens
gttatcatcctcc

SEQ ID NO: 5436748 - DNA, 14 bp, Homo sapiens
gttatcatgaattt

SEQ ID NO: 5436749 - DNA, 22 bp, Homo sapiens
gttatcatgttagtaatacctc

SEQ ID NO: 5436750 - DNA, 23 bp, Homo sapiens
gttatcatgttagtaatacctct

SEQ ID NO: 5436751 - DNA, 13 bp, Homo sapiens
gttatccagaagt

SEQ ID NO: 5436752 - DNA, 22 bp, Homo sapiens
gttatccagaagtattgtttac

SEQ ID NO: 5436753 - DNA, 16 bp, Homo sapiens
gttatcctcttgtata

SEQ ID NO: 5436754 - DNA, 16 bp, Homo sapiens
gttatcctgtgctaca

SEQ ID NO: 5436755 - DNA, 21 bp, Homo sapiens
gttatccttgttcctgttaca

SEQ ID NO: 5436756 - DNA, 23 bp, Homo sapiens
gttatcctttcattaggcaaagt

SEQ ID NO: 5436757 - DNA, 23 bp, Homo sapiens
gttatcctttgtgagcctatgat

SEQ ID NO: 5436758 - DNA, 15 bp, Homo sapiens
gttatcgaaataaca

SEQ ID NO: 5436759 - DNA, 18 bp, Homo sapiens
gttatcgaaataacaatg

SEQ ID NO: 5436760 - DNA, 23 bp, Homo sapiens
gttatcgaaataacaatgttaag

SEQ ID NO: 5436761 - DNA, 21 bp, Homo sapiens
gttatcggacattctaatgca

SEQ ID NO: 5436762 - DNA, 16 bp, Homo sapiens
gttatctaaaagaaat

SEQ ID NO: 5436763 - DNA, 15 bp, Homo sapiens
gttatctaagttaat

SEQ ID NO: 5436764 - DNA, 15 bp, Homo sapiens
gttatctcaggtgag

SEQ ID NO: 5436765 - DNA, 12 bp, Homo sapiens
gttatctctgtg

SEQ ID NO: 5436766 - DNA, 21 bp, Homo sapiens
gttatctcttccttacaggtg

SEQ ID NO: 5436767 - DNA, 19 bp, Homo sapiens
gttatctgaatagtgtcac

SEQ ID NO: 5436768 - DNA, 15 bp, Homo sapiens
gttatctgcctggcc

SEQ ID NO: 5436769 - DNA, 16 bp, Homo sapiens
gttatctgcctggcct

SEQ ID NO: 5436770 - DNA, 18 bp, Homo sapiens
gttatctgcctggcctgg

SEQ ID NO: 5436771 - DNA, 15 bp, Homo sapiens
gttatcttaaatatg

SEQ ID NO: 5436772 - DNA, 15 bp, Homo sapiens
gttatcttaacactg

SEQ ID NO: 5436773 - DNA, 17 bp, Homo sapiens
gttatcttaacactgaa

SEQ ID NO: 5436774 - DNA, 21 bp, Homo sapiens
gttatcttacgctatttctgt

SEQ ID NO: 5436775 - DNA, 19 bp, Homo sapiens
gttatcttatactgtacaa

SEQ ID NO: 5436776 - DNA, 20 bp, Homo sapiens
gttatcttatactgtacaat

SEQ ID NO: 5436777 - DNA, 23 bp, Homo sapiens
gttatcttatactgtacaataaa

SEQ ID NO: 5436778 - DNA, 14 bp, Homo sapiens
gttatcttctttat

SEQ ID NO: 5436779 - DNA, 23 bp, Homo sapiens
gttatgaaaaccctcgatgttca

SEQ ID NO: 5436780 - DNA, 17 bp, Homo sapiens
gttatgaaacatatcat

SEQ ID NO: 5436781 - DNA, 12 bp, Homo sapiens
gttatgaacagc

SEQ ID NO: 5436782 - DNA, 18 bp, Homo sapiens
gttatgacagccatttgt

SEQ ID NO: 5436783 - DNA, 20 bp, Homo sapiens
gttatgagtataatacatta

SEQ ID NO: 5436784 - DNA, 23 bp, Homo sapiens
gttatgataacaccagtgggaat

SEQ ID NO: 5436785 - DNA, 17 bp, Homo sapiens
gttatgatattgtttaa

SEQ ID NO: 5436786 - DNA, 17 bp, Homo sapiens
gttatgatctactcatt

SEQ ID NO: 5436787 - DNA, 17 bp, Homo sapiens
gttatgatggaaaggaa

SEQ ID NO: 5436788 - DNA, 14 bp, Homo sapiens
gttatgatgtgctt

SEQ ID NO: 5436789 - DNA, 17 bp, Homo sapiens
gttatgatgtgcttaac

SEQ ID NO: 5436790 - DNA, 22 bp, Homo sapiens
gttatgcaagggactgtgtgtt

SEQ ID NO: 5436791 - DNA, 15 bp, Homo sapiens
gttatgcactgcctg

SEQ ID NO: 5436792 - DNA, 19 bp, Homo sapiens
gttatgcactgcctgccat

SEQ ID NO: 5436793 - DNA, 20 bp, Homo sapiens
gttatgcagtgaactatttt

SEQ ID NO: 5436794 - DNA, 13 bp, Homo sapiens
gttatgcatcatt

SEQ ID NO: 5436795 - DNA, 14 bp, Homo sapiens
gttatgcatcccca

SEQ ID NO: 5436796 - DNA, 20 bp, Homo sapiens
gttatgccaaacagttgtac

SEQ ID NO: 5436797 - DNA, 13 bp, Homo sapiens
gttatgctgtgac

SEQ ID NO: 5436798 - DNA, 18 bp, Homo sapiens
gttatgctgtttcctagc

SEQ ID NO: 5436799 - DNA, 21 bp, Homo sapiens
gttatggcagcccggctgctg

SEQ ID NO: 5436800 - DNA, 22 bp, Homo sapiens
gttatggcagcccggctgctgc

SEQ ID NO: 5436801 - DNA, 17 bp, Homo sapiens
gttatgggatgtaaaca

SEQ ID NO: 5436802 - DNA, 17 bp, Homo sapiens
gttatggggagagggca

SEQ ID NO: 5436803 - DNA, 15 bp, Homo sapiens
gttatggtagaaaaa

SEQ ID NO: 5436804 - DNA, 15 bp, Homo sapiens
gttccccttccactg

SEQ ID NO: 5436805 - DNA, 19 bp, Homo sapiens
gttccccttggcttcctcc

SEQ ID NO: 5436806 - DNA, 21 bp, Homo sapiens
gttcccgattcacgtttttct

SEQ ID NO: 5436807 - DNA, 14 bp, Homo sapiens
gttcccgctctgca

SEQ ID NO: 5436808 - DNA, 15 bp, Homo sapiens
gttcccggagcacag

SEQ ID NO: 5436809 - DNA, 19 bp, Homo sapiens
gttcccggagcacagccct

SEQ ID NO: 5436810 - DNA, 20 bp, Homo sapiens
gttcccggagcacagccctg

SEQ ID NO: 5436811 - DNA, 14 bp, Homo sapiens
gttcccggctggac

SEQ ID NO: 5436812 - DNA, 18 bp, Homo sapiens
gttcccgggagctgggcc

SEQ ID NO: 5436813 - DNA, 22 bp, Homo sapiens
gttcccgggagctgggccctgc

SEQ ID NO: 5436814 - DNA, 15 bp, Homo sapiens
gttcccgtgcctggg

SEQ ID NO: 5436815 - DNA, 17 bp, Homo sapiens
gttcccgtgcctgggag

SEQ ID NO: 5436816 - DNA, 19 bp, Homo sapiens
gttcccgtgtgcctgagcg

SEQ ID NO: 5436817 - DNA, 16 bp, Homo sapiens
gttcccgtttctccac

SEQ ID NO: 5436818 - DNA, 23 bp, Homo sapiens
gttccctaagtccaactactaaa

SEQ ID NO: 5436819 - DNA, 21 bp, Homo sapiens
gttccctagctgaggatgaca

SEQ ID NO: 5436820 - DNA, 21 bp, Homo sapiens
gttccctatggagaggcttcc

SEQ ID NO: 5436821 - DNA, 13 bp, Homo sapiens
gttccctccccaa

SEQ ID NO: 5436822 - DNA, 17 bp, Homo sapiens
gttccctcctagctctc

SEQ ID NO: 5436823 - DNA, 18 bp, Homo sapiens
gttccctcctagctctcc

SEQ ID NO: 5436824 - DNA, 12 bp, Homo sapiens
gttccctcctgg

SEQ ID NO: 5436825 - DNA, 17 bp, Homo sapiens
gttccctctccctgttg

SEQ ID NO: 5436826 - DNA, 22 bp, Homo sapiens
gttccctctgagaattccaagg

SEQ ID NO: 5436827 - DNA, 18 bp, Homo sapiens
gttccctctgcctgggat

SEQ ID NO: 5436828 - DNA, 17 bp, Homo sapiens
gttccctctgctcagcc

SEQ ID NO: 5436829 - DNA, 18 bp, Homo sapiens
gttccctctgctcagcca

SEQ ID NO: 5436830 - DNA, 18 bp, Homo sapiens
gttccctgaaaacccaga

SEQ ID NO: 5436831 - DNA, 21 bp, Homo sapiens
gttccctgaaaacccagagag

SEQ ID NO: 5436832 - DNA, 23 bp, Homo sapiens
gttccctgaaccttcctgtctcc

SEQ ID NO: 5436833 - DNA, 23 bp, Homo sapiens
gttccctgagaaacccaccagcc

SEQ ID NO: 5436834 - DNA, 16 bp, Homo sapiens
gttccctgattattta

SEQ ID NO: 5436835 - DNA, 11 bp, Homo sapiens
gttccctgcac

SEQ ID NO: 5436836 - DNA, 13 bp, Homo sapiens
gttccctgcaccc

SEQ ID NO: 5436837 - DNA, 15 bp, Homo sapiens
gttccctgcaccctg

SEQ ID NO: 5436838 - DNA, 13 bp, Homo sapiens
gttccctgccaca

SEQ ID NO: 5436839 - DNA, 17 bp, Homo sapiens
gttccctgcgcgcagct

SEQ ID NO: 5436840 - DNA, 13 bp, Homo sapiens
gttccctgctgcg

SEQ ID NO: 5436841 - DNA, 17 bp, Homo sapiens
gttccctgtcagaggct

SEQ ID NO: 5436842 - DNA, 17 bp, Homo sapiens
gttccctgttcttcctc

SEQ ID NO: 5436843 - DNA, 18 bp, Homo sapiens
gttccctgttcttcctcc

SEQ ID NO: 5436844 - DNA, 15 bp, Homo sapiens
gttcccttcctcacc

SEQ ID NO: 5436845 - DNA, 13 bp, Homo sapiens
gttcccttcctct

SEQ ID NO: 5436846 - DNA, 13 bp, Homo sapiens
gttcccttctccc

SEQ ID NO: 5436847 - DNA, 17 bp, Homo sapiens
gttcccttctccccctt

SEQ ID NO: 5436848 - DNA, 18 bp, Homo sapiens
gttcccttctcccccttg

SEQ ID NO: 5436849 - DNA, 20 bp, Homo sapiens
gttcccttctcccccttgtc

SEQ ID NO: 5436850 - DNA, 19 bp, Homo sapiens
gttcccttgattcaaataa

SEQ ID NO: 5436851 - DNA, 13 bp, Homo sapiens
gttcccttggcct

SEQ ID NO: 5436852 - DNA, 12 bp, Homo sapiens
gttccctttccc

SEQ ID NO: 5436853 - DNA, 14 bp, Homo sapiens
gttccctttgcctt

SEQ ID NO: 5436854 - DNA, 22 bp, Homo sapiens
gttccctttgccttaaacctga

SEQ ID NO: 5436855 - DNA, 20 bp, Homo sapiens
gttccctttgctccacccca

SEQ ID NO: 5436856 - DNA, 20 bp, Homo sapiens
gttccctttgttgctgtctg

SEQ ID NO: 5436857 - DNA, 21 bp, Homo sapiens
gttccgaaaccaaagaagaaa

SEQ ID NO: 5436858 - DNA, 23 bp, Homo sapiens
gttccgcactttccacttcttcc

SEQ ID NO: 5436859 - DNA, 23 bp, Homo sapiens
gttccgcccactcattccttctc

SEQ ID NO: 5436860 - DNA, 19 bp, Homo sapiens
gttccggattggcttgtgt

SEQ ID NO: 5436861 - DNA, 15 bp, Homo sapiens
gttccgggaggcaga

SEQ ID NO: 5436862 - DNA, 21 bp, Homo sapiens
gttccgggaggcagagaggag

SEQ ID NO: 5436863 - DNA, 14 bp, Homo sapiens
gttccggggagaaa

SEQ ID NO: 5436864 - DNA, 14 bp, Homo sapiens
gttccgtctcctct

SEQ ID NO: 5436865 - DNA, 23 bp, Homo sapiens
gttccgtgggaccctcagcagct

SEQ ID NO: 5436866 - DNA, 17 bp, Homo sapiens
gttcctaacaggatgaa

SEQ ID NO: 5436867 - DNA, 17 bp, Homo sapiens
gttcctaagaagcttct

SEQ ID NO: 5436868 - DNA, 18 bp, Homo sapiens
gttcctaagaagcttcta

SEQ ID NO: 5436869 - DNA, 19 bp, Homo sapiens
gttcctactttagccactg

SEQ ID NO: 5436870 - DNA, 18 bp, Homo sapiens
gttcctagaggagacagc

SEQ ID NO: 5436871 - DNA, 23 bp, Homo sapiens
gttcctagaggagacagcctgtc

SEQ ID NO: 5436872 - DNA, 13 bp, Homo sapiens
gttcctagcactg

SEQ ID NO: 5436873 - DNA, 20 bp, Homo sapiens
gttcctaggcattgcaggac

SEQ ID NO: 5436874 - DNA, 18 bp, Homo sapiens
gttcctaggggaatgagg

SEQ ID NO: 5436875 - DNA, 20 bp, Homo sapiens
gttcctaggggaatgagggg

SEQ ID NO: 5436876 - DNA, 22 bp, Homo sapiens
gttcctaggggaatgagggggc

SEQ ID NO: 5436877 - DNA, 14 bp, Homo sapiens
gttcctataaaatc

SEQ ID NO: 5436878 - DNA, 18 bp, Homo sapiens
gttcctattgtcattaaa

SEQ ID NO: 5436879 - DNA, 20 bp, Homo sapiens
gttcctcaaagcttggatta

SEQ ID NO: 5436880 - DNA, 20 bp, Homo sapiens
gttcctcatctgagaggctc

SEQ ID NO: 5436881 - DNA, 18 bp, Homo sapiens
gttcctcccaagaggcca

SEQ ID NO: 5436882 - DNA, 16 bp, Homo sapiens
gttcctcccctccagc

SEQ ID NO: 5436883 - DNA, 20 bp, Homo sapiens
gttcctcctaggcgctcaga

SEQ ID NO: 5436884 - DNA, 18 bp, Homo sapiens
gttcctcctcagcctccc

SEQ ID NO: 5436885 - DNA, 12 bp, Homo sapiens
gttcctcctgct

SEQ ID NO: 5436886 - DNA, 14 bp, Homo sapiens
gttcctcctgctgt

SEQ ID NO: 5436887 - DNA, 15 bp, Homo sapiens
gttcctcgccctggg

SEQ ID NO: 5436888 - DNA, 16 bp, Homo sapiens
gttcctcgccctgggt

SEQ ID NO: 5436889 - DNA, 18 bp, Homo sapiens
gttcctcgctctgggatg

SEQ ID NO: 5436890 - DNA, 22 bp, Homo sapiens
gttcctcgggatgaaaagccat

SEQ ID NO: 5436891 - DNA, 17 bp, Homo sapiens
gttcctcggtgggccag

SEQ ID NO: 5436892 - DNA, 15 bp, Homo sapiens
gttcctctatacttt

SEQ ID NO: 5436893 - DNA, 12 bp, Homo sapiens
gttcctctctgg

SEQ ID NO: 5436894 - DNA, 18 bp, Homo sapiens
gttcctctgatttcaagg

SEQ ID NO: 5436895 - DNA, 15 bp, Homo sapiens
gttcctctgcctgcc

SEQ ID NO: 5436896 - DNA, 23 bp, Homo sapiens
gttcctctgctcaccgcccatca

SEQ ID NO: 5436897 - DNA, 12 bp, Homo sapiens
gttcctctgggt

SEQ ID NO: 5436898 - DNA, 13 bp, Homo sapiens
gttcctctttgca

SEQ ID NO: 5436899 - DNA, 14 bp, Homo sapiens
gttcctctttgcat

SEQ ID NO: 5436900 - DNA, 16 bp, Homo sapiens
gttcctctttgcatga

SEQ ID NO: 5436901 - DNA, 18 bp, Homo sapiens
gttcctctttgccctgag

SEQ ID NO: 5436902 - DNA, 22 bp, Homo sapiens
gttcctctttggtgtacagact

SEQ ID NO: 5436903 - DNA, 12 bp, Homo sapiens
gttcctgaaatg

SEQ ID NO: 5436904 - DNA, 22 bp, Homo sapiens
gttcctgagacacccgattcct

SEQ ID NO: 5436905 - DNA, 21 bp, Homo sapiens
gttcctgagtgcgtggatctg

SEQ ID NO: 5436906 - DNA, 23 bp, Homo sapiens
gttcctgatagctacccacagag

SEQ ID NO: 5436907 - DNA, 22 bp, Homo sapiens
gttcctgatgacccaggctgcc

SEQ ID NO: 5436908 - DNA, 14 bp, Homo sapiens
gttcctgcactcca

SEQ ID NO: 5436909 - DNA, 15 bp, Homo sapiens
gttcctgcactccag

SEQ ID NO: 5436910 - DNA, 14 bp, Homo sapiens
gttcctgccaggct

SEQ ID NO: 5436911 - DNA, 11 bp, Homo sapiens
gttcctgcctt

SEQ ID NO: 5436912 - DNA, 15 bp, Homo sapiens
gttcctgccttctct

SEQ ID NO: 5436913 - DNA, 19 bp, Homo sapiens
gttcctgcggagtgaagag

SEQ ID NO: 5436914 - DNA, 23 bp, Homo sapiens
gttcctgctctctgctcatgggt

SEQ ID NO: 5436915 - DNA, 11 bp, Homo sapiens
gttcctgctgc

SEQ ID NO: 5436916 - DNA, 16 bp, Homo sapiens
gttcctgctgcctggg

SEQ ID NO: 5436917 - DNA, 21 bp, Homo sapiens
gttcctgctttctctttcagt

SEQ ID NO: 5436918 - DNA, 14 bp, Homo sapiens
gttcctggaagcag

SEQ ID NO: 5436919 - DNA, 23 bp, Homo sapiens
gttcctggaagcaggtgctacaa

SEQ ID NO: 5436920 - DNA, 22 bp, Homo sapiens
gttcctggacaccacccagagc

SEQ ID NO: 5436921 - DNA, 22 bp, Homo sapiens
gttcctggacagatcaggctag

SEQ ID NO: 5436922 - DNA, 21 bp, Homo sapiens
gttcctggcaatagtgtgttc

SEQ ID NO: 5436923 - DNA, 15 bp, Homo sapiens
gttcctggcctcagc

SEQ ID NO: 5436924 - DNA, 22 bp, Homo sapiens
gttcctggccttctgaactcca

SEQ ID NO: 5436925 - DNA, 15 bp, Homo sapiens
gttcctggctgatga

SEQ ID NO: 5436926 - DNA, 13 bp, Homo sapiens
gttcctggggccg

SEQ ID NO: 5436927 - DNA, 16 bp, Homo sapiens
gttcctggtgactcct

SEQ ID NO: 5436928 - DNA, 20 bp, Homo sapiens
gttcctgtactactgccttg

SEQ ID NO: 5436929 - DNA, 17 bp, Homo sapiens
gttcctgtccctgcgcc

SEQ ID NO: 5436930 - DNA, 17 bp, Homo sapiens
gttcctgtctcaatagc

SEQ ID NO: 5436931 - DNA, 15 bp, Homo sapiens
gttcctgtgcacagc

SEQ ID NO: 5436932 - DNA, 17 bp, Homo sapiens
gttcctgtgcagatgct

SEQ ID NO: 5436933 - DNA, 10 bp, Homo sapiens
gttcctgtgt

SEQ ID NO: 5436934 - DNA, 20 bp, Homo sapiens
gttcctgtttatttttaaat

SEQ ID NO: 5436935 - DNA, 14 bp, Homo sapiens
gttcctgtttgaaa

SEQ ID NO: 5436936 - DNA, 19 bp, Homo sapiens
gttcctgtttgaacccagg

SEQ ID NO: 5436937 - DNA, 21 bp, Homo sapiens
gttcctgtttgaacccaggag

SEQ ID NO: 5436938 - DNA, 14 bp, Homo sapiens
gttccttactgcag

SEQ ID NO: 5436939 - DNA, 15 bp, Homo sapiens
gttccttactgcaga

SEQ ID NO: 5436940 - DNA, 13 bp, Homo sapiens
gttccttagacct

SEQ ID NO: 5436941 - DNA, 19 bp, Homo sapiens
gttccttataagaattaat

SEQ ID NO: 5436942 - DNA, 22 bp, Homo sapiens
gttccttatttctctctcctgg

SEQ ID NO: 5436943 - DNA, 23 bp, Homo sapiens
gttccttatttctctctcctggt

SEQ ID NO: 5436944 - DNA, 13 bp, Homo sapiens
gttccttcctgca

SEQ ID NO: 5436945 - DNA, 18 bp, Homo sapiens
gttccttcctgcagacct

SEQ ID NO: 5436946 - DNA, 17 bp, Homo sapiens
gttccttcgcacactgt

SEQ ID NO: 5436947 - DNA, 21 bp, Homo sapiens
gttccttctatacatgtttgc

SEQ ID NO: 5436948 - DNA, 12 bp, Homo sapiens
gttccttctctg

SEQ ID NO: 5436949 - DNA, 15 bp, Homo sapiens
gttccttctctgggt

SEQ ID NO: 5436950 - DNA, 15 bp, Homo sapiens
gttccttctgcttct

SEQ ID NO: 5436951 - DNA, 23 bp, Homo sapiens
gttccttgatctgtatatacaat

SEQ ID NO: 5436952 - DNA, 13 bp, Homo sapiens
gttccttgcctta

SEQ ID NO: 5436953 - DNA, 19 bp, Homo sapiens
gttccttgctagccctggg

SEQ ID NO: 5436954 - DNA, 12 bp, Homo sapiens
gttccttgcttt

SEQ ID NO: 5436955 - DNA, 18 bp, Homo sapiens
gttccttggccatgcaga

SEQ ID NO: 5436956 - DNA, 22 bp, Homo sapiens
gttcctttcatctctctacctc

SEQ ID NO: 5436957 - DNA, 23 bp, Homo sapiens
gttcctttccttttctttaaaga

SEQ ID NO: 5436958 - DNA, 15 bp, Homo sapiens
gttcctttctctggg

SEQ ID NO: 5436959 - DNA, 16 bp, Homo sapiens
gttcctttctctgggc

SEQ ID NO: 5436960 - DNA, 17 bp, Homo sapiens
gttcctttctctgggct

SEQ ID NO: 5436961 - DNA, 18 bp, Homo sapiens
gttcctttctctgggctt

SEQ ID NO: 5436962 - DNA, 16 bp, Homo sapiens
gttcctttgcaccctg

SEQ ID NO: 5436963 - DNA, 17 bp, Homo sapiens
gttcctttgcaccctgt

SEQ ID NO: 5436964 - DNA, 18 bp, Homo sapiens
gttcctttgcaccctgta

SEQ ID NO: 5436965 - DNA, 19 bp, Homo sapiens
gttcctttgcaccctgtag

SEQ ID NO: 5436966 - DNA, 22 bp, Homo sapiens
gttccttttctctcctgtgtgc

SEQ ID NO: 5436967 - DNA, 20 bp, Homo sapiens
gttcctttttcaaaaaccag

SEQ ID NO: 5436968 - DNA, 21 bp, Homo sapiens
gttcgaaatagatatcctctc

SEQ ID NO: 5436969 - DNA, 16 bp, Homo sapiens
gttcgactcagcctca

SEQ ID NO: 5436970 - DNA, 19 bp, Homo sapiens
gttcgagaccaacctgacc

SEQ ID NO: 5436971 - DNA, 19 bp, Homo sapiens
gttcgagaccagcctggcc

SEQ ID NO: 5436972 - DNA, 17 bp, Homo sapiens
gttcgagagcagcctgg

SEQ ID NO: 5436973 - DNA, 17 bp, Homo sapiens
gttcgatacctggagca

SEQ ID NO: 5436974 - DNA, 18 bp, Homo sapiens
gttcgcaccgtgctgggc

SEQ ID NO: 5436975 - DNA, 20 bp, Homo sapiens
gttcgcaccgtgctgggctc

SEQ ID NO: 5436976 - DNA, 16 bp, Homo sapiens
gttcgccgcgtggaat

SEQ ID NO: 5436977 - DNA, 15 bp, Homo sapiens
gttcgcctctggccc

SEQ ID NO: 5436978 - DNA, 15 bp, Homo sapiens
gttcgcctggagccc

SEQ ID NO: 5436979 - DNA, 16 bp, Homo sapiens
gttcgcctggagccct

SEQ ID NO: 5436980 - DNA, 13 bp, Homo sapiens
gttcgctggctga

SEQ ID NO: 5436981 - DNA, 18 bp, Homo sapiens
gttcggatttggggtgga

SEQ ID NO: 5436982 - DNA, 17 bp, Homo sapiens
gttcttagaagctcacg

SEQ ID NO: 5436983 - DNA, 23 bp, Homo sapiens
gttcttagattcaggggaagggc

SEQ ID NO: 5436984 - DNA, 22 bp, Homo sapiens
gttcttagctgaacaatgaatg

SEQ ID NO: 5436985 - DNA, 15 bp, Homo sapiens
gttcttaggtttact

SEQ ID NO: 5436986 - DNA, 22 bp, Homo sapiens
gttcttaggtttactgtgaaga

SEQ ID NO: 5436987 - DNA, 17 bp, Homo sapiens
gttcttagttctcactg

SEQ ID NO: 5436988 - DNA, 21 bp, Homo sapiens
gttcttataagaagaagagag

SEQ ID NO: 5436989 - DNA, 14 bp, Homo sapiens
gttcttatagaata

SEQ ID NO: 5436990 - DNA, 17 bp, Homo sapiens
gttcttatgcaaaatgg

SEQ ID NO: 5436991 - DNA, 19 bp, Homo sapiens
gttcttatgcaaaatggaa

SEQ ID NO: 5436992 - DNA, 12 bp, Homo sapiens
gttcttatttaa

SEQ ID NO: 5436993 - DNA, 13 bp, Homo sapiens
gttcttattttag

SEQ ID NO: 5436994 - DNA, 21 bp, Homo sapiens
gttcttattttgcattccaga

SEQ ID NO: 5436995 - DNA, 18 bp, Homo sapiens
gttcttcaactcctgggc

SEQ ID NO: 5436996 - DNA, 17 bp, Homo sapiens
gttcttcacttctggga

SEQ ID NO: 5436997 - DNA, 17 bp, Homo sapiens
gttcttcaggagatgat

SEQ ID NO: 5436998 - DNA, 17 bp, Homo sapiens
gttcttcagtcctttgt

SEQ ID NO: 5436999 - DNA, 19 bp, Homo sapiens
gttcttcagtcctttgtct

SEQ ID NO: 5437000 - DNA, 21 bp, Homo sapiens
gttcttcagtgtaatgtgact

SEQ ID NO: 5437001 - DNA, 14 bp, Homo sapiens
gttcttcatctaag

SEQ ID NO: 5437002 - DNA, 11 bp, Homo sapiens
gttcttcatga

SEQ ID NO: 5437003 - DNA, 12 bp, Homo sapiens
gttcttcatgat

SEQ ID NO: 5437004 - DNA, 17 bp, Homo sapiens
gttcttcattagatgtt

SEQ ID NO: 5437005 - DNA, 13 bp, Homo sapiens
gttcttccccaca

SEQ ID NO: 5437006 - DNA, 22 bp, Homo sapiens
gttcttcccccacttcccctcc

SEQ ID NO: 5437007 - DNA, 21 bp, Homo sapiens
gttcttcccttctcttcacta

SEQ ID NO: 5437008 - DNA, 13 bp, Homo sapiens
gttcttcctcagc

SEQ ID NO: 5437009 - DNA, 15 bp, Homo sapiens
gttcttcctcagcca

SEQ ID NO: 5437010 - DNA, 13 bp, Homo sapiens
gttcttcctgcaa

SEQ ID NO: 5437011 - DNA, 12 bp, Homo sapiens
gttcttccttcc

SEQ ID NO: 5437012 - DNA, 13 bp, Homo sapiens
gttcttccttcct

SEQ ID NO: 5437013 - DNA, 19 bp, Homo sapiens
gttcttcctttccctggag

SEQ ID NO: 5437014 - DNA, 22 bp, Homo sapiens
gttcttccttttttaaaataaa

SEQ ID NO: 5437015 - DNA, 19 bp, Homo sapiens
gttcttcgcagctcatctt

SEQ ID NO: 5437016 - DNA, 20 bp, Homo sapiens
gttcttcgggtgtgatcata

SEQ ID NO: 5437017 - DNA, 19 bp, Homo sapiens
gttcttctcaaaaaataat

SEQ ID NO: 5437018 - DNA, 21 bp, Homo sapiens
gttcttctgttctgcagacac

SEQ ID NO: 5437019 - DNA, 17 bp, Homo sapiens
gttcttcttattttgtg

SEQ ID NO: 5437020 - DNA, 20 bp, Homo sapiens
gttcttcttcctgaagctga

SEQ ID NO: 5437021 - DNA, 24 bp, Homo sapiens
gttcttcttgggagtatgttgtca

SEQ ID NO: 5437022 - DNA, 20 bp, Homo sapiens
gttcttgaaagccaagtgtt

SEQ ID NO: 5437023 - DNA, 23 bp, Homo sapiens
gttcttgaagcatttcaaagccc

SEQ ID NO: 5437024 - DNA, 15 bp, Homo sapiens
gttcttgaagctggg

SEQ ID NO: 5437025 - DNA, 19 bp, Homo sapiens
gttcttgaagctgggctgt

SEQ ID NO: 5437026 - DNA, 22 bp, Homo sapiens
gttcttgaattgttatgaaaat

SEQ ID NO: 5437027 - DNA, 18 bp, Homo sapiens
gttcttgagattttgtat

SEQ ID NO: 5437028 - DNA, 15 bp, Homo sapiens
gttcttgagcagctg

SEQ ID NO: 5437029 - DNA, 19 bp, Homo sapiens
gttcttgagtagatctgct

SEQ ID NO: 5437030 - DNA, 20 bp, Homo sapiens
gttcttgagtagatctgctt

SEQ ID NO: 5437031 - DNA, 22 bp, Homo sapiens
gttcttgagtagatctgcttct

SEQ ID NO: 5437032 - DNA, 23 bp, Homo sapiens
gttcttgagtagatctgcttctt

SEQ ID NO: 5437033 - DNA, 22 bp, Homo sapiens
gttcttgatggagattaagatg

SEQ ID NO: 5437034 - DNA, 14 bp, Homo sapiens
gttcttgcaataag

SEQ ID NO: 5437035 - DNA, 12 bp, Homo sapiens
gttcttgctgct

SEQ ID NO: 5437036 - DNA, 21 bp, Homo sapiens
gttcttgctgctagaactttt

SEQ ID NO: 5437037 - DNA, 22 bp, Homo sapiens
gttcttgctgctagaacttttt

SEQ ID NO: 5437038 - DNA, 23 bp, Homo sapiens
gttcttggcaataaattttgaaa

SEQ ID NO: 5437039 - DNA, 12 bp, Homo sapiens
gttcttgggaga

SEQ ID NO: 5437040 - DNA, 22 bp, Homo sapiens
gttcttgggcctcaggctctgc

SEQ ID NO: 5437041 - DNA, 16 bp, Homo sapiens
gttcttgggctaggta

SEQ ID NO: 5437042 - DNA, 15 bp, Homo sapiens
gttcttgggggaggc

SEQ ID NO: 5437043 - DNA, 15 bp, Homo sapiens
gttcttggtgctctg

SEQ ID NO: 5437044 - DNA, 22 bp, Homo sapiens
gttcttggtgtttgactgtaat

SEQ ID NO: 5437045 - DNA, 14 bp, Homo sapiens
gttcttggtttgta

SEQ ID NO: 5437046 - DNA, 18 bp, Homo sapiens
gttcttggtttgtaaatt

SEQ ID NO: 5437047 - DNA, 17 bp, Homo sapiens
gttcttgtattaagaat

SEQ ID NO: 5437048 - DNA, 19 bp, Homo sapiens
gttcttgtcataaaatgca

SEQ ID NO: 5437049 - DNA, 18 bp, Homo sapiens
gttcttgtgcatgtttac

SEQ ID NO: 5437050 - DNA, 18 bp, Homo sapiens
gttcttgttctgttttgt

SEQ ID NO: 5437051 - DNA, 15 bp, Homo sapiens
gttcttgttggtgca

SEQ ID NO: 5437052 - DNA, 23 bp, Homo sapiens
gttcttgttgtttatatgaaaac

SEQ ID NO: 5437053 - DNA, 17 bp, Homo sapiens
gttcttgttttgttata

SEQ ID NO: 5437054 - DNA, 18 bp, Homo sapiens
gttcttgtttttaagttt

SEQ ID NO: 5437055 - DNA, 23 bp, Homo sapiens
gttctttaaaatgtaaagccatg

SEQ ID NO: 5437056 - DNA, 14 bp, Homo sapiens
gttctttaaactgt

SEQ ID NO: 5437057 - DNA, 23 bp, Homo sapiens
gttctttaaactgtcgtgtcata

SEQ ID NO: 5437058 - DNA, 23 bp, Homo sapiens
gttctttactggtgatttctgag

SEQ ID NO: 5437059 - DNA, 15 bp, Homo sapiens
gttctttaggagatt

SEQ ID NO: 5437060 - DNA, 16 bp, Homo sapiens
gttctttaggagattt

SEQ ID NO: 5437061 - DNA, 17 bp, Homo sapiens
gttctttaggtgcctcc

SEQ ID NO: 5437062 - DNA, 21 bp, Homo sapiens
gttctttaggtgcctcctgtc

SEQ ID NO: 5437063 - DNA, 22 bp, Homo sapiens
gttctttatatacaataatgga

SEQ ID NO: 5437064 - DNA, 11 bp, Homo sapiens
gttctttcaac

SEQ ID NO: 5437065 - DNA, 17 bp, Homo sapiens
gttctttcacccatcct

SEQ ID NO: 5437066 - DNA, 20 bp, Homo sapiens
gttctttcatttgctttgga

SEQ ID NO: 5437067 - DNA, 18 bp, Homo sapiens
gttctttccaaagtacac

SEQ ID NO: 5437068 - DNA, 19 bp, Homo sapiens
gttctttccatctttagaa

SEQ ID NO: 5437069 - DNA, 13 bp, Homo sapiens
gttctttcccagc

SEQ ID NO: 5437070 - DNA, 12 bp, Homo sapiens
gttctttcccca

SEQ ID NO: 5437071 - DNA, 18 bp, Homo sapiens
gttctttccccaggggca

SEQ ID NO: 5437072 - DNA, 19 bp, Homo sapiens
gttctttcctccccctgca

SEQ ID NO: 5437073 - DNA, 21 bp, Homo sapiens
gttctttcctctttctgctct

SEQ ID NO: 5437074 - DNA, 13 bp, Homo sapiens
gttctttcctgcc

SEQ ID NO: 5437075 - DNA, 14 bp, Homo sapiens
gttctttcctgccc

SEQ ID NO: 5437076 - DNA, 16 bp, Homo sapiens
gttctttcctgccctg

SEQ ID NO: 5437077 - DNA, 19 bp, Homo sapiens
gttctttcctgccctgtcc

SEQ ID NO: 5437078 - DNA, 23 bp, Homo sapiens
gttctttctgctctatactgtgg

SEQ ID NO: 5437079 - DNA, 15 bp, Homo sapiens
gttctttctggagtc

SEQ ID NO: 5437080 - DNA, 15 bp, Homo sapiens
gttctttcttcctct

SEQ ID NO: 5437081 - DNA, 16 bp, Homo sapiens
gttctttcttcctctg

SEQ ID NO: 5437082 - DNA, 18 bp, Homo sapiens
gttctttcttcctctgct

SEQ ID NO: 5437083 - DNA, 15 bp, Homo sapiens
gttctttcttttctt

SEQ ID NO: 5437084 - DNA, 22 bp, Homo sapiens
gttctttgagggactgcctctg

SEQ ID NO: 5437085 - DNA, 14 bp, Homo sapiens
gttctttgcagtga

SEQ ID NO: 5437086 - DNA, 11 bp, Homo sapiens
gttctttggaa

SEQ ID NO: 5437087 - DNA, 21 bp, Homo sapiens
gttctttgttcatagcccagt

SEQ ID NO: 5437088 - DNA, 14 bp, Homo sapiens
gttctttgttcctg

SEQ ID NO: 5437089 - DNA, 15 bp, Homo sapiens
gttcttttaagccca

SEQ ID NO: 5437090 - DNA, 14 bp, Homo sapiens
gttcttttaccact

SEQ ID NO: 5437091 - DNA, 15 bp, Homo sapiens
gttcttttctattta

SEQ ID NO: 5437092 - DNA, 18 bp, Homo sapiens
gttcttttgagtccttgt

SEQ ID NO: 5437093 - DNA, 16 bp, Homo sapiens
gttcttttgttgtaaa

SEQ ID NO: 5437094 - DNA, 14 bp, Homo sapiens
gttcttttgtttca

SEQ ID NO: 5437095 - DNA, 20 bp, Homo sapiens
gttctttttgactgattgtt

SEQ ID NO: 5437096 - DNA, 21 bp, Homo sapiens
gttcttttttaagactcaatc

SEQ ID NO: 5437097 - DNA, 19 bp, Homo sapiens
gttcttttttgtacagtat

SEQ ID NO: 5437098 - DNA, 21 bp, Homo sapiens
gttgaaaaagtttgtttttgc

SEQ ID NO: 5437099 - DNA, 13 bp, Homo sapiens
gttgaaaaatcta

SEQ ID NO: 5437100 - DNA, 15 bp, Homo sapiens
gttgaaaaatgttgc

SEQ ID NO: 5437101 - DNA, 17 bp, Homo sapiens
gttgaaaaccaaaatga

SEQ ID NO: 5437102 - DNA, 18 bp, Homo sapiens
gttgaaaagtaaaaaata

SEQ ID NO: 5437103 - DNA, 22 bp, Homo sapiens
gttgaaaataaagtgtatattt

SEQ ID NO: 5437104 - DNA, 17 bp, Homo sapiens
gttgaaaatgcaactct

SEQ ID NO: 5437105 - DNA, 19 bp, Homo sapiens
gttgaaaattattttaaac

SEQ ID NO: 5437106 - DNA, 13 bp, Homo sapiens
gttgaaacagaaa

SEQ ID NO: 5437107 - DNA, 17 bp, Homo sapiens
gttgaaacttacactgt

SEQ ID NO: 5437108 - DNA, 14 bp, Homo sapiens
gttgaaagacatca

SEQ ID NO: 5437109 - DNA, 15 bp, Homo sapiens
gttgaaagacatcaa

SEQ ID NO: 5437110 - DNA, 16 bp, Homo sapiens
gttgaaagacatcaat

SEQ ID NO: 5437111 - DNA, 17 bp, Homo sapiens
gttgaaagacatcaatg

SEQ ID NO: 5437112 - DNA, 16 bp, Homo sapiens
gttgaaagcaaaaatg

SEQ ID NO: 5437113 - DNA, 16 bp, Homo sapiens
gttgaaagctttgaaa

SEQ ID NO: 5437114 - DNA, 19 bp, Homo sapiens
gttgaaagctttgaaataa

SEQ ID NO: 5437115 - DNA, 14 bp, Homo sapiens
gttgaaaggttttt

SEQ ID NO: 5437116 - DNA, 19 bp, Homo sapiens
gttgaaagtaaaaaaataa

SEQ ID NO: 5437117 - DNA, 20 bp, Homo sapiens
gttgaaattatgtatgttta

SEQ ID NO: 5437118 - DNA, 16 bp, Homo sapiens
gttgaaattgtaatta

SEQ ID NO: 5437119 - DNA, 24 bp, Homo sapiens
gttgaaattttgcaaatataaaca

SEQ ID NO: 5437120 - DNA, 14 bp, Homo sapiens
gttgaacaaaataa

SEQ ID NO: 5437121 - DNA, 15 bp, Homo sapiens
gttgaacaaaataaa

SEQ ID NO: 5437122 - DNA, 22 bp, Homo sapiens
gttgaacaagccacgttgcaga

SEQ ID NO: 5437123 - DNA, 21 bp, Homo sapiens
gttgaacactagtctgtgtaa

SEQ ID NO: 5437124 - DNA, 12 bp, Homo sapiens
gttgaacagagg

SEQ ID NO: 5437125 - DNA, 19 bp, Homo sapiens
gttgaactaatatatgaaa

SEQ ID NO: 5437126 - DNA, 19 bp, Homo sapiens
gttgaactgttagaatgta

SEQ ID NO: 5437127 - DNA, 15 bp, Homo sapiens
gttgaacttagaact

SEQ ID NO: 5437128 - DNA, 15 bp, Homo sapiens
gttgaactttgccaa

SEQ ID NO: 5437129 - DNA, 20 bp, Homo sapiens
gttgaactttgccaaaaaaa

SEQ ID NO: 5437130 - DNA, 12 bp, Homo sapiens
gttgaacttttt

SEQ ID NO: 5437131 - DNA, 18 bp, Homo sapiens
gttgaagaaaaaatggca

SEQ ID NO: 5437132 - DNA, 13 bp, Homo sapiens
gttgaagaaaaca

SEQ ID NO: 5437133 - DNA, 18 bp, Homo sapiens
gttgaagacagcttccca

SEQ ID NO: 5437134 - DNA, 20 bp, Homo sapiens
gttgaagagacagagacaag

SEQ ID NO: 5437135 - DNA, 18 bp, Homo sapiens
gttgaagaggttttaaag

SEQ ID NO: 5437136 - DNA, 18 bp, Homo sapiens
gttgaagcaaatcgaatg

SEQ ID NO: 5437137 - DNA, 15 bp, Homo sapiens
gttgaagccatgtct

SEQ ID NO: 5437138 - DNA, 22 bp, Homo sapiens
gttgaagctaagatttagagat

SEQ ID NO: 5437139 - DNA, 16 bp, Homo sapiens
gttgaagggaaatcaa

SEQ ID NO: 5437140 - DNA, 17 bp, Homo sapiens
gttgaagggaaatcaat

SEQ ID NO: 5437141 - DNA, 12 bp, Homo sapiens
gttgaagggagg

SEQ ID NO: 5437142 - DNA, 16 bp, Homo sapiens
gttgaagtcatgctcc

SEQ ID NO: 5437143 - DNA, 15 bp, Homo sapiens
gttgaagtgcatgtt

SEQ ID NO: 5437144 - DNA, 14 bp, Homo sapiens
gttgaagtgctgtt

SEQ ID NO: 5437145 - DNA, 17 bp, Homo sapiens
gttgaagtgctgtttta

SEQ ID NO: 5437146 - DNA, 14 bp, Homo sapiens
gttgaataaaaata

SEQ ID NO: 5437147 - DNA, 19 bp, Homo sapiens
gttgaataggggaaagaaa

SEQ ID NO: 5437148 - DNA, 22 bp, Homo sapiens
gttgaatatagcctgcctcagt

SEQ ID NO: 5437149 - DNA, 19 bp, Homo sapiens
gttgaatccagcacgtctg

SEQ ID NO: 5437150 - DNA, 15 bp, Homo sapiens
gttgaatctgggagg

SEQ ID NO: 5437151 - DNA, 14 bp, Homo sapiens
gttgaatgaataaa

SEQ ID NO: 5437152 - DNA, 16 bp, Homo sapiens
gttgaatggcctgcct

SEQ ID NO: 5437153 - DNA, 18 bp, Homo sapiens
gttgaatgggttctcagt

SEQ ID NO: 5437154 - DNA, 13 bp, Homo sapiens
gttgaatgttgca

SEQ ID NO: 5437155 - DNA, 19 bp, Homo sapiens
gttgaatgttgcaatgtga

SEQ ID NO: 5437156 - DNA, 17 bp, Homo sapiens
gttgaattggtgaataa

SEQ ID NO: 5437157 - DNA, 17 bp, Homo sapiens
gttgaatttcagtcctt

SEQ ID NO: 5437158 - DNA, 20 bp, Homo sapiens
gttgaattttgttctctggg

SEQ ID NO: 5437159 - DNA, 22 bp, Homo sapiens
gttgaattttgttctctgggag

SEQ ID NO: 5437160 - DNA, 17 bp, Homo sapiens
gttgtaaagatattgta

SEQ ID NO: 5437161 - DNA, 19 bp, Homo sapiens
gttgtaaagcagtacccta

SEQ ID NO: 5437162 - DNA, 12 bp, Homo sapiens
gttgtaaagtat

SEQ ID NO: 5437163 - DNA, 13 bp, Homo sapiens
gttgtaaatatag

SEQ ID NO: 5437164 - DNA, 16 bp, Homo sapiens
gttgtaaatatataaa

SEQ ID NO: 5437165 - DNA, 18 bp, Homo sapiens
gttgtaaatatataaata

SEQ ID NO: 5437166 - DNA, 21 bp, Homo sapiens
gttgtaaatgaccaagaaaaa

SEQ ID NO: 5437167 - DNA, 20 bp, Homo sapiens
gttgtaaatgctcgtgtgat

SEQ ID NO: 5437168 - DNA, 13 bp, Homo sapiens
gttgtaactaggc

SEQ ID NO: 5437169 - DNA, 18 bp, Homo sapiens
gttgtaacttatgtagat

SEQ ID NO: 5437170 - DNA, 23 bp, Homo sapiens
gttgtaatatcagttacagtggc

SEQ ID NO: 5437171 - DNA, 21 bp, Homo sapiens
gttgtaatgcacacttatttt

SEQ ID NO: 5437172 - DNA, 14 bp, Homo sapiens
gttgtaatgctgca

SEQ ID NO: 5437173 - DNA, 14 bp, Homo sapiens
gttgtacaagctca

SEQ ID NO: 5437174 - DNA, 19 bp, Homo sapiens
gttgtacaattaagttaca

SEQ ID NO: 5437175 - DNA, 19 bp, Homo sapiens
gttgtacaattactgtgag

SEQ ID NO: 5437176 - DNA, 14 bp, Homo sapiens
gttgtacacagtct

SEQ ID NO: 5437177 - DNA, 12 bp, Homo sapiens
gttgtacacttg

SEQ ID NO: 5437178 - DNA, 12 bp, Homo sapiens
gttgtacatgaa

SEQ ID NO: 5437179 - DNA, 16 bp, Homo sapiens
gttgtaccaagtgaaa

SEQ ID NO: 5437180 - DNA, 21 bp, Homo sapiens
gttgtaccactgctaataaat

SEQ ID NO: 5437181 - DNA, 14 bp, Homo sapiens
gttgtactgctttg

SEQ ID NO: 5437182 - DNA, 12 bp, Homo sapiens
gttgtactgtat

SEQ ID NO: 5437183 - DNA, 15 bp, Homo sapiens
gttgtacttaaatgg

SEQ ID NO: 5437184 - DNA, 16 bp, Homo sapiens
gttgtactttatatct

SEQ ID NO: 5437185 - DNA, 18 bp, Homo sapiens
gttgtactttggaattct

SEQ ID NO: 5437186 - DNA, 19 bp, Homo sapiens
gttgtactttttattcaat

SEQ ID NO: 5437187 - DNA, 20 bp, Homo sapiens
gttgtagaatgtattgtacc

SEQ ID NO: 5437188 - DNA, 15 bp, Homo sapiens
gttgtagacaaagta

SEQ ID NO: 5437189 - DNA, 16 bp, Homo sapiens
gttgtagatacaatca

SEQ ID NO: 5437190 - DNA, 21 bp, Homo sapiens
gttgtagatacaatcagctgc

SEQ ID NO: 5437191 - DNA, 14 bp, Homo sapiens
gttgtagcagaaac

SEQ ID NO: 5437192 - DNA, 18 bp, Homo sapiens
gttgtagcatttaaaatg

SEQ ID NO: 5437193 - DNA, 16 bp, Homo sapiens
gttgtagcattttcct

SEQ ID NO: 5437194 - DNA, 22 bp, Homo sapiens
gttgtaggactaaataatgatc

SEQ ID NO: 5437195 - DNA, 14 bp, Homo sapiens
gttgtagtaaagaa

SEQ ID NO: 5437196 - DNA, 12 bp, Homo sapiens
gttgtataattt

SEQ ID NO: 5437197 - DNA, 15 bp, Homo sapiens
gttgtatataaagtt

SEQ ID NO: 5437198 - DNA, 21 bp, Homo sapiens
gttgtatctacagtaatgaaa

SEQ ID NO: 5437199 - DNA, 16 bp, Homo sapiens
gttgtattaacaaaag

SEQ ID NO: 5437200 - DNA, 13 bp, Homo sapiens
gttgtattattag

SEQ ID NO: 5437201 - DNA, 14 bp, Homo sapiens
gttgtattattaga

SEQ ID NO: 5437202 - DNA, 20 bp, Homo sapiens
gttgtattctttgatgttaa

SEQ ID NO: 5437203 - DNA, 22 bp, Homo sapiens
gttgtattctttgatgttaaca

SEQ ID NO: 5437204 - DNA, 12 bp, Homo sapiens
gttgtatttcaa

SEQ ID NO: 5437205 - DNA, 23 bp, Homo sapiens
gttgtatttcaaatatctaagca

SEQ ID NO: 5437206 - DNA, 13 bp, Homo sapiens
gttgtatttctat

SEQ ID NO: 5437207 - DNA, 19 bp, Homo sapiens
gttgtatttgttatttatt

SEQ ID NO: 5437208 - DNA, 23 bp, Homo sapiens
gttgtcaaaactccactcagcac

SEQ ID NO: 5437209 - DNA, 14 bp, Homo sapiens
gttgtcaagaatag

SEQ ID NO: 5437210 - DNA, 17 bp, Homo sapiens
gttgtcaagtctctgct

SEQ ID NO: 5437211 - DNA, 15 bp, Homo sapiens
gttgtcaatattaaa

SEQ ID NO: 5437212 - DNA, 21 bp, Homo sapiens
gttgtcaatattaaatacaga

SEQ ID NO: 5437213 - DNA, 20 bp, Homo sapiens
gttgtcacagaaattatgat

SEQ ID NO: 5437214 - DNA, 17 bp, Homo sapiens
gttgtcacatctcaggg

SEQ ID NO: 5437215 - DNA, 22 bp, Homo sapiens
gttgtcactgcttttggcctgg

SEQ ID NO: 5437216 - DNA, 18 bp, Homo sapiens
gttgtcagcatcttctca

SEQ ID NO: 5437217 - DNA, 16 bp, Homo sapiens
gttgtcagcctgtgct

SEQ ID NO: 5437218 - DNA, 18 bp, Homo sapiens
gttgtcaggttatttatt

SEQ ID NO: 5437219 - DNA, 21 bp, Homo sapiens
gttgtcataacatttaaagag

SEQ ID NO: 5437220 - DNA, 14 bp, Homo sapiens
gttgtcattgcttt

SEQ ID NO: 5437221 - DNA, 17 bp, Homo sapiens
gttgtcattgtccagct

SEQ ID NO: 5437222 - DNA, 16 bp, Homo sapiens
gttgtcatttccaaat

SEQ ID NO: 5437223 - DNA, 14 bp, Homo sapiens
gttgtccaatttgt

SEQ ID NO: 5437224 - DNA, 22 bp, Homo sapiens
gttgtccaatttgtaagtaaca

SEQ ID NO: 5437225 - DNA, 17 bp, Homo sapiens
gttgtccccttcctctc

SEQ ID NO: 5437226 - DNA, 17 bp, Homo sapiens
gttgtccctacaggagg

SEQ ID NO: 5437227 - DNA, 13 bp, Homo sapiens
gttgtcctcccag

SEQ ID NO: 5437228 - DNA, 16 bp, Homo sapiens
gttgtcctcccaggaa

SEQ ID NO: 5437229 - DNA, 22 bp, Homo sapiens
gttgtcctcccaggaaccaaaa

SEQ ID NO: 5437230 - DNA, 20 bp, Homo sapiens
gttgtcctccttccggggaa

SEQ ID NO: 5437231 - DNA, 15 bp, Homo sapiens
gttgtcctgtgtcat

SEQ ID NO: 5437232 - DNA, 17 bp, Homo sapiens
gttgtccttaaaattcc

SEQ ID NO: 5437233 - DNA, 13 bp, Homo sapiens
gttgtcctttctg

SEQ ID NO: 5437234 - DNA, 15 bp, Homo sapiens
gttgtccttttcata

SEQ ID NO: 5437235 - DNA, 18 bp, Homo sapiens
gttgtctacgggggcact

SEQ ID NO: 5437236 - DNA, 20 bp, Homo sapiens
gttgtctaggagacagagcc

SEQ ID NO: 5437237 - DNA, 20 bp, Homo sapiens
gttgtctattctgagccttg

SEQ ID NO: 5437238 - DNA, 22 bp, Homo sapiens
gttgtctattctgagccttgag

SEQ ID NO: 5437239 - DNA, 21 bp, Homo sapiens
gttgtctcagccgagcccagg

SEQ ID NO: 5437240 - DNA, 21 bp, Homo sapiens
gttgtctccacttgtatatat

SEQ ID NO: 5437241 - DNA, 13 bp, Homo sapiens
gttgtctccctgg

SEQ ID NO: 5437242 - DNA, 17 bp, Homo sapiens
gttgtctccctggccct

SEQ ID NO: 5437243 - DNA, 18 bp, Homo sapiens
gttgtctccttccattca

SEQ ID NO: 5437244 - DNA, 23 bp, Homo sapiens
gttgtctccttccattcagatgt

SEQ ID NO: 5437245 - DNA, 13 bp, Homo sapiens
gttgtctctctaa

SEQ ID NO: 5437246 - DNA, 20 bp, Homo sapiens
gttgtctgaacccaggcagc

SEQ ID NO: 5437247 - DNA, 19 bp, Homo sapiens
gttgtctgcaactctgaag

SEQ ID NO: 5437248 - DNA, 19 bp, Homo sapiens
gttgtctgcgcctgaaaag

SEQ ID NO: 5437249 - DNA, 16 bp, Homo sapiens
gttgtctggcaaggac

SEQ ID NO: 5437250 - DNA, 12 bp, Homo sapiens
gttgtctgtcct

SEQ ID NO: 5437251 - DNA, 15 bp, Homo sapiens
gttgtgaaatgtaac

SEQ ID NO: 5437252 - DNA, 17 bp, Homo sapiens
gttgtgaaatgtaacat

SEQ ID NO: 5437253 - DNA, 18 bp, Homo sapiens
gttgtgaaatgtaacatg

SEQ ID NO: 5437254 - DNA, 13 bp, Homo sapiens
gttgtgaataatt

SEQ ID NO: 5437255 - DNA, 14 bp, Homo sapiens
gttgtgaatgttgt

SEQ ID NO: 5437256 - DNA, 13 bp, Homo sapiens
gttgtgacctgaa

SEQ ID NO: 5437257 - DNA, 22 bp, Homo sapiens
gttgtgactctaagctcagtgc

SEQ ID NO: 5437258 - DNA, 23 bp, Homo sapiens
gttgtgactgccaggataaagct

SEQ ID NO: 5437259 - DNA, 19 bp, Homo sapiens
gttgtgactgctgccattt

SEQ ID NO: 5437260 - DNA, 19 bp, Homo sapiens
gttgtgagccctctagggc

SEQ ID NO: 5437261 - DNA, 13 bp, Homo sapiens
gttgtgaggcctg

SEQ ID NO: 5437262 - DNA, 17 bp, Homo sapiens
gttgtgatacagagtat

SEQ ID NO: 5437263 - DNA, 17 bp, Homo sapiens
gttgtgatctgttgtaa

SEQ ID NO: 5437264 - DNA, 21 bp, Homo sapiens
gttgtgatgaagctgaggctg

SEQ ID NO: 5437265 - DNA, 10 bp, Homo sapiens
gttgtgattt

SEQ ID NO: 5437266 - DNA, 22 bp, Homo sapiens
gttgtgattttgtacagaattt

SEQ ID NO: 5437267 - DNA, 12 bp, Homo sapiens
gttgtgccaaat

SEQ ID NO: 5437268 - DNA, 20 bp, Homo sapiens
gttgtgcctggttcgtgcca

SEQ ID NO: 5437269 - DNA, 16 bp, Homo sapiens
gttgtgctaatttctg

SEQ ID NO: 5437270 - DNA, 11 bp, Homo sapiens
gttgtgctata

SEQ ID NO: 5437271 - DNA, 13 bp, Homo sapiens
gttgtgcttgagc

SEQ ID NO: 5437272 - DNA, 14 bp, Homo sapiens
gttgtggaggaggt

SEQ ID NO: 5437273 - DNA, 14 bp, Homo sapiens
gttgtggatatcag

SEQ ID NO: 5437274 - DNA, 17 bp, Homo sapiens
gttgtggatgctccagg

SEQ ID NO: 5437275 - DNA, 14 bp, Homo sapiens
gttgtggccaatgt

SEQ ID NO: 5437276 - DNA, 20 bp, Homo sapiens
gttgtggcccccgccccctc

SEQ ID NO: 5437277 - DNA, 24 bp, Homo sapiens
gttgtggcctttgcgctcctggcc

SEQ ID NO: 5437278 - DNA, 13 bp, Homo sapiens
gttgtggggaggc

SEQ ID NO: 5437279 - DNA, 15 bp, Homo sapiens
gttgtgggtgggaga

SEQ ID NO: 5437280 - DNA, 13 bp, Homo sapiens
gttgtgtaataac

SEQ ID NO: 5437281 - DNA, 19 bp, Homo sapiens
gttgtgtaggcaccacctc

SEQ ID NO: 5437282 - DNA, 12 bp, Homo sapiens
gttgtgtatggg

SEQ ID NO: 5437283 - DNA, 19 bp, Homo sapiens
gttgtgtcactgactcagg

SEQ ID NO: 5437284 - DNA, 22 bp, Homo sapiens
gttgtgtctgtgccctccaaag

SEQ ID NO: 5437285 - DNA, 12 bp, Homo sapiens
gttgtgtctttt

SEQ ID NO: 5437286 - DNA, 15 bp, Homo sapiens
gttgtgtgagcgtgg

SEQ ID NO: 5437287 - DNA, 16 bp, Homo sapiens
gttgtgtgagcgtggc

SEQ ID NO: 5437288 - DNA, 23 bp, Homo sapiens
gttgtgtgagcgtggccttggga

SEQ ID NO: 5437289 - DNA, 14 bp, Homo sapiens
gttgtgtggcccag

SEQ ID NO: 5437290 - DNA, 14 bp, Homo sapiens
gttgtgtgtgggag

SEQ ID NO: 5437291 - DNA, 14 bp, Homo sapiens
gttgtgtgtgttct

SEQ ID NO: 5437292 - DNA, 15 bp, Homo sapiens
gttgtgtgttgcact

SEQ ID NO: 5437293 - DNA, 20 bp, Homo sapiens
gttgtgttaattctttctca

SEQ ID NO: 5437294 - DNA, 16 bp, Homo sapiens
gttgtgttcatgctga

SEQ ID NO: 5437295 - DNA, 21 bp, Homo sapiens
gttgtgttgttatcatttaag

SEQ ID NO: 5437296 - DNA, 20 bp, Homo sapiens
gttgtgtttgttgctggctt

SEQ ID NO: 5437297 - DNA, 16 bp, Homo sapiens
gttgtgttttttaaga

SEQ ID NO: 5437298 - DNA, 15 bp, Homo sapiens
gttgttaaatgctat

SEQ ID NO: 5437299 - DNA, 23 bp, Homo sapiens
gttgttaacacgtgacactgtgg

SEQ ID NO: 5437300 - DNA, 16 bp, Homo sapiens
gttgttaatgaaaatg

SEQ ID NO: 5437301 - DNA, 19 bp, Homo sapiens
gttgttaatgaaaatgtca

SEQ ID NO: 5437302 - DNA, 13 bp, Homo sapiens
gttgttaatgttg

SEQ ID NO: 5437303 - DNA, 14 bp, Homo sapiens
gttgttaatgttgg

SEQ ID NO: 5437304 - DNA, 14 bp, Homo sapiens
gttgttacattttt

SEQ ID NO: 5437305 - DNA, 22 bp, Homo sapiens
gttgttaccaaatacacatttc

SEQ ID NO: 5437306 - DNA, 15 bp, Homo sapiens
gttgttagtttcttt

SEQ ID NO: 5437307 - DNA, 19 bp, Homo sapiens
gttgttatcatttaagatt

SEQ ID NO: 5437308 - DNA, 14 bp, Homo sapiens
gttgttatgatgtg

SEQ ID NO: 5437309 - DNA, 15 bp, Homo sapiens
gttgttatgatgtgc

SEQ ID NO: 5437310 - DNA, 14 bp, Homo sapiens
gttgttattattca

SEQ ID NO: 5437311 - DNA, 24 bp, Homo sapiens
gttgttccagggagcttctacctg

SEQ ID NO: 5437312 - DNA, 14 bp, Homo sapiens
gttgttcccacaca

SEQ ID NO: 5437313 - DNA, 15 bp, Homo sapiens
gttgttcccacacac

SEQ ID NO: 5437314 - DNA, 22 bp, Homo sapiens
gttgttcctctatactttgttc

SEQ ID NO: 5437315 - DNA, 19 bp, Homo sapiens
gttgttccttcacatttaa

SEQ ID NO: 5437316 - DNA, 14 bp, Homo sapiens
gttgttctcagggg

SEQ ID NO: 5437317 - DNA, 13 bp, Homo sapiens
gttgttctgcctg

SEQ ID NO: 5437318 - DNA, 17 bp, Homo sapiens
gttgttctgtggtcaca

SEQ ID NO: 5437319 - DNA, 18 bp, Homo sapiens
gttgttctgttaactgaa

SEQ ID NO: 5437320 - DNA, 19 bp, Homo sapiens
gttgttgacagtgaggaaa

SEQ ID NO: 5437321 - DNA, 15 bp, Homo sapiens
gttgttgactgtgat

SEQ ID NO: 5437322 - DNA, 21 bp, Homo sapiens
gttgttgataaggaacattta

SEQ ID NO: 5437323 - DNA, 23 bp, Homo sapiens
gttgttgccaggttgcagctgct

SEQ ID NO: 5437324 - DNA, 15 bp, Homo sapiens
gttgttgctgctgtt

SEQ ID NO: 5437325 - DNA, 14 bp, Homo sapiens
gttgttggcaagct

SEQ ID NO: 5437326 - DNA, 17 bp, Homo sapiens
gttgttggcaagctgca

SEQ ID NO: 5437327 - DNA, 12 bp, Homo sapiens
gttgttgtagta

SEQ ID NO: 5437328 - DNA, 16 bp, Homo sapiens
gttgttgtccctgcag

SEQ ID NO: 5437329 - DNA, 18 bp, Homo sapiens
gttgttgtgtgtatatgt

SEQ ID NO: 5437330 - DNA, 12 bp, Homo sapiens
gttgttgttctc

SEQ ID NO: 5437331 - DNA, 13 bp, Homo sapiens
gttgttgttcttt

SEQ ID NO: 5437332 - DNA, 16 bp, Homo sapiens
gttgttgttttacatc

SEQ ID NO: 5437333 - DNA, 14 bp, Homo sapiens
gttgttgttttgtt

SEQ ID NO: 5437334 - DNA, 18 bp, Homo sapiens
gttgtttaacttgtcttt

SEQ ID NO: 5437335 - DNA, 22 bp, Homo sapiens
gttgtttaacttgtctttttgt

SEQ ID NO: 5437336 - DNA, 20 bp, Homo sapiens
gttgtttagaaacagaaata

SEQ ID NO: 5437337 - DNA, 17 bp, Homo sapiens
gttgtttatatgaaaac

SEQ ID NO: 5437338 - DNA, 12 bp, Homo sapiens
gttgtttcagtg

SEQ ID NO: 5437339 - DNA, 19 bp, Homo sapiens
gttgtttctataaatgact

SEQ ID NO: 5437340 - DNA, 13 bp, Homo sapiens
gttgtttctctga

SEQ ID NO: 5437341 - DNA, 15 bp, Homo sapiens
gttgtttctctgagc

SEQ ID NO: 5437342 - DNA, 12 bp, Homo sapiens
gttgtttcttcc

SEQ ID NO: 5437343 - DNA, 13 bp, Homo sapiens
gttgtttcttcca

SEQ ID NO: 5437344 - DNA, 13 bp, Homo sapiens
gttgtttgaaaat

SEQ ID NO: 5437345 - DNA, 23 bp, Homo sapiens
gttgtttgaggcaaattaactgt

SEQ ID NO: 5437346 - DNA, 20 bp, Homo sapiens
gttgtttgattcagacagct

SEQ ID NO: 5437347 - DNA, 12 bp, Homo sapiens
gttgtttgcatg

SEQ ID NO: 5437348 - DNA, 13 bp, Homo sapiens
gttgtttgtaaat

SEQ ID NO: 5437349 - DNA, 13 bp, Homo sapiens
gttgtttgtgcct

SEQ ID NO: 5437350 - DNA, 18 bp, Homo sapiens
gttgttttatagaggttc

SEQ ID NO: 5437351 - DNA, 14 bp, Homo sapiens
gttgttttctactt

SEQ ID NO: 5437352 - DNA, 15 bp, Homo sapiens
gttgttttgtacaga

SEQ ID NO: 5437353 - DNA, 15 bp, Homo sapiens
gttgttttgtgtata

SEQ ID NO: 5437354 - DNA, 19 bp, Homo sapiens
gttgtttttaagtcctgta

SEQ ID NO: 5437355 - DNA, 14 bp, Homo sapiens
gtttaaaaaaacat

SEQ ID NO: 5437356 - DNA, 15 bp, Homo sapiens
gtttaaaaaaagaaa

SEQ ID NO: 5437357 - DNA, 14 bp, Homo sapiens
gtttaaaaaaagta

SEQ ID NO: 5437358 - DNA, 22 bp, Homo sapiens
gtttaaaaaaagtatatattct

SEQ ID NO: 5437359 - DNA, 21 bp, Homo sapiens
gtttaaaaaagtttaaaatgt

SEQ ID NO: 5437360 - DNA, 13 bp, Homo sapiens
gtttaaaaaatac

SEQ ID NO: 5437361 - DNA, 14 bp, Homo sapiens
gtttaaaaaataca

SEQ ID NO: 5437362 - DNA, 22 bp, Homo sapiens
gtttaaaaacattttttaagga

SEQ ID NO: 5437363 - DNA, 20 bp, Homo sapiens
gtttaaaaaccgaataaatg

SEQ ID NO: 5437364 - DNA, 14 bp, Homo sapiens
gtttaaaaagtaag

SEQ ID NO: 5437365 - DNA, 12 bp, Homo sapiens
gtttaaaaatat

SEQ ID NO: 5437366 - DNA, 18 bp, Homo sapiens
gtttaaaaatcagaaaga

SEQ ID NO: 5437367 - DNA, 19 bp, Homo sapiens
gtttaaaaatccccaaaaa

SEQ ID NO: 5437368 - DNA, 22 bp, Homo sapiens
gtttaaaaatccccaaaaaagc

SEQ ID NO: 5437369 - DNA, 18 bp, Homo sapiens
gtttaaaaatctgccacc

SEQ ID NO: 5437370 - DNA, 17 bp, Homo sapiens
gtttaaaaattgtctct

SEQ ID NO: 5437371 - DNA, 14 bp, Homo sapiens
gtttaaaaatttat

SEQ ID NO: 5437372 - DNA, 19 bp, Homo sapiens
gtttaaaacagtatttatt

SEQ ID NO: 5437373 - DNA, 22 bp, Homo sapiens
gtttaaaactcagaatataaca

SEQ ID NO: 5437374 - DNA, 14 bp, Homo sapiens
gtttaaaagaaaaa

SEQ ID NO: 5437375 - DNA, 22 bp, Homo sapiens
gtttaaaagcatactctatgtg

SEQ ID NO: 5437376 - DNA, 15 bp, Homo sapiens
gtttaaaagccatgt

SEQ ID NO: 5437377 - DNA, 19 bp, Homo sapiens
gtttaaaaggctaagaata

SEQ ID NO: 5437378 - DNA, 19 bp, Homo sapiens
gtttaaaagttgtgcatgt

SEQ ID NO: 5437379 - DNA, 15 bp, Homo sapiens
gtttaaaataaaagt

SEQ ID NO: 5437380 - DNA, 19 bp, Homo sapiens
gtttaaaatgaagcaattt

SEQ ID NO: 5437381 - DNA, 13 bp, Homo sapiens
gtttaaaatgtaa

SEQ ID NO: 5437382 - DNA, 10 bp, Homo sapiens
gtttaaaatt

SEQ ID NO: 5437383 - DNA, 16 bp, Homo sapiens
gtttaaaattcagttt

SEQ ID NO: 5437384 - DNA, 18 bp, Homo sapiens
gtttaaacaatctttcat

SEQ ID NO: 5437385 - DNA, 20 bp, Homo sapiens
gtttaaacaatctttcatgt

SEQ ID NO: 5437386 - DNA, 17 bp, Homo sapiens
gtttaaacccaagtgct

SEQ ID NO: 5437387 - DNA, 19 bp, Homo sapiens
gtttaaacccaagtgctgc

SEQ ID NO: 5437388 - DNA, 18 bp, Homo sapiens
gtttaaacttctctgaag

SEQ ID NO: 5437389 - DNA, 12 bp, Homo sapiens
gtttaaactttt

SEQ ID NO: 5437390 - DNA, 13 bp, Homo sapiens
gtttaaactttta

SEQ ID NO: 5437391 - DNA, 12 bp, Homo sapiens
gtttaaagaaga

SEQ ID NO: 5437392 - DNA, 13 bp, Homo sapiens
gtttaaagcatta

SEQ ID NO: 5437393 - DNA, 21 bp, Homo sapiens
gtttaaagtgaatttttaaag

SEQ ID NO: 5437394 - DNA, 21 bp, Homo sapiens
gtttaaagtgcagtcatttgt

SEQ ID NO: 5437395 - DNA, 16 bp, Homo sapiens
gtttaaagtgtattat

SEQ ID NO: 5437396 - DNA, 23 bp, Homo sapiens
gtttaaagtgtattataacagtg

SEQ ID NO: 5437397 - DNA, 17 bp, Homo sapiens
gtttaaagttctgtgta

SEQ ID NO: 5437398 - DNA, 13 bp, Homo sapiens
gtttaaataaagt

SEQ ID NO: 5437399 - DNA, 17 bp, Homo sapiens
gtttaaataaagtatca

SEQ ID NO: 5437400 - DNA, 19 bp, Homo sapiens
gtttaaataaagtatcatg

SEQ ID NO: 5437401 - DNA, 22 bp, Homo sapiens
gtttaaataaagtatcatgcat

SEQ ID NO: 5437402 - DNA, 12 bp, Homo sapiens
gtttaaatacat

SEQ ID NO: 5437403 - DNA, 14 bp, Homo sapiens
gtttaaatgaacaa

SEQ ID NO: 5437404 - DNA, 19 bp, Homo sapiens
gtttaaatgaacaagagaa

SEQ ID NO: 5437405 - DNA, 19 bp, Homo sapiens
gtttaaatgccaaaatgta

SEQ ID NO: 5437406 - DNA, 22 bp, Homo sapiens
gtttaacaagtatttattccca

SEQ ID NO: 5437407 - DNA, 23 bp, Homo sapiens
gtttaacacttctgtatgcatca

SEQ ID NO: 5437408 - DNA, 22 bp, Homo sapiens
gtttaacagatatttaaattta

SEQ ID NO: 5437409 - DNA, 15 bp, Homo sapiens
gtttaacataaaggt

SEQ ID NO: 5437410 - DNA, 13 bp, Homo sapiens
gtttaacattgat

SEQ ID NO: 5437411 - DNA, 12 bp, Homo sapiens
gtttaactcaga

SEQ ID NO: 5437412 - DNA, 23 bp, Homo sapiens
gtttaactcagatcactactgca

SEQ ID NO: 5437413 - DNA, 17 bp, Homo sapiens
gtttaactggcatggat

SEQ ID NO: 5437414 - DNA, 23 bp, Homo sapiens
gtttaactttaaaactgtattta

SEQ ID NO: 5437415 - DNA, 23 bp, Homo sapiens
gtttaactttgggcccagaaact

SEQ ID NO: 5437416 - DNA, 13 bp, Homo sapiens
gtttaactttgtg

SEQ ID NO: 5437417 - DNA, 13 bp, Homo sapiens
gtttaagaatcat

SEQ ID NO: 5437418 - DNA, 18 bp, Homo sapiens
gtttaagaatcatggatt

SEQ ID NO: 5437419 - DNA, 14 bp, Homo sapiens
gtttaagagttttc

SEQ ID NO: 5437420 - DNA, 21 bp, Homo sapiens
gtttaagatttaatttgccaa

SEQ ID NO: 5437421 - DNA, 12 bp, Homo sapiens
gtttaagcagaa

SEQ ID NO: 5437422 - DNA, 22 bp, Homo sapiens
gtttaagccagagtgtattaca

SEQ ID NO: 5437423 - DNA, 23 bp, Homo sapiens
gtttaagcttaacatttcatgta

SEQ ID NO: 5437424 - DNA, 15 bp, Homo sapiens
gtttaaggttaatta

SEQ ID NO: 5437425 - DNA, 18 bp, Homo sapiens
gtttaagtagatttcatg

SEQ ID NO: 5437426 - DNA, 22 bp, Homo sapiens
gtttaagtcattttttacttga

SEQ ID NO: 5437427 - DNA, 21 bp, Homo sapiens
gtttaagtgactgatggctaa

SEQ ID NO: 5437428 - DNA, 14 bp, Homo sapiens
gtttaagttgtatt

SEQ ID NO: 5437429 - DNA, 20 bp, Homo sapiens
gtttaagttgtattaaaaat

SEQ ID NO: 5437430 - DNA, 15 bp, Homo sapiens
gtttaataaagcttt

SEQ ID NO: 5437431 - DNA, 17 bp, Homo sapiens
gtttaataaagctttat

SEQ ID NO: 5437432 - DNA, 12 bp, Homo sapiens
gtttaataaagg

SEQ ID NO: 5437433 - DNA, 14 bp, Homo sapiens
gtttaataaaggct

SEQ ID NO: 5437434 - DNA, 16 bp, Homo sapiens
gtttaataatatgtac

SEQ ID NO: 5437435 - DNA, 16 bp, Homo sapiens
gtttaatacaggaaat

SEQ ID NO: 5437436 - DNA, 20 bp, Homo sapiens
gtttaatatctgactgaaat

SEQ ID NO: 5437437 - DNA, 18 bp, Homo sapiens
gtttaatattaaagccat

SEQ ID NO: 5437438 - DNA, 12 bp, Homo sapiens
gtttaatattta

SEQ ID NO: 5437439 - DNA, 19 bp, Homo sapiens
gtttaatcatataaataga

SEQ ID NO: 5437440 - DNA, 12 bp, Homo sapiens
gtttaatgcaaa

SEQ ID NO: 5437441 - DNA, 18 bp, Homo sapiens
gtttaatgggtatgctca

SEQ ID NO: 5437442 - DNA, 17 bp, Homo sapiens
gtttaatggtagtttta

SEQ ID NO: 5437443 - DNA, 21 bp, Homo sapiens
gtttaatgtgaactctcccct

SEQ ID NO: 5437444 - DNA, 23 bp, Homo sapiens
gtttaatgtgaactctcccctcc

SEQ ID NO: 5437445 - DNA, 23 bp, Homo sapiens
gtttaatgttggaaaacatatga

SEQ ID NO: 5437446 - DNA, 13 bp, Homo sapiens
gtttaatgtttat

SEQ ID NO: 5437447 - DNA, 16 bp, Homo sapiens
gtttaatgtttataca

SEQ ID NO: 5437448 - DNA, 13 bp, Homo sapiens
gtttaatgttttg

SEQ ID NO: 5437449 - DNA, 23 bp, Homo sapiens
gtttaattagatttctgaatctc

SEQ ID NO: 5437450 - DNA, 21 bp, Homo sapiens
gtttaattcattaatctgttt

SEQ ID NO: 5437451 - DNA, 20 bp, Homo sapiens
gtttaattgtataaaacagt

SEQ ID NO: 5437452 - DNA, 19 bp, Homo sapiens
gtttaattgtttgtcctca

SEQ ID NO: 5437453 - DNA, 14 bp, Homo sapiens
gtttaatttaaagc

SEQ ID NO: 5437454 - DNA, 14 bp, Homo sapiens
gtttaatttacaca

SEQ ID NO: 5437455 - DNA, 20 bp, Homo sapiens
gtttacaaaaggcagccctt

SEQ ID NO: 5437456 - DNA, 15 bp, Homo sapiens
gtttacaacaaacac

SEQ ID NO: 5437457 - DNA, 21 bp, Homo sapiens
gtttacaacaaacactgtgat

SEQ ID NO: 5437458 - DNA, 13 bp, Homo sapiens
gtttacaacacag

SEQ ID NO: 5437459 - DNA, 22 bp, Homo sapiens
gtttacaacatcaccagtgcca

SEQ ID NO: 5437460 - DNA, 19 bp, Homo sapiens
gtttacaagcccccccttc

SEQ ID NO: 5437461 - DNA, 16 bp, Homo sapiens
gtttacaagtgtatat

SEQ ID NO: 5437462 - DNA, 23 bp, Homo sapiens
gtttacaagtgtatatcagaaaa

SEQ ID NO: 5437463 - DNA, 20 bp, Homo sapiens
gtttacaatattatgtttcc

SEQ ID NO: 5437464 - DNA, 18 bp, Homo sapiens
gtttacaatgatgccgaa

SEQ ID NO: 5437465 - DNA, 18 bp, Homo sapiens
gtttacaatttacaaagt

SEQ ID NO: 5437466 - DNA, 16 bp, Homo sapiens
gtttacactctttgta

SEQ ID NO: 5437467 - DNA, 20 bp, Homo sapiens
gtttacactgcggaagccaa

SEQ ID NO: 5437468 - DNA, 22 bp, Homo sapiens
gtttacagacaaggcaggcctg

SEQ ID NO: 5437469 - DNA, 16 bp, Homo sapiens
gtttacagatgttttc

SEQ ID NO: 5437470 - DNA, 14 bp, Homo sapiens
gtttacaggatatt

SEQ ID NO: 5437471 - DNA, 18 bp, Homo sapiens
gtttacaggatattccaa

SEQ ID NO: 5437472 - DNA, 22 bp, Homo sapiens
gtttacaggatattccaaaata

SEQ ID NO: 5437473 - DNA, 20 bp, Homo sapiens
gtttacagggagcctcctgc

SEQ ID NO: 5437474 - DNA, 13 bp, Homo sapiens
gtttacaggggtt

SEQ ID NO: 5437475 - DNA, 15 bp, Homo sapiens
gtttacagtaaataa

SEQ ID NO: 5437476 - DNA, 13 bp, Homo sapiens
gtttacagtattt

SEQ ID NO: 5437477 - DNA, 19 bp, Homo sapiens
gtttacagtatttctacat

SEQ ID NO: 5437478 - DNA, 21 bp, Homo sapiens
gtttacagtctatttgagact

SEQ ID NO: 5437479 - DNA, 13 bp, Homo sapiens
gtttacagtgaag

SEQ ID NO: 5437480 - DNA, 12 bp, Homo sapiens
gtttacagtgta

SEQ ID NO: 5437481 - DNA, 19 bp, Homo sapiens
gtttacagtgtatttaaga

SEQ ID NO: 5437482 - DNA, 17 bp, Homo sapiens
gtttacagtttgtgttt

SEQ ID NO: 5437483 - DNA, 17 bp, Homo sapiens
gtttacatatctgtccc

SEQ ID NO: 5437484 - DNA, 15 bp, Homo sapiens
gtttacatgaacaca

SEQ ID NO: 5437485 - DNA, 22 bp, Homo sapiens
gtttacatgaacacagctgctg

SEQ ID NO: 5437486 - DNA, 17 bp, Homo sapiens
gtttacatgaagcagaa

SEQ ID NO: 5437487 - DNA, 19 bp, Homo sapiens
gtttacatgaagcagaacc

SEQ ID NO: 5437488 - DNA, 20 bp, Homo sapiens
gtttacatgaagcagaacct

SEQ ID NO: 5437489 - DNA, 21 bp, Homo sapiens
gtttacatgaagcagaacctt

SEQ ID NO: 5437490 - DNA, 13 bp, Homo sapiens
gtttacatgtgta

SEQ ID NO: 5437491 - DNA, 21 bp, Homo sapiens
gtttacatgtgtagcctatgt

SEQ ID NO: 5437492 - DNA, 15 bp, Homo sapiens
gtttacatttaaagc

SEQ ID NO: 5437493 - DNA, 15 bp, Homo sapiens
gtttacattttatgg

SEQ ID NO: 5437494 - DNA, 20 bp, Homo sapiens
gtttacatttttatttatga

SEQ ID NO: 5437495 - DNA, 18 bp, Homo sapiens
gtttaccagttgcctttt

SEQ ID NO: 5437496 - DNA, 20 bp, Homo sapiens
gtttaccatttgtaataaag

SEQ ID NO: 5437497 - DNA, 16 bp, Homo sapiens
gtttaccatttttcat

SEQ ID NO: 5437498 - DNA, 16 bp, Homo sapiens
gtttacccatgaagat

SEQ ID NO: 5437499 - DNA, 13 bp, Homo sapiens
gtttaccctccct

SEQ ID NO: 5437500 - DNA, 19 bp, Homo sapiens
gtttaccggttgtttagaa

SEQ ID NO: 5437501 - DNA, 13 bp, Homo sapiens
gtttacctcactg

SEQ ID NO: 5437502 - DNA, 18 bp, Homo sapiens
gtttacctcactggtgca

SEQ ID NO: 5437503 - DNA, 20 bp, Homo sapiens
gtttacctcatccatgcact

SEQ ID NO: 5437504 - DNA, 14 bp, Homo sapiens
gtttacctgcaccg

SEQ ID NO: 5437505 - DNA, 15 bp, Homo sapiens
gtttacctggtgctc

SEQ ID NO: 5437506 - DNA, 16 bp, Homo sapiens
gtttaccttcagccat

SEQ ID NO: 5437507 - DNA, 19 bp, Homo sapiens
gtttacggtacttggtaag

SEQ ID NO: 5437508 - DNA, 23 bp, Homo sapiens
gtttactatatagaatttcctgt

SEQ ID NO: 5437509 - DNA, 16 bp, Homo sapiens
gtttactatgcctgtg

SEQ ID NO: 5437510 - DNA, 15 bp, Homo sapiens
gtttactcacagcca

SEQ ID NO: 5437511 - DNA, 17 bp, Homo sapiens
gtttactcccttctgta

SEQ ID NO: 5437512 - DNA, 20 bp, Homo sapiens
gtttactcccttctgtagtt

SEQ ID NO: 5437513 - DNA, 17 bp, Homo sapiens
gtttactctctccctct

SEQ ID NO: 5437514 - DNA, 14 bp, Homo sapiens
gtttactgaaattt

SEQ ID NO: 5437515 - DNA, 19 bp, Homo sapiens
gtttactgacatggtgctg

SEQ ID NO: 5437516 - DNA, 22 bp, Homo sapiens
gtttactgacatggtgctgtgt

SEQ ID NO: 5437517 - DNA, 14 bp, Homo sapiens
gtttactgctgtca

SEQ ID NO: 5437518 - DNA, 18 bp, Homo sapiens
gtttactggataaattta

SEQ ID NO: 5437519 - DNA, 20 bp, Homo sapiens
gtttgaagaccaatcaaata

SEQ ID NO: 5437520 - DNA, 15 bp, Homo sapiens
gtttgaagctgctgt

SEQ ID NO: 5437521 - DNA, 17 bp, Homo sapiens
gtttgaaggaggtgagg

SEQ ID NO: 5437522 - DNA, 13 bp, Homo sapiens
gtttgaatataaa

SEQ ID NO: 5437523 - DNA, 17 bp, Homo sapiens
gtttgaatataaacact

SEQ ID NO: 5437524 - DNA, 15 bp, Homo sapiens
gtttgaatgttaaat

SEQ ID NO: 5437525 - DNA, 13 bp, Homo sapiens
gtttgaattcagt

SEQ ID NO: 5437526 - DNA, 21 bp, Homo sapiens
gtttgaattcctcctctattt

SEQ ID NO: 5437527 - DNA, 12 bp, Homo sapiens
gtttgacactgc

SEQ ID NO: 5437528 - DNA, 15 bp, Homo sapiens
gtttgaccaggaaag

SEQ ID NO: 5437529 - DNA, 21 bp, Homo sapiens
gtttgacctcacagtgaccct

SEQ ID NO: 5437530 - DNA, 23 bp, Homo sapiens
gtttgacctcgactggtttttct

SEQ ID NO: 5437531 - DNA, 20 bp, Homo sapiens
gtttgacgaagaaacaaaaa

SEQ ID NO: 5437532 - DNA, 16 bp, Homo sapiens
gtttgacggcaaggtt

SEQ ID NO: 5437533 - DNA, 16 bp, Homo sapiens
gtttgactagatgatg

SEQ ID NO: 5437534 - DNA, 19 bp, Homo sapiens
gtttgactagatgatggat

SEQ ID NO: 5437535 - DNA, 13 bp, Homo sapiens
gtttgactttaaa

SEQ ID NO: 5437536 - DNA, 15 bp, Homo sapiens
gtttgagaagcactg

SEQ ID NO: 5437537 - DNA, 17 bp, Homo sapiens
gtttgagacaagccctg

SEQ ID NO: 5437538 - DNA, 18 bp, Homo sapiens
gtttgagaccagcctggg

SEQ ID NO: 5437539 - DNA, 18 bp, Homo sapiens
gtttgagatcagcctggg

SEQ ID NO: 5437540 - DNA, 15 bp, Homo sapiens
gtttgagatgctgta

SEQ ID NO: 5437541 - DNA, 13 bp, Homo sapiens
gtttgagctgcct

SEQ ID NO: 5437542 - DNA, 17 bp, Homo sapiens
gtttgaggaagtggctg

SEQ ID NO: 5437543 - DNA, 19 bp, Homo sapiens
gtttgaggaccctcccagg

SEQ ID NO: 5437544 - DNA, 21 bp, Homo sapiens
gtttgaggcaaattaactgta

SEQ ID NO: 5437545 - DNA, 12 bp, Homo sapiens
gtttgaggctgc

SEQ ID NO: 5437546 - DNA, 14 bp, Homo sapiens
gtttgaggggcctg

SEQ ID NO: 5437547 - DNA, 16 bp, Homo sapiens
gtttgaggttaaaata

SEQ ID NO: 5437548 - DNA, 19 bp, Homo sapiens
gtttgaggttaaaatataa

SEQ ID NO: 5437549 - DNA, 19 bp, Homo sapiens
gtttgaggtttttaagcct

SEQ ID NO: 5437550 - DNA, 16 bp, Homo sapiens
gtttgagtccctccaa

SEQ ID NO: 5437551 - DNA, 18 bp, Homo sapiens
gtttgagtccctccaaag

SEQ ID NO: 5437552 - DNA, 14 bp, Homo sapiens
gtttgagtgtctgc

SEQ ID NO: 5437553 - DNA, 16 bp, Homo sapiens
gtttgagttttcaaag

SEQ ID NO: 5437554 - DNA, 20 bp, Homo sapiens
gtttgatagtaaatgtccac

SEQ ID NO: 5437555 - DNA, 12 bp, Homo sapiens
gtttgatagtgc

SEQ ID NO: 5437556 - DNA, 17 bp, Homo sapiens
gtttgatagtgcttctt

SEQ ID NO: 5437557 - DNA, 23 bp, Homo sapiens
gtttgatatgggctttctctttg

SEQ ID NO: 5437558 - DNA, 15 bp, Homo sapiens
gtttgatcagacagc

SEQ ID NO: 5437559 - DNA, 14 bp, Homo sapiens
gtttgatcatttct

SEQ ID NO: 5437560 - DNA, 14 bp, Homo sapiens
gtttgatccttgtt

SEQ ID NO: 5437561 - DNA, 19 bp, Homo sapiens
gtttgatgaataaaatgtt

SEQ ID NO: 5437562 - DNA, 21 bp, Homo sapiens
gtttgatgaataaaatgttta

SEQ ID NO: 5437563 - DNA, 18 bp, Homo sapiens
gtttgatgactaaaagtg

SEQ ID NO: 5437564 - DNA, 20 bp, Homo sapiens
gtttgatgcattaaaagaaa

SEQ ID NO: 5437565 - DNA, 19 bp, Homo sapiens
gtttgatgccaaagcagac

SEQ ID NO: 5437566 - DNA, 20 bp, Homo sapiens
gtttgatgccaaagcagaca

SEQ ID NO: 5437567 - DNA, 12 bp, Homo sapiens
gtttgatgtatg

SEQ ID NO: 5437568 - DNA, 17 bp, Homo sapiens
gtttgatgtatgtgtga

SEQ ID NO: 5437569 - DNA, 18 bp, Homo sapiens
gtttgatgtatgtgtgaa

SEQ ID NO: 5437570 - DNA, 19 bp, Homo sapiens
gtttgatgtatgtgtgaaa

SEQ ID NO: 5437571 - DNA, 16 bp, Homo sapiens
gtttgattatagaaaa

SEQ ID NO: 5437572 - DNA, 16 bp, Homo sapiens
gtttgattcagacagc

SEQ ID NO: 5437573 - DNA, 20 bp, Homo sapiens
gtttgattcagacagctgcc

SEQ ID NO: 5437574 - DNA, 22 bp, Homo sapiens
gtttgattcagacagctgcctg

SEQ ID NO: 5437575 - DNA, 21 bp, Homo sapiens
gtttgattggatattctcctc

SEQ ID NO: 5437576 - DNA, 13 bp, Homo sapiens
gtttgattgttta

SEQ ID NO: 5437577 - DNA, 15 bp, Homo sapiens
gtttgattgtttaca

SEQ ID NO: 5437578 - DNA, 18 bp, Homo sapiens
gtttgattgtttacagga

SEQ ID NO: 5437579 - DNA, 11 bp, Homo sapiens
gtttgatttca

SEQ ID NO: 5437580 - DNA, 13 bp, Homo sapiens
gtttgatttcaac

SEQ ID NO: 5437581 - DNA, 16 bp, Homo sapiens
gtttgatttgtctcat

SEQ ID NO: 5437582 - DNA, 13 bp, Homo sapiens
gtttgattttcat

SEQ ID NO: 5437583 - DNA, 14 bp, Homo sapiens
gtttgatttttatt

SEQ ID NO: 5437584 - DNA, 17 bp, Homo sapiens
gtttgatttttgttttt

SEQ ID NO: 5437585 - DNA, 19 bp, Homo sapiens
gtttgcaaacctgcagttt

SEQ ID NO: 5437586 - DNA, 15 bp, Homo sapiens
gtttgcaagaatgaa

SEQ ID NO: 5437587 - DNA, 23 bp, Homo sapiens
gtttgcaagaatgaaatgaatga

SEQ ID NO: 5437588 - DNA, 15 bp, Homo sapiens
gtttgcaaggaagcc

SEQ ID NO: 5437589 - DNA, 20 bp, Homo sapiens
gtttgcacaagttccctgga

SEQ ID NO: 5437590 - DNA, 11 bp, Homo sapiens
gtttgcacaga

SEQ ID NO: 5437591 - DNA, 14 bp, Homo sapiens
gtttgcacataaaa

SEQ ID NO: 5437592 - DNA, 19 bp, Homo sapiens
gtttgcaccgcctgccctc

SEQ ID NO: 5437593 - DNA, 15 bp, Homo sapiens
gtttgcacctgtccc

SEQ ID NO: 5437594 - DNA, 22 bp, Homo sapiens
gtttgcactcaaatcttaagaa

SEQ ID NO: 5437595 - DNA, 20 bp, Homo sapiens
gtttgcactccacacatctt

SEQ ID NO: 5437596 - DNA, 19 bp, Homo sapiens
gtttgcactgtatgctgga

SEQ ID NO: 5437597 - DNA, 21 bp, Homo sapiens
gtttgcagaaaagcacctgcc

SEQ ID NO: 5437598 - DNA, 22 bp, Homo sapiens
gtttgcagaaaagcacctgccg

SEQ ID NO: 5437599 - DNA, 22 bp, Homo sapiens
gtttgcagagtggaaactcagc

SEQ ID NO: 5437600 - DNA, 16 bp, Homo sapiens
gtttgcagatgacaaa

SEQ ID NO: 5437601 - DNA, 20 bp, Homo sapiens
gtttgcagcagcaagtacaa

SEQ ID NO: 5437602 - DNA, 19 bp, Homo sapiens
gtttgcagttgatgtgtct

SEQ ID NO: 5437603 - DNA, 19 bp, Homo sapiens
gtttgcataaacattcttt

SEQ ID NO: 5437604 - DNA, 14 bp, Homo sapiens
gtttgcataggtga

SEQ ID NO: 5437605 - DNA, 23 bp, Homo sapiens
gtttgcatataagggaagtagtt

SEQ ID NO: 5437606 - DNA, 22 bp, Homo sapiens
gtttgcatccacttcaggagcc

SEQ ID NO: 5437607 - DNA, 19 bp, Homo sapiens
gtttgcatctgaaaattga

SEQ ID NO: 5437608 - DNA, 19 bp, Homo sapiens
gtttgcatgattcttctct

SEQ ID NO: 5437609 - DNA, 21 bp, Homo sapiens
gtttgcattccagcgtctgct

SEQ ID NO: 5437610 - DNA, 15 bp, Homo sapiens
gtttgccaagccctt

SEQ ID NO: 5437611 - DNA, 16 bp, Homo sapiens
gtttgccctgcctgca

SEQ ID NO: 5437612 - DNA, 19 bp, Homo sapiens
gtttgccctgttcaaagta

SEQ ID NO: 5437613 - DNA, 16 bp, Homo sapiens
gtttgcctccagaacc

SEQ ID NO: 5437614 - DNA, 16 bp, Homo sapiens
gtttgcctccctgcac

SEQ ID NO: 5437615 - DNA, 13 bp, Homo sapiens
gtttgcctctgca

SEQ ID NO: 5437616 - DNA, 17 bp, Homo sapiens
gtttgcctctgcctctg

SEQ ID NO: 5437617 - DNA, 18 bp, Homo sapiens
gtttgccttcctttctcc

SEQ ID NO: 5437618 - DNA, 18 bp, Homo sapiens
gtttgccttctactttta

SEQ ID NO: 5437619 - DNA, 18 bp, Homo sapiens
gtttgccttgggcctttc

SEQ ID NO: 5437620 - DNA, 18 bp, Homo sapiens
gtttgcctttaggcagga

SEQ ID NO: 5437621 - DNA, 19 bp, Homo sapiens
gtttgctaaattgagaggg

SEQ ID NO: 5437622 - DNA, 21 bp, Homo sapiens
gtttgctcaaaattgcttcta

SEQ ID NO: 5437623 - DNA, 17 bp, Homo sapiens
gtttgctcacccaggac

SEQ ID NO: 5437624 - DNA, 22 bp, Homo sapiens
gtttgctcacccaggacctctg

SEQ ID NO: 5437625 - DNA, 14 bp, Homo sapiens
gtttgctccccttc

SEQ ID NO: 5437626 - DNA, 22 bp, Homo sapiens
gtttgctctaccaaatagtgat

SEQ ID NO: 5437627 - DNA, 19 bp, Homo sapiens
gtttgctctagtcttgctt

SEQ ID NO: 5437628 - DNA, 15 bp, Homo sapiens
gtttgctgattattt

SEQ ID NO: 5437629 - DNA, 13 bp, Homo sapiens
gtttgctgtgcca

SEQ ID NO: 5437630 - DNA, 15 bp, Homo sapiens
gtttgcttaaaatat

SEQ ID NO: 5437631 - DNA, 18 bp, Homo sapiens
gtttgcttaaaatatgtg

SEQ ID NO: 5437632 - DNA, 14 bp, Homo sapiens
gtttgcttaaacaa

SEQ ID NO: 5437633 - DNA, 13 bp, Homo sapiens
gtttgcttattgt

SEQ ID NO: 5437634 - DNA, 15 bp, Homo sapiens
gtttgcttattgttc

SEQ ID NO: 5437635 - DNA, 21 bp, Homo sapiens
gtttgcttcatgtgtcccaga

SEQ ID NO: 5437636 - DNA, 13 bp, Homo sapiens
gtttgcttccatt

SEQ ID NO: 5437637 - DNA, 19 bp, Homo sapiens
gtttgcttctaaaggtttc

SEQ ID NO: 5437638 - DNA, 15 bp, Homo sapiens
gtttgcttgaatgct

SEQ ID NO: 5437639 - DNA, 11 bp, Homo sapiens
gtttgctttct

SEQ ID NO: 5437640 - DNA, 17 bp, Homo sapiens
gtttgctttgctttgta

SEQ ID NO: 5437641 - DNA, 13 bp, Homo sapiens
gtttggaaaataa

SEQ ID NO: 5437642 - DNA, 19 bp, Homo sapiens
gtttggaaaccacagtcag

SEQ ID NO: 5437643 - DNA, 21 bp, Homo sapiens
gtttggaaatggggagctggc

SEQ ID NO: 5437644 - DNA, 22 bp, Homo sapiens
gtttggaaatggggagctggcc

SEQ ID NO: 5437645 - DNA, 17 bp, Homo sapiens
gtttggaagatcctgtg

SEQ ID NO: 5437646 - DNA, 19 bp, Homo sapiens
gtttggaagcttgtctcaa

SEQ ID NO: 5437647 - DNA, 16 bp, Homo sapiens
gtttggaaggagcaga

SEQ ID NO: 5437648 - DNA, 16 bp, Homo sapiens
gtttggacacagtgtt

SEQ ID NO: 5437649 - DNA, 14 bp, Homo sapiens
gtttggacagctga

SEQ ID NO: 5437650 - DNA, 18 bp, Homo sapiens
gtttggaccccagctggg

SEQ ID NO: 5437651 - DNA, 19 bp, Homo sapiens
gtttggaccccagctggga

SEQ ID NO: 5437652 - DNA, 16 bp, Homo sapiens
gtttggacctgcatat

SEQ ID NO: 5437653 - DNA, 18 bp, Homo sapiens
gtttggactgatttgtgg

SEQ ID NO: 5437654 - DNA, 23 bp, Homo sapiens
gtttggactttgtatactttaaa

SEQ ID NO: 5437655 - DNA, 21 bp, Homo sapiens
gtttggagagagcagactggc

SEQ ID NO: 5437656 - DNA, 18 bp, Homo sapiens
gtttggaggcccctgggc

SEQ ID NO: 5437657 - DNA, 15 bp, Homo sapiens
gtttggaggctgctg

SEQ ID NO: 5437658 - DNA, 16 bp, Homo sapiens
gtttggaggctgctgc

SEQ ID NO: 5437659 - DNA, 18 bp, Homo sapiens
gtttggaggctgctgccc

SEQ ID NO: 5437660 - DNA, 17 bp, Homo sapiens
gtttggatacagctgct

SEQ ID NO: 5437661 - DNA, 19 bp, Homo sapiens
gtttggatacatctgctgt

SEQ ID NO: 5437662 - DNA, 20 bp, Homo sapiens
gtttggatatgtaaaacatt

SEQ ID NO: 5437663 - DNA, 21 bp, Homo sapiens
gtttggatatgtaaaacattt

SEQ ID NO: 5437664 - DNA, 20 bp, Homo sapiens
gtttggatgggagtgagaca

SEQ ID NO: 5437665 - DNA, 16 bp, Homo sapiens
gtttggatgtaattta

SEQ ID NO: 5437666 - DNA, 16 bp, Homo sapiens
gtttggattcctcaca

SEQ ID NO: 5437667 - DNA, 21 bp, Homo sapiens
gtttggatttcctttatactg

SEQ ID NO: 5437668 - DNA, 21 bp, Homo sapiens
gtttggatttttaattaaaaa

SEQ ID NO: 5437669 - DNA, 14 bp, Homo sapiens
gtttggcaaggaaa

SEQ ID NO: 5437670 - DNA, 17 bp, Homo sapiens
gtttggcacttgtattt

SEQ ID NO: 5437671 - DNA, 12 bp, Homo sapiens
gtttggccagaa

SEQ ID NO: 5437672 - DNA, 18 bp, Homo sapiens
gtttggccagaagtcaag

SEQ ID NO: 5437673 - DNA, 11 bp, Homo sapiens
gtttggccagg

SEQ ID NO: 5437674 - DNA, 13 bp, Homo sapiens
gtttggccaggga

SEQ ID NO: 5437675 - DNA, 16 bp, Homo sapiens
gtttggccagggaggc

SEQ ID NO: 5437676 - DNA, 20 bp, Homo sapiens
gtttggcccaagactgggct

SEQ ID NO: 5437677 - DNA, 21 bp, Homo sapiens
gtttggcgggccaaggactgc

SEQ ID NO: 5437678 - DNA, 21 bp, Homo sapiens
gtttggctggcttgtttgatt

SEQ ID NO: 5437679 - DNA, 16 bp, Homo sapiens
gtttggcttataaaca

SEQ ID NO: 5437680 - DNA, 18 bp, Homo sapiens
gtttggctttcagggagg

SEQ ID NO: 5437681 - DNA, 16 bp, Homo sapiens
gtttgggaaagatgga

SEQ ID NO: 5437682 - DNA, 22 bp, Homo sapiens
gtttgggacccctggtggttca

SEQ ID NO: 5437683 - DNA, 14 bp, Homo sapiens
gtttgggagacatg

SEQ ID NO: 5437684 - DNA, 13 bp, Homo sapiens
gtttgggagagac

SEQ ID NO: 5437685 - DNA, 13 bp, Homo sapiens
gtttgggagccag

SEQ ID NO: 5437686 - DNA, 21 bp, Homo sapiens
gtttgggcagaagggagaagg

SEQ ID NO: 5437687 - DNA, 12 bp, Homo sapiens
gtttgggcagag

SEQ ID NO: 5437688 - DNA, 16 bp, Homo sapiens
gtttgggcagtggaga

SEQ ID NO: 5437689 - DNA, 20 bp, Homo sapiens
gtttgggccccagaggctgg

SEQ ID NO: 5437690 - DNA, 22 bp, Homo sapiens
gtttggggaatgcggccgcatt

SEQ ID NO: 5437691 - DNA, 14 bp, Homo sapiens
gtttggggagaaat

SEQ ID NO: 5437692 - DNA, 20 bp, Homo sapiens
gtttggggagcagagacact

SEQ ID NO: 5437693 - DNA, 18 bp, Homo sapiens
gtttggggatgagaaagg

SEQ ID NO: 5437694 - DNA, 16 bp, Homo sapiens
gtttggggccctctat

SEQ ID NO: 5437695 - DNA, 14 bp, Homo sapiens
gtttgggggaaaaa

SEQ ID NO: 5437696 - DNA, 15 bp, Homo sapiens
gtttgggggaaaaaa

SEQ ID NO: 5437697 - DNA, 20 bp, Homo sapiens
gttttcgaagctcagcccac

SEQ ID NO: 5437698 - DNA, 22 bp, Homo sapiens
gttttcgatgaggttccatgtt

SEQ ID NO: 5437699 - DNA, 23 bp, Homo sapiens
gttttcgcacctaccatcaggga

SEQ ID NO: 5437700 - DNA, 14 bp, Homo sapiens
gttttcggcagcct

SEQ ID NO: 5437701 - DNA, 14 bp, Homo sapiens
gttttctaaaaaaa

SEQ ID NO: 5437702 - DNA, 16 bp, Homo sapiens
gttttctaaagccagg

SEQ ID NO: 5437703 - DNA, 16 bp, Homo sapiens
gttttctaactgtaaa

SEQ ID NO: 5437704 - DNA, 17 bp, Homo sapiens
gttttctaactgtaaat

SEQ ID NO: 5437705 - DNA, 24 bp, Homo sapiens
gttttctaactgtaaatcacttgt

SEQ ID NO: 5437706 - DNA, 23 bp, Homo sapiens
gttttctaatacgagccttctca

SEQ ID NO: 5437707 - DNA, 12 bp, Homo sapiens
gttttctaattg

SEQ ID NO: 5437708 - DNA, 14 bp, Homo sapiens
gttttctactgtta

SEQ ID NO: 5437709 - DNA, 23 bp, Homo sapiens
gttttctactttgaaatatttaa

SEQ ID NO: 5437710 - DNA, 18 bp, Homo sapiens
gttttctccctctcatgt

SEQ ID NO: 5437711 - DNA, 16 bp, Homo sapiens
gttttctccgggtcct

SEQ ID NO: 5437712 - DNA, 19 bp, Homo sapiens
gttttctccgggtcctcct

SEQ ID NO: 5437713 - DNA, 18 bp, Homo sapiens
gttttctcctcccaggaa

SEQ ID NO: 5437714 - DNA, 20 bp, Homo sapiens
gttttctcctgcctgtgctg

SEQ ID NO: 5437715 - DNA, 11 bp, Homo sapiens
gttttctcctt

SEQ ID NO: 5437716 - DNA, 16 bp, Homo sapiens
gttttctctaacttct

SEQ ID NO: 5437717 - DNA, 19 bp, Homo sapiens
gttttctctcggctcccca

SEQ ID NO: 5437718 - DNA, 13 bp, Homo sapiens
gttttctctctgg

SEQ ID NO: 5437719 - DNA, 15 bp, Homo sapiens
gttttctctctggat

SEQ ID NO: 5437720 - DNA, 16 bp, Homo sapiens
gttttctctctggatg

SEQ ID NO: 5437721 - DNA, 15 bp, Homo sapiens
gttttctctgcataa

SEQ ID NO: 5437722 - DNA, 22 bp, Homo sapiens
gttttctctgcataagtaatta

SEQ ID NO: 5437723 - DNA, 14 bp, Homo sapiens
gttttctctgtgtg

SEQ ID NO: 5437724 - DNA, 20 bp, Homo sapiens
gttttctcttccttgtgatt

SEQ ID NO: 5437725 - DNA, 12 bp, Homo sapiens
gttttctcttga

SEQ ID NO: 5437726 - DNA, 17 bp, Homo sapiens
gttttctgaaaatataa

SEQ ID NO: 5437727 - DNA, 15 bp, Homo sapiens
gttttctgagaaaga

SEQ ID NO: 5437728 - DNA, 10 bp, Homo sapiens
gttttctgat

SEQ ID NO: 5437729 - DNA, 13 bp, Homo sapiens
gttttctgctctg

SEQ ID NO: 5437730 - DNA, 12 bp, Homo sapiens
gttttctgctgt

SEQ ID NO: 5437731 - DNA, 17 bp, Homo sapiens
gttttctgctttaaatt

SEQ ID NO: 5437732 - DNA, 20 bp, Homo sapiens
gttttctgctttaaattaaa

SEQ ID NO: 5437733 - DNA, 14 bp, Homo sapiens
gttttctgtagact

SEQ ID NO: 5437734 - DNA, 17 bp, Homo sapiens
gttttctgtagtcattt

SEQ ID NO: 5437735 - DNA, 15 bp, Homo sapiens
gttttctgtgcactg

SEQ ID NO: 5437736 - DNA, 13 bp, Homo sapiens
gttttctgttcag

SEQ ID NO: 5437737 - DNA, 16 bp, Homo sapiens
gttttctgtttgtaaa

SEQ ID NO: 5437738 - DNA, 17 bp, Homo sapiens
gttttctgtttgtaaat

SEQ ID NO: 5437739 - DNA, 23 bp, Homo sapiens
gttttcttaaatgttttcattgg

SEQ ID NO: 5437740 - DNA, 16 bp, Homo sapiens
gttttcttaaccatct

SEQ ID NO: 5437741 - DNA, 19 bp, Homo sapiens
gttttcttaacttctgaaa

SEQ ID NO: 5437742 - DNA, 22 bp, Homo sapiens
gttttcttaaggtgaggcctgt

SEQ ID NO: 5437743 - DNA, 23 bp, Homo sapiens
gttttcttcaagggaagaaacac

SEQ ID NO: 5437744 - DNA, 19 bp, Homo sapiens
gttttcttcaggaaaataa

SEQ ID NO: 5437745 - DNA, 20 bp, Homo sapiens
gttttcttcccatcactgga

SEQ ID NO: 5437746 - DNA, 15 bp, Homo sapiens
gttttcttcctttga

SEQ ID NO: 5437747 - DNA, 15 bp, Homo sapiens
gttttcttctttccc

SEQ ID NO: 5437748 - DNA, 21 bp, Homo sapiens
gttttcttctttccctggaca

SEQ ID NO: 5437749 - DNA, 16 bp, Homo sapiens
gttttcttgataattt

SEQ ID NO: 5437750 - DNA, 21 bp, Homo sapiens
gttttcttgccaccctctggg

SEQ ID NO: 5437751 - DNA, 23 bp, Homo sapiens
gttttcttgccaccctctgggag

SEQ ID NO: 5437752 - DNA, 15 bp, Homo sapiens
gttttcttgttgctt

SEQ ID NO: 5437753 - DNA, 18 bp, Homo sapiens
gttttcttgttgctttgt

SEQ ID NO: 5437754 - DNA, 20 bp, Homo sapiens
gttttcttgttgctttgttg

SEQ ID NO: 5437755 - DNA, 14 bp, Homo sapiens
gttttctttagtat

SEQ ID NO: 5437756 - DNA, 17 bp, Homo sapiens
gttttctttatgtcttt

SEQ ID NO: 5437757 - DNA, 17 bp, Homo sapiens
gttttctttcctcccca

SEQ ID NO: 5437758 - DNA, 20 bp, Homo sapiens
gttttctttcctcctttcct

SEQ ID NO: 5437759 - DNA, 20 bp, Homo sapiens
gttttctttctttaaatgtt

SEQ ID NO: 5437760 - DNA, 14 bp, Homo sapiens
gttttctttgaatg

SEQ ID NO: 5437761 - DNA, 19 bp, Homo sapiens
gttttctttgctgtgccaa

SEQ ID NO: 5437762 - DNA, 22 bp, Homo sapiens
gttttctttgctgtgccaaagc

SEQ ID NO: 5437763 - DNA, 15 bp, Homo sapiens
gttttctttggtttt

SEQ ID NO: 5437764 - DNA, 11 bp, Homo sapiens
gttttcttttc

SEQ ID NO: 5437765 - DNA, 21 bp, Homo sapiens
gttttcttttttaaatgtttc

SEQ ID NO: 5437766 - DNA, 17 bp, Homo sapiens
gttttcttttttcccct

SEQ ID NO: 5437767 - DNA, 22 bp, Homo sapiens
gttttgaaaacctaaaagacag

SEQ ID NO: 5437768 - DNA, 13 bp, Homo sapiens
gttttgaaaagct

SEQ ID NO: 5437769 - DNA, 18 bp, Homo sapiens
gttttgaaagaaaaatac

SEQ ID NO: 5437770 - DNA, 13 bp, Homo sapiens
gttttgaaatgct

SEQ ID NO: 5437771 - DNA, 15 bp, Homo sapiens
gttttgaaggcaaaa

SEQ ID NO: 5437772 - DNA, 18 bp, Homo sapiens
gttttgaataaattttca

SEQ ID NO: 5437773 - DNA, 13 bp, Homo sapiens
gttttgaatagat

SEQ ID NO: 5437774 - DNA, 14 bp, Homo sapiens
gttttgaatattaa

SEQ ID NO: 5437775 - DNA, 17 bp, Homo sapiens
gttttgacatcagccag

SEQ ID NO: 5437776 - DNA, 16 bp, Homo sapiens
gttttgacggatgatt

SEQ ID NO: 5437777 - DNA, 17 bp, Homo sapiens
gttttgacttgccactg

SEQ ID NO: 5437778 - DNA, 19 bp, Homo sapiens
gttttgacttgccactgcc

SEQ ID NO: 5437779 - DNA, 13 bp, Homo sapiens
gttttgagaaaaa

SEQ ID NO: 5437780 - DNA, 16 bp, Homo sapiens
gttttgagagtaatgc

SEQ ID NO: 5437781 - DNA, 20 bp, Homo sapiens
gttttgagtaaaaagacatt

SEQ ID NO: 5437782 - DNA, 16 bp, Homo sapiens
gttttgataaagtaat

SEQ ID NO: 5437783 - DNA, 19 bp, Homo sapiens
gttttgataaagtagtaaa

SEQ ID NO: 5437784 - DNA, 18 bp, Homo sapiens
gttttgatatttatttcc

SEQ ID NO: 5437785 - DNA, 19 bp, Homo sapiens
gttttgatgactggcattt

SEQ ID NO: 5437786 - DNA, 15 bp, Homo sapiens
gttttgatggctggg

SEQ ID NO: 5437787 - DNA, 23 bp, Homo sapiens
gttttgatgtttgtggcctcaga

SEQ ID NO: 5437788 - DNA, 19 bp, Homo sapiens
gttttgattgagagtaact

SEQ ID NO: 5437789 - DNA, 19 bp, Homo sapiens
gttttgatttgtactgaaa

SEQ ID NO: 5437790 - DNA, 22 bp, Homo sapiens
gttttgatttgtagcactgagg

SEQ ID NO: 5437791 - DNA, 20 bp, Homo sapiens
gttttgcaaagggaaacagg

SEQ ID NO: 5437792 - DNA, 14 bp, Homo sapiens
gttttgcaataact

SEQ ID NO: 5437793 - DNA, 16 bp, Homo sapiens
gttttgcaataacttc

SEQ ID NO: 5437794 - DNA, 16 bp, Homo sapiens
gttttgccaagaatat

SEQ ID NO: 5437795 - DNA, 12 bp, Homo sapiens
gttttgccagcc

SEQ ID NO: 5437796 - DNA, 21 bp, Homo sapiens
gttttgccccatgataaaata

SEQ ID NO: 5437797 - DNA, 17 bp, Homo sapiens
gttttgcctctttaaat

SEQ ID NO: 5437798 - DNA, 14 bp, Homo sapiens
gttttgctgagagc

SEQ ID NO: 5437799 - DNA, 23 bp, Homo sapiens
gttttgcttacaaagtatattta

SEQ ID NO: 5437800 - DNA, 15 bp, Homo sapiens
gttttgcttcccctc

SEQ ID NO: 5437801 - DNA, 21 bp, Homo sapiens
gttttgcttttatccactggc

SEQ ID NO: 5437802 - DNA, 22 bp, Homo sapiens
gttttgcttttatccactggca

SEQ ID NO: 5437803 - DNA, 14 bp, Homo sapiens
gttttgcttttgtt

SEQ ID NO: 5437804 - DNA, 16 bp, Homo sapiens
gttttggaagctctga

SEQ ID NO: 5437805 - DNA, 15 bp, Homo sapiens
gttttggaattcaat

SEQ ID NO: 5437806 - DNA, 18 bp, Homo sapiens
gttttggacagtttacca

SEQ ID NO: 5437807 - DNA, 18 bp, Homo sapiens
gttttggactctctgtgg

SEQ ID NO: 5437808 - DNA, 16 bp, Homo sapiens
gttttggagaaaaatt

SEQ ID NO: 5437809 - DNA, 22 bp, Homo sapiens
gttttggagaaaaattacagat

SEQ ID NO: 5437810 - DNA, 15 bp, Homo sapiens
gttttggagagtttg

SEQ ID NO: 5437811 - DNA, 19 bp, Homo sapiens
gttttggagagtttgcctg

SEQ ID NO: 5437812 - DNA, 18 bp, Homo sapiens
gttttggatcttgaatgt

SEQ ID NO: 5437813 - DNA, 15 bp, Homo sapiens
gttttggattcttta

SEQ ID NO: 5437814 - DNA, 19 bp, Homo sapiens
gttttggattctttaaata

SEQ ID NO: 5437815 - DNA, 23 bp, Homo sapiens
gttttggatttggagagaaatat

SEQ ID NO: 5437816 - DNA, 11 bp, Homo sapiens
gttttggcctg

SEQ ID NO: 5437817 - DNA, 20 bp, Homo sapiens
gttttggctgaaattctcct

SEQ ID NO: 5437818 - DNA, 23 bp, Homo sapiens
gttttggctgaaattctcctgga

SEQ ID NO: 5437819 - DNA, 22 bp, Homo sapiens
gttttgggaggggatggcagac

SEQ ID NO: 5437820 - DNA, 22 bp, Homo sapiens
gttttgggggtcaggcagccag

SEQ ID NO: 5437821 - DNA, 20 bp, Homo sapiens
gttttgggtgaatcttgagg

SEQ ID NO: 5437822 - DNA, 16 bp, Homo sapiens
gttttggtccactttt

SEQ ID NO: 5437823 - DNA, 15 bp, Homo sapiens
gttttggtcccctcc

SEQ ID NO: 5437824 - DNA, 19 bp, Homo sapiens
gttttggtcccctccctcg

SEQ ID NO: 5437825 - DNA, 20 bp, Homo sapiens
gttttggtcccctccctcgt

SEQ ID NO: 5437826 - DNA, 23 bp, Homo sapiens
gttttggtcccctccctcgtggg

SEQ ID NO: 5437827 - DNA, 20 bp, Homo sapiens
gttttggttaagttggcttc

SEQ ID NO: 5437828 - DNA, 16 bp, Homo sapiens
gttttggttgctttaa

SEQ ID NO: 5437829 - DNA, 16 bp, Homo sapiens
gttttgtaaacattta

SEQ ID NO: 5437830 - DNA, 16 bp, Homo sapiens
gttttgtaaactttga

SEQ ID NO: 5437831 - DNA, 17 bp, Homo sapiens
gttttgtaaagtcccca

SEQ ID NO: 5437832 - DNA, 17 bp, Homo sapiens
gttttgtaaataagtga

SEQ ID NO: 5437833 - DNA, 22 bp, Homo sapiens
gttttgtaaatgtactggtaat

SEQ ID NO: 5437834 - DNA, 12 bp, Homo sapiens
gttttgtaaatt

SEQ ID NO: 5437835 - DNA, 23 bp, Homo sapiens
gttttgtaagatgctgggttggt

SEQ ID NO: 5437836 - DNA, 11 bp, Homo sapiens
gttttgtaagc

SEQ ID NO: 5437837 - DNA, 17 bp, Homo sapiens
gttttgtaagtaacaat

SEQ ID NO: 5437838 - DNA, 16 bp, Homo sapiens
gttttgtacaaagttt

SEQ ID NO: 5437839 - DNA, 14 bp, Homo sapiens
gttttgtacactgc

SEQ ID NO: 5437840 - DNA, 18 bp, Homo sapiens
gttttgtacactgctgta

SEQ ID NO: 5437841 - DNA, 15 bp, Homo sapiens
gttttgtaccagtga

SEQ ID NO: 5437842 - DNA, 17 bp, Homo sapiens
gttttgtaccagtgaat

SEQ ID NO: 5437843 - DNA, 19 bp, Homo sapiens
gttttgtaccagtgaattt

SEQ ID NO: 5437844 - DNA, 14 bp, Homo sapiens
gttttgtactggat

SEQ ID NO: 5437845 - DNA, 17 bp, Homo sapiens
gttttgtaggagacttg

SEQ ID NO: 5437846 - DNA, 21 bp, Homo sapiens
gttttgtataaataataaaga

SEQ ID NO: 5437847 - DNA, 22 bp, Homo sapiens
gttttgtatacagagaagaaaa

SEQ ID NO: 5437848 - DNA, 16 bp, Homo sapiens
gttttgtatatgatct

SEQ ID NO: 5437849 - DNA, 15 bp, Homo sapiens
gttttgtattctctg

SEQ ID NO: 5437850 - DNA, 13 bp, Homo sapiens
gttttgtcagaaa

SEQ ID NO: 5437851 - DNA, 15 bp, Homo sapiens
gttttgtctgagcct

SEQ ID NO: 5437852 - DNA, 14 bp, Homo sapiens
gttttgtgaaattt

SEQ ID NO: 5437853 - DNA, 17 bp, Homo sapiens
gttttgtgaagaaacat

SEQ ID NO: 5437854 - DNA, 17 bp, Homo sapiens
gttttgtggtttggaat

SEQ ID NO: 5437855 - DNA, 13 bp, Homo sapiens
gttttgtgtatat

SEQ ID NO: 5437856 - DNA, 14 bp, Homo sapiens
gttttgtgtctctt

SEQ ID NO: 5437857 - DNA, 18 bp, Homo sapiens
gttttgtgtttgttgtag

SEQ ID NO: 5437858 - DNA, 14 bp, Homo sapiens
gttttgttaatata

SEQ ID NO: 5437859 - DNA, 15 bp, Homo sapiens
gttttgttaatatac

SEQ ID NO: 5437860 - DNA, 14 bp, Homo sapiens
gttttgttcaccat

SEQ ID NO: 5437861 - DNA, 16 bp, Homo sapiens
gttttgttgacattct

SEQ ID NO: 5437862 - DNA, 17 bp, Homo sapiens
gttttgttgacattctg

SEQ ID NO: 5437863 - DNA, 19 bp, Homo sapiens
gttttgttgcactgaagtt

SEQ ID NO: 5437864 - DNA, 19 bp, Homo sapiens
gttttgttggctttttgaa

SEQ ID NO: 5437865 - DNA, 19 bp, Homo sapiens
gttttgttgtgttctgttg

SEQ ID NO: 5437866 - DNA, 13 bp, Homo sapiens
gttttgtttacag

SEQ ID NO: 5437867 - DNA, 16 bp, Homo sapiens
gttttgtttattaaat

SEQ ID NO: 5437868 - DNA, 17 bp, Homo sapiens
gttttgtttattaaata

SEQ ID NO: 5437869 - DNA, 19 bp, Homo sapiens
gttttgtttcctttcactg

SEQ ID NO: 5437870 - DNA, 15 bp, Homo sapiens
gttttgtttgctatc

SEQ ID NO: 5437871 - DNA, 22 bp, Homo sapiens
gttttgtttgtctctccttttc

SEQ ID NO: 5437872 - DNA, 14 bp, Homo sapiens
gttttgttttcaat

SEQ ID NO: 5437873 - DNA, 20 bp, Homo sapiens
gttttgttttctaagatgtt

SEQ ID NO: 5437874 - DNA, 18 bp, Homo sapiens
gttttgttttgttttttt

SEQ ID NO: 5437875 - DNA, 12 bp, Homo sapiens
taaaaacatgag

SEQ ID NO: 5437876 - DNA, 18 bp, Homo sapiens
taaaaacatgagaaatgt

SEQ ID NO: 5437877 - DNA, 19 bp, Homo sapiens
taaaaacatgagaaatgtg

SEQ ID NO: 5437878 - DNA, 19 bp, Homo sapiens
taaaaacatgtgaaagata

SEQ ID NO: 5437879 - DNA, 15 bp, Homo sapiens
taaaaacattgaaat

SEQ ID NO: 5437880 - DNA, 12 bp, Homo sapiens
taaaaacattta

SEQ ID NO: 5437881 - DNA, 20 bp, Homo sapiens
taaaaacattttaaaatcaa

SEQ ID NO: 5437882 - DNA, 17 bp, Homo sapiens
taaaaaccaatcatttt

SEQ ID NO: 5437883 - DNA, 21 bp, Homo sapiens
taaaaaccacccacaaagaaa

SEQ ID NO: 5437884 - DNA, 23 bp, Homo sapiens
taaaaaccacccacaaagaaaca

SEQ ID NO: 5437885 - DNA, 17 bp, Homo sapiens
taaaaaccagaatcata

SEQ ID NO: 5437886 - DNA, 18 bp, Homo sapiens
taaaaaccagacaaggaa

SEQ ID NO: 5437887 - DNA, 23 bp, Homo sapiens
taaaaaccattataaaatctttc

SEQ ID NO: 5437888 - DNA, 17 bp, Homo sapiens
taaaaacccacaaaaat

SEQ ID NO: 5437889 - DNA, 18 bp, Homo sapiens
taaaaacctattttgaaa

SEQ ID NO: 5437890 - DNA, 19 bp, Homo sapiens
taaaaacctattttgaaag

SEQ ID NO: 5437891 - DNA, 21 bp, Homo sapiens
taaaaacctattttgaaaggt

SEQ ID NO: 5437892 - DNA, 14 bp, Homo sapiens
taaaaaccttccaa

SEQ ID NO: 5437893 - DNA, 17 bp, Homo sapiens
taaaaactaatttcata

SEQ ID NO: 5437894 - DNA, 15 bp, Homo sapiens
taaaaactactgaat

SEQ ID NO: 5437895 - DNA, 16 bp, Homo sapiens
taaaaactactgaata

SEQ ID NO: 5437896 - DNA, 14 bp, Homo sapiens
taaaaactagtagt

SEQ ID NO: 5437897 - DNA, 20 bp, Homo sapiens
taaaaactagtagttctctt

SEQ ID NO: 5437898 - DNA, 12 bp, Homo sapiens
taaaaactagtt

SEQ ID NO: 5437899 - DNA, 20 bp, Homo sapiens
taaaaactcaggcaaagaaa

SEQ ID NO: 5437900 - DNA, 14 bp, Homo sapiens
taaaaactgaagtt

SEQ ID NO: 5437901 - DNA, 17 bp, Homo sapiens
taaaaactgacttaatg

SEQ ID NO: 5437902 - DNA, 21 bp, Homo sapiens
taaaaactgagtgactctata

SEQ ID NO: 5437903 - DNA, 19 bp, Homo sapiens
taaaaactgcccattgtaa

SEQ ID NO: 5437904 - DNA, 15 bp, Homo sapiens
taaaaactggttcta

SEQ ID NO: 5437905 - DNA, 12 bp, Homo sapiens
taaaaactgtgt

SEQ ID NO: 5437906 - DNA, 14 bp, Homo sapiens
taaaaactgtgtat

SEQ ID NO: 5437907 - DNA, 15 bp, Homo sapiens
taaaaactgtgtatc

SEQ ID NO: 5437908 - DNA, 17 bp, Homo sapiens
taaaaacttgtactatg

SEQ ID NO: 5437909 - DNA, 15 bp, Homo sapiens
taaaaactttaaaga

SEQ ID NO: 5437910 - DNA, 14 bp, Homo sapiens
taaaaactttattg

SEQ ID NO: 5437911 - DNA, 22 bp, Homo sapiens
taaaaactttcagagaattact

SEQ ID NO: 5437912 - DNA, 14 bp, Homo sapiens
taaaaacttttgag

SEQ ID NO: 5437913 - DNA, 22 bp, Homo sapiens
taaaaagaaaaaaatggaaaaa

SEQ ID NO: 5437914 - DNA, 23 bp, Homo sapiens
taaaaagaaaaaccactcccagt

SEQ ID NO: 5437915 - DNA, 18 bp, Homo sapiens
taaaaagaaaaatgtgta

SEQ ID NO: 5437916 - DNA, 17 bp, Homo sapiens
taaaaagaaaacaaaac

SEQ ID NO: 5437917 - DNA, 15 bp, Homo sapiens
taaaaagaaaatatt

SEQ ID NO: 5437918 - DNA, 20 bp, Homo sapiens
taaaaagaaagctaatacta

SEQ ID NO: 5437919 - DNA, 16 bp, Homo sapiens
taaaaagaaatccagt

SEQ ID NO: 5437920 - DNA, 12 bp, Homo sapiens
taaaaagaaatt

SEQ ID NO: 5437921 - DNA, 21 bp, Homo sapiens
taaaaagaaggaaaatgatct

SEQ ID NO: 5437922 - DNA, 13 bp, Homo sapiens
taaaaagacactt

SEQ ID NO: 5437923 - DNA, 20 bp, Homo sapiens
taaaaagacattttttaaaa

SEQ ID NO: 5437924 - DNA, 20 bp, Homo sapiens
taaaaagaccatgcattcag

SEQ ID NO: 5437925 - DNA, 16 bp, Homo sapiens
taaaaagacctggcct

SEQ ID NO: 5437926 - DNA, 19 bp, Homo sapiens
taaaaagagactgtgccat

SEQ ID NO: 5437927 - DNA, 22 bp, Homo sapiens
taaaaagaggatgatttcagaa

SEQ ID NO: 5437928 - DNA, 15 bp, Homo sapiens
taaaaagagtaattt

SEQ ID NO: 5437929 - DNA, 18 bp, Homo sapiens
taaaaagagtaatttcat

SEQ ID NO: 5437930 - DNA, 19 bp, Homo sapiens
taaaaagagtaatttcatt

SEQ ID NO: 5437931 - DNA, 19 bp, Homo sapiens
taaaaagatgaaaaagaat

SEQ ID NO: 5437932 - DNA, 19 bp, Homo sapiens
taaaaagattatatatcat

SEQ ID NO: 5437933 - DNA, 12 bp, Homo sapiens
taaaaagcaaat

SEQ ID NO: 5437934 - DNA, 15 bp, Homo sapiens
taaaaagcagaattt

SEQ ID NO: 5437935 - DNA, 19 bp, Homo sapiens
taaaaagcagtttttgaaa

SEQ ID NO: 5437936 - DNA, 19 bp, Homo sapiens
taaaaagcatcattacaat

SEQ ID NO: 5437937 - DNA, 19 bp, Homo sapiens
taaaaagccaagtgtcctg

SEQ ID NO: 5437938 - DNA, 16 bp, Homo sapiens
taaaaagccaccacac

SEQ ID NO: 5437939 - DNA, 19 bp, Homo sapiens
taaaaagccaccacacact

SEQ ID NO: 5437940 - DNA, 23 bp, Homo sapiens
taaaaagccactagactcttcac

SEQ ID NO: 5437941 - DNA, 16 bp, Homo sapiens
taaaaagcctcagtga

SEQ ID NO: 5437942 - DNA, 19 bp, Homo sapiens
taaaaagcctgcaatttca

SEQ ID NO: 5437943 - DNA, 22 bp, Homo sapiens
taaaaagcctgcaatttcatat

SEQ ID NO: 5437944 - DNA, 12 bp, Homo sapiens
taaaaagctcac

SEQ ID NO: 5437945 - DNA, 21 bp, Homo sapiens
taaaaagctctttcatctttt

SEQ ID NO: 5437946 - DNA, 20 bp, Homo sapiens
taaaaagcttccatgattct

SEQ ID NO: 5437947 - DNA, 14 bp, Homo sapiens
taaaaaggaaatat

SEQ ID NO: 5437948 - DNA, 22 bp, Homo sapiens
taaaaaggaaatatttttcaac

SEQ ID NO: 5437949 - DNA, 15 bp, Homo sapiens
taaaaaggaaatttg

SEQ ID NO: 5437950 - DNA, 22 bp, Homo sapiens
taaaaaggaaatttgtttgtat

SEQ ID NO: 5437951 - DNA, 18 bp, Homo sapiens
taaaaaggaactgcagca

SEQ ID NO: 5437952 - DNA, 21 bp, Homo sapiens
taaaaaggaagtggggacaga

SEQ ID NO: 5437953 - DNA, 23 bp, Homo sapiens
taaaaaggactatattaatcacc

SEQ ID NO: 5437954 - DNA, 20 bp, Homo sapiens
taaaaaggagaatttttcct

SEQ ID NO: 5437955 - DNA, 17 bp, Homo sapiens
taaaaaggagtatacaa

SEQ ID NO: 5437956 - DNA, 20 bp, Homo sapiens
taaaaaggagtatacaaaca

SEQ ID NO: 5437957 - DNA, 19 bp, Homo sapiens
taaaaaggcacctataaaa

SEQ ID NO: 5437958 - DNA, 17 bp, Homo sapiens
taaaaaggccaaagata

SEQ ID NO: 5437959 - DNA, 16 bp, Homo sapiens
taaaaaggcccttaga

SEQ ID NO: 5437960 - DNA, 17 bp, Homo sapiens
taaaaaggcccttagag

SEQ ID NO: 5437961 - DNA, 12 bp, Homo sapiens
taaaaaggcctt

SEQ ID NO: 5437962 - DNA, 16 bp, Homo sapiens
taaaaaggcctttggg

SEQ ID NO: 5437963 - DNA, 19 bp, Homo sapiens
taaaaaggcctttgggatt

SEQ ID NO: 5437964 - DNA, 10 bp, Homo sapiens
taaaaaggga

SEQ ID NO: 5437965 - DNA, 22 bp, Homo sapiens
taaaaagggaaagttttgttct

SEQ ID NO: 5437966 - DNA, 16 bp, Homo sapiens
taaaaagggcagccct

SEQ ID NO: 5437967 - DNA, 20 bp, Homo sapiens
taaaaagggcagggcatctc

SEQ ID NO: 5437968 - DNA, 17 bp, Homo sapiens
taaaaaggggaggagaa

SEQ ID NO: 5437969 - DNA, 16 bp, Homo sapiens
taaaaaggtcctgtaa

SEQ ID NO: 5437970 - DNA, 19 bp, Homo sapiens
taaaaaggtctgttaatgt

SEQ ID NO: 5437971 - DNA, 21 bp, Homo sapiens
taaaaaggtctgttaatgtca

SEQ ID NO: 5437972 - DNA, 15 bp, Homo sapiens
taaaaaggtgaccat

SEQ ID NO: 5437973 - DNA, 14 bp, Homo sapiens
taaaaagtaactga

SEQ ID NO: 5437974 - DNA, 17 bp, Homo sapiens
taaaaagtagattaaaa

SEQ ID NO: 5437975 - DNA, 22 bp, Homo sapiens
taaaaagtagattaaaatattt

SEQ ID NO: 5437976 - DNA, 13 bp, Homo sapiens
taaaaagtattgc

SEQ ID NO: 5437977 - DNA, 21 bp, Homo sapiens
taaaaagtctgtatggcatga

SEQ ID NO: 5437978 - DNA, 14 bp, Homo sapiens
taaaaagtcttcac

SEQ ID NO: 5437979 - DNA, 15 bp, Homo sapiens
taaaaagtgaacttt

SEQ ID NO: 5437980 - DNA, 18 bp, Homo sapiens
taaaaagtgaacttttgt

SEQ ID NO: 5437981 - DNA, 15 bp, Homo sapiens
taaaaagtgacacag

SEQ ID NO: 5437982 - DNA, 18 bp, Homo sapiens
taaaaagtgacacagcag

SEQ ID NO: 5437983 - DNA, 19 bp, Homo sapiens
taaaaagtgagaaagaaag

SEQ ID NO: 5437984 - DNA, 13 bp, Homo sapiens
taaaaagtgcagt

SEQ ID NO: 5437985 - DNA, 12 bp, Homo sapiens
taaaaagtggaa

SEQ ID NO: 5437986 - DNA, 17 bp, Homo sapiens
taaaaagtggaatttct

SEQ ID NO: 5437987 - DNA, 18 bp, Homo sapiens
taaaaagtggaatttctt

SEQ ID NO: 5437988 - DNA, 17 bp, Homo sapiens
taaaaagtggattacaa

SEQ ID NO: 5437989 - DNA, 15 bp, Homo sapiens
taaaaagtggctgcg

SEQ ID NO: 5437990 - DNA, 14 bp, Homo sapiens
taaaaagtgtttaa

SEQ ID NO: 5437991 - DNA, 11 bp, Homo sapiens
taaaaagttaa

SEQ ID NO: 5437992 - DNA, 13 bp, Homo sapiens
taaaaagttatat

SEQ ID NO: 5437993 - DNA, 14 bp, Homo sapiens
taaaaagttgttca

SEQ ID NO: 5437994 - DNA, 23 bp, Homo sapiens
taaaaagttgttctttgtttcca

SEQ ID NO: 5437995 - DNA, 21 bp, Homo sapiens
taaaaataaaaaagatcccaa

SEQ ID NO: 5437996 - DNA, 20 bp, Homo sapiens
taaaaataaaacatcataaa

SEQ ID NO: 5437997 - DNA, 14 bp, Homo sapiens
taaaaataaaagca

SEQ ID NO: 5437998 - DNA, 15 bp, Homo sapiens
taaaaataaaagcta

SEQ ID NO: 5437999 - DNA, 18 bp, Homo sapiens
taaaaataaaagctatta

SEQ ID NO: 5438000 - DNA, 15 bp, Homo sapiens
taaaaataaaatgat

SEQ ID NO: 5438001 - DNA, 17 bp, Homo sapiens
taaaaataaaatgatgt

SEQ ID NO: 5438002 - DNA, 18 bp, Homo sapiens
taaaaataaaatgcattt

SEQ ID NO: 5438003 - DNA, 16 bp, Homo sapiens
taaaaataaacatgtt

SEQ ID NO: 5438004 - DNA, 21 bp, Homo sapiens
taaaaataaaccagatcaaat

SEQ ID NO: 5438005 - DNA, 18 bp, Homo sapiens
taaaaataaactgttatg

SEQ ID NO: 5438006 - DNA, 19 bp, Homo sapiens
taaaaataaaggaaaacaa

SEQ ID NO: 5438007 - DNA, 19 bp, Homo sapiens
taaaaataaatcccatgga

SEQ ID NO: 5438008 - DNA, 14 bp, Homo sapiens
taaaaataaatcta

SEQ ID NO: 5438009 - DNA, 15 bp, Homo sapiens
taaaaataacatcat

SEQ ID NO: 5438010 - DNA, 16 bp, Homo sapiens
taaaaataaccttgca

SEQ ID NO: 5438011 - DNA, 15 bp, Homo sapiens
taaaaataactgaga

SEQ ID NO: 5438012 - DNA, 15 bp, Homo sapiens
taaaaataagcttta

SEQ ID NO: 5438013 - DNA, 22 bp, Homo sapiens
taaaaataagtcattttaataa

SEQ ID NO: 5438014 - DNA, 11 bp, Homo sapiens
taaaaatacaa

SEQ ID NO: 5438015 - DNA, 13 bp, Homo sapiens
taaaaatacaaaa

SEQ ID NO: 5438016 - DNA, 14 bp, Homo sapiens
taaaaatacaaaca

SEQ ID NO: 5438017 - DNA, 18 bp, Homo sapiens
taaaaatacacatgaaaa

SEQ ID NO: 5438018 - DNA, 14 bp, Homo sapiens
taaaaatacatatc

SEQ ID NO: 5438019 - DNA, 14 bp, Homo sapiens
taaaaataccttct

SEQ ID NO: 5438020 - DNA, 17 bp, Homo sapiens
taaaaatagaaacctga

SEQ ID NO: 5438021 - DNA, 22 bp, Homo sapiens
taaaaatagaaacctgaatgaa

SEQ ID NO: 5438022 - DNA, 16 bp, Homo sapiens
taaaaatagaaataaa

SEQ ID NO: 5438023 - DNA, 12 bp, Homo sapiens
taaaaatagaat

SEQ ID NO: 5438024 - DNA, 21 bp, Homo sapiens
taaaaatagatcaataaatgt

SEQ ID NO: 5438025 - DNA, 16 bp, Homo sapiens
taaaaatagctataaa

SEQ ID NO: 5438026 - DNA, 17 bp, Homo sapiens
taaaaatagttaacaca

SEQ ID NO: 5438027 - DNA, 10 bp, Homo sapiens
taaaaatata

SEQ ID NO: 5438028 - DNA, 14 bp, Homo sapiens
taaaaatataaaac

SEQ ID NO: 5438029 - DNA, 14 bp, Homo sapiens
taaaaatataaaca

SEQ ID NO: 5438030 - DNA, 15 bp, Homo sapiens
taaaaatataaacaa

SEQ ID NO: 5438031 - DNA, 18 bp, Homo sapiens
taaaaatataaattgtac

SEQ ID NO: 5438032 - DNA, 18 bp, Homo sapiens
taaaaatataagaacttg

SEQ ID NO: 5438033 - DNA, 13 bp, Homo sapiens
taaaaatatacag

SEQ ID NO: 5438034 - DNA, 17 bp, Homo sapiens
taaaaatatacatgttt

SEQ ID NO: 5438035 - DNA, 15 bp, Homo sapiens
taaaaatatagcaaa

SEQ ID NO: 5438036 - DNA, 16 bp, Homo sapiens
taaaaatatagcaaat

SEQ ID NO: 5438037 - DNA, 19 bp, Homo sapiens
taaaaatatagcaaatgca

SEQ ID NO: 5438038 - DNA, 13 bp, Homo sapiens
taaaaatatatat

SEQ ID NO: 5438039 - DNA, 23 bp, Homo sapiens
taaaaatatcaaattaattgtgt

SEQ ID NO: 5438040 - DNA, 16 bp, Homo sapiens
taaaaatatccttgat

SEQ ID NO: 5438041 - DNA, 11 bp, Homo sapiens
taaaaatatgt

SEQ ID NO: 5438042 - DNA, 16 bp, Homo sapiens
taaaaatatgtaattt

SEQ ID NO: 5438043 - DNA, 15 bp, Homo sapiens
taaaaatatgtacaa

SEQ ID NO: 5438044 - DNA, 19 bp, Homo sapiens
taaaaatatgtgagcatga

SEQ ID NO: 5438045 - DNA, 17 bp, Homo sapiens
taaaaatattcctccaa

SEQ ID NO: 5438046 - DNA, 14 bp, Homo sapiens
taaaaatattgtgt

SEQ ID NO: 5438047 - DNA, 22 bp, Homo sapiens
taaaaatattgtgttgtgaatg

SEQ ID NO: 5438048 - DNA, 19 bp, Homo sapiens
taaaaatattgtttctgca

SEQ ID NO: 5438049 - DNA, 20 bp, Homo sapiens
taaaaatcaagttatttcct

SEQ ID NO: 5438050 - DNA, 14 bp, Homo sapiens
taaaaatcacactg

SEQ ID NO: 5438051 - DNA, 15 bp, Homo sapiens
taaaaatcaggagcc

SEQ ID NO: 5438052 - DNA, 20 bp, Homo sapiens
taaaaatcaggagcctgcta

SEQ ID NO: 5438053 - DNA, 22 bp, Homo sapiens
taaaaatcatatagaccaattg

SEQ ID NO: 5438054 - DNA, 16 bp, Homo sapiens
taaaaggaaaaataac

SEQ ID NO: 5438055 - DNA, 15 bp, Homo sapiens
taaaaggaaaaccag

SEQ ID NO: 5438056 - DNA, 21 bp, Homo sapiens
taaaaggaaaaccagtgaagt

SEQ ID NO: 5438057 - DNA, 23 bp, Homo sapiens
taaaaggaaaaccgaattaggtc

SEQ ID NO: 5438058 - DNA, 21 bp, Homo sapiens
taaaaggaaatctcaccccat

SEQ ID NO: 5438059 - DNA, 19 bp, Homo sapiens
taaaaggaagccaaagagt

SEQ ID NO: 5438060 - DNA, 21 bp, Homo sapiens
taaaaggaagtagatgtgaaa

SEQ ID NO: 5438061 - DNA, 23 bp, Homo sapiens
taaaaggagggtggcctcaagaa

SEQ ID NO: 5438062 - DNA, 18 bp, Homo sapiens
taaaaggataggaaaaga

SEQ ID NO: 5438063 - DNA, 19 bp, Homo sapiens
taaaaggataggaaaagat

SEQ ID NO: 5438064 - DNA, 15 bp, Homo sapiens
taaaaggatagtatt

SEQ ID NO: 5438065 - DNA, 15 bp, Homo sapiens
taaaaggatgtataa

SEQ ID NO: 5438066 - DNA, 12 bp, Homo sapiens
taaaaggatgtt

SEQ ID NO: 5438067 - DNA, 19 bp, Homo sapiens
taaaaggatgttacaagtt

SEQ ID NO: 5438068 - DNA, 19 bp, Homo sapiens
taaaaggcaaatgtgtaca

SEQ ID NO: 5438069 - DNA, 15 bp, Homo sapiens
taaaaggccaaacct

SEQ ID NO: 5438070 - DNA, 19 bp, Homo sapiens
taaaaggctaagaatagtg

SEQ ID NO: 5438071 - DNA, 19 bp, Homo sapiens
taaaagggactgagaaatt

SEQ ID NO: 5438072 - DNA, 18 bp, Homo sapiens
taaaagggtcaaacctgt

SEQ ID NO: 5438073 - DNA, 19 bp, Homo sapiens
taaaagggtcaaacctgta

SEQ ID NO: 5438074 - DNA, 23 bp, Homo sapiens
taaaagggtggtagttttcccta

SEQ ID NO: 5438075 - DNA, 21 bp, Homo sapiens
taaaaggtagagtcttacaat

SEQ ID NO: 5438076 - DNA, 21 bp, Homo sapiens
taaaaggtatgcaatcaaatc

SEQ ID NO: 5438077 - DNA, 12 bp, Homo sapiens
taaaaggtgacc

SEQ ID NO: 5438078 - DNA, 20 bp, Homo sapiens
taaaaggtggagtttctctg

SEQ ID NO: 5438079 - DNA, 14 bp, Homo sapiens
taaaaggtgttgta

SEQ ID NO: 5438080 - DNA, 15 bp, Homo sapiens
taaaaggttcaggga

SEQ ID NO: 5438081 - DNA, 21 bp, Homo sapiens
taaaaggttcagggaaccgtt

SEQ ID NO: 5438082 - DNA, 22 bp, Homo sapiens
taaaaggttgccaaattgctgc

SEQ ID NO: 5438083 - DNA, 14 bp, Homo sapiens
taaaagtaaaatgt

SEQ ID NO: 5438084 - DNA, 21 bp, Homo sapiens
taaaagtaataaagagaaata

SEQ ID NO: 5438085 - DNA, 21 bp, Homo sapiens
taaaagtaccacacaaactat

SEQ ID NO: 5438086 - DNA, 13 bp, Homo sapiens
taaaagtagtaaa

SEQ ID NO: 5438087 - DNA, 20 bp, Homo sapiens
taaaagtagtgttgtccagg

SEQ ID NO: 5438088 - DNA, 14 bp, Homo sapiens
taaaagtatagata

SEQ ID NO: 5438089 - DNA, 22 bp, Homo sapiens
taaaagtatagatacaaaacct

SEQ ID NO: 5438090 - DNA, 20 bp, Homo sapiens
taaaagtcacataaaatgcg

SEQ ID NO: 5438091 - DNA, 17 bp, Homo sapiens
taaaagtcagagctcag

SEQ ID NO: 5438092 - DNA, 18 bp, Homo sapiens
taaaagtcagagctcagg

SEQ ID NO: 5438093 - DNA, 19 bp, Homo sapiens
taaaagtcagcattttctt

SEQ ID NO: 5438094 - DNA, 16 bp, Homo sapiens
taaaagtccaatgttg

SEQ ID NO: 5438095 - DNA, 23 bp, Homo sapiens
taaaagtcgcattccatatcttt

SEQ ID NO: 5438096 - DNA, 22 bp, Homo sapiens
taaaagtctagttacctacttt

SEQ ID NO: 5438097 - DNA, 19 bp, Homo sapiens
taaaagtgaatgaaagatt

SEQ ID NO: 5438098 - DNA, 15 bp, Homo sapiens
taaaagtgatctaca

SEQ ID NO: 5438099 - DNA, 17 bp, Homo sapiens
taaaagtgcacacctta

SEQ ID NO: 5438100 - DNA, 17 bp, Homo sapiens
taaaagtgcatttaagg

SEQ ID NO: 5438101 - DNA, 17 bp, Homo sapiens
taaaagtgccattaaca

SEQ ID NO: 5438102 - DNA, 18 bp, Homo sapiens
taaaagtggcatagagaa

SEQ ID NO: 5438103 - DNA, 17 bp, Homo sapiens
taaaagtggtctctgct

SEQ ID NO: 5438104 - DNA, 20 bp, Homo sapiens
taaaagtggtctctgctggg

SEQ ID NO: 5438105 - DNA, 22 bp, Homo sapiens
taaaagtgtcaccttttcttgc

SEQ ID NO: 5438106 - DNA, 14 bp, Homo sapiens
taaaagtgtgagca

SEQ ID NO: 5438107 - DNA, 18 bp, Homo sapiens
taaaagtgtgagcagtga

SEQ ID NO: 5438108 - DNA, 20 bp, Homo sapiens
taaaagtgtgtaaatgctta

SEQ ID NO: 5438109 - DNA, 18 bp, Homo sapiens
taaaagttacattgtgct

SEQ ID NO: 5438110 - DNA, 15 bp, Homo sapiens
taaaagttactaata

SEQ ID NO: 5438111 - DNA, 22 bp, Homo sapiens
taaaagttactaatatatctgt

SEQ ID NO: 5438112 - DNA, 15 bp, Homo sapiens
taaaagttataataa

SEQ ID NO: 5438113 - DNA, 16 bp, Homo sapiens
taaaagttataataac

SEQ ID NO: 5438114 - DNA, 20 bp, Homo sapiens
taaaagttataataactgaa

SEQ ID NO: 5438115 - DNA, 16 bp, Homo sapiens
taaaagttatatctaa

SEQ ID NO: 5438116 - DNA, 17 bp, Homo sapiens
taaaagttcctctccct

SEQ ID NO: 5438117 - DNA, 14 bp, Homo sapiens
taaaagttctcaat

SEQ ID NO: 5438118 - DNA, 17 bp, Homo sapiens
taaaagttgaaaagcca

SEQ ID NO: 5438119 - DNA, 19 bp, Homo sapiens
taaaagttgaaaagccaaa

SEQ ID NO: 5438120 - DNA, 17 bp, Homo sapiens
taaaagttgcattttaa

SEQ ID NO: 5438121 - DNA, 21 bp, Homo sapiens
taaaagttgcgtttaagttgt

SEQ ID NO: 5438122 - DNA, 22 bp, Homo sapiens
taaaagttgcgtttaagttgta

SEQ ID NO: 5438123 - DNA, 16 bp, Homo sapiens
taaaagtttacaactt

SEQ ID NO: 5438124 - DNA, 20 bp, Homo sapiens
taaaagtttacaacttgatt

SEQ ID NO: 5438125 - DNA, 15 bp, Homo sapiens
taaaagtttcaatgt

SEQ ID NO: 5438126 - DNA, 13 bp, Homo sapiens
taaaagtttgcat

SEQ ID NO: 5438127 - DNA, 17 bp, Homo sapiens
taaaagttttatgtact

SEQ ID NO: 5438128 - DNA, 15 bp, Homo sapiens
taaaagtttttgtca

SEQ ID NO: 5438129 - DNA, 18 bp, Homo sapiens
taaaataaaaaagcaaaa

SEQ ID NO: 5438130 - DNA, 19 bp, Homo sapiens
taaaataaaaaccaaatta

SEQ ID NO: 5438131 - DNA, 17 bp, Homo sapiens
taaaataaaaaccagaa

SEQ ID NO: 5438132 - DNA, 20 bp, Homo sapiens
taaaataaaaaccagaatca

SEQ ID NO: 5438133 - DNA, 21 bp, Homo sapiens
taaaataaaaattctgaatgt

SEQ ID NO: 5438134 - DNA, 16 bp, Homo sapiens
taaaataaaaatttaa

SEQ ID NO: 5438135 - DNA, 13 bp, Homo sapiens
taaaataaaacaa

SEQ ID NO: 5438136 - DNA, 15 bp, Homo sapiens
taaaataaaacaagc

SEQ ID NO: 5438137 - DNA, 19 bp, Homo sapiens
taaaataaaacaagcctta

SEQ ID NO: 5438138 - DNA, 17 bp, Homo sapiens
taaaataaaataaaaat

SEQ ID NO: 5438139 - DNA, 14 bp, Homo sapiens
taaaataaaatgaa

SEQ ID NO: 5438140 - DNA, 15 bp, Homo sapiens
taaaataaaatgcct

SEQ ID NO: 5438141 - DNA, 13 bp, Homo sapiens
taaaataaaatta

SEQ ID NO: 5438142 - DNA, 14 bp, Homo sapiens
taaaataaaattat

SEQ ID NO: 5438143 - DNA, 17 bp, Homo sapiens
taaaataaaattatata

SEQ ID NO: 5438144 - DNA, 15 bp, Homo sapiens
taaaataaacagttg

SEQ ID NO: 5438145 - DNA, 14 bp, Homo sapiens
taaaataaacctgt

SEQ ID NO: 5438146 - DNA, 16 bp, Homo sapiens
taaaataaactagata

SEQ ID NO: 5438147 - DNA, 15 bp, Homo sapiens
taaaataaactgtaa

SEQ ID NO: 5438148 - DNA, 17 bp, Homo sapiens
taaaataaactgtaaac

SEQ ID NO: 5438149 - DNA, 12 bp, Homo sapiens
taaaataaactt

SEQ ID NO: 5438150 - DNA, 13 bp, Homo sapiens
taaaataaagaaa

SEQ ID NO: 5438151 - DNA, 15 bp, Homo sapiens
taaaataaagcaaat

SEQ ID NO: 5438152 - DNA, 15 bp, Homo sapiens
taaaataaagcctat

SEQ ID NO: 5438153 - DNA, 16 bp, Homo sapiens
taaaataaaggctctg

SEQ ID NO: 5438154 - DNA, 11 bp, Homo sapiens
taaaataaata

SEQ ID NO: 5438155 - DNA, 12 bp, Homo sapiens
taaaataaataa

SEQ ID NO: 5438156 - DNA, 13 bp, Homo sapiens
taaaataaataaa

SEQ ID NO: 5438157 - DNA, 13 bp, Homo sapiens
taaaataaataat

SEQ ID NO: 5438158 - DNA, 16 bp, Homo sapiens
taaaataaataccaaa

SEQ ID NO: 5438159 - DNA, 13 bp, Homo sapiens
taaaataaatata

SEQ ID NO: 5438160 - DNA, 16 bp, Homo sapiens
taaaataaatatacta

SEQ ID NO: 5438161 - DNA, 18 bp, Homo sapiens
taaaataaatatactaat

SEQ ID NO: 5438162 - DNA, 23 bp, Homo sapiens
taaaataaatatatataaaccta

SEQ ID NO: 5438163 - DNA, 17 bp, Homo sapiens
taaaataaatattgtct

SEQ ID NO: 5438164 - DNA, 18 bp, Homo sapiens
taaaataaatattgtctt

SEQ ID NO: 5438165 - DNA, 12 bp, Homo sapiens
taaaataaatgg

SEQ ID NO: 5438166 - DNA, 12 bp, Homo sapiens
taaaataaatgt

SEQ ID NO: 5438167 - DNA, 13 bp, Homo sapiens
taaaataaatgtt

SEQ ID NO: 5438168 - DNA, 18 bp, Homo sapiens
taaaataaatgttttgga

SEQ ID NO: 5438169 - DNA, 16 bp, Homo sapiens
taaaataactaaaatg

SEQ ID NO: 5438170 - DNA, 18 bp, Homo sapiens
taaaataactaaaatgta

SEQ ID NO: 5438171 - DNA, 21 bp, Homo sapiens
taaaataactaaaatgtatct

SEQ ID NO: 5438172 - DNA, 21 bp, Homo sapiens
taaaataactagtgttgcttg

SEQ ID NO: 5438173 - DNA, 19 bp, Homo sapiens
taaaataactatcaggcag

SEQ ID NO: 5438174 - DNA, 23 bp, Homo sapiens
taaaataactatcaggcagaaga

SEQ ID NO: 5438175 - DNA, 16 bp, Homo sapiens
taaaataagcaggtgg

SEQ ID NO: 5438176 - DNA, 17 bp, Homo sapiens
taaaataaggatttttc

SEQ ID NO: 5438177 - DNA, 22 bp, Homo sapiens
taaaataaggatttttctctta

SEQ ID NO: 5438178 - DNA, 21 bp, Homo sapiens
taaaataaggttatgattgaa

SEQ ID NO: 5438179 - DNA, 16 bp, Homo sapiens
taaaataagtaacata

SEQ ID NO: 5438180 - DNA, 17 bp, Homo sapiens
taaaataagtaacatat

SEQ ID NO: 5438181 - DNA, 11 bp, Homo sapiens
taaaataagtc

SEQ ID NO: 5438182 - DNA, 14 bp, Homo sapiens
taaaataagtccta

SEQ ID NO: 5438183 - DNA, 14 bp, Homo sapiens
taaaataagttctt

SEQ ID NO: 5438184 - DNA, 17 bp, Homo sapiens
taaaataagttcttaaa

SEQ ID NO: 5438185 - DNA, 12 bp, Homo sapiens
taaaataataaa

SEQ ID NO: 5438186 - DNA, 18 bp, Homo sapiens
taaaataatgatttaagc

SEQ ID NO: 5438187 - DNA, 18 bp, Homo sapiens
taaaataatgcaaagaat

SEQ ID NO: 5438188 - DNA, 17 bp, Homo sapiens
taaaataatgtactgaa

SEQ ID NO: 5438189 - DNA, 19 bp, Homo sapiens
taaaataattaaataaatg

SEQ ID NO: 5438190 - DNA, 20 bp, Homo sapiens
taaaataattatataactgt

SEQ ID NO: 5438191 - DNA, 17 bp, Homo sapiens
taaaataattcatatct

SEQ ID NO: 5438192 - DNA, 17 bp, Homo sapiens
taaaataattctaaagg

SEQ ID NO: 5438193 - DNA, 14 bp, Homo sapiens
taaaataatttatc

SEQ ID NO: 5438194 - DNA, 16 bp, Homo sapiens
taaaataattttgtaa

SEQ ID NO: 5438195 - DNA, 21 bp, Homo sapiens
taaaataattttgtaatgtat

SEQ ID NO: 5438196 - DNA, 22 bp, Homo sapiens
taaaataatttttatatttgaa

SEQ ID NO: 5438197 - DNA, 21 bp, Homo sapiens
taaaatacacactcaaatcaa

SEQ ID NO: 5438198 - DNA, 16 bp, Homo sapiens
taaaatacacgtgtat

SEQ ID NO: 5438199 - DNA, 16 bp, Homo sapiens
taaaatacagaataca

SEQ ID NO: 5438200 - DNA, 16 bp, Homo sapiens
taaaatacataaaaga

SEQ ID NO: 5438201 - DNA, 14 bp, Homo sapiens
taaaatacatataa

SEQ ID NO: 5438202 - DNA, 15 bp, Homo sapiens
taaaatacatataaa

SEQ ID NO: 5438203 - DNA, 13 bp, Homo sapiens
taaaatacatgaa

SEQ ID NO: 5438204 - DNA, 15 bp, Homo sapiens
taaaatacatttaaa

SEQ ID NO: 5438205 - DNA, 16 bp, Homo sapiens
taaaatacatttaaaa

SEQ ID NO: 5438206 - DNA, 14 bp, Homo sapiens
taaaataccactgt

SEQ ID NO: 5438207 - DNA, 21 bp, Homo sapiens
taaaataccagccagtaaatg

SEQ ID NO: 5438208 - DNA, 19 bp, Homo sapiens
taaaatactatattaaatt

SEQ ID NO: 5438209 - DNA, 18 bp, Homo sapiens
taaaatactatgcagtat

SEQ ID NO: 5438210 - DNA, 19 bp, Homo sapiens
taaaatactattggacaga

SEQ ID NO: 5438211 - DNA, 17 bp, Homo sapiens
taaaatactattggaga

SEQ ID NO: 5438212 - DNA, 20 bp, Homo sapiens
taaaatactatttttactgc

SEQ ID NO: 5438213 - DNA, 21 bp, Homo sapiens
taaaatactatttttactgcc

SEQ ID NO: 5438214 - DNA, 23 bp, Homo sapiens
taaaatactctagcctgggccag

SEQ ID NO: 5438215 - DNA, 21 bp, Homo sapiens
taaaatactgtagataattaa

SEQ ID NO: 5438216 - DNA, 12 bp, Homo sapiens
taaaatacttat

SEQ ID NO: 5438217 - DNA, 14 bp, Homo sapiens
taaaatacttttac

SEQ ID NO: 5438218 - DNA, 14 bp, Homo sapiens
taaaatagaaaaag

SEQ ID NO: 5438219 - DNA, 22 bp, Homo sapiens
taaaatagaaattttgtaagaa

SEQ ID NO: 5438220 - DNA, 22 bp, Homo sapiens
taaaatagaataattcttttct

SEQ ID NO: 5438221 - DNA, 13 bp, Homo sapiens
taaaatagaatat

SEQ ID NO: 5438222 - DNA, 17 bp, Homo sapiens
taaaatagaatatagca

SEQ ID NO: 5438223 - DNA, 23 bp, Homo sapiens
taaaatagacctaactgaataca

SEQ ID NO: 5438224 - DNA, 23 bp, Homo sapiens
taaaatagaggctttgagcaact

SEQ ID NO: 5438225 - DNA, 18 bp, Homo sapiens
taaaatagagtctggaat

SEQ ID NO: 5438226 - DNA, 16 bp, Homo sapiens
taaaatagagtgtagt

SEQ ID NO: 5438227 - DNA, 17 bp, Homo sapiens
taaaatagagtgtagtt

SEQ ID NO: 5438228 - DNA, 16 bp, Homo sapiens
taaaatagatataaat

SEQ ID NO: 5438229 - DNA, 22 bp, Homo sapiens
taaaatagatcctaggtgctgg

SEQ ID NO: 5438230 - DNA, 23 bp, Homo sapiens
taaaatagatcctaggtgctgga

SEQ ID NO: 5438231 - DNA, 16 bp, Homo sapiens
taaaatagcaaaagaa

SEQ ID NO: 5438232 - DNA, 17 bp, Homo sapiens
taaaatttcataattct

SEQ ID NO: 5438233 - DNA, 19 bp, Homo sapiens
taaaatttccttcaggttt

SEQ ID NO: 5438234 - DNA, 13 bp, Homo sapiens
taaaatttcgttg

SEQ ID NO: 5438235 - DNA, 18 bp, Homo sapiens
taaaatttcgttgtccaa

SEQ ID NO: 5438236 - DNA, 9 bp, Homo sapiens
taaaatttg

SEQ ID NO: 5438237 - DNA, 12 bp, Homo sapiens
taaaatttgaaa

SEQ ID NO: 5438238 - DNA, 14 bp, Homo sapiens
taaaatttgaaaca

SEQ ID NO: 5438239 - DNA, 21 bp, Homo sapiens
taaaatttgaaacattgcttt

SEQ ID NO: 5438240 - DNA, 21 bp, Homo sapiens
taaaatttgccctcccatccc

SEQ ID NO: 5438241 - DNA, 21 bp, Homo sapiens
taaaatttggccaaacaagtg

SEQ ID NO: 5438242 - DNA, 22 bp, Homo sapiens
taaaatttgggacctgcttcat

SEQ ID NO: 5438243 - DNA, 12 bp, Homo sapiens
taaaatttgtgg

SEQ ID NO: 5438244 - DNA, 20 bp, Homo sapiens
taaaatttgtgtaaatttgt

SEQ ID NO: 5438245 - DNA, 21 bp, Homo sapiens
taaaatttgtgtaaatttgta

SEQ ID NO: 5438246 - DNA, 15 bp, Homo sapiens
taaaatttgttgcat

SEQ ID NO: 5438247 - DNA, 17 bp, Homo sapiens
taaaattttagatgtag

SEQ ID NO: 5438248 - DNA, 17 bp, Homo sapiens
taaaattttatctctta

SEQ ID NO: 5438249 - DNA, 18 bp, Homo sapiens
taaaattttcattctgaa

SEQ ID NO: 5438250 - DNA, 21 bp, Homo sapiens
taaaattttctaagattaact

SEQ ID NO: 5438251 - DNA, 22 bp, Homo sapiens
taaaattttggaatatttgctt

SEQ ID NO: 5438252 - DNA, 16 bp, Homo sapiens
taaaattttgtatgtt

SEQ ID NO: 5438253 - DNA, 23 bp, Homo sapiens
taaaattttgtatgttaaagaga

SEQ ID NO: 5438254 - DNA, 22 bp, Homo sapiens
taaaattttttaaaagttttga

SEQ ID NO: 5438255 - DNA, 20 bp, Homo sapiens
taaaattttttacttttaac

SEQ ID NO: 5438256 - DNA, 22 bp, Homo sapiens
taaaattttttacttttaacta

SEQ ID NO: 5438257 - DNA, 22 bp, Homo sapiens
taaaattttttataaactaaag

SEQ ID NO: 5438258 - DNA, 17 bp, Homo sapiens
taaaatttttttagaaa

SEQ ID NO: 5438259 - DNA, 21 bp, Homo sapiens
taaaatttttttagaaagcat

SEQ ID NO: 5438260 - DNA, 16 bp, Homo sapiens
taaaatttttttggtc

SEQ ID NO: 5438261 - DNA, 16 bp, Homo sapiens
taaaattttttttcat

SEQ ID NO: 5438262 - DNA, 17 bp, Homo sapiens
taaaattttttttcatg

SEQ ID NO: 5438263 - DNA, 14 bp, Homo sapiens
taaacaaaaacttt

SEQ ID NO: 5438264 - DNA, 15 bp, Homo sapiens
taaacaaaaactttc

SEQ ID NO: 5438265 - DNA, 17 bp, Homo sapiens
taaacaaaaactttcca

SEQ ID NO: 5438266 - DNA, 16 bp, Homo sapiens
taaacaaaactggaac

SEQ ID NO: 5438267 - DNA, 20 bp, Homo sapiens
taaacaaaagcaaagatgca

SEQ ID NO: 5438268 - DNA, 18 bp, Homo sapiens
taaacaaaatttcacagt

SEQ ID NO: 5438269 - DNA, 23 bp, Homo sapiens
taaacaaacaaattaatgttgtt

SEQ ID NO: 5438270 - DNA, 15 bp, Homo sapiens
taaacaaacattgtg

SEQ ID NO: 5438271 - DNA, 14 bp, Homo sapiens
taaacaaaccagaa

SEQ ID NO: 5438272 - DNA, 18 bp, Homo sapiens
taaacaaactgtgtaact

SEQ ID NO: 5438273 - DNA, 22 bp, Homo sapiens
taaacaaactgtgtaactgccc

SEQ ID NO: 5438274 - DNA, 14 bp, Homo sapiens
taaacaaagacatt

SEQ ID NO: 5438275 - DNA, 15 bp, Homo sapiens
taaacaaagttacta

SEQ ID NO: 5438276 - DNA, 18 bp, Homo sapiens
taaacaaagtttcagagt

SEQ ID NO: 5438277 - DNA, 14 bp, Homo sapiens
taaacaaataaaat

SEQ ID NO: 5438278 - DNA, 18 bp, Homo sapiens
taaacaaatattttcttt

SEQ ID NO: 5438279 - DNA, 20 bp, Homo sapiens
taaacaaatattttctttat

SEQ ID NO: 5438280 - DNA, 13 bp, Homo sapiens
taaacaaatcttt

SEQ ID NO: 5438281 - DNA, 11 bp, Homo sapiens
taaacaaatga

SEQ ID NO: 5438282 - DNA, 18 bp, Homo sapiens
taaacaaatgaattgtat

SEQ ID NO: 5438283 - DNA, 15 bp, Homo sapiens
taaacaaatgtgtaa

SEQ ID NO: 5438284 - DNA, 15 bp, Homo sapiens
taaacaacagctgaa

SEQ ID NO: 5438285 - DNA, 15 bp, Homo sapiens
taaacaacttgtact

SEQ ID NO: 5438286 - DNA, 22 bp, Homo sapiens
taaacaacttgtacttgtttca

SEQ ID NO: 5438287 - DNA, 16 bp, Homo sapiens
taaacaagaaatctga

SEQ ID NO: 5438288 - DNA, 16 bp, Homo sapiens
taaacaagaaccattt

SEQ ID NO: 5438289 - DNA, 20 bp, Homo sapiens
taaacaagaatcagtctatc

SEQ ID NO: 5438290 - DNA, 18 bp, Homo sapiens
taaacaagaccacgtttc

SEQ ID NO: 5438291 - DNA, 20 bp, Homo sapiens
taaacaagaccacgtttcta

SEQ ID NO: 5438292 - DNA, 18 bp, Homo sapiens
taaacaagtatttgttaa

SEQ ID NO: 5438293 - DNA, 23 bp, Homo sapiens
taaacaagtatttgttaatttag

SEQ ID NO: 5438294 - DNA, 21 bp, Homo sapiens
taaacaataaaaacaactttc

SEQ ID NO: 5438295 - DNA, 20 bp, Homo sapiens
taaacaatataagaaggaaa

SEQ ID NO: 5438296 - DNA, 20 bp, Homo sapiens
taaacaatctttcatgtctt

SEQ ID NO: 5438297 - DNA, 21 bp, Homo sapiens
taaacaatctttcatgtcttg

SEQ ID NO: 5438298 - DNA, 23 bp, Homo sapiens
taaacaatctttcatgtcttgtc

SEQ ID NO: 5438299 - DNA, 19 bp, Homo sapiens
taaacaatgaattcttcaa

SEQ ID NO: 5438300 - DNA, 21 bp, Homo sapiens
taaacaatgctgatttggtga

SEQ ID NO: 5438301 - DNA, 20 bp, Homo sapiens
taaacaatgtataaagattg

SEQ ID NO: 5438302 - DNA, 20 bp, Homo sapiens
taaacaattcttgtaacttt

SEQ ID NO: 5438303 - DNA, 23 bp, Homo sapiens
taaacacaaaatccattccaggt

SEQ ID NO: 5438304 - DNA, 16 bp, Homo sapiens
taaacacaagaaggaa

SEQ ID NO: 5438305 - DNA, 20 bp, Homo sapiens
taaacacaagattggtgttt

SEQ ID NO: 5438306 - DNA, 12 bp, Homo sapiens
taaacacacaga

SEQ ID NO: 5438307 - DNA, 14 bp, Homo sapiens
taaacacacagata

SEQ ID NO: 5438308 - DNA, 14 bp, Homo sapiens
taaacacactagtt

SEQ ID NO: 5438309 - DNA, 22 bp, Homo sapiens
taaacacacttttctttttaaa

SEQ ID NO: 5438310 - DNA, 19 bp, Homo sapiens
taaacacaggctgtcctta

SEQ ID NO: 5438311 - DNA, 14 bp, Homo sapiens
taaacacagggaaa

SEQ ID NO: 5438312 - DNA, 22 bp, Homo sapiens
taaacacagtaagataggttct

SEQ ID NO: 5438313 - DNA, 19 bp, Homo sapiens
taaacacataaatgaaaga

SEQ ID NO: 5438314 - DNA, 15 bp, Homo sapiens
taaacacattgaatg

SEQ ID NO: 5438315 - DNA, 14 bp, Homo sapiens
taaacacatttcca

SEQ ID NO: 5438316 - DNA, 17 bp, Homo sapiens
taaacaccaacccagga

SEQ ID NO: 5438317 - DNA, 15 bp, Homo sapiens
taaacaccatgaaga

SEQ ID NO: 5438318 - DNA, 13 bp, Homo sapiens
taaacacctgaca

SEQ ID NO: 5438319 - DNA, 18 bp, Homo sapiens
taaacacctgacacatct

SEQ ID NO: 5438320 - DNA, 20 bp, Homo sapiens
taaacactacacatttgaaa

SEQ ID NO: 5438321 - DNA, 17 bp, Homo sapiens
taaacactcaccttcta

SEQ ID NO: 5438322 - DNA, 12 bp, Homo sapiens
taaacactcagc

SEQ ID NO: 5438323 - DNA, 17 bp, Homo sapiens
taaacactcttgaaaaa

SEQ ID NO: 5438324 - DNA, 18 bp, Homo sapiens
taaacactcttgaaaaat

SEQ ID NO: 5438325 - DNA, 17 bp, Homo sapiens
taaacactggtgccaac

SEQ ID NO: 5438326 - DNA, 19 bp, Homo sapiens
taaacactggtgccaacca

SEQ ID NO: 5438327 - DNA, 23 bp, Homo sapiens
taaacactgtattgtaagtggaa

SEQ ID NO: 5438328 - DNA, 11 bp, Homo sapiens
taaacactgtg

SEQ ID NO: 5438329 - DNA, 11 bp, Homo sapiens
taaacactgtt

SEQ ID NO: 5438330 - DNA, 14 bp, Homo sapiens
taaacactgtttta

SEQ ID NO: 5438331 - DNA, 19 bp, Homo sapiens
taaacacttatcttctgga

SEQ ID NO: 5438332 - DNA, 15 bp, Homo sapiens
taaacacttctcctt

SEQ ID NO: 5438333 - DNA, 17 bp, Homo sapiens
taaacacttctccttaa

SEQ ID NO: 5438334 - DNA, 13 bp, Homo sapiens
taaacactttttc

SEQ ID NO: 5438335 - DNA, 14 bp, Homo sapiens
taaacagaaatgct

SEQ ID NO: 5438336 - DNA, 16 bp, Homo sapiens
taaacagaaattattt

SEQ ID NO: 5438337 - DNA, 23 bp, Homo sapiens
taaacagaataaaagttcctctc

SEQ ID NO: 5438338 - DNA, 17 bp, Homo sapiens
taaacagacaaaaacaa

SEQ ID NO: 5438339 - DNA, 21 bp, Homo sapiens
taaacagacaggaatttagaa

SEQ ID NO: 5438340 - DNA, 19 bp, Homo sapiens
taaacagactgttttctaa

SEQ ID NO: 5438341 - DNA, 19 bp, Homo sapiens
taaacagagtccgggagaa

SEQ ID NO: 5438342 - DNA, 16 bp, Homo sapiens
taaacagatataaatg

SEQ ID NO: 5438343 - DNA, 18 bp, Homo sapiens
taaacagatatcttcagt

SEQ ID NO: 5438344 - DNA, 17 bp, Homo sapiens
taaacagatgtccctga

SEQ ID NO: 5438345 - DNA, 18 bp, Homo sapiens
taaacagatgtccctgaa

SEQ ID NO: 5438346 - DNA, 17 bp, Homo sapiens
taaacagatttgattgt

SEQ ID NO: 5438347 - DNA, 15 bp, Homo sapiens
taaacagatttttac

SEQ ID NO: 5438348 - DNA, 19 bp, Homo sapiens
taaacagatttttacaaat

SEQ ID NO: 5438349 - DNA, 15 bp, Homo sapiens
taaacagcaaagcca

SEQ ID NO: 5438350 - DNA, 13 bp, Homo sapiens
taaacagcacacc

SEQ ID NO: 5438351 - DNA, 17 bp, Homo sapiens
taaacagcacacctgtg

SEQ ID NO: 5438352 - DNA, 21 bp, Homo sapiens
taaacagcagcactttttagt

SEQ ID NO: 5438353 - DNA, 11 bp, Homo sapiens
taaacagcatt

SEQ ID NO: 5438354 - DNA, 15 bp, Homo sapiens
taaacagcatttatt

SEQ ID NO: 5438355 - DNA, 15 bp, Homo sapiens
taaacagctgcttta

SEQ ID NO: 5438356 - DNA, 15 bp, Homo sapiens
taaacagctttttta

SEQ ID NO: 5438357 - DNA, 17 bp, Homo sapiens
taaacaggaattttatt

SEQ ID NO: 5438358 - DNA, 15 bp, Homo sapiens
taaacaggcccagca

SEQ ID NO: 5438359 - DNA, 19 bp, Homo sapiens
taaacagggcatctccagg

SEQ ID NO: 5438360 - DNA, 20 bp, Homo sapiens
taaacagggcatctccagga

SEQ ID NO: 5438361 - DNA, 21 bp, Homo sapiens
taaacaggtatttttttaaat

SEQ ID NO: 5438362 - DNA, 23 bp, Homo sapiens
taaacaggtggtgagaaatttct

SEQ ID NO: 5438363 - DNA, 17 bp, Homo sapiens
taaacagtaaaccttaa

SEQ ID NO: 5438364 - DNA, 21 bp, Homo sapiens
taaacagtagttgtattcttc

SEQ ID NO: 5438365 - DNA, 15 bp, Homo sapiens
taaacagtatttcat

SEQ ID NO: 5438366 - DNA, 22 bp, Homo sapiens
taaacagtgaacttgtctggct

SEQ ID NO: 5438367 - DNA, 20 bp, Homo sapiens
taaacagtgagcctgaattt

SEQ ID NO: 5438368 - DNA, 17 bp, Homo sapiens
taaacagtgcctgctga

SEQ ID NO: 5438369 - DNA, 19 bp, Homo sapiens
taaacagtggctcataaaa

SEQ ID NO: 5438370 - DNA, 15 bp, Homo sapiens
taaacagtgtttatg

SEQ ID NO: 5438371 - DNA, 17 bp, Homo sapiens
taaacagttctgcactc

SEQ ID NO: 5438372 - DNA, 13 bp, Homo sapiens
taaacagttcttg

SEQ ID NO: 5438373 - DNA, 16 bp, Homo sapiens
taaacagttgcacagc

SEQ ID NO: 5438374 - DNA, 18 bp, Homo sapiens
taaacagttgcacagcat

SEQ ID NO: 5438375 - DNA, 16 bp, Homo sapiens
taaacagttgttactt

SEQ ID NO: 5438376 - DNA, 14 bp, Homo sapiens
taaacataaaaact

SEQ ID NO: 5438377 - DNA, 21 bp, Homo sapiens
taaacataacagcctctgtga

SEQ ID NO: 5438378 - DNA, 23 bp, Homo sapiens
taaacataagtgtacgattctta

SEQ ID NO: 5438379 - DNA, 23 bp, Homo sapiens
taaacataataaatcacacattc

SEQ ID NO: 5438380 - DNA, 15 bp, Homo sapiens
taaacataatgaaaa

SEQ ID NO: 5438381 - DNA, 17 bp, Homo sapiens
taaacataattatttct

SEQ ID NO: 5438382 - DNA, 15 bp, Homo sapiens
taaacataattcttg

SEQ ID NO: 5438383 - DNA, 14 bp, Homo sapiens
taaacataattgtg

SEQ ID NO: 5438384 - DNA, 17 bp, Homo sapiens
taaacataattgtggat

SEQ ID NO: 5438385 - DNA, 15 bp, Homo sapiens
taaacatagatagtg

SEQ ID NO: 5438386 - DNA, 18 bp, Homo sapiens
taaacataggtataatta

SEQ ID NO: 5438387 - DNA, 16 bp, Homo sapiens
taaacatagtggtatt

SEQ ID NO: 5438388 - DNA, 16 bp, Homo sapiens
taaacatatacagaaa

SEQ ID NO: 5438389 - DNA, 19 bp, Homo sapiens
taaacatatccaagtttga

SEQ ID NO: 5438390 - DNA, 16 bp, Homo sapiens
taaacatatgatttca

SEQ ID NO: 5438391 - DNA, 22 bp, Homo sapiens
taaacatatgatttcactagaa

SEQ ID NO: 5438392 - DNA, 18 bp, Homo sapiens
taaacatatggctttagt

SEQ ID NO: 5438393 - DNA, 22 bp, Homo sapiens
taaacatatttatttttacctg

SEQ ID NO: 5438394 - DNA, 19 bp, Homo sapiens
taaacatatttttatactt

SEQ ID NO: 5438395 - DNA, 22 bp, Homo sapiens
taaacatatttttatactttat

SEQ ID NO: 5438396 - DNA, 19 bp, Homo sapiens
taaacatcaggttaggcag

SEQ ID NO: 5438397 - DNA, 20 bp, Homo sapiens
taaacatcaggttaggcagt

SEQ ID NO: 5438398 - DNA, 20 bp, Homo sapiens
taaacatccaatattttctt

SEQ ID NO: 5438399 - DNA, 17 bp, Homo sapiens
taaacatccttcaagaa

SEQ ID NO: 5438400 - DNA, 23 bp, Homo sapiens
taaacatctgtgtctgtgtctgc

SEQ ID NO: 5438401 - DNA, 20 bp, Homo sapiens
taaacatgaatttaatgtct

SEQ ID NO: 5438402 - DNA, 22 bp, Homo sapiens
taaacatgactccatagacctt

SEQ ID NO: 5438403 - DNA, 14 bp, Homo sapiens
taaacatgattatc

SEQ ID NO: 5438404 - DNA, 13 bp, Homo sapiens
taaacatgcagaa

SEQ ID NO: 5438405 - DNA, 20 bp, Homo sapiens
taaacatgctgtacatactt

SEQ ID NO: 5438406 - DNA, 21 bp, Homo sapiens
taaacatgctgtacatacttt

SEQ ID NO: 5438407 - DNA, 18 bp, Homo sapiens
taaacatggttacaatca

SEQ ID NO: 5438408 - DNA, 15 bp, Homo sapiens
taaacatgtcccctt

SEQ ID NO: 5438409 - DNA, 15 bp, Homo sapiens
taaagcaatatgcat

SEQ ID NO: 5438410 - DNA, 17 bp, Homo sapiens
taaagcaatatgcattt

SEQ ID NO: 5438411 - DNA, 16 bp, Homo sapiens
taaagcaatctgattc

SEQ ID NO: 5438412 - DNA, 19 bp, Homo sapiens
taaagcaattttccttgaa

SEQ ID NO: 5438413 - DNA, 17 bp, Homo sapiens
taaagcacgtgcaagga

SEQ ID NO: 5438414 - DNA, 19 bp, Homo sapiens
taaagcactggtttcaaga

SEQ ID NO: 5438415 - DNA, 15 bp, Homo sapiens
taaagcactttgcac

SEQ ID NO: 5438416 - DNA, 16 bp, Homo sapiens
taaagcactttgcact

SEQ ID NO: 5438417 - DNA, 13 bp, Homo sapiens
taaagcagacagt

SEQ ID NO: 5438418 - DNA, 14 bp, Homo sapiens
taaagcagagccaa

SEQ ID NO: 5438419 - DNA, 20 bp, Homo sapiens
taaagcagagccaaggccac

SEQ ID NO: 5438420 - DNA, 12 bp, Homo sapiens
taaagcagatta

SEQ ID NO: 5438421 - DNA, 17 bp, Homo sapiens
taaagcagattacctct

SEQ ID NO: 5438422 - DNA, 11 bp, Homo sapiens
taaagcagcaa

SEQ ID NO: 5438423 - DNA, 15 bp, Homo sapiens
taaagcagcctgatt

SEQ ID NO: 5438424 - DNA, 10 bp, Homo sapiens
taaagcaggg

SEQ ID NO: 5438425 - DNA, 13 bp, Homo sapiens
taaagcagtattt

SEQ ID NO: 5438426 - DNA, 17 bp, Homo sapiens
taaagcagtatttttct

SEQ ID NO: 5438427 - DNA, 19 bp, Homo sapiens
taaagcagtcacttttcct

SEQ ID NO: 5438428 - DNA, 19 bp, Homo sapiens
taaagcagtggacaccagg

SEQ ID NO: 5438429 - DNA, 13 bp, Homo sapiens
taaagcagttaat

SEQ ID NO: 5438430 - DNA, 20 bp, Homo sapiens
taaagcagttcctgtcccac

SEQ ID NO: 5438431 - DNA, 21 bp, Homo sapiens
taaagcatcaccactcatttt

SEQ ID NO: 5438432 - DNA, 15 bp, Homo sapiens
taaagcatctaaact

SEQ ID NO: 5438433 - DNA, 14 bp, Homo sapiens
taaagcatctgtaa

SEQ ID NO: 5438434 - DNA, 15 bp, Homo sapiens
taaagcattactctt

SEQ ID NO: 5438435 - DNA, 23 bp, Homo sapiens
taaagcattcaatttattcaaga

SEQ ID NO: 5438436 - DNA, 19 bp, Homo sapiens
taaagcattgctgttatgt

SEQ ID NO: 5438437 - DNA, 20 bp, Homo sapiens
taaagcattgctgttatgtc

SEQ ID NO: 5438438 - DNA, 11 bp, Homo sapiens
taaagcattta

SEQ ID NO: 5438439 - DNA, 19 bp, Homo sapiens
taaagcatttagaaaactt

SEQ ID NO: 5438440 - DNA, 13 bp, Homo sapiens
taaagcatttata

SEQ ID NO: 5438441 - DNA, 13 bp, Homo sapiens
taaagcatttcct

SEQ ID NO: 5438442 - DNA, 16 bp, Homo sapiens
taaagcattttgcaaa

SEQ ID NO: 5438443 - DNA, 17 bp, Homo sapiens
taaagcattttgcaaac

SEQ ID NO: 5438444 - DNA, 19 bp, Homo sapiens
taaagccaaagtttctgtt

SEQ ID NO: 5438445 - DNA, 21 bp, Homo sapiens
taaagccaaagtttctgttga

SEQ ID NO: 5438446 - DNA, 14 bp, Homo sapiens
taaagccaaatgta

SEQ ID NO: 5438447 - DNA, 23 bp, Homo sapiens
taaagccacttctggcttcagcc

SEQ ID NO: 5438448 - DNA, 21 bp, Homo sapiens
taaagccagcatttcctcagt

SEQ ID NO: 5438449 - DNA, 15 bp, Homo sapiens
taaagccaggaacag

SEQ ID NO: 5438450 - DNA, 23 bp, Homo sapiens
taaagccaggaacagggaccagc

SEQ ID NO: 5438451 - DNA, 14 bp, Homo sapiens
taaagccaggctca

SEQ ID NO: 5438452 - DNA, 16 bp, Homo sapiens
taaagccaggctcagg

SEQ ID NO: 5438453 - DNA, 10 bp, Homo sapiens
taaagccagt

SEQ ID NO: 5438454 - DNA, 18 bp, Homo sapiens
taaagccagtcatcatct

SEQ ID NO: 5438455 - DNA, 18 bp, Homo sapiens
taaagccatgctaaaatt

SEQ ID NO: 5438456 - DNA, 19 bp, Homo sapiens
taaagccatgttaaatgac

SEQ ID NO: 5438457 - DNA, 19 bp, Homo sapiens
taaagccctcagatcccag

SEQ ID NO: 5438458 - DNA, 15 bp, Homo sapiens
taaagccgctgcctt

SEQ ID NO: 5438459 - DNA, 15 bp, Homo sapiens
taaagcctatttttc

SEQ ID NO: 5438460 - DNA, 11 bp, Homo sapiens
taaagcctcaa

SEQ ID NO: 5438461 - DNA, 21 bp, Homo sapiens
taaagcctcaaggttttaggt

SEQ ID NO: 5438462 - DNA, 17 bp, Homo sapiens
taaagcctctgactcaa

SEQ ID NO: 5438463 - DNA, 14 bp, Homo sapiens
taaagcctgaaaat

SEQ ID NO: 5438464 - DNA, 15 bp, Homo sapiens
taaagccttaagcac

SEQ ID NO: 5438465 - DNA, 21 bp, Homo sapiens
taaagccttctggatccatgg

SEQ ID NO: 5438466 - DNA, 17 bp, Homo sapiens
taaagccttgttttctc

SEQ ID NO: 5438467 - DNA, 18 bp, Homo sapiens
taaagccttgttttctct

SEQ ID NO: 5438468 - DNA, 20 bp, Homo sapiens
taaagcctttaaaaccagta

SEQ ID NO: 5438469 - DNA, 21 bp, Homo sapiens
taaagcctttagtatcagtgt

SEQ ID NO: 5438470 - DNA, 11 bp, Homo sapiens
taaagcctttt

SEQ ID NO: 5438471 - DNA, 19 bp, Homo sapiens
taaagccttttaaatcatc

SEQ ID NO: 5438472 - DNA, 17 bp, Homo sapiens
taaagcgaatggaccat

SEQ ID NO: 5438473 - DNA, 18 bp, Homo sapiens
taaagcgggaaggacatt

SEQ ID NO: 5438474 - DNA, 23 bp, Homo sapiens
taaagctaaaatgattttatctg

SEQ ID NO: 5438475 - DNA, 12 bp, Homo sapiens
taaagctaaact

SEQ ID NO: 5438476 - DNA, 13 bp, Homo sapiens
taaagctaaattt

SEQ ID NO: 5438477 - DNA, 14 bp, Homo sapiens
taaagctaaatttt

SEQ ID NO: 5438478 - DNA, 13 bp, Homo sapiens
taaagctactgaa

SEQ ID NO: 5438479 - DNA, 17 bp, Homo sapiens
taaagctactgaattta

SEQ ID NO: 5438480 - DNA, 15 bp, Homo sapiens
taaagctagacaaag

SEQ ID NO: 5438481 - DNA, 15 bp, Homo sapiens
taaagctatatttct

SEQ ID NO: 5438482 - DNA, 13 bp, Homo sapiens
taaagctcacact

SEQ ID NO: 5438483 - DNA, 21 bp, Homo sapiens
taaagctcacacttgggctgg

SEQ ID NO: 5438484 - DNA, 15 bp, Homo sapiens
taaagctcaggaggg

SEQ ID NO: 5438485 - DNA, 17 bp, Homo sapiens
taaagctcgaaaacaat

SEQ ID NO: 5438486 - DNA, 23 bp, Homo sapiens
taaagctcgtccccattgcttaa

SEQ ID NO: 5438487 - DNA, 16 bp, Homo sapiens
taaagctgcctgtagt

SEQ ID NO: 5438488 - DNA, 17 bp, Homo sapiens
taaagctgcctgtagtt

SEQ ID NO: 5438489 - DNA, 21 bp, Homo sapiens
taaagctgcctgtagttagga

SEQ ID NO: 5438490 - DNA, 13 bp, Homo sapiens
taaagctggaaca

SEQ ID NO: 5438491 - DNA, 23 bp, Homo sapiens
taaagctggaacatttgatattt

SEQ ID NO: 5438492 - DNA, 18 bp, Homo sapiens
taaagctggacaagaagc

SEQ ID NO: 5438493 - DNA, 19 bp, Homo sapiens
taaagctggacaagaagct

SEQ ID NO: 5438494 - DNA, 20 bp, Homo sapiens
taaagctggacaagaagctg

SEQ ID NO: 5438495 - DNA, 23 bp, Homo sapiens
taaagctggacaagaagctgcta

SEQ ID NO: 5438496 - DNA, 10 bp, Homo sapiens
taaagctggc

SEQ ID NO: 5438497 - DNA, 11 bp, Homo sapiens
taaagctggcc

SEQ ID NO: 5438498 - DNA, 12 bp, Homo sapiens
taaagctggccc

SEQ ID NO: 5438499 - DNA, 15 bp, Homo sapiens
taaagctggccctgc

SEQ ID NO: 5438500 - DNA, 20 bp, Homo sapiens
taaagctggccctgcctcct

SEQ ID NO: 5438501 - DNA, 15 bp, Homo sapiens
taaagctggtttaat

SEQ ID NO: 5438502 - DNA, 19 bp, Homo sapiens
taaagctggtttaatgttt

SEQ ID NO: 5438503 - DNA, 14 bp, Homo sapiens
taaagctgtacacc

SEQ ID NO: 5438504 - DNA, 13 bp, Homo sapiens
taaagctgttaaa

SEQ ID NO: 5438505 - DNA, 14 bp, Homo sapiens
taaagctgttaaaa

SEQ ID NO: 5438506 - DNA, 19 bp, Homo sapiens
taaagctgttattcttgtt

SEQ ID NO: 5438507 - DNA, 12 bp, Homo sapiens
taaagcttaaat

SEQ ID NO: 5438508 - DNA, 20 bp, Homo sapiens
taaagcttacccttggtttg

SEQ ID NO: 5438509 - DNA, 22 bp, Homo sapiens
taaagcttactctgtccattta

SEQ ID NO: 5438510 - DNA, 16 bp, Homo sapiens
taaagcttatttttat

SEQ ID NO: 5438511 - DNA, 20 bp, Homo sapiens
taaagcttatttttctgtga

SEQ ID NO: 5438512 - DNA, 11 bp, Homo sapiens
taaagcttcag

SEQ ID NO: 5438513 - DNA, 16 bp, Homo sapiens
taaagcttctctctga

SEQ ID NO: 5438514 - DNA, 17 bp, Homo sapiens
taaagcttctctctgag

SEQ ID NO: 5438515 - DNA, 20 bp, Homo sapiens
taaagcttctctctgagctg

SEQ ID NO: 5438516 - DNA, 20 bp, Homo sapiens
taaagcttgttgactcagct

SEQ ID NO: 5438517 - DNA, 17 bp, Homo sapiens
taaagctttcaacatgt

SEQ ID NO: 5438518 - DNA, 22 bp, Homo sapiens
taaagctttggacaagtccttg

SEQ ID NO: 5438519 - DNA, 14 bp, Homo sapiens
taaaggaaaagaca

SEQ ID NO: 5438520 - DNA, 17 bp, Homo sapiens
taaaggaaaagacacat

SEQ ID NO: 5438521 - DNA, 16 bp, Homo sapiens
taaaggaaagttctat

SEQ ID NO: 5438522 - DNA, 20 bp, Homo sapiens
taaaggaaataggatctcca

SEQ ID NO: 5438523 - DNA, 16 bp, Homo sapiens
taaaggaaatgattga

SEQ ID NO: 5438524 - DNA, 20 bp, Homo sapiens
taaaggaacatggtttgtca

SEQ ID NO: 5438525 - DNA, 20 bp, Homo sapiens
taaaggaagcactctgtata

SEQ ID NO: 5438526 - DNA, 18 bp, Homo sapiens
taaaggaagtcaccaaaa

SEQ ID NO: 5438527 - DNA, 23 bp, Homo sapiens
taaaggaatctagccagtgaaca

SEQ ID NO: 5438528 - DNA, 17 bp, Homo sapiens
taaaggaatgtgaaatt

SEQ ID NO: 5438529 - DNA, 17 bp, Homo sapiens
taaaggaattaaactaa

SEQ ID NO: 5438530 - DNA, 14 bp, Homo sapiens
taaaggaatttaaa

SEQ ID NO: 5438531 - DNA, 22 bp, Homo sapiens
taaaggacaaacagtgaattta

SEQ ID NO: 5438532 - DNA, 16 bp, Homo sapiens
taaaggacactggatc

SEQ ID NO: 5438533 - DNA, 17 bp, Homo sapiens
taaaggacactggatca

SEQ ID NO: 5438534 - DNA, 14 bp, Homo sapiens
taaaggacagtgaa

SEQ ID NO: 5438535 - DNA, 18 bp, Homo sapiens
taaaggaccctgtttctg

SEQ ID NO: 5438536 - DNA, 22 bp, Homo sapiens
taaaggactatttataactaat

SEQ ID NO: 5438537 - DNA, 20 bp, Homo sapiens
taaaggactggtttttaagt

SEQ ID NO: 5438538 - DNA, 22 bp, Homo sapiens
taaaggagaaggcatgaaattg

SEQ ID NO: 5438539 - DNA, 22 bp, Homo sapiens
taaaggagaggttaaagcaaac

SEQ ID NO: 5438540 - DNA, 23 bp, Homo sapiens
taaaggagcagctagctgctttt

SEQ ID NO: 5438541 - DNA, 21 bp, Homo sapiens
taaaggagcatttttttattc

SEQ ID NO: 5438542 - DNA, 13 bp, Homo sapiens
taaaggagggaga

SEQ ID NO: 5438543 - DNA, 15 bp, Homo sapiens
taaaggagtttatgt

SEQ ID NO: 5438544 - DNA, 19 bp, Homo sapiens
taaaggagtttatgttcca

SEQ ID NO: 5438545 - DNA, 23 bp, Homo sapiens
taaaggataatggtgaacatttt

SEQ ID NO: 5438546 - DNA, 14 bp, Homo sapiens
taaaggatatttca

SEQ ID NO: 5438547 - DNA, 16 bp, Homo sapiens
taaaggatatttcaaa

SEQ ID NO: 5438548 - DNA, 21 bp, Homo sapiens
taaaggatatttcaaatgatt

SEQ ID NO: 5438549 - DNA, 15 bp, Homo sapiens
taaaggatccagaga

SEQ ID NO: 5438550 - DNA, 16 bp, Homo sapiens
taaaggatccagagag

SEQ ID NO: 5438551 - DNA, 15 bp, Homo sapiens
taaaggatgagattt

SEQ ID NO: 5438552 - DNA, 22 bp, Homo sapiens
taaaggatgagatttttcatgt

SEQ ID NO: 5438553 - DNA, 17 bp, Homo sapiens
taaaggatgttggtgtt

SEQ ID NO: 5438554 - DNA, 14 bp, Homo sapiens
taaaggcaaggaaa

SEQ ID NO: 5438555 - DNA, 19 bp, Homo sapiens
taaaggcaccatctaatag

SEQ ID NO: 5438556 - DNA, 21 bp, Homo sapiens
taaaggcagcaaccattcatc

SEQ ID NO: 5438557 - DNA, 12 bp, Homo sapiens
taaaggcagctg

SEQ ID NO: 5438558 - DNA, 13 bp, Homo sapiens
taaaggcagctgc

SEQ ID NO: 5438559 - DNA, 15 bp, Homo sapiens
taaaggcagctgcct

SEQ ID NO: 5438560 - DNA, 18 bp, Homo sapiens
taaaggcagctgcctctg

SEQ ID NO: 5438561 - DNA, 21 bp, Homo sapiens
taaaggcagctgcctctgctc

SEQ ID NO: 5438562 - DNA, 22 bp, Homo sapiens
taaaggcagctgcctctgctcc

SEQ ID NO: 5438563 - DNA, 23 bp, Homo sapiens
taaaggcagctgcctctgctccc

SEQ ID NO: 5438564 - DNA, 24 bp, Homo sapiens
taaaggcagctgcctctgctccct

SEQ ID NO: 5438565 - DNA, 20 bp, Homo sapiens
taaaggcatccttgtctttt

SEQ ID NO: 5438566 - DNA, 19 bp, Homo sapiens
taaaggcattccacaggat

SEQ ID NO: 5438567 - DNA, 18 bp, Homo sapiens
taaaggccacaggagaca

SEQ ID NO: 5438568 - DNA, 15 bp, Homo sapiens
taaaggccatgtgaa

SEQ ID NO: 5438569 - DNA, 16 bp, Homo sapiens
taaaggcccagcccct

SEQ ID NO: 5438570 - DNA, 19 bp, Homo sapiens
taaaggccgtcatttcatt

SEQ ID NO: 5438571 - DNA, 15 bp, Homo sapiens
taaaggcctcctccc

SEQ ID NO: 5438572 - DNA, 15 bp, Homo sapiens
taaaggcctctgcct

SEQ ID NO: 5438573 - DNA, 23 bp, Homo sapiens
taaaggcctctgcctcacaacat

SEQ ID NO: 5438574 - DNA, 20 bp, Homo sapiens
taaaggcctcttccttgctg

SEQ ID NO: 5438575 - DNA, 22 bp, Homo sapiens
taaaggcctttaataagtcatt

SEQ ID NO: 5438576 - DNA, 16 bp, Homo sapiens
taaaggctaactatga

SEQ ID NO: 5438577 - DNA, 21 bp, Homo sapiens
taaaggctacctttgtattct

SEQ ID NO: 5438578 - DNA, 20 bp, Homo sapiens
taaaggctatacttgtcttg

SEQ ID NO: 5438579 - DNA, 15 bp, Homo sapiens
taaaggctctggaag

SEQ ID NO: 5438580 - DNA, 16 bp, Homo sapiens
taaaggctgagtttag

SEQ ID NO: 5438581 - DNA, 19 bp, Homo sapiens
taaaggcttaaatcaaaag

SEQ ID NO: 5438582 - DNA, 13 bp, Homo sapiens
taaagggaagaaa

SEQ ID NO: 5438583 - DNA, 14 bp, Homo sapiens
taaagggaagaaaa

SEQ ID NO: 5438584 - DNA, 14 bp, Homo sapiens
taaagggaagccct

SEQ ID NO: 5438585 - DNA, 23 bp, Homo sapiens
taaagggacacccctacacacac

SEQ ID NO: 5438586 - DNA, 16 bp, Homo sapiens
taaagggacagtttgt

SEQ ID NO: 5438587 - DNA, 13 bp, Homo sapiens
taaataatttatt

SEQ ID NO: 5438588 - DNA, 16 bp, Homo sapiens
taaataatttcctaca

SEQ ID NO: 5438589 - DNA, 17 bp, Homo sapiens
taaataatttgcactga

SEQ ID NO: 5438590 - DNA, 13 bp, Homo sapiens
taaataattttaa

SEQ ID NO: 5438591 - DNA, 23 bp, Homo sapiens
taaataattttaaataacctctg

SEQ ID NO: 5438592 - DNA, 17 bp, Homo sapiens
taaataattttacatgt

SEQ ID NO: 5438593 - DNA, 19 bp, Homo sapiens
taaataattttacatgtct

SEQ ID NO: 5438594 - DNA, 16 bp, Homo sapiens
taaataattttctaag

SEQ ID NO: 5438595 - DNA, 17 bp, Homo sapiens
taaataattttctaaga

SEQ ID NO: 5438596 - DNA, 18 bp, Homo sapiens
taaatacaaaaatgaata

SEQ ID NO: 5438597 - DNA, 20 bp, Homo sapiens
taaatacaagactgttgtga

SEQ ID NO: 5438598 - DNA, 22 bp, Homo sapiens
taaatacaatttgtactttttt

SEQ ID NO: 5438599 - DNA, 15 bp, Homo sapiens
taaatacaattttgt

SEQ ID NO: 5438600 - DNA, 23 bp, Homo sapiens
taaatacaattttgtttctgtac

SEQ ID NO: 5438601 - DNA, 19 bp, Homo sapiens
taaatacaattttttttat

SEQ ID NO: 5438602 - DNA, 19 bp, Homo sapiens
taaatacacatagcatgta

SEQ ID NO: 5438603 - DNA, 23 bp, Homo sapiens
taaatacaccacctcactcctgt

SEQ ID NO: 5438604 - DNA, 17 bp, Homo sapiens
taaatacactgaattga

SEQ ID NO: 5438605 - DNA, 21 bp, Homo sapiens
taaatacactgaattgaatct

SEQ ID NO: 5438606 - DNA, 23 bp, Homo sapiens
taaatacagataattcatttgta

SEQ ID NO: 5438607 - DNA, 16 bp, Homo sapiens
taaatacagcatactt

SEQ ID NO: 5438608 - DNA, 14 bp, Homo sapiens
taaatacaggaaac

SEQ ID NO: 5438609 - DNA, 23 bp, Homo sapiens
taaatacagtcttccatttgcaa

SEQ ID NO: 5438610 - DNA, 14 bp, Homo sapiens
taaatacataaata

SEQ ID NO: 5438611 - DNA, 17 bp, Homo sapiens
taaatacatcactgtat

SEQ ID NO: 5438612 - DNA, 15 bp, Homo sapiens
taaatacatggaaat

SEQ ID NO: 5438613 - DNA, 13 bp, Homo sapiens
taaatacatgtgt

SEQ ID NO: 5438614 - DNA, 12 bp, Homo sapiens
taaatacatgtt

SEQ ID NO: 5438615 - DNA, 15 bp, Homo sapiens
taaatacatttcctt

SEQ ID NO: 5438616 - DNA, 15 bp, Homo sapiens
taaataccaaagata

SEQ ID NO: 5438617 - DNA, 12 bp, Homo sapiens
taaataccacaa

SEQ ID NO: 5438618 - DNA, 18 bp, Homo sapiens
taaataccacaagatgga

SEQ ID NO: 5438619 - DNA, 22 bp, Homo sapiens
taaatacctcaacctatggtat

SEQ ID NO: 5438620 - DNA, 15 bp, Homo sapiens
taaatacgtgtcaaa

SEQ ID NO: 5438621 - DNA, 12 bp, Homo sapiens
taaatactatag

SEQ ID NO: 5438622 - DNA, 14 bp, Homo sapiens
taaatactcatgaa

SEQ ID NO: 5438623 - DNA, 16 bp, Homo sapiens
taaatactcccttttt

SEQ ID NO: 5438624 - DNA, 16 bp, Homo sapiens
taaatactgcaaatca

SEQ ID NO: 5438625 - DNA, 15 bp, Homo sapiens
taaatactggactca

SEQ ID NO: 5438626 - DNA, 18 bp, Homo sapiens
taaatactggactcagga

SEQ ID NO: 5438627 - DNA, 13 bp, Homo sapiens
taaatactgtaca

SEQ ID NO: 5438628 - DNA, 15 bp, Homo sapiens
taaatactgtgaaat

SEQ ID NO: 5438629 - DNA, 13 bp, Homo sapiens
taaatactgtgca

SEQ ID NO: 5438630 - DNA, 16 bp, Homo sapiens
taaatactgtgtggaa

SEQ ID NO: 5438631 - DNA, 14 bp, Homo sapiens
taaatacttcatga

SEQ ID NO: 5438632 - DNA, 23 bp, Homo sapiens
taaatacttcatgagcattcata

SEQ ID NO: 5438633 - DNA, 18 bp, Homo sapiens
taaatacttgcagttgtg

SEQ ID NO: 5438634 - DNA, 18 bp, Homo sapiens
taaatactttccatgttt

SEQ ID NO: 5438635 - DNA, 19 bp, Homo sapiens
taaatactttccatgtttt

SEQ ID NO: 5438636 - DNA, 12 bp, Homo sapiens
taaatacttttt

SEQ ID NO: 5438637 - DNA, 23 bp, Homo sapiens
taaatactttttcagttgtttag

SEQ ID NO: 5438638 - DNA, 15 bp, Homo sapiens
taaatagaaatatag

SEQ ID NO: 5438639 - DNA, 14 bp, Homo sapiens
taaatagaacttga

SEQ ID NO: 5438640 - DNA, 20 bp, Homo sapiens
taaatagaatgtaaatgtct

SEQ ID NO: 5438641 - DNA, 22 bp, Homo sapiens
taaatagagttccaaataagga

SEQ ID NO: 5438642 - DNA, 15 bp, Homo sapiens
taaatagatactttt

SEQ ID NO: 5438643 - DNA, 15 bp, Homo sapiens
taaatagatgatttc

SEQ ID NO: 5438644 - DNA, 16 bp, Homo sapiens
taaatagatgatttca

SEQ ID NO: 5438645 - DNA, 22 bp, Homo sapiens
taaatagatttttagattccta

SEQ ID NO: 5438646 - DNA, 16 bp, Homo sapiens
taaatagcactttttg

SEQ ID NO: 5438647 - DNA, 14 bp, Homo sapiens
taaatagcataaaa

SEQ ID NO: 5438648 - DNA, 13 bp, Homo sapiens
taaatagcatctg

SEQ ID NO: 5438649 - DNA, 19 bp, Homo sapiens
taaatagcatgtattgtgt

SEQ ID NO: 5438650 - DNA, 17 bp, Homo sapiens
taaatagcctaaatgat

SEQ ID NO: 5438651 - DNA, 17 bp, Homo sapiens
taaatagccttcaaaaa

SEQ ID NO: 5438652 - DNA, 17 bp, Homo sapiens
taaatagctatatccat

SEQ ID NO: 5438653 - DNA, 22 bp, Homo sapiens
taaatagctatatccatgtact

SEQ ID NO: 5438654 - DNA, 19 bp, Homo sapiens
taaatagctgaaaactaat

SEQ ID NO: 5438655 - DNA, 22 bp, Homo sapiens
taaatagctgaaaactaatgta

SEQ ID NO: 5438656 - DNA, 12 bp, Homo sapiens
taaatagctttt

SEQ ID NO: 5438657 - DNA, 17 bp, Homo sapiens
taaatagcttttgtgtc

SEQ ID NO: 5438658 - DNA, 15 bp, Homo sapiens
taaataggatcctgg

SEQ ID NO: 5438659 - DNA, 21 bp, Homo sapiens
taaataggcggggcttgcctt

SEQ ID NO: 5438660 - DNA, 19 bp, Homo sapiens
taaatagggaaaaaacatg

SEQ ID NO: 5438661 - DNA, 21 bp, Homo sapiens
taaatagggaaaaaacatgta

SEQ ID NO: 5438662 - DNA, 22 bp, Homo sapiens
taaataggttcttcttgttctg

SEQ ID NO: 5438663 - DNA, 18 bp, Homo sapiens
taaatagtaggaccaatg

SEQ ID NO: 5438664 - DNA, 16 bp, Homo sapiens
taaatagtatatgcat

SEQ ID NO: 5438665 - DNA, 18 bp, Homo sapiens
taaatagtatttgagagt

SEQ ID NO: 5438666 - DNA, 23 bp, Homo sapiens
taaatagtgtcatataaactcat

SEQ ID NO: 5438667 - DNA, 12 bp, Homo sapiens
taaatagtgtta

SEQ ID NO: 5438668 - DNA, 13 bp, Homo sapiens
taaatagttctat

SEQ ID NO: 5438669 - DNA, 13 bp, Homo sapiens
taaatagttgctc

SEQ ID NO: 5438670 - DNA, 18 bp, Homo sapiens
taaatagttttaaatatg

SEQ ID NO: 5438671 - DNA, 13 bp, Homo sapiens
taaatataaagac

SEQ ID NO: 5438672 - DNA, 15 bp, Homo sapiens
taaatataaatagct

SEQ ID NO: 5438673 - DNA, 18 bp, Homo sapiens
taaatataattctgtaaa

SEQ ID NO: 5438674 - DNA, 20 bp, Homo sapiens
taaatataatttataagcat

SEQ ID NO: 5438675 - DNA, 22 bp, Homo sapiens
taaatataatttataagcattg

SEQ ID NO: 5438676 - DNA, 16 bp, Homo sapiens
taaatatacagcatga

SEQ ID NO: 5438677 - DNA, 20 bp, Homo sapiens
taaatatacagcatgagatt

SEQ ID NO: 5438678 - DNA, 15 bp, Homo sapiens
taaatatacatataa

SEQ ID NO: 5438679 - DNA, 13 bp, Homo sapiens
taaatatactaat

SEQ ID NO: 5438680 - DNA, 16 bp, Homo sapiens
taaatatactaataaa

SEQ ID NO: 5438681 - DNA, 17 bp, Homo sapiens
taaatatactaataaaa

SEQ ID NO: 5438682 - DNA, 20 bp, Homo sapiens
taaatatactaataaaaagg

SEQ ID NO: 5438683 - DNA, 23 bp, Homo sapiens
taaatatactaataaaaaggttt

SEQ ID NO: 5438684 - DNA, 21 bp, Homo sapiens
taaatatagcagtagtctttt

SEQ ID NO: 5438685 - DNA, 23 bp, Homo sapiens
taaatatagttcctaagaagctt

SEQ ID NO: 5438686 - DNA, 21 bp, Homo sapiens
taaatatagttgtctttcttt

SEQ ID NO: 5438687 - DNA, 12 bp, Homo sapiens
taaatatataaa

SEQ ID NO: 5438688 - DNA, 15 bp, Homo sapiens
taaatatataaacaa

SEQ ID NO: 5438689 - DNA, 15 bp, Homo sapiens
taaatatataaatat

SEQ ID NO: 5438690 - DNA, 13 bp, Homo sapiens
taaatatatataa

SEQ ID NO: 5438691 - DNA, 20 bp, Homo sapiens
taaatatatataaagaatat

SEQ ID NO: 5438692 - DNA, 21 bp, Homo sapiens
taaatatatatatatataaaa

SEQ ID NO: 5438693 - DNA, 14 bp, Homo sapiens
taaatatatatggt

SEQ ID NO: 5438694 - DNA, 16 bp, Homo sapiens
taaatatatatgtcaa

SEQ ID NO: 5438695 - DNA, 17 bp, Homo sapiens
taaatatatatgtcaat

SEQ ID NO: 5438696 - DNA, 13 bp, Homo sapiens
taaatatatatta

SEQ ID NO: 5438697 - DNA, 15 bp, Homo sapiens
taaatatatattatt

SEQ ID NO: 5438698 - DNA, 20 bp, Homo sapiens
taaatatatattattctcat

SEQ ID NO: 5438699 - DNA, 14 bp, Homo sapiens
taaatatatattta

SEQ ID NO: 5438700 - DNA, 20 bp, Homo sapiens
taaatatatatttatcatat

SEQ ID NO: 5438701 - DNA, 17 bp, Homo sapiens
taaatatatatttctaa

SEQ ID NO: 5438702 - DNA, 14 bp, Homo sapiens
taaatatatatttt

SEQ ID NO: 5438703 - DNA, 19 bp, Homo sapiens
taaatatatatttttcaac

SEQ ID NO: 5438704 - DNA, 21 bp, Homo sapiens
taaatatatatttttcaacca

SEQ ID NO: 5438705 - DNA, 14 bp, Homo sapiens
taaatatatctacc

SEQ ID NO: 5438706 - DNA, 20 bp, Homo sapiens
taaatatatctttgtaaatt

SEQ ID NO: 5438707 - DNA, 19 bp, Homo sapiens
taaatatatgtatacatat

SEQ ID NO: 5438708 - DNA, 15 bp, Homo sapiens
taaatatatgtatgt

SEQ ID NO: 5438709 - DNA, 16 bp, Homo sapiens
taaatatatgtatgta

SEQ ID NO: 5438710 - DNA, 19 bp, Homo sapiens
taaatatatgtatgtaaaa

SEQ ID NO: 5438711 - DNA, 20 bp, Homo sapiens
taaatatatgtctgataatg

SEQ ID NO: 5438712 - DNA, 16 bp, Homo sapiens
taaatatatgttttga

SEQ ID NO: 5438713 - DNA, 22 bp, Homo sapiens
taaatatatgttttgagaaaaa

SEQ ID NO: 5438714 - DNA, 11 bp, Homo sapiens
taaatatatta

SEQ ID NO: 5438715 - DNA, 20 bp, Homo sapiens
taaatatattattacttgta

SEQ ID NO: 5438716 - DNA, 22 bp, Homo sapiens
taaatatattattacttgtaaa

SEQ ID NO: 5438717 - DNA, 22 bp, Homo sapiens
taaatatatttttttcaactgc

SEQ ID NO: 5438718 - DNA, 16 bp, Homo sapiens
taaatatcaatcattt

SEQ ID NO: 5438719 - DNA, 12 bp, Homo sapiens
taaatatcacaa

SEQ ID NO: 5438720 - DNA, 19 bp, Homo sapiens
taaatatcacagtattatc

SEQ ID NO: 5438721 - DNA, 13 bp, Homo sapiens
taaatatcaccta

SEQ ID NO: 5438722 - DNA, 13 bp, Homo sapiens
taaatatccaaag

SEQ ID NO: 5438723 - DNA, 16 bp, Homo sapiens
taaatatccatttatc

SEQ ID NO: 5438724 - DNA, 14 bp, Homo sapiens
taaatatcccagag

SEQ ID NO: 5438725 - DNA, 20 bp, Homo sapiens
taaatatcccttggacattt

SEQ ID NO: 5438726 - DNA, 16 bp, Homo sapiens
taaatatctagtgcta

SEQ ID NO: 5438727 - DNA, 17 bp, Homo sapiens
taaatatctagtgctaa

SEQ ID NO: 5438728 - DNA, 17 bp, Homo sapiens
taaatatcttctgattt

SEQ ID NO: 5438729 - DNA, 23 bp, Homo sapiens
taaatatcttttatgtttgaata

SEQ ID NO: 5438730 - DNA, 14 bp, Homo sapiens
taaatatgaaagcc

SEQ ID NO: 5438731 - DNA, 13 bp, Homo sapiens
taaatatgaaagt

SEQ ID NO: 5438732 - DNA, 14 bp, Homo sapiens
taaatatgaaatga

SEQ ID NO: 5438733 - DNA, 21 bp, Homo sapiens
taaatatgaaatgataaagat

SEQ ID NO: 5438734 - DNA, 13 bp, Homo sapiens
taaatatgaaatt

SEQ ID NO: 5438735 - DNA, 13 bp, Homo sapiens
taaatatgaacaa

SEQ ID NO: 5438736 - DNA, 14 bp, Homo sapiens
taaatatgaacaaa

SEQ ID NO: 5438737 - DNA, 18 bp, Homo sapiens
taaatatgaaccctttgt

SEQ ID NO: 5438738 - DNA, 23 bp, Homo sapiens
taaatatgaaccctttgtttctt

SEQ ID NO: 5438739 - DNA, 22 bp, Homo sapiens
taaatatgaatctgctcacttt

SEQ ID NO: 5438740 - DNA, 17 bp, Homo sapiens
taaatatgaatgaacaa

SEQ ID NO: 5438741 - DNA, 17 bp, Homo sapiens
taaatatgaattctgtt

SEQ ID NO: 5438742 - DNA, 15 bp, Homo sapiens
taaatatgatttgca

SEQ ID NO: 5438743 - DNA, 19 bp, Homo sapiens
taaatatggactgctcagg

SEQ ID NO: 5438744 - DNA, 14 bp, Homo sapiens
taaatatggggata

SEQ ID NO: 5438745 - DNA, 17 bp, Homo sapiens
taaatatggggatagtc

SEQ ID NO: 5438746 - DNA, 20 bp, Homo sapiens
taaatatggggatagtctgg

SEQ ID NO: 5438747 - DNA, 22 bp, Homo sapiens
taaatatggggatagtctgggt

SEQ ID NO: 5438748 - DNA, 23 bp, Homo sapiens
taaatatggggatagtctgggtc

SEQ ID NO: 5438749 - DNA, 18 bp, Homo sapiens
taaatatgtacatttgtc

SEQ ID NO: 5438750 - DNA, 12 bp, Homo sapiens
taaatatgtaga

SEQ ID NO: 5438751 - DNA, 13 bp, Homo sapiens
taaatatgtcaga

SEQ ID NO: 5438752 - DNA, 16 bp, Homo sapiens
taaatatgtcagatgt

SEQ ID NO: 5438753 - DNA, 13 bp, Homo sapiens
taaatatgtgaag

SEQ ID NO: 5438754 - DNA, 16 bp, Homo sapiens
taaatatgtgacattc

SEQ ID NO: 5438755 - DNA, 21 bp, Homo sapiens
taaatatgtgacattcctgat

SEQ ID NO: 5438756 - DNA, 18 bp, Homo sapiens
taaatatgttagcaaaga

SEQ ID NO: 5438757 - DNA, 14 bp, Homo sapiens
taaatatgtttcac

SEQ ID NO: 5438758 - DNA, 17 bp, Homo sapiens
taaatatgtttcacaca

SEQ ID NO: 5438759 - DNA, 22 bp, Homo sapiens
taaatatgtttcaccctgtccc

SEQ ID NO: 5438760 - DNA, 23 bp, Homo sapiens
taaatattaaagctccattggga

SEQ ID NO: 5438761 - DNA, 15 bp, Homo sapiens
taaatattatgattt

SEQ ID NO: 5438762 - DNA, 14 bp, Homo sapiens
taaatattatgcct

SEQ ID NO: 5438763 - DNA, 20 bp, Homo sapiens
taaatattatgccttgagaa

SEQ ID NO: 5438764 - DNA, 16 bp, Homo sapiens
taaatattatgctgct

SEQ ID NO: 5438765 - DNA, 14 bp, Homo sapiens
taaatattcacact

SEQ ID NO: 5438766 - DNA, 20 bp, Homo sapiens
taaattctagtgtccataaa

SEQ ID NO: 5438767 - DNA, 23 bp, Homo sapiens
taaattctagtgtccataaataa

SEQ ID NO: 5438768 - DNA, 13 bp, Homo sapiens
taaattctatgtt

SEQ ID NO: 5438769 - DNA, 18 bp, Homo sapiens
taaattctatgttaaata

SEQ ID NO: 5438770 - DNA, 15 bp, Homo sapiens
taaattctcagtcat

SEQ ID NO: 5438771 - DNA, 12 bp, Homo sapiens
taaattctctcc

SEQ ID NO: 5438772 - DNA, 19 bp, Homo sapiens
taaattctctctaacataa

SEQ ID NO: 5438773 - DNA, 12 bp, Homo sapiens
taaattctgatt

SEQ ID NO: 5438774 - DNA, 13 bp, Homo sapiens
taaattctgattc

SEQ ID NO: 5438775 - DNA, 15 bp, Homo sapiens
taaattctgatttct

SEQ ID NO: 5438776 - DNA, 16 bp, Homo sapiens
taaattctgatttctt

SEQ ID NO: 5438777 - DNA, 15 bp, Homo sapiens
taaattctgttgaac

SEQ ID NO: 5438778 - DNA, 14 bp, Homo sapiens
taaattcttactct

SEQ ID NO: 5438779 - DNA, 16 bp, Homo sapiens
taaattcttgcaaagt

SEQ ID NO: 5438780 - DNA, 18 bp, Homo sapiens
taaattcttgcaaagtat

SEQ ID NO: 5438781 - DNA, 13 bp, Homo sapiens
taaattctttcat

SEQ ID NO: 5438782 - DNA, 14 bp, Homo sapiens
taaattctttcatg

SEQ ID NO: 5438783 - DNA, 16 bp, Homo sapiens
taaattctttcatgag

SEQ ID NO: 5438784 - DNA, 11 bp, Homo sapiens
taaattctttt

SEQ ID NO: 5438785 - DNA, 12 bp, Homo sapiens
taaattcttttg

SEQ ID NO: 5438786 - DNA, 16 bp, Homo sapiens
taaattctttttcaaa

SEQ ID NO: 5438787 - DNA, 17 bp, Homo sapiens
taaattctttttcaaaa

SEQ ID NO: 5438788 - DNA, 18 bp, Homo sapiens
taaattctttttcaaaaa

SEQ ID NO: 5438789 - DNA, 20 bp, Homo sapiens
taaattcttttttaaatttt

SEQ ID NO: 5438790 - DNA, 13 bp, Homo sapiens
taaattgaaattg

SEQ ID NO: 5438791 - DNA, 13 bp, Homo sapiens
taaattgaataat

SEQ ID NO: 5438792 - DNA, 17 bp, Homo sapiens
taaattgaataatggta

SEQ ID NO: 5438793 - DNA, 14 bp, Homo sapiens
taaattgaatacac

SEQ ID NO: 5438794 - DNA, 19 bp, Homo sapiens
taaattgaatcagtataaa

SEQ ID NO: 5438795 - DNA, 20 bp, Homo sapiens
taaattgacacttaaaaatg

SEQ ID NO: 5438796 - DNA, 14 bp, Homo sapiens
taaattgatccttt

SEQ ID NO: 5438797 - DNA, 15 bp, Homo sapiens
taaattgatgttgat

SEQ ID NO: 5438798 - DNA, 13 bp, Homo sapiens
taaattgatttgt

SEQ ID NO: 5438799 - DNA, 17 bp, Homo sapiens
taaattgatttgttatg

SEQ ID NO: 5438800 - DNA, 21 bp, Homo sapiens
taaattgatttttataaatac

SEQ ID NO: 5438801 - DNA, 16 bp, Homo sapiens
taaattgcaacatatt

SEQ ID NO: 5438802 - DNA, 12 bp, Homo sapiens
taaattgcaata

SEQ ID NO: 5438803 - DNA, 16 bp, Homo sapiens
taaattgcacagagca

SEQ ID NO: 5438804 - DNA, 22 bp, Homo sapiens
taaattgcacagagcacactta

SEQ ID NO: 5438805 - DNA, 20 bp, Homo sapiens
taaattgcagaattcaaaag

SEQ ID NO: 5438806 - DNA, 17 bp, Homo sapiens
taaattgcagacagtgt

SEQ ID NO: 5438807 - DNA, 19 bp, Homo sapiens
taaattgcagtttacagta

SEQ ID NO: 5438808 - DNA, 21 bp, Homo sapiens
taaattgcagtttacagtatt

SEQ ID NO: 5438809 - DNA, 19 bp, Homo sapiens
taaattgcatgctgcttta

SEQ ID NO: 5438810 - DNA, 20 bp, Homo sapiens
taaattgcatgctgctttaa

SEQ ID NO: 5438811 - DNA, 13 bp, Homo sapiens
taaattgccataa

SEQ ID NO: 5438812 - DNA, 16 bp, Homo sapiens
taaattgccataatat

SEQ ID NO: 5438813 - DNA, 18 bp, Homo sapiens
taaattgccataatatga

SEQ ID NO: 5438814 - DNA, 15 bp, Homo sapiens
taaattgcctgattt

SEQ ID NO: 5438815 - DNA, 16 bp, Homo sapiens
taaattgcctgatttg

SEQ ID NO: 5438816 - DNA, 23 bp, Homo sapiens
taaattgcctttgtaatatgaga

SEQ ID NO: 5438817 - DNA, 17 bp, Homo sapiens
taaattgctaatgttgc

SEQ ID NO: 5438818 - DNA, 17 bp, Homo sapiens
taaattgctctgttccc

SEQ ID NO: 5438819 - DNA, 15 bp, Homo sapiens
taaattgctgtgtat

SEQ ID NO: 5438820 - DNA, 16 bp, Homo sapiens
taaattgcttattcta

SEQ ID NO: 5438821 - DNA, 20 bp, Homo sapiens
taaattgctttctatatctt

SEQ ID NO: 5438822 - DNA, 14 bp, Homo sapiens
taaattggaaacat

SEQ ID NO: 5438823 - DNA, 16 bp, Homo sapiens
taaattggagttttaa

SEQ ID NO: 5438824 - DNA, 11 bp, Homo sapiens
taaattggatt

SEQ ID NO: 5438825 - DNA, 17 bp, Homo sapiens
taaattggattattttc

SEQ ID NO: 5438826 - DNA, 21 bp, Homo sapiens
taaattggcctggtatggctg

SEQ ID NO: 5438827 - DNA, 17 bp, Homo sapiens
taaattggctcctttcc

SEQ ID NO: 5438828 - DNA, 18 bp, Homo sapiens
taaattggctcctttccc

SEQ ID NO: 5438829 - DNA, 23 bp, Homo sapiens
taaattggctcctttcccacagt

SEQ ID NO: 5438830 - DNA, 21 bp, Homo sapiens
taaattgggcttcaatcactg

SEQ ID NO: 5438831 - DNA, 15 bp, Homo sapiens
taaattggtcatggt

SEQ ID NO: 5438832 - DNA, 16 bp, Homo sapiens
taaattggtcatggta

SEQ ID NO: 5438833 - DNA, 16 bp, Homo sapiens
taaattggtgataagt

SEQ ID NO: 5438834 - DNA, 12 bp, Homo sapiens
taaattgtaatt

SEQ ID NO: 5438835 - DNA, 18 bp, Homo sapiens
taaattgtacattttgta

SEQ ID NO: 5438836 - DNA, 21 bp, Homo sapiens
taaattgtaccatcattttat

SEQ ID NO: 5438837 - DNA, 23 bp, Homo sapiens
taaattgtagggctttagctttc

SEQ ID NO: 5438838 - DNA, 19 bp, Homo sapiens
taaattgtatacattttgt

SEQ ID NO: 5438839 - DNA, 18 bp, Homo sapiens
taaattgtatattcactt

SEQ ID NO: 5438840 - DNA, 19 bp, Homo sapiens
taaattgtatattcacttt

SEQ ID NO: 5438841 - DNA, 20 bp, Homo sapiens
taaattgtcagatcgttcat

SEQ ID NO: 5438842 - DNA, 14 bp, Homo sapiens
taaattgtcttaat

SEQ ID NO: 5438843 - DNA, 18 bp, Homo sapiens
taaattgtctttaaaaac

SEQ ID NO: 5438844 - DNA, 21 bp, Homo sapiens
taaattgttagcttccttaag

SEQ ID NO: 5438845 - DNA, 18 bp, Homo sapiens
taaattgttataacttca

SEQ ID NO: 5438846 - DNA, 14 bp, Homo sapiens
taaattgtttcata

SEQ ID NO: 5438847 - DNA, 13 bp, Homo sapiens
taaatttaaaaca

SEQ ID NO: 5438848 - DNA, 18 bp, Homo sapiens
taaatttaaaacacagta

SEQ ID NO: 5438849 - DNA, 15 bp, Homo sapiens
taaatttaaagatat

SEQ ID NO: 5438850 - DNA, 18 bp, Homo sapiens
taaatttaaatttaaaga

SEQ ID NO: 5438851 - DNA, 14 bp, Homo sapiens
taaatttaagaaaa

SEQ ID NO: 5438852 - DNA, 13 bp, Homo sapiens
taaatttaagcaa

SEQ ID NO: 5438853 - DNA, 13 bp, Homo sapiens
taaatttaagcat

SEQ ID NO: 5438854 - DNA, 22 bp, Homo sapiens
taaatttaagcttaagccataa

SEQ ID NO: 5438855 - DNA, 20 bp, Homo sapiens
taaatttaataaaaacttca

SEQ ID NO: 5438856 - DNA, 20 bp, Homo sapiens
taaatttaatatactgcata

SEQ ID NO: 5438857 - DNA, 14 bp, Homo sapiens
taaatttaatgctg

SEQ ID NO: 5438858 - DNA, 15 bp, Homo sapiens
taaatttaatgctgc

SEQ ID NO: 5438859 - DNA, 13 bp, Homo sapiens
taaatttacagaa

SEQ ID NO: 5438860 - DNA, 22 bp, Homo sapiens
taaatttactctgttgaatatt

SEQ ID NO: 5438861 - DNA, 17 bp, Homo sapiens
taaatttactttacaca

SEQ ID NO: 5438862 - DNA, 21 bp, Homo sapiens
taaatttaggtaaataaagct

SEQ ID NO: 5438863 - DNA, 13 bp, Homo sapiens
taaatttagtgtt

SEQ ID NO: 5438864 - DNA, 14 bp, Homo sapiens
taaatttagtgttt

SEQ ID NO: 5438865 - DNA, 15 bp, Homo sapiens
taaatttatttcaaa

SEQ ID NO: 5438866 - DNA, 17 bp, Homo sapiens
taaatttatttcaaaaa

SEQ ID NO: 5438867 - DNA, 18 bp, Homo sapiens
taaatttatttgaaaatg

SEQ ID NO: 5438868 - DNA, 17 bp, Homo sapiens
taaatttcaaatgcaga

SEQ ID NO: 5438869 - DNA, 21 bp, Homo sapiens
taaatttcactactagattga

SEQ ID NO: 5438870 - DNA, 20 bp, Homo sapiens
taaatttcagtcaattctga

SEQ ID NO: 5438871 - DNA, 18 bp, Homo sapiens
taaatttccatatccttc

SEQ ID NO: 5438872 - DNA, 18 bp, Homo sapiens
taaatttcccaattttct

SEQ ID NO: 5438873 - DNA, 20 bp, Homo sapiens
taaatttcccagttaaagat

SEQ ID NO: 5438874 - DNA, 22 bp, Homo sapiens
taaatttcccagttaaagatta

SEQ ID NO: 5438875 - DNA, 20 bp, Homo sapiens
taaatttccccaacagtgtg

SEQ ID NO: 5438876 - DNA, 23 bp, Homo sapiens
taaatttccccaacagtgtgaag

SEQ ID NO: 5438877 - DNA, 20 bp, Homo sapiens
taaatttcgcttcttagaac

SEQ ID NO: 5438878 - DNA, 12 bp, Homo sapiens
taaatttctcag

SEQ ID NO: 5438879 - DNA, 20 bp, Homo sapiens
taaatttctgccctgagccc

SEQ ID NO: 5438880 - DNA, 21 bp, Homo sapiens
taaatttctgggatatttaac

SEQ ID NO: 5438881 - DNA, 13 bp, Homo sapiens
taaatttctgtct

SEQ ID NO: 5438882 - DNA, 15 bp, Homo sapiens
taaatttcttatgtg

SEQ ID NO: 5438883 - DNA, 17 bp, Homo sapiens
taaatttcttttattaa

SEQ ID NO: 5438884 - DNA, 17 bp, Homo sapiens
taaatttgacttttctg

SEQ ID NO: 5438885 - DNA, 13 bp, Homo sapiens
taaatttgatact

SEQ ID NO: 5438886 - DNA, 21 bp, Homo sapiens
taaatttgatacttatatttt

SEQ ID NO: 5438887 - DNA, 13 bp, Homo sapiens
taaatttgattta

SEQ ID NO: 5438888 - DNA, 22 bp, Homo sapiens
taaatttgatttacatatatta

SEQ ID NO: 5438889 - DNA, 22 bp, Homo sapiens
taaatttgcatgaaagcacaag

SEQ ID NO: 5438890 - DNA, 14 bp, Homo sapiens
taaatttgccagtt

SEQ ID NO: 5438891 - DNA, 13 bp, Homo sapiens
taaatttgctagc

SEQ ID NO: 5438892 - DNA, 22 bp, Homo sapiens
taaatttggtgccgatgttgaa

SEQ ID NO: 5438893 - DNA, 21 bp, Homo sapiens
taaatttggtttgttaattct

SEQ ID NO: 5438894 - DNA, 12 bp, Homo sapiens
taaatttgtaag

SEQ ID NO: 5438895 - DNA, 18 bp, Homo sapiens
taaatttgtaagtttcag

SEQ ID NO: 5438896 - DNA, 13 bp, Homo sapiens
taaatttgtaata

SEQ ID NO: 5438897 - DNA, 19 bp, Homo sapiens
taaatttgtactatttaac

SEQ ID NO: 5438898 - DNA, 20 bp, Homo sapiens
taaatttgtataaataagca

SEQ ID NO: 5438899 - DNA, 15 bp, Homo sapiens
taaatttgtccaatg

SEQ ID NO: 5438900 - DNA, 15 bp, Homo sapiens
taaatttgtctttca

SEQ ID NO: 5438901 - DNA, 14 bp, Homo sapiens
taaatttgttcttt

SEQ ID NO: 5438902 - DNA, 11 bp, Homo sapiens
taaatttgttg

SEQ ID NO: 5438903 - DNA, 13 bp, Homo sapiens
taaatttgttgaa

SEQ ID NO: 5438904 - DNA, 18 bp, Homo sapiens
taaatttgttgtcatgtg

SEQ ID NO: 5438905 - DNA, 19 bp, Homo sapiens
taaatttgttgtcatgtgt

SEQ ID NO: 5438906 - DNA, 17 bp, Homo sapiens
taaattttaactaaatt

SEQ ID NO: 5438907 - DNA, 14 bp, Homo sapiens
taaattttaatgta

SEQ ID NO: 5438908 - DNA, 17 bp, Homo sapiens
taaattttaatgtaaaa

SEQ ID NO: 5438909 - DNA, 22 bp, Homo sapiens
taaattttaatgtaaaattcat

SEQ ID NO: 5438910 - DNA, 18 bp, Homo sapiens
taaattttaattcaagaa

SEQ ID NO: 5438911 - DNA, 19 bp, Homo sapiens
taaattttaattcaagaaa

SEQ ID NO: 5438912 - DNA, 13 bp, Homo sapiens
taaattttacatg

SEQ ID NO: 5438913 - DNA, 15 bp, Homo sapiens
taaattttagtacat

SEQ ID NO: 5438914 - DNA, 22 bp, Homo sapiens
taaattttataggactgttctt

SEQ ID NO: 5438915 - DNA, 18 bp, Homo sapiens
taaattttatatcatttt

SEQ ID NO: 5438916 - DNA, 19 bp, Homo sapiens
taaattttatatcatttta

SEQ ID NO: 5438917 - DNA, 21 bp, Homo sapiens
taaattttcaaactagattta

SEQ ID NO: 5438918 - DNA, 18 bp, Homo sapiens
taaattttcaaatcctta

SEQ ID NO: 5438919 - DNA, 13 bp, Homo sapiens
taaattttcagaa

SEQ ID NO: 5438920 - DNA, 17 bp, Homo sapiens
taaattttcatgaatgt

SEQ ID NO: 5438921 - DNA, 21 bp, Homo sapiens
taaattttcatgaatgtgctg

SEQ ID NO: 5438922 - DNA, 16 bp, Homo sapiens
taaattttccattaat

SEQ ID NO: 5438923 - DNA, 13 bp, Homo sapiens
taaattttctaaa

SEQ ID NO: 5438924 - DNA, 14 bp, Homo sapiens
taaattttctctaa

SEQ ID NO: 5438925 - DNA, 14 bp, Homo sapiens
taaattttcttcag

SEQ ID NO: 5438926 - DNA, 18 bp, Homo sapiens
taaattttctttaagtca

SEQ ID NO: 5438927 - DNA, 15 bp, Homo sapiens
taaattttcttttaa

SEQ ID NO: 5438928 - DNA, 21 bp, Homo sapiens
taaattttcttttaagcattt

SEQ ID NO: 5438929 - DNA, 16 bp, Homo sapiens
taaattttctttttct

SEQ ID NO: 5438930 - DNA, 18 bp, Homo sapiens
taaattttctttttgttt

SEQ ID NO: 5438931 - DNA, 14 bp, Homo sapiens
taaattttgaaaag

SEQ ID NO: 5438932 - DNA, 22 bp, Homo sapiens
taaattttgaaaagtaatattt

SEQ ID NO: 5438933 - DNA, 20 bp, Homo sapiens
taaattttggaagaattcat

SEQ ID NO: 5438934 - DNA, 15 bp, Homo sapiens
taaattttgtacatt

SEQ ID NO: 5438935 - DNA, 23 bp, Homo sapiens
taaattttgtgatgaataaaata

SEQ ID NO: 5438936 - DNA, 21 bp, Homo sapiens
taaattttgttttttaagttt

SEQ ID NO: 5438937 - DNA, 13 bp, Homo sapiens
taaatttttaagt

SEQ ID NO: 5438938 - DNA, 14 bp, Homo sapiens
taaatttttaagtg

SEQ ID NO: 5438939 - DNA, 17 bp, Homo sapiens
taaatttttaagtgtca

SEQ ID NO: 5438940 - DNA, 19 bp, Homo sapiens
taaatttttaggcaaagat

SEQ ID NO: 5438941 - DNA, 13 bp, Homo sapiens
taaatttttcata

SEQ ID NO: 5438942 - DNA, 17 bp, Homo sapiens
taaatttttgtaagaaa

SEQ ID NO: 5438943 - DNA, 16 bp, Homo sapiens
taaattttttaagcaa

SEQ ID NO: 5438944 - DNA, 23 bp, Homo sapiens
taaattttttacgtagctatttt

SEQ ID NO: 5438945 - DNA, 23 bp, Homo sapiens
taacactttagttatattcactg

SEQ ID NO: 5438946 - DNA, 20 bp, Homo sapiens
taacactttgtattacttag

SEQ ID NO: 5438947 - DNA, 17 bp, Homo sapiens
taacagaaactcctaat

SEQ ID NO: 5438948 - DNA, 21 bp, Homo sapiens
taacagaaagggcaacaataa

SEQ ID NO: 5438949 - DNA, 15 bp, Homo sapiens
taacagaaattgtat

SEQ ID NO: 5438950 - DNA, 16 bp, Homo sapiens
taacagaacagcttca

SEQ ID NO: 5438951 - DNA, 18 bp, Homo sapiens
taacagaacagcttcagg

SEQ ID NO: 5438952 - DNA, 21 bp, Homo sapiens
taacagaacagcttcaggtta

SEQ ID NO: 5438953 - DNA, 22 bp, Homo sapiens
taacagaacagcttcaggttat

SEQ ID NO: 5438954 - DNA, 17 bp, Homo sapiens
taacagaaccagagggt

SEQ ID NO: 5438955 - DNA, 15 bp, Homo sapiens
taacagaagaaaata

SEQ ID NO: 5438956 - DNA, 18 bp, Homo sapiens
taacagaagttgtgaaac

SEQ ID NO: 5438957 - DNA, 20 bp, Homo sapiens
taacagaagttgtgaaacta

SEQ ID NO: 5438958 - DNA, 21 bp, Homo sapiens
taacagaagttgtgaaactaa

SEQ ID NO: 5438959 - DNA, 19 bp, Homo sapiens
taacagacactgtaaaata

SEQ ID NO: 5438960 - DNA, 18 bp, Homo sapiens
taacagacattgttttgc

SEQ ID NO: 5438961 - DNA, 14 bp, Homo sapiens
taacagagtagttt

SEQ ID NO: 5438962 - DNA, 22 bp, Homo sapiens
taacagagtttgatatgggctt

SEQ ID NO: 5438963 - DNA, 18 bp, Homo sapiens
taacagataagcaagaga

SEQ ID NO: 5438964 - DNA, 12 bp, Homo sapiens
taacagatattt

SEQ ID NO: 5438965 - DNA, 17 bp, Homo sapiens
taacagatatttaaatt

SEQ ID NO: 5438966 - DNA, 16 bp, Homo sapiens
taacagatcctttcaa

SEQ ID NO: 5438967 - DNA, 15 bp, Homo sapiens
taacagatctttact

SEQ ID NO: 5438968 - DNA, 12 bp, Homo sapiens
taacagatgcaa

SEQ ID NO: 5438969 - DNA, 15 bp, Homo sapiens
taacagatgcaatgt

SEQ ID NO: 5438970 - DNA, 14 bp, Homo sapiens
taacagatgtgaaa

SEQ ID NO: 5438971 - DNA, 16 bp, Homo sapiens
taacagatgtgaaaat

SEQ ID NO: 5438972 - DNA, 17 bp, Homo sapiens
taacagattataataaa

SEQ ID NO: 5438973 - DNA, 18 bp, Homo sapiens
taacagattataataaat

SEQ ID NO: 5438974 - DNA, 22 bp, Homo sapiens
taacagattttggggttgtgtt

SEQ ID NO: 5438975 - DNA, 20 bp, Homo sapiens
taacagcaacacaaagcttt

SEQ ID NO: 5438976 - DNA, 20 bp, Homo sapiens
taacagcaggtgtgaccctg

SEQ ID NO: 5438977 - DNA, 23 bp, Homo sapiens
taacagcatccccaaaacaaagt

SEQ ID NO: 5438978 - DNA, 23 bp, Homo sapiens
taacagcattcttgtcacaataa

SEQ ID NO: 5438979 - DNA, 15 bp, Homo sapiens
taacagccaagaagc

SEQ ID NO: 5438980 - DNA, 18 bp, Homo sapiens
taacagccctcctctgca

SEQ ID NO: 5438981 - DNA, 15 bp, Homo sapiens
taacagccttttcct

SEQ ID NO: 5438982 - DNA, 17 bp, Homo sapiens
taacagcgtttattata

SEQ ID NO: 5438983 - DNA, 20 bp, Homo sapiens
taacagctacaaacttttaa

SEQ ID NO: 5438984 - DNA, 19 bp, Homo sapiens
taacagctcaaagagtaaa

SEQ ID NO: 5438985 - DNA, 18 bp, Homo sapiens
taacagctccatacttct

SEQ ID NO: 5438986 - DNA, 16 bp, Homo sapiens
taacagctccttggga

SEQ ID NO: 5438987 - DNA, 23 bp, Homo sapiens
taacagctccttgggaggaagca

SEQ ID NO: 5438988 - DNA, 15 bp, Homo sapiens
taacagctgaattat

SEQ ID NO: 5438989 - DNA, 12 bp, Homo sapiens
taacagctgagg

SEQ ID NO: 5438990 - DNA, 14 bp, Homo sapiens
taacagctgtatta

SEQ ID NO: 5438991 - DNA, 22 bp, Homo sapiens
taacagctgtattatcttaaac

SEQ ID NO: 5438992 - DNA, 13 bp, Homo sapiens
taacagctttctc

SEQ ID NO: 5438993 - DNA, 14 bp, Homo sapiens
taacaggagaaagg

SEQ ID NO: 5438994 - DNA, 17 bp, Homo sapiens
taacaggatacaggtga

SEQ ID NO: 5438995 - DNA, 15 bp, Homo sapiens
taacaggatgaaagt

SEQ ID NO: 5438996 - DNA, 15 bp, Homo sapiens
taacaggcaaacatt

SEQ ID NO: 5438997 - DNA, 17 bp, Homo sapiens
taacaggcattgcacta

SEQ ID NO: 5438998 - DNA, 20 bp, Homo sapiens
taacaggcatttgttcactg

SEQ ID NO: 5438999 - DNA, 19 bp, Homo sapiens
taacaggctcaaacaatga

SEQ ID NO: 5439000 - DNA, 23 bp, Homo sapiens
taacaggctcaatattcctgaat

SEQ ID NO: 5439001 - DNA, 14 bp, Homo sapiens
taacaggcttagtg

SEQ ID NO: 5439002 - DNA, 15 bp, Homo sapiens
taacagggaacgtga

SEQ ID NO: 5439003 - DNA, 19 bp, Homo sapiens
taacagggaaggcaggcag

SEQ ID NO: 5439004 - DNA, 15 bp, Homo sapiens
taacagggccttgct

SEQ ID NO: 5439005 - DNA, 17 bp, Homo sapiens
taacagggccttgctaa

SEQ ID NO: 5439006 - DNA, 16 bp, Homo sapiens
taacagggtcaactgg

SEQ ID NO: 5439007 - DNA, 23 bp, Homo sapiens
taacagggtctctagtgctgtga

SEQ ID NO: 5439008 - DNA, 14 bp, Homo sapiens
taacaggtattttc

SEQ ID NO: 5439009 - DNA, 15 bp, Homo sapiens
taacaggtattttca

SEQ ID NO: 5439010 - DNA, 22 bp, Homo sapiens
taacaggtctagaaaaccagct

SEQ ID NO: 5439011 - DNA, 24 bp, Homo sapiens
taacaggtgtggggacacagcagt

SEQ ID NO: 5439012 - DNA, 22 bp, Homo sapiens
taacaggttattttagtttctg

SEQ ID NO: 5439013 - DNA, 15 bp, Homo sapiens
taacaggttttcttc

SEQ ID NO: 5439014 - DNA, 13 bp, Homo sapiens
taacagtaaaaat

SEQ ID NO: 5439015 - DNA, 14 bp, Homo sapiens
taacagtaactgcc

SEQ ID NO: 5439016 - DNA, 16 bp, Homo sapiens
taacagtaactgccat

SEQ ID NO: 5439017 - DNA, 22 bp, Homo sapiens
taacagtaactgccattttttg

SEQ ID NO: 5439018 - DNA, 16 bp, Homo sapiens
taacagtattaaatga

SEQ ID NO: 5439019 - DNA, 18 bp, Homo sapiens
taacagtattaaatgact

SEQ ID NO: 5439020 - DNA, 14 bp, Homo sapiens
taacagtatttcca

SEQ ID NO: 5439021 - DNA, 16 bp, Homo sapiens
taacagtatttccata

SEQ ID NO: 5439022 - DNA, 23 bp, Homo sapiens
taacagtatttctcttttattct

SEQ ID NO: 5439023 - DNA, 15 bp, Homo sapiens
taacagtattttaag

SEQ ID NO: 5439024 - DNA, 16 bp, Homo sapiens
taacagtcatcattta

SEQ ID NO: 5439025 - DNA, 16 bp, Homo sapiens
taacagtctagtgcaa

SEQ ID NO: 5439026 - DNA, 18 bp, Homo sapiens
taacagtgccattgtctt

SEQ ID NO: 5439027 - DNA, 18 bp, Homo sapiens
taacagtggctgcttctc

SEQ ID NO: 5439028 - DNA, 16 bp, Homo sapiens
taacagttagccactg

SEQ ID NO: 5439029 - DNA, 19 bp, Homo sapiens
taacagttagccactgctg

SEQ ID NO: 5439030 - DNA, 16 bp, Homo sapiens
taacagttataaagaa

SEQ ID NO: 5439031 - DNA, 18 bp, Homo sapiens
taacagttatatcaagct

SEQ ID NO: 5439032 - DNA, 18 bp, Homo sapiens
taacagttcatgtttgct

SEQ ID NO: 5439033 - DNA, 17 bp, Homo sapiens
taacagttcctttcaaa

SEQ ID NO: 5439034 - DNA, 18 bp, Homo sapiens
taacagttgaagaaaaaa

SEQ ID NO: 5439035 - DNA, 20 bp, Homo sapiens
taacagttggtgattttaga

SEQ ID NO: 5439036 - DNA, 23 bp, Homo sapiens
taacagttgtatttaacagaaat

SEQ ID NO: 5439037 - DNA, 20 bp, Homo sapiens
taacagtttgcctgctgtat

SEQ ID NO: 5439038 - DNA, 21 bp, Homo sapiens
taacagtttgcctgctgtatt

SEQ ID NO: 5439039 - DNA, 17 bp, Homo sapiens
taacagttttccatgaa

SEQ ID NO: 5439040 - DNA, 21 bp, Homo sapiens
taacagttttccatgaaaacg

SEQ ID NO: 5439041 - DNA, 21 bp, Homo sapiens
taacagttttgagtaattcaa

SEQ ID NO: 5439042 - DNA, 19 bp, Homo sapiens
taacagttttgtgtaactc

SEQ ID NO: 5439043 - DNA, 15 bp, Homo sapiens
taacataaaatctgt

SEQ ID NO: 5439044 - DNA, 16 bp, Homo sapiens
taacataaaatctgtg

SEQ ID NO: 5439045 - DNA, 21 bp, Homo sapiens
taacataaaatctgtgaatta

SEQ ID NO: 5439046 - DNA, 19 bp, Homo sapiens
taacataaagaaacacttt

SEQ ID NO: 5439047 - DNA, 15 bp, Homo sapiens
taacataaagaataa

SEQ ID NO: 5439048 - DNA, 18 bp, Homo sapiens
taacataaataaaaattc

SEQ ID NO: 5439049 - DNA, 15 bp, Homo sapiens
taacataaatctgtg

SEQ ID NO: 5439050 - DNA, 18 bp, Homo sapiens
taacataaatctgtgaac

SEQ ID NO: 5439051 - DNA, 16 bp, Homo sapiens
taacataactgcttct

SEQ ID NO: 5439052 - DNA, 19 bp, Homo sapiens
taacataactgcttcttgg

SEQ ID NO: 5439053 - DNA, 22 bp, Homo sapiens
taacataactgcttcttggagc

SEQ ID NO: 5439054 - DNA, 21 bp, Homo sapiens
taacataagctagaaaaatta

SEQ ID NO: 5439055 - DNA, 14 bp, Homo sapiens
taacataagctatt

SEQ ID NO: 5439056 - DNA, 20 bp, Homo sapiens
taacataatggttgtgaaat

SEQ ID NO: 5439057 - DNA, 23 bp, Homo sapiens
taacataatggttgtgaaatgta

SEQ ID NO: 5439058 - DNA, 20 bp, Homo sapiens
taacatacaagaaaatgtat

SEQ ID NO: 5439059 - DNA, 14 bp, Homo sapiens
taacatacaatgac

SEQ ID NO: 5439060 - DNA, 23 bp, Homo sapiens
taacatacccgcctagctgctgt

SEQ ID NO: 5439061 - DNA, 16 bp, Homo sapiens
taacatagatgcctgg

SEQ ID NO: 5439062 - DNA, 17 bp, Homo sapiens
taacatagatgcctggg

SEQ ID NO: 5439063 - DNA, 17 bp, Homo sapiens
taacatagcacagtatt

SEQ ID NO: 5439064 - DNA, 18 bp, Homo sapiens
taacataggcaagaggag

SEQ ID NO: 5439065 - DNA, 13 bp, Homo sapiens
taacataggtttt

SEQ ID NO: 5439066 - DNA, 19 bp, Homo sapiens
taacataggttttgattta

SEQ ID NO: 5439067 - DNA, 16 bp, Homo sapiens
taacatataaattaat

SEQ ID NO: 5439068 - DNA, 23 bp, Homo sapiens
taacatataatgttgttatttaa

SEQ ID NO: 5439069 - DNA, 20 bp, Homo sapiens
taacatatcattcagaatgt

SEQ ID NO: 5439070 - DNA, 15 bp, Homo sapiens
taacatatctaaagt

SEQ ID NO: 5439071 - DNA, 16 bp, Homo sapiens
taacatatctaaagtc

SEQ ID NO: 5439072 - DNA, 17 bp, Homo sapiens
taacatatctaaagtca

SEQ ID NO: 5439073 - DNA, 23 bp, Homo sapiens
taacatattcaatgcaagtaaga

SEQ ID NO: 5439074 - DNA, 14 bp, Homo sapiens
taacatattctaaa

SEQ ID NO: 5439075 - DNA, 19 bp, Homo sapiens
taacatattcttgctttca

SEQ ID NO: 5439076 - DNA, 14 bp, Homo sapiens
taacatatttacta

SEQ ID NO: 5439077 - DNA, 23 bp, Homo sapiens
taacatatttcttgagtaattta

SEQ ID NO: 5439078 - DNA, 15 bp, Homo sapiens
taacatattttttct

SEQ ID NO: 5439079 - DNA, 14 bp, Homo sapiens
taacatcaaacacg

SEQ ID NO: 5439080 - DNA, 14 bp, Homo sapiens
taacatcaaagatt

SEQ ID NO: 5439081 - DNA, 21 bp, Homo sapiens
taacatcactacaaaaagaag

SEQ ID NO: 5439082 - DNA, 17 bp, Homo sapiens
taacatcagccattttt

SEQ ID NO: 5439083 - DNA, 22 bp, Homo sapiens
taacatcagtgtctgtttcaga

SEQ ID NO: 5439084 - DNA, 14 bp, Homo sapiens
taacatcataatta

SEQ ID NO: 5439085 - DNA, 13 bp, Homo sapiens
taacatcattgca

SEQ ID NO: 5439086 - DNA, 13 bp, Homo sapiens
taacatccaagcc

SEQ ID NO: 5439087 - DNA, 15 bp, Homo sapiens
taacatccaagccag

SEQ ID NO: 5439088 - DNA, 18 bp, Homo sapiens
taacatccaagccagagt

SEQ ID NO: 5439089 - DNA, 23 bp, Homo sapiens
taacatccagctctatgtgggaa

SEQ ID NO: 5439090 - DNA, 15 bp, Homo sapiens
taacatcgcacagtt

SEQ ID NO: 5439091 - DNA, 16 bp, Homo sapiens
taacatcgtgggtcac

SEQ ID NO: 5439092 - DNA, 14 bp, Homo sapiens
taacatctaaaaat

SEQ ID NO: 5439093 - DNA, 15 bp, Homo sapiens
taacatctgaaaaga

SEQ ID NO: 5439094 - DNA, 17 bp, Homo sapiens
taacatctgaaaagaaa

SEQ ID NO: 5439095 - DNA, 19 bp, Homo sapiens
taacatctgggtctactca

SEQ ID NO: 5439096 - DNA, 16 bp, Homo sapiens
taacatcttctttcct

SEQ ID NO: 5439097 - DNA, 20 bp, Homo sapiens
taacatctttacgtactgta

SEQ ID NO: 5439098 - DNA, 20 bp, Homo sapiens
taacatctttcttttttcct

SEQ ID NO: 5439099 - DNA, 19 bp, Homo sapiens
taacatctttgaaaagaaa

SEQ ID NO: 5439100 - DNA, 12 bp, Homo sapiens
taacatctttgt

SEQ ID NO: 5439101 - DNA, 15 bp, Homo sapiens
taacatgaaatatat

SEQ ID NO: 5439102 - DNA, 14 bp, Homo sapiens
taacatgaaatgat

SEQ ID NO: 5439103 - DNA, 15 bp, Homo sapiens
taacatgaaatgata

SEQ ID NO: 5439104 - DNA, 18 bp, Homo sapiens
taacatgaaatgatagat

SEQ ID NO: 5439105 - DNA, 19 bp, Homo sapiens
taacatgaaatgatagatt

SEQ ID NO: 5439106 - DNA, 20 bp, Homo sapiens
taacatgaagcaaactaact

SEQ ID NO: 5439107 - DNA, 19 bp, Homo sapiens
taacatgaggggacatttt

SEQ ID NO: 5439108 - DNA, 19 bp, Homo sapiens
taacatgatactattcaga

SEQ ID NO: 5439109 - DNA, 14 bp, Homo sapiens
taacatgatttcaa

SEQ ID NO: 5439110 - DNA, 15 bp, Homo sapiens
taacatgatttcaaa

SEQ ID NO: 5439111 - DNA, 20 bp, Homo sapiens
taacatgatttccctccaga

SEQ ID NO: 5439112 - DNA, 15 bp, Homo sapiens
taacatgcaataaca

SEQ ID NO: 5439113 - DNA, 14 bp, Homo sapiens
taacatgcatactt

SEQ ID NO: 5439114 - DNA, 18 bp, Homo sapiens
taacatgcatactttatt

SEQ ID NO: 5439115 - DNA, 17 bp, Homo sapiens
taacatgccagcttcct

SEQ ID NO: 5439116 - DNA, 13 bp, Homo sapiens
taacatgctgtgt

SEQ ID NO: 5439117 - DNA, 14 bp, Homo sapiens
taacatgctgtgta

SEQ ID NO: 5439118 - DNA, 18 bp, Homo sapiens
taacatgctgtgtaagct

SEQ ID NO: 5439119 - DNA, 15 bp, Homo sapiens
taacatggaagtact

SEQ ID NO: 5439120 - DNA, 16 bp, Homo sapiens
taacatggaatttaat

SEQ ID NO: 5439121 - DNA, 18 bp, Homo sapiens
taacatggacatgatctt

SEQ ID NO: 5439122 - DNA, 22 bp, Homo sapiens
taactgtcaggctgaaaacaat

SEQ ID NO: 5439123 - DNA, 20 bp, Homo sapiens
taactgtcatctagcccctt

SEQ ID NO: 5439124 - DNA, 15 bp, Homo sapiens
taactgtcccagcga

SEQ ID NO: 5439125 - DNA, 11 bp, Homo sapiens
taactgtcctg

SEQ ID NO: 5439126 - DNA, 23 bp, Homo sapiens
taactgtcctttttcttccctta

SEQ ID NO: 5439127 - DNA, 15 bp, Homo sapiens
taactgtcttctgga

SEQ ID NO: 5439128 - DNA, 14 bp, Homo sapiens
taactgtgaaatac

SEQ ID NO: 5439129 - DNA, 16 bp, Homo sapiens
taactgtgaaatacca

SEQ ID NO: 5439130 - DNA, 11 bp, Homo sapiens
taactgtgaac

SEQ ID NO: 5439131 - DNA, 17 bp, Homo sapiens
taactgtgaataataaa

SEQ ID NO: 5439132 - DNA, 14 bp, Homo sapiens
taactgtgatgaaa

SEQ ID NO: 5439133 - DNA, 21 bp, Homo sapiens
taactgtgcttgttgaatgtc

SEQ ID NO: 5439134 - DNA, 20 bp, Homo sapiens
taactgtgtatgtacatata

SEQ ID NO: 5439135 - DNA, 22 bp, Homo sapiens
taactgtgtatgtacatatata

SEQ ID NO: 5439136 - DNA, 20 bp, Homo sapiens
taactgtgtgaagaaatgga

SEQ ID NO: 5439137 - DNA, 15 bp, Homo sapiens
taactgttaacccag

SEQ ID NO: 5439138 - DNA, 22 bp, Homo sapiens
taactgttaactatgacagata

SEQ ID NO: 5439139 - DNA, 17 bp, Homo sapiens
taactgttacagtaatg

SEQ ID NO: 5439140 - DNA, 20 bp, Homo sapiens
taactgttacagtaatgtca

SEQ ID NO: 5439141 - DNA, 21 bp, Homo sapiens
taactgttacagtaatgtcat

SEQ ID NO: 5439142 - DNA, 11 bp, Homo sapiens
taactgttacc

SEQ ID NO: 5439143 - DNA, 19 bp, Homo sapiens
taactgttagtattaacta

SEQ ID NO: 5439144 - DNA, 14 bp, Homo sapiens
taactgttcagtat

SEQ ID NO: 5439145 - DNA, 20 bp, Homo sapiens
taactgttctttgcagtgaa

SEQ ID NO: 5439146 - DNA, 17 bp, Homo sapiens
taactgttgttgataag

SEQ ID NO: 5439147 - DNA, 22 bp, Homo sapiens
taactgtttacatatctgtccc

SEQ ID NO: 5439148 - DNA, 22 bp, Homo sapiens
taactgtttatatgtgttgaaa

SEQ ID NO: 5439149 - DNA, 16 bp, Homo sapiens
taactgttttagaaat

SEQ ID NO: 5439150 - DNA, 22 bp, Homo sapiens
taacttaaaaaactgcatccca

SEQ ID NO: 5439151 - DNA, 21 bp, Homo sapiens
taacttaaaaatgtaaatatt

SEQ ID NO: 5439152 - DNA, 15 bp, Homo sapiens
taacttaaaagaaca

SEQ ID NO: 5439153 - DNA, 18 bp, Homo sapiens
taacttaaaagaacatag

SEQ ID NO: 5439154 - DNA, 22 bp, Homo sapiens
taacttaaaagaacatgtatat

SEQ ID NO: 5439155 - DNA, 14 bp, Homo sapiens
taacttaaatattg

SEQ ID NO: 5439156 - DNA, 16 bp, Homo sapiens
taacttaaatatttga

SEQ ID NO: 5439157 - DNA, 21 bp, Homo sapiens
taacttaaatatttgaaaatt

SEQ ID NO: 5439158 - DNA, 22 bp, Homo sapiens
taacttaacaattaattttcta

SEQ ID NO: 5439159 - DNA, 14 bp, Homo sapiens
taacttaactgaaa

SEQ ID NO: 5439160 - DNA, 14 bp, Homo sapiens
taacttaataatca

SEQ ID NO: 5439161 - DNA, 17 bp, Homo sapiens
taacttaataatcaaga

SEQ ID NO: 5439162 - DNA, 16 bp, Homo sapiens
taacttaatagtattt

SEQ ID NO: 5439163 - DNA, 14 bp, Homo sapiens
taacttaatcaatt

SEQ ID NO: 5439164 - DNA, 15 bp, Homo sapiens
taacttaatcaatta

SEQ ID NO: 5439165 - DNA, 16 bp, Homo sapiens
taacttaatgaaaaca

SEQ ID NO: 5439166 - DNA, 13 bp, Homo sapiens
taacttaattata

SEQ ID NO: 5439167 - DNA, 15 bp, Homo sapiens
taacttaattgctat

SEQ ID NO: 5439168 - DNA, 20 bp, Homo sapiens
taacttacaaactggtttga

SEQ ID NO: 5439169 - DNA, 19 bp, Homo sapiens
taacttacaagactgtaaa

SEQ ID NO: 5439170 - DNA, 20 bp, Homo sapiens
taacttacaagactgtaaat

SEQ ID NO: 5439171 - DNA, 17 bp, Homo sapiens
taacttacatgactttc

SEQ ID NO: 5439172 - DNA, 17 bp, Homo sapiens
taacttacatttgtact

SEQ ID NO: 5439173 - DNA, 19 bp, Homo sapiens
taacttacatttgtacttt

SEQ ID NO: 5439174 - DNA, 18 bp, Homo sapiens
taacttacccttagggag

SEQ ID NO: 5439175 - DNA, 16 bp, Homo sapiens
taacttactatttaga

SEQ ID NO: 5439176 - DNA, 17 bp, Homo sapiens
taacttactgtatatgt

SEQ ID NO: 5439177 - DNA, 15 bp, Homo sapiens
taacttactgtccac

SEQ ID NO: 5439178 - DNA, 11 bp, Homo sapiens
taacttagaaa

SEQ ID NO: 5439179 - DNA, 17 bp, Homo sapiens
taacttagagctttttt

SEQ ID NO: 5439180 - DNA, 17 bp, Homo sapiens
taacttagctttatttt

SEQ ID NO: 5439181 - DNA, 14 bp, Homo sapiens
taacttatattgaa

SEQ ID NO: 5439182 - DNA, 15 bp, Homo sapiens
taacttatgtagata

SEQ ID NO: 5439183 - DNA, 17 bp, Homo sapiens
taacttatgtagatatt

SEQ ID NO: 5439184 - DNA, 21 bp, Homo sapiens
taacttatgtagatatttggc

SEQ ID NO: 5439185 - DNA, 15 bp, Homo sapiens
taacttatgtatgtg

SEQ ID NO: 5439186 - DNA, 15 bp, Homo sapiens
taacttattcaaaga

SEQ ID NO: 5439187 - DNA, 21 bp, Homo sapiens
taacttattccaagtgcattt

SEQ ID NO: 5439188 - DNA, 21 bp, Homo sapiens
taacttattgcctgggcagtg

SEQ ID NO: 5439189 - DNA, 14 bp, Homo sapiens
taacttattgctag

SEQ ID NO: 5439190 - DNA, 21 bp, Homo sapiens
taacttatttatgttaaaaga

SEQ ID NO: 5439191 - DNA, 13 bp, Homo sapiens
taacttattttga

SEQ ID NO: 5439192 - DNA, 17 bp, Homo sapiens
taacttattttgattgt

SEQ ID NO: 5439193 - DNA, 21 bp, Homo sapiens
taacttattttgattgtttga

SEQ ID NO: 5439194 - DNA, 13 bp, Homo sapiens
taacttattttgt

SEQ ID NO: 5439195 - DNA, 13 bp, Homo sapiens
taacttcacatat

SEQ ID NO: 5439196 - DNA, 21 bp, Homo sapiens
taacttcacatattgatttcc

SEQ ID NO: 5439197 - DNA, 16 bp, Homo sapiens
taacttcagagaagtc

SEQ ID NO: 5439198 - DNA, 18 bp, Homo sapiens
taacttcagagaagtcag

SEQ ID NO: 5439199 - DNA, 20 bp, Homo sapiens
taacttcagagaagtcagtt

SEQ ID NO: 5439200 - DNA, 16 bp, Homo sapiens
taacttcagatgtttc

SEQ ID NO: 5439201 - DNA, 17 bp, Homo sapiens
taacttcagatgtttcc

SEQ ID NO: 5439202 - DNA, 18 bp, Homo sapiens
taacttcagatgtttcca

SEQ ID NO: 5439203 - DNA, 22 bp, Homo sapiens
taacttcagtaggatttatgta

SEQ ID NO: 5439204 - DNA, 13 bp, Homo sapiens
taacttcagtcct

SEQ ID NO: 5439205 - DNA, 22 bp, Homo sapiens
taacttcagtgcaagagacttt

SEQ ID NO: 5439206 - DNA, 14 bp, Homo sapiens
taacttcatagaaa

SEQ ID NO: 5439207 - DNA, 14 bp, Homo sapiens
taacttcatttttc

SEQ ID NO: 5439208 - DNA, 20 bp, Homo sapiens
taacttccactgttaaaata

SEQ ID NO: 5439209 - DNA, 20 bp, Homo sapiens
taacttccctgaaaaatcta

SEQ ID NO: 5439210 - DNA, 11 bp, Homo sapiens
taacttcctgc

SEQ ID NO: 5439211 - DNA, 12 bp, Homo sapiens
taacttcctgct

SEQ ID NO: 5439212 - DNA, 14 bp, Homo sapiens
taacttcctgctgc

SEQ ID NO: 5439213 - DNA, 18 bp, Homo sapiens
taacttcctgctgcaccc

SEQ ID NO: 5439214 - DNA, 14 bp, Homo sapiens
taacttcctgtact

SEQ ID NO: 5439215 - DNA, 19 bp, Homo sapiens
taacttccttcacatctcc

SEQ ID NO: 5439216 - DNA, 20 bp, Homo sapiens
taacttccttgcccctgctc

SEQ ID NO: 5439217 - DNA, 15 bp, Homo sapiens
taacttctaaaactg

SEQ ID NO: 5439218 - DNA, 18 bp, Homo sapiens
taacttctagttgctctt

SEQ ID NO: 5439219 - DNA, 16 bp, Homo sapiens
taacttctcatgtata

SEQ ID NO: 5439220 - DNA, 15 bp, Homo sapiens
taacttctgaagtaa

SEQ ID NO: 5439221 - DNA, 13 bp, Homo sapiens
taacttctgttac

SEQ ID NO: 5439222 - DNA, 16 bp, Homo sapiens
taacttctgttttacc

SEQ ID NO: 5439223 - DNA, 17 bp, Homo sapiens
taacttcttaaaccatt

SEQ ID NO: 5439224 - DNA, 17 bp, Homo sapiens
taacttcttatggaatt

SEQ ID NO: 5439225 - DNA, 13 bp, Homo sapiens
taacttcttcata

SEQ ID NO: 5439226 - DNA, 13 bp, Homo sapiens
taacttcttcctg

SEQ ID NO: 5439227 - DNA, 17 bp, Homo sapiens
taacttcttcctgctgg

SEQ ID NO: 5439228 - DNA, 18 bp, Homo sapiens
taacttcttcctgctgga

SEQ ID NO: 5439229 - DNA, 15 bp, Homo sapiens
taacttcttgaaaaa

SEQ ID NO: 5439230 - DNA, 13 bp, Homo sapiens
taacttcttgctt

SEQ ID NO: 5439231 - DNA, 23 bp, Homo sapiens
taacttctttctatttgacttgt

SEQ ID NO: 5439232 - DNA, 12 bp, Homo sapiens
taacttgaaaag

SEQ ID NO: 5439233 - DNA, 20 bp, Homo sapiens
taacttgaaaagattgcaaa

SEQ ID NO: 5439234 - DNA, 16 bp, Homo sapiens
taacttgaaaattttt

SEQ ID NO: 5439235 - DNA, 20 bp, Homo sapiens
taacttgaagaaaccgattt

SEQ ID NO: 5439236 - DNA, 14 bp, Homo sapiens
taacttgaagagcc

SEQ ID NO: 5439237 - DNA, 18 bp, Homo sapiens
taacttgcaagttttcag

SEQ ID NO: 5439238 - DNA, 13 bp, Homo sapiens
taacttgccattt

SEQ ID NO: 5439239 - DNA, 19 bp, Homo sapiens
taacttgccatttctttat

SEQ ID NO: 5439240 - DNA, 21 bp, Homo sapiens
taacttgccatttctttatat

SEQ ID NO: 5439241 - DNA, 13 bp, Homo sapiens
taacttgctgtga

SEQ ID NO: 5439242 - DNA, 14 bp, Homo sapiens
taacttgctgtgaa

SEQ ID NO: 5439243 - DNA, 19 bp, Homo sapiens
taacttgctgtgaaatgac

SEQ ID NO: 5439244 - DNA, 20 bp, Homo sapiens
taacttgctgtgaaatgact

SEQ ID NO: 5439245 - DNA, 14 bp, Homo sapiens
taacttgcttaaat

SEQ ID NO: 5439246 - DNA, 16 bp, Homo sapiens
taacttgcttaaatgt

SEQ ID NO: 5439247 - DNA, 17 bp, Homo sapiens
taacttgcttaaatgtg

SEQ ID NO: 5439248 - DNA, 20 bp, Homo sapiens
taacttgcttaaatgtgaat

SEQ ID NO: 5439249 - DNA, 20 bp, Homo sapiens
taacttgcttaaatttctta

SEQ ID NO: 5439250 - DNA, 13 bp, Homo sapiens
taacttgctttct

SEQ ID NO: 5439251 - DNA, 21 bp, Homo sapiens
taacttgctttcttctttcct

SEQ ID NO: 5439252 - DNA, 17 bp, Homo sapiens
taacttggatgagtttt

SEQ ID NO: 5439253 - DNA, 23 bp, Homo sapiens
taacttggatgagttttgggaag

SEQ ID NO: 5439254 - DNA, 16 bp, Homo sapiens
taacttgggctgtaaa

SEQ ID NO: 5439255 - DNA, 21 bp, Homo sapiens
taacttgtattttgtcacttt

SEQ ID NO: 5439256 - DNA, 16 bp, Homo sapiens
taacttgtctaaataa

SEQ ID NO: 5439257 - DNA, 17 bp, Homo sapiens
taacttgtcttaaataa

SEQ ID NO: 5439258 - DNA, 21 bp, Homo sapiens
taacttgtgtattagatatca

SEQ ID NO: 5439259 - DNA, 21 bp, Homo sapiens
taacttgttaccattgtaata

SEQ ID NO: 5439260 - DNA, 17 bp, Homo sapiens
taacttgtttccaatgt

SEQ ID NO: 5439261 - DNA, 14 bp, Homo sapiens
taacttgtttgagg

SEQ ID NO: 5439262 - DNA, 14 bp, Homo sapiens
taacttgtttgtaa

SEQ ID NO: 5439263 - DNA, 15 bp, Homo sapiens
taacttgtttgtaaa

SEQ ID NO: 5439264 - DNA, 19 bp, Homo sapiens
taacttgtttttattgcat

SEQ ID NO: 5439265 - DNA, 15 bp, Homo sapiens
taactttaaacatct

SEQ ID NO: 5439266 - DNA, 15 bp, Homo sapiens
taactttaaatcttt

SEQ ID NO: 5439267 - DNA, 21 bp, Homo sapiens
taactttaaatcttttcttca

SEQ ID NO: 5439268 - DNA, 22 bp, Homo sapiens
taactttaaatcttttcttcaa

SEQ ID NO: 5439269 - DNA, 18 bp, Homo sapiens
taactttaaggatttgaa

SEQ ID NO: 5439270 - DNA, 22 bp, Homo sapiens
taactttaattctctttcaaag

SEQ ID NO: 5439271 - DNA, 14 bp, Homo sapiens
taactttacagaaa

SEQ ID NO: 5439272 - DNA, 21 bp, Homo sapiens
taactttactctgtgtttaaa

SEQ ID NO: 5439273 - DNA, 22 bp, Homo sapiens
taactttagaagtgcatttctg

SEQ ID NO: 5439274 - DNA, 19 bp, Homo sapiens
taactttataaataaacat

SEQ ID NO: 5439275 - DNA, 15 bp, Homo sapiens
taactttatgtgtaa

SEQ ID NO: 5439276 - DNA, 16 bp, Homo sapiens
taactttatgtgtaaa

SEQ ID NO: 5439277 - DNA, 21 bp, Homo sapiens
taactttattacaatttgtat

SEQ ID NO: 5439278 - DNA, 20 bp, Homo sapiens
taactttattcttgaaagaa

SEQ ID NO: 5439279 - DNA, 20 bp, Homo sapiens
taactttattctttgttctt

SEQ ID NO: 5439280 - DNA, 19 bp, Homo sapiens
taactttattgcatataga

SEQ ID NO: 5439281 - DNA, 16 bp, Homo sapiens
taactttattggtctt

SEQ ID NO: 5439282 - DNA, 17 bp, Homo sapiens
taactttcataccactt

SEQ ID NO: 5439283 - DNA, 15 bp, Homo sapiens
taactttctctatga

SEQ ID NO: 5439284 - DNA, 18 bp, Homo sapiens
taactttctctgtgaaag

SEQ ID NO: 5439285 - DNA, 12 bp, Homo sapiens
taactttctgaa

SEQ ID NO: 5439286 - DNA, 16 bp, Homo sapiens
taactttctgaaataa

SEQ ID NO: 5439287 - DNA, 16 bp, Homo sapiens
taactttcttaccatt

SEQ ID NO: 5439288 - DNA, 14 bp, Homo sapiens
taactttgcatgtt

SEQ ID NO: 5439289 - DNA, 15 bp, Homo sapiens
taactttgcatgttc

SEQ ID NO: 5439290 - DNA, 24 bp, Homo sapiens
taactttgcccttcactgttgctt

SEQ ID NO: 5439291 - DNA, 21 bp, Homo sapiens
taactttgcttgattaaacag

SEQ ID NO: 5439292 - DNA, 22 bp, Homo sapiens
taactttgcttgcagtagattt

SEQ ID NO: 5439293 - DNA, 22 bp, Homo sapiens
taactttgctttcatgaccatc

SEQ ID NO: 5439294 - DNA, 16 bp, Homo sapiens
taactttgggcccaga

SEQ ID NO: 5439295 - DNA, 15 bp, Homo sapiens
taactttgggttaaa

SEQ ID NO: 5439296 - DNA, 18 bp, Homo sapiens
taactttggttaaaatct

SEQ ID NO: 5439297 - DNA, 21 bp, Homo sapiens
taactttgtctcgttcctgtt

SEQ ID NO: 5439298 - DNA, 23 bp, Homo sapiens
taactttgtggtaacttctttga

SEQ ID NO: 5439299 - DNA, 24 bp, Homo sapiens
taactttgtggtaacttctttgaa

SEQ ID NO: 5439300 - DNA, 16 bp, Homo sapiens
taagagtggaggagga

SEQ ID NO: 5439301 - DNA, 19 bp, Homo sapiens
taagagtgtagaagcattc

SEQ ID NO: 5439302 - DNA, 19 bp, Homo sapiens
taagagtgtcactgagctg

SEQ ID NO: 5439303 - DNA, 14 bp, Homo sapiens
taagagtttacaag

SEQ ID NO: 5439304 - DNA, 21 bp, Homo sapiens
taagagtttctaaaacagaca

SEQ ID NO: 5439305 - DNA, 14 bp, Homo sapiens
taagataaaataaa

SEQ ID NO: 5439306 - DNA, 16 bp, Homo sapiens
taagataaaataaaat

SEQ ID NO: 5439307 - DNA, 14 bp, Homo sapiens
taagataaatgaaa

SEQ ID NO: 5439308 - DNA, 15 bp, Homo sapiens
taagataaatgaaat

SEQ ID NO: 5439309 - DNA, 15 bp, Homo sapiens
taagataatatttaa

SEQ ID NO: 5439310 - DNA, 21 bp, Homo sapiens
taagataatggataatcttcg

SEQ ID NO: 5439311 - DNA, 20 bp, Homo sapiens
taagataattaaatgaaata

SEQ ID NO: 5439312 - DNA, 22 bp, Homo sapiens
taagataattaaatgaaatact

SEQ ID NO: 5439313 - DNA, 17 bp, Homo sapiens
taagataattgtacttt

SEQ ID NO: 5439314 - DNA, 13 bp, Homo sapiens
taagatacaaata

SEQ ID NO: 5439315 - DNA, 15 bp, Homo sapiens
taagatacaaatggt

SEQ ID NO: 5439316 - DNA, 15 bp, Homo sapiens
taagatacaataaaa

SEQ ID NO: 5439317 - DNA, 19 bp, Homo sapiens
taagatacactcctgctgt

SEQ ID NO: 5439318 - DNA, 22 bp, Homo sapiens
taagatacactgcactttgttt

SEQ ID NO: 5439319 - DNA, 18 bp, Homo sapiens
taagatacatatactgat

SEQ ID NO: 5439320 - DNA, 18 bp, Homo sapiens
taagatactcaagcaggt

SEQ ID NO: 5439321 - DNA, 20 bp, Homo sapiens
taagatactcaagcaggttt

SEQ ID NO: 5439322 - DNA, 23 bp, Homo sapiens
taagatactgctgatgctgaaat

SEQ ID NO: 5439323 - DNA, 22 bp, Homo sapiens
taagatacttagattagaccta

SEQ ID NO: 5439324 - DNA, 14 bp, Homo sapiens
taagatagaaagct

SEQ ID NO: 5439325 - DNA, 17 bp, Homo sapiens
taagatagacttattct

SEQ ID NO: 5439326 - DNA, 19 bp, Homo sapiens
taagatagacttattcttt

SEQ ID NO: 5439327 - DNA, 16 bp, Homo sapiens
taagatagtgtaactt

SEQ ID NO: 5439328 - DNA, 17 bp, Homo sapiens
taagatagttacattta

SEQ ID NO: 5439329 - DNA, 18 bp, Homo sapiens
taagatagttacatttat

SEQ ID NO: 5439330 - DNA, 23 bp, Homo sapiens
taagatataatttaaacgtgatt

SEQ ID NO: 5439331 - DNA, 23 bp, Homo sapiens
taagatatacttgtttttgtaaa

SEQ ID NO: 5439332 - DNA, 15 bp, Homo sapiens
taagatatatacatg

SEQ ID NO: 5439333 - DNA, 21 bp, Homo sapiens
taagatatatttgtcattttc

SEQ ID NO: 5439334 - DNA, 20 bp, Homo sapiens
taagatatccatctttttct

SEQ ID NO: 5439335 - DNA, 21 bp, Homo sapiens
taagatatccatctttttctt

SEQ ID NO: 5439336 - DNA, 20 bp, Homo sapiens
taagatatcccagctttaaa

SEQ ID NO: 5439337 - DNA, 23 bp, Homo sapiens
taagatatccctaatgttttgct

SEQ ID NO: 5439338 - DNA, 21 bp, Homo sapiens
taagatatgggacatttttga

SEQ ID NO: 5439339 - DNA, 14 bp, Homo sapiens
taagatatgtaaca

SEQ ID NO: 5439340 - DNA, 18 bp, Homo sapiens
taagatatgtgagaactt

SEQ ID NO: 5439341 - DNA, 15 bp, Homo sapiens
taagatcacacaaat

SEQ ID NO: 5439342 - DNA, 17 bp, Homo sapiens
taagatcactgtttaga

SEQ ID NO: 5439343 - DNA, 18 bp, Homo sapiens
taagatcactgtttagat

SEQ ID NO: 5439344 - DNA, 21 bp, Homo sapiens
taagatcactgtttagatttg

SEQ ID NO: 5439345 - DNA, 15 bp, Homo sapiens
taagatcataacaat

SEQ ID NO: 5439346 - DNA, 17 bp, Homo sapiens
taagatcccagtgtgaa

SEQ ID NO: 5439347 - DNA, 23 bp, Homo sapiens
taagatcctagatcctaagggtc

SEQ ID NO: 5439348 - DNA, 13 bp, Homo sapiens
taagatctgactg

SEQ ID NO: 5439349 - DNA, 16 bp, Homo sapiens
taagatctgtgtttta

SEQ ID NO: 5439350 - DNA, 14 bp, Homo sapiens
taagatcttagatt

SEQ ID NO: 5439351 - DNA, 17 bp, Homo sapiens
taagatcttagattctc

SEQ ID NO: 5439352 - DNA, 14 bp, Homo sapiens
taagatgaaacatc

SEQ ID NO: 5439353 - DNA, 19 bp, Homo sapiens
taagatgaaatgcactgta

SEQ ID NO: 5439354 - DNA, 12 bp, Homo sapiens
taagatgaaatt

SEQ ID NO: 5439355 - DNA, 16 bp, Homo sapiens
taagatgacattgcta

SEQ ID NO: 5439356 - DNA, 14 bp, Homo sapiens
taagatgactctga

SEQ ID NO: 5439357 - DNA, 20 bp, Homo sapiens
taagatgagatttgccagca

SEQ ID NO: 5439358 - DNA, 20 bp, Homo sapiens
taagatgatgttaaatgcct

SEQ ID NO: 5439359 - DNA, 23 bp, Homo sapiens
taagatgctaccttgtgacccag

SEQ ID NO: 5439360 - DNA, 13 bp, Homo sapiens
taagatgctgggt

SEQ ID NO: 5439361 - DNA, 17 bp, Homo sapiens
taagatggaagcttcca

SEQ ID NO: 5439362 - DNA, 15 bp, Homo sapiens
taagatggagaataa

SEQ ID NO: 5439363 - DNA, 19 bp, Homo sapiens
taagatggcaggtgatgtc

SEQ ID NO: 5439364 - DNA, 16 bp, Homo sapiens
taagatggctgtggca

SEQ ID NO: 5439365 - DNA, 19 bp, Homo sapiens
taagatggctgtggcattt

SEQ ID NO: 5439366 - DNA, 17 bp, Homo sapiens
taagatgtacatttaat

SEQ ID NO: 5439367 - DNA, 18 bp, Homo sapiens
taagatgtacatttaata

SEQ ID NO: 5439368 - DNA, 19 bp, Homo sapiens
taagatgtgatattctaag

SEQ ID NO: 5439369 - DNA, 21 bp, Homo sapiens
taagatgtgcagcatttcact

SEQ ID NO: 5439370 - DNA, 16 bp, Homo sapiens
taagatgtgtcttcaa

SEQ ID NO: 5439371 - DNA, 15 bp, Homo sapiens
taagatgtgttctta

SEQ ID NO: 5439372 - DNA, 17 bp, Homo sapiens
taagatgtgttcttatt

SEQ ID NO: 5439373 - DNA, 19 bp, Homo sapiens
taagatgttatatttttct

SEQ ID NO: 5439374 - DNA, 22 bp, Homo sapiens
taagattaaattatatctgagg

SEQ ID NO: 5439375 - DNA, 17 bp, Homo sapiens
taagattaagagcaaat

SEQ ID NO: 5439376 - DNA, 20 bp, Homo sapiens
taagattaatgacctgaatt

SEQ ID NO: 5439377 - DNA, 19 bp, Homo sapiens
taagattacaaatcagaag

SEQ ID NO: 5439378 - DNA, 22 bp, Homo sapiens
taagattacaaatcagaagtca

SEQ ID NO: 5439379 - DNA, 15 bp, Homo sapiens
taagattagttgaat

SEQ ID NO: 5439380 - DNA, 14 bp, Homo sapiens
taagattataattg

SEQ ID NO: 5439381 - DNA, 23 bp, Homo sapiens
taagattatagattctaaagatt

SEQ ID NO: 5439382 - DNA, 17 bp, Homo sapiens
taagattatatacaaag

SEQ ID NO: 5439383 - DNA, 16 bp, Homo sapiens
taagattattgtctga

SEQ ID NO: 5439384 - DNA, 20 bp, Homo sapiens
taagattattgtctgattga

SEQ ID NO: 5439385 - DNA, 22 bp, Homo sapiens
taagattattgtctgattgaaa

SEQ ID NO: 5439386 - DNA, 14 bp, Homo sapiens
taagattccagaga

SEQ ID NO: 5439387 - DNA, 14 bp, Homo sapiens
taagattccttttc

SEQ ID NO: 5439388 - DNA, 12 bp, Homo sapiens
taagattctaaa

SEQ ID NO: 5439389 - DNA, 16 bp, Homo sapiens
taagattctaaaggtc

SEQ ID NO: 5439390 - DNA, 17 bp, Homo sapiens
taagattctaacggtct

SEQ ID NO: 5439391 - DNA, 12 bp, Homo sapiens
taagattctaga

SEQ ID NO: 5439392 - DNA, 19 bp, Homo sapiens
taagattctctgcccagcc

SEQ ID NO: 5439393 - DNA, 13 bp, Homo sapiens
taagattctttgt

SEQ ID NO: 5439394 - DNA, 23 bp, Homo sapiens
taagattcttttaaattagaaaa

SEQ ID NO: 5439395 - DNA, 18 bp, Homo sapiens
taagattgcgcctgagat

SEQ ID NO: 5439396 - DNA, 14 bp, Homo sapiens
taagattggaaatg

SEQ ID NO: 5439397 - DNA, 14 bp, Homo sapiens
taagattgtaattc

SEQ ID NO: 5439398 - DNA, 18 bp, Homo sapiens
taagattgtacatatgga

SEQ ID NO: 5439399 - DNA, 22 bp, Homo sapiens
taagatttaattgtaattgtct

SEQ ID NO: 5439400 - DNA, 14 bp, Homo sapiens
taagatttaatttg

SEQ ID NO: 5439401 - DNA, 18 bp, Homo sapiens
taagatttaatttgccaa

SEQ ID NO: 5439402 - DNA, 22 bp, Homo sapiens
taagatttacccagaatgtcag

SEQ ID NO: 5439403 - DNA, 19 bp, Homo sapiens
taagatttacttaattgct

SEQ ID NO: 5439404 - DNA, 13 bp, Homo sapiens
taagatttatctg

SEQ ID NO: 5439405 - DNA, 16 bp, Homo sapiens
taagatttccttcttt

SEQ ID NO: 5439406 - DNA, 15 bp, Homo sapiens
taagatttctcctga

SEQ ID NO: 5439407 - DNA, 14 bp, Homo sapiens
taagatttctctaa

SEQ ID NO: 5439408 - DNA, 13 bp, Homo sapiens
taagatttctgtc

SEQ ID NO: 5439409 - DNA, 21 bp, Homo sapiens
taagatttgtacatattatca

SEQ ID NO: 5439410 - DNA, 19 bp, Homo sapiens
taagatttgtttttaaact

SEQ ID NO: 5439411 - DNA, 20 bp, Homo sapiens
taagatttgtttttaaactg

SEQ ID NO: 5439412 - DNA, 14 bp, Homo sapiens
taagattttacaaa

SEQ ID NO: 5439413 - DNA, 17 bp, Homo sapiens
taagattttatctgggg

SEQ ID NO: 5439414 - DNA, 18 bp, Homo sapiens
taagattttattttcaag

SEQ ID NO: 5439415 - DNA, 17 bp, Homo sapiens
taagatttttatattaa

SEQ ID NO: 5439416 - DNA, 21 bp, Homo sapiens
taagatttttctcaaagtttt

SEQ ID NO: 5439417 - DNA, 13 bp, Homo sapiens
taagcaaaaacgt

SEQ ID NO: 5439418 - DNA, 22 bp, Homo sapiens
taagcaaacgtctattttgtat

SEQ ID NO: 5439419 - DNA, 16 bp, Homo sapiens
taagcaaaggaaacca

SEQ ID NO: 5439420 - DNA, 20 bp, Homo sapiens
taagcaaaggctccctcgcc

SEQ ID NO: 5439421 - DNA, 21 bp, Homo sapiens
taagcaaaggctctgaaataa

SEQ ID NO: 5439422 - DNA, 23 bp, Homo sapiens
taagcaaagggagcactgggttg

SEQ ID NO: 5439423 - DNA, 22 bp, Homo sapiens
taagcaaaggggacagctgtgt

SEQ ID NO: 5439424 - DNA, 22 bp, Homo sapiens
taagcaaatacttagcaaaaag

SEQ ID NO: 5439425 - DNA, 19 bp, Homo sapiens
taagcaaattttgtattat

SEQ ID NO: 5439426 - DNA, 13 bp, Homo sapiens
taagcaacaatgg

SEQ ID NO: 5439427 - DNA, 13 bp, Homo sapiens
taagcaacaattt

SEQ ID NO: 5439428 - DNA, 18 bp, Homo sapiens
taagcaacaattttcaga

SEQ ID NO: 5439429 - DNA, 16 bp, Homo sapiens
taagcaacatgaatta

SEQ ID NO: 5439430 - DNA, 18 bp, Homo sapiens
taagcaaccttaaagcaa

SEQ ID NO: 5439431 - DNA, 21 bp, Homo sapiens
taagcaacgttagtagaactt

SEQ ID NO: 5439432 - DNA, 15 bp, Homo sapiens
taagcaactggaaaa

SEQ ID NO: 5439433 - DNA, 18 bp, Homo sapiens
taagcaacttgcttctaa

SEQ ID NO: 5439434 - DNA, 16 bp, Homo sapiens
taagcaagaatgcagt

SEQ ID NO: 5439435 - DNA, 13 bp, Homo sapiens
taagcaagatgtt

SEQ ID NO: 5439436 - DNA, 21 bp, Homo sapiens
taagcaagatgttttgtataa

SEQ ID NO: 5439437 - DNA, 23 bp, Homo sapiens
taagcaaggtgtccctgccttca

SEQ ID NO: 5439438 - DNA, 21 bp, Homo sapiens
taagcaagtgaactcatccct

SEQ ID NO: 5439439 - DNA, 15 bp, Homo sapiens
taagcaatcactggg

SEQ ID NO: 5439440 - DNA, 16 bp, Homo sapiens
taagcaatcactgggc

SEQ ID NO: 5439441 - DNA, 23 bp, Homo sapiens
taagcaatcactgggcccagagg

SEQ ID NO: 5439442 - DNA, 11 bp, Homo sapiens
taagcacaaaa

SEQ ID NO: 5439443 - DNA, 23 bp, Homo sapiens
taagcacacacatctggccctga

SEQ ID NO: 5439444 - DNA, 17 bp, Homo sapiens
taagcacactaaaccaa

SEQ ID NO: 5439445 - DNA, 13 bp, Homo sapiens
taagcacagacaa

SEQ ID NO: 5439446 - DNA, 23 bp, Homo sapiens
taagcacatcagtacttttctct

SEQ ID NO: 5439447 - DNA, 15 bp, Homo sapiens
taagcaccagtggga

SEQ ID NO: 5439448 - DNA, 22 bp, Homo sapiens
taagcaccagtgggactgtggt

SEQ ID NO: 5439449 - DNA, 18 bp, Homo sapiens
taagcacctgggctgagg

SEQ ID NO: 5439450 - DNA, 18 bp, Homo sapiens
taagcacctttagaatat

SEQ ID NO: 5439451 - DNA, 13 bp, Homo sapiens
taagcactacata

SEQ ID NO: 5439452 - DNA, 17 bp, Homo sapiens
taagcactcttaaagca

SEQ ID NO: 5439453 - DNA, 18 bp, Homo sapiens
taagcactcttaaagcaa

SEQ ID NO: 5439454 - DNA, 13 bp, Homo sapiens
taagcactgtgct

SEQ ID NO: 5439455 - DNA, 17 bp, Homo sapiens
taagcactgtgctaata

SEQ ID NO: 5439456 - DNA, 22 bp, Homo sapiens
taagcactgtggatcacgacag

SEQ ID NO: 5439457 - DNA, 16 bp, Homo sapiens
taagcactgtttttcc

SEQ ID NO: 5439458 - DNA, 15 bp, Homo sapiens
taagcacttctagaa

SEQ ID NO: 5439459 - DNA, 13 bp, Homo sapiens
taagcacttttta

SEQ ID NO: 5439460 - DNA, 16 bp, Homo sapiens
taagcagaacaaatgt

SEQ ID NO: 5439461 - DNA, 20 bp, Homo sapiens
taagcagaacaaatgtgttt

SEQ ID NO: 5439462 - DNA, 13 bp, Homo sapiens
taagcagagaagg

SEQ ID NO: 5439463 - DNA, 21 bp, Homo sapiens
taagcagagataaataaaaga

SEQ ID NO: 5439464 - DNA, 15 bp, Homo sapiens
taagcagaggagggg

SEQ ID NO: 5439465 - DNA, 22 bp, Homo sapiens
taagcagatggaatgctgtgtt

SEQ ID NO: 5439466 - DNA, 21 bp, Homo sapiens
taagcagcaaataaacaacta

SEQ ID NO: 5439467 - DNA, 15 bp, Homo sapiens
taagcagcatggaaa

SEQ ID NO: 5439468 - DNA, 23 bp, Homo sapiens
taagcagcatttctgaagtggac

SEQ ID NO: 5439469 - DNA, 12 bp, Homo sapiens
taagcagccagg

SEQ ID NO: 5439470 - DNA, 14 bp, Homo sapiens
taagcagcctttct

SEQ ID NO: 5439471 - DNA, 17 bp, Homo sapiens
taagcagcttattgttt

SEQ ID NO: 5439472 - DNA, 16 bp, Homo sapiens
taagcagcttgaatgg

SEQ ID NO: 5439473 - DNA, 14 bp, Homo sapiens
taagcaggaaggat

SEQ ID NO: 5439474 - DNA, 15 bp, Homo sapiens
taagcaggaggaggt

SEQ ID NO: 5439475 - DNA, 18 bp, Homo sapiens
taagcaggaggaggtgcc

SEQ ID NO: 5439476 - DNA, 23 bp, Homo sapiens
taagcaggaggaggtgccaacag

SEQ ID NO: 5439477 - DNA, 16 bp, Homo sapiens
taagggtaaaaaagat

SEQ ID NO: 5439478 - DNA, 19 bp, Homo sapiens
taagggtaggatgttgctt

SEQ ID NO: 5439479 - DNA, 17 bp, Homo sapiens
taagggtcactggcctc

SEQ ID NO: 5439480 - DNA, 15 bp, Homo sapiens
taagggtctgttgta

SEQ ID NO: 5439481 - DNA, 13 bp, Homo sapiens
taagggtggagag

SEQ ID NO: 5439482 - DNA, 20 bp, Homo sapiens
taagggtgggtgctcagaat

SEQ ID NO: 5439483 - DNA, 16 bp, Homo sapiens
taagggttgaaggcag

SEQ ID NO: 5439484 - DNA, 18 bp, Homo sapiens
taagggttgaaggcagtc

SEQ ID NO: 5439485 - DNA, 22 bp, Homo sapiens
taaggtaactactgctaatgtt

SEQ ID NO: 5439486 - DNA, 19 bp, Homo sapiens
taaggtaatttctgtgtat

SEQ ID NO: 5439487 - DNA, 13 bp, Homo sapiens
taaggtacatcat

SEQ ID NO: 5439488 - DNA, 13 bp, Homo sapiens
taaggtactgtgg

SEQ ID NO: 5439489 - DNA, 23 bp, Homo sapiens
taaggtataaggatcttttgtaa

SEQ ID NO: 5439490 - DNA, 20 bp, Homo sapiens
taaggtatatcattctaaag

SEQ ID NO: 5439491 - DNA, 14 bp, Homo sapiens
taaggtattgcaag

SEQ ID NO: 5439492 - DNA, 20 bp, Homo sapiens
taaggtatttcgaaactgcc

SEQ ID NO: 5439493 - DNA, 23 bp, Homo sapiens
taaggtatttcgaaactgccaag

SEQ ID NO: 5439494 - DNA, 15 bp, Homo sapiens
taaggtcaagggaaa

SEQ ID NO: 5439495 - DNA, 17 bp, Homo sapiens
taaggtcagctcagagc

SEQ ID NO: 5439496 - DNA, 22 bp, Homo sapiens
taaggtcagtgttataaaatct

SEQ ID NO: 5439497 - DNA, 19 bp, Homo sapiens
taaggtcatagattcttga

SEQ ID NO: 5439498 - DNA, 13 bp, Homo sapiens
taaggtccccagc

SEQ ID NO: 5439499 - DNA, 13 bp, Homo sapiens
taaggtcctaagg

SEQ ID NO: 5439500 - DNA, 16 bp, Homo sapiens
taaggtcctgaaagta

SEQ ID NO: 5439501 - DNA, 13 bp, Homo sapiens
taaggtcctgctt

SEQ ID NO: 5439502 - DNA, 19 bp, Homo sapiens
taaggtctaatcagtgatt

SEQ ID NO: 5439503 - DNA, 22 bp, Homo sapiens
taaggtctcatgctgttgctgc

SEQ ID NO: 5439504 - DNA, 21 bp, Homo sapiens
taaggtctgggagtgttctgt

SEQ ID NO: 5439505 - DNA, 13 bp, Homo sapiens
taaggtctgtttg

SEQ ID NO: 5439506 - DNA, 22 bp, Homo sapiens
taaggtctgtttgctgttgctg

SEQ ID NO: 5439507 - DNA, 21 bp, Homo sapiens
taaggtctttgtaaaatcttg

SEQ ID NO: 5439508 - DNA, 18 bp, Homo sapiens
taaggtgactttctgaaa

SEQ ID NO: 5439509 - DNA, 17 bp, Homo sapiens
taaggtgaggcctgtct

SEQ ID NO: 5439510 - DNA, 17 bp, Homo sapiens
taaggtgagttctcact

SEQ ID NO: 5439511 - DNA, 18 bp, Homo sapiens
taaggtgcctcagttttc

SEQ ID NO: 5439512 - DNA, 15 bp, Homo sapiens
taaggtgctaaatct

SEQ ID NO: 5439513 - DNA, 16 bp, Homo sapiens
taaggtgcttgctccc

SEQ ID NO: 5439514 - DNA, 17 bp, Homo sapiens
taaggtgcttgctcccc

SEQ ID NO: 5439515 - DNA, 21 bp, Homo sapiens
taaggtggacagcagacaaga

SEQ ID NO: 5439516 - DNA, 10 bp, Homo sapiens
taaggtggct

SEQ ID NO: 5439517 - DNA, 18 bp, Homo sapiens
taaggtgggagaattgct

SEQ ID NO: 5439518 - DNA, 20 bp, Homo sapiens
taaggtgggtacgggagggt

SEQ ID NO: 5439519 - DNA, 22 bp, Homo sapiens
taaggtgggtccaggaaggcag

SEQ ID NO: 5439520 - DNA, 13 bp, Homo sapiens
taaggtgtagcca

SEQ ID NO: 5439521 - DNA, 15 bp, Homo sapiens
taaggtgtgctctga

SEQ ID NO: 5439522 - DNA, 15 bp, Homo sapiens
taaggtgtttgaaaa

SEQ ID NO: 5439523 - DNA, 17 bp, Homo sapiens
taaggtgttttctgtgt

SEQ ID NO: 5439524 - DNA, 18 bp, Homo sapiens
taaggtgttttctgtgta

SEQ ID NO: 5439525 - DNA, 12 bp, Homo sapiens
taaggttaatta

SEQ ID NO: 5439526 - DNA, 18 bp, Homo sapiens
taaggttctcagacctcc

SEQ ID NO: 5439527 - DNA, 16 bp, Homo sapiens
taaggttgcacacagt

SEQ ID NO: 5439528 - DNA, 14 bp, Homo sapiens
taaggttgtgcagg

SEQ ID NO: 5439529 - DNA, 10 bp, Homo sapiens
taaggtttca

SEQ ID NO: 5439530 - DNA, 19 bp, Homo sapiens
taaggtttcgtttctgtat

SEQ ID NO: 5439531 - DNA, 17 bp, Homo sapiens
taaggttttaatttagt

SEQ ID NO: 5439532 - DNA, 14 bp, Homo sapiens
taaggttttgttgt

SEQ ID NO: 5439533 - DNA, 22 bp, Homo sapiens
taaggttttgttgtgttctgtt

SEQ ID NO: 5439534 - DNA, 17 bp, Homo sapiens
taagtaaaaccacagca

SEQ ID NO: 5439535 - DNA, 19 bp, Homo sapiens
taagtaaacctagtaaaac

SEQ ID NO: 5439536 - DNA, 13 bp, Homo sapiens
taagtaaactgcc

SEQ ID NO: 5439537 - DNA, 14 bp, Homo sapiens
taagtaaagttcca

SEQ ID NO: 5439538 - DNA, 14 bp, Homo sapiens
taagtaaatacaat

SEQ ID NO: 5439539 - DNA, 16 bp, Homo sapiens
taagtaaatacaattt

SEQ ID NO: 5439540 - DNA, 16 bp, Homo sapiens
taagtaaatctcttct

SEQ ID NO: 5439541 - DNA, 13 bp, Homo sapiens
taagtaaatgcta

SEQ ID NO: 5439542 - DNA, 16 bp, Homo sapiens
taagtaaatgtctgtg

SEQ ID NO: 5439543 - DNA, 14 bp, Homo sapiens
taagtaaatgtctt

SEQ ID NO: 5439544 - DNA, 22 bp, Homo sapiens
taagtaaattagtaatgtacta

SEQ ID NO: 5439545 - DNA, 12 bp, Homo sapiens
taagtaacttgt

SEQ ID NO: 5439546 - DNA, 12 bp, Homo sapiens
taagtaagaaaa

SEQ ID NO: 5439547 - DNA, 19 bp, Homo sapiens
taagtaagaaaatattttg

SEQ ID NO: 5439548 - DNA, 20 bp, Homo sapiens
taagtaagaaaatattttgt

SEQ ID NO: 5439549 - DNA, 19 bp, Homo sapiens
taagtaagcaacagcataa

SEQ ID NO: 5439550 - DNA, 18 bp, Homo sapiens
taagtaagtttcattcta

SEQ ID NO: 5439551 - DNA, 14 bp, Homo sapiens
taagtaataatttg

SEQ ID NO: 5439552 - DNA, 16 bp, Homo sapiens
taagtaatatctttca

SEQ ID NO: 5439553 - DNA, 13 bp, Homo sapiens
taagtaatctttt

SEQ ID NO: 5439554 - DNA, 23 bp, Homo sapiens
taagtaatgaaggcatatttcca

SEQ ID NO: 5439555 - DNA, 14 bp, Homo sapiens
taagtaatggttaa

SEQ ID NO: 5439556 - DNA, 21 bp, Homo sapiens
taagtaattatcgggaacagt

SEQ ID NO: 5439557 - DNA, 23 bp, Homo sapiens
taagtaattatcgggaacagtgt

SEQ ID NO: 5439558 - DNA, 12 bp, Homo sapiens
taagtaattatg

SEQ ID NO: 5439559 - DNA, 16 bp, Homo sapiens
taagtaatttagaaga

SEQ ID NO: 5439560 - DNA, 14 bp, Homo sapiens
taagtaatttcatg

SEQ ID NO: 5439561 - DNA, 18 bp, Homo sapiens
taagtacagaacagtaaa

SEQ ID NO: 5439562 - DNA, 12 bp, Homo sapiens
taagtacagaga

SEQ ID NO: 5439563 - DNA, 16 bp, Homo sapiens
taagtacagagaagcc

SEQ ID NO: 5439564 - DNA, 17 bp, Homo sapiens
taagtacagagaagcca

SEQ ID NO: 5439565 - DNA, 18 bp, Homo sapiens
taagtacagagaagccat

SEQ ID NO: 5439566 - DNA, 18 bp, Homo sapiens
taagtaccaatgggaagc

SEQ ID NO: 5439567 - DNA, 21 bp, Homo sapiens
taagtaccaatgggaagcagg

SEQ ID NO: 5439568 - DNA, 18 bp, Homo sapiens
taagtacctcagcattta

SEQ ID NO: 5439569 - DNA, 19 bp, Homo sapiens
taagtactacacattttta

SEQ ID NO: 5439570 - DNA, 15 bp, Homo sapiens
taagtactagatgca

SEQ ID NO: 5439571 - DNA, 15 bp, Homo sapiens
taagtactatctttg

SEQ ID NO: 5439572 - DNA, 13 bp, Homo sapiens
taagtactatgta

SEQ ID NO: 5439573 - DNA, 16 bp, Homo sapiens
taagtactatgtatca

SEQ ID NO: 5439574 - DNA, 19 bp, Homo sapiens
taagtactatgtatcaatg

SEQ ID NO: 5439575 - DNA, 14 bp, Homo sapiens
taagtactgtaata

SEQ ID NO: 5439576 - DNA, 19 bp, Homo sapiens
taagtactgtaataatacc

SEQ ID NO: 5439577 - DNA, 21 bp, Homo sapiens
taagtactgtaataatacctc

SEQ ID NO: 5439578 - DNA, 20 bp, Homo sapiens
taagtacttgctctctgaga

SEQ ID NO: 5439579 - DNA, 21 bp, Homo sapiens
taagtagactttaattcttct

SEQ ID NO: 5439580 - DNA, 20 bp, Homo sapiens
taagtagatctgctttctgt

SEQ ID NO: 5439581 - DNA, 19 bp, Homo sapiens
taagtagatgaaacattaa

SEQ ID NO: 5439582 - DNA, 12 bp, Homo sapiens
taagtagatttg

SEQ ID NO: 5439583 - DNA, 20 bp, Homo sapiens
taagtagcaaccctgtgata

SEQ ID NO: 5439584 - DNA, 14 bp, Homo sapiens
taagtaggtgatga

SEQ ID NO: 5439585 - DNA, 24 bp, Homo sapiens
taagtagtgtcattcatatgagtt

SEQ ID NO: 5439586 - DNA, 18 bp, Homo sapiens
taagtagttggtttgtat

SEQ ID NO: 5439587 - DNA, 16 bp, Homo sapiens
taagtataaaatacaa

SEQ ID NO: 5439588 - DNA, 14 bp, Homo sapiens
taagtataaacctt

SEQ ID NO: 5439589 - DNA, 15 bp, Homo sapiens
taagtatatcatgta

SEQ ID NO: 5439590 - DNA, 17 bp, Homo sapiens
taagtatatcatgtaaa

SEQ ID NO: 5439591 - DNA, 14 bp, Homo sapiens
taagtatatttgta

SEQ ID NO: 5439592 - DNA, 16 bp, Homo sapiens
taagtatatttgtaaa

SEQ ID NO: 5439593 - DNA, 16 bp, Homo sapiens
taagtatctaggagta

SEQ ID NO: 5439594 - DNA, 16 bp, Homo sapiens
taagtatctgacatct

SEQ ID NO: 5439595 - DNA, 16 bp, Homo sapiens
taagtatcttgtgctt

SEQ ID NO: 5439596 - DNA, 17 bp, Homo sapiens
taagtatggaatattca

SEQ ID NO: 5439597 - DNA, 17 bp, Homo sapiens
taagtattaaaacattg

SEQ ID NO: 5439598 - DNA, 17 bp, Homo sapiens
taagtattatgtctctt

SEQ ID NO: 5439599 - DNA, 21 bp, Homo sapiens
taagtattccttggcccagca

SEQ ID NO: 5439600 - DNA, 16 bp, Homo sapiens
taagtattctaaattt

SEQ ID NO: 5439601 - DNA, 11 bp, Homo sapiens
taagtattgca

SEQ ID NO: 5439602 - DNA, 18 bp, Homo sapiens
taagtattgcatctgtat

SEQ ID NO: 5439603 - DNA, 18 bp, Homo sapiens
taagtatttatatattta

SEQ ID NO: 5439604 - DNA, 23 bp, Homo sapiens
taagtatttatatatttataact

SEQ ID NO: 5439605 - DNA, 12 bp, Homo sapiens
taagtatttcca

SEQ ID NO: 5439606 - DNA, 13 bp, Homo sapiens
taagtatttctga

SEQ ID NO: 5439607 - DNA, 20 bp, Homo sapiens
taagtattttcctgttgtca

SEQ ID NO: 5439608 - DNA, 21 bp, Homo sapiens
taagtattttcctgttgtcaa

SEQ ID NO: 5439609 - DNA, 20 bp, Homo sapiens
taagtcaaaaggaacaaaaa

SEQ ID NO: 5439610 - DNA, 23 bp, Homo sapiens
taagtcaaaataatctgaaatga

SEQ ID NO: 5439611 - DNA, 17 bp, Homo sapiens
taagtcaagcacatgta

SEQ ID NO: 5439612 - DNA, 20 bp, Homo sapiens
taagtcaagcacatgtaata

SEQ ID NO: 5439613 - DNA, 21 bp, Homo sapiens
taagtcaagcacatgtaataa

SEQ ID NO: 5439614 - DNA, 12 bp, Homo sapiens
taagtcacatat

SEQ ID NO: 5439615 - DNA, 20 bp, Homo sapiens
taagtcacccagagcacagg

SEQ ID NO: 5439616 - DNA, 23 bp, Homo sapiens
taagtcagaaactaaaacaaata

SEQ ID NO: 5439617 - DNA, 18 bp, Homo sapiens
taagtcagatttttattt

SEQ ID NO: 5439618 - DNA, 13 bp, Homo sapiens
taagtcaggacag

SEQ ID NO: 5439619 - DNA, 21 bp, Homo sapiens
taagtcaggagtgtagttgga

SEQ ID NO: 5439620 - DNA, 22 bp, Homo sapiens
taagtcagggaagagcagtgct

SEQ ID NO: 5439621 - DNA, 18 bp, Homo sapiens
taagtcaggtaatatacc

SEQ ID NO: 5439622 - DNA, 20 bp, Homo sapiens
taagtcaggtaatatacctg

SEQ ID NO: 5439623 - DNA, 17 bp, Homo sapiens
taagtcagtttcacata

SEQ ID NO: 5439624 - DNA, 14 bp, Homo sapiens
taagtcataatgaa

SEQ ID NO: 5439625 - DNA, 16 bp, Homo sapiens
taagtcatcatctcca

SEQ ID NO: 5439626 - DNA, 19 bp, Homo sapiens
taagtcatcatctccaaac

SEQ ID NO: 5439627 - DNA, 12 bp, Homo sapiens
taagtcatcatt

SEQ ID NO: 5439628 - DNA, 19 bp, Homo sapiens
taagtcatggtcctggctg

SEQ ID NO: 5439629 - DNA, 14 bp, Homo sapiens
taagtcatgtatgt

SEQ ID NO: 5439630 - DNA, 17 bp, Homo sapiens
taagtcatgtatgtttc

SEQ ID NO: 5439631 - DNA, 18 bp, Homo sapiens
taagtcattcataaacct

SEQ ID NO: 5439632 - DNA, 22 bp, Homo sapiens
taagtcattgaaatttactgtg

SEQ ID NO: 5439633 - DNA, 17 bp, Homo sapiens
taagtcattggcaaagt

SEQ ID NO: 5439634 - DNA, 16 bp, Homo sapiens
taagtcattttcatgt

SEQ ID NO: 5439635 - DNA, 21 bp, Homo sapiens
taagtcattttttacttgaat

SEQ ID NO: 5439636 - DNA, 12 bp, Homo sapiens
taagtccagctc

SEQ ID NO: 5439637 - DNA, 14 bp, Homo sapiens
taagtccagctcat

SEQ ID NO: 5439638 - DNA, 18 bp, Homo sapiens
taagtccatgaatgttca

SEQ ID NO: 5439639 - DNA, 21 bp, Homo sapiens
taagtcccagtatacctcatt

SEQ ID NO: 5439640 - DNA, 20 bp, Homo sapiens
taagtcccattcagtggcaa

SEQ ID NO: 5439641 - DNA, 17 bp, Homo sapiens
taagtccctgccccctc

SEQ ID NO: 5439642 - DNA, 22 bp, Homo sapiens
taagtccctgccccctcccctt

SEQ ID NO: 5439643 - DNA, 15 bp, Homo sapiens
taagtccctgtcacc

SEQ ID NO: 5439644 - DNA, 15 bp, Homo sapiens
taagtcctactttta

SEQ ID NO: 5439645 - DNA, 20 bp, Homo sapiens
taagtcctacttttaaagaa

SEQ ID NO: 5439646 - DNA, 16 bp, Homo sapiens
taagtccttccacctg

SEQ ID NO: 5439647 - DNA, 20 bp, Homo sapiens
taagtcctttatgtggaaaa

SEQ ID NO: 5439648 - DNA, 22 bp, Homo sapiens
taagtcgggaaattctgctgct

SEQ ID NO: 5439649 - DNA, 23 bp, Homo sapiens
taagtcgggaaattctgctgctt

SEQ ID NO: 5439650 - DNA, 20 bp, Homo sapiens
taagtcgttgagggaatgac

SEQ ID NO: 5439651 - DNA, 16 bp, Homo sapiens
taagtctacattaaac

SEQ ID NO: 5439652 - DNA, 21 bp, Homo sapiens
taagtctcctttactgaatgt

SEQ ID NO: 5439653 - DNA, 19 bp, Homo sapiens
taagtctcttttttacaaa

SEQ ID NO: 5439654 - DNA, 21 bp, Homo sapiens
taagtctcttttttacaaagg

SEQ ID NO: 5439655 - DNA, 18 bp, Homo sapiens
taataagtatatcttaag

SEQ ID NO: 5439656 - DNA, 23 bp, Homo sapiens
taataagtatatcttaagaatgt

SEQ ID NO: 5439657 - DNA, 21 bp, Homo sapiens
taataagtccacatcttctca

SEQ ID NO: 5439658 - DNA, 14 bp, Homo sapiens
taataagtttgaaa

SEQ ID NO: 5439659 - DNA, 19 bp, Homo sapiens
taataagtttgaaatatat

SEQ ID NO: 5439660 - DNA, 21 bp, Homo sapiens
taataagtttgatcaaatcta

SEQ ID NO: 5439661 - DNA, 22 bp, Homo sapiens
taataagttttgatataatctt

SEQ ID NO: 5439662 - DNA, 11 bp, Homo sapiens
taataataaat

SEQ ID NO: 5439663 - DNA, 14 bp, Homo sapiens
taataataaatagt

SEQ ID NO: 5439664 - DNA, 12 bp, Homo sapiens
taataataaatt

SEQ ID NO: 5439665 - DNA, 14 bp, Homo sapiens
taataataaattaa

SEQ ID NO: 5439666 - DNA, 19 bp, Homo sapiens
taataataagataatgatg

SEQ ID NO: 5439667 - DNA, 12 bp, Homo sapiens
taataatacaag

SEQ ID NO: 5439668 - DNA, 14 bp, Homo sapiens
taataatacctcaa

SEQ ID NO: 5439669 - DNA, 12 bp, Homo sapiens
taataatactga

SEQ ID NO: 5439670 - DNA, 14 bp, Homo sapiens
taataatagttatt

SEQ ID NO: 5439671 - DNA, 21 bp, Homo sapiens
taataatatacttgtggacta

SEQ ID NO: 5439672 - DNA, 13 bp, Homo sapiens
taataatatatgt

SEQ ID NO: 5439673 - DNA, 16 bp, Homo sapiens
taataatatgtacaaa

SEQ ID NO: 5439674 - DNA, 18 bp, Homo sapiens
taataatattaataagaa

SEQ ID NO: 5439675 - DNA, 20 bp, Homo sapiens
taataatcaagagccttaaa

SEQ ID NO: 5439676 - DNA, 23 bp, Homo sapiens
taataatcattggattctgagag

SEQ ID NO: 5439677 - DNA, 20 bp, Homo sapiens
taataatcttattagggaga

SEQ ID NO: 5439678 - DNA, 15 bp, Homo sapiens
taataatcttgtttc

SEQ ID NO: 5439679 - DNA, 14 bp, Homo sapiens
taataatgaagtag

SEQ ID NO: 5439680 - DNA, 15 bp, Homo sapiens
taataatgactctaa

SEQ ID NO: 5439681 - DNA, 21 bp, Homo sapiens
taataatgagctattaaaact

SEQ ID NO: 5439682 - DNA, 16 bp, Homo sapiens
taataatgccaatgaa

SEQ ID NO: 5439683 - DNA, 22 bp, Homo sapiens
taataatggttactcattttat

SEQ ID NO: 5439684 - DNA, 17 bp, Homo sapiens
taataatgtaacatgat

SEQ ID NO: 5439685 - DNA, 21 bp, Homo sapiens
taataatgtaatactgtagaa

SEQ ID NO: 5439686 - DNA, 22 bp, Homo sapiens
taataatgtaatactgtagaaa

SEQ ID NO: 5439687 - DNA, 14 bp, Homo sapiens
taataatgtacaga

SEQ ID NO: 5439688 - DNA, 20 bp, Homo sapiens
taataatgtcctttccctgg

SEQ ID NO: 5439689 - DNA, 22 bp, Homo sapiens
taataatgttgccttggaaaca

SEQ ID NO: 5439690 - DNA, 15 bp, Homo sapiens
taataatgtttcaaa

SEQ ID NO: 5439691 - DNA, 18 bp, Homo sapiens
taataattacttaatgtg

SEQ ID NO: 5439692 - DNA, 19 bp, Homo sapiens
taataattatgtgccattt

SEQ ID NO: 5439693 - DNA, 20 bp, Homo sapiens
taataattattaagctgttt

SEQ ID NO: 5439694 - DNA, 16 bp, Homo sapiens
taataattctgcttta

SEQ ID NO: 5439695 - DNA, 14 bp, Homo sapiens
taataattgaagaa

SEQ ID NO: 5439696 - DNA, 14 bp, Homo sapiens
taataattgtatct

SEQ ID NO: 5439697 - DNA, 21 bp, Homo sapiens
taataattgtatctacattaa

SEQ ID NO: 5439698 - DNA, 13 bp, Homo sapiens
taataatttcatc

SEQ ID NO: 5439699 - DNA, 15 bp, Homo sapiens
taataatttcatccc

SEQ ID NO: 5439700 - DNA, 13 bp, Homo sapiens
taataatttgcac

SEQ ID NO: 5439701 - DNA, 16 bp, Homo sapiens
taataattttatagaa

SEQ ID NO: 5439702 - DNA, 17 bp, Homo sapiens
taataattttatagaaa

SEQ ID NO: 5439703 - DNA, 20 bp, Homo sapiens
taataatttttaagaaataa

SEQ ID NO: 5439704 - DNA, 16 bp, Homo sapiens
taataatttttgctga

SEQ ID NO: 5439705 - DNA, 19 bp, Homo sapiens
taataatttttgctgaatt

SEQ ID NO: 5439706 - DNA, 16 bp, Homo sapiens
taataattttttaatt

SEQ ID NO: 5439707 - DNA, 19 bp, Homo sapiens
taatacaaattggctttca

SEQ ID NO: 5439708 - DNA, 14 bp, Homo sapiens
taatacaagcatat

SEQ ID NO: 5439709 - DNA, 19 bp, Homo sapiens
taatacaccaaatagcttt

SEQ ID NO: 5439710 - DNA, 14 bp, Homo sapiens
taatacaccactac

SEQ ID NO: 5439711 - DNA, 19 bp, Homo sapiens
taatacaccactacattct

SEQ ID NO: 5439712 - DNA, 23 bp, Homo sapiens
taatacaccactacattctgtta

SEQ ID NO: 5439713 - DNA, 19 bp, Homo sapiens
taatacactccacttgaag

SEQ ID NO: 5439714 - DNA, 16 bp, Homo sapiens
taatacacttgccctg

SEQ ID NO: 5439715 - DNA, 21 bp, Homo sapiens
taatacagataagtgttcttc

SEQ ID NO: 5439716 - DNA, 22 bp, Homo sapiens
taatacagatgtatcatgattg

SEQ ID NO: 5439717 - DNA, 16 bp, Homo sapiens
taatacagattgaaag

SEQ ID NO: 5439718 - DNA, 21 bp, Homo sapiens
taatacagcaacaatttatga

SEQ ID NO: 5439719 - DNA, 20 bp, Homo sapiens
taatacagccaaagataatc

SEQ ID NO: 5439720 - DNA, 22 bp, Homo sapiens
taatacagcgctctctctgctt

SEQ ID NO: 5439721 - DNA, 19 bp, Homo sapiens
taatacaggtaacattata

SEQ ID NO: 5439722 - DNA, 11 bp, Homo sapiens
taatacatcac

SEQ ID NO: 5439723 - DNA, 14 bp, Homo sapiens
taatacatccattc

SEQ ID NO: 5439724 - DNA, 18 bp, Homo sapiens
taatacatctttatcatt

SEQ ID NO: 5439725 - DNA, 21 bp, Homo sapiens
taatacattccatcacagcca

SEQ ID NO: 5439726 - DNA, 22 bp, Homo sapiens
taatacattctatgacattttt

SEQ ID NO: 5439727 - DNA, 18 bp, Homo sapiens
taataccaaagactattt

SEQ ID NO: 5439728 - DNA, 22 bp, Homo sapiens
taataccaaagactatttcaaa

SEQ ID NO: 5439729 - DNA, 18 bp, Homo sapiens
taataccaaatattttag

SEQ ID NO: 5439730 - DNA, 17 bp, Homo sapiens
taataccaagactaagc

SEQ ID NO: 5439731 - DNA, 14 bp, Homo sapiens
taataccaccaaca

SEQ ID NO: 5439732 - DNA, 23 bp, Homo sapiens
taataccaccatttaaaaatgtt

SEQ ID NO: 5439733 - DNA, 23 bp, Homo sapiens
taatacccaaaccctaaacctct

SEQ ID NO: 5439734 - DNA, 19 bp, Homo sapiens
taatacccccgtcggaatg

SEQ ID NO: 5439735 - DNA, 16 bp, Homo sapiens
taataccctgtacata

SEQ ID NO: 5439736 - DNA, 13 bp, Homo sapiens
taatacctctgtg

SEQ ID NO: 5439737 - DNA, 14 bp, Homo sapiens
taatacctctgtgt

SEQ ID NO: 5439738 - DNA, 20 bp, Homo sapiens
taatacctcttactttgctt

SEQ ID NO: 5439739 - DNA, 20 bp, Homo sapiens
taatacctgggtgattacat

SEQ ID NO: 5439740 - DNA, 14 bp, Homo sapiens
taatacctttaaat

SEQ ID NO: 5439741 - DNA, 21 bp, Homo sapiens
taatacctttaaatatcattc

SEQ ID NO: 5439742 - DNA, 22 bp, Homo sapiens
taatacctttaaatatcattct

SEQ ID NO: 5439743 - DNA, 21 bp, Homo sapiens
taatacctttggaaaaatctt

SEQ ID NO: 5439744 - DNA, 17 bp, Homo sapiens
taatacgtgccagatat

SEQ ID NO: 5439745 - DNA, 16 bp, Homo sapiens
taatactaaagtgtct

SEQ ID NO: 5439746 - DNA, 12 bp, Homo sapiens
taatactatatt

SEQ ID NO: 5439747 - DNA, 21 bp, Homo sapiens
taatactcaaatgagtaacat

SEQ ID NO: 5439748 - DNA, 13 bp, Homo sapiens
taatactctattt

SEQ ID NO: 5439749 - DNA, 14 bp, Homo sapiens
taatactctatttt

SEQ ID NO: 5439750 - DNA, 15 bp, Homo sapiens
taatactgaaccact

SEQ ID NO: 5439751 - DNA, 20 bp, Homo sapiens
taatactgaatttctttgat

SEQ ID NO: 5439752 - DNA, 21 bp, Homo sapiens
taatactgaatttctttgatt

SEQ ID NO: 5439753 - DNA, 13 bp, Homo sapiens
taatactgagaaa

SEQ ID NO: 5439754 - DNA, 16 bp, Homo sapiens
taatactgagaaaaag

SEQ ID NO: 5439755 - DNA, 19 bp, Homo sapiens
taatactggaataatttgt

SEQ ID NO: 5439756 - DNA, 22 bp, Homo sapiens
taatactggaataatttgtaaa

SEQ ID NO: 5439757 - DNA, 21 bp, Homo sapiens
taatactggttatcctgtgct

SEQ ID NO: 5439758 - DNA, 14 bp, Homo sapiens
taatactgtagaaa

SEQ ID NO: 5439759 - DNA, 12 bp, Homo sapiens
taatactgtatt

SEQ ID NO: 5439760 - DNA, 22 bp, Homo sapiens
taatactgttattctttgcact

SEQ ID NO: 5439761 - DNA, 16 bp, Homo sapiens
taatactgttttaaaa

SEQ ID NO: 5439762 - DNA, 15 bp, Homo sapiens
taatacttaaaaata

SEQ ID NO: 5439763 - DNA, 17 bp, Homo sapiens
taatacttcatttggtg

SEQ ID NO: 5439764 - DNA, 19 bp, Homo sapiens
taatacttccttataaaaa

SEQ ID NO: 5439765 - DNA, 17 bp, Homo sapiens
taatacttcttgtgtgt

SEQ ID NO: 5439766 - DNA, 17 bp, Homo sapiens
taatacttgacctctgt

SEQ ID NO: 5439767 - DNA, 12 bp, Homo sapiens
taatacttgcaa

SEQ ID NO: 5439768 - DNA, 15 bp, Homo sapiens
taatacttgcaacta

SEQ ID NO: 5439769 - DNA, 19 bp, Homo sapiens
taatactttaggaaatacg

SEQ ID NO: 5439770 - DNA, 15 bp, Homo sapiens
taatacttttgtaat

SEQ ID NO: 5439771 - DNA, 20 bp, Homo sapiens
taatacttttttattttgtt

SEQ ID NO: 5439772 - DNA, 18 bp, Homo sapiens
taatagaaaactgaaaat

SEQ ID NO: 5439773 - DNA, 22 bp, Homo sapiens
taatagaaaagtctccacccct

SEQ ID NO: 5439774 - DNA, 14 bp, Homo sapiens
taatagaaaattaa

SEQ ID NO: 5439775 - DNA, 19 bp, Homo sapiens
taatagaaaattaaaataa

SEQ ID NO: 5439776 - DNA, 23 bp, Homo sapiens
taatagaaagaaattacttctag

SEQ ID NO: 5439777 - DNA, 20 bp, Homo sapiens
taatagaaagtcagatgact

SEQ ID NO: 5439778 - DNA, 21 bp, Homo sapiens
taatagaaagtcagatgacta

SEQ ID NO: 5439779 - DNA, 15 bp, Homo sapiens
taatagaaatgtctc

SEQ ID NO: 5439780 - DNA, 22 bp, Homo sapiens
taatagaagtccatgagttgag

SEQ ID NO: 5439781 - DNA, 14 bp, Homo sapiens
taatagaataaagg

SEQ ID NO: 5439782 - DNA, 17 bp, Homo sapiens
taatagaataaaggcct

SEQ ID NO: 5439783 - DNA, 21 bp, Homo sapiens
taatagaatataattatcgga

SEQ ID NO: 5439784 - DNA, 19 bp, Homo sapiens
taatagaatttcctaatga

SEQ ID NO: 5439785 - DNA, 14 bp, Homo sapiens
taatagacaattta

SEQ ID NO: 5439786 - DNA, 21 bp, Homo sapiens
taatagactcgctagtcagta

SEQ ID NO: 5439787 - DNA, 22 bp, Homo sapiens
taatagactgtaacttccaaat

SEQ ID NO: 5439788 - DNA, 16 bp, Homo sapiens
taatagagaacttttt

SEQ ID NO: 5439789 - DNA, 21 bp, Homo sapiens
taatagagcaaaattgatgtg

SEQ ID NO: 5439790 - DNA, 17 bp, Homo sapiens
taatagaggagctgctt

SEQ ID NO: 5439791 - DNA, 14 bp, Homo sapiens
taatagagtactta

SEQ ID NO: 5439792 - DNA, 22 bp, Homo sapiens
taatagagtacttaatatactc

SEQ ID NO: 5439793 - DNA, 21 bp, Homo sapiens
taatagagttggagttttatt

SEQ ID NO: 5439794 - DNA, 15 bp, Homo sapiens
taatagatgatggta

SEQ ID NO: 5439795 - DNA, 14 bp, Homo sapiens
taatagatgtgaaa

SEQ ID NO: 5439796 - DNA, 19 bp, Homo sapiens
taatagatgtgaaaatgct

SEQ ID NO: 5439797 - DNA, 16 bp, Homo sapiens
taatagatgtttgata

SEQ ID NO: 5439798 - DNA, 12 bp, Homo sapiens
taatagattctc

SEQ ID NO: 5439799 - DNA, 19 bp, Homo sapiens
taatagattgttttgccac

SEQ ID NO: 5439800 - DNA, 19 bp, Homo sapiens
taatagatttttttttcca

SEQ ID NO: 5439801 - DNA, 21 bp, Homo sapiens
taatagcaacttttgtgtaat

SEQ ID NO: 5439802 - DNA, 23 bp, Homo sapiens
taatagcactaaccaatgccttt

SEQ ID NO: 5439803 - DNA, 14 bp, Homo sapiens
taatagcagccttt

SEQ ID NO: 5439804 - DNA, 13 bp, Homo sapiens
taatagcattttt

SEQ ID NO: 5439805 - DNA, 16 bp, Homo sapiens
taatagcatttttgta

SEQ ID NO: 5439806 - DNA, 19 bp, Homo sapiens
taatagcatttttgtaact

SEQ ID NO: 5439807 - DNA, 18 bp, Homo sapiens
taatagccaaagatttca

SEQ ID NO: 5439808 - DNA, 22 bp, Homo sapiens
taatagcccataaagtctgaga

SEQ ID NO: 5439809 - DNA, 17 bp, Homo sapiens
taatagcccatttctgt

SEQ ID NO: 5439810 - DNA, 19 bp, Homo sapiens
taatagcctaaaagatttt

SEQ ID NO: 5439811 - DNA, 19 bp, Homo sapiens
taatagcgtcataactaga

SEQ ID NO: 5439812 - DNA, 18 bp, Homo sapiens
taatagctaataataaat

SEQ ID NO: 5439813 - DNA, 19 bp, Homo sapiens
taatagctaataataaatg

SEQ ID NO: 5439814 - DNA, 23 bp, Homo sapiens
taatagctcacagcacatttgtt

SEQ ID NO: 5439815 - DNA, 12 bp, Homo sapiens
taatagctcaga

SEQ ID NO: 5439816 - DNA, 14 bp, Homo sapiens
taatagctgaacct

SEQ ID NO: 5439817 - DNA, 14 bp, Homo sapiens
taatagcttctgtg

SEQ ID NO: 5439818 - DNA, 23 bp, Homo sapiens
taatagcttctgtgtgtgagcta

SEQ ID NO: 5439819 - DNA, 15 bp, Homo sapiens
taatagcttttcctg

SEQ ID NO: 5439820 - DNA, 16 bp, Homo sapiens
taatagcttttgatta

SEQ ID NO: 5439821 - DNA, 21 bp, Homo sapiens
taataggaacaatctttgctg

SEQ ID NO: 5439822 - DNA, 17 bp, Homo sapiens
taataggaagaacagta

SEQ ID NO: 5439823 - DNA, 12 bp, Homo sapiens
taataggaattc

SEQ ID NO: 5439824 - DNA, 13 bp, Homo sapiens
taataggaattca

SEQ ID NO: 5439825 - DNA, 15 bp, Homo sapiens
taataggagtatttt

SEQ ID NO: 5439826 - DNA, 21 bp, Homo sapiens
taataggcattttaagtaaaa

SEQ ID NO: 5439827 - DNA, 16 bp, Homo sapiens
taatagggaatatatc

SEQ ID NO: 5439828 - DNA, 17 bp, Homo sapiens
taataggtagtttggat

SEQ ID NO: 5439829 - DNA, 21 bp, Homo sapiens
taataggtatatagaacacaa

SEQ ID NO: 5439830 - DNA, 19 bp, Homo sapiens
taataggtttggacaaaat

SEQ ID NO: 5439831 - DNA, 19 bp, Homo sapiens
taatagtaatggttctaga

SEQ ID NO: 5439832 - DNA, 14 bp, Homo sapiens
taatctagaacaca

SEQ ID NO: 5439833 - DNA, 14 bp, Homo sapiens
taatctagacaata

SEQ ID NO: 5439834 - DNA, 17 bp, Homo sapiens
taatctagatatcgact

SEQ ID NO: 5439835 - DNA, 15 bp, Homo sapiens
taatctagtttacag

SEQ ID NO: 5439836 - DNA, 17 bp, Homo sapiens
taatctagtttacagaa

SEQ ID NO: 5439837 - DNA, 18 bp, Homo sapiens
taatctagtttacagaaa

SEQ ID NO: 5439838 - DNA, 18 bp, Homo sapiens
taatctatattaaatgag

SEQ ID NO: 5439839 - DNA, 20 bp, Homo sapiens
taatctatgtgtttctgtaa

SEQ ID NO: 5439840 - DNA, 20 bp, Homo sapiens
taatctattgggttcattat

SEQ ID NO: 5439841 - DNA, 14 bp, Homo sapiens
taatctatttacat

SEQ ID NO: 5439842 - DNA, 17 bp, Homo sapiens
taatctatttctatgag

SEQ ID NO: 5439843 - DNA, 17 bp, Homo sapiens
taatctcacaaaacata

SEQ ID NO: 5439844 - DNA, 22 bp, Homo sapiens
taatctcacaaaacatatttta

SEQ ID NO: 5439845 - DNA, 23 bp, Homo sapiens
taatctcacttcatcaatcaaat

SEQ ID NO: 5439846 - DNA, 17 bp, Homo sapiens
taatctcatacctctga

SEQ ID NO: 5439847 - DNA, 20 bp, Homo sapiens
taatctcatacctctgacca

SEQ ID NO: 5439848 - DNA, 21 bp, Homo sapiens
taatctcatccccccacccga

SEQ ID NO: 5439849 - DNA, 13 bp, Homo sapiens
taatctccaactt

SEQ ID NO: 5439850 - DNA, 22 bp, Homo sapiens
taatctccacccaatgaatgat

SEQ ID NO: 5439851 - DNA, 16 bp, Homo sapiens
taatctccactttttt

SEQ ID NO: 5439852 - DNA, 21 bp, Homo sapiens
taatctcctgagttgtataaa

SEQ ID NO: 5439853 - DNA, 12 bp, Homo sapiens
taatctcctgtt

SEQ ID NO: 5439854 - DNA, 16 bp, Homo sapiens
taatctcgtttcaaaa

SEQ ID NO: 5439855 - DNA, 15 bp, Homo sapiens
taatctctaaaattc

SEQ ID NO: 5439856 - DNA, 21 bp, Homo sapiens
taatctctaaaattctagtct

SEQ ID NO: 5439857 - DNA, 19 bp, Homo sapiens
taatctctctgcagctgcc

SEQ ID NO: 5439858 - DNA, 13 bp, Homo sapiens
taatctctgatta

SEQ ID NO: 5439859 - DNA, 23 bp, Homo sapiens
taatctctgattccctgatttaa

SEQ ID NO: 5439860 - DNA, 17 bp, Homo sapiens
taatctctgtaaagcta

SEQ ID NO: 5439861 - DNA, 18 bp, Homo sapiens
taatctctgtaaagctaa

SEQ ID NO: 5439862 - DNA, 14 bp, Homo sapiens
taatctctgtgtgt

SEQ ID NO: 5439863 - DNA, 21 bp, Homo sapiens
taatctctgtgtgttttcttt

SEQ ID NO: 5439864 - DNA, 16 bp, Homo sapiens
taatctctgttatgta

SEQ ID NO: 5439865 - DNA, 18 bp, Homo sapiens
taatctctgttatgtact

SEQ ID NO: 5439866 - DNA, 22 bp, Homo sapiens
taatctctgttatgtactgtac

SEQ ID NO: 5439867 - DNA, 20 bp, Homo sapiens
taatctcttgtcattctcat

SEQ ID NO: 5439868 - DNA, 15 bp, Homo sapiens
taatctgaaatgaca

SEQ ID NO: 5439869 - DNA, 16 bp, Homo sapiens
taatctgaaattctaa

SEQ ID NO: 5439870 - DNA, 21 bp, Homo sapiens
taatctgaataaagtgtaaca

SEQ ID NO: 5439871 - DNA, 23 bp, Homo sapiens
taatctgaataaagtgtaacaat

SEQ ID NO: 5439872 - DNA, 21 bp, Homo sapiens
taatctgacttctcacttcct

SEQ ID NO: 5439873 - DNA, 21 bp, Homo sapiens
taatctgagctgcagcctggc

SEQ ID NO: 5439874 - DNA, 22 bp, Homo sapiens
taatctgagctgcagcctggct

SEQ ID NO: 5439875 - DNA, 18 bp, Homo sapiens
taatctgaggatgagaca

SEQ ID NO: 5439876 - DNA, 20 bp, Homo sapiens
taatctgatcgttctttcta

SEQ ID NO: 5439877 - DNA, 21 bp, Homo sapiens
taatctgatggcttctccagg

SEQ ID NO: 5439878 - DNA, 15 bp, Homo sapiens
taatctgcctccctc

SEQ ID NO: 5439879 - DNA, 15 bp, Homo sapiens
taatctgctttgtta

SEQ ID NO: 5439880 - DNA, 19 bp, Homo sapiens
taatctggaaggcccctcc

SEQ ID NO: 5439881 - DNA, 15 bp, Homo sapiens
taatctggactcctc

SEQ ID NO: 5439882 - DNA, 17 bp, Homo sapiens
taatctggactcctctg

SEQ ID NO: 5439883 - DNA, 21 bp, Homo sapiens
taatctggactcctctgtcca

SEQ ID NO: 5439884 - DNA, 22 bp, Homo sapiens
taatctggactcctctgtccag

SEQ ID NO: 5439885 - DNA, 12 bp, Homo sapiens
taatctggatgt

SEQ ID NO: 5439886 - DNA, 17 bp, Homo sapiens
taatctgggaagggaag

SEQ ID NO: 5439887 - DNA, 13 bp, Homo sapiens
taatctgtacatt

SEQ ID NO: 5439888 - DNA, 20 bp, Homo sapiens
taatctgtagggctggacct

SEQ ID NO: 5439889 - DNA, 21 bp, Homo sapiens
taatctgtcaaaacactgtgg

SEQ ID NO: 5439890 - DNA, 18 bp, Homo sapiens
taatctgtcgcatttcat

SEQ ID NO: 5439891 - DNA, 20 bp, Homo sapiens
taatctgtcgcatttcatca

SEQ ID NO: 5439892 - DNA, 21 bp, Homo sapiens
taatctgtcgcatttcatcaa

SEQ ID NO: 5439893 - DNA, 19 bp, Homo sapiens
taatctgtgagtgaaagtt

SEQ ID NO: 5439894 - DNA, 14 bp, Homo sapiens
taatctgtgtacaa

SEQ ID NO: 5439895 - DNA, 13 bp, Homo sapiens
taatctgttatgt

SEQ ID NO: 5439896 - DNA, 14 bp, Homo sapiens
taatctgttgtttg

SEQ ID NO: 5439897 - DNA, 15 bp, Homo sapiens
taatctgttgtttga

SEQ ID NO: 5439898 - DNA, 20 bp, Homo sapiens
taatctgtttgtgcaaacat

SEQ ID NO: 5439899 - DNA, 22 bp, Homo sapiens
taatcttagaacagatggctgt

SEQ ID NO: 5439900 - DNA, 20 bp, Homo sapiens
taatcttagagacaaacctt

SEQ ID NO: 5439901 - DNA, 13 bp, Homo sapiens
taatcttagcttt

SEQ ID NO: 5439902 - DNA, 13 bp, Homo sapiens
taatcttagtgta

SEQ ID NO: 5439903 - DNA, 18 bp, Homo sapiens
taatcttagtgtatgatt

SEQ ID NO: 5439904 - DNA, 20 bp, Homo sapiens
taatcttattgtttaatctt

SEQ ID NO: 5439905 - DNA, 21 bp, Homo sapiens
taatcttattgtttaatcttt

SEQ ID NO: 5439906 - DNA, 14 bp, Homo sapiens
taatcttcaggtga

SEQ ID NO: 5439907 - DNA, 16 bp, Homo sapiens
taatcttctctcttga

SEQ ID NO: 5439908 - DNA, 15 bp, Homo sapiens
taatcttctgccttc

SEQ ID NO: 5439909 - DNA, 16 bp, Homo sapiens
taatcttgaattgtaa

SEQ ID NO: 5439910 - DNA, 15 bp, Homo sapiens
taatcttgctgctta

SEQ ID NO: 5439911 - DNA, 18 bp, Homo sapiens
taatcttgctttctttag

SEQ ID NO: 5439912 - DNA, 22 bp, Homo sapiens
taatcttgctttctttagaatt

SEQ ID NO: 5439913 - DNA, 14 bp, Homo sapiens
taatcttggctcag

SEQ ID NO: 5439914 - DNA, 21 bp, Homo sapiens
taatcttggcttcttaaaaac

SEQ ID NO: 5439915 - DNA, 23 bp, Homo sapiens
taatcttggcttcttaaaaactg

SEQ ID NO: 5439916 - DNA, 15 bp, Homo sapiens
taatcttgggtttct

SEQ ID NO: 5439917 - DNA, 17 bp, Homo sapiens
taatcttgtagacactt

SEQ ID NO: 5439918 - DNA, 18 bp, Homo sapiens
taatcttgtagacactta

SEQ ID NO: 5439919 - DNA, 13 bp, Homo sapiens
taatcttgtccct

SEQ ID NO: 5439920 - DNA, 19 bp, Homo sapiens
taatcttgtgaaaataatt

SEQ ID NO: 5439921 - DNA, 17 bp, Homo sapiens
taatcttgttgataaaa

SEQ ID NO: 5439922 - DNA, 17 bp, Homo sapiens
taatcttgtttctgaaa

SEQ ID NO: 5439923 - DNA, 19 bp, Homo sapiens
taatctttacctgtataca

SEQ ID NO: 5439924 - DNA, 14 bp, Homo sapiens
taatctttatactg

SEQ ID NO: 5439925 - DNA, 22 bp, Homo sapiens
taatctttatactgggtttcaa

SEQ ID NO: 5439926 - DNA, 12 bp, Homo sapiens
taatctttattt

SEQ ID NO: 5439927 - DNA, 16 bp, Homo sapiens
taatctttattttatt

SEQ ID NO: 5439928 - DNA, 18 bp, Homo sapiens
taatctttattttattat

SEQ ID NO: 5439929 - DNA, 22 bp, Homo sapiens
taatctttattttattattcag

SEQ ID NO: 5439930 - DNA, 19 bp, Homo sapiens
taatctttcggtctcctta

SEQ ID NO: 5439931 - DNA, 14 bp, Homo sapiens
taatctttctacct

SEQ ID NO: 5439932 - DNA, 19 bp, Homo sapiens
taatctttctatatttttt

SEQ ID NO: 5439933 - DNA, 15 bp, Homo sapiens
taatcttttaaaaat

SEQ ID NO: 5439934 - DNA, 17 bp, Homo sapiens
taatcttttcacaaata

SEQ ID NO: 5439935 - DNA, 18 bp, Homo sapiens
taatcttttcacaaataa

SEQ ID NO: 5439936 - DNA, 13 bp, Homo sapiens
taatcttttctga

SEQ ID NO: 5439937 - DNA, 15 bp, Homo sapiens
taatcttttctgaat

SEQ ID NO: 5439938 - DNA, 12 bp, Homo sapiens
taatctttttca

SEQ ID NO: 5439939 - DNA, 19 bp, Homo sapiens
taatctttttcatcattgt

SEQ ID NO: 5439940 - DNA, 23 bp, Homo sapiens
taatctttttcatcattgttgtg

SEQ ID NO: 5439941 - DNA, 22 bp, Homo sapiens
taatcttttttttaaaaaaact

SEQ ID NO: 5439942 - DNA, 19 bp, Homo sapiens
taatgaaaaacaaaaagct

SEQ ID NO: 5439943 - DNA, 20 bp, Homo sapiens
taatgaaaaacaaaaagcta

SEQ ID NO: 5439944 - DNA, 14 bp, Homo sapiens
taatgaaaaataca

SEQ ID NO: 5439945 - DNA, 18 bp, Homo sapiens
taatgaaaaatctgaatt

SEQ ID NO: 5439946 - DNA, 16 bp, Homo sapiens
taatgaaaacaatgca

SEQ ID NO: 5439947 - DNA, 18 bp, Homo sapiens
taatgaaaataaaacaca

SEQ ID NO: 5439948 - DNA, 21 bp, Homo sapiens
taatgaaaataaaacacacct

SEQ ID NO: 5439949 - DNA, 23 bp, Homo sapiens
taatgaaaatgatgtagacattt

SEQ ID NO: 5439950 - DNA, 15 bp, Homo sapiens
taatgaaaatgtcag

SEQ ID NO: 5439951 - DNA, 20 bp, Homo sapiens
taatgaaaatgtctcagtat

SEQ ID NO: 5439952 - DNA, 16 bp, Homo sapiens
taatgaaacaaagagt

SEQ ID NO: 5439953 - DNA, 23 bp, Homo sapiens
taatgaaacaaagagttcaagaa

SEQ ID NO: 5439954 - DNA, 20 bp, Homo sapiens
taatgaaacaccttctctgg

SEQ ID NO: 5439955 - DNA, 22 bp, Homo sapiens
taatgaaagactgtacaaagta

SEQ ID NO: 5439956 - DNA, 23 bp, Homo sapiens
taatgaaagactgtacaaagtag

SEQ ID NO: 5439957 - DNA, 20 bp, Homo sapiens
taatgaaagggtttgtaata

SEQ ID NO: 5439958 - DNA, 21 bp, Homo sapiens
taatgaaagtgcactgcagtg

SEQ ID NO: 5439959 - DNA, 23 bp, Homo sapiens
taatgaaataaaactgtttttga

SEQ ID NO: 5439960 - DNA, 23 bp, Homo sapiens
taatgaaataaatcatgttaatc

SEQ ID NO: 5439961 - DNA, 15 bp, Homo sapiens
taatgaaataatcag

SEQ ID NO: 5439962 - DNA, 19 bp, Homo sapiens
taatgaaatctgtttgttg

SEQ ID NO: 5439963 - DNA, 17 bp, Homo sapiens
taatgaaatgataaaga

SEQ ID NO: 5439964 - DNA, 15 bp, Homo sapiens
taatgaaatgtttac

SEQ ID NO: 5439965 - DNA, 17 bp, Homo sapiens
taatgaacaaaattatt

SEQ ID NO: 5439966 - DNA, 15 bp, Homo sapiens
taatgaacacaattt

SEQ ID NO: 5439967 - DNA, 19 bp, Homo sapiens
taatgaacagcagaaagac

SEQ ID NO: 5439968 - DNA, 13 bp, Homo sapiens
taatgaactgtga

SEQ ID NO: 5439969 - DNA, 13 bp, Homo sapiens
taatgaactttat

SEQ ID NO: 5439970 - DNA, 13 bp, Homo sapiens
taatgaactttga

SEQ ID NO: 5439971 - DNA, 16 bp, Homo sapiens
taatgaagaaagtgga

SEQ ID NO: 5439972 - DNA, 14 bp, Homo sapiens
taatgaagaaatac

SEQ ID NO: 5439973 - DNA, 14 bp, Homo sapiens
taatgaagacaatg

SEQ ID NO: 5439974 - DNA, 17 bp, Homo sapiens
taatgaagacccagtgt

SEQ ID NO: 5439975 - DNA, 22 bp, Homo sapiens
taatgaagagccagcccaagta

SEQ ID NO: 5439976 - DNA, 16 bp, Homo sapiens
taatgaagatctaaat

SEQ ID NO: 5439977 - DNA, 13 bp, Homo sapiens
taatgaagatctt

SEQ ID NO: 5439978 - DNA, 15 bp, Homo sapiens
taatgaagatctttg

SEQ ID NO: 5439979 - DNA, 17 bp, Homo sapiens
taatgaagatctttgtt

SEQ ID NO: 5439980 - DNA, 13 bp, Homo sapiens
taatgaagattaa

SEQ ID NO: 5439981 - DNA, 18 bp, Homo sapiens
taatgaaggcatatttcc

SEQ ID NO: 5439982 - DNA, 19 bp, Homo sapiens
taatgaaggcatatttcca

SEQ ID NO: 5439983 - DNA, 19 bp, Homo sapiens
taatgaaggtcataagttt

SEQ ID NO: 5439984 - DNA, 15 bp, Homo sapiens
taatgaaggtgtgct

SEQ ID NO: 5439985 - DNA, 19 bp, Homo sapiens
taatgaaggtgtgctacag

SEQ ID NO: 5439986 - DNA, 20 bp, Homo sapiens
taatgaaggttttcatttgc

SEQ ID NO: 5439987 - DNA, 17 bp, Homo sapiens
taatgaagtcactattt

SEQ ID NO: 5439988 - DNA, 16 bp, Homo sapiens
taatgaagtttgaatg

SEQ ID NO: 5439989 - DNA, 17 bp, Homo sapiens
taatgaagtttgaatgt

SEQ ID NO: 5439990 - DNA, 21 bp, Homo sapiens
taatgaagtttgaatgttaaa

SEQ ID NO: 5439991 - DNA, 15 bp, Homo sapiens
taatgaataaactga

SEQ ID NO: 5439992 - DNA, 12 bp, Homo sapiens
taatgaatacct

SEQ ID NO: 5439993 - DNA, 13 bp, Homo sapiens
taatgaatacctt

SEQ ID NO: 5439994 - DNA, 16 bp, Homo sapiens
taatgaatactttctt

SEQ ID NO: 5439995 - DNA, 16 bp, Homo sapiens
taatgaatagaataaa

SEQ ID NO: 5439996 - DNA, 13 bp, Homo sapiens
taatgaatatctg

SEQ ID NO: 5439997 - DNA, 18 bp, Homo sapiens
taatgaatctaagcagca

SEQ ID NO: 5439998 - DNA, 15 bp, Homo sapiens
taatgaatgcataaa

SEQ ID NO: 5439999 - DNA, 12 bp, Homo sapiens
taatgaatgcta

SEQ ID NO: 5440000 - DNA, 13 bp, Homo sapiens
taatgaatgctta

SEQ ID NO: 5440001 - DNA, 14 bp, Homo sapiens
taatgaattataac

SEQ ID NO: 5440002 - DNA, 19 bp, Homo sapiens
taatgaattataacagtta

SEQ ID NO: 5440003 - DNA, 14 bp, Homo sapiens
taatgaattgaaat

SEQ ID NO: 5440004 - DNA, 19 bp, Homo sapiens
taatgaatttaaggcaaaa

SEQ ID NO: 5440005 - DNA, 15 bp, Homo sapiens
taatgaatttagtga

SEQ ID NO: 5440006 - DNA, 21 bp, Homo sapiens
taatgaatttttatgatattc

SEQ ID NO: 5440007 - DNA, 14 bp, Homo sapiens
taatgacaaaagat

SEQ ID NO: 5440008 - DNA, 19 bp, Homo sapiens
taatgacaattttgagaaa

SEQ ID NO: 5440009 - DNA, 14 bp, Homo sapiens
taattatatttcta

SEQ ID NO: 5440010 - DNA, 23 bp, Homo sapiens
taattatatttctacagagaaaa

SEQ ID NO: 5440011 - DNA, 16 bp, Homo sapiens
taattatctaaagtat

SEQ ID NO: 5440012 - DNA, 13 bp, Homo sapiens
taattatctagta

SEQ ID NO: 5440013 - DNA, 23 bp, Homo sapiens
taattatcttttcaaaggtactt

SEQ ID NO: 5440014 - DNA, 13 bp, Homo sapiens
taattatgaaaag

SEQ ID NO: 5440015 - DNA, 21 bp, Homo sapiens
taattatgacagttatactgt

SEQ ID NO: 5440016 - DNA, 15 bp, Homo sapiens
taattatgcagtgtt

SEQ ID NO: 5440017 - DNA, 22 bp, Homo sapiens
taattatgggaataattgcttt

SEQ ID NO: 5440018 - DNA, 12 bp, Homo sapiens
taattatggtac

SEQ ID NO: 5440019 - DNA, 22 bp, Homo sapiens
taattatggtctggggtaaaat

SEQ ID NO: 5440020 - DNA, 13 bp, Homo sapiens
taattatgtaaat

SEQ ID NO: 5440021 - DNA, 15 bp, Homo sapiens
taattatgtaaataa

SEQ ID NO: 5440022 - DNA, 16 bp, Homo sapiens
taattatgtaaataca

SEQ ID NO: 5440023 - DNA, 15 bp, Homo sapiens
taattatgtagctct

SEQ ID NO: 5440024 - DNA, 14 bp, Homo sapiens
taattatgttattg

SEQ ID NO: 5440025 - DNA, 19 bp, Homo sapiens
taattatgttattgaaaaa

SEQ ID NO: 5440026 - DNA, 20 bp, Homo sapiens
taattatgtttacctcactg

SEQ ID NO: 5440027 - DNA, 14 bp, Homo sapiens
taattatgttttca

SEQ ID NO: 5440028 - DNA, 16 bp, Homo sapiens
taattattataaaaat

SEQ ID NO: 5440029 - DNA, 13 bp, Homo sapiens
taattattattaa

SEQ ID NO: 5440030 - DNA, 14 bp, Homo sapiens
taattattattctt

SEQ ID NO: 5440031 - DNA, 13 bp, Homo sapiens
taattattattta

SEQ ID NO: 5440032 - DNA, 14 bp, Homo sapiens
taattattatttat

SEQ ID NO: 5440033 - DNA, 18 bp, Homo sapiens
taattattgcactagaga

SEQ ID NO: 5440034 - DNA, 22 bp, Homo sapiens
taattattgtttatattttcaa

SEQ ID NO: 5440035 - DNA, 14 bp, Homo sapiens
taattatttaaata

SEQ ID NO: 5440036 - DNA, 15 bp, Homo sapiens
taattatttaaataa

SEQ ID NO: 5440037 - DNA, 18 bp, Homo sapiens
taattatttaaataaaat

SEQ ID NO: 5440038 - DNA, 16 bp, Homo sapiens
taattatttaaatgta

SEQ ID NO: 5440039 - DNA, 13 bp, Homo sapiens
taattatttctaa

SEQ ID NO: 5440040 - DNA, 22 bp, Homo sapiens
taattatttctaacactagctt

SEQ ID NO: 5440041 - DNA, 13 bp, Homo sapiens
taattattttaaa

SEQ ID NO: 5440042 - DNA, 18 bp, Homo sapiens
taattattttaattaggt

SEQ ID NO: 5440043 - DNA, 16 bp, Homo sapiens
taattattttccaaaa

SEQ ID NO: 5440044 - DNA, 20 bp, Homo sapiens
taattattttccaaaatcta

SEQ ID NO: 5440045 - DNA, 13 bp, Homo sapiens
taattattttggt

SEQ ID NO: 5440046 - DNA, 21 bp, Homo sapiens
taattattttggtacttttat

SEQ ID NO: 5440047 - DNA, 16 bp, Homo sapiens
taattcaagaaatgac

SEQ ID NO: 5440048 - DNA, 17 bp, Homo sapiens
taattcaagcctctaaa

SEQ ID NO: 5440049 - DNA, 19 bp, Homo sapiens
taattcaagcctctaaaca

SEQ ID NO: 5440050 - DNA, 18 bp, Homo sapiens
taattcaaggaatttctt

SEQ ID NO: 5440051 - DNA, 20 bp, Homo sapiens
taattcaaggaatttcttaa

SEQ ID NO: 5440052 - DNA, 13 bp, Homo sapiens
taattcaataaaa

SEQ ID NO: 5440053 - DNA, 15 bp, Homo sapiens
taattcaatgaaatg

SEQ ID NO: 5440054 - DNA, 15 bp, Homo sapiens
taattcaatgctttc

SEQ ID NO: 5440055 - DNA, 19 bp, Homo sapiens
taattcaattcaaagctgt

SEQ ID NO: 5440056 - DNA, 17 bp, Homo sapiens
taattcaattcatgtaa

SEQ ID NO: 5440057 - DNA, 19 bp, Homo sapiens
taattcacagaatagcaca

SEQ ID NO: 5440058 - DNA, 22 bp, Homo sapiens
taattcacagtgctcttttctc

SEQ ID NO: 5440059 - DNA, 19 bp, Homo sapiens
taattcaccaaaagttcat

SEQ ID NO: 5440060 - DNA, 21 bp, Homo sapiens
taattcaccaaaagttcatat

SEQ ID NO: 5440061 - DNA, 16 bp, Homo sapiens
taattcaccaaagtat

SEQ ID NO: 5440062 - DNA, 19 bp, Homo sapiens
taattcacctcagcctgga

SEQ ID NO: 5440063 - DNA, 13 bp, Homo sapiens
taattcacgtgct

SEQ ID NO: 5440064 - DNA, 16 bp, Homo sapiens
taattcacttcagttt

SEQ ID NO: 5440065 - DNA, 16 bp, Homo sapiens
taattcagaaaacata

SEQ ID NO: 5440066 - DNA, 22 bp, Homo sapiens
taattcagattaggacacagtg

SEQ ID NO: 5440067 - DNA, 19 bp, Homo sapiens
taattcagccatgtacaga

SEQ ID NO: 5440068 - DNA, 15 bp, Homo sapiens
taattcagctcttga

SEQ ID NO: 5440069 - DNA, 16 bp, Homo sapiens
taattcaggactccaa

SEQ ID NO: 5440070 - DNA, 22 bp, Homo sapiens
taattcaggggctgacacttca

SEQ ID NO: 5440071 - DNA, 18 bp, Homo sapiens
taattcagtatgttttac

SEQ ID NO: 5440072 - DNA, 18 bp, Homo sapiens
taattcagtctcagctgc

SEQ ID NO: 5440073 - DNA, 12 bp, Homo sapiens
taattcatattt

SEQ ID NO: 5440074 - DNA, 17 bp, Homo sapiens
taattcatcttttaatc

SEQ ID NO: 5440075 - DNA, 20 bp, Homo sapiens
taattcatcttttaatcatg

SEQ ID NO: 5440076 - DNA, 13 bp, Homo sapiens
taattcatgttgc

SEQ ID NO: 5440077 - DNA, 15 bp, Homo sapiens
taattcattaaaaac

SEQ ID NO: 5440078 - DNA, 17 bp, Homo sapiens
taattcattaaaagttt

SEQ ID NO: 5440079 - DNA, 15 bp, Homo sapiens
taattcattaatctg

SEQ ID NO: 5440080 - DNA, 22 bp, Homo sapiens
taattcattaatctgtttgttt

SEQ ID NO: 5440081 - DNA, 13 bp, Homo sapiens
taattcatttaag

SEQ ID NO: 5440082 - DNA, 18 bp, Homo sapiens
taattcatttaagaacaa

SEQ ID NO: 5440083 - DNA, 18 bp, Homo sapiens
taattcatttactcacca

SEQ ID NO: 5440084 - DNA, 18 bp, Homo sapiens
taattcatttattaagta

SEQ ID NO: 5440085 - DNA, 12 bp, Homo sapiens
taattcatttgt

SEQ ID NO: 5440086 - DNA, 13 bp, Homo sapiens
taattccaagatt

SEQ ID NO: 5440087 - DNA, 17 bp, Homo sapiens
taattccaagattaaaa

SEQ ID NO: 5440088 - DNA, 20 bp, Homo sapiens
taattccaagtgtttctgtt

SEQ ID NO: 5440089 - DNA, 20 bp, Homo sapiens
taattccacaggtcatcaga

SEQ ID NO: 5440090 - DNA, 15 bp, Homo sapiens
taattccatgaatgt

SEQ ID NO: 5440091 - DNA, 16 bp, Homo sapiens
taattcccaacatttc

SEQ ID NO: 5440092 - DNA, 22 bp, Homo sapiens
taattccgtaggttattttcag

SEQ ID NO: 5440093 - DNA, 16 bp, Homo sapiens
taattcctacagcact

SEQ ID NO: 5440094 - DNA, 21 bp, Homo sapiens
taattcctacagcactactgg

SEQ ID NO: 5440095 - DNA, 18 bp, Homo sapiens
taattcctggaaaactgg

SEQ ID NO: 5440096 - DNA, 18 bp, Homo sapiens
taattcctgttgctctgt

SEQ ID NO: 5440097 - DNA, 18 bp, Homo sapiens
taattcctgtttttatta

SEQ ID NO: 5440098 - DNA, 15 bp, Homo sapiens
taattccttaaaatt

SEQ ID NO: 5440099 - DNA, 16 bp, Homo sapiens
taattccttaaatgaa

SEQ ID NO: 5440100 - DNA, 21 bp, Homo sapiens
taattccttcagcactttaga

SEQ ID NO: 5440101 - DNA, 12 bp, Homo sapiens
taattccttggt

SEQ ID NO: 5440102 - DNA, 16 bp, Homo sapiens
taattcgagcaaacaa

SEQ ID NO: 5440103 - DNA, 17 bp, Homo sapiens
taattctaaaagagaag

SEQ ID NO: 5440104 - DNA, 14 bp, Homo sapiens
taattctaaactta

SEQ ID NO: 5440105 - DNA, 22 bp, Homo sapiens
taattctaaacttagaaatatg

SEQ ID NO: 5440106 - DNA, 11 bp, Homo sapiens
taattctaaat

SEQ ID NO: 5440107 - DNA, 22 bp, Homo sapiens
taattctaaccagagcaagctt

SEQ ID NO: 5440108 - DNA, 18 bp, Homo sapiens
taattctagatcagagag

SEQ ID NO: 5440109 - DNA, 14 bp, Homo sapiens
taattctatttctc

SEQ ID NO: 5440110 - DNA, 16 bp, Homo sapiens
taattctatttctcta

SEQ ID NO: 5440111 - DNA, 19 bp, Homo sapiens
taattctcacatccctcta

SEQ ID NO: 5440112 - DNA, 14 bp, Homo sapiens
taattctcattaaa

SEQ ID NO: 5440113 - DNA, 15 bp, Homo sapiens
taattctccttccca

SEQ ID NO: 5440114 - DNA, 23 bp, Homo sapiens
taattctctattatttttattac

SEQ ID NO: 5440115 - DNA, 12 bp, Homo sapiens
taattctcttga

SEQ ID NO: 5440116 - DNA, 13 bp, Homo sapiens
taattctcttgaa

SEQ ID NO: 5440117 - DNA, 21 bp, Homo sapiens
taattctcttttcaaacacac

SEQ ID NO: 5440118 - DNA, 16 bp, Homo sapiens
taattctgaagttata

SEQ ID NO: 5440119 - DNA, 14 bp, Homo sapiens
taattctgcatctg

SEQ ID NO: 5440120 - DNA, 13 bp, Homo sapiens
taattctgcttta

SEQ ID NO: 5440121 - DNA, 12 bp, Homo sapiens
taattctgtaca

SEQ ID NO: 5440122 - DNA, 15 bp, Homo sapiens
taattctgtactgat

SEQ ID NO: 5440123 - DNA, 21 bp, Homo sapiens
taattctgttctgatattaat

SEQ ID NO: 5440124 - DNA, 18 bp, Homo sapiens
taattcttaaaactataa

SEQ ID NO: 5440125 - DNA, 19 bp, Homo sapiens
taattcttaagtcttttgt

SEQ ID NO: 5440126 - DNA, 18 bp, Homo sapiens
taattcttaataggcttt

SEQ ID NO: 5440127 - DNA, 19 bp, Homo sapiens
taattcttaataggcttta

SEQ ID NO: 5440128 - DNA, 22 bp, Homo sapiens
taattcttactgttctgaaatt

SEQ ID NO: 5440129 - DNA, 21 bp, Homo sapiens
taattcttagtggaagacaat

SEQ ID NO: 5440130 - DNA, 19 bp, Homo sapiens
taattcttatgactaaatt

SEQ ID NO: 5440131 - DNA, 17 bp, Homo sapiens
taattcttattccatat

SEQ ID NO: 5440132 - DNA, 19 bp, Homo sapiens
taattcttatttctgtgtt

SEQ ID NO: 5440133 - DNA, 17 bp, Homo sapiens
taattcttattttgtgg

SEQ ID NO: 5440134 - DNA, 15 bp, Homo sapiens
taattcttattttta

SEQ ID NO: 5440135 - DNA, 15 bp, Homo sapiens
taattcttcacctgt

SEQ ID NO: 5440136 - DNA, 20 bp, Homo sapiens
taattcttcaccttaggaat

SEQ ID NO: 5440137 - DNA, 17 bp, Homo sapiens
taattcttcacctttgt

SEQ ID NO: 5440138 - DNA, 18 bp, Homo sapiens
taattcttcacctttgta

SEQ ID NO: 5440139 - DNA, 19 bp, Homo sapiens
taattcttcagcgtaaaat

SEQ ID NO: 5440140 - DNA, 22 bp, Homo sapiens
taattcttcatagggaccttta

SEQ ID NO: 5440141 - DNA, 15 bp, Homo sapiens
taattcttcattata

SEQ ID NO: 5440142 - DNA, 14 bp, Homo sapiens
taattcttcctgtt

SEQ ID NO: 5440143 - DNA, 15 bp, Homo sapiens
taattcttccttccc

SEQ ID NO: 5440144 - DNA, 15 bp, Homo sapiens
taattcttcctttgt

SEQ ID NO: 5440145 - DNA, 20 bp, Homo sapiens
taattcttctcctttgtcaa

SEQ ID NO: 5440146 - DNA, 15 bp, Homo sapiens
taattcttctgtcct

SEQ ID NO: 5440147 - DNA, 16 bp, Homo sapiens
taattcttggattcca

SEQ ID NO: 5440148 - DNA, 11 bp, Homo sapiens
taattctttaa

SEQ ID NO: 5440149 - DNA, 12 bp, Homo sapiens
taattctttcaa

SEQ ID NO: 5440150 - DNA, 13 bp, Homo sapiens
taattctttcaac

SEQ ID NO: 5440151 - DNA, 11 bp, Homo sapiens
taattctttct

SEQ ID NO: 5440152 - DNA, 19 bp, Homo sapiens
taattctttgacctgttgg

SEQ ID NO: 5440153 - DNA, 16 bp, Homo sapiens
taattctttgcaaaaa

SEQ ID NO: 5440154 - DNA, 17 bp, Homo sapiens
taattctttgcaaaaat

SEQ ID NO: 5440155 - DNA, 21 bp, Homo sapiens
taattctttgcaaaaatccaa

SEQ ID NO: 5440156 - DNA, 14 bp, Homo sapiens
taattcttttcaaa

SEQ ID NO: 5440157 - DNA, 15 bp, Homo sapiens
taattcttttttatt

SEQ ID NO: 5440158 - DNA, 18 bp, Homo sapiens
taattcttttttattaat

SEQ ID NO: 5440159 - DNA, 20 bp, Homo sapiens
taattgaaaagattttaaca

SEQ ID NO: 5440160 - DNA, 20 bp, Homo sapiens
taattgaaacaacattattt

SEQ ID NO: 5440161 - DNA, 18 bp, Homo sapiens
taattgaaattaactttt

SEQ ID NO: 5440162 - DNA, 18 bp, Homo sapiens
taattgaacaataaagtt

SEQ ID NO: 5440163 - DNA, 11 bp, Homo sapiens
taattgaagaa

SEQ ID NO: 5440164 - DNA, 19 bp, Homo sapiens
taattgaagaactgcactt

SEQ ID NO: 5440165 - DNA, 13 bp, Homo sapiens
taattgaagcttt

SEQ ID NO: 5440166 - DNA, 22 bp, Homo sapiens
taattgaatggaagcaaaatta

SEQ ID NO: 5440167 - DNA, 20 bp, Homo sapiens
taattgacaggattattgga

SEQ ID NO: 5440168 - DNA, 17 bp, Homo sapiens
taattgacggtttttta

SEQ ID NO: 5440169 - DNA, 14 bp, Homo sapiens
taattgactgaaat

SEQ ID NO: 5440170 - DNA, 15 bp, Homo sapiens
taattgactgaaatt

SEQ ID NO: 5440171 - DNA, 16 bp, Homo sapiens
taattgactgaaatta

SEQ ID NO: 5440172 - DNA, 21 bp, Homo sapiens
taattgacttgcaaagaccta

SEQ ID NO: 5440173 - DNA, 18 bp, Homo sapiens
taattgagaaacatgaat

SEQ ID NO: 5440174 - DNA, 20 bp, Homo sapiens
taattgagaagaaaaactca

SEQ ID NO: 5440175 - DNA, 12 bp, Homo sapiens
taattgagaagc

SEQ ID NO: 5440176 - DNA, 17 bp, Homo sapiens
taattgagaatagaaat

SEQ ID NO: 5440177 - DNA, 20 bp, Homo sapiens
taattgatgatgttgtaaaa

SEQ ID NO: 5440178 - DNA, 12 bp, Homo sapiens
taattgattaaa

SEQ ID NO: 5440179 - DNA, 14 bp, Homo sapiens
taattgattaaaat

SEQ ID NO: 5440180 - DNA, 15 bp, Homo sapiens
taattgattaaaatc

SEQ ID NO: 5440181 - DNA, 13 bp, Homo sapiens
taattgattaaac

SEQ ID NO: 5440182 - DNA, 17 bp, Homo sapiens
taattgatttttcttct

SEQ ID NO: 5440183 - DNA, 16 bp, Homo sapiens
taattgcaacaatgca

SEQ ID NO: 5440184 - DNA, 19 bp, Homo sapiens
taattgcaacaatgcaaaa

SEQ ID NO: 5440185 - DNA, 23 bp, Homo sapiens
taattgcaccatagtatgctctg

SEQ ID NO: 5440186 - DNA, 22 bp, Homo sapiens
taattgcagataactttgactt

SEQ ID NO: 5440187 - DNA, 12 bp, Homo sapiens
taattgcatcag

SEQ ID NO: 5440188 - DNA, 12 bp, Homo sapiens
taattgcattca

SEQ ID NO: 5440189 - DNA, 20 bp, Homo sapiens
taattttgttttaaactgtg

SEQ ID NO: 5440190 - DNA, 16 bp, Homo sapiens
taattttgttttaatc

SEQ ID NO: 5440191 - DNA, 15 bp, Homo sapiens
taatttttaaaagac

SEQ ID NO: 5440192 - DNA, 21 bp, Homo sapiens
taatttttaaaagactttgat

SEQ ID NO: 5440193 - DNA, 13 bp, Homo sapiens
taatttttaaagt

SEQ ID NO: 5440194 - DNA, 13 bp, Homo sapiens
taatttttaaatg

SEQ ID NO: 5440195 - DNA, 15 bp, Homo sapiens
taatttttaaatgca

SEQ ID NO: 5440196 - DNA, 20 bp, Homo sapiens
taatttttaaatgtttatat

SEQ ID NO: 5440197 - DNA, 22 bp, Homo sapiens
taatttttaacttttggaatca

SEQ ID NO: 5440198 - DNA, 19 bp, Homo sapiens
taatttttaatgatgacaa

SEQ ID NO: 5440199 - DNA, 12 bp, Homo sapiens
taatttttaatt

SEQ ID NO: 5440200 - DNA, 14 bp, Homo sapiens
taatttttacatga

SEQ ID NO: 5440201 - DNA, 16 bp, Homo sapiens
taatttttacatgacc

SEQ ID NO: 5440202 - DNA, 21 bp, Homo sapiens
taatttttaccccctaaggaa

SEQ ID NO: 5440203 - DNA, 14 bp, Homo sapiens
taatttttacccta

SEQ ID NO: 5440204 - DNA, 18 bp, Homo sapiens
taatttttaccctaatgt

SEQ ID NO: 5440205 - DNA, 21 bp, Homo sapiens
taatttttaccctaatgtctt

SEQ ID NO: 5440206 - DNA, 14 bp, Homo sapiens
taatttttacctaa

SEQ ID NO: 5440207 - DNA, 18 bp, Homo sapiens
taatttttacctaatctc

SEQ ID NO: 5440208 - DNA, 22 bp, Homo sapiens
taatttttagatattcattaat

SEQ ID NO: 5440209 - DNA, 14 bp, Homo sapiens
taatttttataaat

SEQ ID NO: 5440210 - DNA, 21 bp, Homo sapiens
taatttttatatttgaaatat

SEQ ID NO: 5440211 - DNA, 23 bp, Homo sapiens
taatttttattcataagccaatt

SEQ ID NO: 5440212 - DNA, 23 bp, Homo sapiens
taatttttatttttgctgagact

SEQ ID NO: 5440213 - DNA, 14 bp, Homo sapiens
taatttttctgtat

SEQ ID NO: 5440214 - DNA, 15 bp, Homo sapiens
taatttttgaaaagc

SEQ ID NO: 5440215 - DNA, 21 bp, Homo sapiens
taatttttgatactaagcatt

SEQ ID NO: 5440216 - DNA, 13 bp, Homo sapiens
taatttttgcaat

SEQ ID NO: 5440217 - DNA, 20 bp, Homo sapiens
taatttttgcttttagaaaa

SEQ ID NO: 5440218 - DNA, 14 bp, Homo sapiens
taatttttggagaa

SEQ ID NO: 5440219 - DNA, 22 bp, Homo sapiens
taatttttggagaaatgtcata

SEQ ID NO: 5440220 - DNA, 14 bp, Homo sapiens
taatttttgtaatt

SEQ ID NO: 5440221 - DNA, 15 bp, Homo sapiens
taatttttgtacatt

SEQ ID NO: 5440222 - DNA, 16 bp, Homo sapiens
taatttttgtacatta

SEQ ID NO: 5440223 - DNA, 18 bp, Homo sapiens
taatttttgtatttttag

SEQ ID NO: 5440224 - DNA, 18 bp, Homo sapiens
taattttttaattattta

SEQ ID NO: 5440225 - DNA, 19 bp, Homo sapiens
taattttttagagagctgt

SEQ ID NO: 5440226 - DNA, 19 bp, Homo sapiens
taattttttagttaaaatc

SEQ ID NO: 5440227 - DNA, 17 bp, Homo sapiens
taattttttattcaagt

SEQ ID NO: 5440228 - DNA, 23 bp, Homo sapiens
taattttttgcagtcttttgctg

SEQ ID NO: 5440229 - DNA, 16 bp, Homo sapiens
taatttttttaaattt

SEQ ID NO: 5440230 - DNA, 14 bp, Homo sapiens
taatttttttaatt

SEQ ID NO: 5440231 - DNA, 17 bp, Homo sapiens
taatttttttatgtttt

SEQ ID NO: 5440232 - DNA, 18 bp, Homo sapiens
taatttttttattgttta

SEQ ID NO: 5440233 - DNA, 14 bp, Homo sapiens
taattttttttcct

SEQ ID NO: 5440234 - DNA, 16 bp, Homo sapiens
taatttttttttgtaa

SEQ ID NO: 5440235 - DNA, 18 bp, Homo sapiens
taatttttttttgtaaag

SEQ ID NO: 5440236 - DNA, 20 bp, Homo sapiens
tacaaaaaaaaagttttatt

SEQ ID NO: 5440237 - DNA, 22 bp, Homo sapiens
tacaaaaaaaagtgtattgcaa

SEQ ID NO: 5440238 - DNA, 22 bp, Homo sapiens
tacaaaaaaacctttattcttt

SEQ ID NO: 5440239 - DNA, 20 bp, Homo sapiens
tacaaaaaagttataagaaa

SEQ ID NO: 5440240 - DNA, 16 bp, Homo sapiens
tacaaaaaataaaata

SEQ ID NO: 5440241 - DNA, 13 bp, Homo sapiens
tacaaaaaattag

SEQ ID NO: 5440242 - DNA, 17 bp, Homo sapiens
tacaaaaaattagctgg

SEQ ID NO: 5440243 - DNA, 12 bp, Homo sapiens
tacaaaaacaaa

SEQ ID NO: 5440244 - DNA, 14 bp, Homo sapiens
tacaaaaacaaaac

SEQ ID NO: 5440245 - DNA, 18 bp, Homo sapiens
tacaaaaacatacttcaa

SEQ ID NO: 5440246 - DNA, 20 bp, Homo sapiens
tacaaaaacatacttcaaaa

SEQ ID NO: 5440247 - DNA, 21 bp, Homo sapiens
tacaaaaaccaaaaagttaaa

SEQ ID NO: 5440248 - DNA, 12 bp, Homo sapiens
tacaaaaagaag

SEQ ID NO: 5440249 - DNA, 15 bp, Homo sapiens
tacaaaaagaagagt

SEQ ID NO: 5440250 - DNA, 14 bp, Homo sapiens
tacaaaaataaatt

SEQ ID NO: 5440251 - DNA, 22 bp, Homo sapiens
tacaaaaatagtagaacaagca

SEQ ID NO: 5440252 - DNA, 14 bp, Homo sapiens
tacaaaaatataaa

SEQ ID NO: 5440253 - DNA, 16 bp, Homo sapiens
tacaaaaatatattaa

SEQ ID NO: 5440254 - DNA, 18 bp, Homo sapiens
tacaaaaatatattaaaa

SEQ ID NO: 5440255 - DNA, 20 bp, Homo sapiens
tacaaaaatatattaaaaat

SEQ ID NO: 5440256 - DNA, 21 bp, Homo sapiens
tacaaaaatatattaaaaata

SEQ ID NO: 5440257 - DNA, 17 bp, Homo sapiens
tacaaaaatcagccaga

SEQ ID NO: 5440258 - DNA, 18 bp, Homo sapiens
tacaaaaatcagccagac

SEQ ID NO: 5440259 - DNA, 22 bp, Homo sapiens
tacaaaaatgagctaggcatgg

SEQ ID NO: 5440260 - DNA, 14 bp, Homo sapiens
tacaaaacaaactc

SEQ ID NO: 5440261 - DNA, 12 bp, Homo sapiens
tacaaaacatta

SEQ ID NO: 5440262 - DNA, 16 bp, Homo sapiens
tacaaaacattaaact

SEQ ID NO: 5440263 - DNA, 21 bp, Homo sapiens
tacaaaaccacagtgtaccat

SEQ ID NO: 5440264 - DNA, 20 bp, Homo sapiens
tacaaaacgcgcagatgtgc

SEQ ID NO: 5440265 - DNA, 23 bp, Homo sapiens
tacaaaactattaagtatgtcaa

SEQ ID NO: 5440266 - DNA, 16 bp, Homo sapiens
tacaaaactgtaaata

SEQ ID NO: 5440267 - DNA, 21 bp, Homo sapiens
tacaaaagaagggctggtatt

SEQ ID NO: 5440268 - DNA, 16 bp, Homo sapiens
tacaaaagagcatgga

SEQ ID NO: 5440269 - DNA, 23 bp, Homo sapiens
tacaaaagaggagcacttccaaa

SEQ ID NO: 5440270 - DNA, 12 bp, Homo sapiens
tacaaaagcaaa

SEQ ID NO: 5440271 - DNA, 20 bp, Homo sapiens
tacaaaaggtttgagattcc

SEQ ID NO: 5440272 - DNA, 15 bp, Homo sapiens
tacaaaataaaaaca

SEQ ID NO: 5440273 - DNA, 18 bp, Homo sapiens
tacaaaataaaattatgg

SEQ ID NO: 5440274 - DNA, 19 bp, Homo sapiens
tacaaaataaagctgttct

SEQ ID NO: 5440275 - DNA, 21 bp, Homo sapiens
tacaaaataacattctgaatc

SEQ ID NO: 5440276 - DNA, 13 bp, Homo sapiens
tacaaaataattt

SEQ ID NO: 5440277 - DNA, 14 bp, Homo sapiens
tacaaaataattta

SEQ ID NO: 5440278 - DNA, 18 bp, Homo sapiens
tacaaaataatttaacta

SEQ ID NO: 5440279 - DNA, 20 bp, Homo sapiens
tacaaaatacaatcctgttt

SEQ ID NO: 5440280 - DNA, 21 bp, Homo sapiens
tacaaaatcctggaagatttt

SEQ ID NO: 5440281 - DNA, 13 bp, Homo sapiens
tacaaaatgaatg

SEQ ID NO: 5440282 - DNA, 17 bp, Homo sapiens
tacaaaatgaattgcct

SEQ ID NO: 5440283 - DNA, 18 bp, Homo sapiens
tacaaaatgattgtcttt

SEQ ID NO: 5440284 - DNA, 18 bp, Homo sapiens
tacaaaatgtaactgtta

SEQ ID NO: 5440285 - DNA, 23 bp, Homo sapiens
tacaaaatgtaactgttaccatt

SEQ ID NO: 5440286 - DNA, 14 bp, Homo sapiens
tacaaaattaagca

SEQ ID NO: 5440287 - DNA, 15 bp, Homo sapiens
tacaaaattaagcaa

SEQ ID NO: 5440288 - DNA, 12 bp, Homo sapiens
tacaaaatttat

SEQ ID NO: 5440289 - DNA, 16 bp, Homo sapiens
tacaaaatttattctc

SEQ ID NO: 5440290 - DNA, 10 bp, Homo sapiens
tacaaacaaa

SEQ ID NO: 5440291 - DNA, 18 bp, Homo sapiens
tacaaacaaaagcagccc

SEQ ID NO: 5440292 - DNA, 20 bp, Homo sapiens
tacaaacaaaagcagccctc

SEQ ID NO: 5440293 - DNA, 19 bp, Homo sapiens
tacaaacaaaggatttgaa

SEQ ID NO: 5440294 - DNA, 19 bp, Homo sapiens
tacaaacaagcatataaaa

SEQ ID NO: 5440295 - DNA, 17 bp, Homo sapiens
tacaaacaataagaaca

SEQ ID NO: 5440296 - DNA, 20 bp, Homo sapiens
tacaaacaatctcttaaatt

SEQ ID NO: 5440297 - DNA, 17 bp, Homo sapiens
tacaaacacctggactt

SEQ ID NO: 5440298 - DNA, 14 bp, Homo sapiens
tacaaacaggtgct

SEQ ID NO: 5440299 - DNA, 14 bp, Homo sapiens
tacaaaccaggagc

SEQ ID NO: 5440300 - DNA, 15 bp, Homo sapiens
tacaaaccaggagca

SEQ ID NO: 5440301 - DNA, 20 bp, Homo sapiens
tacaaaccaggtcaccatcc

SEQ ID NO: 5440302 - DNA, 13 bp, Homo sapiens
tacaaacctctca

SEQ ID NO: 5440303 - DNA, 22 bp, Homo sapiens
tacaaacctttagctgtgaatg

SEQ ID NO: 5440304 - DNA, 21 bp, Homo sapiens
tacaaacgtttgacaaacaca

SEQ ID NO: 5440305 - DNA, 15 bp, Homo sapiens
tacaaactatttcag

SEQ ID NO: 5440306 - DNA, 17 bp, Homo sapiens
tacaaactcagatcctt

SEQ ID NO: 5440307 - DNA, 12 bp, Homo sapiens
tacaaactctca

SEQ ID NO: 5440308 - DNA, 13 bp, Homo sapiens
tacaaactctcac

SEQ ID NO: 5440309 - DNA, 11 bp, Homo sapiens
tacaaactgca

SEQ ID NO: 5440310 - DNA, 22 bp, Homo sapiens
tacaaactgcaatagagactgt

SEQ ID NO: 5440311 - DNA, 15 bp, Homo sapiens
tacaaacttttaaga

SEQ ID NO: 5440312 - DNA, 23 bp, Homo sapiens
tacaaacttttaagatttctcta

SEQ ID NO: 5440313 - DNA, 16 bp, Homo sapiens
tacaaacttttataaa

SEQ ID NO: 5440314 - DNA, 18 bp, Homo sapiens
tacaaacttttataaatg

SEQ ID NO: 5440315 - DNA, 20 bp, Homo sapiens
tacaaacttttataaatgtt

SEQ ID NO: 5440316 - DNA, 22 bp, Homo sapiens
tacaaagaaaaattaattagga

SEQ ID NO: 5440317 - DNA, 14 bp, Homo sapiens
tacaaagaaaataa

SEQ ID NO: 5440318 - DNA, 19 bp, Homo sapiens
tacaaagaaagcacttctt

SEQ ID NO: 5440319 - DNA, 19 bp, Homo sapiens
tacaaagaaccaagaaaaa

SEQ ID NO: 5440320 - DNA, 19 bp, Homo sapiens
tacaaagaagacatgtttt

SEQ ID NO: 5440321 - DNA, 12 bp, Homo sapiens
tacaaagacagg

SEQ ID NO: 5440322 - DNA, 13 bp, Homo sapiens
tacaaagacaggg

SEQ ID NO: 5440323 - DNA, 19 bp, Homo sapiens
tacaaagagatgcttggag

SEQ ID NO: 5440324 - DNA, 19 bp, Homo sapiens
tacaaagagccttcctatt

SEQ ID NO: 5440325 - DNA, 20 bp, Homo sapiens
tacaaagatacttgatgcac

SEQ ID NO: 5440326 - DNA, 13 bp, Homo sapiens
tacaaagatgact

SEQ ID NO: 5440327 - DNA, 17 bp, Homo sapiens
tacaaagcccttttata

SEQ ID NO: 5440328 - DNA, 17 bp, Homo sapiens
tacaaagctgaagaaaa

SEQ ID NO: 5440329 - DNA, 18 bp, Homo sapiens
tacaaagctgaagaaaat

SEQ ID NO: 5440330 - DNA, 19 bp, Homo sapiens
tacaaagctttgctacaaa

SEQ ID NO: 5440331 - DNA, 14 bp, Homo sapiens
tacaaaggaaaaag

SEQ ID NO: 5440332 - DNA, 17 bp, Homo sapiens
tacaaaggaggacaaga

SEQ ID NO: 5440333 - DNA, 21 bp, Homo sapiens
tacaaaggcatgttttaaaat

SEQ ID NO: 5440334 - DNA, 23 bp, Homo sapiens
tacaaaggcatgttttaaaatct

SEQ ID NO: 5440335 - DNA, 20 bp, Homo sapiens
tacaaagggaaagcctctgg

SEQ ID NO: 5440336 - DNA, 21 bp, Homo sapiens
tacaaagggaaagcctctggc

SEQ ID NO: 5440337 - DNA, 22 bp, Homo sapiens
tacaaagggaaagcctctggcc

SEQ ID NO: 5440338 - DNA, 22 bp, Homo sapiens
tacaaagggaagcagagcctgg

SEQ ID NO: 5440339 - DNA, 19 bp, Homo sapiens
tacaaaggggaaagaacat

SEQ ID NO: 5440340 - DNA, 14 bp, Homo sapiens
tacaaaggtttaaa

SEQ ID NO: 5440341 - DNA, 15 bp, Homo sapiens
tacaaagtaaaatga

SEQ ID NO: 5440342 - DNA, 13 bp, Homo sapiens
tacaaagtaaata

SEQ ID NO: 5440343 - DNA, 15 bp, Homo sapiens
tacaaagtaaataca

SEQ ID NO: 5440344 - DNA, 16 bp, Homo sapiens
tacaaagtaatttctt

SEQ ID NO: 5440345 - DNA, 17 bp, Homo sapiens
tacaaagtaatttcttt

SEQ ID NO: 5440346 - DNA, 16 bp, Homo sapiens
tacaaagtagagaagt

SEQ ID NO: 5440347 - DNA, 19 bp, Homo sapiens
tacaaagtattaagcatat

SEQ ID NO: 5440348 - DNA, 14 bp, Homo sapiens
tacaaagtgtacca

SEQ ID NO: 5440349 - DNA, 18 bp, Homo sapiens
tacaaagtgtgtattaaa

SEQ ID NO: 5440350 - DNA, 19 bp, Homo sapiens
tacaaagtgtgtattaaaa

SEQ ID NO: 5440351 - DNA, 17 bp, Homo sapiens
tacaaagttaaaattgt

SEQ ID NO: 5440352 - DNA, 14 bp, Homo sapiens
tacaaagttcactg

SEQ ID NO: 5440353 - DNA, 16 bp, Homo sapiens
tacaaagttttccttt

SEQ ID NO: 5440354 - DNA, 14 bp, Homo sapiens
tacaaataaacagt

SEQ ID NO: 5440355 - DNA, 15 bp, Homo sapiens
tacaaataaacagtt

SEQ ID NO: 5440356 - DNA, 17 bp, Homo sapiens
tacaaataaacagttgt

SEQ ID NO: 5440357 - DNA, 19 bp, Homo sapiens
tacaaataaacagttgtta

SEQ ID NO: 5440358 - DNA, 15 bp, Homo sapiens
tacaaataaacctga

SEQ ID NO: 5440359 - DNA, 17 bp, Homo sapiens
tacaaataaacctgagg

SEQ ID NO: 5440360 - DNA, 19 bp, Homo sapiens
tacaaataaatccaagact

SEQ ID NO: 5440361 - DNA, 17 bp, Homo sapiens
tacaaataatttagaaa

SEQ ID NO: 5440362 - DNA, 16 bp, Homo sapiens
tacaaataattttttg

SEQ ID NO: 5440363 - DNA, 19 bp, Homo sapiens
tacaaatactcttaggaag

SEQ ID NO: 5440364 - DNA, 15 bp, Homo sapiens
tacaaataggtagag

SEQ ID NO: 5440365 - DNA, 18 bp, Homo sapiens
tacaaatataagaataaa

SEQ ID NO: 5440366 - DNA, 15 bp, Homo sapiens
tacaaatataggttt

SEQ ID NO: 5440367 - DNA, 20 bp, Homo sapiens
tacactgtaagctttgttct

SEQ ID NO: 5440368 - DNA, 21 bp, Homo sapiens
tacactgtaagctttgttctg

SEQ ID NO: 5440369 - DNA, 22 bp, Homo sapiens
tacactgtaagctttgttctgg

SEQ ID NO: 5440370 - DNA, 15 bp, Homo sapiens
tacactgtaccatat

SEQ ID NO: 5440371 - DNA, 16 bp, Homo sapiens
tacactgtataactgt

SEQ ID NO: 5440372 - DNA, 17 bp, Homo sapiens
tacactgtataactgtt

SEQ ID NO: 5440373 - DNA, 13 bp, Homo sapiens
tacactgtatcta

SEQ ID NO: 5440374 - DNA, 16 bp, Homo sapiens
tacactgtatttgtat

SEQ ID NO: 5440375 - DNA, 22 bp, Homo sapiens
tacactgtgctgagtctgaagg

SEQ ID NO: 5440376 - DNA, 14 bp, Homo sapiens
tacactgtgtctct

SEQ ID NO: 5440377 - DNA, 19 bp, Homo sapiens
tacactgtgtctctatgtg

SEQ ID NO: 5440378 - DNA, 20 bp, Homo sapiens
tacactgtgtctctatgtga

SEQ ID NO: 5440379 - DNA, 19 bp, Homo sapiens
tacactgttagaacactat

SEQ ID NO: 5440380 - DNA, 13 bp, Homo sapiens
tacactgttattt

SEQ ID NO: 5440381 - DNA, 15 bp, Homo sapiens
tacactgttattttc

SEQ ID NO: 5440382 - DNA, 14 bp, Homo sapiens
tacactgtttcaaa

SEQ ID NO: 5440383 - DNA, 17 bp, Homo sapiens
tacactgtttcaaactt

SEQ ID NO: 5440384 - DNA, 17 bp, Homo sapiens
tacactgtttcatctca

SEQ ID NO: 5440385 - DNA, 22 bp, Homo sapiens
tacactgtttcatctcagcttt

SEQ ID NO: 5440386 - DNA, 13 bp, Homo sapiens
tacacttaaaaga

SEQ ID NO: 5440387 - DNA, 15 bp, Homo sapiens
tacacttacaagtaa

SEQ ID NO: 5440388 - DNA, 16 bp, Homo sapiens
tacacttacactttat

SEQ ID NO: 5440389 - DNA, 19 bp, Homo sapiens
tacacttactgttgtccta

SEQ ID NO: 5440390 - DNA, 21 bp, Homo sapiens
tacacttactgttgtcctatg

SEQ ID NO: 5440391 - DNA, 15 bp, Homo sapiens
tacacttatttgtca

SEQ ID NO: 5440392 - DNA, 17 bp, Homo sapiens
tacacttcacctccttc

SEQ ID NO: 5440393 - DNA, 18 bp, Homo sapiens
tacacttcacctccttct

SEQ ID NO: 5440394 - DNA, 20 bp, Homo sapiens
tacacttctcaaatgctact

SEQ ID NO: 5440395 - DNA, 18 bp, Homo sapiens
tacacttctggctcacag

SEQ ID NO: 5440396 - DNA, 14 bp, Homo sapiens
tacacttgccctgc

SEQ ID NO: 5440397 - DNA, 19 bp, Homo sapiens
tacacttgctttatttttc

SEQ ID NO: 5440398 - DNA, 20 bp, Homo sapiens
tacacttgctttatttttca

SEQ ID NO: 5440399 - DNA, 13 bp, Homo sapiens
tacacttggagcc

SEQ ID NO: 5440400 - DNA, 17 bp, Homo sapiens
tacacttggatttcatt

SEQ ID NO: 5440401 - DNA, 15 bp, Homo sapiens
tacacttgtaaataa

SEQ ID NO: 5440402 - DNA, 18 bp, Homo sapiens
tacacttgtataaatgta

SEQ ID NO: 5440403 - DNA, 22 bp, Homo sapiens
tacacttgtataaatgtatata

SEQ ID NO: 5440404 - DNA, 13 bp, Homo sapiens
tacacttgtgaat

SEQ ID NO: 5440405 - DNA, 21 bp, Homo sapiens
tacactttatgccggatgtgc

SEQ ID NO: 5440406 - DNA, 22 bp, Homo sapiens
tacactttgttgcaagatgtga

SEQ ID NO: 5440407 - DNA, 16 bp, Homo sapiens
tacacttttatttcct

SEQ ID NO: 5440408 - DNA, 15 bp, Homo sapiens
tacactttttacagc

SEQ ID NO: 5440409 - DNA, 17 bp, Homo sapiens
tacacttttttccaaag

SEQ ID NO: 5440410 - DNA, 20 bp, Homo sapiens
tacagaaaaaccttgggtta

SEQ ID NO: 5440411 - DNA, 14 bp, Homo sapiens
tacagaaaagaaat

SEQ ID NO: 5440412 - DNA, 18 bp, Homo sapiens
tacagaaaagttgaattt

SEQ ID NO: 5440413 - DNA, 16 bp, Homo sapiens
tacagaaaatgctggc

SEQ ID NO: 5440414 - DNA, 19 bp, Homo sapiens
tacagaaaatttgcaacat

SEQ ID NO: 5440415 - DNA, 16 bp, Homo sapiens
tacagaaacaactgcc

SEQ ID NO: 5440416 - DNA, 17 bp, Homo sapiens
tacagaaacaactgcca

SEQ ID NO: 5440417 - DNA, 18 bp, Homo sapiens
tacagaaacaactgccaa

SEQ ID NO: 5440418 - DNA, 21 bp, Homo sapiens
tacagaaagaaaaatgcatta

SEQ ID NO: 5440419 - DNA, 14 bp, Homo sapiens
tacagaaagctgcc

SEQ ID NO: 5440420 - DNA, 19 bp, Homo sapiens
tacagaaataacagctggg

SEQ ID NO: 5440421 - DNA, 19 bp, Homo sapiens
tacagaaatactataacat

SEQ ID NO: 5440422 - DNA, 22 bp, Homo sapiens
tacagaaatactataacatatg

SEQ ID NO: 5440423 - DNA, 15 bp, Homo sapiens
tacagaaatgcaaaa

SEQ ID NO: 5440424 - DNA, 18 bp, Homo sapiens
tacagaaattagccgggc

SEQ ID NO: 5440425 - DNA, 14 bp, Homo sapiens
tacagaacaaagaa

SEQ ID NO: 5440426 - DNA, 19 bp, Homo sapiens
tacagaacacgctttcaca

SEQ ID NO: 5440427 - DNA, 18 bp, Homo sapiens
tacagaacagagggccag

SEQ ID NO: 5440428 - DNA, 19 bp, Homo sapiens
tacagaaccaattcacttt

SEQ ID NO: 5440429 - DNA, 22 bp, Homo sapiens
tacagaaccaattcactttaga

SEQ ID NO: 5440430 - DNA, 20 bp, Homo sapiens
tacagaaccagcactcccag

SEQ ID NO: 5440431 - DNA, 23 bp, Homo sapiens
tacagaaccagcactcccagggc

SEQ ID NO: 5440432 - DNA, 23 bp, Homo sapiens
tacagaacccattccatttatct

SEQ ID NO: 5440433 - DNA, 15 bp, Homo sapiens
tacagaagaaaataa

SEQ ID NO: 5440434 - DNA, 13 bp, Homo sapiens
tacagaagcagga

SEQ ID NO: 5440435 - DNA, 22 bp, Homo sapiens
tacagaagccaagctccctgga

SEQ ID NO: 5440436 - DNA, 16 bp, Homo sapiens
tacagaataatccagt

SEQ ID NO: 5440437 - DNA, 23 bp, Homo sapiens
tacagaataatccagtattgctg

SEQ ID NO: 5440438 - DNA, 18 bp, Homo sapiens
tacagaataatgtgttaa

SEQ ID NO: 5440439 - DNA, 13 bp, Homo sapiens
tacagaatactag

SEQ ID NO: 5440440 - DNA, 17 bp, Homo sapiens
tacagaatagggtggca

SEQ ID NO: 5440441 - DNA, 16 bp, Homo sapiens
tacagaatattaaata

SEQ ID NO: 5440442 - DNA, 17 bp, Homo sapiens
tacagaatattaaatat

SEQ ID NO: 5440443 - DNA, 17 bp, Homo sapiens
tacagaatcattgctta

SEQ ID NO: 5440444 - DNA, 18 bp, Homo sapiens
tacagaatcttgttttga

SEQ ID NO: 5440445 - DNA, 19 bp, Homo sapiens
tacagaatgcattaaaaaa

SEQ ID NO: 5440446 - DNA, 21 bp, Homo sapiens
tacagaatgcggcctctgaga

SEQ ID NO: 5440447 - DNA, 23 bp, Homo sapiens
tacagaattactgtaactgatta

SEQ ID NO: 5440448 - DNA, 18 bp, Homo sapiens
tacagaattctgctacct

SEQ ID NO: 5440449 - DNA, 20 bp, Homo sapiens
tacagaattgactgcagttg

SEQ ID NO: 5440450 - DNA, 17 bp, Homo sapiens
tacagaatttccactgt

SEQ ID NO: 5440451 - DNA, 16 bp, Homo sapiens
tacagaatttgaatta

SEQ ID NO: 5440452 - DNA, 12 bp, Homo sapiens
tacagaattttt

SEQ ID NO: 5440453 - DNA, 20 bp, Homo sapiens
tacagaatttttaatgactt

SEQ ID NO: 5440454 - DNA, 21 bp, Homo sapiens
tacagacaaacttgatttctt

SEQ ID NO: 5440455 - DNA, 18 bp, Homo sapiens
tacagacaaggttctgcc

SEQ ID NO: 5440456 - DNA, 14 bp, Homo sapiens
tacagacactaagt

SEQ ID NO: 5440457 - DNA, 18 bp, Homo sapiens
tacagacactaagttata

SEQ ID NO: 5440458 - DNA, 21 bp, Homo sapiens
tacagacagcttacaggagcc

SEQ ID NO: 5440459 - DNA, 23 bp, Homo sapiens
tacagacagcttacaggagccag

SEQ ID NO: 5440460 - DNA, 14 bp, Homo sapiens
tacagacatattta

SEQ ID NO: 5440461 - DNA, 15 bp, Homo sapiens
tacagacatatttaa

SEQ ID NO: 5440462 - DNA, 19 bp, Homo sapiens
tacagacatggaacagtgt

SEQ ID NO: 5440463 - DNA, 18 bp, Homo sapiens
tacagacattcaatgaat

SEQ ID NO: 5440464 - DNA, 16 bp, Homo sapiens
tacagaccatctgtat

SEQ ID NO: 5440465 - DNA, 16 bp, Homo sapiens
tacagacccacagagt

SEQ ID NO: 5440466 - DNA, 19 bp, Homo sapiens
tacagaccgagaggccagt

SEQ ID NO: 5440467 - DNA, 20 bp, Homo sapiens
tacagaccgagaggccagtt

SEQ ID NO: 5440468 - DNA, 16 bp, Homo sapiens
tacagacctaatatca

SEQ ID NO: 5440469 - DNA, 22 bp, Homo sapiens
tacagacctaatatcattttat

SEQ ID NO: 5440470 - DNA, 15 bp, Homo sapiens
tacagacctgctttt

SEQ ID NO: 5440471 - DNA, 16 bp, Homo sapiens
tacagacctgcttttt

SEQ ID NO: 5440472 - DNA, 21 bp, Homo sapiens
tacagacctgctttttgaaat

SEQ ID NO: 5440473 - DNA, 23 bp, Homo sapiens
tacagacctgctttttgaaatga

SEQ ID NO: 5440474 - DNA, 20 bp, Homo sapiens
tacagacctggctctcagag

SEQ ID NO: 5440475 - DNA, 17 bp, Homo sapiens
tacagacgctgctgtca

SEQ ID NO: 5440476 - DNA, 16 bp, Homo sapiens
tacagacgtatgctta

SEQ ID NO: 5440477 - DNA, 17 bp, Homo sapiens
tacagacgtatgcttat

SEQ ID NO: 5440478 - DNA, 22 bp, Homo sapiens
tacagacgtctcaagactgaaa

SEQ ID NO: 5440479 - DNA, 15 bp, Homo sapiens
tacagactccatctc

SEQ ID NO: 5440480 - DNA, 13 bp, Homo sapiens
tacagactctgat

SEQ ID NO: 5440481 - DNA, 18 bp, Homo sapiens
tacagactgcagacattc

SEQ ID NO: 5440482 - DNA, 19 bp, Homo sapiens
tacagactggatgtaccac

SEQ ID NO: 5440483 - DNA, 19 bp, Homo sapiens
tacagactgttttactgtt

SEQ ID NO: 5440484 - DNA, 14 bp, Homo sapiens
tacagacttctcca

SEQ ID NO: 5440485 - DNA, 15 bp, Homo sapiens
tacagagaaaccagc

SEQ ID NO: 5440486 - DNA, 16 bp, Homo sapiens
tacagagaaagaaatt

SEQ ID NO: 5440487 - DNA, 14 bp, Homo sapiens
tacagagaagaaaa

SEQ ID NO: 5440488 - DNA, 15 bp, Homo sapiens
tacagagaagccagc

SEQ ID NO: 5440489 - DNA, 17 bp, Homo sapiens
tacagagaagccagctt

SEQ ID NO: 5440490 - DNA, 20 bp, Homo sapiens
tacagagaagccagcttgtt

SEQ ID NO: 5440491 - DNA, 15 bp, Homo sapiens
tacagagaagccatc

SEQ ID NO: 5440492 - DNA, 16 bp, Homo sapiens
tacagagaagccttca

SEQ ID NO: 5440493 - DNA, 20 bp, Homo sapiens
tacagagaagccttcaagct

SEQ ID NO: 5440494 - DNA, 14 bp, Homo sapiens
tacagagaaggaat

SEQ ID NO: 5440495 - DNA, 13 bp, Homo sapiens
tacagagaagtca

SEQ ID NO: 5440496 - DNA, 17 bp, Homo sapiens
tacagagacagaaagca

SEQ ID NO: 5440497 - DNA, 13 bp, Homo sapiens
tacagagactcta

SEQ ID NO: 5440498 - DNA, 15 bp, Homo sapiens
tacagagactctatt

SEQ ID NO: 5440499 - DNA, 22 bp, Homo sapiens
tacagagactctattttaatgt

SEQ ID NO: 5440500 - DNA, 23 bp, Homo sapiens
tacagagactctattttaatgta

SEQ ID NO: 5440501 - DNA, 17 bp, Homo sapiens
tacagagaggagaaaca

SEQ ID NO: 5440502 - DNA, 18 bp, Homo sapiens
tacagagaggagaaacac

SEQ ID NO: 5440503 - DNA, 18 bp, Homo sapiens
tacagagatataaatgaa

SEQ ID NO: 5440504 - DNA, 14 bp, Homo sapiens
tacagagcaggcca

SEQ ID NO: 5440505 - DNA, 18 bp, Homo sapiens
tacagagccaaaatgcca

SEQ ID NO: 5440506 - DNA, 17 bp, Homo sapiens
tacagagcctgttttaa

SEQ ID NO: 5440507 - DNA, 13 bp, Homo sapiens
tacagagctgtgg

SEQ ID NO: 5440508 - DNA, 15 bp, Homo sapiens
tacagagcttccctg

SEQ ID NO: 5440509 - DNA, 16 bp, Homo sapiens
tacagagcttccctga

SEQ ID NO: 5440510 - DNA, 17 bp, Homo sapiens
tacagagcttgaaaact

SEQ ID NO: 5440511 - DNA, 15 bp, Homo sapiens
tacagaggaaatctg

SEQ ID NO: 5440512 - DNA, 18 bp, Homo sapiens
tacagaggaaatctgtaa

SEQ ID NO: 5440513 - DNA, 17 bp, Homo sapiens
tacagaggaggcctcaa

SEQ ID NO: 5440514 - DNA, 19 bp, Homo sapiens
tacagaggaggcctcaaag

SEQ ID NO: 5440515 - DNA, 19 bp, Homo sapiens
tacagaggatgccttttct

SEQ ID NO: 5440516 - DNA, 17 bp, Homo sapiens
tacagaggattctgtct

SEQ ID NO: 5440517 - DNA, 11 bp, Homo sapiens
tacagaggtga

SEQ ID NO: 5440518 - DNA, 20 bp, Homo sapiens
tacagagtggaataagacag

SEQ ID NO: 5440519 - DNA, 20 bp, Homo sapiens
tacagagtggcccctcacct

SEQ ID NO: 5440520 - DNA, 16 bp, Homo sapiens
tacagataacttcttt

SEQ ID NO: 5440521 - DNA, 20 bp, Homo sapiens
tacagataaggaaactgagg

SEQ ID NO: 5440522 - DNA, 17 bp, Homo sapiens
tacagataattcatttg

SEQ ID NO: 5440523 - DNA, 19 bp, Homo sapiens
tacagataatttattttgt

SEQ ID NO: 5440524 - DNA, 19 bp, Homo sapiens
tacagatagagagttgttg

SEQ ID NO: 5440525 - DNA, 18 bp, Homo sapiens
tacagatcaggcagtgtt

SEQ ID NO: 5440526 - DNA, 20 bp, Homo sapiens
tacagatccccaagcctggc

SEQ ID NO: 5440527 - DNA, 13 bp, Homo sapiens
tacagatccccag

SEQ ID NO: 5440528 - DNA, 15 bp, Homo sapiens
tacagatccccagcc

SEQ ID NO: 5440529 - DNA, 16 bp, Homo sapiens
tacagatccgcatgtg

SEQ ID NO: 5440530 - DNA, 18 bp, Homo sapiens
tacagatccgcatgtgtc

SEQ ID NO: 5440531 - DNA, 21 bp, Homo sapiens
tacagatccgcatgtgtctgt

SEQ ID NO: 5440532 - DNA, 22 bp, Homo sapiens
tacagatccgcatgtgtctgta

SEQ ID NO: 5440533 - DNA, 19 bp, Homo sapiens
tacagatcctctggggttt

SEQ ID NO: 5440534 - DNA, 16 bp, Homo sapiens
tacagatctcagggct

SEQ ID NO: 5440535 - DNA, 18 bp, Homo sapiens
tacagatgagattccctc

SEQ ID NO: 5440536 - DNA, 17 bp, Homo sapiens
tacagatgcaagcaagg

SEQ ID NO: 5440537 - DNA, 21 bp, Homo sapiens
tacagatggcatacctgtgcc

SEQ ID NO: 5440538 - DNA, 16 bp, Homo sapiens
tacagatgtagatata

SEQ ID NO: 5440539 - DNA, 17 bp, Homo sapiens
tacagatgtgaaaataa

SEQ ID NO: 5440540 - DNA, 23 bp, Homo sapiens
tacagattaacctgaaagaacat

SEQ ID NO: 5440541 - DNA, 21 bp, Homo sapiens
tacagattgggcggggcttct

SEQ ID NO: 5440542 - DNA, 19 bp, Homo sapiens
tacagatttagtttaccaa

SEQ ID NO: 5440543 - DNA, 17 bp, Homo sapiens
tacagatttattccttt

SEQ ID NO: 5440544 - DNA, 17 bp, Homo sapiens
tacatacgcaattgtat

SEQ ID NO: 5440545 - DNA, 18 bp, Homo sapiens
tacatacgcaattgtata

SEQ ID NO: 5440546 - DNA, 19 bp, Homo sapiens
tacatacgtgttctataga

SEQ ID NO: 5440547 - DNA, 13 bp, Homo sapiens
tacatactaatga

SEQ ID NO: 5440548 - DNA, 15 bp, Homo sapiens
tacatactaatgaag

SEQ ID NO: 5440549 - DNA, 19 bp, Homo sapiens
tacatactatgaaatatgt

SEQ ID NO: 5440550 - DNA, 14 bp, Homo sapiens
tacatactgccgaa

SEQ ID NO: 5440551 - DNA, 13 bp, Homo sapiens
tacatactgctgt

SEQ ID NO: 5440552 - DNA, 15 bp, Homo sapiens
tacatactggcctct

SEQ ID NO: 5440553 - DNA, 17 bp, Homo sapiens
tacatactggcctctgt

SEQ ID NO: 5440554 - DNA, 15 bp, Homo sapiens
tacatactttatcaa

SEQ ID NO: 5440555 - DNA, 23 bp, Homo sapiens
tacatactttcatcctgactctg

SEQ ID NO: 5440556 - DNA, 17 bp, Homo sapiens
tacatacttttgcaaaa

SEQ ID NO: 5440557 - DNA, 14 bp, Homo sapiens
tacatactttttgg

SEQ ID NO: 5440558 - DNA, 12 bp, Homo sapiens
tacatagacatt

SEQ ID NO: 5440559 - DNA, 14 bp, Homo sapiens
tacatagagcaatg

SEQ ID NO: 5440560 - DNA, 22 bp, Homo sapiens
tacatagagcaatgttggtttt

SEQ ID NO: 5440561 - DNA, 14 bp, Homo sapiens
tacatagagctcta

SEQ ID NO: 5440562 - DNA, 12 bp, Homo sapiens
tacatagatcag

SEQ ID NO: 5440563 - DNA, 22 bp, Homo sapiens
tacatagatcagccattaaaat

SEQ ID NO: 5440564 - DNA, 14 bp, Homo sapiens
tacatagatgctta

SEQ ID NO: 5440565 - DNA, 17 bp, Homo sapiens
tacatagatgcttagtc

SEQ ID NO: 5440566 - DNA, 13 bp, Homo sapiens
tacatagatggac

SEQ ID NO: 5440567 - DNA, 18 bp, Homo sapiens
tacatagatgtatcatta

SEQ ID NO: 5440568 - DNA, 21 bp, Homo sapiens
tacatagatttatttttcagt

SEQ ID NO: 5440569 - DNA, 22 bp, Homo sapiens
tacataggaaccaaatcaatga

SEQ ID NO: 5440570 - DNA, 13 bp, Homo sapiens
tacataggtctgt

SEQ ID NO: 5440571 - DNA, 18 bp, Homo sapiens
tacatagtcacaaaaatg

SEQ ID NO: 5440572 - DNA, 20 bp, Homo sapiens
tacatagtcacaaaaatggt

SEQ ID NO: 5440573 - DNA, 19 bp, Homo sapiens
tacatagtctttgtttaca

SEQ ID NO: 5440574 - DNA, 20 bp, Homo sapiens
tacatagtctttgtttacat

SEQ ID NO: 5440575 - DNA, 15 bp, Homo sapiens
tacatagtgaatttt

SEQ ID NO: 5440576 - DNA, 17 bp, Homo sapiens
tacatagtgaattttaa

SEQ ID NO: 5440577 - DNA, 22 bp, Homo sapiens
tacatagtgaattttaaaatgt

SEQ ID NO: 5440578 - DNA, 21 bp, Homo sapiens
tacatagtgctaacatgaaga

SEQ ID NO: 5440579 - DNA, 23 bp, Homo sapiens
tacatagtgctaacatgaagacc

SEQ ID NO: 5440580 - DNA, 17 bp, Homo sapiens
tacatagtgctgctgtg

SEQ ID NO: 5440581 - DNA, 18 bp, Homo sapiens
tacatagttgagattgta

SEQ ID NO: 5440582 - DNA, 21 bp, Homo sapiens
tacatagttttaaactcattt

SEQ ID NO: 5440583 - DNA, 23 bp, Homo sapiens
tacatagttttcttcctttgaaa

SEQ ID NO: 5440584 - DNA, 22 bp, Homo sapiens
tacatataaatgaatctggtgt

SEQ ID NO: 5440585 - DNA, 22 bp, Homo sapiens
tacatataagtgattgctggtt

SEQ ID NO: 5440586 - DNA, 19 bp, Homo sapiens
tacatatatacattttgca

SEQ ID NO: 5440587 - DNA, 18 bp, Homo sapiens
tacatatatatatataac

SEQ ID NO: 5440588 - DNA, 17 bp, Homo sapiens
tacatatatatatttgt

SEQ ID NO: 5440589 - DNA, 15 bp, Homo sapiens
tacatatatatctga

SEQ ID NO: 5440590 - DNA, 12 bp, Homo sapiens
tacatatatatt

SEQ ID NO: 5440591 - DNA, 13 bp, Homo sapiens
tacatatatctac

SEQ ID NO: 5440592 - DNA, 17 bp, Homo sapiens
tacatatatctacacat

SEQ ID NO: 5440593 - DNA, 18 bp, Homo sapiens
tacatatatctacacata

SEQ ID NO: 5440594 - DNA, 14 bp, Homo sapiens
tacatatatgtata

SEQ ID NO: 5440595 - DNA, 17 bp, Homo sapiens
tacatatcagaaaagta

SEQ ID NO: 5440596 - DNA, 22 bp, Homo sapiens
tacatatcagaaaagtagaatt

SEQ ID NO: 5440597 - DNA, 23 bp, Homo sapiens
tacatatcgctgacttcatggaa

SEQ ID NO: 5440598 - DNA, 17 bp, Homo sapiens
tacatatctttgagttc

SEQ ID NO: 5440599 - DNA, 22 bp, Homo sapiens
tacatatgagtgtggaagccgg

SEQ ID NO: 5440600 - DNA, 18 bp, Homo sapiens
tacatatgatcaaatact

SEQ ID NO: 5440601 - DNA, 19 bp, Homo sapiens
tacatatggaaatcctgtt

SEQ ID NO: 5440602 - DNA, 22 bp, Homo sapiens
tacatatggaaatcctgttact

SEQ ID NO: 5440603 - DNA, 15 bp, Homo sapiens
tacatatggaaatgt

SEQ ID NO: 5440604 - DNA, 19 bp, Homo sapiens
tacatatggatgttactct

SEQ ID NO: 5440605 - DNA, 17 bp, Homo sapiens
tacatatgtaaaataaa

SEQ ID NO: 5440606 - DNA, 20 bp, Homo sapiens
tacatatgtaaaataaaatt

SEQ ID NO: 5440607 - DNA, 19 bp, Homo sapiens
tacatatgtaaaatattgt

SEQ ID NO: 5440608 - DNA, 20 bp, Homo sapiens
tacatatgtaaaatattgtt

SEQ ID NO: 5440609 - DNA, 13 bp, Homo sapiens
tacatatgtaaac

SEQ ID NO: 5440610 - DNA, 14 bp, Homo sapiens
tacatatgtaaaca

SEQ ID NO: 5440611 - DNA, 21 bp, Homo sapiens
tacatatgtagaaacatttag

SEQ ID NO: 5440612 - DNA, 15 bp, Homo sapiens
tacatatgtagacta

SEQ ID NO: 5440613 - DNA, 22 bp, Homo sapiens
tacatatgtagactatatacat

SEQ ID NO: 5440614 - DNA, 17 bp, Homo sapiens
tacatatgtatacatgt

SEQ ID NO: 5440615 - DNA, 18 bp, Homo sapiens
tacatatgtatacatgtg

SEQ ID NO: 5440616 - DNA, 17 bp, Homo sapiens
tacatatgtatgtgtga

SEQ ID NO: 5440617 - DNA, 16 bp, Homo sapiens
tacatattacaagaaa

SEQ ID NO: 5440618 - DNA, 14 bp, Homo sapiens
tacatattactgtt

SEQ ID NO: 5440619 - DNA, 20 bp, Homo sapiens
tacatattataaataaatgc

SEQ ID NO: 5440620 - DNA, 21 bp, Homo sapiens
tacatattataaataaatgcc

SEQ ID NO: 5440621 - DNA, 22 bp, Homo sapiens
tacatattataaataaatgcca

SEQ ID NO: 5440622 - DNA, 14 bp, Homo sapiens
tacatattcaaagt

SEQ ID NO: 5440623 - DNA, 20 bp, Homo sapiens
tacatattgcaggagacatt

SEQ ID NO: 5440624 - DNA, 22 bp, Homo sapiens
tacatattgcaggagacatttt

SEQ ID NO: 5440625 - DNA, 17 bp, Homo sapiens
tacatattgtgaatgta

SEQ ID NO: 5440626 - DNA, 14 bp, Homo sapiens
tacatatttacctg

SEQ ID NO: 5440627 - DNA, 17 bp, Homo sapiens
tacatatttattttctt

SEQ ID NO: 5440628 - DNA, 18 bp, Homo sapiens
tacatatttgactctttc

SEQ ID NO: 5440629 - DNA, 19 bp, Homo sapiens
tacatatttgactctttca

SEQ ID NO: 5440630 - DNA, 13 bp, Homo sapiens
tacatatttgtat

SEQ ID NO: 5440631 - DNA, 17 bp, Homo sapiens
tacatatttttgtagca

SEQ ID NO: 5440632 - DNA, 23 bp, Homo sapiens
tacatcaaatcagtcctttgatt

SEQ ID NO: 5440633 - DNA, 16 bp, Homo sapiens
tacatcaacaagaaga

SEQ ID NO: 5440634 - DNA, 13 bp, Homo sapiens
tacatcaattaat

SEQ ID NO: 5440635 - DNA, 20 bp, Homo sapiens
tacatcaattggaaatcaat

SEQ ID NO: 5440636 - DNA, 21 bp, Homo sapiens
tacatcaatttaaaaagcaaa

SEQ ID NO: 5440637 - DNA, 21 bp, Homo sapiens
tacatcacatcttatttattt

SEQ ID NO: 5440638 - DNA, 23 bp, Homo sapiens
tacatcacctttttgacttttcc

SEQ ID NO: 5440639 - DNA, 15 bp, Homo sapiens
tacatcactgcttga

SEQ ID NO: 5440640 - DNA, 19 bp, Homo sapiens
tacatcactgcttgatgaa

SEQ ID NO: 5440641 - DNA, 22 bp, Homo sapiens
tacatcactgcttgatgaagca

SEQ ID NO: 5440642 - DNA, 16 bp, Homo sapiens
tacatcacttcctgtt

SEQ ID NO: 5440643 - DNA, 19 bp, Homo sapiens
tacatcacttcctgtttta

SEQ ID NO: 5440644 - DNA, 15 bp, Homo sapiens
tacatcagaaaataa

SEQ ID NO: 5440645 - DNA, 15 bp, Homo sapiens
tacatcagaagtttg

SEQ ID NO: 5440646 - DNA, 17 bp, Homo sapiens
tacatcagactctagaa

SEQ ID NO: 5440647 - DNA, 14 bp, Homo sapiens
tacatcagtttgat

SEQ ID NO: 5440648 - DNA, 17 bp, Homo sapiens
tacatcagtttgataca

SEQ ID NO: 5440649 - DNA, 23 bp, Homo sapiens
tacatcattattgtagtttgaaa

SEQ ID NO: 5440650 - DNA, 23 bp, Homo sapiens
tacatcattttttgtttcttcct

SEQ ID NO: 5440651 - DNA, 19 bp, Homo sapiens
tacatccaaagcagacagc

SEQ ID NO: 5440652 - DNA, 20 bp, Homo sapiens
tacatccaaagcagacagct

SEQ ID NO: 5440653 - DNA, 23 bp, Homo sapiens
tacatccagcttctcatgttaaa

SEQ ID NO: 5440654 - DNA, 17 bp, Homo sapiens
tacatcccaaaggatga

SEQ ID NO: 5440655 - DNA, 21 bp, Homo sapiens
tacatcccatgtaacagaaag

SEQ ID NO: 5440656 - DNA, 22 bp, Homo sapiens
tacatcccatgtaacagaaagg

SEQ ID NO: 5440657 - DNA, 22 bp, Homo sapiens
tacatccctcagtttcttaaaa

SEQ ID NO: 5440658 - DNA, 20 bp, Homo sapiens
tacatcccttacctgggaaa

SEQ ID NO: 5440659 - DNA, 20 bp, Homo sapiens
tacatccgtaggacaagttt

SEQ ID NO: 5440660 - DNA, 22 bp, Homo sapiens
tacatcctcatgcagccgtgat

SEQ ID NO: 5440661 - DNA, 13 bp, Homo sapiens
tacatcctgggta

SEQ ID NO: 5440662 - DNA, 19 bp, Homo sapiens
tacatccttgattacttcc

SEQ ID NO: 5440663 - DNA, 20 bp, Homo sapiens
tacatccttgtggcacattt

SEQ ID NO: 5440664 - DNA, 21 bp, Homo sapiens
tacatccttgtggcacatttt

SEQ ID NO: 5440665 - DNA, 17 bp, Homo sapiens
tacatctaagtcagttt

SEQ ID NO: 5440666 - DNA, 15 bp, Homo sapiens
tacatctaatgcttc

SEQ ID NO: 5440667 - DNA, 18 bp, Homo sapiens
tacatctagcacagctgt

SEQ ID NO: 5440668 - DNA, 19 bp, Homo sapiens
tacatctagcacagctgtg

SEQ ID NO: 5440669 - DNA, 19 bp, Homo sapiens
tacatctattttggattgt

SEQ ID NO: 5440670 - DNA, 20 bp, Homo sapiens
tacatctctaattttggata

SEQ ID NO: 5440671 - DNA, 15 bp, Homo sapiens
tacatctctccccaa

SEQ ID NO: 5440672 - DNA, 12 bp, Homo sapiens
tacatctgaaat

SEQ ID NO: 5440673 - DNA, 14 bp, Homo sapiens
tacatctgaaatct

SEQ ID NO: 5440674 - DNA, 19 bp, Homo sapiens
tacatctgaggtcctgtga

SEQ ID NO: 5440675 - DNA, 14 bp, Homo sapiens
tacatctgccttaa

SEQ ID NO: 5440676 - DNA, 15 bp, Homo sapiens
tacatctgctgtgtg

SEQ ID NO: 5440677 - DNA, 22 bp, Homo sapiens
tacatctggaatctgaggcatc

SEQ ID NO: 5440678 - DNA, 15 bp, Homo sapiens
tacatctggctggaa

SEQ ID NO: 5440679 - DNA, 15 bp, Homo sapiens
tacatctggcttatt

SEQ ID NO: 5440680 - DNA, 13 bp, Homo sapiens
tacatctgtcatg

SEQ ID NO: 5440681 - DNA, 23 bp, Homo sapiens
tacatctgtctttcatctcccag

SEQ ID NO: 5440682 - DNA, 20 bp, Homo sapiens
tacatctgtgcagggctggt

SEQ ID NO: 5440683 - DNA, 22 bp, Homo sapiens
tacatctgtgcagggctggttt

SEQ ID NO: 5440684 - DNA, 16 bp, Homo sapiens
tacatcttatttcctc

SEQ ID NO: 5440685 - DNA, 17 bp, Homo sapiens
tacatcttatttcctca

SEQ ID NO: 5440686 - DNA, 19 bp, Homo sapiens
tacatcttcagctcccata

SEQ ID NO: 5440687 - DNA, 21 bp, Homo sapiens
tacatcttcagctcccatagc

SEQ ID NO: 5440688 - DNA, 14 bp, Homo sapiens
tacatcttcattaa

SEQ ID NO: 5440689 - DNA, 17 bp, Homo sapiens
tacatcttctgccttag

SEQ ID NO: 5440690 - DNA, 22 bp, Homo sapiens
tacatcttctgtgaaatataat

SEQ ID NO: 5440691 - DNA, 16 bp, Homo sapiens
tacatcttcttcccag

SEQ ID NO: 5440692 - DNA, 16 bp, Homo sapiens
tacatcttctttggaa

SEQ ID NO: 5440693 - DNA, 21 bp, Homo sapiens
tacatcttctttggaaataaa

SEQ ID NO: 5440694 - DNA, 19 bp, Homo sapiens
tacatcttgtgcatgcaaa

SEQ ID NO: 5440695 - DNA, 21 bp, Homo sapiens
tacatcttgtgcatgcaaaaa

SEQ ID NO: 5440696 - DNA, 16 bp, Homo sapiens
tacatcttgttggtac

SEQ ID NO: 5440697 - DNA, 15 bp, Homo sapiens
tacatcttgtttctg

SEQ ID NO: 5440698 - DNA, 15 bp, Homo sapiens
tacatctttatcatt

SEQ ID NO: 5440699 - DNA, 21 bp, Homo sapiens
tacatctttatcattaaacat

SEQ ID NO: 5440700 - DNA, 14 bp, Homo sapiens
tacatctttcacat

SEQ ID NO: 5440701 - DNA, 16 bp, Homo sapiens
tacatcttttgggaag

SEQ ID NO: 5440702 - DNA, 17 bp, Homo sapiens
tacatcttttttcacaa

SEQ ID NO: 5440703 - DNA, 18 bp, Homo sapiens
tacatgaaaacacatttt

SEQ ID NO: 5440704 - DNA, 19 bp, Homo sapiens
tacatgaaaacacattttt

SEQ ID NO: 5440705 - DNA, 19 bp, Homo sapiens
tacatgaaaatttgtttga

SEQ ID NO: 5440706 - DNA, 21 bp, Homo sapiens
tacatgaaaattttaaaaata

SEQ ID NO: 5440707 - DNA, 13 bp, Homo sapiens
tacatgaaacaga

SEQ ID NO: 5440708 - DNA, 14 bp, Homo sapiens
tacatgaaacagaa

SEQ ID NO: 5440709 - DNA, 11 bp, Homo sapiens
tacatgaacac

SEQ ID NO: 5440710 - DNA, 17 bp, Homo sapiens
tacatgaacacaaatgt

SEQ ID NO: 5440711 - DNA, 16 bp, Homo sapiens
tacatgaacacagctg

SEQ ID NO: 5440712 - DNA, 23 bp, Homo sapiens
tacatgaacacagctgctgaaga

SEQ ID NO: 5440713 - DNA, 14 bp, Homo sapiens
tacatgaagaatgt

SEQ ID NO: 5440714 - DNA, 20 bp, Homo sapiens
tacatgaagttgtaagaaaa

SEQ ID NO: 5440715 - DNA, 20 bp, Homo sapiens
tacatgacactgaaatgcct

SEQ ID NO: 5440716 - DNA, 21 bp, Homo sapiens
tacatgacatttatttttcat

SEQ ID NO: 5440717 - DNA, 17 bp, Homo sapiens
tacatgaccagaaaaca

SEQ ID NO: 5440718 - DNA, 13 bp, Homo sapiens
tacatgactgggc

SEQ ID NO: 5440719 - DNA, 14 bp, Homo sapiens
tacatgactgggcc

SEQ ID NO: 5440720 - DNA, 18 bp, Homo sapiens
tacattgaaaacagatat

SEQ ID NO: 5440721 - DNA, 21 bp, Homo sapiens
tacattgacacacagaaatgt

SEQ ID NO: 5440722 - DNA, 21 bp, Homo sapiens
tacattgagcaaataaactta

SEQ ID NO: 5440723 - DNA, 14 bp, Homo sapiens
tacattgagcattt

SEQ ID NO: 5440724 - DNA, 19 bp, Homo sapiens
tacattgagcatttgaaag

SEQ ID NO: 5440725 - DNA, 22 bp, Homo sapiens
tacattgagtagacacatttaa

SEQ ID NO: 5440726 - DNA, 19 bp, Homo sapiens
tacattgatacaaagtaca

SEQ ID NO: 5440727 - DNA, 19 bp, Homo sapiens
tacattgccatttttaatt

SEQ ID NO: 5440728 - DNA, 17 bp, Homo sapiens
tacattgcctgactaaa

SEQ ID NO: 5440729 - DNA, 21 bp, Homo sapiens
tacattgctggtcttgtaaga

SEQ ID NO: 5440730 - DNA, 22 bp, Homo sapiens
tacattgctggtcttgtaagag

SEQ ID NO: 5440731 - DNA, 12 bp, Homo sapiens
tacattgcttaa

SEQ ID NO: 5440732 - DNA, 19 bp, Homo sapiens
tacattggaagcctgagca

SEQ ID NO: 5440733 - DNA, 19 bp, Homo sapiens
tacattggaagctttgagt

SEQ ID NO: 5440734 - DNA, 18 bp, Homo sapiens
tacattggctttttaaat

SEQ ID NO: 5440735 - DNA, 19 bp, Homo sapiens
tacattggtctttctacat

SEQ ID NO: 5440736 - DNA, 18 bp, Homo sapiens
tacattgtaaaataaagt

SEQ ID NO: 5440737 - DNA, 16 bp, Homo sapiens
tacattgtaacctgtt

SEQ ID NO: 5440738 - DNA, 23 bp, Homo sapiens
tacattgtaacctgtttgtcttt

SEQ ID NO: 5440739 - DNA, 22 bp, Homo sapiens
tacattgtacgaagagtatttt

SEQ ID NO: 5440740 - DNA, 21 bp, Homo sapiens
tacattgtataggccatctgt

SEQ ID NO: 5440741 - DNA, 22 bp, Homo sapiens
tacattgtataggccatctgta

SEQ ID NO: 5440742 - DNA, 16 bp, Homo sapiens
tacattgtcctgtagc

SEQ ID NO: 5440743 - DNA, 23 bp, Homo sapiens
tacattgtgggatgttcagcact

SEQ ID NO: 5440744 - DNA, 22 bp, Homo sapiens
tacattgtgtcctgcttatact

SEQ ID NO: 5440745 - DNA, 18 bp, Homo sapiens
tacattgtgttttcctaa

SEQ ID NO: 5440746 - DNA, 14 bp, Homo sapiens
tacattgttcaatt

SEQ ID NO: 5440747 - DNA, 15 bp, Homo sapiens
tacattgttcaatta

SEQ ID NO: 5440748 - DNA, 13 bp, Homo sapiens
tacattgttgagc

SEQ ID NO: 5440749 - DNA, 20 bp, Homo sapiens
tacatttaaaacattaaaat

SEQ ID NO: 5440750 - DNA, 20 bp, Homo sapiens
tacatttaaaagacagacat

SEQ ID NO: 5440751 - DNA, 17 bp, Homo sapiens
tacatttaaaattgcta

SEQ ID NO: 5440752 - DNA, 13 bp, Homo sapiens
tacatttaaacaa

SEQ ID NO: 5440753 - DNA, 17 bp, Homo sapiens
tacatttaaagcattgc

SEQ ID NO: 5440754 - DNA, 22 bp, Homo sapiens
tacatttaaagcattgctgtta

SEQ ID NO: 5440755 - DNA, 14 bp, Homo sapiens
tacatttaaatttt

SEQ ID NO: 5440756 - DNA, 19 bp, Homo sapiens
tacatttaataatatcaaa

SEQ ID NO: 5440757 - DNA, 17 bp, Homo sapiens
tacatttacaaactgaa

SEQ ID NO: 5440758 - DNA, 23 bp, Homo sapiens
tacatttagaacctgcatttaag

SEQ ID NO: 5440759 - DNA, 20 bp, Homo sapiens
tacatttatagttgtaacta

SEQ ID NO: 5440760 - DNA, 13 bp, Homo sapiens
tacatttatattt

SEQ ID NO: 5440761 - DNA, 18 bp, Homo sapiens
tacatttatcatggtcct

SEQ ID NO: 5440762 - DNA, 19 bp, Homo sapiens
tacatttatctattaaaat

SEQ ID NO: 5440763 - DNA, 17 bp, Homo sapiens
tacatttatcttctgtt

SEQ ID NO: 5440764 - DNA, 12 bp, Homo sapiens
tacatttatgat

SEQ ID NO: 5440765 - DNA, 16 bp, Homo sapiens
tacatttatgatttaa

SEQ ID NO: 5440766 - DNA, 20 bp, Homo sapiens
tacatttatgatttaataaa

SEQ ID NO: 5440767 - DNA, 22 bp, Homo sapiens
tacatttatttacactcttgat

SEQ ID NO: 5440768 - DNA, 20 bp, Homo sapiens
tacatttatttatccagaaa

SEQ ID NO: 5440769 - DNA, 15 bp, Homo sapiens
tacatttatttatta

SEQ ID NO: 5440770 - DNA, 18 bp, Homo sapiens
tacatttcacaggctaat

SEQ ID NO: 5440771 - DNA, 23 bp, Homo sapiens
tacatttcataaggcctgccctc

SEQ ID NO: 5440772 - DNA, 18 bp, Homo sapiens
tacatttcatacaacaga

SEQ ID NO: 5440773 - DNA, 13 bp, Homo sapiens
tacatttcattta

SEQ ID NO: 5440774 - DNA, 15 bp, Homo sapiens
tacatttcatttata

SEQ ID NO: 5440775 - DNA, 17 bp, Homo sapiens
tacatttccaaatgaac

SEQ ID NO: 5440776 - DNA, 19 bp, Homo sapiens
tacatttctaagtcaaaca

SEQ ID NO: 5440777 - DNA, 18 bp, Homo sapiens
tacatttctcctttgata

SEQ ID NO: 5440778 - DNA, 16 bp, Homo sapiens
tacatttctctgagca

SEQ ID NO: 5440779 - DNA, 14 bp, Homo sapiens
tacatttctgaaat

SEQ ID NO: 5440780 - DNA, 13 bp, Homo sapiens
tacatttctgaat

SEQ ID NO: 5440781 - DNA, 14 bp, Homo sapiens
tacatttctgattc

SEQ ID NO: 5440782 - DNA, 15 bp, Homo sapiens
tacatttctgattct

SEQ ID NO: 5440783 - DNA, 11 bp, Homo sapiens
tacatttctgc

SEQ ID NO: 5440784 - DNA, 15 bp, Homo sapiens
tacatttctgcagat

SEQ ID NO: 5440785 - DNA, 22 bp, Homo sapiens
tacatttcttagactacattta

SEQ ID NO: 5440786 - DNA, 15 bp, Homo sapiens
tacatttcttttaaa

SEQ ID NO: 5440787 - DNA, 14 bp, Homo sapiens
tacatttgaaaata

SEQ ID NO: 5440788 - DNA, 22 bp, Homo sapiens
tacatttgatttgatatacaga

SEQ ID NO: 5440789 - DNA, 12 bp, Homo sapiens
tacatttgcaat

SEQ ID NO: 5440790 - DNA, 14 bp, Homo sapiens
tacatttgcaatta

SEQ ID NO: 5440791 - DNA, 22 bp, Homo sapiens
tacatttgcatgccttttgggt

SEQ ID NO: 5440792 - DNA, 15 bp, Homo sapiens
tacatttggaacagt

SEQ ID NO: 5440793 - DNA, 17 bp, Homo sapiens
tacatttggaacagtga

SEQ ID NO: 5440794 - DNA, 23 bp, Homo sapiens
tacatttggattagaaatttaac

SEQ ID NO: 5440795 - DNA, 21 bp, Homo sapiens
tacatttgggagtttttatga

SEQ ID NO: 5440796 - DNA, 19 bp, Homo sapiens
tacatttgtaatttaaggt

SEQ ID NO: 5440797 - DNA, 17 bp, Homo sapiens
tacatttgtatgttgtg

SEQ ID NO: 5440798 - DNA, 13 bp, Homo sapiens
tacatttgtgctg

SEQ ID NO: 5440799 - DNA, 17 bp, Homo sapiens
tacatttgtttgtattc

SEQ ID NO: 5440800 - DNA, 11 bp, Homo sapiens
tacattttaaa

SEQ ID NO: 5440801 - DNA, 18 bp, Homo sapiens
tacattttaaaggataat

SEQ ID NO: 5440802 - DNA, 12 bp, Homo sapiens
tacattttaaca

SEQ ID NO: 5440803 - DNA, 22 bp, Homo sapiens
tacattttacacactgtacaca

SEQ ID NO: 5440804 - DNA, 17 bp, Homo sapiens
tacattttactgattaa

SEQ ID NO: 5440805 - DNA, 13 bp, Homo sapiens
tacattttagttt

SEQ ID NO: 5440806 - DNA, 14 bp, Homo sapiens
tacattttataatt

SEQ ID NO: 5440807 - DNA, 19 bp, Homo sapiens
tacattttatatttttgta

SEQ ID NO: 5440808 - DNA, 20 bp, Homo sapiens
tacattttatatttttgtac

SEQ ID NO: 5440809 - DNA, 18 bp, Homo sapiens
tacattttattacactaa

SEQ ID NO: 5440810 - DNA, 13 bp, Homo sapiens
tacattttattct

SEQ ID NO: 5440811 - DNA, 18 bp, Homo sapiens
tacattttatttattagc

SEQ ID NO: 5440812 - DNA, 22 bp, Homo sapiens
tacattttatttattagctgta

SEQ ID NO: 5440813 - DNA, 17 bp, Homo sapiens
tacattttcagtaccaa

SEQ ID NO: 5440814 - DNA, 13 bp, Homo sapiens
tacattttcctgt

SEQ ID NO: 5440815 - DNA, 17 bp, Homo sapiens
tacattttcctgtgtaa

SEQ ID NO: 5440816 - DNA, 15 bp, Homo sapiens
tacattttctaaata

SEQ ID NO: 5440817 - DNA, 23 bp, Homo sapiens
tacattttctaaataaaaatatg

SEQ ID NO: 5440818 - DNA, 15 bp, Homo sapiens
tacattttctaagaa

SEQ ID NO: 5440819 - DNA, 18 bp, Homo sapiens
tacattttcttgtccaaa

SEQ ID NO: 5440820 - DNA, 16 bp, Homo sapiens
tacattttctttcata

SEQ ID NO: 5440821 - DNA, 22 bp, Homo sapiens
tacattttgaggttttgtaaaa

SEQ ID NO: 5440822 - DNA, 21 bp, Homo sapiens
tacattttgtatatttgtatt

SEQ ID NO: 5440823 - DNA, 17 bp, Homo sapiens
tacattttgtgcagtga

SEQ ID NO: 5440824 - DNA, 11 bp, Homo sapiens
tacatttttaa

SEQ ID NO: 5440825 - DNA, 17 bp, Homo sapiens
tacatttttaaattctt

SEQ ID NO: 5440826 - DNA, 22 bp, Homo sapiens
tacatttttaagtgctgcattt

SEQ ID NO: 5440827 - DNA, 14 bp, Homo sapiens
tacatttttacaat

SEQ ID NO: 5440828 - DNA, 16 bp, Homo sapiens
tacatttttacaataa

SEQ ID NO: 5440829 - DNA, 19 bp, Homo sapiens
tacatttttacaataaata

SEQ ID NO: 5440830 - DNA, 16 bp, Homo sapiens
tacatttttatttatg

SEQ ID NO: 5440831 - DNA, 17 bp, Homo sapiens
tacatttttatttatga

SEQ ID NO: 5440832 - DNA, 19 bp, Homo sapiens
tacatttttatttatgaag

SEQ ID NO: 5440833 - DNA, 22 bp, Homo sapiens
tacatttttatttatgaagttt

SEQ ID NO: 5440834 - DNA, 16 bp, Homo sapiens
tacatttttcaacttt

SEQ ID NO: 5440835 - DNA, 14 bp, Homo sapiens
tacatttttctgat

SEQ ID NO: 5440836 - DNA, 15 bp, Homo sapiens
tacatttttctgatg

SEQ ID NO: 5440837 - DNA, 16 bp, Homo sapiens
tacatttttctgatgg

SEQ ID NO: 5440838 - DNA, 16 bp, Homo sapiens
tacatttttgatcaaa

SEQ ID NO: 5440839 - DNA, 15 bp, Homo sapiens
tacattttttaagct

SEQ ID NO: 5440840 - DNA, 21 bp, Homo sapiens
tacattttttaggacatctta

SEQ ID NO: 5440841 - DNA, 17 bp, Homo sapiens
tacatttttttaaacaa

SEQ ID NO: 5440842 - DNA, 14 bp, Homo sapiens
tacattttttttca

SEQ ID NO: 5440843 - DNA, 15 bp, Homo sapiens
taccaaaaaaaggaa

SEQ ID NO: 5440844 - DNA, 20 bp, Homo sapiens
taccaaaaaaattacagttt

SEQ ID NO: 5440845 - DNA, 19 bp, Homo sapiens
taccaaaaaccatgttgcg

SEQ ID NO: 5440846 - DNA, 22 bp, Homo sapiens
taccaaaaatctcaatatttca

SEQ ID NO: 5440847 - DNA, 15 bp, Homo sapiens
taccaaaaattgcca

SEQ ID NO: 5440848 - DNA, 14 bp, Homo sapiens
taccaaaagacatt

SEQ ID NO: 5440849 - DNA, 19 bp, Homo sapiens
taccaaaattcactaatct

SEQ ID NO: 5440850 - DNA, 23 bp, Homo sapiens
taccaaaattttaaaaaagggag

SEQ ID NO: 5440851 - DNA, 15 bp, Homo sapiens
taccaaacaaggaag

SEQ ID NO: 5440852 - DNA, 18 bp, Homo sapiens
taccaaacaaggaagcca

SEQ ID NO: 5440853 - DNA, 15 bp, Homo sapiens
taccaaacagcaaac

SEQ ID NO: 5440854 - DNA, 21 bp, Homo sapiens
taccaaacagcaaaccaagag

SEQ ID NO: 5440855 - DNA, 20 bp, Homo sapiens
taccaaagaatgcatgttct

SEQ ID NO: 5440856 - DNA, 16 bp, Homo sapiens
taccaaagactatttc

SEQ ID NO: 5440857 - DNA, 19 bp, Homo sapiens
taccaaagagacagggccc

SEQ ID NO: 5440858 - DNA, 17 bp, Homo sapiens
taccaaagatgaatgaa

SEQ ID NO: 5440859 - DNA, 12 bp, Homo sapiens
taccaaagcaca

SEQ ID NO: 5440860 - DNA, 13 bp, Homo sapiens
taccaaaggatag

SEQ ID NO: 5440861 - DNA, 19 bp, Homo sapiens
taccaaaggtttttaaagt

SEQ ID NO: 5440862 - DNA, 22 bp, Homo sapiens
taccaaagtgtcttttgacatt

SEQ ID NO: 5440863 - DNA, 17 bp, Homo sapiens
taccaaagttttatcaa

SEQ ID NO: 5440864 - DNA, 18 bp, Homo sapiens
taccaaatacacatttca

SEQ ID NO: 5440865 - DNA, 14 bp, Homo sapiens
taccaaatagtgat

SEQ ID NO: 5440866 - DNA, 14 bp, Homo sapiens
taccaaatatttta

SEQ ID NO: 5440867 - DNA, 15 bp, Homo sapiens
taccaaatgcctgtt

SEQ ID NO: 5440868 - DNA, 19 bp, Homo sapiens
taccaaatgcctgttgtat

SEQ ID NO: 5440869 - DNA, 21 bp, Homo sapiens
taccaaatgcctgttgtattt

SEQ ID NO: 5440870 - DNA, 13 bp, Homo sapiens
taccaacatgtat

SEQ ID NO: 5440871 - DNA, 15 bp, Homo sapiens
taccaacatgtatct

SEQ ID NO: 5440872 - DNA, 17 bp, Homo sapiens
taccaacctaaatttct

SEQ ID NO: 5440873 - DNA, 19 bp, Homo sapiens
taccaacttcctctgccat

SEQ ID NO: 5440874 - DNA, 21 bp, Homo sapiens
taccaactttcaagaacttgt

SEQ ID NO: 5440875 - DNA, 14 bp, Homo sapiens
taccaactttctgt

SEQ ID NO: 5440876 - DNA, 16 bp, Homo sapiens
taccaagactcctgca

SEQ ID NO: 5440877 - DNA, 14 bp, Homo sapiens
taccaagagaaggg

SEQ ID NO: 5440878 - DNA, 17 bp, Homo sapiens
taccaagagtaacttta

SEQ ID NO: 5440879 - DNA, 16 bp, Homo sapiens
taccaagatcacaaat

SEQ ID NO: 5440880 - DNA, 20 bp, Homo sapiens
taccaagccaccgcagctgc

SEQ ID NO: 5440881 - DNA, 21 bp, Homo sapiens
taccaagcgcttctttctgac

SEQ ID NO: 5440882 - DNA, 17 bp, Homo sapiens
taccaagctgtcacagg

SEQ ID NO: 5440883 - DNA, 22 bp, Homo sapiens
taccaaggtacaactgtattta

SEQ ID NO: 5440884 - DNA, 23 bp, Homo sapiens
taccaagtaagacatctcaaata

SEQ ID NO: 5440885 - DNA, 20 bp, Homo sapiens
taccaagtatagcctatggc

SEQ ID NO: 5440886 - DNA, 13 bp, Homo sapiens
taccaagtgcttc

SEQ ID NO: 5440887 - DNA, 19 bp, Homo sapiens
taccaagtgtgttgggaat

SEQ ID NO: 5440888 - DNA, 17 bp, Homo sapiens
taccaagttacttgaaa

SEQ ID NO: 5440889 - DNA, 18 bp, Homo sapiens
taccaagttatataaaga

SEQ ID NO: 5440890 - DNA, 14 bp, Homo sapiens
taccaagttgtgct

SEQ ID NO: 5440891 - DNA, 20 bp, Homo sapiens
taccaagttgtgcttttctg

SEQ ID NO: 5440892 - DNA, 16 bp, Homo sapiens
taccaagttttattgt

SEQ ID NO: 5440893 - DNA, 15 bp, Homo sapiens
taccaataaactgag

SEQ ID NO: 5440894 - DNA, 13 bp, Homo sapiens
taccaataaagtg

SEQ ID NO: 5440895 - DNA, 14 bp, Homo sapiens
taccaataaagtga

SEQ ID NO: 5440896 - DNA, 18 bp, Homo sapiens
taccaatacaaaatgtat

SEQ ID NO: 5440897 - DNA, 22 bp, Homo sapiens
taccaatagattccccattgcc

SEQ ID NO: 5440898 - DNA, 21 bp, Homo sapiens
tacccggtggcttctggcacc

SEQ ID NO: 5440899 - DNA, 21 bp, Homo sapiens
tacccgtgtctagaggcaggt

SEQ ID NO: 5440900 - DNA, 16 bp, Homo sapiens
taccctaaccaagttc

SEQ ID NO: 5440901 - DNA, 19 bp, Homo sapiens
taccctaagaatgctttgc

SEQ ID NO: 5440902 - DNA, 16 bp, Homo sapiens
taccctaatgtcttca

SEQ ID NO: 5440903 - DNA, 14 bp, Homo sapiens
taccctacagacag

SEQ ID NO: 5440904 - DNA, 14 bp, Homo sapiens
taccctactgtggg

SEQ ID NO: 5440905 - DNA, 16 bp, Homo sapiens
taccctagaagaaaac

SEQ ID NO: 5440906 - DNA, 17 bp, Homo sapiens
taccctaggtctccacc

SEQ ID NO: 5440907 - DNA, 16 bp, Homo sapiens
taccctatatctataa

SEQ ID NO: 5440908 - DNA, 13 bp, Homo sapiens
taccctcaaagta

SEQ ID NO: 5440909 - DNA, 14 bp, Homo sapiens
taccctcaaatgct

SEQ ID NO: 5440910 - DNA, 22 bp, Homo sapiens
taccctcaaccctattcattag

SEQ ID NO: 5440911 - DNA, 22 bp, Homo sapiens
taccctcagaatattaagcaca

SEQ ID NO: 5440912 - DNA, 12 bp, Homo sapiens
taccctcagcct

SEQ ID NO: 5440913 - DNA, 16 bp, Homo sapiens
taccctcagcctccaa

SEQ ID NO: 5440914 - DNA, 17 bp, Homo sapiens
taccctcagtctacact

SEQ ID NO: 5440915 - DNA, 15 bp, Homo sapiens
taccctcatgttctt

SEQ ID NO: 5440916 - DNA, 23 bp, Homo sapiens
taccctccaagtctgtacctcaa

SEQ ID NO: 5440917 - DNA, 14 bp, Homo sapiens
taccctcccaccag

SEQ ID NO: 5440918 - DNA, 17 bp, Homo sapiens
taccctcccaccagaac

SEQ ID NO: 5440919 - DNA, 14 bp, Homo sapiens
taccctcccacccc

SEQ ID NO: 5440920 - DNA, 15 bp, Homo sapiens
taccctcccaccccc

SEQ ID NO: 5440921 - DNA, 11 bp, Homo sapiens
taccctccctg

SEQ ID NO: 5440922 - DNA, 12 bp, Homo sapiens
taccctccctgc

SEQ ID NO: 5440923 - DNA, 13 bp, Homo sapiens
taccctccctgtc

SEQ ID NO: 5440924 - DNA, 14 bp, Homo sapiens
taccctcctctgct

SEQ ID NO: 5440925 - DNA, 18 bp, Homo sapiens
taccctcctctgctggga

SEQ ID NO: 5440926 - DNA, 23 bp, Homo sapiens
taccctcctgctgagctgcccct

SEQ ID NO: 5440927 - DNA, 15 bp, Homo sapiens
taccctcctggctct

SEQ ID NO: 5440928 - DNA, 15 bp, Homo sapiens
taccctcctgtaaat

SEQ ID NO: 5440929 - DNA, 20 bp, Homo sapiens
taccctccttccacatgtac

SEQ ID NO: 5440930 - DNA, 21 bp, Homo sapiens
taccctccttccacatgtaca

SEQ ID NO: 5440931 - DNA, 18 bp, Homo sapiens
taccctcctttttttccc

SEQ ID NO: 5440932 - DNA, 18 bp, Homo sapiens
taccctcgggcccacctg

SEQ ID NO: 5440933 - DNA, 23 bp, Homo sapiens
taccctcgggcccacctggccac

SEQ ID NO: 5440934 - DNA, 16 bp, Homo sapiens
taccctctcagctcca

SEQ ID NO: 5440935 - DNA, 17 bp, Homo sapiens
taccctctcagctccag

SEQ ID NO: 5440936 - DNA, 21 bp, Homo sapiens
taccctctcagctccaggtgg

SEQ ID NO: 5440937 - DNA, 15 bp, Homo sapiens
taccctctgcagaac

SEQ ID NO: 5440938 - DNA, 22 bp, Homo sapiens
taccctctggaggggtgtggct

SEQ ID NO: 5440939 - DNA, 12 bp, Homo sapiens
taccctcttatt

SEQ ID NO: 5440940 - DNA, 15 bp, Homo sapiens
taccctcttttacca

SEQ ID NO: 5440941 - DNA, 18 bp, Homo sapiens
taccctcttttaccaact

SEQ ID NO: 5440942 - DNA, 22 bp, Homo sapiens
taccctgacctggccccctcag

SEQ ID NO: 5440943 - DNA, 16 bp, Homo sapiens
taccctgagcccacca

SEQ ID NO: 5440944 - DNA, 17 bp, Homo sapiens
taccctgagctgaggca

SEQ ID NO: 5440945 - DNA, 18 bp, Homo sapiens
taccctgagctgaggcag

SEQ ID NO: 5440946 - DNA, 23 bp, Homo sapiens
taccctgagctgcagctgagcct

SEQ ID NO: 5440947 - DNA, 18 bp, Homo sapiens
taccctgatctggaccct

SEQ ID NO: 5440948 - DNA, 12 bp, Homo sapiens
taccctgcagct

SEQ ID NO: 5440949 - DNA, 20 bp, Homo sapiens
taccctgcgattttgcctgt

SEQ ID NO: 5440950 - DNA, 14 bp, Homo sapiens
taccctgcttccca

SEQ ID NO: 5440951 - DNA, 22 bp, Homo sapiens
taccctggcactataatgtaag

SEQ ID NO: 5440952 - DNA, 22 bp, Homo sapiens
taccctggcagagaagagacca

SEQ ID NO: 5440953 - DNA, 13 bp, Homo sapiens
taccctggcccct

SEQ ID NO: 5440954 - DNA, 19 bp, Homo sapiens
taccctggcccctctccct

SEQ ID NO: 5440955 - DNA, 18 bp, Homo sapiens
taccctggccgccccctg

SEQ ID NO: 5440956 - DNA, 12 bp, Homo sapiens
taccctggtgga

SEQ ID NO: 5440957 - DNA, 12 bp, Homo sapiens
taccctgtcctt

SEQ ID NO: 5440958 - DNA, 13 bp, Homo sapiens
taccctgtccttt

SEQ ID NO: 5440959 - DNA, 18 bp, Homo sapiens
taccctgtgtcagagcct

SEQ ID NO: 5440960 - DNA, 20 bp, Homo sapiens
taccctgttcccaagcaaag

SEQ ID NO: 5440961 - DNA, 14 bp, Homo sapiens
tacccttaagctag

SEQ ID NO: 5440962 - DNA, 20 bp, Homo sapiens
tacccttcacctttggtgca

SEQ ID NO: 5440963 - DNA, 15 bp, Homo sapiens
tacccttccctgcac

SEQ ID NO: 5440964 - DNA, 16 bp, Homo sapiens
tacccttccctgcact

SEQ ID NO: 5440965 - DNA, 15 bp, Homo sapiens
tacccttcctcatct

SEQ ID NO: 5440966 - DNA, 11 bp, Homo sapiens
tacccttcctg

SEQ ID NO: 5440967 - DNA, 18 bp, Homo sapiens
tacccttctacaaaagaa

SEQ ID NO: 5440968 - DNA, 19 bp, Homo sapiens
tacccttctacaaaagaag

SEQ ID NO: 5440969 - DNA, 19 bp, Homo sapiens
tacccttctgtgcccagct

SEQ ID NO: 5440970 - DNA, 20 bp, Homo sapiens
tacccttctgtgcccagctc

SEQ ID NO: 5440971 - DNA, 21 bp, Homo sapiens
tacccttctttaaatcaaaag

SEQ ID NO: 5440972 - DNA, 17 bp, Homo sapiens
tacccttgccaaggccg

SEQ ID NO: 5440973 - DNA, 23 bp, Homo sapiens
tacccttgccaaggccgcccacc

SEQ ID NO: 5440974 - DNA, 13 bp, Homo sapiens
tacccttggaaat

SEQ ID NO: 5440975 - DNA, 15 bp, Homo sapiens
tacccttggtttgca

SEQ ID NO: 5440976 - DNA, 22 bp, Homo sapiens
tacccttggtttgcacataaaa

SEQ ID NO: 5440977 - DNA, 16 bp, Homo sapiens
tacccttgtaccccat

SEQ ID NO: 5440978 - DNA, 16 bp, Homo sapiens
tacccttgttttgaaa

SEQ ID NO: 5440979 - DNA, 23 bp, Homo sapiens
taccctttaagatatccatcttt

SEQ ID NO: 5440980 - DNA, 15 bp, Homo sapiens
taccctttatagaac

SEQ ID NO: 5440981 - DNA, 16 bp, Homo sapiens
taccctttatctctgt

SEQ ID NO: 5440982 - DNA, 16 bp, Homo sapiens
tacccttttccccctt

SEQ ID NO: 5440983 - DNA, 17 bp, Homo sapiens
tacccttttcccccttc

SEQ ID NO: 5440984 - DNA, 20 bp, Homo sapiens
tacccttttcccccttccca

SEQ ID NO: 5440985 - DNA, 18 bp, Homo sapiens
taccctttttctccagct

SEQ ID NO: 5440986 - DNA, 16 bp, Homo sapiens
taccctttttcttgaa

SEQ ID NO: 5440987 - DNA, 23 bp, Homo sapiens
taccgaccatcgtccagccctcc

SEQ ID NO: 5440988 - DNA, 13 bp, Homo sapiens
taccgagagccaa

SEQ ID NO: 5440989 - DNA, 22 bp, Homo sapiens
taccgagagccaaacagagccc

SEQ ID NO: 5440990 - DNA, 22 bp, Homo sapiens
taccgaggacagcctgcctctg

SEQ ID NO: 5440991 - DNA, 15 bp, Homo sapiens
taccgagtatctgta

SEQ ID NO: 5440992 - DNA, 17 bp, Homo sapiens
taccgagtatctgtaac

SEQ ID NO: 5440993 - DNA, 19 bp, Homo sapiens
taccgagtatctgtaaccc

SEQ ID NO: 5440994 - DNA, 18 bp, Homo sapiens
taccgagtctcttctcca

SEQ ID NO: 5440995 - DNA, 20 bp, Homo sapiens
taccgagttcaagtgatttt

SEQ ID NO: 5440996 - DNA, 15 bp, Homo sapiens
taccgatggtcccag

SEQ ID NO: 5440997 - DNA, 15 bp, Homo sapiens
taccgcaggcccgga

SEQ ID NO: 5440998 - DNA, 23 bp, Homo sapiens
taccgcaggcccggactcaccaa

SEQ ID NO: 5440999 - DNA, 15 bp, Homo sapiens
taccgcagtggctct

SEQ ID NO: 5441000 - DNA, 12 bp, Homo sapiens
taccgcatggca

SEQ ID NO: 5441001 - DNA, 17 bp, Homo sapiens
taccgcatggcagctgg

SEQ ID NO: 5441002 - DNA, 20 bp, Homo sapiens
taccgcatggcagctgggcc

SEQ ID NO: 5441003 - DNA, 21 bp, Homo sapiens
taccgcatggcagctgggccc

SEQ ID NO: 5441004 - DNA, 19 bp, Homo sapiens
taccgccacgggtttccct

SEQ ID NO: 5441005 - DNA, 16 bp, Homo sapiens
taccgcccacccagca

SEQ ID NO: 5441006 - DNA, 18 bp, Homo sapiens
taccgcccacccagcagc

SEQ ID NO: 5441007 - DNA, 20 bp, Homo sapiens
taccgcccacccagcagcgc

SEQ ID NO: 5441008 - DNA, 14 bp, Homo sapiens
taccgccctgcggg

SEQ ID NO: 5441009 - DNA, 12 bp, Homo sapiens
taccgccctggg

SEQ ID NO: 5441010 - DNA, 17 bp, Homo sapiens
taccgccctgggctgga

SEQ ID NO: 5441011 - DNA, 21 bp, Homo sapiens
taccgcctcgtgccagcagcc

SEQ ID NO: 5441012 - DNA, 17 bp, Homo sapiens
taccgcctgtctcttta

SEQ ID NO: 5441013 - DNA, 19 bp, Homo sapiens
taccgcgtctaccctggga

SEQ ID NO: 5441014 - DNA, 15 bp, Homo sapiens
taccgcgttgtaaaa

SEQ ID NO: 5441015 - DNA, 16 bp, Homo sapiens
taccgcgttgtaaaat

SEQ ID NO: 5441016 - DNA, 17 bp, Homo sapiens
taccgctggggaacaga

SEQ ID NO: 5441017 - DNA, 19 bp, Homo sapiens
taccggacacacctctgct

SEQ ID NO: 5441018 - DNA, 18 bp, Homo sapiens
taccggagagagaatgta

SEQ ID NO: 5441019 - DNA, 15 bp, Homo sapiens
taccggagagttatc

SEQ ID NO: 5441020 - DNA, 16 bp, Homo sapiens
taccggagctccagtt

SEQ ID NO: 5441021 - DNA, 16 bp, Homo sapiens
taccggatgcagaccc

SEQ ID NO: 5441022 - DNA, 18 bp, Homo sapiens
taccggattctctcttta

SEQ ID NO: 5441023 - DNA, 14 bp, Homo sapiens
taccggccactgca

SEQ ID NO: 5441024 - DNA, 20 bp, Homo sapiens
taccgtaacaatgtttgtca

SEQ ID NO: 5441025 - DNA, 14 bp, Homo sapiens
taccgtagcctccg

SEQ ID NO: 5441026 - DNA, 12 bp, Homo sapiens
taccgtatttca

SEQ ID NO: 5441027 - DNA, 16 bp, Homo sapiens
taccgtggatctcctt

SEQ ID NO: 5441028 - DNA, 18 bp, Homo sapiens
taccgtggatctccttcc

SEQ ID NO: 5441029 - DNA, 19 bp, Homo sapiens
taccgtttggtgtctgatg

SEQ ID NO: 5441030 - DNA, 22 bp, Homo sapiens
taccgtttggtgtctgatgtgt

SEQ ID NO: 5441031 - DNA, 13 bp, Homo sapiens
tacctaaaaaaag

SEQ ID NO: 5441032 - DNA, 15 bp, Homo sapiens
tacctaaacagatat

SEQ ID NO: 5441033 - DNA, 15 bp, Homo sapiens
tacctaacaatgttt

SEQ ID NO: 5441034 - DNA, 13 bp, Homo sapiens
tacctaacatctg

SEQ ID NO: 5441035 - DNA, 12 bp, Homo sapiens
tacctaagaatt

SEQ ID NO: 5441036 - DNA, 13 bp, Homo sapiens
tacctaagtactg

SEQ ID NO: 5441037 - DNA, 19 bp, Homo sapiens
tacctaagtgacatttgta

SEQ ID NO: 5441038 - DNA, 18 bp, Homo sapiens
tacctaatccaaatatca

SEQ ID NO: 5441039 - DNA, 15 bp, Homo sapiens
tacctaattgtggat

SEQ ID NO: 5441040 - DNA, 15 bp, Homo sapiens
tacctacaaaatgag

SEQ ID NO: 5441041 - DNA, 15 bp, Homo sapiens
tacctacacccaagg

SEQ ID NO: 5441042 - DNA, 21 bp, Homo sapiens
tacctacatatttgtatgttt

SEQ ID NO: 5441043 - DNA, 18 bp, Homo sapiens
tacctactggtgtaatct

SEQ ID NO: 5441044 - DNA, 20 bp, Homo sapiens
tacctactttttctttgatt

SEQ ID NO: 5441045 - DNA, 13 bp, Homo sapiens
tacctagaaatct

SEQ ID NO: 5441046 - DNA, 13 bp, Homo sapiens
tacctagaagaag

SEQ ID NO: 5441047 - DNA, 18 bp, Homo sapiens
tacctagatttaatataa

SEQ ID NO: 5441048 - DNA, 14 bp, Homo sapiens
tacctagtgaaact

SEQ ID NO: 5441049 - DNA, 15 bp, Homo sapiens
tacctagtgtttact

SEQ ID NO: 5441050 - DNA, 23 bp, Homo sapiens
tacctataatgtgtgtatgtgta

SEQ ID NO: 5441051 - DNA, 17 bp, Homo sapiens
tacctatacctatgtga

SEQ ID NO: 5441052 - DNA, 19 bp, Homo sapiens
tacctatacctatgtgaaa

SEQ ID NO: 5441053 - DNA, 12 bp, Homo sapiens
tacctatatgca

SEQ ID NO: 5441054 - DNA, 19 bp, Homo sapiens
tacctatccttacatttca

SEQ ID NO: 5441055 - DNA, 20 bp, Homo sapiens
tacctatccttacatttcac

SEQ ID NO: 5441056 - DNA, 15 bp, Homo sapiens
tacctatgacttttt

SEQ ID NO: 5441057 - DNA, 18 bp, Homo sapiens
tacctatggctgcctgca

SEQ ID NO: 5441058 - DNA, 13 bp, Homo sapiens
tacctatgtaaca

SEQ ID NO: 5441059 - DNA, 20 bp, Homo sapiens
tacctatgtgagtttcagaa

SEQ ID NO: 5441060 - DNA, 16 bp, Homo sapiens
tacctattaaaggaaa

SEQ ID NO: 5441061 - DNA, 17 bp, Homo sapiens
tacctattaaaggaaaa

SEQ ID NO: 5441062 - DNA, 18 bp, Homo sapiens
tacctattaaaggaaaac

SEQ ID NO: 5441063 - DNA, 22 bp, Homo sapiens
tacctattcaagaagatagttg

SEQ ID NO: 5441064 - DNA, 14 bp, Homo sapiens
tacctattccttca

SEQ ID NO: 5441065 - DNA, 20 bp, Homo sapiens
tacctattctgaaaaagaca

SEQ ID NO: 5441066 - DNA, 23 bp, Homo sapiens
tacctattctgaaaaagacataa

SEQ ID NO: 5441067 - DNA, 14 bp, Homo sapiens
tacctattgaacat

SEQ ID NO: 5441068 - DNA, 17 bp, Homo sapiens
tacctatttctgatgat

SEQ ID NO: 5441069 - DNA, 16 bp, Homo sapiens
tacctatttggtgcta

SEQ ID NO: 5441070 - DNA, 15 bp, Homo sapiens
tacctcaaactatct

SEQ ID NO: 5441071 - DNA, 13 bp, Homo sapiens
tacctcaaatgaa

SEQ ID NO: 5441072 - DNA, 22 bp, Homo sapiens
tacctcaacccccatttctatt

SEQ ID NO: 5441073 - DNA, 22 bp, Homo sapiens
tacctcaagccccatttcctca

SEQ ID NO: 5441074 - DNA, 20 bp, Homo sapiens
tacctcaaggtaacaagagt

SEQ ID NO: 5441075 - DNA, 17 bp, Homo sapiens
tacctcaagttcttgga

SEQ ID NO: 5441076 - DNA, 19 bp, Homo sapiens
tacctcaagttcttggacc

SEQ ID NO: 5441077 - DNA, 21 bp, Homo sapiens
tactactgctgcaaagtgcaa

SEQ ID NO: 5441078 - DNA, 18 bp, Homo sapiens
tactactggtgatgccta

SEQ ID NO: 5441079 - DNA, 13 bp, Homo sapiens
tactactgtaaat

SEQ ID NO: 5441080 - DNA, 15 bp, Homo sapiens
tactactgtaaatgt

SEQ ID NO: 5441081 - DNA, 17 bp, Homo sapiens
tactacttatgaaatgt

SEQ ID NO: 5441082 - DNA, 14 bp, Homo sapiens
tactacttcttgga

SEQ ID NO: 5441083 - DNA, 16 bp, Homo sapiens
tactacttcttggaaa

SEQ ID NO: 5441084 - DNA, 22 bp, Homo sapiens
tactacttgttacctttcccat

SEQ ID NO: 5441085 - DNA, 23 bp, Homo sapiens
tactactttaaatcctaccaaag

SEQ ID NO: 5441086 - DNA, 22 bp, Homo sapiens
tactagaagatgaatacaaaca

SEQ ID NO: 5441087 - DNA, 17 bp, Homo sapiens
tactagaatcagataca

SEQ ID NO: 5441088 - DNA, 21 bp, Homo sapiens
tactagactttgatttcctta

SEQ ID NO: 5441089 - DNA, 24 bp, Homo sapiens
tactagagatattttgtaaaatgt

SEQ ID NO: 5441090 - DNA, 22 bp, Homo sapiens
tactagagtaaaggccatcaaa

SEQ ID NO: 5441091 - DNA, 20 bp, Homo sapiens
tactagatgcatcactgggt

SEQ ID NO: 5441092 - DNA, 17 bp, Homo sapiens
tactagcaaaataaaac

SEQ ID NO: 5441093 - DNA, 19 bp, Homo sapiens
tactagcaaaataaaacat

SEQ ID NO: 5441094 - DNA, 23 bp, Homo sapiens
tactaggatacagaaatgcaaaa

SEQ ID NO: 5441095 - DNA, 18 bp, Homo sapiens
tactaggcagttagagat

SEQ ID NO: 5441096 - DNA, 20 bp, Homo sapiens
tactaggccattagcccttc

SEQ ID NO: 5441097 - DNA, 21 bp, Homo sapiens
tactagggatccctcatctgt

SEQ ID NO: 5441098 - DNA, 15 bp, Homo sapiens
tactaggtaacttca

SEQ ID NO: 5441099 - DNA, 20 bp, Homo sapiens
tactaggtacataagcttct

SEQ ID NO: 5441100 - DNA, 18 bp, Homo sapiens
tactaggtctgctcctga

SEQ ID NO: 5441101 - DNA, 16 bp, Homo sapiens
tactagtaataatgta

SEQ ID NO: 5441102 - DNA, 18 bp, Homo sapiens
tactagtactattgctat

SEQ ID NO: 5441103 - DNA, 17 bp, Homo sapiens
tactagtactatttctt

SEQ ID NO: 5441104 - DNA, 16 bp, Homo sapiens
tactagtactgtgtac

SEQ ID NO: 5441105 - DNA, 17 bp, Homo sapiens
tactagtactgtgtact

SEQ ID NO: 5441106 - DNA, 18 bp, Homo sapiens
tactagtactgtgtactg

SEQ ID NO: 5441107 - DNA, 9 bp, Homo sapiens
tactagtgt

SEQ ID NO: 5441108 - DNA, 17 bp, Homo sapiens
tactagtgtggtgtgtt

SEQ ID NO: 5441109 - DNA, 15 bp, Homo sapiens
tactagtgttctgtt

SEQ ID NO: 5441110 - DNA, 16 bp, Homo sapiens
tactagtgttctgttt

SEQ ID NO: 5441111 - DNA, 16 bp, Homo sapiens
tactagtgtttaagtc

SEQ ID NO: 5441112 - DNA, 19 bp, Homo sapiens
tactagtgtttaagtcatt

SEQ ID NO: 5441113 - DNA, 21 bp, Homo sapiens
tactagttgtgaccttagtgt

SEQ ID NO: 5441114 - DNA, 22 bp, Homo sapiens
tactataaaatgcagtaacatt

SEQ ID NO: 5441115 - DNA, 13 bp, Homo sapiens
tactataaagaga

SEQ ID NO: 5441116 - DNA, 21 bp, Homo sapiens
tactataacatagaattgcaa

SEQ ID NO: 5441117 - DNA, 13 bp, Homo sapiens
tactataacatat

SEQ ID NO: 5441118 - DNA, 17 bp, Homo sapiens
tactataagaactttga

SEQ ID NO: 5441119 - DNA, 19 bp, Homo sapiens
tactataagactataaata

SEQ ID NO: 5441120 - DNA, 22 bp, Homo sapiens
tactataagtagttggtttgta

SEQ ID NO: 5441121 - DNA, 15 bp, Homo sapiens
tactataatcaaatg

SEQ ID NO: 5441122 - DNA, 16 bp, Homo sapiens
tactataatcaaatga

SEQ ID NO: 5441123 - DNA, 17 bp, Homo sapiens
tactataatcaaatgat

SEQ ID NO: 5441124 - DNA, 19 bp, Homo sapiens
tactataattgtaaatatt

SEQ ID NO: 5441125 - DNA, 16 bp, Homo sapiens
tactatacaacaatgt

SEQ ID NO: 5441126 - DNA, 15 bp, Homo sapiens
tactatacagccata

SEQ ID NO: 5441127 - DNA, 18 bp, Homo sapiens
tactatagaccaaaagga

SEQ ID NO: 5441128 - DNA, 18 bp, Homo sapiens
tactatagatataactgt

SEQ ID NO: 5441129 - DNA, 17 bp, Homo sapiens
tactatagattctttat

SEQ ID NO: 5441130 - DNA, 16 bp, Homo sapiens
tactatagcaaagtag

SEQ ID NO: 5441131 - DNA, 17 bp, Homo sapiens
tactatagttatataga

SEQ ID NO: 5441132 - DNA, 13 bp, Homo sapiens
tactatatacata

SEQ ID NO: 5441133 - DNA, 15 bp, Homo sapiens
tactatatacatata

SEQ ID NO: 5441134 - DNA, 18 bp, Homo sapiens
tactatatacatatatat

SEQ ID NO: 5441135 - DNA, 17 bp, Homo sapiens
tactatatatacaatat

SEQ ID NO: 5441136 - DNA, 12 bp, Homo sapiens
tactatattaaa

SEQ ID NO: 5441137 - DNA, 13 bp, Homo sapiens
tactatattaaat

SEQ ID NO: 5441138 - DNA, 12 bp, Homo sapiens
tactatattaac

SEQ ID NO: 5441139 - DNA, 14 bp, Homo sapiens
tactatatttatgg

SEQ ID NO: 5441140 - DNA, 23 bp, Homo sapiens
tactatccccaaactcctttact

SEQ ID NO: 5441141 - DNA, 16 bp, Homo sapiens
tactatcctgtaaata

SEQ ID NO: 5441142 - DNA, 19 bp, Homo sapiens
tactatcctgtaaatatat

SEQ ID NO: 5441143 - DNA, 12 bp, Homo sapiens
tactatctttgt

SEQ ID NO: 5441144 - DNA, 13 bp, Homo sapiens
tactatcttttca

SEQ ID NO: 5441145 - DNA, 14 bp, Homo sapiens
tactatcttttcat

SEQ ID NO: 5441146 - DNA, 14 bp, Homo sapiens
tactatgacactgt

SEQ ID NO: 5441147 - DNA, 14 bp, Homo sapiens
tactatgatcagaa

SEQ ID NO: 5441148 - DNA, 21 bp, Homo sapiens
tactatgatcagaagaacatg

SEQ ID NO: 5441149 - DNA, 12 bp, Homo sapiens
tactatgcacaa

SEQ ID NO: 5441150 - DNA, 19 bp, Homo sapiens
tactatgcagtatctctta

SEQ ID NO: 5441151 - DNA, 14 bp, Homo sapiens
tactatgcctgtgt

SEQ ID NO: 5441152 - DNA, 20 bp, Homo sapiens
tactatggaagccacatcac

SEQ ID NO: 5441153 - DNA, 16 bp, Homo sapiens
tactatggctgagttc

SEQ ID NO: 5441154 - DNA, 16 bp, Homo sapiens
tactatggctgtattt

SEQ ID NO: 5441155 - DNA, 18 bp, Homo sapiens
tactatggtgtgttgtat

SEQ ID NO: 5441156 - DNA, 14 bp, Homo sapiens
tactatgtatcaat

SEQ ID NO: 5441157 - DNA, 12 bp, Homo sapiens
tactattaaaca

SEQ ID NO: 5441158 - DNA, 15 bp, Homo sapiens
tactattaaacatgc

SEQ ID NO: 5441159 - DNA, 18 bp, Homo sapiens
tactattaaacatgctgt

SEQ ID NO: 5441160 - DNA, 14 bp, Homo sapiens
tactattaacatga

SEQ ID NO: 5441161 - DNA, 19 bp, Homo sapiens
tactattaacatgatgtac

SEQ ID NO: 5441162 - DNA, 18 bp, Homo sapiens
tactattaactctgcata

SEQ ID NO: 5441163 - DNA, 20 bp, Homo sapiens
tactattaagcagtaaaaac

SEQ ID NO: 5441164 - DNA, 22 bp, Homo sapiens
tactattaagcagtaaaaactg

SEQ ID NO: 5441165 - DNA, 13 bp, Homo sapiens
tactattattgtt

SEQ ID NO: 5441166 - DNA, 14 bp, Homo sapiens
tactattatttgtt

SEQ ID NO: 5441167 - DNA, 14 bp, Homo sapiens
tactattcatgttt

SEQ ID NO: 5441168 - DNA, 18 bp, Homo sapiens
tactattcccactttcat

SEQ ID NO: 5441169 - DNA, 23 bp, Homo sapiens
tactattccctttgacttcagct

SEQ ID NO: 5441170 - DNA, 19 bp, Homo sapiens
tactattcttggttcttat

SEQ ID NO: 5441171 - DNA, 20 bp, Homo sapiens
tactattcttggttcttatt

SEQ ID NO: 5441172 - DNA, 23 bp, Homo sapiens
tactattcttggttcttatttaa

SEQ ID NO: 5441173 - DNA, 14 bp, Homo sapiens
tactattgcctcat

SEQ ID NO: 5441174 - DNA, 19 bp, Homo sapiens
tactattgctcataatgac

SEQ ID NO: 5441175 - DNA, 21 bp, Homo sapiens
tactattgctcataatgactt

SEQ ID NO: 5441176 - DNA, 23 bp, Homo sapiens
tactattggaacaaatatttaga

SEQ ID NO: 5441177 - DNA, 22 bp, Homo sapiens
tactattggaagataaacttgt

SEQ ID NO: 5441178 - DNA, 17 bp, Homo sapiens
tactattggacagacac

SEQ ID NO: 5441179 - DNA, 22 bp, Homo sapiens
tactattggagagaaaaaatta

SEQ ID NO: 5441180 - DNA, 23 bp, Homo sapiens
tactattgttgctgaaacttgct

SEQ ID NO: 5441181 - DNA, 12 bp, Homo sapiens
tactatttaaag

SEQ ID NO: 5441182 - DNA, 19 bp, Homo sapiens
tactatttaaagcctcctc

SEQ ID NO: 5441183 - DNA, 14 bp, Homo sapiens
tactatttaactga

SEQ ID NO: 5441184 - DNA, 15 bp, Homo sapiens
tactatttaagatgt

SEQ ID NO: 5441185 - DNA, 17 bp, Homo sapiens
tactatttaagatgtga

SEQ ID NO: 5441186 - DNA, 21 bp, Homo sapiens
tactatttcttgtggttataa

SEQ ID NO: 5441187 - DNA, 18 bp, Homo sapiens
tactatttgccaatgtat

SEQ ID NO: 5441188 - DNA, 19 bp, Homo sapiens
tactattttctacaattaa

SEQ ID NO: 5441189 - DNA, 14 bp, Homo sapiens
tactatttttactg

SEQ ID NO: 5441190 - DNA, 19 bp, Homo sapiens
tactatttttactgccact

SEQ ID NO: 5441191 - DNA, 18 bp, Homo sapiens
tactcaaaatgcaggaca

SEQ ID NO: 5441192 - DNA, 20 bp, Homo sapiens
tactcaaacacttattgttt

SEQ ID NO: 5441193 - DNA, 15 bp, Homo sapiens
tactcaaagcccaga

SEQ ID NO: 5441194 - DNA, 21 bp, Homo sapiens
tactcaaagtggaaaggatca

SEQ ID NO: 5441195 - DNA, 18 bp, Homo sapiens
tactcaaatgagtaacat

SEQ ID NO: 5441196 - DNA, 19 bp, Homo sapiens
tactcaaatggtgtcatgg

SEQ ID NO: 5441197 - DNA, 14 bp, Homo sapiens
tactcaaccctctc

SEQ ID NO: 5441198 - DNA, 18 bp, Homo sapiens
tactcaagatactggact

SEQ ID NO: 5441199 - DNA, 15 bp, Homo sapiens
tactcaagcccgcgg

SEQ ID NO: 5441200 - DNA, 16 bp, Homo sapiens
tactcaagtttcaggt

SEQ ID NO: 5441201 - DNA, 13 bp, Homo sapiens
tactcaatactac

SEQ ID NO: 5441202 - DNA, 15 bp, Homo sapiens
tactcaatactacct

SEQ ID NO: 5441203 - DNA, 17 bp, Homo sapiens
tactcaatactacctct

SEQ ID NO: 5441204 - DNA, 16 bp, Homo sapiens
tactcaatcaagcaaa

SEQ ID NO: 5441205 - DNA, 23 bp, Homo sapiens
tactcaatggagtatgtctgatg

SEQ ID NO: 5441206 - DNA, 14 bp, Homo sapiens
tactcaatggattt

SEQ ID NO: 5441207 - DNA, 19 bp, Homo sapiens
tactcaatggtatcattac

SEQ ID NO: 5441208 - DNA, 22 bp, Homo sapiens
tactcaatgttactatctgctt

SEQ ID NO: 5441209 - DNA, 13 bp, Homo sapiens
tactcaattttaa

SEQ ID NO: 5441210 - DNA, 13 bp, Homo sapiens
tactcacacaggc

SEQ ID NO: 5441211 - DNA, 14 bp, Homo sapiens
tactcacacaggca

SEQ ID NO: 5441212 - DNA, 16 bp, Homo sapiens
tactcacatataacat

SEQ ID NO: 5441213 - DNA, 14 bp, Homo sapiens
tactcacattttgt

SEQ ID NO: 5441214 - DNA, 16 bp, Homo sapiens
tactcacattttgtta

SEQ ID NO: 5441215 - DNA, 15 bp, Homo sapiens
tactcaccaaaatat

SEQ ID NO: 5441216 - DNA, 17 bp, Homo sapiens
tactcaccaaaatatag

SEQ ID NO: 5441217 - DNA, 12 bp, Homo sapiens
tactcacctcac

SEQ ID NO: 5441218 - DNA, 14 bp, Homo sapiens
tactcacctcctcc

SEQ ID NO: 5441219 - DNA, 15 bp, Homo sapiens
tactcactgaagcct

SEQ ID NO: 5441220 - DNA, 14 bp, Homo sapiens
tactcacttttcac

SEQ ID NO: 5441221 - DNA, 16 bp, Homo sapiens
tactcacttttcccac

SEQ ID NO: 5441222 - DNA, 18 bp, Homo sapiens
tactcacttttcccactc

SEQ ID NO: 5441223 - DNA, 22 bp, Homo sapiens
tactcagaactgtcccatcccc

SEQ ID NO: 5441224 - DNA, 19 bp, Homo sapiens
tactcagaagcctgaggct

SEQ ID NO: 5441225 - DNA, 20 bp, Homo sapiens
tactcagaatagctgttttg

SEQ ID NO: 5441226 - DNA, 22 bp, Homo sapiens
tactcagaattctctagtttga

SEQ ID NO: 5441227 - DNA, 15 bp, Homo sapiens
tactcagagcagatg

SEQ ID NO: 5441228 - DNA, 13 bp, Homo sapiens
tactcagagctgc

SEQ ID NO: 5441229 - DNA, 16 bp, Homo sapiens
tactcagagctgcggg

SEQ ID NO: 5441230 - DNA, 19 bp, Homo sapiens
tactcagagctgcgggctg

SEQ ID NO: 5441231 - DNA, 22 bp, Homo sapiens
tactcagaggctgacactgaca

SEQ ID NO: 5441232 - DNA, 16 bp, Homo sapiens
tactcagataaggtaa

SEQ ID NO: 5441233 - DNA, 14 bp, Homo sapiens
tactcagatctgca

SEQ ID NO: 5441234 - DNA, 22 bp, Homo sapiens
tactcagatgaccccagaaact

SEQ ID NO: 5441235 - DNA, 21 bp, Homo sapiens
tactcagcagcagagagccct

SEQ ID NO: 5441236 - DNA, 14 bp, Homo sapiens
tactcagcagccct

SEQ ID NO: 5441237 - DNA, 15 bp, Homo sapiens
tactcagcagccctc

SEQ ID NO: 5441238 - DNA, 16 bp, Homo sapiens
tactcagcagtaagca

SEQ ID NO: 5441239 - DNA, 17 bp, Homo sapiens
tactcagcagtaagcag

SEQ ID NO: 5441240 - DNA, 13 bp, Homo sapiens
tactcagcccagc

SEQ ID NO: 5441241 - DNA, 12 bp, Homo sapiens
tactcagcctgc

SEQ ID NO: 5441242 - DNA, 13 bp, Homo sapiens
tactcagcctgct

SEQ ID NO: 5441243 - DNA, 14 bp, Homo sapiens
tactcaggaagaac

SEQ ID NO: 5441244 - DNA, 20 bp, Homo sapiens
tactcaggataacagagaat

SEQ ID NO: 5441245 - DNA, 17 bp, Homo sapiens
tactcaggccactccaa

SEQ ID NO: 5441246 - DNA, 16 bp, Homo sapiens
tactcaggctttctat

SEQ ID NO: 5441247 - DNA, 21 bp, Homo sapiens
tactcagggattccttctaag

SEQ ID NO: 5441248 - DNA, 21 bp, Homo sapiens
tactcagggctcctcccagct

SEQ ID NO: 5441249 - DNA, 14 bp, Homo sapiens
tactcaggggatgt

SEQ ID NO: 5441250 - DNA, 19 bp, Homo sapiens
tactcagggttcatctgtc

SEQ ID NO: 5441251 - DNA, 22 bp, Homo sapiens
tactcagtgaaatcatattaat

SEQ ID NO: 5441252 - DNA, 22 bp, Homo sapiens
tactcagttagaattttcctaa

SEQ ID NO: 5441253 - DNA, 21 bp, Homo sapiens
tactcagtttatgttgtacaa

SEQ ID NO: 5441254 - DNA, 20 bp, Homo sapiens
tactcataaaggacactgga

SEQ ID NO: 5441255 - DNA, 16 bp, Homo sapiens
tactgctctagaaagt

SEQ ID NO: 5441256 - DNA, 13 bp, Homo sapiens
tactgctctgaat

SEQ ID NO: 5441257 - DNA, 14 bp, Homo sapiens
tactgctctgaata

SEQ ID NO: 5441258 - DNA, 21 bp, Homo sapiens
tactgctgagatacatacaga

SEQ ID NO: 5441259 - DNA, 22 bp, Homo sapiens
tactgctgattcttgtaaatct

SEQ ID NO: 5441260 - DNA, 13 bp, Homo sapiens
tactgctgctgct

SEQ ID NO: 5441261 - DNA, 16 bp, Homo sapiens
tactgctgctgtgctt

SEQ ID NO: 5441262 - DNA, 15 bp, Homo sapiens
tactgctgtcattgt

SEQ ID NO: 5441263 - DNA, 20 bp, Homo sapiens
tactgcttaattcaaataat

SEQ ID NO: 5441264 - DNA, 17 bp, Homo sapiens
tactgcttaattgctga

SEQ ID NO: 5441265 - DNA, 13 bp, Homo sapiens
tactgcttatttt

SEQ ID NO: 5441266 - DNA, 18 bp, Homo sapiens
tactgcttattttatgat

SEQ ID NO: 5441267 - DNA, 21 bp, Homo sapiens
tactgcttcatttttgtaata

SEQ ID NO: 5441268 - DNA, 16 bp, Homo sapiens
tactgcttctctttgt

SEQ ID NO: 5441269 - DNA, 23 bp, Homo sapiens
tactgcttgcagtaattcaactg

SEQ ID NO: 5441270 - DNA, 23 bp, Homo sapiens
tactgcttgcttacaatctttat

SEQ ID NO: 5441271 - DNA, 15 bp, Homo sapiens
tactgctttctgaat

SEQ ID NO: 5441272 - DNA, 16 bp, Homo sapiens
tactgctttgcaaaga

SEQ ID NO: 5441273 - DNA, 20 bp, Homo sapiens
tactgctttttctctgcttc

SEQ ID NO: 5441274 - DNA, 19 bp, Homo sapiens
tactggaaaagttagtatt

SEQ ID NO: 5441275 - DNA, 14 bp, Homo sapiens
tactggaaatgtag

SEQ ID NO: 5441276 - DNA, 17 bp, Homo sapiens
tactggaagttttgcat

SEQ ID NO: 5441277 - DNA, 18 bp, Homo sapiens
tactggaagttttgcatt

SEQ ID NO: 5441278 - DNA, 23 bp, Homo sapiens
tactggaagttttgcatttatgg

SEQ ID NO: 5441279 - DNA, 14 bp, Homo sapiens
tactggaataattt

SEQ ID NO: 5441280 - DNA, 18 bp, Homo sapiens
tactggaataatttgtaa

SEQ ID NO: 5441281 - DNA, 22 bp, Homo sapiens
tactggaataatttgtaaatga

SEQ ID NO: 5441282 - DNA, 16 bp, Homo sapiens
tactggaattcttctg

SEQ ID NO: 5441283 - DNA, 18 bp, Homo sapiens
tactggaatttattatgt

SEQ ID NO: 5441284 - DNA, 19 bp, Homo sapiens
tactggaccccgcctccca

SEQ ID NO: 5441285 - DNA, 22 bp, Homo sapiens
tactggacttgaatggttaata

SEQ ID NO: 5441286 - DNA, 19 bp, Homo sapiens
tactggagtggaaggtcta

SEQ ID NO: 5441287 - DNA, 18 bp, Homo sapiens
tactggataaatttaaaa

SEQ ID NO: 5441288 - DNA, 14 bp, Homo sapiens
tactggcagctcct

SEQ ID NO: 5441289 - DNA, 17 bp, Homo sapiens
tactggcatagtttcat

SEQ ID NO: 5441290 - DNA, 18 bp, Homo sapiens
tactggcattaattatta

SEQ ID NO: 5441291 - DNA, 15 bp, Homo sapiens
tactggccagtgtca

SEQ ID NO: 5441292 - DNA, 16 bp, Homo sapiens
tactggccagtgtcat

SEQ ID NO: 5441293 - DNA, 21 bp, Homo sapiens
tactggcctcgcctggcctga

SEQ ID NO: 5441294 - DNA, 13 bp, Homo sapiens
tactggcctctgt

SEQ ID NO: 5441295 - DNA, 23 bp, Homo sapiens
tactggcctgtaatctaccagtg

SEQ ID NO: 5441296 - DNA, 14 bp, Homo sapiens
tactggccttttca

SEQ ID NO: 5441297 - DNA, 21 bp, Homo sapiens
tactggcgtggattaaactta

SEQ ID NO: 5441298 - DNA, 18 bp, Homo sapiens
tactggcttacctcctca

SEQ ID NO: 5441299 - DNA, 23 bp, Homo sapiens
tactgggaaagggattttcagcc

SEQ ID NO: 5441300 - DNA, 14 bp, Homo sapiens
tactgggaagcagt

SEQ ID NO: 5441301 - DNA, 17 bp, Homo sapiens
tactgggagtgtgggct

SEQ ID NO: 5441302 - DNA, 20 bp, Homo sapiens
tactgggccatgttgtgcct

SEQ ID NO: 5441303 - DNA, 12 bp, Homo sapiens
tactgggcctta

SEQ ID NO: 5441304 - DNA, 22 bp, Homo sapiens
tactgggccttagtgggccagg

SEQ ID NO: 5441305 - DNA, 16 bp, Homo sapiens
tactggggaaactggc

SEQ ID NO: 5441306 - DNA, 24 bp, Homo sapiens
tactggggaaactggccatggcct

SEQ ID NO: 5441307 - DNA, 17 bp, Homo sapiens
tactggggaggctgagg

SEQ ID NO: 5441308 - DNA, 23 bp, Homo sapiens
tactggggagtaaacggcccagg

SEQ ID NO: 5441309 - DNA, 21 bp, Homo sapiens
tactgggggcaaaatcagaat

SEQ ID NO: 5441310 - DNA, 15 bp, Homo sapiens
tactggggggcaggc

SEQ ID NO: 5441311 - DNA, 18 bp, Homo sapiens
tactggggggcaggcctc

SEQ ID NO: 5441312 - DNA, 22 bp, Homo sapiens
tactggggggcaggcctcccaa

SEQ ID NO: 5441313 - DNA, 14 bp, Homo sapiens
tactgggtctgcga

SEQ ID NO: 5441314 - DNA, 15 bp, Homo sapiens
tactgggtgtcattt

SEQ ID NO: 5441315 - DNA, 17 bp, Homo sapiens
tactgggtgtcatttca

SEQ ID NO: 5441316 - DNA, 16 bp, Homo sapiens
tactgggttcttaacc

SEQ ID NO: 5441317 - DNA, 17 bp, Homo sapiens
tactggtaagattgtta

SEQ ID NO: 5441318 - DNA, 18 bp, Homo sapiens
tactggtaattgtacaat

SEQ ID NO: 5441319 - DNA, 15 bp, Homo sapiens
tactggtaccttccc

SEQ ID NO: 5441320 - DNA, 17 bp, Homo sapiens
tactggtatctgtcact

SEQ ID NO: 5441321 - DNA, 22 bp, Homo sapiens
tactggtattagttaaaacaca

SEQ ID NO: 5441322 - DNA, 19 bp, Homo sapiens
tactggtgagggcaagagg

SEQ ID NO: 5441323 - DNA, 22 bp, Homo sapiens
tactggtgatgcctaattatga

SEQ ID NO: 5441324 - DNA, 19 bp, Homo sapiens
tactggtgatttctgagat

SEQ ID NO: 5441325 - DNA, 19 bp, Homo sapiens
tactggtgcagtcattatg

SEQ ID NO: 5441326 - DNA, 19 bp, Homo sapiens
tactggtgtaatctcaatg

SEQ ID NO: 5441327 - DNA, 17 bp, Homo sapiens
tactggttacctggaga

SEQ ID NO: 5441328 - DNA, 20 bp, Homo sapiens
tactggttacctggagaagt

SEQ ID NO: 5441329 - DNA, 13 bp, Homo sapiens
tactggttatagt

SEQ ID NO: 5441330 - DNA, 23 bp, Homo sapiens
tactggttatagttgatatgtaa

SEQ ID NO: 5441331 - DNA, 22 bp, Homo sapiens
tactggttatcctgtgctacag

SEQ ID NO: 5441332 - DNA, 13 bp, Homo sapiens
tactggttcattg

SEQ ID NO: 5441333 - DNA, 14 bp, Homo sapiens
tactggttgcatgg

SEQ ID NO: 5441334 - DNA, 14 bp, Homo sapiens
tactggttggtgtt

SEQ ID NO: 5441335 - DNA, 19 bp, Homo sapiens
tactggttggtgttcttcc

SEQ ID NO: 5441336 - DNA, 21 bp, Homo sapiens
tactgtaaaagttataataac

SEQ ID NO: 5441337 - DNA, 22 bp, Homo sapiens
tactgtaaaagttataataact

SEQ ID NO: 5441338 - DNA, 13 bp, Homo sapiens
tactgtaaacagt

SEQ ID NO: 5441339 - DNA, 21 bp, Homo sapiens
tactgtaaacagttctgcact

SEQ ID NO: 5441340 - DNA, 17 bp, Homo sapiens
tactgtaaagaaagaga

SEQ ID NO: 5441341 - DNA, 19 bp, Homo sapiens
tactgtaaagaaagagaga

SEQ ID NO: 5441342 - DNA, 14 bp, Homo sapiens
tactgtaaagaatt

SEQ ID NO: 5441343 - DNA, 20 bp, Homo sapiens
tactgtaaagagacctacct

SEQ ID NO: 5441344 - DNA, 11 bp, Homo sapiens
tactgtaaatg

SEQ ID NO: 5441345 - DNA, 14 bp, Homo sapiens
tactgtaaatgtat

SEQ ID NO: 5441346 - DNA, 15 bp, Homo sapiens
tactgtaactgctca

SEQ ID NO: 5441347 - DNA, 13 bp, Homo sapiens
tactgtaactttt

SEQ ID NO: 5441348 - DNA, 18 bp, Homo sapiens
tactgtaagaataattta

SEQ ID NO: 5441349 - DNA, 19 bp, Homo sapiens
tactgtaagaataatttat

SEQ ID NO: 5441350 - DNA, 14 bp, Homo sapiens
tactgtaagacatt

SEQ ID NO: 5441351 - DNA, 15 bp, Homo sapiens
tactgtaagacatta

SEQ ID NO: 5441352 - DNA, 21 bp, Homo sapiens
tactgtaatagatcagcatcc

SEQ ID NO: 5441353 - DNA, 15 bp, Homo sapiens
tactgtaatcgtgct

SEQ ID NO: 5441354 - DNA, 19 bp, Homo sapiens
tactgtaatgctgcctcag

SEQ ID NO: 5441355 - DNA, 15 bp, Homo sapiens
tactgtaattcctca

SEQ ID NO: 5441356 - DNA, 13 bp, Homo sapiens
tactgtaatttct

SEQ ID NO: 5441357 - DNA, 23 bp, Homo sapiens
tactgtaatttgtgatacaatgc

SEQ ID NO: 5441358 - DNA, 16 bp, Homo sapiens
tactgtacacattaag

SEQ ID NO: 5441359 - DNA, 11 bp, Homo sapiens
tactgtacata

SEQ ID NO: 5441360 - DNA, 19 bp, Homo sapiens
tactgtacataaacaatga

SEQ ID NO: 5441361 - DNA, 21 bp, Homo sapiens
tactgtacataaacaatgatg

SEQ ID NO: 5441362 - DNA, 16 bp, Homo sapiens
tactgtacataaattc

SEQ ID NO: 5441363 - DNA, 18 bp, Homo sapiens
tactgtacataaattcca

SEQ ID NO: 5441364 - DNA, 17 bp, Homo sapiens
tactgtacatagatgta

SEQ ID NO: 5441365 - DNA, 22 bp, Homo sapiens
tactgtacatgaaaacacattt

SEQ ID NO: 5441366 - DNA, 14 bp, Homo sapiens
tactgtacatgcta

SEQ ID NO: 5441367 - DNA, 15 bp, Homo sapiens
tactgtacatgctat

SEQ ID NO: 5441368 - DNA, 15 bp, Homo sapiens
tactgtacatgggac

SEQ ID NO: 5441369 - DNA, 14 bp, Homo sapiens
tactgtacttaata

SEQ ID NO: 5441370 - DNA, 15 bp, Homo sapiens
tactgtactttttta

SEQ ID NO: 5441371 - DNA, 17 bp, Homo sapiens
tactgtagaaaggaaat

SEQ ID NO: 5441372 - DNA, 16 bp, Homo sapiens
tactgtagaactgatt

SEQ ID NO: 5441373 - DNA, 16 bp, Homo sapiens
tactgtagatttcagt

SEQ ID NO: 5441374 - DNA, 18 bp, Homo sapiens
tactgtagatttcagtag

SEQ ID NO: 5441375 - DNA, 11 bp, Homo sapiens
tactgtagcaa

SEQ ID NO: 5441376 - DNA, 16 bp, Homo sapiens
tactgtagcaatatat

SEQ ID NO: 5441377 - DNA, 18 bp, Homo sapiens
tactgtagcaatatattt

SEQ ID NO: 5441378 - DNA, 23 bp, Homo sapiens
tactgtagttgtcacagtcttgt

SEQ ID NO: 5441379 - DNA, 15 bp, Homo sapiens
tactgtataaacaaa

SEQ ID NO: 5441380 - DNA, 16 bp, Homo sapiens
tactgtataaacaaat

SEQ ID NO: 5441381 - DNA, 12 bp, Homo sapiens
tactgtatactg

SEQ ID NO: 5441382 - DNA, 17 bp, Homo sapiens
tactgtatagacagttt

SEQ ID NO: 5441383 - DNA, 15 bp, Homo sapiens
tactgtatataaact

SEQ ID NO: 5441384 - DNA, 16 bp, Homo sapiens
tactgtatattttgta

SEQ ID NO: 5441385 - DNA, 16 bp, Homo sapiens
tactgtatcaataaaa

SEQ ID NO: 5441386 - DNA, 21 bp, Homo sapiens
tactgtatcaataaaattctg

SEQ ID NO: 5441387 - DNA, 14 bp, Homo sapiens
tactgtatcaattt

SEQ ID NO: 5441388 - DNA, 18 bp, Homo sapiens
tactgtattgggcttctt

SEQ ID NO: 5441389 - DNA, 21 bp, Homo sapiens
tactgtatttcattatctgta

SEQ ID NO: 5441390 - DNA, 15 bp, Homo sapiens
tactgtatttctaag

SEQ ID NO: 5441391 - DNA, 16 bp, Homo sapiens
tactgtatttctaaga

SEQ ID NO: 5441392 - DNA, 17 bp, Homo sapiens
tactgtattttgtattg

SEQ ID NO: 5441393 - DNA, 18 bp, Homo sapiens
tactgtcaaaataatttt

SEQ ID NO: 5441394 - DNA, 19 bp, Homo sapiens
tactgtcaaaataatttta

SEQ ID NO: 5441395 - DNA, 15 bp, Homo sapiens
tactgtcaaacaata

SEQ ID NO: 5441396 - DNA, 15 bp, Homo sapiens
tactgtcaaatgatg

SEQ ID NO: 5441397 - DNA, 16 bp, Homo sapiens
tactgtcaaatgatgt

SEQ ID NO: 5441398 - DNA, 21 bp, Homo sapiens
tactgtcaaatgatgtgcaaa

SEQ ID NO: 5441399 - DNA, 11 bp, Homo sapiens
tactgtcaata

SEQ ID NO: 5441400 - DNA, 15 bp, Homo sapiens
tactgtcaataaaca

SEQ ID NO: 5441401 - DNA, 16 bp, Homo sapiens
tactgtcagagaatat

SEQ ID NO: 5441402 - DNA, 14 bp, Homo sapiens
tactgtcagattaa

SEQ ID NO: 5441403 - DNA, 23 bp, Homo sapiens
tactgtcagctcccctcggagaa

SEQ ID NO: 5441404 - DNA, 19 bp, Homo sapiens
tactgtcagtgtcctcagg

SEQ ID NO: 5441405 - DNA, 21 bp, Homo sapiens
tactgtccagcttatagtctt

SEQ ID NO: 5441406 - DNA, 11 bp, Homo sapiens
tactgtcccag

SEQ ID NO: 5441407 - DNA, 15 bp, Homo sapiens
tactgtcctcagagg

SEQ ID NO: 5441408 - DNA, 16 bp, Homo sapiens
tactgtctaagcagtt

SEQ ID NO: 5441409 - DNA, 18 bp, Homo sapiens
tactgtctattaatattc

SEQ ID NO: 5441410 - DNA, 15 bp, Homo sapiens
tactgtctcctccct

SEQ ID NO: 5441411 - DNA, 19 bp, Homo sapiens
tactgtctcctccctgggc

SEQ ID NO: 5441412 - DNA, 15 bp, Homo sapiens
tactgtctccttccc

SEQ ID NO: 5441413 - DNA, 16 bp, Homo sapiens
tactgtctccttccca

SEQ ID NO: 5441414 - DNA, 21 bp, Homo sapiens
tactgtctccttcccactgtc

SEQ ID NO: 5441415 - DNA, 13 bp, Homo sapiens
tactgtctgacta

SEQ ID NO: 5441416 - DNA, 20 bp, Homo sapiens
tactgtctgactacaacatg

SEQ ID NO: 5441417 - DNA, 19 bp, Homo sapiens
tactgtctggttttaacaa

SEQ ID NO: 5441418 - DNA, 20 bp, Homo sapiens
tactgtctggttttaacaat

SEQ ID NO: 5441419 - DNA, 21 bp, Homo sapiens
tactgtctggttttaacaatt

SEQ ID NO: 5441420 - DNA, 19 bp, Homo sapiens
tactgtctttattcttatt

SEQ ID NO: 5441421 - DNA, 19 bp, Homo sapiens
tactgtgaaaaaaaatttg

SEQ ID NO: 5441422 - DNA, 15 bp, Homo sapiens
tactgtgaaactggc

SEQ ID NO: 5441423 - DNA, 22 bp, Homo sapiens
tactgtgaaatgagttggccag

SEQ ID NO: 5441424 - DNA, 16 bp, Homo sapiens
tactgtgaagagaatg

SEQ ID NO: 5441425 - DNA, 23 bp, Homo sapiens
tactgtgaagttacatgcataaa

SEQ ID NO: 5441426 - DNA, 18 bp, Homo sapiens
tactgtgacctttgtcta

SEQ ID NO: 5441427 - DNA, 14 bp, Homo sapiens
tactgtgactttat

SEQ ID NO: 5441428 - DNA, 22 bp, Homo sapiens
tactgtgagaactgtgaatatg

SEQ ID NO: 5441429 - DNA, 13 bp, Homo sapiens
tactgtgatttct

SEQ ID NO: 5441430 - DNA, 15 bp, Homo sapiens
tactgtgatttctgg

SEQ ID NO: 5441431 - DNA, 13 bp, Homo sapiens
tactgtgcagaat

SEQ ID NO: 5441432 - DNA, 15 bp, Homo sapiens
tactgtgcatacatg

SEQ ID NO: 5441433 - DNA, 15 bp, Homo sapiens
tactttttgtagaga

SEQ ID NO: 5441434 - DNA, 21 bp, Homo sapiens
tactttttgtagagagagctg

SEQ ID NO: 5441435 - DNA, 15 bp, Homo sapiens
tactttttgtgaaga

SEQ ID NO: 5441436 - DNA, 14 bp, Homo sapiens
tacttttttaaaat

SEQ ID NO: 5441437 - DNA, 23 bp, Homo sapiens
tacttttttaaatattttctatt

SEQ ID NO: 5441438 - DNA, 20 bp, Homo sapiens
tacttttttaacatgtgtta

SEQ ID NO: 5441439 - DNA, 19 bp, Homo sapiens
tacttttttacactgataa

SEQ ID NO: 5441440 - DNA, 17 bp, Homo sapiens
tacttttttcaaatatt

SEQ ID NO: 5441441 - DNA, 19 bp, Homo sapiens
tacttttttcaaatattga

SEQ ID NO: 5441442 - DNA, 20 bp, Homo sapiens
tacttttttcaaatattgaa

SEQ ID NO: 5441443 - DNA, 15 bp, Homo sapiens
tacttttttcttaag

SEQ ID NO: 5441444 - DNA, 14 bp, Homo sapiens
tacttttttgaaat

SEQ ID NO: 5441445 - DNA, 23 bp, Homo sapiens
tactttttttggaagttatttat

SEQ ID NO: 5441446 - DNA, 15 bp, Homo sapiens
tactttttttgttat

SEQ ID NO: 5441447 - DNA, 23 bp, Homo sapiens
tactttttttgttatagattgtc

SEQ ID NO: 5441448 - DNA, 21 bp, Homo sapiens
tacttttttttttttttggta

SEQ ID NO: 5441449 - DNA, 17 bp, Homo sapiens
tagaaaaaaaaataaca

SEQ ID NO: 5441450 - DNA, 23 bp, Homo sapiens
tagaaaaaaaaataacacttaac

SEQ ID NO: 5441451 - DNA, 16 bp, Homo sapiens
tagaaaaaaacaaact

SEQ ID NO: 5441452 - DNA, 13 bp, Homo sapiens
tagaaaaaaagaa

SEQ ID NO: 5441453 - DNA, 15 bp, Homo sapiens
tagaaaaaaagaaaa

SEQ ID NO: 5441454 - DNA, 23 bp, Homo sapiens
tagaaaaaactggaaacatctga

SEQ ID NO: 5441455 - DNA, 23 bp, Homo sapiens
tagaaaaaagtagcaaatgttta

SEQ ID NO: 5441456 - DNA, 21 bp, Homo sapiens
tagaaaaacatctgaagagct

SEQ ID NO: 5441457 - DNA, 21 bp, Homo sapiens
tagaaaaacatttaaactttt

SEQ ID NO: 5441458 - DNA, 20 bp, Homo sapiens
tagaaaaagaacatgcagtt

SEQ ID NO: 5441459 - DNA, 21 bp, Homo sapiens
tagaaaaagaacatgcagttt

SEQ ID NO: 5441460 - DNA, 11 bp, Homo sapiens
tagaaaaagca

SEQ ID NO: 5441461 - DNA, 18 bp, Homo sapiens
tagaaaaaggatggaaga

SEQ ID NO: 5441462 - DNA, 14 bp, Homo sapiens
tagaaaaagggtca

SEQ ID NO: 5441463 - DNA, 19 bp, Homo sapiens
tagaaaaagtaaaagatca

SEQ ID NO: 5441464 - DNA, 19 bp, Homo sapiens
tagaaaaagtcaatgtact

SEQ ID NO: 5441465 - DNA, 17 bp, Homo sapiens
tagaaaaataaaatgtt

SEQ ID NO: 5441466 - DNA, 16 bp, Homo sapiens
tagaaaaatgatgtct

SEQ ID NO: 5441467 - DNA, 12 bp, Homo sapiens
tagaaaaatgga

SEQ ID NO: 5441468 - DNA, 19 bp, Homo sapiens
tagaaaaatgtataaaaat

SEQ ID NO: 5441469 - DNA, 15 bp, Homo sapiens
tagaaaaattgtttc

SEQ ID NO: 5441470 - DNA, 13 bp, Homo sapiens
tagaaaaatttca

SEQ ID NO: 5441471 - DNA, 20 bp, Homo sapiens
tagaaaacaatgcaaaacct

SEQ ID NO: 5441472 - DNA, 22 bp, Homo sapiens
tagaaaacaggaaaaaaacttt

SEQ ID NO: 5441473 - DNA, 20 bp, Homo sapiens
tagaaaaccccacagaaatc

SEQ ID NO: 5441474 - DNA, 21 bp, Homo sapiens
tagaaaaccccacagaaatct

SEQ ID NO: 5441475 - DNA, 19 bp, Homo sapiens
tagaaaactaatctaaact

SEQ ID NO: 5441476 - DNA, 16 bp, Homo sapiens
tagaaaactgaaaatc

SEQ ID NO: 5441477 - DNA, 21 bp, Homo sapiens
tagaaaactgaaaatctaata

SEQ ID NO: 5441478 - DNA, 22 bp, Homo sapiens
tagaaaactgaaaatctaatat

SEQ ID NO: 5441479 - DNA, 11 bp, Homo sapiens
tagaaaacttt

SEQ ID NO: 5441480 - DNA, 13 bp, Homo sapiens
tagaaaactttgt

SEQ ID NO: 5441481 - DNA, 14 bp, Homo sapiens
tagaaaactttgtt

SEQ ID NO: 5441482 - DNA, 21 bp, Homo sapiens
tagaaaagaaaaaaaaaatat

SEQ ID NO: 5441483 - DNA, 17 bp, Homo sapiens
tagaaaagaaaacattt

SEQ ID NO: 5441484 - DNA, 21 bp, Homo sapiens
tagaaaagaaaacatttaaca

SEQ ID NO: 5441485 - DNA, 14 bp, Homo sapiens
tagaaaagaaatgg

SEQ ID NO: 5441486 - DNA, 16 bp, Homo sapiens
tagaaaagagacttct

SEQ ID NO: 5441487 - DNA, 18 bp, Homo sapiens
tagaaaagagacttctct

SEQ ID NO: 5441488 - DNA, 22 bp, Homo sapiens
tagaaaagcagtcccattcata

SEQ ID NO: 5441489 - DNA, 23 bp, Homo sapiens
tagaaaagcagtcccattcatat

SEQ ID NO: 5441490 - DNA, 12 bp, Homo sapiens
tagaaaaggaag

SEQ ID NO: 5441491 - DNA, 17 bp, Homo sapiens
tagaaaaggcgtgcagt

SEQ ID NO: 5441492 - DNA, 18 bp, Homo sapiens
tagaaaagtgaattgaag

SEQ ID NO: 5441493 - DNA, 22 bp, Homo sapiens
tagaaaagtggtgtaaacttgt

SEQ ID NO: 5441494 - DNA, 16 bp, Homo sapiens
tagaaaagttaacatt

SEQ ID NO: 5441495 - DNA, 19 bp, Homo sapiens
tagaaaagttgctcttaaa

SEQ ID NO: 5441496 - DNA, 21 bp, Homo sapiens
tagaaaagtttgttttacttt

SEQ ID NO: 5441497 - DNA, 17 bp, Homo sapiens
tagaaaataaatacaag

SEQ ID NO: 5441498 - DNA, 17 bp, Homo sapiens
tagaaaataatgcaaat

SEQ ID NO: 5441499 - DNA, 21 bp, Homo sapiens
tagaaaatagagcttttaaaa

SEQ ID NO: 5441500 - DNA, 23 bp, Homo sapiens
tagaaaataggggttaagactga

SEQ ID NO: 5441501 - DNA, 16 bp, Homo sapiens
tagaaaatccttcagc

SEQ ID NO: 5441502 - DNA, 15 bp, Homo sapiens
tagaaaatcttagta

SEQ ID NO: 5441503 - DNA, 12 bp, Homo sapiens
tagaaaatgaac

SEQ ID NO: 5441504 - DNA, 19 bp, Homo sapiens
tagaaaatgaactgtatat

SEQ ID NO: 5441505 - DNA, 15 bp, Homo sapiens
tagaaaatgagaaaa

SEQ ID NO: 5441506 - DNA, 13 bp, Homo sapiens
tagaaaatgagga

SEQ ID NO: 5441507 - DNA, 19 bp, Homo sapiens
tagaaaatgcaaaatgaaa

SEQ ID NO: 5441508 - DNA, 14 bp, Homo sapiens
tagaaaatgcacca

SEQ ID NO: 5441509 - DNA, 21 bp, Homo sapiens
tagaaaatggaaaatatacaa

SEQ ID NO: 5441510 - DNA, 21 bp, Homo sapiens
tagaaaatgtgaccctccaaa

SEQ ID NO: 5441511 - DNA, 21 bp, Homo sapiens
tagaaaatgtttggaatttaa

SEQ ID NO: 5441512 - DNA, 14 bp, Homo sapiens
tagaaaattaaaat

SEQ ID NO: 5441513 - DNA, 19 bp, Homo sapiens
tagaaaattagtgaccatt

SEQ ID NO: 5441514 - DNA, 17 bp, Homo sapiens
tagaaaattatgcagct

SEQ ID NO: 5441515 - DNA, 16 bp, Homo sapiens
tagaaaattcagctcc

SEQ ID NO: 5441516 - DNA, 17 bp, Homo sapiens
tagaaaatttaaaacat

SEQ ID NO: 5441517 - DNA, 22 bp, Homo sapiens
tagaaaatttaaaacattactc

SEQ ID NO: 5441518 - DNA, 23 bp, Homo sapiens
tagaaaattttatgtattttaaa

SEQ ID NO: 5441519 - DNA, 15 bp, Homo sapiens
tagaaaattttgtaa

SEQ ID NO: 5441520 - DNA, 16 bp, Homo sapiens
tagaaacaaaatacaa

SEQ ID NO: 5441521 - DNA, 17 bp, Homo sapiens
tagaaacaacactgtag

SEQ ID NO: 5441522 - DNA, 20 bp, Homo sapiens
tagaaacaacactgtagtaa

SEQ ID NO: 5441523 - DNA, 15 bp, Homo sapiens
tagaaacacaactat

SEQ ID NO: 5441524 - DNA, 21 bp, Homo sapiens
tagaaacacataattaacact

SEQ ID NO: 5441525 - DNA, 10 bp, Homo sapiens
tagaaacaga

SEQ ID NO: 5441526 - DNA, 18 bp, Homo sapiens
tagaaacataaataaaat

SEQ ID NO: 5441527 - DNA, 13 bp, Homo sapiens
tagaaacatacac

SEQ ID NO: 5441528 - DNA, 15 bp, Homo sapiens
tagaaacatacacaa

SEQ ID NO: 5441529 - DNA, 13 bp, Homo sapiens
tagaaacatgaca

SEQ ID NO: 5441530 - DNA, 14 bp, Homo sapiens
tagaaacattgtaa

SEQ ID NO: 5441531 - DNA, 14 bp, Homo sapiens
tagaaaccaaatta

SEQ ID NO: 5441532 - DNA, 17 bp, Homo sapiens
tagaaaccagtatggaa

SEQ ID NO: 5441533 - DNA, 18 bp, Homo sapiens
tagaaacccaagctcctc

SEQ ID NO: 5441534 - DNA, 19 bp, Homo sapiens
tagaaacctcattggccag

SEQ ID NO: 5441535 - DNA, 14 bp, Homo sapiens
tagaaaccttaata

SEQ ID NO: 5441536 - DNA, 15 bp, Homo sapiens
tagaaaccttaatat

SEQ ID NO: 5441537 - DNA, 22 bp, Homo sapiens
tagaaacctttatccctgctta

SEQ ID NO: 5441538 - DNA, 22 bp, Homo sapiens
tagaaacgtaaactatgaccta

SEQ ID NO: 5441539 - DNA, 20 bp, Homo sapiens
tagaaacgtgataaatatat

SEQ ID NO: 5441540 - DNA, 19 bp, Homo sapiens
tagaaactaattgacttta

SEQ ID NO: 5441541 - DNA, 19 bp, Homo sapiens
tagaaactcaccatgtaaa

SEQ ID NO: 5441542 - DNA, 16 bp, Homo sapiens
tagaaactctggctca

SEQ ID NO: 5441543 - DNA, 20 bp, Homo sapiens
tagaaactctggctcagcct

SEQ ID NO: 5441544 - DNA, 13 bp, Homo sapiens
tagaaactgaaaa

SEQ ID NO: 5441545 - DNA, 14 bp, Homo sapiens
tagaaactgaaaaa

SEQ ID NO: 5441546 - DNA, 21 bp, Homo sapiens
tagaaactgaaaactgtaaat

SEQ ID NO: 5441547 - DNA, 16 bp, Homo sapiens
tagaaactgaggccca

SEQ ID NO: 5441548 - DNA, 20 bp, Homo sapiens
tagaaactgaggcccagaga

SEQ ID NO: 5441549 - DNA, 14 bp, Homo sapiens
tagaaactggaaat

SEQ ID NO: 5441550 - DNA, 18 bp, Homo sapiens
tagaaactggaaatacta

SEQ ID NO: 5441551 - DNA, 16 bp, Homo sapiens
tagaaacttaaacaca

SEQ ID NO: 5441552 - DNA, 15 bp, Homo sapiens
tagaaacttccaaat

SEQ ID NO: 5441553 - DNA, 15 bp, Homo sapiens
tagaaactttggaag

SEQ ID NO: 5441554 - DNA, 16 bp, Homo sapiens
tagaaagaaaattata

SEQ ID NO: 5441555 - DNA, 13 bp, Homo sapiens
tagaaagaagcca

SEQ ID NO: 5441556 - DNA, 14 bp, Homo sapiens
tagaaagaagccca

SEQ ID NO: 5441557 - DNA, 21 bp, Homo sapiens
tagaaagaagcccaatattat

SEQ ID NO: 5441558 - DNA, 23 bp, Homo sapiens
tagaaagaagctcgccccacctc

SEQ ID NO: 5441559 - DNA, 17 bp, Homo sapiens
tagaaagacagagctgg

SEQ ID NO: 5441560 - DNA, 12 bp, Homo sapiens
tagaaagacatg

SEQ ID NO: 5441561 - DNA, 17 bp, Homo sapiens
tagaaagagatacagag

SEQ ID NO: 5441562 - DNA, 12 bp, Homo sapiens
tagaaagagtct

SEQ ID NO: 5441563 - DNA, 14 bp, Homo sapiens
tagaaagagttcta

SEQ ID NO: 5441564 - DNA, 13 bp, Homo sapiens
tagaaagcatttg

SEQ ID NO: 5441565 - DNA, 22 bp, Homo sapiens
tagaaagcatttgaatgcattt

SEQ ID NO: 5441566 - DNA, 18 bp, Homo sapiens
tagaaagccatattccag

SEQ ID NO: 5441567 - DNA, 22 bp, Homo sapiens
tagaaagccatatttttttctg

SEQ ID NO: 5441568 - DNA, 23 bp, Homo sapiens
tagaaagcccctcacctcaggac

SEQ ID NO: 5441569 - DNA, 11 bp, Homo sapiens
tagaaagctaa

SEQ ID NO: 5441570 - DNA, 13 bp, Homo sapiens
tagaaagctaaat

SEQ ID NO: 5441571 - DNA, 12 bp, Homo sapiens
tagaaagctaat

SEQ ID NO: 5441572 - DNA, 11 bp, Homo sapiens
tagaaagctat

SEQ ID NO: 5441573 - DNA, 21 bp, Homo sapiens
tagaaagctctgcatgtgtgt

SEQ ID NO: 5441574 - DNA, 14 bp, Homo sapiens
tagaaagctggact

SEQ ID NO: 5441575 - DNA, 20 bp, Homo sapiens
tagaaagctggcaacatgaa

SEQ ID NO: 5441576 - DNA, 18 bp, Homo sapiens
tagaaagcttgaaaagat

SEQ ID NO: 5441577 - DNA, 22 bp, Homo sapiens
tagaaagctttgttgaaagaaa

SEQ ID NO: 5441578 - DNA, 13 bp, Homo sapiens
tagaaaggaacac

SEQ ID NO: 5441579 - DNA, 21 bp, Homo sapiens
tagaaaggacaacagttctga

SEQ ID NO: 5441580 - DNA, 20 bp, Homo sapiens
tagaaaggagagaacgggcg

SEQ ID NO: 5441581 - DNA, 14 bp, Homo sapiens
tagaaaggccttta

SEQ ID NO: 5441582 - DNA, 15 bp, Homo sapiens
tagaaaggcctttaa

SEQ ID NO: 5441583 - DNA, 16 bp, Homo sapiens
tagaaaggctaacaaa

SEQ ID NO: 5441584 - DNA, 23 bp, Homo sapiens
tagaaaggttgattctcatgcac

SEQ ID NO: 5441585 - DNA, 18 bp, Homo sapiens
tagaaagtgccagaaagt

SEQ ID NO: 5441586 - DNA, 21 bp, Homo sapiens
tagaaagtgcttagaggttct

SEQ ID NO: 5441587 - DNA, 22 bp, Homo sapiens
tagaaagtgttctgttacaaaa

SEQ ID NO: 5441588 - DNA, 15 bp, Homo sapiens
tagaaagttattgtg

SEQ ID NO: 5441589 - DNA, 23 bp, Homo sapiens
tagaaagttattgtgttgcctta

SEQ ID NO: 5441590 - DNA, 18 bp, Homo sapiens
tagaaagttccaaatgtt

SEQ ID NO: 5441591 - DNA, 23 bp, Homo sapiens
tagaaagttgctaactgggaaga

SEQ ID NO: 5441592 - DNA, 15 bp, Homo sapiens
tagaaataaaagatg

SEQ ID NO: 5441593 - DNA, 15 bp, Homo sapiens
tagaaataaacctta

SEQ ID NO: 5441594 - DNA, 16 bp, Homo sapiens
tagaaataaagcatct

SEQ ID NO: 5441595 - DNA, 19 bp, Homo sapiens
tagaaataaatagctatat

SEQ ID NO: 5441596 - DNA, 18 bp, Homo sapiens
tagaaataaatgaaaaca

SEQ ID NO: 5441597 - DNA, 14 bp, Homo sapiens
tagaaataaattac

SEQ ID NO: 5441598 - DNA, 15 bp, Homo sapiens
tagaaataaattact

SEQ ID NO: 5441599 - DNA, 22 bp, Homo sapiens
tagaaataagtggttatttctc

SEQ ID NO: 5441600 - DNA, 15 bp, Homo sapiens
tagaaataatatgca

SEQ ID NO: 5441601 - DNA, 16 bp, Homo sapiens
tagaaataatatgcat

SEQ ID NO: 5441602 - DNA, 23 bp, Homo sapiens
tagaaatacacttttttccaaag

SEQ ID NO: 5441603 - DNA, 23 bp, Homo sapiens
tagaaatacccaacgcacaaatg

SEQ ID NO: 5441604 - DNA, 13 bp, Homo sapiens
tagaaatactttt

SEQ ID NO: 5441605 - DNA, 15 bp, Homo sapiens
tagaaatataattga

SEQ ID NO: 5441606 - DNA, 18 bp, Homo sapiens
tagaaatatctttctctt

SEQ ID NO: 5441607 - DNA, 16 bp, Homo sapiens
tagaaatattaaagat

SEQ ID NO: 5441608 - DNA, 20 bp, Homo sapiens
tagaaatattgctctaattc

SEQ ID NO: 5441609 - DNA, 23 bp, Homo sapiens
tagaaatcaagcataaatcactt

SEQ ID NO: 5441610 - DNA, 20 bp, Homo sapiens
tagacaaatactcatgtgta

SEQ ID NO: 5441611 - DNA, 20 bp, Homo sapiens
tagacaaatagaaaatggtc

SEQ ID NO: 5441612 - DNA, 19 bp, Homo sapiens
tagacaaccatagaactgt

SEQ ID NO: 5441613 - DNA, 15 bp, Homo sapiens
tagacaaccctgcaa

SEQ ID NO: 5441614 - DNA, 14 bp, Homo sapiens
tagacaacctttct

SEQ ID NO: 5441615 - DNA, 15 bp, Homo sapiens
tagacaacctttctg

SEQ ID NO: 5441616 - DNA, 17 bp, Homo sapiens
tagacaacctttctgta

SEQ ID NO: 5441617 - DNA, 21 bp, Homo sapiens
tagacaacgatgaatttcttc

SEQ ID NO: 5441618 - DNA, 18 bp, Homo sapiens
tagacaactagatttgtc

SEQ ID NO: 5441619 - DNA, 18 bp, Homo sapiens
tagacaactcttccattt

SEQ ID NO: 5441620 - DNA, 17 bp, Homo sapiens
tagacaagatattgtac

SEQ ID NO: 5441621 - DNA, 13 bp, Homo sapiens
tagacaagccaga

SEQ ID NO: 5441622 - DNA, 12 bp, Homo sapiens
tagacaagcctg

SEQ ID NO: 5441623 - DNA, 13 bp, Homo sapiens
tagacaagcctgg

SEQ ID NO: 5441624 - DNA, 14 bp, Homo sapiens
tagacaagcctgga

SEQ ID NO: 5441625 - DNA, 12 bp, Homo sapiens
tagacaagtgtt

SEQ ID NO: 5441626 - DNA, 13 bp, Homo sapiens
tagacaagttttg

SEQ ID NO: 5441627 - DNA, 18 bp, Homo sapiens
tagacaatataagagctt

SEQ ID NO: 5441628 - DNA, 23 bp, Homo sapiens
tagacaatcattgttttgaatat

SEQ ID NO: 5441629 - DNA, 12 bp, Homo sapiens
tagacaatgtgg

SEQ ID NO: 5441630 - DNA, 17 bp, Homo sapiens
tagacaatgtggaatta

SEQ ID NO: 5441631 - DNA, 20 bp, Homo sapiens
tagacaatgtggaattacat

SEQ ID NO: 5441632 - DNA, 23 bp, Homo sapiens
tagacaatgtggaattacataac

SEQ ID NO: 5441633 - DNA, 15 bp, Homo sapiens
tagacaattgaggta

SEQ ID NO: 5441634 - DNA, 16 bp, Homo sapiens
tagacaatttattatg

SEQ ID NO: 5441635 - DNA, 12 bp, Homo sapiens
tagacacacaaa

SEQ ID NO: 5441636 - DNA, 11 bp, Homo sapiens
tagacacacat

SEQ ID NO: 5441637 - DNA, 18 bp, Homo sapiens
tagacacacatatacatt

SEQ ID NO: 5441638 - DNA, 13 bp, Homo sapiens
tagacacacatga

SEQ ID NO: 5441639 - DNA, 19 bp, Homo sapiens
tagacacagtattgacttc

SEQ ID NO: 5441640 - DNA, 19 bp, Homo sapiens
tagacacatgaaggtaaat

SEQ ID NO: 5441641 - DNA, 15 bp, Homo sapiens
tagacacatttaagg

SEQ ID NO: 5441642 - DNA, 20 bp, Homo sapiens
tagacaccaaagttctaata

SEQ ID NO: 5441643 - DNA, 21 bp, Homo sapiens
tagacaccaaagttctaataa

SEQ ID NO: 5441644 - DNA, 16 bp, Homo sapiens
tagacaccaaggaggc

SEQ ID NO: 5441645 - DNA, 16 bp, Homo sapiens
tagacaccacctggag

SEQ ID NO: 5441646 - DNA, 18 bp, Homo sapiens
tagacaccacctggagtg

SEQ ID NO: 5441647 - DNA, 18 bp, Homo sapiens
tagacacccattttcaca

SEQ ID NO: 5441648 - DNA, 14 bp, Homo sapiens
tagacaccctggca

SEQ ID NO: 5441649 - DNA, 16 bp, Homo sapiens
tagacacgcacggcag

SEQ ID NO: 5441650 - DNA, 17 bp, Homo sapiens
tagacactccccacggg

SEQ ID NO: 5441651 - DNA, 15 bp, Homo sapiens
tagacactgaaggca

SEQ ID NO: 5441652 - DNA, 13 bp, Homo sapiens
tagacactggaca

SEQ ID NO: 5441653 - DNA, 15 bp, Homo sapiens
tagacactgggagaa

SEQ ID NO: 5441654 - DNA, 17 bp, Homo sapiens
tagacactgggagaaga

SEQ ID NO: 5441655 - DNA, 16 bp, Homo sapiens
tagacactttacctct

SEQ ID NO: 5441656 - DNA, 23 bp, Homo sapiens
tagacactttggaatctaaccac

SEQ ID NO: 5441657 - DNA, 13 bp, Homo sapiens
tagacagaaacag

SEQ ID NO: 5441658 - DNA, 18 bp, Homo sapiens
tagacagaaaccaagcca

SEQ ID NO: 5441659 - DNA, 14 bp, Homo sapiens
tagacagaacacct

SEQ ID NO: 5441660 - DNA, 15 bp, Homo sapiens
tagacagaacaccta

SEQ ID NO: 5441661 - DNA, 15 bp, Homo sapiens
tagacagaagaaaca

SEQ ID NO: 5441662 - DNA, 10 bp, Homo sapiens
tagacagagt

SEQ ID NO: 5441663 - DNA, 21 bp, Homo sapiens
tagacagagtctcactgttgc

SEQ ID NO: 5441664 - DNA, 18 bp, Homo sapiens
tagacagatatttcaaac

SEQ ID NO: 5441665 - DNA, 22 bp, Homo sapiens
tagacagatgtggacatgcacc

SEQ ID NO: 5441666 - DNA, 22 bp, Homo sapiens
tagacaggaaaagcatgtctta

SEQ ID NO: 5441667 - DNA, 20 bp, Homo sapiens
tagacaggttaaatatataa

SEQ ID NO: 5441668 - DNA, 23 bp, Homo sapiens
tagacaggttaaatatataaaca

SEQ ID NO: 5441669 - DNA, 14 bp, Homo sapiens
tagacagtgctgcc

SEQ ID NO: 5441670 - DNA, 16 bp, Homo sapiens
tagacagtgctgccct

SEQ ID NO: 5441671 - DNA, 21 bp, Homo sapiens
tagacagttaaactggcttaa

SEQ ID NO: 5441672 - DNA, 21 bp, Homo sapiens
tagacagtttgtaaatgttat

SEQ ID NO: 5441673 - DNA, 20 bp, Homo sapiens
tagacataaagaagaaactt

SEQ ID NO: 5441674 - DNA, 15 bp, Homo sapiens
tagacataaattgta

SEQ ID NO: 5441675 - DNA, 18 bp, Homo sapiens
tagacataaattgtaatt

SEQ ID NO: 5441676 - DNA, 12 bp, Homo sapiens
tagacatatttg

SEQ ID NO: 5441677 - DNA, 13 bp, Homo sapiens
tagacatcaaact

SEQ ID NO: 5441678 - DNA, 20 bp, Homo sapiens
tagacatccccctccttgcc

SEQ ID NO: 5441679 - DNA, 19 bp, Homo sapiens
tagacatctacctatactt

SEQ ID NO: 5441680 - DNA, 22 bp, Homo sapiens
tagacatggaggttctaaggcc

SEQ ID NO: 5441681 - DNA, 23 bp, Homo sapiens
tagacatggaggttctaaggcct

SEQ ID NO: 5441682 - DNA, 19 bp, Homo sapiens
tagacattatcttttggct

SEQ ID NO: 5441683 - DNA, 13 bp, Homo sapiens
tagacattctgtc

SEQ ID NO: 5441684 - DNA, 15 bp, Homo sapiens
tagacattgtaaata

SEQ ID NO: 5441685 - DNA, 19 bp, Homo sapiens
tagacatttcaaaattaat

SEQ ID NO: 5441686 - DNA, 18 bp, Homo sapiens
tagacatttctcttactg

SEQ ID NO: 5441687 - DNA, 21 bp, Homo sapiens
tagacatttctcttactgcaa

SEQ ID NO: 5441688 - DNA, 23 bp, Homo sapiens
tagacatttctcttactgcaaat

SEQ ID NO: 5441689 - DNA, 19 bp, Homo sapiens
tagacatttgtaaatgtaa

SEQ ID NO: 5441690 - DNA, 20 bp, Homo sapiens
tagacatttgtgtggaaatc

SEQ ID NO: 5441691 - DNA, 21 bp, Homo sapiens
tagacatttgtgtggaaatca

SEQ ID NO: 5441692 - DNA, 23 bp, Homo sapiens
tagacatttgtgtggaaatcata

SEQ ID NO: 5441693 - DNA, 18 bp, Homo sapiens
tagacattttaacaagaa

SEQ ID NO: 5441694 - DNA, 19 bp, Homo sapiens
tagacattttaacaagaag

SEQ ID NO: 5441695 - DNA, 21 bp, Homo sapiens
tagacattttaacaagaagat

SEQ ID NO: 5441696 - DNA, 23 bp, Homo sapiens
tagacattttaacaagaagatga

SEQ ID NO: 5441697 - DNA, 12 bp, Homo sapiens
tagacattttga

SEQ ID NO: 5441698 - DNA, 15 bp, Homo sapiens
tagacattttgaaat

SEQ ID NO: 5441699 - DNA, 16 bp, Homo sapiens
tagacatttttgtgcc

SEQ ID NO: 5441700 - DNA, 18 bp, Homo sapiens
tagaccaagcttgtccaa

SEQ ID NO: 5441701 - DNA, 13 bp, Homo sapiens
tagaccaaggaac

SEQ ID NO: 5441702 - DNA, 14 bp, Homo sapiens
tagaccaaggaaca

SEQ ID NO: 5441703 - DNA, 18 bp, Homo sapiens
tagaccaaggaacaaaaa

SEQ ID NO: 5441704 - DNA, 12 bp, Homo sapiens
tagaccaataaa

SEQ ID NO: 5441705 - DNA, 16 bp, Homo sapiens
tagaccaattgaagca

SEQ ID NO: 5441706 - DNA, 23 bp, Homo sapiens
tagaccacggctgccccttccac

SEQ ID NO: 5441707 - DNA, 22 bp, Homo sapiens
tagaccagcagacagagccagg

SEQ ID NO: 5441708 - DNA, 16 bp, Homo sapiens
tagaccaggatttcta

SEQ ID NO: 5441709 - DNA, 18 bp, Homo sapiens
tagaccagggctgctctt

SEQ ID NO: 5441710 - DNA, 22 bp, Homo sapiens
tagaccagggctgctctttcca

SEQ ID NO: 5441711 - DNA, 24 bp, Homo sapiens
tagaccagggctgctctttccact

SEQ ID NO: 5441712 - DNA, 15 bp, Homo sapiens
tagaccaggtgctca

SEQ ID NO: 5441713 - DNA, 14 bp, Homo sapiens
tagaccagtttgca

SEQ ID NO: 5441714 - DNA, 23 bp, Homo sapiens
tagaccatgtcttatcttgtttc

SEQ ID NO: 5441715 - DNA, 16 bp, Homo sapiens
tagaccccaagcattc

SEQ ID NO: 5441716 - DNA, 14 bp, Homo sapiens
tagacccctggctg

SEQ ID NO: 5441717 - DNA, 15 bp, Homo sapiens
tagacccctggctgg

SEQ ID NO: 5441718 - DNA, 17 bp, Homo sapiens
tagaccctcatgctgcc

SEQ ID NO: 5441719 - DNA, 17 bp, Homo sapiens
tagaccctcccccacca

SEQ ID NO: 5441720 - DNA, 19 bp, Homo sapiens
tagaccctctttcttgttt

SEQ ID NO: 5441721 - DNA, 19 bp, Homo sapiens
tagaccctgaggccctggg

SEQ ID NO: 5441722 - DNA, 16 bp, Homo sapiens
tagaccctgggtgggc

SEQ ID NO: 5441723 - DNA, 23 bp, Homo sapiens
tagaccgctctcttttctgtact

SEQ ID NO: 5441724 - DNA, 16 bp, Homo sapiens
tagacctaactgtgaa

SEQ ID NO: 5441725 - DNA, 18 bp, Homo sapiens
tagacctacagacctggc

SEQ ID NO: 5441726 - DNA, 22 bp, Homo sapiens
tagacctagggaggaccttatc

SEQ ID NO: 5441727 - DNA, 14 bp, Homo sapiens
tagacctatactga

SEQ ID NO: 5441728 - DNA, 11 bp, Homo sapiens
tagacctcagc

SEQ ID NO: 5441729 - DNA, 16 bp, Homo sapiens
tagacctcagcctgtg

SEQ ID NO: 5441730 - DNA, 20 bp, Homo sapiens
tagacctcagcctgtgctgc

SEQ ID NO: 5441731 - DNA, 22 bp, Homo sapiens
tagacctcagcctgtgctgccc

SEQ ID NO: 5441732 - DNA, 19 bp, Homo sapiens
tagacctcttcctggaata

SEQ ID NO: 5441733 - DNA, 15 bp, Homo sapiens
tagacctgagctggg

SEQ ID NO: 5441734 - DNA, 13 bp, Homo sapiens
tagacctgggcca

SEQ ID NO: 5441735 - DNA, 14 bp, Homo sapiens
tagacctgtctcct

SEQ ID NO: 5441736 - DNA, 16 bp, Homo sapiens
tagacctgtgacctgg

SEQ ID NO: 5441737 - DNA, 18 bp, Homo sapiens
tagacctgtgacctggtc

SEQ ID NO: 5441738 - DNA, 22 bp, Homo sapiens
tagaccttatgttagagtcatt

SEQ ID NO: 5441739 - DNA, 22 bp, Homo sapiens
tagaccttttttttttttccaa

SEQ ID NO: 5441740 - DNA, 16 bp, Homo sapiens
tagacgatcacagaaa

SEQ ID NO: 5441741 - DNA, 13 bp, Homo sapiens
tagacgcaccgcc

SEQ ID NO: 5441742 - DNA, 15 bp, Homo sapiens
tagacgcccctccca

SEQ ID NO: 5441743 - DNA, 18 bp, Homo sapiens
tagacgcccctcccaagc

SEQ ID NO: 5441744 - DNA, 20 bp, Homo sapiens
tagacgcccctcccaagcgt

SEQ ID NO: 5441745 - DNA, 14 bp, Homo sapiens
tagacggaacagtg

SEQ ID NO: 5441746 - DNA, 23 bp, Homo sapiens
tagacggagccctggcatgtcaa

SEQ ID NO: 5441747 - DNA, 16 bp, Homo sapiens
tagacgggttgaaaga

SEQ ID NO: 5441748 - DNA, 19 bp, Homo sapiens
tagacgggttgaaagacat

SEQ ID NO: 5441749 - DNA, 22 bp, Homo sapiens
tagacgtacgtcaactgtatgt

SEQ ID NO: 5441750 - DNA, 14 bp, Homo sapiens
tagactaaatgaaa

SEQ ID NO: 5441751 - DNA, 14 bp, Homo sapiens
tagactaagggcag

SEQ ID NO: 5441752 - DNA, 18 bp, Homo sapiens
tagactaattaaaatctg

SEQ ID NO: 5441753 - DNA, 23 bp, Homo sapiens
tagactaattaaaatctggaaat

SEQ ID NO: 5441754 - DNA, 17 bp, Homo sapiens
tagactagtcctatgga

SEQ ID NO: 5441755 - DNA, 21 bp, Homo sapiens
tagactagttctcttgtcctg

SEQ ID NO: 5441756 - DNA, 20 bp, Homo sapiens
tagactattccttttctgta

SEQ ID NO: 5441757 - DNA, 21 bp, Homo sapiens
tagactattccttttctgtat

SEQ ID NO: 5441758 - DNA, 17 bp, Homo sapiens
tagactcatcttactgt

SEQ ID NO: 5441759 - DNA, 21 bp, Homo sapiens
tagactcatcttactgtacct

SEQ ID NO: 5441760 - DNA, 22 bp, Homo sapiens
tagactcctcttcccagagtca

SEQ ID NO: 5441761 - DNA, 16 bp, Homo sapiens
tagactcctgcttctt

SEQ ID NO: 5441762 - DNA, 21 bp, Homo sapiens
tagactcggggtgcttccttg

SEQ ID NO: 5441763 - DNA, 17 bp, Homo sapiens
tagactctctagtttta

SEQ ID NO: 5441764 - DNA, 21 bp, Homo sapiens
tagactctctagttttatctt

SEQ ID NO: 5441765 - DNA, 22 bp, Homo sapiens
tagactctgaagttggttgtga

SEQ ID NO: 5441766 - DNA, 15 bp, Homo sapiens
tagactctgacttcc

SEQ ID NO: 5441767 - DNA, 16 bp, Homo sapiens
tagactgaagatttat

SEQ ID NO: 5441768 - DNA, 13 bp, Homo sapiens
tagactgaattta

SEQ ID NO: 5441769 - DNA, 12 bp, Homo sapiens
tagactgaggga

SEQ ID NO: 5441770 - DNA, 20 bp, Homo sapiens
tagactgaggtataaagaca

SEQ ID NO: 5441771 - DNA, 20 bp, Homo sapiens
tagactgatgttttagcatt

SEQ ID NO: 5441772 - DNA, 20 bp, Homo sapiens
tagactgccacaaggaagaa

SEQ ID NO: 5441773 - DNA, 16 bp, Homo sapiens
tagactgccagctctt

SEQ ID NO: 5441774 - DNA, 19 bp, Homo sapiens
tagactggaaaaaatgagc

SEQ ID NO: 5441775 - DNA, 16 bp, Homo sapiens
tagactggaagttcat

SEQ ID NO: 5441776 - DNA, 23 bp, Homo sapiens
tagactggagtgaggcttccagg

SEQ ID NO: 5441777 - DNA, 20 bp, Homo sapiens
tagactggccatgcaagtgg

SEQ ID NO: 5441778 - DNA, 13 bp, Homo sapiens
tagactgggctgg

SEQ ID NO: 5441779 - DNA, 14 bp, Homo sapiens
tagactgggctggc

SEQ ID NO: 5441780 - DNA, 20 bp, Homo sapiens
tagactgggctggctgcctt

SEQ ID NO: 5441781 - DNA, 14 bp, Homo sapiens
tagactggtgactg

SEQ ID NO: 5441782 - DNA, 20 bp, Homo sapiens
tagactggtgactgattctt

SEQ ID NO: 5441783 - DNA, 23 bp, Homo sapiens
tagactggtgactgattcttcag

SEQ ID NO: 5441784 - DNA, 23 bp, Homo sapiens
tagactgtaactttttttcagtt

SEQ ID NO: 5441785 - DNA, 18 bp, Homo sapiens
tagactgtgattcagaaa

SEQ ID NO: 5441786 - DNA, 13 bp, Homo sapiens
tagactgtgccag

SEQ ID NO: 5441787 - DNA, 14 bp, Homo sapiens
tagatattattcat

SEQ ID NO: 5441788 - DNA, 21 bp, Homo sapiens
tagatattcaggaaatgttca

SEQ ID NO: 5441789 - DNA, 18 bp, Homo sapiens
tagatattcatactttcc

SEQ ID NO: 5441790 - DNA, 19 bp, Homo sapiens
tagatattcatactttcca

SEQ ID NO: 5441791 - DNA, 12 bp, Homo sapiens
tagatattgcta

SEQ ID NO: 5441792 - DNA, 18 bp, Homo sapiens
tagatattgctactataa

SEQ ID NO: 5441793 - DNA, 13 bp, Homo sapiens
tagatattgtttt

SEQ ID NO: 5441794 - DNA, 22 bp, Homo sapiens
tagatatttcgaccctggggcg

SEQ ID NO: 5441795 - DNA, 18 bp, Homo sapiens
tagatatttggcttaaat

SEQ ID NO: 5441796 - DNA, 16 bp, Homo sapiens
tagatattttatatgt

SEQ ID NO: 5441797 - DNA, 12 bp, Homo sapiens
tagatattttca

SEQ ID NO: 5441798 - DNA, 24 bp, Homo sapiens
tagatattttcacaatgtcagtat

SEQ ID NO: 5441799 - DNA, 13 bp, Homo sapiens
tagatattttcca

SEQ ID NO: 5441800 - DNA, 14 bp, Homo sapiens
tagatattttccat

SEQ ID NO: 5441801 - DNA, 20 bp, Homo sapiens
tagatatttttcataaacaa

SEQ ID NO: 5441802 - DNA, 21 bp, Homo sapiens
tagatatttttcataaacaag

SEQ ID NO: 5441803 - DNA, 17 bp, Homo sapiens
tagatcaacaataaaaa

SEQ ID NO: 5441804 - DNA, 19 bp, Homo sapiens
tagatcaaggagcccagaa

SEQ ID NO: 5441805 - DNA, 18 bp, Homo sapiens
tagatcaaggcaaaaata

SEQ ID NO: 5441806 - DNA, 16 bp, Homo sapiens
tagatcacaactgaag

SEQ ID NO: 5441807 - DNA, 20 bp, Homo sapiens
tagatcacataacagaatgc

SEQ ID NO: 5441808 - DNA, 16 bp, Homo sapiens
tagatcacatcttaaa

SEQ ID NO: 5441809 - DNA, 23 bp, Homo sapiens
tagatcacctcctcgaacccact

SEQ ID NO: 5441810 - DNA, 17 bp, Homo sapiens
tagatcacgagatcaag

SEQ ID NO: 5441811 - DNA, 19 bp, Homo sapiens
tagatcagatgctccaaga

SEQ ID NO: 5441812 - DNA, 23 bp, Homo sapiens
tagatcagatgctccaagattct

SEQ ID NO: 5441813 - DNA, 13 bp, Homo sapiens
tagatcagccatt

SEQ ID NO: 5441814 - DNA, 20 bp, Homo sapiens
tagatcagccattaaaataa

SEQ ID NO: 5441815 - DNA, 13 bp, Homo sapiens
tagatcaggtttg

SEQ ID NO: 5441816 - DNA, 15 bp, Homo sapiens
tagatcagtatttca

SEQ ID NO: 5441817 - DNA, 17 bp, Homo sapiens
tagatcatagttttatt

SEQ ID NO: 5441818 - DNA, 15 bp, Homo sapiens
tagatcattttttgt

SEQ ID NO: 5441819 - DNA, 14 bp, Homo sapiens
tagatccaaatgta

SEQ ID NO: 5441820 - DNA, 18 bp, Homo sapiens
tagatccaaatgtaaagg

SEQ ID NO: 5441821 - DNA, 18 bp, Homo sapiens
tagatccacacacagagg

SEQ ID NO: 5441822 - DNA, 20 bp, Homo sapiens
tagatccagatccagactgt

SEQ ID NO: 5441823 - DNA, 18 bp, Homo sapiens
tagatccagcccaaacct

SEQ ID NO: 5441824 - DNA, 15 bp, Homo sapiens
tagatccatttccat

SEQ ID NO: 5441825 - DNA, 21 bp, Homo sapiens
tagatccatttggacaaaatg

SEQ ID NO: 5441826 - DNA, 23 bp, Homo sapiens
tagatccatttggacaaaatgga

SEQ ID NO: 5441827 - DNA, 15 bp, Homo sapiens
tagatcccatattta

SEQ ID NO: 5441828 - DNA, 17 bp, Homo sapiens
tagatcccatatttact

SEQ ID NO: 5441829 - DNA, 22 bp, Homo sapiens
tagatcccatgtcacctcagct

SEQ ID NO: 5441830 - DNA, 15 bp, Homo sapiens
tagatcccccagact

SEQ ID NO: 5441831 - DNA, 17 bp, Homo sapiens
tagatcctaagatgtgt

SEQ ID NO: 5441832 - DNA, 21 bp, Homo sapiens
tagatcctaagatgtgttctt

SEQ ID NO: 5441833 - DNA, 13 bp, Homo sapiens
tagatcctgcacc

SEQ ID NO: 5441834 - DNA, 18 bp, Homo sapiens
tagatcctgcaccccagc

SEQ ID NO: 5441835 - DNA, 13 bp, Homo sapiens
tagatcctttaaa

SEQ ID NO: 5441836 - DNA, 22 bp, Homo sapiens
tagatcgatgatatgaccagaa

SEQ ID NO: 5441837 - DNA, 18 bp, Homo sapiens
tagatctacactctcgag

SEQ ID NO: 5441838 - DNA, 14 bp, Homo sapiens
tagatctcagccat

SEQ ID NO: 5441839 - DNA, 13 bp, Homo sapiens
tagatctccagcg

SEQ ID NO: 5441840 - DNA, 22 bp, Homo sapiens
tagatctcctatttttcagaat

SEQ ID NO: 5441841 - DNA, 23 bp, Homo sapiens
tagatctcctgtaattttgtagt

SEQ ID NO: 5441842 - DNA, 14 bp, Homo sapiens
tagatctctcctgc

SEQ ID NO: 5441843 - DNA, 14 bp, Homo sapiens
tagatctgagccct

SEQ ID NO: 5441844 - DNA, 14 bp, Homo sapiens
tagatctgcaggct

SEQ ID NO: 5441845 - DNA, 16 bp, Homo sapiens
tagatctgctttctgt

SEQ ID NO: 5441846 - DNA, 21 bp, Homo sapiens
tagatctgctttctgttcatc

SEQ ID NO: 5441847 - DNA, 16 bp, Homo sapiens
tagatctggtgtccag

SEQ ID NO: 5441848 - DNA, 18 bp, Homo sapiens
tagatcttatattggttt

SEQ ID NO: 5441849 - DNA, 16 bp, Homo sapiens
tagatcttctgaaatg

SEQ ID NO: 5441850 - DNA, 12 bp, Homo sapiens
tagatctttata

SEQ ID NO: 5441851 - DNA, 19 bp, Homo sapiens
tagatctttgtaaatgcat

SEQ ID NO: 5441852 - DNA, 13 bp, Homo sapiens
tagatgaaaaagc

SEQ ID NO: 5441853 - DNA, 18 bp, Homo sapiens
tagatgaaaaagcatgta

SEQ ID NO: 5441854 - DNA, 19 bp, Homo sapiens
tagatgaaaaagcatgtac

SEQ ID NO: 5441855 - DNA, 23 bp, Homo sapiens
tagatgaaaaagcatgtacagtg

SEQ ID NO: 5441856 - DNA, 13 bp, Homo sapiens
tagatgaaacatt

SEQ ID NO: 5441857 - DNA, 16 bp, Homo sapiens
tagatgaaacattaac

SEQ ID NO: 5441858 - DNA, 15 bp, Homo sapiens
tagatgaacatctct

SEQ ID NO: 5441859 - DNA, 15 bp, Homo sapiens
tagatgaactcaact

SEQ ID NO: 5441860 - DNA, 20 bp, Homo sapiens
tagatgaacttgagctctgt

SEQ ID NO: 5441861 - DNA, 14 bp, Homo sapiens
tagatgaagaaaga

SEQ ID NO: 5441862 - DNA, 16 bp, Homo sapiens
tagatgaagttttaca

SEQ ID NO: 5441863 - DNA, 19 bp, Homo sapiens
tagatgactgaatttctat

SEQ ID NO: 5441864 - DNA, 20 bp, Homo sapiens
tagatgagaattcagctgcc

SEQ ID NO: 5441865 - DNA, 22 bp, Homo sapiens
tagatgagaattcagctgcccc

SEQ ID NO: 5441866 - DNA, 22 bp, Homo sapiens
tagatgagtttttcattatttg

SEQ ID NO: 5441867 - DNA, 16 bp, Homo sapiens
tagatgataatttttt

SEQ ID NO: 5441868 - DNA, 13 bp, Homo sapiens
tagatgatatgtt

SEQ ID NO: 5441869 - DNA, 20 bp, Homo sapiens
tagatgattaaataagattc

SEQ ID NO: 5441870 - DNA, 20 bp, Homo sapiens
tagatgattgaataacagta

SEQ ID NO: 5441871 - DNA, 18 bp, Homo sapiens
tagatgattttttgaaag

SEQ ID NO: 5441872 - DNA, 22 bp, Homo sapiens
tagatgattttttgaaagttaa

SEQ ID NO: 5441873 - DNA, 18 bp, Homo sapiens
tagatgcagaaaaagaaa

SEQ ID NO: 5441874 - DNA, 19 bp, Homo sapiens
tagatgcagaaaaagaaaa

SEQ ID NO: 5441875 - DNA, 20 bp, Homo sapiens
tagatgcagaaaaagaaaaa

SEQ ID NO: 5441876 - DNA, 16 bp, Homo sapiens
tagatgcagttctgaa

SEQ ID NO: 5441877 - DNA, 17 bp, Homo sapiens
tagatgcagttctgaag

SEQ ID NO: 5441878 - DNA, 20 bp, Homo sapiens
tagatgcctcttaggactgg

SEQ ID NO: 5441879 - DNA, 13 bp, Homo sapiens
tagatgcctgggc

SEQ ID NO: 5441880 - DNA, 20 bp, Homo sapiens
tagatgcctgttttgagacc

SEQ ID NO: 5441881 - DNA, 15 bp, Homo sapiens
tagatgctattcttt

SEQ ID NO: 5441882 - DNA, 22 bp, Homo sapiens
tagatgctctatgtgcttgtaa

SEQ ID NO: 5441883 - DNA, 16 bp, Homo sapiens
tagatgctgaatatct

SEQ ID NO: 5441884 - DNA, 18 bp, Homo sapiens
tagatgctgaatatctgt

SEQ ID NO: 5441885 - DNA, 14 bp, Homo sapiens
tagatgctgcctag

SEQ ID NO: 5441886 - DNA, 13 bp, Homo sapiens
tagatgctggccc

SEQ ID NO: 5441887 - DNA, 15 bp, Homo sapiens
tagatgctggcccag

SEQ ID NO: 5441888 - DNA, 22 bp, Homo sapiens
tagatgctggcccagggcccag

SEQ ID NO: 5441889 - DNA, 14 bp, Homo sapiens
tagatgcttagtgt

SEQ ID NO: 5441890 - DNA, 17 bp, Homo sapiens
tagatgcttagtgtgaa

SEQ ID NO: 5441891 - DNA, 17 bp, Homo sapiens
tagatggaaaaacttgt

SEQ ID NO: 5441892 - DNA, 13 bp, Homo sapiens
tagatggaaaaat

SEQ ID NO: 5441893 - DNA, 17 bp, Homo sapiens
tagatggaccccagcat

SEQ ID NO: 5441894 - DNA, 13 bp, Homo sapiens
tagatggatgaat

SEQ ID NO: 5441895 - DNA, 14 bp, Homo sapiens
tagatggatgaatt

SEQ ID NO: 5441896 - DNA, 23 bp, Homo sapiens
tagatggatgaattatgataaag

SEQ ID NO: 5441897 - DNA, 20 bp, Homo sapiens
tagatggcaagcatgtaact

SEQ ID NO: 5441898 - DNA, 20 bp, Homo sapiens
tagatgggaggatgaattgt

SEQ ID NO: 5441899 - DNA, 15 bp, Homo sapiens
tagatgggcattttt

SEQ ID NO: 5441900 - DNA, 16 bp, Homo sapiens
tagatgggcatttttt

SEQ ID NO: 5441901 - DNA, 22 bp, Homo sapiens
tagatgggggaaagcaaagcac

SEQ ID NO: 5441902 - DNA, 18 bp, Homo sapiens
tagatgggggaactgtga

SEQ ID NO: 5441903 - DNA, 13 bp, Homo sapiens
tagatgggtgggg

SEQ ID NO: 5441904 - DNA, 23 bp, Homo sapiens
tagatgggtgggggctcctggtg

SEQ ID NO: 5441905 - DNA, 14 bp, Homo sapiens
tagatggtgctgag

SEQ ID NO: 5441906 - DNA, 15 bp, Homo sapiens
tagatggtgctgaga

SEQ ID NO: 5441907 - DNA, 16 bp, Homo sapiens
tagatggtgctgagaa

SEQ ID NO: 5441908 - DNA, 21 bp, Homo sapiens
tagatggttacactgttagaa

SEQ ID NO: 5441909 - DNA, 14 bp, Homo sapiens
tagatgtaaataaa

SEQ ID NO: 5441910 - DNA, 15 bp, Homo sapiens
tagatgtaaataaaa

SEQ ID NO: 5441911 - DNA, 14 bp, Homo sapiens
tagatgtaaatttt

SEQ ID NO: 5441912 - DNA, 15 bp, Homo sapiens
tagatgtagcattgt

SEQ ID NO: 5441913 - DNA, 14 bp, Homo sapiens
tagatgtagtcttg

SEQ ID NO: 5441914 - DNA, 16 bp, Homo sapiens
tagatgtataactagg

SEQ ID NO: 5441915 - DNA, 12 bp, Homo sapiens
tagatgtatata

SEQ ID NO: 5441916 - DNA, 20 bp, Homo sapiens
tagatgtatgtacttcatgc

SEQ ID NO: 5441917 - DNA, 18 bp, Homo sapiens
tagatgtatgtgaataaa

SEQ ID NO: 5441918 - DNA, 21 bp, Homo sapiens
tagatgtattttcaataaaga

SEQ ID NO: 5441919 - DNA, 15 bp, Homo sapiens
tagatgtcagcaatt

SEQ ID NO: 5441920 - DNA, 21 bp, Homo sapiens
tagatgtccctttcttggcca

SEQ ID NO: 5441921 - DNA, 22 bp, Homo sapiens
tagatgtccctttcttggccag

SEQ ID NO: 5441922 - DNA, 23 bp, Homo sapiens
tagatgtccctttcttggccagt

SEQ ID NO: 5441923 - DNA, 21 bp, Homo sapiens
tagatgtcgtggactccagct

SEQ ID NO: 5441924 - DNA, 21 bp, Homo sapiens
tagatgtctaggtacttcagg

SEQ ID NO: 5441925 - DNA, 13 bp, Homo sapiens
tagatgtctcaaa

SEQ ID NO: 5441926 - DNA, 14 bp, Homo sapiens
tagatgtcttcatc

SEQ ID NO: 5441927 - DNA, 17 bp, Homo sapiens
tagatgtcttttatagt

SEQ ID NO: 5441928 - DNA, 13 bp, Homo sapiens
tagatgtcttttc

SEQ ID NO: 5441929 - DNA, 13 bp, Homo sapiens
tagatgtgattcc

SEQ ID NO: 5441930 - DNA, 20 bp, Homo sapiens
tagatgtgcaacctgtggct

SEQ ID NO: 5441931 - DNA, 20 bp, Homo sapiens
tagatgtgcaagtcttgtca

SEQ ID NO: 5441932 - DNA, 22 bp, Homo sapiens
tagatgtgcatttttgtgaaat

SEQ ID NO: 5441933 - DNA, 17 bp, Homo sapiens
tagatgttactacctta

SEQ ID NO: 5441934 - DNA, 23 bp, Homo sapiens
tagatgttctctatcatttaata

SEQ ID NO: 5441935 - DNA, 14 bp, Homo sapiens
tagatgttcttttc

SEQ ID NO: 5441936 - DNA, 15 bp, Homo sapiens
tagatgttcttttct

SEQ ID NO: 5441937 - DNA, 16 bp, Homo sapiens
tagatgttcttttcta

SEQ ID NO: 5441938 - DNA, 17 bp, Homo sapiens
tagatgttcttttctat

SEQ ID NO: 5441939 - DNA, 20 bp, Homo sapiens
tagatgttcttttctattta

SEQ ID NO: 5441940 - DNA, 16 bp, Homo sapiens
tagatgttgtcttggc

SEQ ID NO: 5441941 - DNA, 14 bp, Homo sapiens
tagatgtttaacaa

SEQ ID NO: 5441942 - DNA, 21 bp, Homo sapiens
tagatgtttattcttctagag

SEQ ID NO: 5441943 - DNA, 17 bp, Homo sapiens
tagatgtttatttagaa

SEQ ID NO: 5441944 - DNA, 21 bp, Homo sapiens
tagatgtttatttagaaactg

SEQ ID NO: 5441945 - DNA, 13 bp, Homo sapiens
tagatgtttcaca

SEQ ID NO: 5441946 - DNA, 12 bp, Homo sapiens
tagatgtttcct

SEQ ID NO: 5441947 - DNA, 15 bp, Homo sapiens
tagatgttttaactt

SEQ ID NO: 5441948 - DNA, 19 bp, Homo sapiens
tagatgttttaacttattt

SEQ ID NO: 5441949 - DNA, 15 bp, Homo sapiens
tagatgttttacaaa

SEQ ID NO: 5441950 - DNA, 23 bp, Homo sapiens
tagatgttttgggatcaggagcc

SEQ ID NO: 5441951 - DNA, 12 bp, Homo sapiens
tagattaaaata

SEQ ID NO: 5441952 - DNA, 13 bp, Homo sapiens
tagattaaatata

SEQ ID NO: 5441953 - DNA, 15 bp, Homo sapiens
tagattaaatataga

SEQ ID NO: 5441954 - DNA, 20 bp, Homo sapiens
tagattaagattttacttta

SEQ ID NO: 5441955 - DNA, 23 bp, Homo sapiens
tagattaatactctatttttaca

SEQ ID NO: 5441956 - DNA, 16 bp, Homo sapiens
tagattaatggcactg

SEQ ID NO: 5441957 - DNA, 17 bp, Homo sapiens
tagattaatggcactga

SEQ ID NO: 5441958 - DNA, 18 bp, Homo sapiens
tagattacatctgcctta

SEQ ID NO: 5441959 - DNA, 20 bp, Homo sapiens
tagattacctgatcatggtc

SEQ ID NO: 5441960 - DNA, 14 bp, Homo sapiens
tagattacctgcca

SEQ ID NO: 5441961 - DNA, 14 bp, Homo sapiens
tagattagaattct

SEQ ID NO: 5441962 - DNA, 20 bp, Homo sapiens
tagattagagagtgttgaaa

SEQ ID NO: 5441963 - DNA, 15 bp, Homo sapiens
tagattagctctgga

SEQ ID NO: 5441964 - DNA, 18 bp, Homo sapiens
tagattagctctggacca

SEQ ID NO: 5441965 - DNA, 20 bp, Homo sapiens
tagccccaagaaggctgggg

SEQ ID NO: 5441966 - DNA, 16 bp, Homo sapiens
tagccccacaggaggt

SEQ ID NO: 5441967 - DNA, 12 bp, Homo sapiens
tagccccagact

SEQ ID NO: 5441968 - DNA, 13 bp, Homo sapiens
tagccccagagat

SEQ ID NO: 5441969 - DNA, 18 bp, Homo sapiens
tagccccaggtcttttct

SEQ ID NO: 5441970 - DNA, 17 bp, Homo sapiens
tagccccagtcagaagt

SEQ ID NO: 5441971 - DNA, 17 bp, Homo sapiens
tagccccagtgacagct

SEQ ID NO: 5441972 - DNA, 18 bp, Homo sapiens
tagcccccacccacttcc

SEQ ID NO: 5441973 - DNA, 18 bp, Homo sapiens
tagcccccaggctgctgg

SEQ ID NO: 5441974 - DNA, 20 bp, Homo sapiens
tagccccctcatctgcagga

SEQ ID NO: 5441975 - DNA, 15 bp, Homo sapiens
tagccccctcttccc

SEQ ID NO: 5441976 - DNA, 15 bp, Homo sapiens
tagccccctggcctc

SEQ ID NO: 5441977 - DNA, 17 bp, Homo sapiens
tagccccctggcctctg

SEQ ID NO: 5441978 - DNA, 21 bp, Homo sapiens
tagccccctggtaatagctgt

SEQ ID NO: 5441979 - DNA, 22 bp, Homo sapiens
tagccccctggtaatagctgta

SEQ ID NO: 5441980 - DNA, 23 bp, Homo sapiens
tagccccgagacaccatcctgag

SEQ ID NO: 5441981 - DNA, 16 bp, Homo sapiens
tagccccgccccagcc

SEQ ID NO: 5441982 - DNA, 14 bp, Homo sapiens
tagccccggccccc

SEQ ID NO: 5441983 - DNA, 23 bp, Homo sapiens
tagcccctctccccgcagtgttt

SEQ ID NO: 5441984 - DNA, 14 bp, Homo sapiens
tagcccctctctca

SEQ ID NO: 5441985 - DNA, 15 bp, Homo sapiens
tagcccctctctcac

SEQ ID NO: 5441986 - DNA, 21 bp, Homo sapiens
tagcccctctggattcccttt

SEQ ID NO: 5441987 - DNA, 20 bp, Homo sapiens
tagcccctggtgtgtaaata

SEQ ID NO: 5441988 - DNA, 15 bp, Homo sapiens
tagcccgaatacaaa

SEQ ID NO: 5441989 - DNA, 16 bp, Homo sapiens
tagcccgaatacaaac

SEQ ID NO: 5441990 - DNA, 18 bp, Homo sapiens
tagcccgaggaccgggct

SEQ ID NO: 5441991 - DNA, 20 bp, Homo sapiens
tagcccgcctgccagtccta

SEQ ID NO: 5441992 - DNA, 17 bp, Homo sapiens
tagcccggccagggcct

SEQ ID NO: 5441993 - DNA, 18 bp, Homo sapiens
tagcccggccagggcctg

SEQ ID NO: 5441994 - DNA, 18 bp, Homo sapiens
tagccctcagcccacctg

SEQ ID NO: 5441995 - DNA, 13 bp, Homo sapiens
tagccctcccact

SEQ ID NO: 5441996 - DNA, 17 bp, Homo sapiens
tagccctcccactttgc

SEQ ID NO: 5441997 - DNA, 13 bp, Homo sapiens
tagccctccccct

SEQ ID NO: 5441998 - DNA, 13 bp, Homo sapiens
tagccctccctgg

SEQ ID NO: 5441999 - DNA, 20 bp, Homo sapiens
tagccctcctttttccaaca

SEQ ID NO: 5442000 - DNA, 19 bp, Homo sapiens
tagccctctccaaatcaag

SEQ ID NO: 5442001 - DNA, 20 bp, Homo sapiens
tagccctctccaaatcaagg

SEQ ID NO: 5442002 - DNA, 13 bp, Homo sapiens
tagccctctccct

SEQ ID NO: 5442003 - DNA, 22 bp, Homo sapiens
tagccctctccctctaggctct

SEQ ID NO: 5442004 - DNA, 20 bp, Homo sapiens
tagccctctttctctctgtg

SEQ ID NO: 5442005 - DNA, 12 bp, Homo sapiens
tagccctgcccg

SEQ ID NO: 5442006 - DNA, 12 bp, Homo sapiens
tagccctgccct

SEQ ID NO: 5442007 - DNA, 15 bp, Homo sapiens
tagccctgccctccc

SEQ ID NO: 5442008 - DNA, 21 bp, Homo sapiens
tagccctgccctcccaagtcc

SEQ ID NO: 5442009 - DNA, 19 bp, Homo sapiens
tagccctggatggcctctg

SEQ ID NO: 5442010 - DNA, 20 bp, Homo sapiens
tagccctggatggcctctgg

SEQ ID NO: 5442011 - DNA, 22 bp, Homo sapiens
tagccctggatggcctctgggg

SEQ ID NO: 5442012 - DNA, 16 bp, Homo sapiens
tagccctggccagagg

SEQ ID NO: 5442013 - DNA, 12 bp, Homo sapiens
tagccctggccc

SEQ ID NO: 5442014 - DNA, 21 bp, Homo sapiens
tagccctggttagctgacagt

SEQ ID NO: 5442015 - DNA, 14 bp, Homo sapiens
tagccctgtcctgg

SEQ ID NO: 5442016 - DNA, 17 bp, Homo sapiens
tagccctgtcctggtgg

SEQ ID NO: 5442017 - DNA, 10 bp, Homo sapiens
tagcccttcc

SEQ ID NO: 5442018 - DNA, 11 bp, Homo sapiens
tagcccttcca

SEQ ID NO: 5442019 - DNA, 15 bp, Homo sapiens
tagcccttccagcct

SEQ ID NO: 5442020 - DNA, 16 bp, Homo sapiens
tagcccttccagcctg

SEQ ID NO: 5442021 - DNA, 22 bp, Homo sapiens
tagcccttccagcctgggacac

SEQ ID NO: 5442022 - DNA, 14 bp, Homo sapiens
tagcccttccctga

SEQ ID NO: 5442023 - DNA, 15 bp, Homo sapiens
tagcccttccctgcc

SEQ ID NO: 5442024 - DNA, 17 bp, Homo sapiens
tagcccttccctgcctt

SEQ ID NO: 5442025 - DNA, 20 bp, Homo sapiens
tagcccttctaccccacctg

SEQ ID NO: 5442026 - DNA, 14 bp, Homo sapiens
tagcccttgtccct

SEQ ID NO: 5442027 - DNA, 13 bp, Homo sapiens
tagccctttctgt

SEQ ID NO: 5442028 - DNA, 14 bp, Homo sapiens
tagccctttctgtg

SEQ ID NO: 5442029 - DNA, 15 bp, Homo sapiens
tagccgaactccagg

SEQ ID NO: 5442030 - DNA, 18 bp, Homo sapiens
tagccgaactccaggctg

SEQ ID NO: 5442031 - DNA, 20 bp, Homo sapiens
tagccgaactccaggctggg

SEQ ID NO: 5442032 - DNA, 15 bp, Homo sapiens
tagccgacctcagcc

SEQ ID NO: 5442033 - DNA, 14 bp, Homo sapiens
tagccgcaccctgc

SEQ ID NO: 5442034 - DNA, 15 bp, Homo sapiens
tagccgggcatggtg

SEQ ID NO: 5442035 - DNA, 19 bp, Homo sapiens
tagccgggcatggtggcgc

SEQ ID NO: 5442036 - DNA, 22 bp, Homo sapiens
tagccgggcgtggtggcaggca

SEQ ID NO: 5442037 - DNA, 15 bp, Homo sapiens
tagccgggctccagg

SEQ ID NO: 5442038 - DNA, 16 bp, Homo sapiens
tagccgggctctgcac

SEQ ID NO: 5442039 - DNA, 23 bp, Homo sapiens
tagccgggtgtggcacgcacctg

SEQ ID NO: 5442040 - DNA, 18 bp, Homo sapiens
tagccgtgtcacgggcat

SEQ ID NO: 5442041 - DNA, 20 bp, Homo sapiens
tagcctaaagaccatttaat

SEQ ID NO: 5442042 - DNA, 15 bp, Homo sapiens
tagcctaaagggcag

SEQ ID NO: 5442043 - DNA, 17 bp, Homo sapiens
tagcctaaagggcaggg

SEQ ID NO: 5442044 - DNA, 24 bp, Homo sapiens
tagcctaaagtatacaactgcctg

SEQ ID NO: 5442045 - DNA, 20 bp, Homo sapiens
tagcctaaggctcctgtttt

SEQ ID NO: 5442046 - DNA, 18 bp, Homo sapiens
tagcctaagtgtggagaa

SEQ ID NO: 5442047 - DNA, 19 bp, Homo sapiens
tagcctaatattcatgctg

SEQ ID NO: 5442048 - DNA, 22 bp, Homo sapiens
tagcctaatattcatgctgcct

SEQ ID NO: 5442049 - DNA, 15 bp, Homo sapiens
tagcctaatttacca

SEQ ID NO: 5442050 - DNA, 14 bp, Homo sapiens
tagcctagaaatat

SEQ ID NO: 5442051 - DNA, 23 bp, Homo sapiens
tagcctagaacaagccagagccg

SEQ ID NO: 5442052 - DNA, 22 bp, Homo sapiens
tagcctagatatgaatatatgg

SEQ ID NO: 5442053 - DNA, 17 bp, Homo sapiens
tagcctatatttacagt

SEQ ID NO: 5442054 - DNA, 16 bp, Homo sapiens
tagcctatgtctggca

SEQ ID NO: 5442055 - DNA, 17 bp, Homo sapiens
tagcctatgtctggcag

SEQ ID NO: 5442056 - DNA, 19 bp, Homo sapiens
tagcctcaatttctgaaca

SEQ ID NO: 5442057 - DNA, 17 bp, Homo sapiens
tagcctcacgaaactgg

SEQ ID NO: 5442058 - DNA, 21 bp, Homo sapiens
tagcctcacgaaactggaata

SEQ ID NO: 5442059 - DNA, 23 bp, Homo sapiens
tagcctcacttttaatgaacaaa

SEQ ID NO: 5442060 - DNA, 22 bp, Homo sapiens
tagcctcaggggtctgagctcc

SEQ ID NO: 5442061 - DNA, 14 bp, Homo sapiens
tagcctcatagtta

SEQ ID NO: 5442062 - DNA, 17 bp, Homo sapiens
tagcctccctctcctct

SEQ ID NO: 5442063 - DNA, 12 bp, Homo sapiens
tagcctccctga

SEQ ID NO: 5442064 - DNA, 20 bp, Homo sapiens
tagcctccgtttatgggcct

SEQ ID NO: 5442065 - DNA, 19 bp, Homo sapiens
tagcctcgaatatcttaat

SEQ ID NO: 5442066 - DNA, 21 bp, Homo sapiens
tagcctcgatgtcctcctctg

SEQ ID NO: 5442067 - DNA, 24 bp, Homo sapiens
tagcctcgatgtcctcctctgtga

SEQ ID NO: 5442068 - DNA, 12 bp, Homo sapiens
tagcctctccca

SEQ ID NO: 5442069 - DNA, 17 bp, Homo sapiens
tagcctctcctttgtag

SEQ ID NO: 5442070 - DNA, 23 bp, Homo sapiens
tagcctctgagatgctaatttat

SEQ ID NO: 5442071 - DNA, 14 bp, Homo sapiens
tagcctctggatct

SEQ ID NO: 5442072 - DNA, 15 bp, Homo sapiens
tagcctcttgtgtaa

SEQ ID NO: 5442073 - DNA, 18 bp, Homo sapiens
tagcctgaggtcccctcg

SEQ ID NO: 5442074 - DNA, 13 bp, Homo sapiens
tagcctgatgaga

SEQ ID NO: 5442075 - DNA, 14 bp, Homo sapiens
tagcctgcctcacc

SEQ ID NO: 5442076 - DNA, 16 bp, Homo sapiens
tagcctgcctcaccca

SEQ ID NO: 5442077 - DNA, 20 bp, Homo sapiens
tagcctgcctcagtggcagc

SEQ ID NO: 5442078 - DNA, 17 bp, Homo sapiens
tagcctgcctcttctct

SEQ ID NO: 5442079 - DNA, 21 bp, Homo sapiens
tagcctgcgtcatggctcaag

SEQ ID NO: 5442080 - DNA, 12 bp, Homo sapiens
tagcctgctctg

SEQ ID NO: 5442081 - DNA, 14 bp, Homo sapiens
tagcctgctctgcc

SEQ ID NO: 5442082 - DNA, 17 bp, Homo sapiens
tagcctggacctctgac

SEQ ID NO: 5442083 - DNA, 23 bp, Homo sapiens
tagcctggacctctgacagcagc

SEQ ID NO: 5442084 - DNA, 20 bp, Homo sapiens
tagcctggactaaaggcatc

SEQ ID NO: 5442085 - DNA, 17 bp, Homo sapiens
tagcctggactgtttca

SEQ ID NO: 5442086 - DNA, 18 bp, Homo sapiens
tagcctggactgtttcat

SEQ ID NO: 5442087 - DNA, 14 bp, Homo sapiens
tagcctggctgtca

SEQ ID NO: 5442088 - DNA, 14 bp, Homo sapiens
tagcctggcttggg

SEQ ID NO: 5442089 - DNA, 20 bp, Homo sapiens
tagcctgggctcactgtgct

SEQ ID NO: 5442090 - DNA, 14 bp, Homo sapiens
tagcctggggtggg

SEQ ID NO: 5442091 - DNA, 15 bp, Homo sapiens
tagcctggtctgtgc

SEQ ID NO: 5442092 - DNA, 16 bp, Homo sapiens
tagcctgtcctgtcat

SEQ ID NO: 5442093 - DNA, 18 bp, Homo sapiens
tagcctgtgcctctggga

SEQ ID NO: 5442094 - DNA, 23 bp, Homo sapiens
tagcctgtggcagtaaagagaaa

SEQ ID NO: 5442095 - DNA, 12 bp, Homo sapiens
tagcctgtggcc

SEQ ID NO: 5442096 - DNA, 20 bp, Homo sapiens
tagcctgtggccctgtcctg

SEQ ID NO: 5442097 - DNA, 13 bp, Homo sapiens
tagcctgtggcct

SEQ ID NO: 5442098 - DNA, 20 bp, Homo sapiens
tagccttagaagtcacacag

SEQ ID NO: 5442099 - DNA, 21 bp, Homo sapiens
tagccttattcacctttttaa

SEQ ID NO: 5442100 - DNA, 20 bp, Homo sapiens
tagccttccgtaacccaact

SEQ ID NO: 5442101 - DNA, 13 bp, Homo sapiens
tagccttcctcca

SEQ ID NO: 5442102 - DNA, 23 bp, Homo sapiens
tagccttcctccacatcctttct

SEQ ID NO: 5442103 - DNA, 16 bp, Homo sapiens
tagccttcctgacctc

SEQ ID NO: 5442104 - DNA, 14 bp, Homo sapiens
tagccttctctgtt

SEQ ID NO: 5442105 - DNA, 21 bp, Homo sapiens
tagccttgccttttaaaagaa

SEQ ID NO: 5442106 - DNA, 22 bp, Homo sapiens
tagccttgccttttaaaagaaa

SEQ ID NO: 5442107 - DNA, 16 bp, Homo sapiens
tagccttgctgtagag

SEQ ID NO: 5442108 - DNA, 14 bp, Homo sapiens
tagccttgcttgtt

SEQ ID NO: 5442109 - DNA, 14 bp, Homo sapiens
tagccttgtgccct

SEQ ID NO: 5442110 - DNA, 23 bp, Homo sapiens
tagcctttacatggacagaattt

SEQ ID NO: 5442111 - DNA, 19 bp, Homo sapiens
tagcctttattattactgt

SEQ ID NO: 5442112 - DNA, 23 bp, Homo sapiens
tagcctttccctaattctgcctt

SEQ ID NO: 5442113 - DNA, 13 bp, Homo sapiens
tagcctttctttt

SEQ ID NO: 5442114 - DNA, 23 bp, Homo sapiens
tagcctttgacattgatgtgttc

SEQ ID NO: 5442115 - DNA, 15 bp, Homo sapiens
tagcctttgccctgt

SEQ ID NO: 5442116 - DNA, 16 bp, Homo sapiens
tagcctttggctctgg

SEQ ID NO: 5442117 - DNA, 18 bp, Homo sapiens
tagcctttggctctggag

SEQ ID NO: 5442118 - DNA, 23 bp, Homo sapiens
tagcctttgggcacaattcctgt

SEQ ID NO: 5442119 - DNA, 12 bp, Homo sapiens
tagcctttgtag

SEQ ID NO: 5442120 - DNA, 19 bp, Homo sapiens
tagccttttttccccagac

SEQ ID NO: 5442121 - DNA, 19 bp, Homo sapiens
tagcgacaacagattggat

SEQ ID NO: 5442122 - DNA, 23 bp, Homo sapiens
tagcgacattgcagtctgcttct

SEQ ID NO: 5442123 - DNA, 14 bp, Homo sapiens
tagcgaccccagac

SEQ ID NO: 5442124 - DNA, 18 bp, Homo sapiens
tagcgagctgctctgcta

SEQ ID NO: 5442125 - DNA, 22 bp, Homo sapiens
tagcgattgattgatgtacaga

SEQ ID NO: 5442126 - DNA, 15 bp, Homo sapiens
tagcgatttcagacc

SEQ ID NO: 5442127 - DNA, 16 bp, Homo sapiens
tagcgatttcagacct

SEQ ID NO: 5442128 - DNA, 12 bp, Homo sapiens
tagcgctctgga

SEQ ID NO: 5442129 - DNA, 20 bp, Homo sapiens
tagcggaaaagttgtcttaa

SEQ ID NO: 5442130 - DNA, 14 bp, Homo sapiens
tagcggagcccagc

SEQ ID NO: 5442131 - DNA, 16 bp, Homo sapiens
tagcggagcccagcct

SEQ ID NO: 5442132 - DNA, 16 bp, Homo sapiens
tagcggccctggagga

SEQ ID NO: 5442133 - DNA, 18 bp, Homo sapiens
tagcgggatggggctccc

SEQ ID NO: 5442134 - DNA, 17 bp, Homo sapiens
tagcgggccgggcgggg

SEQ ID NO: 5442135 - DNA, 14 bp, Homo sapiens
tagcgtatacattt

SEQ ID NO: 5442136 - DNA, 16 bp, Homo sapiens
tagcgtcctgccctgc

SEQ ID NO: 5442137 - DNA, 19 bp, Homo sapiens
tagcgtgcccgtgtgcatg

SEQ ID NO: 5442138 - DNA, 13 bp, Homo sapiens
tagcgttcccaac

SEQ ID NO: 5442139 - DNA, 22 bp, Homo sapiens
tagcgttctggactctgcccca

SEQ ID NO: 5442140 - DNA, 18 bp, Homo sapiens
tagcgttcttgtaatttt

SEQ ID NO: 5442141 - DNA, 21 bp, Homo sapiens
tagcgttcttgtaattttaca

SEQ ID NO: 5442142 - DNA, 16 bp, Homo sapiens
tagcgttttttaaatg

SEQ ID NO: 5442143 - DNA, 15 bp, Homo sapiens
taggaaccctggagg

SEQ ID NO: 5442144 - DNA, 22 bp, Homo sapiens
taggaaccgtggtatgtctgcc

SEQ ID NO: 5442145 - DNA, 21 bp, Homo sapiens
taggaacttaaataatgtgaa

SEQ ID NO: 5442146 - DNA, 14 bp, Homo sapiens
taggaacttcagag

SEQ ID NO: 5442147 - DNA, 16 bp, Homo sapiens
taggaacttcagagat

SEQ ID NO: 5442148 - DNA, 16 bp, Homo sapiens
taggaacttgagaact

SEQ ID NO: 5442149 - DNA, 20 bp, Homo sapiens
taggaactttaacttttaat

SEQ ID NO: 5442150 - DNA, 12 bp, Homo sapiens
taggaagaaaga

SEQ ID NO: 5442151 - DNA, 16 bp, Homo sapiens
taggaagaacttgaag

SEQ ID NO: 5442152 - DNA, 14 bp, Homo sapiens
taggaagaatcagt

SEQ ID NO: 5442153 - DNA, 17 bp, Homo sapiens
taggaagaattttaaaa

SEQ ID NO: 5442154 - DNA, 21 bp, Homo sapiens
taggaagaattttaaaaatga

SEQ ID NO: 5442155 - DNA, 15 bp, Homo sapiens
taggaagacataaaa

SEQ ID NO: 5442156 - DNA, 19 bp, Homo sapiens
taggaagacataaaacttt

SEQ ID NO: 5442157 - DNA, 14 bp, Homo sapiens
taggaagactttgg

SEQ ID NO: 5442158 - DNA, 12 bp, Homo sapiens
taggaagagagg

SEQ ID NO: 5442159 - DNA, 18 bp, Homo sapiens
taggaagagcaggactcc

SEQ ID NO: 5442160 - DNA, 22 bp, Homo sapiens
taggaagagtagcatttcattc

SEQ ID NO: 5442161 - DNA, 19 bp, Homo sapiens
taggaagatcgttccacct

SEQ ID NO: 5442162 - DNA, 17 bp, Homo sapiens
taggaaggaaaaaataa

SEQ ID NO: 5442163 - DNA, 16 bp, Homo sapiens
taggaaggattttctt

SEQ ID NO: 5442164 - DNA, 21 bp, Homo sapiens
taggaaggcacttctgcctga

SEQ ID NO: 5442165 - DNA, 16 bp, Homo sapiens
taggaaggctgtgata

SEQ ID NO: 5442166 - DNA, 20 bp, Homo sapiens
taggaagggatctgagaaca

SEQ ID NO: 5442167 - DNA, 18 bp, Homo sapiens
taggaaggtcatttccat

SEQ ID NO: 5442168 - DNA, 23 bp, Homo sapiens
taggaaggtcatttccatgtatg

SEQ ID NO: 5442169 - DNA, 15 bp, Homo sapiens
taggaaggttaatgt

SEQ ID NO: 5442170 - DNA, 20 bp, Homo sapiens
taggaagtaaagtgaagaat

SEQ ID NO: 5442171 - DNA, 20 bp, Homo sapiens
taggaagtcaatatgtggaa

SEQ ID NO: 5442172 - DNA, 21 bp, Homo sapiens
taggaagtgacttgaatgtac

SEQ ID NO: 5442173 - DNA, 18 bp, Homo sapiens
taggaagtggcagttctt

SEQ ID NO: 5442174 - DNA, 13 bp, Homo sapiens
taggaagtggctg

SEQ ID NO: 5442175 - DNA, 19 bp, Homo sapiens
taggaagttaaaagcacaa

SEQ ID NO: 5442176 - DNA, 22 bp, Homo sapiens
taggaagttgacttatagtaca

SEQ ID NO: 5442177 - DNA, 22 bp, Homo sapiens
taggaagttttctgtagtcatt

SEQ ID NO: 5442178 - DNA, 16 bp, Homo sapiens
taggaataacactgca

SEQ ID NO: 5442179 - DNA, 16 bp, Homo sapiens
taggaataataaattc

SEQ ID NO: 5442180 - DNA, 17 bp, Homo sapiens
taggaatagaggaagaa

SEQ ID NO: 5442181 - DNA, 15 bp, Homo sapiens
taggaatagcatgtc

SEQ ID NO: 5442182 - DNA, 22 bp, Homo sapiens
taggaatatcaatataatgttt

SEQ ID NO: 5442183 - DNA, 21 bp, Homo sapiens
taggaatatgactcaggagcc

SEQ ID NO: 5442184 - DNA, 17 bp, Homo sapiens
taggaatcattcagaaa

SEQ ID NO: 5442185 - DNA, 18 bp, Homo sapiens
taggaatcattctgtaaa

SEQ ID NO: 5442186 - DNA, 16 bp, Homo sapiens
taggaatctcttcact

SEQ ID NO: 5442187 - DNA, 21 bp, Homo sapiens
taggaatctgccttccagccc

SEQ ID NO: 5442188 - DNA, 13 bp, Homo sapiens
taggaatgctcaa

SEQ ID NO: 5442189 - DNA, 16 bp, Homo sapiens
taggaatgctcaatgt

SEQ ID NO: 5442190 - DNA, 22 bp, Homo sapiens
taggaatgctcaatgtgctgtt

SEQ ID NO: 5442191 - DNA, 23 bp, Homo sapiens
taggaatgcttttattcaagaca

SEQ ID NO: 5442192 - DNA, 18 bp, Homo sapiens
taggaatggaggagccag

SEQ ID NO: 5442193 - DNA, 19 bp, Homo sapiens
taggaatgtccaccatgaa

SEQ ID NO: 5442194 - DNA, 22 bp, Homo sapiens
taggaatgtccaccatgaactt

SEQ ID NO: 5442195 - DNA, 18 bp, Homo sapiens
taggaatgtccagactgt

SEQ ID NO: 5442196 - DNA, 22 bp, Homo sapiens
taggaattactttattataaaa

SEQ ID NO: 5442197 - DNA, 15 bp, Homo sapiens
taggaattctttgca

SEQ ID NO: 5442198 - DNA, 17 bp, Homo sapiens
taggaattctttgcatt

SEQ ID NO: 5442199 - DNA, 18 bp, Homo sapiens
taggaattctttgcattc

SEQ ID NO: 5442200 - DNA, 13 bp, Homo sapiens
taggacaaatgat

SEQ ID NO: 5442201 - DNA, 14 bp, Homo sapiens
taggacaaggctgt

SEQ ID NO: 5442202 - DNA, 17 bp, Homo sapiens
taggacaaggctgtgcc

SEQ ID NO: 5442203 - DNA, 13 bp, Homo sapiens
taggacaagtttt

SEQ ID NO: 5442204 - DNA, 21 bp, Homo sapiens
taggacacctgtggtatcttt

SEQ ID NO: 5442205 - DNA, 19 bp, Homo sapiens
taggacagcaaagcagcag

SEQ ID NO: 5442206 - DNA, 19 bp, Homo sapiens
taggacagttgattcaaca

SEQ ID NO: 5442207 - DNA, 18 bp, Homo sapiens
taggacatactgcatgta

SEQ ID NO: 5442208 - DNA, 14 bp, Homo sapiens
taggacatcttaaa

SEQ ID NO: 5442209 - DNA, 14 bp, Homo sapiens
taggaccaagaaag

SEQ ID NO: 5442210 - DNA, 17 bp, Homo sapiens
taggaccactcagcccc

SEQ ID NO: 5442211 - DNA, 18 bp, Homo sapiens
taggaccactcagcccct

SEQ ID NO: 5442212 - DNA, 15 bp, Homo sapiens
taggaccagttttgt

SEQ ID NO: 5442213 - DNA, 19 bp, Homo sapiens
taggaccatggttaagagt

SEQ ID NO: 5442214 - DNA, 23 bp, Homo sapiens
taggacccatatgggaattatta

SEQ ID NO: 5442215 - DNA, 19 bp, Homo sapiens
taggacccgtctccagctg

SEQ ID NO: 5442216 - DNA, 14 bp, Homo sapiens
taggaccctcatga

SEQ ID NO: 5442217 - DNA, 19 bp, Homo sapiens
taggaccctcgagagcctt

SEQ ID NO: 5442218 - DNA, 14 bp, Homo sapiens
taggacctcaggcg

SEQ ID NO: 5442219 - DNA, 22 bp, Homo sapiens
taggacctcaggcggggaggag

SEQ ID NO: 5442220 - DNA, 23 bp, Homo sapiens
taggacgcatgaaggtcactcgt

SEQ ID NO: 5442221 - DNA, 20 bp, Homo sapiens
taggacgccaacttctccca

SEQ ID NO: 5442222 - DNA, 16 bp, Homo sapiens
taggacgccacccagc

SEQ ID NO: 5442223 - DNA, 13 bp, Homo sapiens
taggacgtattta

SEQ ID NO: 5442224 - DNA, 18 bp, Homo sapiens
taggacgttggcctcagg

SEQ ID NO: 5442225 - DNA, 14 bp, Homo sapiens
taggactaccgcag

SEQ ID NO: 5442226 - DNA, 18 bp, Homo sapiens
taggactatataaagtac

SEQ ID NO: 5442227 - DNA, 15 bp, Homo sapiens
taggactctggacaa

SEQ ID NO: 5442228 - DNA, 17 bp, Homo sapiens
taggactgtggcaaaca

SEQ ID NO: 5442229 - DNA, 21 bp, Homo sapiens
taggacttaaaattagtcttt

SEQ ID NO: 5442230 - DNA, 20 bp, Homo sapiens
taggacttaaccttgaaatg

SEQ ID NO: 5442231 - DNA, 17 bp, Homo sapiens
taggacttaatttagca

SEQ ID NO: 5442232 - DNA, 18 bp, Homo sapiens
taggacttccttaagcat

SEQ ID NO: 5442233 - DNA, 23 bp, Homo sapiens
taggacttggtaagatgactctg

SEQ ID NO: 5442234 - DNA, 17 bp, Homo sapiens
taggacttgtttttgtt

SEQ ID NO: 5442235 - DNA, 22 bp, Homo sapiens
taggactttcttctaaatgagc

SEQ ID NO: 5442236 - DNA, 18 bp, Homo sapiens
taggacttttaaacaaaa

SEQ ID NO: 5442237 - DNA, 18 bp, Homo sapiens
taggagaacgtatcaata

SEQ ID NO: 5442238 - DNA, 20 bp, Homo sapiens
taggagaagaggcatcctgc

SEQ ID NO: 5442239 - DNA, 23 bp, Homo sapiens
taggagaagaggcatcctgcctg

SEQ ID NO: 5442240 - DNA, 12 bp, Homo sapiens
taggagaagcca

SEQ ID NO: 5442241 - DNA, 13 bp, Homo sapiens
taggagaagggct

SEQ ID NO: 5442242 - DNA, 18 bp, Homo sapiens
taggagaagtcttctatt

SEQ ID NO: 5442243 - DNA, 17 bp, Homo sapiens
taggagaatagcagaga

SEQ ID NO: 5442244 - DNA, 21 bp, Homo sapiens
taggagaatagcagagagcca

SEQ ID NO: 5442245 - DNA, 22 bp, Homo sapiens
taggagaattgcttgaacctgg

SEQ ID NO: 5442246 - DNA, 19 bp, Homo sapiens
taggagacacatccagcaa

SEQ ID NO: 5442247 - DNA, 21 bp, Homo sapiens
taggagacacgacagcacaca

SEQ ID NO: 5442248 - DNA, 12 bp, Homo sapiens
taggagacagtc

SEQ ID NO: 5442249 - DNA, 21 bp, Homo sapiens
taggagaccaaggcgggagca

SEQ ID NO: 5442250 - DNA, 16 bp, Homo sapiens
taggagacgctgcact

SEQ ID NO: 5442251 - DNA, 12 bp, Homo sapiens
taggagactggt

SEQ ID NO: 5442252 - DNA, 23 bp, Homo sapiens
taggagacttgccagagccgggc

SEQ ID NO: 5442253 - DNA, 13 bp, Homo sapiens
taggagacttgta

SEQ ID NO: 5442254 - DNA, 14 bp, Homo sapiens
taggagagaaggta

SEQ ID NO: 5442255 - DNA, 14 bp, Homo sapiens
taggagagaccgag

SEQ ID NO: 5442256 - DNA, 21 bp, Homo sapiens
taggagagagatcatgagaaa

SEQ ID NO: 5442257 - DNA, 20 bp, Homo sapiens
taggagagataccttgaaaa

SEQ ID NO: 5442258 - DNA, 16 bp, Homo sapiens
taggagagcactgcct

SEQ ID NO: 5442259 - DNA, 16 bp, Homo sapiens
taggagagccaacctc

SEQ ID NO: 5442260 - DNA, 13 bp, Homo sapiens
taggagaggagaa

SEQ ID NO: 5442261 - DNA, 15 bp, Homo sapiens
taggagagggagatg

SEQ ID NO: 5442262 - DNA, 23 bp, Homo sapiens
taggagagggagatgatccagag

SEQ ID NO: 5442263 - DNA, 15 bp, Homo sapiens
taggagatcagaaaa

SEQ ID NO: 5442264 - DNA, 17 bp, Homo sapiens
taggagatgaaactggt

SEQ ID NO: 5442265 - DNA, 16 bp, Homo sapiens
taggagcaaagcctgt

SEQ ID NO: 5442266 - DNA, 17 bp, Homo sapiens
taggagcaaagcctgtt

SEQ ID NO: 5442267 - DNA, 21 bp, Homo sapiens
taggagcaagggcacaaactg

SEQ ID NO: 5442268 - DNA, 14 bp, Homo sapiens
taggagcagagctc

SEQ ID NO: 5442269 - DNA, 11 bp, Homo sapiens
taggagcagcc

SEQ ID NO: 5442270 - DNA, 22 bp, Homo sapiens
taggagcagtgggccctggctc

SEQ ID NO: 5442271 - DNA, 12 bp, Homo sapiens
taggagcatgag

SEQ ID NO: 5442272 - DNA, 17 bp, Homo sapiens
taggagcccactgtaac

SEQ ID NO: 5442273 - DNA, 21 bp, Homo sapiens
taggagcccactgtaacaata

SEQ ID NO: 5442274 - DNA, 13 bp, Homo sapiens
taggagcccagcc

SEQ ID NO: 5442275 - DNA, 12 bp, Homo sapiens
taggagcccttc

SEQ ID NO: 5442276 - DNA, 16 bp, Homo sapiens
taggagcccttctctt

SEQ ID NO: 5442277 - DNA, 20 bp, Homo sapiens
taggagccgactctttgata

SEQ ID NO: 5442278 - DNA, 14 bp, Homo sapiens
taggagctaaggct

SEQ ID NO: 5442279 - DNA, 17 bp, Homo sapiens
taggagctaaggctcta

SEQ ID NO: 5442280 - DNA, 15 bp, Homo sapiens
taggagctcagttga

SEQ ID NO: 5442281 - DNA, 16 bp, Homo sapiens
taggagctgaggtttc

SEQ ID NO: 5442282 - DNA, 17 bp, Homo sapiens
taggagctgcagttctt

SEQ ID NO: 5442283 - DNA, 21 bp, Homo sapiens
taggagctggctggcaggtgt

SEQ ID NO: 5442284 - DNA, 17 bp, Homo sapiens
taggagcttaagaaaga

SEQ ID NO: 5442285 - DNA, 19 bp, Homo sapiens
taggagctttgactcagga

SEQ ID NO: 5442286 - DNA, 19 bp, Homo sapiens
taggaggaaaagacagagc

SEQ ID NO: 5442287 - DNA, 15 bp, Homo sapiens
taggaggaaaattcc

SEQ ID NO: 5442288 - DNA, 22 bp, Homo sapiens
taggaggaaacagttctcactg

SEQ ID NO: 5442289 - DNA, 22 bp, Homo sapiens
taggaggaatgtgcttttccat

SEQ ID NO: 5442290 - DNA, 19 bp, Homo sapiens
taggaggacaaaaggaatg

SEQ ID NO: 5442291 - DNA, 16 bp, Homo sapiens
taggaggacagaacca

SEQ ID NO: 5442292 - DNA, 20 bp, Homo sapiens
taggaggaccagagctactg

SEQ ID NO: 5442293 - DNA, 17 bp, Homo sapiens
taggaggaggcatggaa

SEQ ID NO: 5442294 - DNA, 19 bp, Homo sapiens
taggaggaggcatggaaac

SEQ ID NO: 5442295 - DNA, 16 bp, Homo sapiens
taggaggatgctgtgc

SEQ ID NO: 5442296 - DNA, 18 bp, Homo sapiens
taggaggccgaggtagga

SEQ ID NO: 5442297 - DNA, 14 bp, Homo sapiens
taggaggctgcatg

SEQ ID NO: 5442298 - DNA, 21 bp, Homo sapiens
taggaggctgcatgctctgga

SEQ ID NO: 5442299 - DNA, 22 bp, Homo sapiens
taggaggctgcatgctctggaa

SEQ ID NO: 5442300 - DNA, 21 bp, Homo sapiens
taggagggaagatttttccat

SEQ ID NO: 5442301 - DNA, 16 bp, Homo sapiens
taggagggaaggagct

SEQ ID NO: 5442302 - DNA, 14 bp, Homo sapiens
taggagggagactg

SEQ ID NO: 5442303 - DNA, 18 bp, Homo sapiens
taggagggagactgtggt

SEQ ID NO: 5442304 - DNA, 19 bp, Homo sapiens
taggagggagactgtggta

SEQ ID NO: 5442305 - DNA, 18 bp, Homo sapiens
taggagggagttatctaa

SEQ ID NO: 5442306 - DNA, 23 bp, Homo sapiens
taggagggggcggcagggctggg

SEQ ID NO: 5442307 - DNA, 16 bp, Homo sapiens
taggaggggttaataa

SEQ ID NO: 5442308 - DNA, 24 bp, Homo sapiens
taggagtcttatatcccaggtgag

SEQ ID NO: 5442309 - DNA, 23 bp, Homo sapiens
taggagtgagtgtatgtgtgtgt

SEQ ID NO: 5442310 - DNA, 22 bp, Homo sapiens
taggagtggttctcatttggtc

SEQ ID NO: 5442311 - DNA, 18 bp, Homo sapiens
taggagtgtgtgacattc

SEQ ID NO: 5442312 - DNA, 17 bp, Homo sapiens
taggagtgtgtgatttt

SEQ ID NO: 5442313 - DNA, 15 bp, Homo sapiens
taggagttctcctgg

SEQ ID NO: 5442314 - DNA, 20 bp, Homo sapiens
taggagttctctgatgcaga

SEQ ID NO: 5442315 - DNA, 21 bp, Homo sapiens
taggagttttatatactgtgt

SEQ ID NO: 5442316 - DNA, 21 bp, Homo sapiens
taggataaaaagccagggctg

SEQ ID NO: 5442317 - DNA, 22 bp, Homo sapiens
taggataaaaagccagggctgg

SEQ ID NO: 5442318 - DNA, 23 bp, Homo sapiens
taggataaaaagccagggctgga

SEQ ID NO: 5442319 - DNA, 15 bp, Homo sapiens
taggcgaccaccgcc

SEQ ID NO: 5442320 - DNA, 14 bp, Homo sapiens
taggcgagtgccag

SEQ ID NO: 5442321 - DNA, 18 bp, Homo sapiens
taggcgagtgccaggact

SEQ ID NO: 5442322 - DNA, 23 bp, Homo sapiens
taggcgatcacaacgtgcattgt

SEQ ID NO: 5442323 - DNA, 15 bp, Homo sapiens
taggcgcccctgggg

SEQ ID NO: 5442324 - DNA, 17 bp, Homo sapiens
taggcgctcagaggccg

SEQ ID NO: 5442325 - DNA, 18 bp, Homo sapiens
taggcgctcagaggccgc

SEQ ID NO: 5442326 - DNA, 17 bp, Homo sapiens
taggcggcgatttttgt

SEQ ID NO: 5442327 - DNA, 16 bp, Homo sapiens
taggcgggaaggaggg

SEQ ID NO: 5442328 - DNA, 22 bp, Homo sapiens
taggcggggcttgccttctggt

SEQ ID NO: 5442329 - DNA, 19 bp, Homo sapiens
taggcggtcatgtgtgcat

SEQ ID NO: 5442330 - DNA, 20 bp, Homo sapiens
taggcggtcatgtgtgcatg

SEQ ID NO: 5442331 - DNA, 16 bp, Homo sapiens
taggcgtgagaagcat

SEQ ID NO: 5442332 - DNA, 15 bp, Homo sapiens
taggctaaaaggtct

SEQ ID NO: 5442333 - DNA, 14 bp, Homo sapiens
taggctaagaaaga

SEQ ID NO: 5442334 - DNA, 15 bp, Homo sapiens
taggctacaattttc

SEQ ID NO: 5442335 - DNA, 19 bp, Homo sapiens
taggctacagagaagcctt

SEQ ID NO: 5442336 - DNA, 21 bp, Homo sapiens
taggctacagagaagccttca

SEQ ID NO: 5442337 - DNA, 19 bp, Homo sapiens
taggctaccctcctctaga

SEQ ID NO: 5442338 - DNA, 19 bp, Homo sapiens
taggctacccttgccaagg

SEQ ID NO: 5442339 - DNA, 21 bp, Homo sapiens
taggctactgtaatgctgcct

SEQ ID NO: 5442340 - DNA, 15 bp, Homo sapiens
taggctagggtgggg

SEQ ID NO: 5442341 - DNA, 17 bp, Homo sapiens
taggctataagaagtag

SEQ ID NO: 5442342 - DNA, 17 bp, Homo sapiens
taggctatatgcatttg

SEQ ID NO: 5442343 - DNA, 16 bp, Homo sapiens
taggctattaaaaaag

SEQ ID NO: 5442344 - DNA, 15 bp, Homo sapiens
taggctattcctgag

SEQ ID NO: 5442345 - DNA, 17 bp, Homo sapiens
taggctattcctgagag

SEQ ID NO: 5442346 - DNA, 16 bp, Homo sapiens
taggctcactctttcc

SEQ ID NO: 5442347 - DNA, 16 bp, Homo sapiens
taggctcatttactgt

SEQ ID NO: 5442348 - DNA, 17 bp, Homo sapiens
taggctcatttactgtt

SEQ ID NO: 5442349 - DNA, 14 bp, Homo sapiens
taggctccagacag

SEQ ID NO: 5442350 - DNA, 22 bp, Homo sapiens
taggctcctgccagtgtggaac

SEQ ID NO: 5442351 - DNA, 14 bp, Homo sapiens
taggctcctgggag

SEQ ID NO: 5442352 - DNA, 16 bp, Homo sapiens
taggctccttcctgtg

SEQ ID NO: 5442353 - DNA, 17 bp, Homo sapiens
taggctccttcctgtgg

SEQ ID NO: 5442354 - DNA, 23 bp, Homo sapiens
taggctccttcctgtgggtgggg

SEQ ID NO: 5442355 - DNA, 22 bp, Homo sapiens
taggctctatttaactgagtca

SEQ ID NO: 5442356 - DNA, 19 bp, Homo sapiens
taggctctgaaatcttggg

SEQ ID NO: 5442357 - DNA, 12 bp, Homo sapiens
taggctctgaga

SEQ ID NO: 5442358 - DNA, 14 bp, Homo sapiens
taggctctgagact

SEQ ID NO: 5442359 - DNA, 13 bp, Homo sapiens
taggctctgcctt

SEQ ID NO: 5442360 - DNA, 15 bp, Homo sapiens
taggctcttaagcag

SEQ ID NO: 5442361 - DNA, 20 bp, Homo sapiens
taggctcttaagcagcatgg

SEQ ID NO: 5442362 - DNA, 19 bp, Homo sapiens
taggctgacacctaactct

SEQ ID NO: 5442363 - DNA, 21 bp, Homo sapiens
taggctgacacctaactcttc

SEQ ID NO: 5442364 - DNA, 19 bp, Homo sapiens
taggctgatgggcaaaaaa

SEQ ID NO: 5442365 - DNA, 15 bp, Homo sapiens
taggctgctccctga

SEQ ID NO: 5442366 - DNA, 16 bp, Homo sapiens
taggctgctccctgag

SEQ ID NO: 5442367 - DNA, 11 bp, Homo sapiens
taggctgctgc

SEQ ID NO: 5442368 - DNA, 15 bp, Homo sapiens
taggctgctggcgcc

SEQ ID NO: 5442369 - DNA, 16 bp, Homo sapiens
taggctgctggcgcct

SEQ ID NO: 5442370 - DNA, 14 bp, Homo sapiens
taggctggagaagc

SEQ ID NO: 5442371 - DNA, 15 bp, Homo sapiens
taggctggagaagct

SEQ ID NO: 5442372 - DNA, 16 bp, Homo sapiens
taggctgggcccagag

SEQ ID NO: 5442373 - DNA, 18 bp, Homo sapiens
taggctgggcccagaggc

SEQ ID NO: 5442374 - DNA, 14 bp, Homo sapiens
taggctggggacac

SEQ ID NO: 5442375 - DNA, 11 bp, Homo sapiens
taggctgggtg

SEQ ID NO: 5442376 - DNA, 12 bp, Homo sapiens
taggctgggtgc

SEQ ID NO: 5442377 - DNA, 19 bp, Homo sapiens
taggctgtaatcaagaaaa

SEQ ID NO: 5442378 - DNA, 22 bp, Homo sapiens
taggctgtcgtccccctccagt

SEQ ID NO: 5442379 - DNA, 17 bp, Homo sapiens
taggctgtctgcgaaga

SEQ ID NO: 5442380 - DNA, 16 bp, Homo sapiens
taggctgtctgtgcca

SEQ ID NO: 5442381 - DNA, 12 bp, Homo sapiens
taggctgtgggg

SEQ ID NO: 5442382 - DNA, 21 bp, Homo sapiens
taggctgtggggtctggctgt

SEQ ID NO: 5442383 - DNA, 14 bp, Homo sapiens
taggctgttccctt

SEQ ID NO: 5442384 - DNA, 21 bp, Homo sapiens
taggctgttccttgtactctt

SEQ ID NO: 5442385 - DNA, 22 bp, Homo sapiens
taggctgttccttgtactctta

SEQ ID NO: 5442386 - DNA, 15 bp, Homo sapiens
taggcttctattacc

SEQ ID NO: 5442387 - DNA, 16 bp, Homo sapiens
taggcttctattacct

SEQ ID NO: 5442388 - DNA, 12 bp, Homo sapiens
taggcttggctc

SEQ ID NO: 5442389 - DNA, 22 bp, Homo sapiens
taggctttcatgttgcaaagaa

SEQ ID NO: 5442390 - DNA, 12 bp, Homo sapiens
taggcttttgtt

SEQ ID NO: 5442391 - DNA, 14 bp, Homo sapiens
taggctttttaatc

SEQ ID NO: 5442392 - DNA, 21 bp, Homo sapiens
tagggaaaaaccagcgtgtga

SEQ ID NO: 5442393 - DNA, 13 bp, Homo sapiens
tagggaaaaatgc

SEQ ID NO: 5442394 - DNA, 19 bp, Homo sapiens
tagggaaaccttggagagg

SEQ ID NO: 5442395 - DNA, 18 bp, Homo sapiens
tagggaaaggtaaataca

SEQ ID NO: 5442396 - DNA, 17 bp, Homo sapiens
tagggaaaggttttgta

SEQ ID NO: 5442397 - DNA, 16 bp, Homo sapiens
tagggaaataataggg

SEQ ID NO: 5442398 - DNA, 15 bp, Homo sapiens
tagggaactctgggg

SEQ ID NO: 5442399 - DNA, 15 bp, Homo sapiens
tagggaagagaaaca

SEQ ID NO: 5442400 - DNA, 21 bp, Homo sapiens
tagggaagcagggacaccccc

SEQ ID NO: 5442401 - DNA, 17 bp, Homo sapiens
tagggaaggccacctgc

SEQ ID NO: 5442402 - DNA, 14 bp, Homo sapiens
tagggaagggcctg

SEQ ID NO: 5442403 - DNA, 22 bp, Homo sapiens
tagggaaggtatatcaggaggg

SEQ ID NO: 5442404 - DNA, 13 bp, Homo sapiens
tagggaagtaaaa

SEQ ID NO: 5442405 - DNA, 15 bp, Homo sapiens
tagggaagtaaaaaa

SEQ ID NO: 5442406 - DNA, 20 bp, Homo sapiens
tagggaagttgtctccttcc

SEQ ID NO: 5442407 - DNA, 19 bp, Homo sapiens
tagggacaggaccccagct

SEQ ID NO: 5442408 - DNA, 17 bp, Homo sapiens
tagggacccctcctccc

SEQ ID NO: 5442409 - DNA, 20 bp, Homo sapiens
tagggacccctcgccccagc

SEQ ID NO: 5442410 - DNA, 22 bp, Homo sapiens
tagggacccctcgccccagcct

SEQ ID NO: 5442411 - DNA, 15 bp, Homo sapiens
tagggacctggggaa

SEQ ID NO: 5442412 - DNA, 18 bp, Homo sapiens
tagggacctggggaagca

SEQ ID NO: 5442413 - DNA, 14 bp, Homo sapiens
tagggactatcagg

SEQ ID NO: 5442414 - DNA, 20 bp, Homo sapiens
tagggactcaatttctcccc

SEQ ID NO: 5442415 - DNA, 15 bp, Homo sapiens
tagggactgaccagc

SEQ ID NO: 5442416 - DNA, 21 bp, Homo sapiens
tagggactgccaggctgtttc

SEQ ID NO: 5442417 - DNA, 14 bp, Homo sapiens
tagggacttaaaaa

SEQ ID NO: 5442418 - DNA, 11 bp, Homo sapiens
tagggagaagg

SEQ ID NO: 5442419 - DNA, 23 bp, Homo sapiens
tagggagacagggtaggaaaggg

SEQ ID NO: 5442420 - DNA, 20 bp, Homo sapiens
tagggagatgagttgcagtt

SEQ ID NO: 5442421 - DNA, 12 bp, Homo sapiens
tagggagccatg

SEQ ID NO: 5442422 - DNA, 17 bp, Homo sapiens
tagggagcctcccctcc

SEQ ID NO: 5442423 - DNA, 22 bp, Homo sapiens
tagggaggaccttatctgtgcg

SEQ ID NO: 5442424 - DNA, 18 bp, Homo sapiens
tagggagtacctgctgcc

SEQ ID NO: 5442425 - DNA, 16 bp, Homo sapiens
tagggagtgaagccac

SEQ ID NO: 5442426 - DNA, 23 bp, Homo sapiens
tagggatagtcaccttttaaatc

SEQ ID NO: 5442427 - DNA, 15 bp, Homo sapiens
tagggatataaaaac

SEQ ID NO: 5442428 - DNA, 18 bp, Homo sapiens
tagggatatggcaggact

SEQ ID NO: 5442429 - DNA, 22 bp, Homo sapiens
tagggatatggcaggactcctg

SEQ ID NO: 5442430 - DNA, 12 bp, Homo sapiens
tagggatctgaa

SEQ ID NO: 5442431 - DNA, 14 bp, Homo sapiens
tagggatgcctcct

SEQ ID NO: 5442432 - DNA, 16 bp, Homo sapiens
tagggatgcctccttt

SEQ ID NO: 5442433 - DNA, 22 bp, Homo sapiens
tagggatgcggatcctgctggg

SEQ ID NO: 5442434 - DNA, 15 bp, Homo sapiens
tagggattcaggctg

SEQ ID NO: 5442435 - DNA, 18 bp, Homo sapiens
tagggatttattttcaat

SEQ ID NO: 5442436 - DNA, 21 bp, Homo sapiens
tagggcaattaattccttcag

SEQ ID NO: 5442437 - DNA, 15 bp, Homo sapiens
tagggcactgggctg

SEQ ID NO: 5442438 - DNA, 16 bp, Homo sapiens
tagggcactgggctgt

SEQ ID NO: 5442439 - DNA, 20 bp, Homo sapiens
tagggcagattttcatgcaa

SEQ ID NO: 5442440 - DNA, 17 bp, Homo sapiens
tagggcagattttggtt

SEQ ID NO: 5442441 - DNA, 13 bp, Homo sapiens
tagggcagcttgc

SEQ ID NO: 5442442 - DNA, 17 bp, Homo sapiens
tagggcatttttcttgg

SEQ ID NO: 5442443 - DNA, 16 bp, Homo sapiens
tagggccaagcccagc

SEQ ID NO: 5442444 - DNA, 14 bp, Homo sapiens
tagggccaggcagg

SEQ ID NO: 5442445 - DNA, 15 bp, Homo sapiens
tagggccaggcaggt

SEQ ID NO: 5442446 - DNA, 21 bp, Homo sapiens
tagggccaggcaggtgcctgg

SEQ ID NO: 5442447 - DNA, 14 bp, Homo sapiens
tagggccagggctc

SEQ ID NO: 5442448 - DNA, 14 bp, Homo sapiens
tagggccctggagg

SEQ ID NO: 5442449 - DNA, 18 bp, Homo sapiens
tagggcctcggaggctcc

SEQ ID NO: 5442450 - DNA, 13 bp, Homo sapiens
tagggcctgactc

SEQ ID NO: 5442451 - DNA, 18 bp, Homo sapiens
tagggcctgcatggagaa

SEQ ID NO: 5442452 - DNA, 23 bp, Homo sapiens
tagggcgtgtggtttccctgccc

SEQ ID NO: 5442453 - DNA, 15 bp, Homo sapiens
tagggctcagagggg

SEQ ID NO: 5442454 - DNA, 15 bp, Homo sapiens
tagggctctccaagc

SEQ ID NO: 5442455 - DNA, 19 bp, Homo sapiens
tagggctctccaagcacta

SEQ ID NO: 5442456 - DNA, 15 bp, Homo sapiens
tagggctgagcacct

SEQ ID NO: 5442457 - DNA, 12 bp, Homo sapiens
tagggctgctgc

SEQ ID NO: 5442458 - DNA, 15 bp, Homo sapiens
tagggctgctgcttc

SEQ ID NO: 5442459 - DNA, 23 bp, Homo sapiens
tagggctgctgcttctgctccag

SEQ ID NO: 5442460 - DNA, 18 bp, Homo sapiens
tagggctggctggaggaa

SEQ ID NO: 5442461 - DNA, 19 bp, Homo sapiens
tagggctgggcaaggaaaa

SEQ ID NO: 5442462 - DNA, 20 bp, Homo sapiens
tagggctgggcaaggaaaaa

SEQ ID NO: 5442463 - DNA, 17 bp, Homo sapiens
tagggctggggactggg

SEQ ID NO: 5442464 - DNA, 19 bp, Homo sapiens
tagggctgttgctagggag

SEQ ID NO: 5442465 - DNA, 20 bp, Homo sapiens
tagggctgttgctagggaga

SEQ ID NO: 5442466 - DNA, 23 bp, Homo sapiens
tagggcttcaaggccctcagaga

SEQ ID NO: 5442467 - DNA, 13 bp, Homo sapiens
tagggcttttatt

SEQ ID NO: 5442468 - DNA, 18 bp, Homo sapiens
taggggaaccctgtccct

SEQ ID NO: 5442469 - DNA, 19 bp, Homo sapiens
taggggaagtaaaacagtc

SEQ ID NO: 5442470 - DNA, 20 bp, Homo sapiens
taggggaagtgtgctgaggt

SEQ ID NO: 5442471 - DNA, 14 bp, Homo sapiens
taggggaatgaggg

SEQ ID NO: 5442472 - DNA, 23 bp, Homo sapiens
taggggacacttccctctgtttc

SEQ ID NO: 5442473 - DNA, 16 bp, Homo sapiens
taggggacttggggat

SEQ ID NO: 5442474 - DNA, 12 bp, Homo sapiens
taggggaggaga

SEQ ID NO: 5442475 - DNA, 13 bp, Homo sapiens
taggggaggagag

SEQ ID NO: 5442476 - DNA, 23 bp, Homo sapiens
taggggaggggttgccacaggcc

SEQ ID NO: 5442477 - DNA, 19 bp, Homo sapiens
taggggagggtggggcaat

SEQ ID NO: 5442478 - DNA, 17 bp, Homo sapiens
taggggagtgtgggtga

SEQ ID NO: 5442479 - DNA, 13 bp, Homo sapiens
taggggcagcctc

SEQ ID NO: 5442480 - DNA, 15 bp, Homo sapiens
taggggcagcctccg

SEQ ID NO: 5442481 - DNA, 22 bp, Homo sapiens
taggggcagggatgggggtggc

SEQ ID NO: 5442482 - DNA, 17 bp, Homo sapiens
taggggcatagccagtt

SEQ ID NO: 5442483 - DNA, 20 bp, Homo sapiens
taggggccacctcctccccc

SEQ ID NO: 5442484 - DNA, 18 bp, Homo sapiens
taggggccgagggaaatg

SEQ ID NO: 5442485 - DNA, 24 bp, Homo sapiens
taggggccgagtccaggagcccca

SEQ ID NO: 5442486 - DNA, 21 bp, Homo sapiens
taggggctggggccaaataaa

SEQ ID NO: 5442487 - DNA, 23 bp, Homo sapiens
taggggcttataataaaggactg

SEQ ID NO: 5442488 - DNA, 18 bp, Homo sapiens
taggggcttggtcctagg

SEQ ID NO: 5442489 - DNA, 16 bp, Homo sapiens
tagggggaactctagc

SEQ ID NO: 5442490 - DNA, 17 bp, Homo sapiens
tagggggacggggctga

SEQ ID NO: 5442491 - DNA, 18 bp, Homo sapiens
tagggggacggggctgac

SEQ ID NO: 5442492 - DNA, 16 bp, Homo sapiens
tagggggcaggggcag

SEQ ID NO: 5442493 - DNA, 21 bp, Homo sapiens
tagggggccttgcggaagcca

SEQ ID NO: 5442494 - DNA, 23 bp, Homo sapiens
tagggggccttgcggaagccata

SEQ ID NO: 5442495 - DNA, 15 bp, Homo sapiens
tagggggctggagga

SEQ ID NO: 5442496 - DNA, 16 bp, Homo sapiens
taggggtaccactgaa

SEQ ID NO: 5442497 - DNA, 16 bp, Homo sapiens
tagtgaaaatcgagga

SEQ ID NO: 5442498 - DNA, 19 bp, Homo sapiens
tagtgaaaattttattgaa

SEQ ID NO: 5442499 - DNA, 15 bp, Homo sapiens
tagtgaaacagcttt

SEQ ID NO: 5442500 - DNA, 23 bp, Homo sapiens
tagtgaaatgaatatttaaataa

SEQ ID NO: 5442501 - DNA, 17 bp, Homo sapiens
tagtgaaccacaggttt

SEQ ID NO: 5442502 - DNA, 14 bp, Homo sapiens
tagtgaagaccaga

SEQ ID NO: 5442503 - DNA, 12 bp, Homo sapiens
tagtgaagatgt

SEQ ID NO: 5442504 - DNA, 15 bp, Homo sapiens
tagtgaagttgtgca

SEQ ID NO: 5442505 - DNA, 18 bp, Homo sapiens
tagtgaattggcttcctt

SEQ ID NO: 5442506 - DNA, 19 bp, Homo sapiens
tagtgaattggcttccttg

SEQ ID NO: 5442507 - DNA, 19 bp, Homo sapiens
tagtgaattttaaaatgta

SEQ ID NO: 5442508 - DNA, 20 bp, Homo sapiens
tagtgacaccagtaattatg

SEQ ID NO: 5442509 - DNA, 21 bp, Homo sapiens
tagtgacagagcccagcatcc

SEQ ID NO: 5442510 - DNA, 15 bp, Homo sapiens
tagtgacatgcagtt

SEQ ID NO: 5442511 - DNA, 18 bp, Homo sapiens
tagtgaccaagtgcaata

SEQ ID NO: 5442512 - DNA, 16 bp, Homo sapiens
tagtgaccattattca

SEQ ID NO: 5442513 - DNA, 22 bp, Homo sapiens
tagtgaccccttccctgtcctt

SEQ ID NO: 5442514 - DNA, 13 bp, Homo sapiens
tagtgagaagaat

SEQ ID NO: 5442515 - DNA, 16 bp, Homo sapiens
tagtgagaagaatatt

SEQ ID NO: 5442516 - DNA, 19 bp, Homo sapiens
tagtgagaagaatattgtt

SEQ ID NO: 5442517 - DNA, 22 bp, Homo sapiens
tagtgagcagtcaggaaagaga

SEQ ID NO: 5442518 - DNA, 23 bp, Homo sapiens
tagtgagcagtgagcactgaaac

SEQ ID NO: 5442519 - DNA, 23 bp, Homo sapiens
tagtgagccactcagtctcttcc

SEQ ID NO: 5442520 - DNA, 13 bp, Homo sapiens
tagtgagcctggg

SEQ ID NO: 5442521 - DNA, 22 bp, Homo sapiens
tagtgagcgagtggatgctgtg

SEQ ID NO: 5442522 - DNA, 14 bp, Homo sapiens
tagtgagtgtagac

SEQ ID NO: 5442523 - DNA, 23 bp, Homo sapiens
tagtgagtgtggcttagtaatag

SEQ ID NO: 5442524 - DNA, 20 bp, Homo sapiens
tagtgataaatcgggaaatt

SEQ ID NO: 5442525 - DNA, 12 bp, Homo sapiens
tagtgatatttc

SEQ ID NO: 5442526 - DNA, 14 bp, Homo sapiens
tagtgatcacagca

SEQ ID NO: 5442527 - DNA, 15 bp, Homo sapiens
tagtgatcacagcag

SEQ ID NO: 5442528 - DNA, 20 bp, Homo sapiens
tagtgatcacagcagcttct

SEQ ID NO: 5442529 - DNA, 15 bp, Homo sapiens
tagtgatcatttaaa

SEQ ID NO: 5442530 - DNA, 16 bp, Homo sapiens
tagtgatcatttaaaa

SEQ ID NO: 5442531 - DNA, 17 bp, Homo sapiens
tagtgatctgaacagaa

SEQ ID NO: 5442532 - DNA, 18 bp, Homo sapiens
tagtgatggttcccctgt

SEQ ID NO: 5442533 - DNA, 15 bp, Homo sapiens
tagtgattaaatata

SEQ ID NO: 5442534 - DNA, 13 bp, Homo sapiens
tagtgattctgat

SEQ ID NO: 5442535 - DNA, 17 bp, Homo sapiens
tagtgatttacacaggt

SEQ ID NO: 5442536 - DNA, 16 bp, Homo sapiens
tagtgatttcattacc

SEQ ID NO: 5442537 - DNA, 20 bp, Homo sapiens
tagtgcaaaaactgtaaaag

SEQ ID NO: 5442538 - DNA, 22 bp, Homo sapiens
tagtgcaaaaactgtaaaagtg

SEQ ID NO: 5442539 - DNA, 16 bp, Homo sapiens
tagtgcaaaactgtgt

SEQ ID NO: 5442540 - DNA, 14 bp, Homo sapiens
tagtgcaaaatggt

SEQ ID NO: 5442541 - DNA, 14 bp, Homo sapiens
tagtgcaaatcata

SEQ ID NO: 5442542 - DNA, 14 bp, Homo sapiens
tagtgcaaattgtc

SEQ ID NO: 5442543 - DNA, 19 bp, Homo sapiens
tagtgcaacatctctgaat

SEQ ID NO: 5442544 - DNA, 15 bp, Homo sapiens
tagtgcaacttagat

SEQ ID NO: 5442545 - DNA, 22 bp, Homo sapiens
tagtgcaagctttaacagacta

SEQ ID NO: 5442546 - DNA, 19 bp, Homo sapiens
tagtgcaatagtgcaacat

SEQ ID NO: 5442547 - DNA, 18 bp, Homo sapiens
tagtgcaatatattttgt

SEQ ID NO: 5442548 - DNA, 23 bp, Homo sapiens
tagtgcaatatattttgtatgca

SEQ ID NO: 5442549 - DNA, 13 bp, Homo sapiens
tagtgcaatttct

SEQ ID NO: 5442550 - DNA, 15 bp, Homo sapiens
tagtgcagcagggca

SEQ ID NO: 5442551 - DNA, 18 bp, Homo sapiens
tagtgcagctgaaattga

SEQ ID NO: 5442552 - DNA, 21 bp, Homo sapiens
tagtgcagctgaaattgaaaa

SEQ ID NO: 5442553 - DNA, 22 bp, Homo sapiens
tagtgcagctgaaattgaaaag

SEQ ID NO: 5442554 - DNA, 14 bp, Homo sapiens
tagtgcagctgatt

SEQ ID NO: 5442555 - DNA, 15 bp, Homo sapiens
tagtgcagctgattt

SEQ ID NO: 5442556 - DNA, 22 bp, Homo sapiens
tagtgcagctgattttaacaat

SEQ ID NO: 5442557 - DNA, 16 bp, Homo sapiens
tagtgcagttatttgc

SEQ ID NO: 5442558 - DNA, 11 bp, Homo sapiens
tagtgcatgtc

SEQ ID NO: 5442559 - DNA, 20 bp, Homo sapiens
tagtgcatgtcacatgacat

SEQ ID NO: 5442560 - DNA, 20 bp, Homo sapiens
tagtgcattgtttctgtggg

SEQ ID NO: 5442561 - DNA, 21 bp, Homo sapiens
tagtgccaaaaggccccttcc

SEQ ID NO: 5442562 - DNA, 20 bp, Homo sapiens
tagtgccaacttcccctcta

SEQ ID NO: 5442563 - DNA, 22 bp, Homo sapiens
tagtgccaagtttttcagaaag

SEQ ID NO: 5442564 - DNA, 17 bp, Homo sapiens
tagtgccaatgttgtgt

SEQ ID NO: 5442565 - DNA, 14 bp, Homo sapiens
tagtgccaccacag

SEQ ID NO: 5442566 - DNA, 16 bp, Homo sapiens
tagtgccacccacctt

SEQ ID NO: 5442567 - DNA, 21 bp, Homo sapiens
tagtgccagaattttaggaac

SEQ ID NO: 5442568 - DNA, 16 bp, Homo sapiens
tagtgccaggagggca

SEQ ID NO: 5442569 - DNA, 22 bp, Homo sapiens
tagtgcccacttgaggctggca

SEQ ID NO: 5442570 - DNA, 13 bp, Homo sapiens
tagtgccccacct

SEQ ID NO: 5442571 - DNA, 18 bp, Homo sapiens
tagtgccccacctcccgc

SEQ ID NO: 5442572 - DNA, 17 bp, Homo sapiens
tagtgccccagactgag

SEQ ID NO: 5442573 - DNA, 21 bp, Homo sapiens
tagtgccccagactgagctct

SEQ ID NO: 5442574 - DNA, 15 bp, Homo sapiens
tagtgcccctcccat

SEQ ID NO: 5442575 - DNA, 14 bp, Homo sapiens
tagtgcccgcctag

SEQ ID NO: 5442576 - DNA, 17 bp, Homo sapiens
tagtgccctccacagcc

SEQ ID NO: 5442577 - DNA, 23 bp, Homo sapiens
tagtgccctccacagccgcagcc

SEQ ID NO: 5442578 - DNA, 13 bp, Homo sapiens
tagtgccctgccc

SEQ ID NO: 5442579 - DNA, 18 bp, Homo sapiens
tagtgccctgccccctgg

SEQ ID NO: 5442580 - DNA, 13 bp, Homo sapiens
tagtgcctctgca

SEQ ID NO: 5442581 - DNA, 19 bp, Homo sapiens
tagtgccttctaaaggtgt

SEQ ID NO: 5442582 - DNA, 17 bp, Homo sapiens
tagtgccttgcccacag

SEQ ID NO: 5442583 - DNA, 14 bp, Homo sapiens
tagtgcggacaagt

SEQ ID NO: 5442584 - DNA, 17 bp, Homo sapiens
tagtgcggacaagtttt

SEQ ID NO: 5442585 - DNA, 18 bp, Homo sapiens
tagtgctaagtgtgaact

SEQ ID NO: 5442586 - DNA, 16 bp, Homo sapiens
tagtgctaatgcattt

SEQ ID NO: 5442587 - DNA, 16 bp, Homo sapiens
tagtgctattctgtgt

SEQ ID NO: 5442588 - DNA, 21 bp, Homo sapiens
tagtgctattctgtgttgaac

SEQ ID NO: 5442589 - DNA, 17 bp, Homo sapiens
tagtgctcttaacttgt

SEQ ID NO: 5442590 - DNA, 15 bp, Homo sapiens
tagtgctgaagctta

SEQ ID NO: 5442591 - DNA, 22 bp, Homo sapiens
tagtgctgaagcttattaatgc

SEQ ID NO: 5442592 - DNA, 13 bp, Homo sapiens
tagtgctgctgaa

SEQ ID NO: 5442593 - DNA, 12 bp, Homo sapiens
tagtgctgggat

SEQ ID NO: 5442594 - DNA, 12 bp, Homo sapiens
tagtgctgtgaa

SEQ ID NO: 5442595 - DNA, 15 bp, Homo sapiens
tagtgcttaacattt

SEQ ID NO: 5442596 - DNA, 17 bp, Homo sapiens
tagtgctttaagaatga

SEQ ID NO: 5442597 - DNA, 17 bp, Homo sapiens
tagtgctttattttgtt

SEQ ID NO: 5442598 - DNA, 23 bp, Homo sapiens
tagtggaaaaacacatggggaaa

SEQ ID NO: 5442599 - DNA, 16 bp, Homo sapiens
tagtggaaaataggct

SEQ ID NO: 5442600 - DNA, 17 bp, Homo sapiens
tagtggaaacatttata

SEQ ID NO: 5442601 - DNA, 19 bp, Homo sapiens
tagtggaaagattgtgtct

SEQ ID NO: 5442602 - DNA, 13 bp, Homo sapiens
tagtggaaagtga

SEQ ID NO: 5442603 - DNA, 19 bp, Homo sapiens
tagtggaaatcgcttatat

SEQ ID NO: 5442604 - DNA, 14 bp, Homo sapiens
tagtggaagagcag

SEQ ID NO: 5442605 - DNA, 17 bp, Homo sapiens
tagtggaagagcagcct

SEQ ID NO: 5442606 - DNA, 23 bp, Homo sapiens
tagtggaagagcagcctgatggc

SEQ ID NO: 5442607 - DNA, 17 bp, Homo sapiens
tagtggaccctgaaatg

SEQ ID NO: 5442608 - DNA, 20 bp, Homo sapiens
tagtggaccctgaaatgtgt

SEQ ID NO: 5442609 - DNA, 21 bp, Homo sapiens
tagtggaccctgaaatgtgtg

SEQ ID NO: 5442610 - DNA, 14 bp, Homo sapiens
tagtggacttgttt

SEQ ID NO: 5442611 - DNA, 13 bp, Homo sapiens
tagtggagccagg

SEQ ID NO: 5442612 - DNA, 19 bp, Homo sapiens
tagtggagttttataaatt

SEQ ID NO: 5442613 - DNA, 15 bp, Homo sapiens
tagtggatggaaggg

SEQ ID NO: 5442614 - DNA, 15 bp, Homo sapiens
tagtggatggacaga

SEQ ID NO: 5442615 - DNA, 23 bp, Homo sapiens
tagtggattactgccattcactt

SEQ ID NO: 5442616 - DNA, 17 bp, Homo sapiens
tagtggcaaaaaagaac

SEQ ID NO: 5442617 - DNA, 23 bp, Homo sapiens
tagtggcaaagagaggtccagag

SEQ ID NO: 5442618 - DNA, 21 bp, Homo sapiens
tagtggcaagacagtggttct

SEQ ID NO: 5442619 - DNA, 15 bp, Homo sapiens
tagtggcaataagtt

SEQ ID NO: 5442620 - DNA, 19 bp, Homo sapiens
tagtggcataccaaatggc

SEQ ID NO: 5442621 - DNA, 13 bp, Homo sapiens
tagtggccactgg

SEQ ID NO: 5442622 - DNA, 23 bp, Homo sapiens
tagtggccactggggtgccttca

SEQ ID NO: 5442623 - DNA, 13 bp, Homo sapiens
tagtggctgtcca

SEQ ID NO: 5442624 - DNA, 14 bp, Homo sapiens
tagtggcttcaaaa

SEQ ID NO: 5442625 - DNA, 16 bp, Homo sapiens
tagtggcttcagcccc

SEQ ID NO: 5442626 - DNA, 17 bp, Homo sapiens
tagtggcttcagcccct

SEQ ID NO: 5442627 - DNA, 15 bp, Homo sapiens
tagtggcttcctccg

SEQ ID NO: 5442628 - DNA, 15 bp, Homo sapiens
tagtgggaagagctg

SEQ ID NO: 5442629 - DNA, 15 bp, Homo sapiens
tagtgggcaggtggc

SEQ ID NO: 5442630 - DNA, 14 bp, Homo sapiens
tagtgggccagggc

SEQ ID NO: 5442631 - DNA, 15 bp, Homo sapiens
tagtgggccagggct

SEQ ID NO: 5442632 - DNA, 17 bp, Homo sapiens
tagtgggccttcattaa

SEQ ID NO: 5442633 - DNA, 21 bp, Homo sapiens
tagtgggccttcattaaatgt

SEQ ID NO: 5442634 - DNA, 14 bp, Homo sapiens
tagtggggcctggg

SEQ ID NO: 5442635 - DNA, 21 bp, Homo sapiens
tagtggggtaattctgcttct

SEQ ID NO: 5442636 - DNA, 15 bp, Homo sapiens
tagtgggtacatcaa

SEQ ID NO: 5442637 - DNA, 12 bp, Homo sapiens
tagtggtagtat

SEQ ID NO: 5442638 - DNA, 13 bp, Homo sapiens
tagtggtatgtct

SEQ ID NO: 5442639 - DNA, 14 bp, Homo sapiens
tagtggtattatac

SEQ ID NO: 5442640 - DNA, 13 bp, Homo sapiens
tagtggtctgatt

SEQ ID NO: 5442641 - DNA, 13 bp, Homo sapiens
tagtggtctttgt

SEQ ID NO: 5442642 - DNA, 14 bp, Homo sapiens
tagtggtctttgta

SEQ ID NO: 5442643 - DNA, 18 bp, Homo sapiens
tagtggtctttgtaagag

SEQ ID NO: 5442644 - DNA, 21 bp, Homo sapiens
tagtggtctttgtaagagtgt

SEQ ID NO: 5442645 - DNA, 22 bp, Homo sapiens
tagtggtgttttaaagagaatg

SEQ ID NO: 5442646 - DNA, 12 bp, Homo sapiens
tagtggtttgct

SEQ ID NO: 5442647 - DNA, 16 bp, Homo sapiens
tagtggttttaggata

SEQ ID NO: 5442648 - DNA, 14 bp, Homo sapiens
tagtgtaaaaatga

SEQ ID NO: 5442649 - DNA, 18 bp, Homo sapiens
tagtgtaagaactgtaca

SEQ ID NO: 5442650 - DNA, 20 bp, Homo sapiens
tagtgtacctattaaaagtt

SEQ ID NO: 5442651 - DNA, 23 bp, Homo sapiens
tagtgtacctcctctcagtgttt

SEQ ID NO: 5442652 - DNA, 23 bp, Homo sapiens
tagtgtagctgtgtggctttcct

SEQ ID NO: 5442653 - DNA, 14 bp, Homo sapiens
tagtgtagtattct

SEQ ID NO: 5442654 - DNA, 16 bp, Homo sapiens
tagtgtagtcaggtgc

SEQ ID NO: 5442655 - DNA, 15 bp, Homo sapiens
tagtgtagtgttaaa

SEQ ID NO: 5442656 - DNA, 17 bp, Homo sapiens
tagtgtataccacctgt

SEQ ID NO: 5442657 - DNA, 21 bp, Homo sapiens
tagtgtataccacctgtacat

SEQ ID NO: 5442658 - DNA, 18 bp, Homo sapiens
tagtgtatatgtgatttt

SEQ ID NO: 5442659 - DNA, 12 bp, Homo sapiens
tagtgtatcaaa

SEQ ID NO: 5442660 - DNA, 14 bp, Homo sapiens
tagtgtatcaaaat

SEQ ID NO: 5442661 - DNA, 17 bp, Homo sapiens
tagtgtatcaaaatgct

SEQ ID NO: 5442662 - DNA, 15 bp, Homo sapiens
tagtgtatctttaaa

SEQ ID NO: 5442663 - DNA, 19 bp, Homo sapiens
tagtgtatgattactggcc

SEQ ID NO: 5442664 - DNA, 18 bp, Homo sapiens
tagtgtattaatcataga

SEQ ID NO: 5442665 - DNA, 17 bp, Homo sapiens
tagtgtattatcactgt

SEQ ID NO: 5442666 - DNA, 14 bp, Homo sapiens
tagtgtcacagaga

SEQ ID NO: 5442667 - DNA, 21 bp, Homo sapiens
tagtgtcacttttttcctgtc

SEQ ID NO: 5442668 - DNA, 14 bp, Homo sapiens
tagtgtcccccctt

SEQ ID NO: 5442669 - DNA, 17 bp, Homo sapiens
tagtgtccccccttgaa

SEQ ID NO: 5442670 - DNA, 15 bp, Homo sapiens
tagtgtcccttacct

SEQ ID NO: 5442671 - DNA, 22 bp, Homo sapiens
tagtgtccgcataagaaaaaga

SEQ ID NO: 5442672 - DNA, 14 bp, Homo sapiens
tagtgtcctatgca

SEQ ID NO: 5442673 - DNA, 16 bp, Homo sapiens
tagtgtcctatgcaat

SEQ ID NO: 5442674 - DNA, 18 bp, Homo sapiens
tagtgtctctatttatga

SEQ ID NO: 5442675 - DNA, 18 bp, Homo sapiens
tagtgtctgtccatctgt

SEQ ID NO: 5442676 - DNA, 13 bp, Homo sapiens
tagttttgctttt

SEQ ID NO: 5442677 - DNA, 15 bp, Homo sapiens
tagttttggttttta

SEQ ID NO: 5442678 - DNA, 19 bp, Homo sapiens
tagttttgtaaaaactgaa

SEQ ID NO: 5442679 - DNA, 15 bp, Homo sapiens
tagttttgtcaaact

SEQ ID NO: 5442680 - DNA, 18 bp, Homo sapiens
tagttttgtgaaggtgat

SEQ ID NO: 5442681 - DNA, 13 bp, Homo sapiens
tagttttgttcca

SEQ ID NO: 5442682 - DNA, 13 bp, Homo sapiens
tagttttgtttat

SEQ ID NO: 5442683 - DNA, 21 bp, Homo sapiens
tagtttttaaaatatcttttg

SEQ ID NO: 5442684 - DNA, 18 bp, Homo sapiens
tagtttttacctaccaca

SEQ ID NO: 5442685 - DNA, 15 bp, Homo sapiens
tagtttttatatgtt

SEQ ID NO: 5442686 - DNA, 21 bp, Homo sapiens
tagtttttatctttgaccaac

SEQ ID NO: 5442687 - DNA, 14 bp, Homo sapiens
tagtttttcagctt

SEQ ID NO: 5442688 - DNA, 21 bp, Homo sapiens
tagtttttcctatcatgttaa

SEQ ID NO: 5442689 - DNA, 17 bp, Homo sapiens
tagtttttcttcaacat

SEQ ID NO: 5442690 - DNA, 21 bp, Homo sapiens
tagtttttgaaaattatgcaa

SEQ ID NO: 5442691 - DNA, 15 bp, Homo sapiens
tagtttttgctgaag

SEQ ID NO: 5442692 - DNA, 16 bp, Homo sapiens
tagtttttgctgaagg

SEQ ID NO: 5442693 - DNA, 13 bp, Homo sapiens
tagtttttgttct

SEQ ID NO: 5442694 - DNA, 15 bp, Homo sapiens
tagtttttgttctta

SEQ ID NO: 5442695 - DNA, 17 bp, Homo sapiens
tagttttttcatcttca

SEQ ID NO: 5442696 - DNA, 18 bp, Homo sapiens
tagttttttttgtaaact

SEQ ID NO: 5442697 - DNA, 18 bp, Homo sapiens
tagtttttttttaatcta

SEQ ID NO: 5442698 - DNA, 23 bp, Homo sapiens
tataaaaaaaatagttgagccag

SEQ ID NO: 5442699 - DNA, 23 bp, Homo sapiens
tataaaaaaaatgaaatgtttta

SEQ ID NO: 5442700 - DNA, 13 bp, Homo sapiens
tataaaaaagaaa

SEQ ID NO: 5442701 - DNA, 13 bp, Homo sapiens
tataaaaaataaa

SEQ ID NO: 5442702 - DNA, 15 bp, Homo sapiens
tataaaaaataagta

SEQ ID NO: 5442703 - DNA, 17 bp, Homo sapiens
tataaaaaatatgtatt

SEQ ID NO: 5442704 - DNA, 14 bp, Homo sapiens
tataaaaaatcttt

SEQ ID NO: 5442705 - DNA, 19 bp, Homo sapiens
tataaaaaatggtgcctga

SEQ ID NO: 5442706 - DNA, 16 bp, Homo sapiens
tataaaaaatggttca

SEQ ID NO: 5442707 - DNA, 14 bp, Homo sapiens
tataaaaaatgtaa

SEQ ID NO: 5442708 - DNA, 16 bp, Homo sapiens
tataaaaaatgtaaca

SEQ ID NO: 5442709 - DNA, 17 bp, Homo sapiens
tataaaaaatgtaacat

SEQ ID NO: 5442710 - DNA, 12 bp, Homo sapiens
tataaaaacaat

SEQ ID NO: 5442711 - DNA, 12 bp, Homo sapiens
tataaaaacaga

SEQ ID NO: 5442712 - DNA, 20 bp, Homo sapiens
tataaaaacagattctgatt

SEQ ID NO: 5442713 - DNA, 20 bp, Homo sapiens
tataaaaacatgagttattc

SEQ ID NO: 5442714 - DNA, 21 bp, Homo sapiens
tataaaaacattgaaatatta

SEQ ID NO: 5442715 - DNA, 15 bp, Homo sapiens
tataaaaacatttgt

SEQ ID NO: 5442716 - DNA, 19 bp, Homo sapiens
tataaaaactcctgggctt

SEQ ID NO: 5442717 - DNA, 23 bp, Homo sapiens
tataaaaagaaaagataaagatg

SEQ ID NO: 5442718 - DNA, 17 bp, Homo sapiens
tataaaaagcagcagag

SEQ ID NO: 5442719 - DNA, 18 bp, Homo sapiens
tataaaaagcttccatga

SEQ ID NO: 5442720 - DNA, 22 bp, Homo sapiens
tataaaaaggaaattagtcttt

SEQ ID NO: 5442721 - DNA, 23 bp, Homo sapiens
tataaaaaggaagtggggacaga

SEQ ID NO: 5442722 - DNA, 16 bp, Homo sapiens
tataaaaagtgaaata

SEQ ID NO: 5442723 - DNA, 17 bp, Homo sapiens
tataaaaagtgaaataa

SEQ ID NO: 5442724 - DNA, 19 bp, Homo sapiens
tataaaaataaaaaacact

SEQ ID NO: 5442725 - DNA, 20 bp, Homo sapiens
tataaaaataaaaaacactg

SEQ ID NO: 5442726 - DNA, 22 bp, Homo sapiens
tataaaaataaaaaagatccca

SEQ ID NO: 5442727 - DNA, 14 bp, Homo sapiens
tataaaaatacaac

SEQ ID NO: 5442728 - DNA, 21 bp, Homo sapiens
tataaaaatagataattaaaa

SEQ ID NO: 5442729 - DNA, 15 bp, Homo sapiens
tataaaaatgtaaat

SEQ ID NO: 5442730 - DNA, 18 bp, Homo sapiens
tataaaaatgtaaattag

SEQ ID NO: 5442731 - DNA, 14 bp, Homo sapiens
tataaaaatgtgaa

SEQ ID NO: 5442732 - DNA, 21 bp, Homo sapiens
tataaaacagagtaatcttgt

SEQ ID NO: 5442733 - DNA, 17 bp, Homo sapiens
tataaaacagtgtttcc

SEQ ID NO: 5442734 - DNA, 20 bp, Homo sapiens
tataaaacagtgtttccagt

SEQ ID NO: 5442735 - DNA, 17 bp, Homo sapiens
tataaaacctgatatat

SEQ ID NO: 5442736 - DNA, 16 bp, Homo sapiens
tataaaactgctttgt

SEQ ID NO: 5442737 - DNA, 16 bp, Homo sapiens
tataaaactgtacttc

SEQ ID NO: 5442738 - DNA, 15 bp, Homo sapiens
tataaaactttcctc

SEQ ID NO: 5442739 - DNA, 13 bp, Homo sapiens
tataaaagaaata

SEQ ID NO: 5442740 - DNA, 16 bp, Homo sapiens
tataaaagacaaaact

SEQ ID NO: 5442741 - DNA, 11 bp, Homo sapiens
tataaaagatg

SEQ ID NO: 5442742 - DNA, 23 bp, Homo sapiens
tataaaagatggggtctgtaaaa

SEQ ID NO: 5442743 - DNA, 12 bp, Homo sapiens
tataaaagcctt

SEQ ID NO: 5442744 - DNA, 22 bp, Homo sapiens
tataaaagctcagatgacattt

SEQ ID NO: 5442745 - DNA, 15 bp, Homo sapiens
tataaaagctttctg

SEQ ID NO: 5442746 - DNA, 20 bp, Homo sapiens
tataaaaggatgttacaagt

SEQ ID NO: 5442747 - DNA, 19 bp, Homo sapiens
tataaaaggtgagctcagc

SEQ ID NO: 5442748 - DNA, 18 bp, Homo sapiens
tataaaaggttgccaaat

SEQ ID NO: 5442749 - DNA, 24 bp, Homo sapiens
tataaaaggttgccaaattgctgc

SEQ ID NO: 5442750 - DNA, 22 bp, Homo sapiens
tataaaagtgattgttggcaca

SEQ ID NO: 5442751 - DNA, 9 bp, Homo sapiens
tataaaata

SEQ ID NO: 5442752 - DNA, 17 bp, Homo sapiens
tataaaataaacttctt

SEQ ID NO: 5442753 - DNA, 14 bp, Homo sapiens
tataaaataaatat

SEQ ID NO: 5442754 - DNA, 16 bp, Homo sapiens
tataaaataaatatac

SEQ ID NO: 5442755 - DNA, 22 bp, Homo sapiens
tataaaataaatatactaataa

SEQ ID NO: 5442756 - DNA, 23 bp, Homo sapiens
tataaaataaatatactaataaa

SEQ ID NO: 5442757 - DNA, 12 bp, Homo sapiens
tataaaataatg

SEQ ID NO: 5442758 - DNA, 20 bp, Homo sapiens
tataaaatacacgtgtatat

SEQ ID NO: 5442759 - DNA, 12 bp, Homo sapiens
tataaaatacat

SEQ ID NO: 5442760 - DNA, 19 bp, Homo sapiens
tataaaatagacaaataga

SEQ ID NO: 5442761 - DNA, 12 bp, Homo sapiens
tataaaataggc

SEQ ID NO: 5442762 - DNA, 17 bp, Homo sapiens
tataaaatattgttaat

SEQ ID NO: 5442763 - DNA, 21 bp, Homo sapiens
tataaaatcaaagaaaacata

SEQ ID NO: 5442764 - DNA, 17 bp, Homo sapiens
tataaaatcagccaatt

SEQ ID NO: 5442765 - DNA, 20 bp, Homo sapiens
tataaaatctgaattttgca

SEQ ID NO: 5442766 - DNA, 18 bp, Homo sapiens
tataaaatgaaagatttt

SEQ ID NO: 5442767 - DNA, 23 bp, Homo sapiens
tataaaatgaaagatttttacta

SEQ ID NO: 5442768 - DNA, 21 bp, Homo sapiens
tataaaatgcaaaataaatgt

SEQ ID NO: 5442769 - DNA, 23 bp, Homo sapiens
tataaaatgcaaaataaatgttt

SEQ ID NO: 5442770 - DNA, 21 bp, Homo sapiens
tataaaatgcagtaacattct

SEQ ID NO: 5442771 - DNA, 12 bp, Homo sapiens
tataaaatgtaa

SEQ ID NO: 5442772 - DNA, 20 bp, Homo sapiens
tataaaatgtaacactgatg

SEQ ID NO: 5442773 - DNA, 12 bp, Homo sapiens
tataaaatgtgc

SEQ ID NO: 5442774 - DNA, 13 bp, Homo sapiens
tataaaatgtgcg

SEQ ID NO: 5442775 - DNA, 18 bp, Homo sapiens
tataaaattaaagaaaat

SEQ ID NO: 5442776 - DNA, 18 bp, Homo sapiens
tataaaattaaatgcctt

SEQ ID NO: 5442777 - DNA, 23 bp, Homo sapiens
tataaaattaaatgccttgtata

SEQ ID NO: 5442778 - DNA, 18 bp, Homo sapiens
tataaaattagattagaa

SEQ ID NO: 5442779 - DNA, 12 bp, Homo sapiens
tataaaattatg

SEQ ID NO: 5442780 - DNA, 16 bp, Homo sapiens
tataaaattgaaaaca

SEQ ID NO: 5442781 - DNA, 15 bp, Homo sapiens
tataaaatttactgt

SEQ ID NO: 5442782 - DNA, 14 bp, Homo sapiens
tataaaatttctgg

SEQ ID NO: 5442783 - DNA, 19 bp, Homo sapiens
tataaacaagaaaaataaa

SEQ ID NO: 5442784 - DNA, 13 bp, Homo sapiens
tataaacacagta

SEQ ID NO: 5442785 - DNA, 20 bp, Homo sapiens
tataaacacagtaagatagg

SEQ ID NO: 5442786 - DNA, 18 bp, Homo sapiens
tataaacacattgaatgc

SEQ ID NO: 5442787 - DNA, 19 bp, Homo sapiens
tataaacactccacagtgt

SEQ ID NO: 5442788 - DNA, 12 bp, Homo sapiens
tataaacactgt

SEQ ID NO: 5442789 - DNA, 18 bp, Homo sapiens
tataaacactgtattgta

SEQ ID NO: 5442790 - DNA, 13 bp, Homo sapiens
tataaacactgtt

SEQ ID NO: 5442791 - DNA, 17 bp, Homo sapiens
tataaacagaaatggaa

SEQ ID NO: 5442792 - DNA, 21 bp, Homo sapiens
tataaacagaaatggaaagca

SEQ ID NO: 5442793 - DNA, 19 bp, Homo sapiens
tataaacagaactcccttc

SEQ ID NO: 5442794 - DNA, 12 bp, Homo sapiens
tataaacagcag

SEQ ID NO: 5442795 - DNA, 13 bp, Homo sapiens
tataaacagcagg

SEQ ID NO: 5442796 - DNA, 12 bp, Homo sapiens
tataaacagctt

SEQ ID NO: 5442797 - DNA, 14 bp, Homo sapiens
tataaacagtttta

SEQ ID NO: 5442798 - DNA, 15 bp, Homo sapiens
tataaacatattttt

SEQ ID NO: 5442799 - DNA, 18 bp, Homo sapiens
tataaacatatttttata

SEQ ID NO: 5442800 - DNA, 17 bp, Homo sapiens
tataaacattaaaagaa

SEQ ID NO: 5442801 - DNA, 16 bp, Homo sapiens
tataaacattaaatgt

SEQ ID NO: 5442802 - DNA, 19 bp, Homo sapiens
tataaacattaaatgtctt

SEQ ID NO: 5442803 - DNA, 15 bp, Homo sapiens
tataaacatttaaag

SEQ ID NO: 5442804 - DNA, 20 bp, Homo sapiens
tataaaccaatcttaaacat

SEQ ID NO: 5442805 - DNA, 20 bp, Homo sapiens
tataaacccattttggtgca

SEQ ID NO: 5442806 - DNA, 20 bp, Homo sapiens
tataaaccgtggtctcatgt

SEQ ID NO: 5442807 - DNA, 16 bp, Homo sapiens
tataaacctaaaaaag

SEQ ID NO: 5442808 - DNA, 17 bp, Homo sapiens
tataaacgatatatgta

SEQ ID NO: 5442809 - DNA, 21 bp, Homo sapiens
tataaacgatatatgtaaata

SEQ ID NO: 5442810 - DNA, 15 bp, Homo sapiens
tataaactactgtaa

SEQ ID NO: 5442811 - DNA, 16 bp, Homo sapiens
tataaactactgtaat

SEQ ID NO: 5442812 - DNA, 15 bp, Homo sapiens
tataaactagatctc

SEQ ID NO: 5442813 - DNA, 16 bp, Homo sapiens
tataaactataaactt

SEQ ID NO: 5442814 - DNA, 19 bp, Homo sapiens
tataaactatcagtttgtc

SEQ ID NO: 5442815 - DNA, 23 bp, Homo sapiens
tataaactccaggcttgattcca

SEQ ID NO: 5442816 - DNA, 17 bp, Homo sapiens
tataaactgctgtcaat

SEQ ID NO: 5442817 - DNA, 22 bp, Homo sapiens
tataaactgctgtcaataaatg

SEQ ID NO: 5442818 - DNA, 11 bp, Homo sapiens
tataaactgtg

SEQ ID NO: 5442819 - DNA, 14 bp, Homo sapiens
tataaactgtgaga

SEQ ID NO: 5442820 - DNA, 15 bp, Homo sapiens
tataaactgtgagat

SEQ ID NO: 5442821 - DNA, 16 bp, Homo sapiens
tataaactgtgagata

SEQ ID NO: 5442822 - DNA, 17 bp, Homo sapiens
tataaacttaagggcaa

SEQ ID NO: 5442823 - DNA, 13 bp, Homo sapiens
tataaacttcaga

SEQ ID NO: 5442824 - DNA, 11 bp, Homo sapiens
tataaacttta

SEQ ID NO: 5442825 - DNA, 18 bp, Homo sapiens
tataaactttaccttttt

SEQ ID NO: 5442826 - DNA, 15 bp, Homo sapiens
tataaactttagagt

SEQ ID NO: 5442827 - DNA, 15 bp, Homo sapiens
tataaagaaaaatag

SEQ ID NO: 5442828 - DNA, 14 bp, Homo sapiens
tataaagaaacttt

SEQ ID NO: 5442829 - DNA, 15 bp, Homo sapiens
tataaagaaactttt

SEQ ID NO: 5442830 - DNA, 16 bp, Homo sapiens
tataaagaaacttttg

SEQ ID NO: 5442831 - DNA, 15 bp, Homo sapiens
tataaagaacaaggt

SEQ ID NO: 5442832 - DNA, 21 bp, Homo sapiens
tataaagaataggacttgttt

SEQ ID NO: 5442833 - DNA, 15 bp, Homo sapiens
tataaagaatgaaag

SEQ ID NO: 5442834 - DNA, 14 bp, Homo sapiens
tataaagaattgtg

SEQ ID NO: 5442835 - DNA, 14 bp, Homo sapiens
tataaagagaaaat

SEQ ID NO: 5442836 - DNA, 22 bp, Homo sapiens
tataaagagaaaattgaattta

SEQ ID NO: 5442837 - DNA, 17 bp, Homo sapiens
tataaagagaagacgaa

SEQ ID NO: 5442838 - DNA, 15 bp, Homo sapiens
tataaagatatatag

SEQ ID NO: 5442839 - DNA, 14 bp, Homo sapiens
tataaagatcattt

SEQ ID NO: 5442840 - DNA, 17 bp, Homo sapiens
tataaagatggctgact

SEQ ID NO: 5442841 - DNA, 15 bp, Homo sapiens
tataaagattaacac

SEQ ID NO: 5442842 - DNA, 15 bp, Homo sapiens
tataaagattgtact

SEQ ID NO: 5442843 - DNA, 14 bp, Homo sapiens
tataaagcagatta

SEQ ID NO: 5442844 - DNA, 18 bp, Homo sapiens
tataaagcagattacctc

SEQ ID NO: 5442845 - DNA, 21 bp, Homo sapiens
tataaagcctgtattctcaaa

SEQ ID NO: 5442846 - DNA, 22 bp, Homo sapiens
tataaagcgatatacagatgaa

SEQ ID NO: 5442847 - DNA, 23 bp, Homo sapiens
tataaagcgatatacagatgaaa

SEQ ID NO: 5442848 - DNA, 17 bp, Homo sapiens
tataaagctgttattct

SEQ ID NO: 5442849 - DNA, 20 bp, Homo sapiens
tataaagctgttattcttgt

SEQ ID NO: 5442850 - DNA, 15 bp, Homo sapiens
tataaagctgttctt

SEQ ID NO: 5442851 - DNA, 21 bp, Homo sapiens
tataaagctgttcttgaaagc

SEQ ID NO: 5442852 - DNA, 14 bp, Homo sapiens
tataaaggaaacac

SEQ ID NO: 5442853 - DNA, 18 bp, Homo sapiens
tataaaggaccctgtttc

SEQ ID NO: 5442854 - DNA, 19 bp, Homo sapiens
tataaaggaccctgtttct

SEQ ID NO: 5442855 - DNA, 16 bp, Homo sapiens
tataatgggcattact

SEQ ID NO: 5442856 - DNA, 17 bp, Homo sapiens
tataatggttggaacta

SEQ ID NO: 5442857 - DNA, 15 bp, Homo sapiens
tataatggtttactg

SEQ ID NO: 5442858 - DNA, 18 bp, Homo sapiens
tataatggtttcaaagat

SEQ ID NO: 5442859 - DNA, 19 bp, Homo sapiens
tataatgtaagctctactg

SEQ ID NO: 5442860 - DNA, 21 bp, Homo sapiens
tataatgtaatgtttttattt

SEQ ID NO: 5442861 - DNA, 16 bp, Homo sapiens
tataatgtatgaattt

SEQ ID NO: 5442862 - DNA, 16 bp, Homo sapiens
tataatgtatttgaaa

SEQ ID NO: 5442863 - DNA, 21 bp, Homo sapiens
tataatgtatttgaaaattac

SEQ ID NO: 5442864 - DNA, 22 bp, Homo sapiens
tataatgtatttgaaaattaca

SEQ ID NO: 5442865 - DNA, 23 bp, Homo sapiens
tataatgtattttcagctcaatt

SEQ ID NO: 5442866 - DNA, 20 bp, Homo sapiens
tataatgtcagcttatccta

SEQ ID NO: 5442867 - DNA, 17 bp, Homo sapiens
tataatgtcattaaaca

SEQ ID NO: 5442868 - DNA, 19 bp, Homo sapiens
tataatgtggatttcctat

SEQ ID NO: 5442869 - DNA, 14 bp, Homo sapiens
tataatgtgtctgt

SEQ ID NO: 5442870 - DNA, 16 bp, Homo sapiens
tataatgtgtctgtgt

SEQ ID NO: 5442871 - DNA, 19 bp, Homo sapiens
tataatgtgtgtatgtgta

SEQ ID NO: 5442872 - DNA, 14 bp, Homo sapiens
tataatgttggtgt

SEQ ID NO: 5442873 - DNA, 17 bp, Homo sapiens
tataatgttgttattta

SEQ ID NO: 5442874 - DNA, 19 bp, Homo sapiens
tataatgtttaaatcatgt

SEQ ID NO: 5442875 - DNA, 15 bp, Homo sapiens
tataatgtttgctat

SEQ ID NO: 5442876 - DNA, 11 bp, Homo sapiens
tataattaaac

SEQ ID NO: 5442877 - DNA, 17 bp, Homo sapiens
tataattaaagatgcca

SEQ ID NO: 5442878 - DNA, 18 bp, Homo sapiens
tataattaaagatgccat

SEQ ID NO: 5442879 - DNA, 19 bp, Homo sapiens
tataattaaagatgccata

SEQ ID NO: 5442880 - DNA, 22 bp, Homo sapiens
tataattaacatgttaaaccat

SEQ ID NO: 5442881 - DNA, 21 bp, Homo sapiens
tataattaacttaactgaaga

SEQ ID NO: 5442882 - DNA, 15 bp, Homo sapiens
tataattacttaatg

SEQ ID NO: 5442883 - DNA, 18 bp, Homo sapiens
tataattagagttgtgat

SEQ ID NO: 5442884 - DNA, 24 bp, Homo sapiens
tataattagtcgggcatgagtctg

SEQ ID NO: 5442885 - DNA, 22 bp, Homo sapiens
tataattatttttatctgaagc

SEQ ID NO: 5442886 - DNA, 20 bp, Homo sapiens
tataattcacattgtattca

SEQ ID NO: 5442887 - DNA, 15 bp, Homo sapiens
tataattcaccttct

SEQ ID NO: 5442888 - DNA, 23 bp, Homo sapiens
tataattcactcaagcactgata

SEQ ID NO: 5442889 - DNA, 23 bp, Homo sapiens
tataattcagtatgttttacact

SEQ ID NO: 5442890 - DNA, 13 bp, Homo sapiens
tataattccctat

SEQ ID NO: 5442891 - DNA, 19 bp, Homo sapiens
tataattccttaaaatttt

SEQ ID NO: 5442892 - DNA, 17 bp, Homo sapiens
tataattctgaaatgtt

SEQ ID NO: 5442893 - DNA, 18 bp, Homo sapiens
tataattctgaaatgttt

SEQ ID NO: 5442894 - DNA, 13 bp, Homo sapiens
tataattctgtac

SEQ ID NO: 5442895 - DNA, 22 bp, Homo sapiens
tataattctgtacatagcctat

SEQ ID NO: 5442896 - DNA, 13 bp, Homo sapiens
tataattctttca

SEQ ID NO: 5442897 - DNA, 14 bp, Homo sapiens
tataattggaagtg

SEQ ID NO: 5442898 - DNA, 19 bp, Homo sapiens
tataattggatttcctaat

SEQ ID NO: 5442899 - DNA, 20 bp, Homo sapiens
tataattggatttcctaata

SEQ ID NO: 5442900 - DNA, 13 bp, Homo sapiens
tataattggctta

SEQ ID NO: 5442901 - DNA, 21 bp, Homo sapiens
tataattggtgctatttgaag

SEQ ID NO: 5442902 - DNA, 14 bp, Homo sapiens
tataattgtacaaa

SEQ ID NO: 5442903 - DNA, 16 bp, Homo sapiens
tataattgtacaaaat

SEQ ID NO: 5442904 - DNA, 23 bp, Homo sapiens
tataattgtacaaaattaagcaa

SEQ ID NO: 5442905 - DNA, 18 bp, Homo sapiens
tataattgtatcagaggc

SEQ ID NO: 5442906 - DNA, 14 bp, Homo sapiens
tataattgtatcgt

SEQ ID NO: 5442907 - DNA, 13 bp, Homo sapiens
tataattgtcatg

SEQ ID NO: 5442908 - DNA, 21 bp, Homo sapiens
tataattgtgtagcccctttt

SEQ ID NO: 5442909 - DNA, 12 bp, Homo sapiens
tataattgtgtg

SEQ ID NO: 5442910 - DNA, 23 bp, Homo sapiens
tataattgtgtgatatttcagaa

SEQ ID NO: 5442911 - DNA, 17 bp, Homo sapiens
tataattgttatacatt

SEQ ID NO: 5442912 - DNA, 19 bp, Homo sapiens
tataattgttgatattttc

SEQ ID NO: 5442913 - DNA, 15 bp, Homo sapiens
tataattgttgcata

SEQ ID NO: 5442914 - DNA, 13 bp, Homo sapiens
tataattgtttat

SEQ ID NO: 5442915 - DNA, 14 bp, Homo sapiens
tataattgtttata

SEQ ID NO: 5442916 - DNA, 14 bp, Homo sapiens
tataatttaaagaa

SEQ ID NO: 5442917 - DNA, 12 bp, Homo sapiens
tataatttaaat

SEQ ID NO: 5442918 - DNA, 14 bp, Homo sapiens
tataatttaaatga

SEQ ID NO: 5442919 - DNA, 15 bp, Homo sapiens
tataatttaacagaa

SEQ ID NO: 5442920 - DNA, 12 bp, Homo sapiens
tataatttaatg

SEQ ID NO: 5442921 - DNA, 22 bp, Homo sapiens
tataatttaatgtaaataaaac

SEQ ID NO: 5442922 - DNA, 17 bp, Homo sapiens
tataatttacctaagat

SEQ ID NO: 5442923 - DNA, 15 bp, Homo sapiens
tataatttataagca

SEQ ID NO: 5442924 - DNA, 15 bp, Homo sapiens
tataatttcaatttt

SEQ ID NO: 5442925 - DNA, 15 bp, Homo sapiens
tataatttccaaact

SEQ ID NO: 5442926 - DNA, 18 bp, Homo sapiens
tataatttccaaactgtt

SEQ ID NO: 5442927 - DNA, 15 bp, Homo sapiens
tataatttcctcact

SEQ ID NO: 5442928 - DNA, 21 bp, Homo sapiens
tataatttcgagatttgtagg

SEQ ID NO: 5442929 - DNA, 14 bp, Homo sapiens
tataatttgacttg

SEQ ID NO: 5442930 - DNA, 17 bp, Homo sapiens
tataattttaaaattgc

SEQ ID NO: 5442931 - DNA, 19 bp, Homo sapiens
tataattttaaaattgcag

SEQ ID NO: 5442932 - DNA, 16 bp, Homo sapiens
tataattttatctgta

SEQ ID NO: 5442933 - DNA, 17 bp, Homo sapiens
tataattttatgaatgt

SEQ ID NO: 5442934 - DNA, 22 bp, Homo sapiens
tataattttccagtataaaaca

SEQ ID NO: 5442935 - DNA, 15 bp, Homo sapiens
tataattttctaatt

SEQ ID NO: 5442936 - DNA, 16 bp, Homo sapiens
tataattttctgaaag

SEQ ID NO: 5442937 - DNA, 19 bp, Homo sapiens
tataattttctgaaagtta

SEQ ID NO: 5442938 - DNA, 13 bp, Homo sapiens
tataattttgcct

SEQ ID NO: 5442939 - DNA, 22 bp, Homo sapiens
tataatttttttatgttttgtt

SEQ ID NO: 5442940 - DNA, 15 bp, Homo sapiens
tataatttttttctt

SEQ ID NO: 5442941 - DNA, 15 bp, Homo sapiens
tatacaaaaaatttt

SEQ ID NO: 5442942 - DNA, 15 bp, Homo sapiens
tatacaaaactttat

SEQ ID NO: 5442943 - DNA, 15 bp, Homo sapiens
tatacaaaataattt

SEQ ID NO: 5442944 - DNA, 17 bp, Homo sapiens
tatacaaaataatttaa

SEQ ID NO: 5442945 - DNA, 18 bp, Homo sapiens
tatacaaaataatttaac

SEQ ID NO: 5442946 - DNA, 19 bp, Homo sapiens
tatacaaaataatttaact

SEQ ID NO: 5442947 - DNA, 23 bp, Homo sapiens
tatacaaaataatttaactaatt

SEQ ID NO: 5442948 - DNA, 21 bp, Homo sapiens
tatacaaacctttagctgtga

SEQ ID NO: 5442949 - DNA, 22 bp, Homo sapiens
tatacaaagctgtcactcacaa

SEQ ID NO: 5442950 - DNA, 14 bp, Homo sapiens
tatacaaatatatt

SEQ ID NO: 5442951 - DNA, 22 bp, Homo sapiens
tatacaaatatatttaattgtg

SEQ ID NO: 5442952 - DNA, 23 bp, Homo sapiens
tatacaaatttaacttttaaaga

SEQ ID NO: 5442953 - DNA, 23 bp, Homo sapiens
tatacaacaccaaaaaatatcta

SEQ ID NO: 5442954 - DNA, 21 bp, Homo sapiens
tatacaacagcaaaccctgat

SEQ ID NO: 5442955 - DNA, 15 bp, Homo sapiens
tatacaacagtgcta

SEQ ID NO: 5442956 - DNA, 21 bp, Homo sapiens
tatacaacctaacttatggac

SEQ ID NO: 5442957 - DNA, 18 bp, Homo sapiens
tatacaaccttcatttaa

SEQ ID NO: 5442958 - DNA, 20 bp, Homo sapiens
tatacaaccttcatttaaaa

SEQ ID NO: 5442959 - DNA, 21 bp, Homo sapiens
tatacaacgattgtatttgtg

SEQ ID NO: 5442960 - DNA, 22 bp, Homo sapiens
tatacaactttggaatttgaag

SEQ ID NO: 5442961 - DNA, 19 bp, Homo sapiens
tatacaagataagcttcca

SEQ ID NO: 5442962 - DNA, 20 bp, Homo sapiens
tatacaagataagcttccag

SEQ ID NO: 5442963 - DNA, 23 bp, Homo sapiens
tatacaaggtgagtgtgacttcc

SEQ ID NO: 5442964 - DNA, 18 bp, Homo sapiens
tatacaagtaaattctgt

SEQ ID NO: 5442965 - DNA, 19 bp, Homo sapiens
tatacaagtaatttcctga

SEQ ID NO: 5442966 - DNA, 13 bp, Homo sapiens
tatacaagtactg

SEQ ID NO: 5442967 - DNA, 14 bp, Homo sapiens
tatacaagtagatc

SEQ ID NO: 5442968 - DNA, 15 bp, Homo sapiens
tatacaagtgtttct

SEQ ID NO: 5442969 - DNA, 20 bp, Homo sapiens
tatacaataacccagttact

SEQ ID NO: 5442970 - DNA, 18 bp, Homo sapiens
tatacaataatgtaattt

SEQ ID NO: 5442971 - DNA, 18 bp, Homo sapiens
tatacaatatataaaaat

SEQ ID NO: 5442972 - DNA, 13 bp, Homo sapiens
tatacaattcagt

SEQ ID NO: 5442973 - DNA, 22 bp, Homo sapiens
tatacaatttccatatagtcta

SEQ ID NO: 5442974 - DNA, 20 bp, Homo sapiens
tatacacaacatttatttca

SEQ ID NO: 5442975 - DNA, 16 bp, Homo sapiens
tatacacaactttgca

SEQ ID NO: 5442976 - DNA, 19 bp, Homo sapiens
tatacacaagcaatgcaag

SEQ ID NO: 5442977 - DNA, 12 bp, Homo sapiens
tatacacacaca

SEQ ID NO: 5442978 - DNA, 14 bp, Homo sapiens
tatacacacacaca

SEQ ID NO: 5442979 - DNA, 12 bp, Homo sapiens
tatacacacata

SEQ ID NO: 5442980 - DNA, 16 bp, Homo sapiens
tatacacacatataca

SEQ ID NO: 5442981 - DNA, 21 bp, Homo sapiens
tatacacaccctgcccctgca

SEQ ID NO: 5442982 - DNA, 14 bp, Homo sapiens
tatacacattttgt

SEQ ID NO: 5442983 - DNA, 15 bp, Homo sapiens
tatacacattttgta

SEQ ID NO: 5442984 - DNA, 16 bp, Homo sapiens
tatacacattttgtaa

SEQ ID NO: 5442985 - DNA, 18 bp, Homo sapiens
tatacacattttgtaaat

SEQ ID NO: 5442986 - DNA, 22 bp, Homo sapiens
tatacaccattgttccttacct

SEQ ID NO: 5442987 - DNA, 21 bp, Homo sapiens
tatacacgggacagttgctgg

SEQ ID NO: 5442988 - DNA, 21 bp, Homo sapiens
tatacacttacactttatgca

SEQ ID NO: 5442989 - DNA, 13 bp, Homo sapiens
tatacagaaaaat

SEQ ID NO: 5442990 - DNA, 23 bp, Homo sapiens
tatacagaactgaattaagttat

SEQ ID NO: 5442991 - DNA, 11 bp, Homo sapiens
tatacagacct

SEQ ID NO: 5442992 - DNA, 12 bp, Homo sapiens
tatacagaccta

SEQ ID NO: 5442993 - DNA, 19 bp, Homo sapiens
tatacagacctaatatcat

SEQ ID NO: 5442994 - DNA, 15 bp, Homo sapiens
tatacagagcctgtt

SEQ ID NO: 5442995 - DNA, 17 bp, Homo sapiens
tatacagagcctgtttt

SEQ ID NO: 5442996 - DNA, 19 bp, Homo sapiens
tatacagagcctgttttaa

SEQ ID NO: 5442997 - DNA, 23 bp, Homo sapiens
tatacagagcctgttttaaaaaa

SEQ ID NO: 5442998 - DNA, 12 bp, Homo sapiens
tatacagatgaa

SEQ ID NO: 5442999 - DNA, 18 bp, Homo sapiens
tatacagattcctgttgt

SEQ ID NO: 5443000 - DNA, 14 bp, Homo sapiens
tatacagcatgaga

SEQ ID NO: 5443001 - DNA, 19 bp, Homo sapiens
tatacagcatgagattgta

SEQ ID NO: 5443002 - DNA, 20 bp, Homo sapiens
tatacagccataaaaaggaa

SEQ ID NO: 5443003 - DNA, 20 bp, Homo sapiens
tatacagctgtattgtctga

SEQ ID NO: 5443004 - DNA, 19 bp, Homo sapiens
tatacaggaggatgtgaat

SEQ ID NO: 5443005 - DNA, 19 bp, Homo sapiens
tatacaggggaatatttta

SEQ ID NO: 5443006 - DNA, 20 bp, Homo sapiens
tatacagtaactttatgtgt

SEQ ID NO: 5443007 - DNA, 16 bp, Homo sapiens
tatacagtacagtggt

SEQ ID NO: 5443008 - DNA, 22 bp, Homo sapiens
tatacagtagtgagaagaatat

SEQ ID NO: 5443009 - DNA, 22 bp, Homo sapiens
tatacagtatagatttttgggt

SEQ ID NO: 5443010 - DNA, 17 bp, Homo sapiens
tatacagtgcagagcct

SEQ ID NO: 5443011 - DNA, 14 bp, Homo sapiens
tatacagtgtacat

SEQ ID NO: 5443012 - DNA, 16 bp, Homo sapiens
tatacagtgtacatgt

SEQ ID NO: 5443013 - DNA, 20 bp, Homo sapiens
tatacagttataaaattaaa

SEQ ID NO: 5443014 - DNA, 22 bp, Homo sapiens
tatacagttataaaattaaaag

SEQ ID NO: 5443015 - DNA, 14 bp, Homo sapiens
tatacagttatttt

SEQ ID NO: 5443016 - DNA, 15 bp, Homo sapiens
tatacagttattttg

SEQ ID NO: 5443017 - DNA, 19 bp, Homo sapiens
tatacagttattttggata

SEQ ID NO: 5443018 - DNA, 20 bp, Homo sapiens
tatacagttcaataaactta

SEQ ID NO: 5443019 - DNA, 15 bp, Homo sapiens
tatacagttgcaagt

SEQ ID NO: 5443020 - DNA, 15 bp, Homo sapiens
tatacagtttgactt

SEQ ID NO: 5443021 - DNA, 16 bp, Homo sapiens
tatacagtttgacttt

SEQ ID NO: 5443022 - DNA, 22 bp, Homo sapiens
tatacagttttcctaaatgtat

SEQ ID NO: 5443023 - DNA, 12 bp, Homo sapiens
tatacataaaca

SEQ ID NO: 5443024 - DNA, 14 bp, Homo sapiens
tatacataaacagt

SEQ ID NO: 5443025 - DNA, 15 bp, Homo sapiens
tatacataaacagtt

SEQ ID NO: 5443026 - DNA, 20 bp, Homo sapiens
tatacataaacagttttgga

SEQ ID NO: 5443027 - DNA, 22 bp, Homo sapiens
tatacataacagggtaaattat

SEQ ID NO: 5443028 - DNA, 23 bp, Homo sapiens
tatacataacagggtaaattatt

SEQ ID NO: 5443029 - DNA, 14 bp, Homo sapiens
tatacataataaag

SEQ ID NO: 5443030 - DNA, 20 bp, Homo sapiens
tatacatacacttgtataaa

SEQ ID NO: 5443031 - DNA, 13 bp, Homo sapiens
tatacatacagag

SEQ ID NO: 5443032 - DNA, 20 bp, Homo sapiens
tataggtgctacaaaaacac

SEQ ID NO: 5443033 - DNA, 20 bp, Homo sapiens
tataggttgttcttaatttt

SEQ ID NO: 5443034 - DNA, 16 bp, Homo sapiens
tataggttttgtttgc

SEQ ID NO: 5443035 - DNA, 21 bp, Homo sapiens
tatagtaaatctatgagcaac

SEQ ID NO: 5443036 - DNA, 14 bp, Homo sapiens
tatagtaaatgtgt

SEQ ID NO: 5443037 - DNA, 20 bp, Homo sapiens
tatagtaatgtgacttggat

SEQ ID NO: 5443038 - DNA, 14 bp, Homo sapiens
tatagtacatgata

SEQ ID NO: 5443039 - DNA, 18 bp, Homo sapiens
tatagtaccagaagcaag

SEQ ID NO: 5443040 - DNA, 20 bp, Homo sapiens
tatagtacctttgctcttgc

SEQ ID NO: 5443041 - DNA, 19 bp, Homo sapiens
tatagtactgctttactgt

SEQ ID NO: 5443042 - DNA, 13 bp, Homo sapiens
tatagtactttat

SEQ ID NO: 5443043 - DNA, 22 bp, Homo sapiens
tatagtagatttttaacaaaaa

SEQ ID NO: 5443044 - DNA, 18 bp, Homo sapiens
tatagtagtcaattagta

SEQ ID NO: 5443045 - DNA, 13 bp, Homo sapiens
tatagtatatctg

SEQ ID NO: 5443046 - DNA, 18 bp, Homo sapiens
tatagtatatctggacaa

SEQ ID NO: 5443047 - DNA, 12 bp, Homo sapiens
tatagtatatta

SEQ ID NO: 5443048 - DNA, 17 bp, Homo sapiens
tatagtatatttatact

SEQ ID NO: 5443049 - DNA, 18 bp, Homo sapiens
tatagtatatttatactc

SEQ ID NO: 5443050 - DNA, 22 bp, Homo sapiens
tatagtatgatttttacaataa

SEQ ID NO: 5443051 - DNA, 15 bp, Homo sapiens
tatagtattaagtga

SEQ ID NO: 5443052 - DNA, 23 bp, Homo sapiens
tatagtattaagtgaaattttaa

SEQ ID NO: 5443053 - DNA, 22 bp, Homo sapiens
tatagtatttaattgtttcaaa

SEQ ID NO: 5443054 - DNA, 14 bp, Homo sapiens
tatagtatttgaaa

SEQ ID NO: 5443055 - DNA, 15 bp, Homo sapiens
tatagtatttgaaaa

SEQ ID NO: 5443056 - DNA, 18 bp, Homo sapiens
tatagtatttgaaaacag

SEQ ID NO: 5443057 - DNA, 22 bp, Homo sapiens
tatagtatttgaaaacagaaat

SEQ ID NO: 5443058 - DNA, 13 bp, Homo sapiens
tatagtcaaatcg

SEQ ID NO: 5443059 - DNA, 11 bp, Homo sapiens
tatagtcaata

SEQ ID NO: 5443060 - DNA, 22 bp, Homo sapiens
tatagtcaatggcttgttcatc

SEQ ID NO: 5443061 - DNA, 17 bp, Homo sapiens
tatagtcactcattctt

SEQ ID NO: 5443062 - DNA, 18 bp, Homo sapiens
tatagtcctagctgacgc

SEQ ID NO: 5443063 - DNA, 16 bp, Homo sapiens
tatagtctacagttgt

SEQ ID NO: 5443064 - DNA, 14 bp, Homo sapiens
tatagtctgtactt

SEQ ID NO: 5443065 - DNA, 14 bp, Homo sapiens
tatagtgaagaata

SEQ ID NO: 5443066 - DNA, 23 bp, Homo sapiens
tatagtgacagtataacctgtct

SEQ ID NO: 5443067 - DNA, 16 bp, Homo sapiens
tatagtgacatgcagt

SEQ ID NO: 5443068 - DNA, 18 bp, Homo sapiens
tatagtgcacaaaatgaa

SEQ ID NO: 5443069 - DNA, 19 bp, Homo sapiens
tatagtgcctaaaattgta

SEQ ID NO: 5443070 - DNA, 22 bp, Homo sapiens
tatagtggatgatatacacagt

SEQ ID NO: 5443071 - DNA, 21 bp, Homo sapiens
tatagtgtaaaataagaatga

SEQ ID NO: 5443072 - DNA, 13 bp, Homo sapiens
tatagtgtaataa

SEQ ID NO: 5443073 - DNA, 22 bp, Homo sapiens
tatagtgtataccacctgtaca

SEQ ID NO: 5443074 - DNA, 14 bp, Homo sapiens
tatagtgtatagaa

SEQ ID NO: 5443075 - DNA, 22 bp, Homo sapiens
tatagtgtgtgttgcaaatcac

SEQ ID NO: 5443076 - DNA, 17 bp, Homo sapiens
tatagtgttcacaaact

SEQ ID NO: 5443077 - DNA, 18 bp, Homo sapiens
tatagtgttcacaaactg

SEQ ID NO: 5443078 - DNA, 16 bp, Homo sapiens
tatagtgtttaactgg

SEQ ID NO: 5443079 - DNA, 17 bp, Homo sapiens
tatagttaaactgagag

SEQ ID NO: 5443080 - DNA, 21 bp, Homo sapiens
tatagttaaactgagagtaat

SEQ ID NO: 5443081 - DNA, 16 bp, Homo sapiens
tatagttaacacacta

SEQ ID NO: 5443082 - DNA, 16 bp, Homo sapiens
tatagttaatattttg

SEQ ID NO: 5443083 - DNA, 22 bp, Homo sapiens
tatagttaattgtggctttatg

SEQ ID NO: 5443084 - DNA, 13 bp, Homo sapiens
tatagttactgtg

SEQ ID NO: 5443085 - DNA, 20 bp, Homo sapiens
tatagttactgtgtaattag

SEQ ID NO: 5443086 - DNA, 13 bp, Homo sapiens
tatagttagcttt

SEQ ID NO: 5443087 - DNA, 18 bp, Homo sapiens
tatagttaggatagcatt

SEQ ID NO: 5443088 - DNA, 22 bp, Homo sapiens
tatagttatacatcttcattaa

SEQ ID NO: 5443089 - DNA, 11 bp, Homo sapiens
tatagttatat

SEQ ID NO: 5443090 - DNA, 17 bp, Homo sapiens
tatagttatgcatacat

SEQ ID NO: 5443091 - DNA, 16 bp, Homo sapiens
tatagttatgtaaata

SEQ ID NO: 5443092 - DNA, 22 bp, Homo sapiens
tatagttattaagttctttaaa

SEQ ID NO: 5443093 - DNA, 17 bp, Homo sapiens
tatagttcctaagaagc

SEQ ID NO: 5443094 - DNA, 22 bp, Homo sapiens
tatagttcctaagaagcttcta

SEQ ID NO: 5443095 - DNA, 15 bp, Homo sapiens
tatagttctagacat

SEQ ID NO: 5443096 - DNA, 12 bp, Homo sapiens
tatagttctgtg

SEQ ID NO: 5443097 - DNA, 13 bp, Homo sapiens
tatagttctgtgt

SEQ ID NO: 5443098 - DNA, 15 bp, Homo sapiens
tatagttgcagccca

SEQ ID NO: 5443099 - DNA, 16 bp, Homo sapiens
tatagttgcagcccaa

SEQ ID NO: 5443100 - DNA, 23 bp, Homo sapiens
tatagtttaaaaatctgccacct

SEQ ID NO: 5443101 - DNA, 18 bp, Homo sapiens
tatagtttcaccactcct

SEQ ID NO: 5443102 - DNA, 22 bp, Homo sapiens
tatagtttcagatatatatcat

SEQ ID NO: 5443103 - DNA, 15 bp, Homo sapiens
tatagtttgtacatg

SEQ ID NO: 5443104 - DNA, 18 bp, Homo sapiens
tatagtttgtacatgcat

SEQ ID NO: 5443105 - DNA, 13 bp, Homo sapiens
tatagttttacac

SEQ ID NO: 5443106 - DNA, 15 bp, Homo sapiens
tatagttttactttt

SEQ ID NO: 5443107 - DNA, 16 bp, Homo sapiens
tatagttttactttta

SEQ ID NO: 5443108 - DNA, 12 bp, Homo sapiens
tatagtttttct

SEQ ID NO: 5443109 - DNA, 23 bp, Homo sapiens
tatataaaaaatatatgtaatat

SEQ ID NO: 5443110 - DNA, 19 bp, Homo sapiens
tatataaaaagaaaagata

SEQ ID NO: 5443111 - DNA, 23 bp, Homo sapiens
tatataaaaagaaaagataaaga

SEQ ID NO: 5443112 - DNA, 21 bp, Homo sapiens
tatataaaaatatatgttgaa

SEQ ID NO: 5443113 - DNA, 12 bp, Homo sapiens
tatataaaaatg

SEQ ID NO: 5443114 - DNA, 19 bp, Homo sapiens
tatataaaacggtgctgtg

SEQ ID NO: 5443115 - DNA, 16 bp, Homo sapiens
tatataaaagaaatat

SEQ ID NO: 5443116 - DNA, 22 bp, Homo sapiens
tatataaaagtttaaagaagag

SEQ ID NO: 5443117 - DNA, 10 bp, Homo sapiens
tatataaaat

SEQ ID NO: 5443118 - DNA, 11 bp, Homo sapiens
tatataaaata

SEQ ID NO: 5443119 - DNA, 12 bp, Homo sapiens
tatataaaataa

SEQ ID NO: 5443120 - DNA, 17 bp, Homo sapiens
tatataaaataaatata

SEQ ID NO: 5443121 - DNA, 19 bp, Homo sapiens
tatataaaataaatatact

SEQ ID NO: 5443122 - DNA, 20 bp, Homo sapiens
tatataaaataaatatacta

SEQ ID NO: 5443123 - DNA, 15 bp, Homo sapiens
tatataaaatacacg

SEQ ID NO: 5443124 - DNA, 20 bp, Homo sapiens
tatataaaatacacgtgtat

SEQ ID NO: 5443125 - DNA, 23 bp, Homo sapiens
tatataaaatacacgtgtatatg

SEQ ID NO: 5443126 - DNA, 15 bp, Homo sapiens
tatataaaatacata

SEQ ID NO: 5443127 - DNA, 21 bp, Homo sapiens
tatataaaatattttcataca

SEQ ID NO: 5443128 - DNA, 12 bp, Homo sapiens
tatataaacaaa

SEQ ID NO: 5443129 - DNA, 13 bp, Homo sapiens
tatataaacaaac

SEQ ID NO: 5443130 - DNA, 14 bp, Homo sapiens
tatataaacaataa

SEQ ID NO: 5443131 - DNA, 12 bp, Homo sapiens
tatataaacact

SEQ ID NO: 5443132 - DNA, 21 bp, Homo sapiens
tatataaacactccacagtgt

SEQ ID NO: 5443133 - DNA, 22 bp, Homo sapiens
tatataaacactccacagtgtt

SEQ ID NO: 5443134 - DNA, 14 bp, Homo sapiens
tatataaacctaaa

SEQ ID NO: 5443135 - DNA, 17 bp, Homo sapiens
tatataaacctaaaaaa

SEQ ID NO: 5443136 - DNA, 19 bp, Homo sapiens
tatataaacgatatatgta

SEQ ID NO: 5443137 - DNA, 16 bp, Homo sapiens
tatataaactgggatg

SEQ ID NO: 5443138 - DNA, 21 bp, Homo sapiens
tatataaagaaaatcaatgaa

SEQ ID NO: 5443139 - DNA, 23 bp, Homo sapiens
tatataaagaaaatgatacagca

SEQ ID NO: 5443140 - DNA, 12 bp, Homo sapiens
tatataaagaga

SEQ ID NO: 5443141 - DNA, 15 bp, Homo sapiens
tatataaagagaaaa

SEQ ID NO: 5443142 - DNA, 16 bp, Homo sapiens
tatataaagatatata

SEQ ID NO: 5443143 - DNA, 23 bp, Homo sapiens
tatataaaggaaaaaagagaagt

SEQ ID NO: 5443144 - DNA, 21 bp, Homo sapiens
tatataaagtactactgtaga

SEQ ID NO: 5443145 - DNA, 13 bp, Homo sapiens
tatataaagtcag

SEQ ID NO: 5443146 - DNA, 23 bp, Homo sapiens
tatataaagtttttttatttctt

SEQ ID NO: 5443147 - DNA, 16 bp, Homo sapiens
tatataaataaagcaa

SEQ ID NO: 5443148 - DNA, 19 bp, Homo sapiens
tatataaataaagcaaata

SEQ ID NO: 5443149 - DNA, 18 bp, Homo sapiens
tatataaataaatatata

SEQ ID NO: 5443150 - DNA, 11 bp, Homo sapiens
tatataaatat

SEQ ID NO: 5443151 - DNA, 19 bp, Homo sapiens
tatataaatatattattac

SEQ ID NO: 5443152 - DNA, 19 bp, Homo sapiens
tatataaatatctatttat

SEQ ID NO: 5443153 - DNA, 15 bp, Homo sapiens
tatataaatgacatt

SEQ ID NO: 5443154 - DNA, 18 bp, Homo sapiens
tatataaatgacattatt

SEQ ID NO: 5443155 - DNA, 12 bp, Homo sapiens
tatataaatggt

SEQ ID NO: 5443156 - DNA, 13 bp, Homo sapiens
tatataaatggtg

SEQ ID NO: 5443157 - DNA, 18 bp, Homo sapiens
tatataaatggttaaaag

SEQ ID NO: 5443158 - DNA, 14 bp, Homo sapiens
tatataaattatta

SEQ ID NO: 5443159 - DNA, 22 bp, Homo sapiens
tatataaattattactttaaat

SEQ ID NO: 5443160 - DNA, 23 bp, Homo sapiens
tatataaattttttttgtttcat

SEQ ID NO: 5443161 - DNA, 12 bp, Homo sapiens
tatataacaaaa

SEQ ID NO: 5443162 - DNA, 19 bp, Homo sapiens
tatataacaatgctgtatt

SEQ ID NO: 5443163 - DNA, 13 bp, Homo sapiens
tatataacagata

SEQ ID NO: 5443164 - DNA, 17 bp, Homo sapiens
tatataacagatacatt

SEQ ID NO: 5443165 - DNA, 18 bp, Homo sapiens
tatataacagatacattt

SEQ ID NO: 5443166 - DNA, 14 bp, Homo sapiens
tatataacatatat

SEQ ID NO: 5443167 - DNA, 17 bp, Homo sapiens
tatataacatatatgga

SEQ ID NO: 5443168 - DNA, 13 bp, Homo sapiens
tatataactgttg

SEQ ID NO: 5443169 - DNA, 13 bp, Homo sapiens
tatataacttatt

SEQ ID NO: 5443170 - DNA, 12 bp, Homo sapiens
tatataactttt

SEQ ID NO: 5443171 - DNA, 13 bp, Homo sapiens
tatataagaaaga

SEQ ID NO: 5443172 - DNA, 15 bp, Homo sapiens
tatataagaaagaca

SEQ ID NO: 5443173 - DNA, 14 bp, Homo sapiens
tatataagacaaga

SEQ ID NO: 5443174 - DNA, 16 bp, Homo sapiens
tatataagacattaag

SEQ ID NO: 5443175 - DNA, 14 bp, Homo sapiens
tatataagactatt

SEQ ID NO: 5443176 - DNA, 20 bp, Homo sapiens
tatataagagcatgaaattt

SEQ ID NO: 5443177 - DNA, 23 bp, Homo sapiens
tatataagagcatgaaattttta

SEQ ID NO: 5443178 - DNA, 22 bp, Homo sapiens
tatataagatggaagcttccag

SEQ ID NO: 5443179 - DNA, 21 bp, Homo sapiens
tatataagcccttaataataa

SEQ ID NO: 5443180 - DNA, 17 bp, Homo sapiens
tatataagctgtttagt

SEQ ID NO: 5443181 - DNA, 16 bp, Homo sapiens
tatataaggtaatgta

SEQ ID NO: 5443182 - DNA, 19 bp, Homo sapiens
tatataagtgtacatatgt

SEQ ID NO: 5443183 - DNA, 20 bp, Homo sapiens
tatataataaatgggaaatg

SEQ ID NO: 5443184 - DNA, 21 bp, Homo sapiens
tatataataactttattgcat

SEQ ID NO: 5443185 - DNA, 20 bp, Homo sapiens
tatataatacttaaaaatat

SEQ ID NO: 5443186 - DNA, 21 bp, Homo sapiens
tatataatacttaaaaatatg

SEQ ID NO: 5443187 - DNA, 17 bp, Homo sapiens
tatataatcatgctcat

SEQ ID NO: 5443188 - DNA, 13 bp, Homo sapiens
tatataatgcaac

SEQ ID NO: 5443189 - DNA, 14 bp, Homo sapiens
tatataatggttta

SEQ ID NO: 5443190 - DNA, 20 bp, Homo sapiens
tatataatggtttactgctg

SEQ ID NO: 5443191 - DNA, 21 bp, Homo sapiens
tatataatggtttactgctgt

SEQ ID NO: 5443192 - DNA, 15 bp, Homo sapiens
tatataatggtttca

SEQ ID NO: 5443193 - DNA, 14 bp, Homo sapiens
tatataattatgtt

SEQ ID NO: 5443194 - DNA, 16 bp, Homo sapiens
tatataattctgaaat

SEQ ID NO: 5443195 - DNA, 17 bp, Homo sapiens
tatataattctgtacat

SEQ ID NO: 5443196 - DNA, 13 bp, Homo sapiens
tatataattgcca

SEQ ID NO: 5443197 - DNA, 14 bp, Homo sapiens
tatataattgccaa

SEQ ID NO: 5443198 - DNA, 18 bp, Homo sapiens
tatataatttactttgta

SEQ ID NO: 5443199 - DNA, 15 bp, Homo sapiens
tatataatttcctca

SEQ ID NO: 5443200 - DNA, 19 bp, Homo sapiens
tatataatttcctcactgc

SEQ ID NO: 5443201 - DNA, 22 bp, Homo sapiens
tatataatttgagtgtatatat

SEQ ID NO: 5443202 - DNA, 13 bp, Homo sapiens
tatataattttat

SEQ ID NO: 5443203 - DNA, 14 bp, Homo sapiens
tatataattttatg

SEQ ID NO: 5443204 - DNA, 18 bp, Homo sapiens
tatataattttattgctg

SEQ ID NO: 5443205 - DNA, 22 bp, Homo sapiens
tatataatttttttatgttttg

SEQ ID NO: 5443206 - DNA, 18 bp, Homo sapiens
tatatacaaaaagaaaat

SEQ ID NO: 5443207 - DNA, 22 bp, Homo sapiens
tatatacaaacctttagctgtg

SEQ ID NO: 5443208 - DNA, 18 bp, Homo sapiens
tatatacaaagccttggt

SEQ ID NO: 5443209 - DNA, 18 bp, Homo sapiens
tatatacaaagctgtcac

SEQ ID NO: 5443210 - DNA, 12 bp, Homo sapiens
tatatgttgtaa

SEQ ID NO: 5443211 - DNA, 14 bp, Homo sapiens
tatatgttgtaata

SEQ ID NO: 5443212 - DNA, 20 bp, Homo sapiens
tatatgtttaccttttaatt

SEQ ID NO: 5443213 - DNA, 20 bp, Homo sapiens
tatatgtttatacacacagg

SEQ ID NO: 5443214 - DNA, 16 bp, Homo sapiens
tatatgtttgtggaat

SEQ ID NO: 5443215 - DNA, 22 bp, Homo sapiens
tatatgttttataattcataac

SEQ ID NO: 5443216 - DNA, 13 bp, Homo sapiens
tatatgttttgag

SEQ ID NO: 5443217 - DNA, 18 bp, Homo sapiens
tatatgttttgtctcgct

SEQ ID NO: 5443218 - DNA, 15 bp, Homo sapiens
tatattaaaaatata

SEQ ID NO: 5443219 - DNA, 19 bp, Homo sapiens
tatattaaaaatataaaac

SEQ ID NO: 5443220 - DNA, 20 bp, Homo sapiens
tatattaaaaatataaaact

SEQ ID NO: 5443221 - DNA, 19 bp, Homo sapiens
tatattaaaaatataaaca

SEQ ID NO: 5443222 - DNA, 13 bp, Homo sapiens
tatattaaaaatg

SEQ ID NO: 5443223 - DNA, 12 bp, Homo sapiens
tatattaaaaca

SEQ ID NO: 5443224 - DNA, 13 bp, Homo sapiens
tatattaaaacaa

SEQ ID NO: 5443225 - DNA, 16 bp, Homo sapiens
tatattaaaagcaggc

SEQ ID NO: 5443226 - DNA, 18 bp, Homo sapiens
tatattaaaatagcatac

SEQ ID NO: 5443227 - DNA, 23 bp, Homo sapiens
tatattaaaatagcatactgtgt

SEQ ID NO: 5443228 - DNA, 13 bp, Homo sapiens
tatattaaaattc

SEQ ID NO: 5443229 - DNA, 22 bp, Homo sapiens
tatattaaaattccaaattcat

SEQ ID NO: 5443230 - DNA, 13 bp, Homo sapiens
tatattaaacaaa

SEQ ID NO: 5443231 - DNA, 21 bp, Homo sapiens
tatattaaaccttcagattaa

SEQ ID NO: 5443232 - DNA, 12 bp, Homo sapiens
tatattaaagaa

SEQ ID NO: 5443233 - DNA, 20 bp, Homo sapiens
tatattaaaggtatacaaat

SEQ ID NO: 5443234 - DNA, 15 bp, Homo sapiens
tatattaaataacat

SEQ ID NO: 5443235 - DNA, 18 bp, Homo sapiens
tatattaaataacatgtt

SEQ ID NO: 5443236 - DNA, 13 bp, Homo sapiens
tatattaaatgag

SEQ ID NO: 5443237 - DNA, 14 bp, Homo sapiens
tatattaacatcat

SEQ ID NO: 5443238 - DNA, 15 bp, Homo sapiens
tatattaaggcagta

SEQ ID NO: 5443239 - DNA, 20 bp, Homo sapiens
tatattaagtgtgccaaatc

SEQ ID NO: 5443240 - DNA, 13 bp, Homo sapiens
tatattaatagta

SEQ ID NO: 5443241 - DNA, 23 bp, Homo sapiens
tatattaatagtaatttgtaaag

SEQ ID NO: 5443242 - DNA, 21 bp, Homo sapiens
tatattaatttcggttatagc

SEQ ID NO: 5443243 - DNA, 11 bp, Homo sapiens
tatattacaag

SEQ ID NO: 5443244 - DNA, 20 bp, Homo sapiens
tatattacacatttgtacag

SEQ ID NO: 5443245 - DNA, 17 bp, Homo sapiens
tatattacccaatggaa

SEQ ID NO: 5443246 - DNA, 18 bp, Homo sapiens
tatattactactcctttg

SEQ ID NO: 5443247 - DNA, 18 bp, Homo sapiens
tatattactgatttagaa

SEQ ID NO: 5443248 - DNA, 22 bp, Homo sapiens
tatattagatcaaatagttgca

SEQ ID NO: 5443249 - DNA, 23 bp, Homo sapiens
tatattagcatttagtccaatgt

SEQ ID NO: 5443250 - DNA, 17 bp, Homo sapiens
tatattagctaattaga

SEQ ID NO: 5443251 - DNA, 17 bp, Homo sapiens
tatattagctgaaacaa

SEQ ID NO: 5443252 - DNA, 23 bp, Homo sapiens
tatattaggatctgcaaacaatg

SEQ ID NO: 5443253 - DNA, 20 bp, Homo sapiens
tatattaggcatgttcaggg

SEQ ID NO: 5443254 - DNA, 16 bp, Homo sapiens
tatattagtatgtatg

SEQ ID NO: 5443255 - DNA, 15 bp, Homo sapiens
tatattagtgaagat

SEQ ID NO: 5443256 - DNA, 16 bp, Homo sapiens
tatattagtgaagatg

SEQ ID NO: 5443257 - DNA, 18 bp, Homo sapiens
tatattagttgctttgtt

SEQ ID NO: 5443258 - DNA, 20 bp, Homo sapiens
tatattatacttgtaattat

SEQ ID NO: 5443259 - DNA, 18 bp, Homo sapiens
tatattatataactcttt

SEQ ID NO: 5443260 - DNA, 12 bp, Homo sapiens
tatattatatat

SEQ ID NO: 5443261 - DNA, 14 bp, Homo sapiens
tatattatatatac

SEQ ID NO: 5443262 - DNA, 16 bp, Homo sapiens
tatattatatatacat

SEQ ID NO: 5443263 - DNA, 17 bp, Homo sapiens
tatattatatatatcta

SEQ ID NO: 5443264 - DNA, 13 bp, Homo sapiens
tatattatatgga

SEQ ID NO: 5443265 - DNA, 19 bp, Homo sapiens
tatattatatggaaatata

SEQ ID NO: 5443266 - DNA, 14 bp, Homo sapiens
tatattatcatgca

SEQ ID NO: 5443267 - DNA, 13 bp, Homo sapiens
tatattatctttt

SEQ ID NO: 5443268 - DNA, 15 bp, Homo sapiens
tatattatgaataaa

SEQ ID NO: 5443269 - DNA, 22 bp, Homo sapiens
tatattatggtgtaatgcacaa

SEQ ID NO: 5443270 - DNA, 13 bp, Homo sapiens
tatattatgtgaa

SEQ ID NO: 5443271 - DNA, 15 bp, Homo sapiens
tatattatgtgaaga

SEQ ID NO: 5443272 - DNA, 13 bp, Homo sapiens
tatattatgttta

SEQ ID NO: 5443273 - DNA, 14 bp, Homo sapiens
tatattattctcat

SEQ ID NO: 5443274 - DNA, 18 bp, Homo sapiens
tatattattctcatttag

SEQ ID NO: 5443275 - DNA, 17 bp, Homo sapiens
tatattattgtaagttg

SEQ ID NO: 5443276 - DNA, 18 bp, Homo sapiens
tatattattgtaagttgt

SEQ ID NO: 5443277 - DNA, 14 bp, Homo sapiens
tatattatttacat

SEQ ID NO: 5443278 - DNA, 14 bp, Homo sapiens
tatattcaaccatg

SEQ ID NO: 5443279 - DNA, 16 bp, Homo sapiens
tatattcaatgcattt

SEQ ID NO: 5443280 - DNA, 12 bp, Homo sapiens
tatattcacaga

SEQ ID NO: 5443281 - DNA, 16 bp, Homo sapiens
tatattcaccaatgtt

SEQ ID NO: 5443282 - DNA, 22 bp, Homo sapiens
tatattcataaagttacagttt

SEQ ID NO: 5443283 - DNA, 16 bp, Homo sapiens
tatattcatacctgtt

SEQ ID NO: 5443284 - DNA, 14 bp, Homo sapiens
tatattcatatatt

SEQ ID NO: 5443285 - DNA, 14 bp, Homo sapiens
tatattcatcaaat

SEQ ID NO: 5443286 - DNA, 23 bp, Homo sapiens
tatattcatcaaataaaccttgt

SEQ ID NO: 5443287 - DNA, 16 bp, Homo sapiens
tatattcatgtaataa

SEQ ID NO: 5443288 - DNA, 20 bp, Homo sapiens
tatattcatgtaataaatct

SEQ ID NO: 5443289 - DNA, 22 bp, Homo sapiens
tatattcattcagatataagat

SEQ ID NO: 5443290 - DNA, 13 bp, Homo sapiens
tatattcattctt

SEQ ID NO: 5443291 - DNA, 21 bp, Homo sapiens
tatattccaggtttaagtaga

SEQ ID NO: 5443292 - DNA, 15 bp, Homo sapiens
tatattccatgtata

SEQ ID NO: 5443293 - DNA, 15 bp, Homo sapiens
tatattcctaaacta

SEQ ID NO: 5443294 - DNA, 17 bp, Homo sapiens
tatattccttactagaa

SEQ ID NO: 5443295 - DNA, 20 bp, Homo sapiens
tatattccttttaaagaagc

SEQ ID NO: 5443296 - DNA, 13 bp, Homo sapiens
tatattctaaaga

SEQ ID NO: 5443297 - DNA, 16 bp, Homo sapiens
tatattctaatagttt

SEQ ID NO: 5443298 - DNA, 13 bp, Homo sapiens
tatattctctttg

SEQ ID NO: 5443299 - DNA, 15 bp, Homo sapiens
tatattctggaaaaa

SEQ ID NO: 5443300 - DNA, 18 bp, Homo sapiens
tatattcttatgttatca

SEQ ID NO: 5443301 - DNA, 11 bp, Homo sapiens
tatattctttc

SEQ ID NO: 5443302 - DNA, 12 bp, Homo sapiens
tatattctttca

SEQ ID NO: 5443303 - DNA, 13 bp, Homo sapiens
tatattgaaaaga

SEQ ID NO: 5443304 - DNA, 23 bp, Homo sapiens
tatattgaaaagaaaaagaagag

SEQ ID NO: 5443305 - DNA, 17 bp, Homo sapiens
tatattgaaagttgctt

SEQ ID NO: 5443306 - DNA, 17 bp, Homo sapiens
tatattgaagacaattt

SEQ ID NO: 5443307 - DNA, 18 bp, Homo sapiens
tatattgaagacaatttg

SEQ ID NO: 5443308 - DNA, 13 bp, Homo sapiens
tatattgaagtaa

SEQ ID NO: 5443309 - DNA, 22 bp, Homo sapiens
tatattgagaatcccttaaaat

SEQ ID NO: 5443310 - DNA, 19 bp, Homo sapiens
tatattgagacaaaaatta

SEQ ID NO: 5443311 - DNA, 13 bp, Homo sapiens
tatattgataaat

SEQ ID NO: 5443312 - DNA, 12 bp, Homo sapiens
tatattgataac

SEQ ID NO: 5443313 - DNA, 16 bp, Homo sapiens
tatattgatccagaaa

SEQ ID NO: 5443314 - DNA, 17 bp, Homo sapiens
tatattgattatttgtt

SEQ ID NO: 5443315 - DNA, 14 bp, Homo sapiens
tatattgcaatgaa

SEQ ID NO: 5443316 - DNA, 14 bp, Homo sapiens
tatattgccaaata

SEQ ID NO: 5443317 - DNA, 22 bp, Homo sapiens
tatattgcttcctgtgtaacat

SEQ ID NO: 5443318 - DNA, 19 bp, Homo sapiens
tatattgggtgtagatttc

SEQ ID NO: 5443319 - DNA, 17 bp, Homo sapiens
tatattggtaacatcct

SEQ ID NO: 5443320 - DNA, 21 bp, Homo sapiens
tatattggtaacatcctttct

SEQ ID NO: 5443321 - DNA, 22 bp, Homo sapiens
tatattggtgtatattatataa

SEQ ID NO: 5443322 - DNA, 18 bp, Homo sapiens
tatattggtttgcacaag

SEQ ID NO: 5443323 - DNA, 21 bp, Homo sapiens
tatattggtttgcacaagttc

SEQ ID NO: 5443324 - DNA, 15 bp, Homo sapiens
tatattggttttatg

SEQ ID NO: 5443325 - DNA, 20 bp, Homo sapiens
tatattgtaagaaatactgt

SEQ ID NO: 5443326 - DNA, 15 bp, Homo sapiens
tatattgtacaaatg

SEQ ID NO: 5443327 - DNA, 17 bp, Homo sapiens
tatattgtacaaatgta

SEQ ID NO: 5443328 - DNA, 15 bp, Homo sapiens
tatattgtatattct

SEQ ID NO: 5443329 - DNA, 18 bp, Homo sapiens
tatattgtatattctgga

SEQ ID NO: 5443330 - DNA, 15 bp, Homo sapiens
tatattgtccaggct

SEQ ID NO: 5443331 - DNA, 22 bp, Homo sapiens
tatattgtcctcccctatttta

SEQ ID NO: 5443332 - DNA, 15 bp, Homo sapiens
tatattgtctgtaaa

SEQ ID NO: 5443333 - DNA, 12 bp, Homo sapiens
tatattgtgaac

SEQ ID NO: 5443334 - DNA, 19 bp, Homo sapiens
tatattgtgttttaacacc

SEQ ID NO: 5443335 - DNA, 18 bp, Homo sapiens
tatattgttagtggactt

SEQ ID NO: 5443336 - DNA, 17 bp, Homo sapiens
tatattgttcacttctt

SEQ ID NO: 5443337 - DNA, 19 bp, Homo sapiens
tatattgttcagcatgcaa

SEQ ID NO: 5443338 - DNA, 18 bp, Homo sapiens
tatattgttttataaatg

SEQ ID NO: 5443339 - DNA, 13 bp, Homo sapiens
tatattgttttcc

SEQ ID NO: 5443340 - DNA, 18 bp, Homo sapiens
tatattgttttgtctcct

SEQ ID NO: 5443341 - DNA, 22 bp, Homo sapiens
tatattgtttttatatattata

SEQ ID NO: 5443342 - DNA, 14 bp, Homo sapiens
tatatttaaaaaca

SEQ ID NO: 5443343 - DNA, 14 bp, Homo sapiens
tatatttaaaaata

SEQ ID NO: 5443344 - DNA, 16 bp, Homo sapiens
tatatttaaaaattgt

SEQ ID NO: 5443345 - DNA, 21 bp, Homo sapiens
tatatttaaaaattgtttctt

SEQ ID NO: 5443346 - DNA, 22 bp, Homo sapiens
tatatttaaaaattgtttcttg

SEQ ID NO: 5443347 - DNA, 14 bp, Homo sapiens
tatatttaaaagaa

SEQ ID NO: 5443348 - DNA, 21 bp, Homo sapiens
tatatttaaaggggagatact

SEQ ID NO: 5443349 - DNA, 15 bp, Homo sapiens
tatatttaaatgcaa

SEQ ID NO: 5443350 - DNA, 15 bp, Homo sapiens
tatatttaacaagat

SEQ ID NO: 5443351 - DNA, 16 bp, Homo sapiens
tatatttaacaatgac

SEQ ID NO: 5443352 - DNA, 13 bp, Homo sapiens
tatatttaacatg

SEQ ID NO: 5443353 - DNA, 14 bp, Homo sapiens
tatatttaacttct

SEQ ID NO: 5443354 - DNA, 15 bp, Homo sapiens
tatatttaacttcta

SEQ ID NO: 5443355 - DNA, 21 bp, Homo sapiens
tatatttaatacctttggaaa

SEQ ID NO: 5443356 - DNA, 13 bp, Homo sapiens
tatatttaatata

SEQ ID NO: 5443357 - DNA, 16 bp, Homo sapiens
tatatttaatgcatta

SEQ ID NO: 5443358 - DNA, 21 bp, Homo sapiens
tatatttaattgtgtcatatt

SEQ ID NO: 5443359 - DNA, 17 bp, Homo sapiens
tatatttacaaataaaa

SEQ ID NO: 5443360 - DNA, 14 bp, Homo sapiens
tatatttacaaatg

SEQ ID NO: 5443361 - DNA, 15 bp, Homo sapiens
tatatttacaaatgg

SEQ ID NO: 5443362 - DNA, 16 bp, Homo sapiens
tatatttacaataaat

SEQ ID NO: 5443363 - DNA, 23 bp, Homo sapiens
tatatttacaataaatgaagatt

SEQ ID NO: 5443364 - DNA, 17 bp, Homo sapiens
tatatttactaaaagaa

SEQ ID NO: 5443365 - DNA, 13 bp, Homo sapiens
tatatttactgtt

SEQ ID NO: 5443366 - DNA, 17 bp, Homo sapiens
tatatttaggaaattca

SEQ ID NO: 5443367 - DNA, 16 bp, Homo sapiens
tatatttagtatcttt

SEQ ID NO: 5443368 - DNA, 14 bp, Homo sapiens
tatatttagtgctg

SEQ ID NO: 5443369 - DNA, 16 bp, Homo sapiens
tatatttagttacgta

SEQ ID NO: 5443370 - DNA, 18 bp, Homo sapiens
tatatttagttatagttt

SEQ ID NO: 5443371 - DNA, 16 bp, Homo sapiens
tatatttatatacttt

SEQ ID NO: 5443372 - DNA, 20 bp, Homo sapiens
tatatttatcatatttaata

SEQ ID NO: 5443373 - DNA, 23 bp, Homo sapiens
tatatttcaaacattttgtatca

SEQ ID NO: 5443374 - DNA, 12 bp, Homo sapiens
tatatttcaagt

SEQ ID NO: 5443375 - DNA, 23 bp, Homo sapiens
tatatttcacactggagtgaatg

SEQ ID NO: 5443376 - DNA, 20 bp, Homo sapiens
tatatttcacttttgttctg

SEQ ID NO: 5443377 - DNA, 19 bp, Homo sapiens
tatatttcagatgtaatgt

SEQ ID NO: 5443378 - DNA, 13 bp, Homo sapiens
tatatttcatatt

SEQ ID NO: 5443379 - DNA, 15 bp, Homo sapiens
tatatttcatattga

SEQ ID NO: 5443380 - DNA, 21 bp, Homo sapiens
tatatttccctgaaggaacca

SEQ ID NO: 5443381 - DNA, 16 bp, Homo sapiens
tatatttcctcttctg

SEQ ID NO: 5443382 - DNA, 20 bp, Homo sapiens
tatatttcctgtattgcttt

SEQ ID NO: 5443383 - DNA, 14 bp, Homo sapiens
tatatttcctttat

SEQ ID NO: 5443384 - DNA, 18 bp, Homo sapiens
tatatttcctttatgtga

SEQ ID NO: 5443385 - DNA, 19 bp, Homo sapiens
tatatttcctttatgtgaa

SEQ ID NO: 5443386 - DNA, 20 bp, Homo sapiens
tatatttcctttatgtgaat

SEQ ID NO: 5443387 - DNA, 13 bp, Homo sapiens
tatatttctaaat

SEQ ID NO: 5443388 - DNA, 15 bp, Homo sapiens
tatatttctcataat

SEQ ID NO: 5443389 - DNA, 13 bp, Homo sapiens
tatatttctccaa

SEQ ID NO: 5443390 - DNA, 19 bp, Homo sapiens
tatcctaataaaaaggtga

SEQ ID NO: 5443391 - DNA, 17 bp, Homo sapiens
tatcctaattgtccaca

SEQ ID NO: 5443392 - DNA, 21 bp, Homo sapiens
tatcctaggcatctgctgtaa

SEQ ID NO: 5443393 - DNA, 18 bp, Homo sapiens
tatcctaggggtgcgctc

SEQ ID NO: 5443394 - DNA, 20 bp, Homo sapiens
tatcctagtcattcttccct

SEQ ID NO: 5443395 - DNA, 19 bp, Homo sapiens
tatcctagttccattcttg

SEQ ID NO: 5443396 - DNA, 13 bp, Homo sapiens
tatcctatttcag

SEQ ID NO: 5443397 - DNA, 19 bp, Homo sapiens
tatcctcaagttgtgtgct

SEQ ID NO: 5443398 - DNA, 15 bp, Homo sapiens
tatcctcaattatct

SEQ ID NO: 5443399 - DNA, 15 bp, Homo sapiens
tatcctccaccgtct

SEQ ID NO: 5443400 - DNA, 12 bp, Homo sapiens
tatcctccaggt

SEQ ID NO: 5443401 - DNA, 18 bp, Homo sapiens
tatcctccaggtttttca

SEQ ID NO: 5443402 - DNA, 19 bp, Homo sapiens
tatcctccaggtttttcaa

SEQ ID NO: 5443403 - DNA, 20 bp, Homo sapiens
tatcctccaggtttttcaat

SEQ ID NO: 5443404 - DNA, 23 bp, Homo sapiens
tatcctccaggtttttcaattaa

SEQ ID NO: 5443405 - DNA, 12 bp, Homo sapiens
tatcctccctgc

SEQ ID NO: 5443406 - DNA, 16 bp, Homo sapiens
tatcctccctgcccat

SEQ ID NO: 5443407 - DNA, 15 bp, Homo sapiens
tatcctccctgtaac

SEQ ID NO: 5443408 - DNA, 16 bp, Homo sapiens
tatcctccctgtaact

SEQ ID NO: 5443409 - DNA, 12 bp, Homo sapiens
tatcctcctaaa

SEQ ID NO: 5443410 - DNA, 15 bp, Homo sapiens
tatcctctctctctc

SEQ ID NO: 5443411 - DNA, 14 bp, Homo sapiens
tatcctctgatctc

SEQ ID NO: 5443412 - DNA, 12 bp, Homo sapiens
tatcctctgtaa

SEQ ID NO: 5443413 - DNA, 14 bp, Homo sapiens
tatcctctttagag

SEQ ID NO: 5443414 - DNA, 16 bp, Homo sapiens
tatcctctttagagtt

SEQ ID NO: 5443415 - DNA, 22 bp, Homo sapiens
tatcctctttagagttagactg

SEQ ID NO: 5443416 - DNA, 23 bp, Homo sapiens
tatcctctttagagttagactgt

SEQ ID NO: 5443417 - DNA, 19 bp, Homo sapiens
tatcctgaaaggcaacata

SEQ ID NO: 5443418 - DNA, 14 bp, Homo sapiens
tatcctgaaatttc

SEQ ID NO: 5443419 - DNA, 23 bp, Homo sapiens
tatcctgacttctaatatcattc

SEQ ID NO: 5443420 - DNA, 19 bp, Homo sapiens
tatcctgattccaaatatg

SEQ ID NO: 5443421 - DNA, 15 bp, Homo sapiens
tatcctgcaccctct

SEQ ID NO: 5443422 - DNA, 15 bp, Homo sapiens
tatcctgcattttac

SEQ ID NO: 5443423 - DNA, 18 bp, Homo sapiens
tatcctgccaaaatcatt

SEQ ID NO: 5443424 - DNA, 15 bp, Homo sapiens
tatcctgcccagtgt

SEQ ID NO: 5443425 - DNA, 15 bp, Homo sapiens
tatcctgcctcagcc

SEQ ID NO: 5443426 - DNA, 21 bp, Homo sapiens
tatcctgcgggttttaattta

SEQ ID NO: 5443427 - DNA, 15 bp, Homo sapiens
tatcctgctgttcta

SEQ ID NO: 5443428 - DNA, 16 bp, Homo sapiens
tatcctggaacaatat

SEQ ID NO: 5443429 - DNA, 12 bp, Homo sapiens
tatcctggagac

SEQ ID NO: 5443430 - DNA, 17 bp, Homo sapiens
tatcctggcaaataata

SEQ ID NO: 5443431 - DNA, 18 bp, Homo sapiens
tatcctggccttgtactt

SEQ ID NO: 5443432 - DNA, 17 bp, Homo sapiens
tatcctggctttgccca

SEQ ID NO: 5443433 - DNA, 15 bp, Homo sapiens
tatcctgggggaaga

SEQ ID NO: 5443434 - DNA, 18 bp, Homo sapiens
tatcctgggggaagagga

SEQ ID NO: 5443435 - DNA, 21 bp, Homo sapiens
tatcctgggggaagaggagat

SEQ ID NO: 5443436 - DNA, 23 bp, Homo sapiens
tatcctgggggaagaggagatgt

SEQ ID NO: 5443437 - DNA, 15 bp, Homo sapiens
tatcctggtgtctag

SEQ ID NO: 5443438 - DNA, 16 bp, Homo sapiens
tatcctggtgtctagt

SEQ ID NO: 5443439 - DNA, 20 bp, Homo sapiens
tatcctggtgtctagtttgc

SEQ ID NO: 5443440 - DNA, 19 bp, Homo sapiens
tatcctggttagaagaaaa

SEQ ID NO: 5443441 - DNA, 12 bp, Homo sapiens
tatcctgtaata

SEQ ID NO: 5443442 - DNA, 18 bp, Homo sapiens
tatcctgtaataaagctc

SEQ ID NO: 5443443 - DNA, 14 bp, Homo sapiens
tatcctgtattctt

SEQ ID NO: 5443444 - DNA, 13 bp, Homo sapiens
tatcctgtctgag

SEQ ID NO: 5443445 - DNA, 14 bp, Homo sapiens
tatcctgtgctaca

SEQ ID NO: 5443446 - DNA, 23 bp, Homo sapiens
tatcctgtgtacctcactgtcca

SEQ ID NO: 5443447 - DNA, 18 bp, Homo sapiens
tatcctgttaggggaaaa

SEQ ID NO: 5443448 - DNA, 17 bp, Homo sapiens
tatccttacaatgtgaa

SEQ ID NO: 5443449 - DNA, 18 bp, Homo sapiens
tatccttaggaaaatgct

SEQ ID NO: 5443450 - DNA, 23 bp, Homo sapiens
tatccttaggaaaatgcttctgt

SEQ ID NO: 5443451 - DNA, 13 bp, Homo sapiens
tatccttcattgt

SEQ ID NO: 5443452 - DNA, 15 bp, Homo sapiens
tatccttcctagtgg

SEQ ID NO: 5443453 - DNA, 17 bp, Homo sapiens
tatccttcctctccttc

SEQ ID NO: 5443454 - DNA, 14 bp, Homo sapiens
tatccttccttcag

SEQ ID NO: 5443455 - DNA, 14 bp, Homo sapiens
tatccttctacttg

SEQ ID NO: 5443456 - DNA, 16 bp, Homo sapiens
tatccttctacttgtc

SEQ ID NO: 5443457 - DNA, 17 bp, Homo sapiens
tatccttctctttcaat

SEQ ID NO: 5443458 - DNA, 17 bp, Homo sapiens
tatccttggagagcagc

SEQ ID NO: 5443459 - DNA, 19 bp, Homo sapiens
tatccttggagagcagctg

SEQ ID NO: 5443460 - DNA, 23 bp, Homo sapiens
tatccttgggggctcccagggca

SEQ ID NO: 5443461 - DNA, 21 bp, Homo sapiens
tatccttgtctgaatgtattt

SEQ ID NO: 5443462 - DNA, 19 bp, Homo sapiens
tatcctttatacagttgta

SEQ ID NO: 5443463 - DNA, 12 bp, Homo sapiens
tatcctttcaca

SEQ ID NO: 5443464 - DNA, 18 bp, Homo sapiens
tatcctttcatatagtta

SEQ ID NO: 5443465 - DNA, 24 bp, Homo sapiens
tatcctttcattaggcaaagtaca

SEQ ID NO: 5443466 - DNA, 11 bp, Homo sapiens
tatcctttcct

SEQ ID NO: 5443467 - DNA, 24 bp, Homo sapiens
tatcctttcctcattaaattacct

SEQ ID NO: 5443468 - DNA, 17 bp, Homo sapiens
tatcctttctaacaaaa

SEQ ID NO: 5443469 - DNA, 17 bp, Homo sapiens
tatcctttgccccaagg

SEQ ID NO: 5443470 - DNA, 12 bp, Homo sapiens
tatccttttcta

SEQ ID NO: 5443471 - DNA, 15 bp, Homo sapiens
tatccttttctgtgt

SEQ ID NO: 5443472 - DNA, 21 bp, Homo sapiens
tatccttttttattgaataac

SEQ ID NO: 5443473 - DNA, 19 bp, Homo sapiens
tatccttttttcctttcct

SEQ ID NO: 5443474 - DNA, 14 bp, Homo sapiens
tatcgaaagtaaaa

SEQ ID NO: 5443475 - DNA, 16 bp, Homo sapiens
tatcgaaataacaatg

SEQ ID NO: 5443476 - DNA, 19 bp, Homo sapiens
tatcgaaatgacggtgtta

SEQ ID NO: 5443477 - DNA, 13 bp, Homo sapiens
tatcgaaatttgt

SEQ ID NO: 5443478 - DNA, 18 bp, Homo sapiens
tatcgaatatagttctgt

SEQ ID NO: 5443479 - DNA, 14 bp, Homo sapiens
tatcgagtttgcaa

SEQ ID NO: 5443480 - DNA, 16 bp, Homo sapiens
tatcgagtttgcaatg

SEQ ID NO: 5443481 - DNA, 16 bp, Homo sapiens
tatcgatgttttatta

SEQ ID NO: 5443482 - DNA, 23 bp, Homo sapiens
tatcgcaacatgaatttttatga

SEQ ID NO: 5443483 - DNA, 23 bp, Homo sapiens
tatcgccatggcttcccatctgt

SEQ ID NO: 5443484 - DNA, 14 bp, Homo sapiens
tatcgccattccag

SEQ ID NO: 5443485 - DNA, 16 bp, Homo sapiens
tatcgccctcctttcc

SEQ ID NO: 5443486 - DNA, 18 bp, Homo sapiens
tatcgccctcctttccct

SEQ ID NO: 5443487 - DNA, 20 bp, Homo sapiens
tatcgccctcctttccctta

SEQ ID NO: 5443488 - DNA, 16 bp, Homo sapiens
tatcgctgatgcagac

SEQ ID NO: 5443489 - DNA, 17 bp, Homo sapiens
tatcgctgggaaatgag

SEQ ID NO: 5443490 - DNA, 14 bp, Homo sapiens
tatcggaagcagtg

SEQ ID NO: 5443491 - DNA, 15 bp, Homo sapiens
tatcggaagcagtgc

SEQ ID NO: 5443492 - DNA, 22 bp, Homo sapiens
tatcggagcagttcaataacaa

SEQ ID NO: 5443493 - DNA, 23 bp, Homo sapiens
tatcggcagatgatgctttggaa

SEQ ID NO: 5443494 - DNA, 17 bp, Homo sapiens
tatcgggaacagtgttt

SEQ ID NO: 5443495 - DNA, 18 bp, Homo sapiens
tatcggggaagccagacg

SEQ ID NO: 5443496 - DNA, 16 bp, Homo sapiens
tatcgtattcaccttc

SEQ ID NO: 5443497 - DNA, 16 bp, Homo sapiens
tatcgtcactgcttaa

SEQ ID NO: 5443498 - DNA, 18 bp, Homo sapiens
tatcgttttcttaaagtg

SEQ ID NO: 5443499 - DNA, 12 bp, Homo sapiens
tatcgtttttgt

SEQ ID NO: 5443500 - DNA, 18 bp, Homo sapiens
tatcgtttttgtattttc

SEQ ID NO: 5443501 - DNA, 23 bp, Homo sapiens
tatctaaaagtgtcaccttttct

SEQ ID NO: 5443502 - DNA, 14 bp, Homo sapiens
tatctaaaccatat

SEQ ID NO: 5443503 - DNA, 23 bp, Homo sapiens
tatctaaacccagcaaaacagat

SEQ ID NO: 5443504 - DNA, 22 bp, Homo sapiens
tatctaaagtcatcatgaactg

SEQ ID NO: 5443505 - DNA, 13 bp, Homo sapiens
tatctaaagttat

SEQ ID NO: 5443506 - DNA, 18 bp, Homo sapiens
tatctaaagttatatttc

SEQ ID NO: 5443507 - DNA, 20 bp, Homo sapiens
tatctaaagttatatttcag

SEQ ID NO: 5443508 - DNA, 15 bp, Homo sapiens
tatctaaagtttgtt

SEQ ID NO: 5443509 - DNA, 16 bp, Homo sapiens
tatctaaatcaccaga

SEQ ID NO: 5443510 - DNA, 13 bp, Homo sapiens
tatctaaatgaaa

SEQ ID NO: 5443511 - DNA, 20 bp, Homo sapiens
tatctaaattgaataatggt

SEQ ID NO: 5443512 - DNA, 15 bp, Homo sapiens
tatctaaatttggaa

SEQ ID NO: 5443513 - DNA, 16 bp, Homo sapiens
tatctaacattttcta

SEQ ID NO: 5443514 - DNA, 19 bp, Homo sapiens
tatctaagaataataaaat

SEQ ID NO: 5443515 - DNA, 19 bp, Homo sapiens
tatctaagttaatttaaag

SEQ ID NO: 5443516 - DNA, 15 bp, Homo sapiens
tatctaagttcacag

SEQ ID NO: 5443517 - DNA, 19 bp, Homo sapiens
tatctaataatgaagtgtt

SEQ ID NO: 5443518 - DNA, 14 bp, Homo sapiens
tatctaatacaaaa

SEQ ID NO: 5443519 - DNA, 16 bp, Homo sapiens
tatctaatacctctgt

SEQ ID NO: 5443520 - DNA, 17 bp, Homo sapiens
tatctaatatatatgaa

SEQ ID NO: 5443521 - DNA, 20 bp, Homo sapiens
tatctaatatatatgaataa

SEQ ID NO: 5443522 - DNA, 21 bp, Homo sapiens
tatctaatatatatgaataaa

SEQ ID NO: 5443523 - DNA, 16 bp, Homo sapiens
tatctaatcagatctt

SEQ ID NO: 5443524 - DNA, 18 bp, Homo sapiens
tatctaattatttccact

SEQ ID NO: 5443525 - DNA, 13 bp, Homo sapiens
tatctaatttata

SEQ ID NO: 5443526 - DNA, 14 bp, Homo sapiens
tatctaatttatac

SEQ ID NO: 5443527 - DNA, 15 bp, Homo sapiens
tatctaatttataca

SEQ ID NO: 5443528 - DNA, 20 bp, Homo sapiens
tatctaatttatacaaaata

SEQ ID NO: 5443529 - DNA, 14 bp, Homo sapiens
tatctaatttgtgc

SEQ ID NO: 5443530 - DNA, 15 bp, Homo sapiens
tatctacagcttcta

SEQ ID NO: 5443531 - DNA, 16 bp, Homo sapiens
tatctacagcttctat

SEQ ID NO: 5443532 - DNA, 16 bp, Homo sapiens
tatctacagtaatgaa

SEQ ID NO: 5443533 - DNA, 21 bp, Homo sapiens
tatctacattaaaatgacaaa

SEQ ID NO: 5443534 - DNA, 22 bp, Homo sapiens
tatctaccccagactagatgta

SEQ ID NO: 5443535 - DNA, 22 bp, Homo sapiens
tatctacctcaaggtaacaaga

SEQ ID NO: 5443536 - DNA, 20 bp, Homo sapiens
tatctacctgccctctctca

SEQ ID NO: 5443537 - DNA, 15 bp, Homo sapiens
tatctacctgttctg

SEQ ID NO: 5443538 - DNA, 14 bp, Homo sapiens
tatctactctcctc

SEQ ID NO: 5443539 - DNA, 22 bp, Homo sapiens
tatctactgactatattttccc

SEQ ID NO: 5443540 - DNA, 19 bp, Homo sapiens
tatctactgactgaaatca

SEQ ID NO: 5443541 - DNA, 21 bp, Homo sapiens
tatctactgactgaaatcagt

SEQ ID NO: 5443542 - DNA, 22 bp, Homo sapiens
tatctacttttactcataagta

SEQ ID NO: 5443543 - DNA, 18 bp, Homo sapiens
tatctagaaagaaaagac

SEQ ID NO: 5443544 - DNA, 21 bp, Homo sapiens
tatctagaaagaaaagaccct

SEQ ID NO: 5443545 - DNA, 20 bp, Homo sapiens
tatctagaacattcagattt

SEQ ID NO: 5443546 - DNA, 19 bp, Homo sapiens
tatctagaactatcatttt

SEQ ID NO: 5443547 - DNA, 12 bp, Homo sapiens
tatctagagaat

SEQ ID NO: 5443548 - DNA, 19 bp, Homo sapiens
tatctagcagtaaaagata

SEQ ID NO: 5443549 - DNA, 21 bp, Homo sapiens
tatctagcatttatttctctg

SEQ ID NO: 5443550 - DNA, 13 bp, Homo sapiens
tatctagctgcat

SEQ ID NO: 5443551 - DNA, 14 bp, Homo sapiens
tatctagcttcttc

SEQ ID NO: 5443552 - DNA, 18 bp, Homo sapiens
tatctaggcatttcatta

SEQ ID NO: 5443553 - DNA, 23 bp, Homo sapiens
tatctaggcatttcattatgctt

SEQ ID NO: 5443554 - DNA, 23 bp, Homo sapiens
tatctagtaatatatttaaaggg

SEQ ID NO: 5443555 - DNA, 19 bp, Homo sapiens
tatctagtcagtatctgta

SEQ ID NO: 5443556 - DNA, 14 bp, Homo sapiens
tatctagtgcagct

SEQ ID NO: 5443557 - DNA, 17 bp, Homo sapiens
tatctagtgctaaacct

SEQ ID NO: 5443558 - DNA, 20 bp, Homo sapiens
tatctagtgctaaacctatc

SEQ ID NO: 5443559 - DNA, 23 bp, Homo sapiens
tatctagtggtctgattttaatt

SEQ ID NO: 5443560 - DNA, 17 bp, Homo sapiens
tatctagtgtgtcctgt

SEQ ID NO: 5443561 - DNA, 17 bp, Homo sapiens
tatctagtttaattaat

SEQ ID NO: 5443562 - DNA, 22 bp, Homo sapiens
tatctataaaatagatataaat

SEQ ID NO: 5443563 - DNA, 13 bp, Homo sapiens
tatctataattta

SEQ ID NO: 5443564 - DNA, 20 bp, Homo sapiens
tatctatacatatctttatt

SEQ ID NO: 5443565 - DNA, 16 bp, Homo sapiens
tatctatagcaactca

SEQ ID NO: 5443566 - DNA, 22 bp, Homo sapiens
tatctatagtagtcaattagta

SEQ ID NO: 5443567 - DNA, 21 bp, Homo sapiens
tatctatatagtacctttgct

SEQ ID NO: 5443568 - DNA, 13 bp, Homo sapiens
tatgaaatgccag

SEQ ID NO: 5443569 - DNA, 16 bp, Homo sapiens
tatgaaattaacaaga

SEQ ID NO: 5443570 - DNA, 20 bp, Homo sapiens
tatgaaattcatggcttttt

SEQ ID NO: 5443571 - DNA, 16 bp, Homo sapiens
tatgaaattccagcaa

SEQ ID NO: 5443572 - DNA, 20 bp, Homo sapiens
tatgaaattttttttcatgc

SEQ ID NO: 5443573 - DNA, 21 bp, Homo sapiens
tatgaacaaagaaaaaaatat

SEQ ID NO: 5443574 - DNA, 21 bp, Homo sapiens
tatgaacaacagtagtttctc

SEQ ID NO: 5443575 - DNA, 22 bp, Homo sapiens
tatgaacacagacaaagtgcta

SEQ ID NO: 5443576 - DNA, 10 bp, Homo sapiens
tatgaacaga

SEQ ID NO: 5443577 - DNA, 16 bp, Homo sapiens
tatgaacagctgtgtc

SEQ ID NO: 5443578 - DNA, 22 bp, Homo sapiens
tatgaacagggcccaggcctgg

SEQ ID NO: 5443579 - DNA, 14 bp, Homo sapiens
tatgaacatgcagt

SEQ ID NO: 5443580 - DNA, 16 bp, Homo sapiens
tatgaaccacatggaa

SEQ ID NO: 5443581 - DNA, 21 bp, Homo sapiens
tatgaaccctttgtttcttgt

SEQ ID NO: 5443582 - DNA, 18 bp, Homo sapiens
tatgaacctattttcatt

SEQ ID NO: 5443583 - DNA, 23 bp, Homo sapiens
tatgaacctattttcatttgtac

SEQ ID NO: 5443584 - DNA, 22 bp, Homo sapiens
tatgaacgcacaacatgcacat

SEQ ID NO: 5443585 - DNA, 18 bp, Homo sapiens
tatgaacggtgagcattg

SEQ ID NO: 5443586 - DNA, 21 bp, Homo sapiens
tatgaactacaggtgtttgac

SEQ ID NO: 5443587 - DNA, 15 bp, Homo sapiens
tatgaactgcatgta

SEQ ID NO: 5443588 - DNA, 23 bp, Homo sapiens
tatgaacttaacatgctgtgtaa

SEQ ID NO: 5443589 - DNA, 18 bp, Homo sapiens
tatgaacttgaggacaca

SEQ ID NO: 5443590 - DNA, 20 bp, Homo sapiens
tatgaacttgaggacacatg

SEQ ID NO: 5443591 - DNA, 21 bp, Homo sapiens
tatgaacttgaggacacatgt

SEQ ID NO: 5443592 - DNA, 22 bp, Homo sapiens
tatgaacttgaggacacatgtc

SEQ ID NO: 5443593 - DNA, 23 bp, Homo sapiens
tatgaacttgaggacacatgtcc

SEQ ID NO: 5443594 - DNA, 15 bp, Homo sapiens
tatgaagaaaaaata

SEQ ID NO: 5443595 - DNA, 20 bp, Homo sapiens
tatgaagaaaaaatacattt

SEQ ID NO: 5443596 - DNA, 14 bp, Homo sapiens
tatgaagaaaatac

SEQ ID NO: 5443597 - DNA, 20 bp, Homo sapiens
tatgaagaaaatacttaaat

SEQ ID NO: 5443598 - DNA, 18 bp, Homo sapiens
tatgaagaaacgcaacaa

SEQ ID NO: 5443599 - DNA, 18 bp, Homo sapiens
tatgaagaactattatat

SEQ ID NO: 5443600 - DNA, 16 bp, Homo sapiens
tatgaagaactgagga

SEQ ID NO: 5443601 - DNA, 17 bp, Homo sapiens
tatgaagaactgaggag

SEQ ID NO: 5443602 - DNA, 21 bp, Homo sapiens
tatgaagaattgccaatcttg

SEQ ID NO: 5443603 - DNA, 22 bp, Homo sapiens
tatgaagaattgccaatcttgt

SEQ ID NO: 5443604 - DNA, 21 bp, Homo sapiens
tatgaagacactgtcaatgag

SEQ ID NO: 5443605 - DNA, 23 bp, Homo sapiens
tatgaagacagaggcagagattg

SEQ ID NO: 5443606 - DNA, 15 bp, Homo sapiens
tatgaagacttaaaa

SEQ ID NO: 5443607 - DNA, 21 bp, Homo sapiens
tatgaagagctgtcttcccct

SEQ ID NO: 5443608 - DNA, 19 bp, Homo sapiens
tatgaagagtattaatgta

SEQ ID NO: 5443609 - DNA, 14 bp, Homo sapiens
tatgaagcaagctg

SEQ ID NO: 5443610 - DNA, 15 bp, Homo sapiens
tatgaagcaagctgt

SEQ ID NO: 5443611 - DNA, 15 bp, Homo sapiens
tatgaagcagaatga

SEQ ID NO: 5443612 - DNA, 17 bp, Homo sapiens
tatgaagcagaatgaga

SEQ ID NO: 5443613 - DNA, 20 bp, Homo sapiens
tatgaagcttttatgtgaaa

SEQ ID NO: 5443614 - DNA, 17 bp, Homo sapiens
tatgaaggaatcattcc

SEQ ID NO: 5443615 - DNA, 20 bp, Homo sapiens
tatgaaggaatcattccagt

SEQ ID NO: 5443616 - DNA, 13 bp, Homo sapiens
tatgaaggaattt

SEQ ID NO: 5443617 - DNA, 15 bp, Homo sapiens
tatgaaggaatttga

SEQ ID NO: 5443618 - DNA, 21 bp, Homo sapiens
tatgaagggccttgagcatct

SEQ ID NO: 5443619 - DNA, 14 bp, Homo sapiens
tatgaagtactttt

SEQ ID NO: 5443620 - DNA, 14 bp, Homo sapiens
tatgaagtataaat

SEQ ID NO: 5443621 - DNA, 14 bp, Homo sapiens
tatgaagtatataa

SEQ ID NO: 5443622 - DNA, 16 bp, Homo sapiens
tatgaagtatataatg

SEQ ID NO: 5443623 - DNA, 15 bp, Homo sapiens
tatgaagtattaaaa

SEQ ID NO: 5443624 - DNA, 17 bp, Homo sapiens
tatgaagtattaaaatg

SEQ ID NO: 5443625 - DNA, 13 bp, Homo sapiens
tatgaagtgcgtg

SEQ ID NO: 5443626 - DNA, 19 bp, Homo sapiens
tatgaagtgcgtgaatgta

SEQ ID NO: 5443627 - DNA, 20 bp, Homo sapiens
tatgaagttactttcttaat

SEQ ID NO: 5443628 - DNA, 13 bp, Homo sapiens
tatgaagttgctg

SEQ ID NO: 5443629 - DNA, 14 bp, Homo sapiens
tatgaagttgctgt

SEQ ID NO: 5443630 - DNA, 17 bp, Homo sapiens
tatgaagttggcacatt

SEQ ID NO: 5443631 - DNA, 22 bp, Homo sapiens
tatgaagttggcacatttcatg

SEQ ID NO: 5443632 - DNA, 17 bp, Homo sapiens
tatgaagtttttaaaaa

SEQ ID NO: 5443633 - DNA, 20 bp, Homo sapiens
tatgaagtttttaaaaataa

SEQ ID NO: 5443634 - DNA, 22 bp, Homo sapiens
tatgaagtttttaaaaataaag

SEQ ID NO: 5443635 - DNA, 20 bp, Homo sapiens
tatgaagtttttattttaaa

SEQ ID NO: 5443636 - DNA, 12 bp, Homo sapiens
tatgaataaaat

SEQ ID NO: 5443637 - DNA, 18 bp, Homo sapiens
tatgaataaagacaccta

SEQ ID NO: 5443638 - DNA, 12 bp, Homo sapiens
tatgaataacat

SEQ ID NO: 5443639 - DNA, 16 bp, Homo sapiens
tatgaataattatgtt

SEQ ID NO: 5443640 - DNA, 17 bp, Homo sapiens
tatgaataattatgttt

SEQ ID NO: 5443641 - DNA, 21 bp, Homo sapiens
tatgaataattatgtttacct

SEQ ID NO: 5443642 - DNA, 15 bp, Homo sapiens
tatgaataattgcat

SEQ ID NO: 5443643 - DNA, 16 bp, Homo sapiens
tatgaatacagcagca

SEQ ID NO: 5443644 - DNA, 20 bp, Homo sapiens
tatgaatacagcagcaagaa

SEQ ID NO: 5443645 - DNA, 12 bp, Homo sapiens
tatgaatacagg

SEQ ID NO: 5443646 - DNA, 16 bp, Homo sapiens
tatgaatacagggcat

SEQ ID NO: 5443647 - DNA, 15 bp, Homo sapiens
tatgaatagacataa

SEQ ID NO: 5443648 - DNA, 21 bp, Homo sapiens
tatgaatagacataaattgta

SEQ ID NO: 5443649 - DNA, 16 bp, Homo sapiens
tatgaatatatacata

SEQ ID NO: 5443650 - DNA, 23 bp, Homo sapiens
tatgaatatatacataaaaattg

SEQ ID NO: 5443651 - DNA, 21 bp, Homo sapiens
tatgaatatatggcatttgca

SEQ ID NO: 5443652 - DNA, 18 bp, Homo sapiens
tatgaatattactctcaa

SEQ ID NO: 5443653 - DNA, 18 bp, Homo sapiens
tatgaatatttcattttg

SEQ ID NO: 5443654 - DNA, 12 bp, Homo sapiens
tatgaatcaaat

SEQ ID NO: 5443655 - DNA, 15 bp, Homo sapiens
tatgaatctatgcca

SEQ ID NO: 5443656 - DNA, 21 bp, Homo sapiens
tatgaatctatgccaaagatc

SEQ ID NO: 5443657 - DNA, 22 bp, Homo sapiens
tatgaatctatgccaaagatca

SEQ ID NO: 5443658 - DNA, 18 bp, Homo sapiens
tatgaatctattatactg

SEQ ID NO: 5443659 - DNA, 23 bp, Homo sapiens
tatgaatctattatactgtatta

SEQ ID NO: 5443660 - DNA, 21 bp, Homo sapiens
tatgaatctctacgcaaaaaa

SEQ ID NO: 5443661 - DNA, 15 bp, Homo sapiens
tatgaatctgagaga

SEQ ID NO: 5443662 - DNA, 11 bp, Homo sapiens
tatgaatctgg

SEQ ID NO: 5443663 - DNA, 15 bp, Homo sapiens
tatgaatgaaacatg

SEQ ID NO: 5443664 - DNA, 15 bp, Homo sapiens
tatgaatgatatctt

SEQ ID NO: 5443665 - DNA, 22 bp, Homo sapiens
tatgaatgatgttttagaatga

SEQ ID NO: 5443666 - DNA, 23 bp, Homo sapiens
tatgaatgatttgcatatgaaag

SEQ ID NO: 5443667 - DNA, 22 bp, Homo sapiens
tatgaatgcagcactgctgcct

SEQ ID NO: 5443668 - DNA, 20 bp, Homo sapiens
tatgaatgcccccagctggc

SEQ ID NO: 5443669 - DNA, 22 bp, Homo sapiens
tatgaatgggcaaaactgaatt

SEQ ID NO: 5443670 - DNA, 20 bp, Homo sapiens
tatgaatgtactgcatgtta

SEQ ID NO: 5443671 - DNA, 13 bp, Homo sapiens
tatgaatgtcaca

SEQ ID NO: 5443672 - DNA, 14 bp, Homo sapiens
tatgaatgtcacat

SEQ ID NO: 5443673 - DNA, 19 bp, Homo sapiens
tatgaatgtgaagccttcc

SEQ ID NO: 5443674 - DNA, 13 bp, Homo sapiens
tatgaatgtgatt

SEQ ID NO: 5443675 - DNA, 18 bp, Homo sapiens
tatgaatgtgcatttctt

SEQ ID NO: 5443676 - DNA, 13 bp, Homo sapiens
tatgaattcaaga

SEQ ID NO: 5443677 - DNA, 18 bp, Homo sapiens
tatgaattcaagaaagga

SEQ ID NO: 5443678 - DNA, 18 bp, Homo sapiens
tatgaattcacagatatt

SEQ ID NO: 5443679 - DNA, 18 bp, Homo sapiens
tatgaattgaattatctt

SEQ ID NO: 5443680 - DNA, 13 bp, Homo sapiens
tatgaattgtaca

SEQ ID NO: 5443681 - DNA, 17 bp, Homo sapiens
tatgaattgtctaaagt

SEQ ID NO: 5443682 - DNA, 15 bp, Homo sapiens
tatgaatttaaatat

SEQ ID NO: 5443683 - DNA, 19 bp, Homo sapiens
tatgaatttaaatataatt

SEQ ID NO: 5443684 - DNA, 21 bp, Homo sapiens
tatgaatttaaatataattct

SEQ ID NO: 5443685 - DNA, 13 bp, Homo sapiens
tatgaattttgta

SEQ ID NO: 5443686 - DNA, 14 bp, Homo sapiens
tatgaattttgtaa

SEQ ID NO: 5443687 - DNA, 21 bp, Homo sapiens
tatgacaaaaaaaattaagtc

SEQ ID NO: 5443688 - DNA, 14 bp, Homo sapiens
tatgacaaatgaaa

SEQ ID NO: 5443689 - DNA, 17 bp, Homo sapiens
tatgacaaatgaaagag

SEQ ID NO: 5443690 - DNA, 18 bp, Homo sapiens
tatgacaaatgaaagaga

SEQ ID NO: 5443691 - DNA, 14 bp, Homo sapiens
tatgacaaattcaa

SEQ ID NO: 5443692 - DNA, 18 bp, Homo sapiens
tatgacaagcctttgtgc

SEQ ID NO: 5443693 - DNA, 17 bp, Homo sapiens
tatgacaagctgtatca

SEQ ID NO: 5443694 - DNA, 21 bp, Homo sapiens
tatgacaagctgtatcactgc

SEQ ID NO: 5443695 - DNA, 22 bp, Homo sapiens
tatgacaagctgtatcactgcc

SEQ ID NO: 5443696 - DNA, 19 bp, Homo sapiens
tatgacaatcctgaagaaa

SEQ ID NO: 5443697 - DNA, 19 bp, Homo sapiens
tatgacaatcttattgtca

SEQ ID NO: 5443698 - DNA, 20 bp, Homo sapiens
tatgacaatttcaaaatgca

SEQ ID NO: 5443699 - DNA, 23 bp, Homo sapiens
tatgacaatttcaaaatgcatgt

SEQ ID NO: 5443700 - DNA, 13 bp, Homo sapiens
tatgacacaatga

SEQ ID NO: 5443701 - DNA, 11 bp, Homo sapiens
tatgacacagt

SEQ ID NO: 5443702 - DNA, 16 bp, Homo sapiens
tatgacagatatattt

SEQ ID NO: 5443703 - DNA, 21 bp, Homo sapiens
tatgacagatatatttaagcc

SEQ ID NO: 5443704 - DNA, 21 bp, Homo sapiens
tatgacagccatttgtaatga

SEQ ID NO: 5443705 - DNA, 16 bp, Homo sapiens
tatgacagctgtccct

SEQ ID NO: 5443706 - DNA, 15 bp, Homo sapiens
tatgacagtaattgt

SEQ ID NO: 5443707 - DNA, 22 bp, Homo sapiens
tatgacagtaattgtgtttaca

SEQ ID NO: 5443708 - DNA, 19 bp, Homo sapiens
tatgacataaaaacaactt

SEQ ID NO: 5443709 - DNA, 22 bp, Homo sapiens
tatgacataaaaacaactttat

SEQ ID NO: 5443710 - DNA, 19 bp, Homo sapiens
tatgacatcacttgtacaa

SEQ ID NO: 5443711 - DNA, 23 bp, Homo sapiens
tatgacatcacttgtacaaaata

SEQ ID NO: 5443712 - DNA, 14 bp, Homo sapiens
tatgacattcatgc

SEQ ID NO: 5443713 - DNA, 20 bp, Homo sapiens
tatgacattcatgcctggct

SEQ ID NO: 5443714 - DNA, 20 bp, Homo sapiens
tatgacatttcttaaaactt

SEQ ID NO: 5443715 - DNA, 19 bp, Homo sapiens
tatgaccacactccagctg

SEQ ID NO: 5443716 - DNA, 15 bp, Homo sapiens
tatgaccagagcaaa

SEQ ID NO: 5443717 - DNA, 22 bp, Homo sapiens
tatgacccacattactttttat

SEQ ID NO: 5443718 - DNA, 16 bp, Homo sapiens
tatgacccctggccac

SEQ ID NO: 5443719 - DNA, 22 bp, Homo sapiens
tatgacccctggccacagcctt

SEQ ID NO: 5443720 - DNA, 23 bp, Homo sapiens
tatgacccctggccacagccttc

SEQ ID NO: 5443721 - DNA, 15 bp, Homo sapiens
tatgaccctgtgcct

SEQ ID NO: 5443722 - DNA, 16 bp, Homo sapiens
tatgaccctgtgcctg

SEQ ID NO: 5443723 - DNA, 21 bp, Homo sapiens
tatgacctaaatccattttct

SEQ ID NO: 5443724 - DNA, 23 bp, Homo sapiens
tatgacctaaatccattttctaa

SEQ ID NO: 5443725 - DNA, 21 bp, Homo sapiens
tatgacctaggggtttctgtt

SEQ ID NO: 5443726 - DNA, 21 bp, Homo sapiens
tatgaccttaaggaaaagtaa

SEQ ID NO: 5443727 - DNA, 22 bp, Homo sapiens
tatgaccttaaggaaaagtaag

SEQ ID NO: 5443728 - DNA, 21 bp, Homo sapiens
tatgaccttccaagtttgact

SEQ ID NO: 5443729 - DNA, 16 bp, Homo sapiens
tatgaccttctaggaa

SEQ ID NO: 5443730 - DNA, 18 bp, Homo sapiens
tatgaccttctaggaagc

SEQ ID NO: 5443731 - DNA, 23 bp, Homo sapiens
tatgacgcggctcaaaaggaaac

SEQ ID NO: 5443732 - DNA, 17 bp, Homo sapiens
tatgacgctgatacata

SEQ ID NO: 5443733 - DNA, 22 bp, Homo sapiens
tatgacgtgcacaaaccttctt

SEQ ID NO: 5443734 - DNA, 12 bp, Homo sapiens
tatgactaaaga

SEQ ID NO: 5443735 - DNA, 14 bp, Homo sapiens
tatgactaaagaga

SEQ ID NO: 5443736 - DNA, 16 bp, Homo sapiens
tatgactaaagagaga

SEQ ID NO: 5443737 - DNA, 19 bp, Homo sapiens
tatgactaaagagagaatg

SEQ ID NO: 5443738 - DNA, 15 bp, Homo sapiens
tatgactaaattttc

SEQ ID NO: 5443739 - DNA, 20 bp, Homo sapiens
tatgactaaattttctttta

SEQ ID NO: 5443740 - DNA, 24 bp, Homo sapiens
tatgactaatccttaataactatg

SEQ ID NO: 5443741 - DNA, 16 bp, Homo sapiens
tatgactaattcacaa

SEQ ID NO: 5443742 - DNA, 21 bp, Homo sapiens
tatgactaatttggggaaaat

SEQ ID NO: 5443743 - DNA, 19 bp, Homo sapiens
tatgggaacaagtgtacag

SEQ ID NO: 5443744 - DNA, 18 bp, Homo sapiens
tatgggaacactggcaga

SEQ ID NO: 5443745 - DNA, 21 bp, Homo sapiens
tatgggaactatgaggagcct

SEQ ID NO: 5443746 - DNA, 15 bp, Homo sapiens
tatgggaagctctgt

SEQ ID NO: 5443747 - DNA, 16 bp, Homo sapiens
tatgggaagctctgtg

SEQ ID NO: 5443748 - DNA, 16 bp, Homo sapiens
tatgggaatcaagatt

SEQ ID NO: 5443749 - DNA, 14 bp, Homo sapiens
tatgggagaaatag

SEQ ID NO: 5443750 - DNA, 10 bp, Homo sapiens
tatgggagag

SEQ ID NO: 5443751 - DNA, 21 bp, Homo sapiens
tatgggagatggcagcagtga

SEQ ID NO: 5443752 - DNA, 14 bp, Homo sapiens
tatgggaggaacaa

SEQ ID NO: 5443753 - DNA, 20 bp, Homo sapiens
tatgggatattcccaagccg

SEQ ID NO: 5443754 - DNA, 19 bp, Homo sapiens
tatgggatcatttttccag

SEQ ID NO: 5443755 - DNA, 19 bp, Homo sapiens
tatgggatgtaaacaatgt

SEQ ID NO: 5443756 - DNA, 23 bp, Homo sapiens
tatgggatgtaaacaatgtaaag

SEQ ID NO: 5443757 - DNA, 16 bp, Homo sapiens
tatgggattagattca

SEQ ID NO: 5443758 - DNA, 15 bp, Homo sapiens
tatgggcaaaaaact

SEQ ID NO: 5443759 - DNA, 11 bp, Homo sapiens
tatgggctggg

SEQ ID NO: 5443760 - DNA, 16 bp, Homo sapiens
tatggggagagggcat

SEQ ID NO: 5443761 - DNA, 18 bp, Homo sapiens
tatggggatagatgtgtg

SEQ ID NO: 5443762 - DNA, 19 bp, Homo sapiens
tatggggatagatgtgtgg

SEQ ID NO: 5443763 - DNA, 17 bp, Homo sapiens
tatggggatggtagttt

SEQ ID NO: 5443764 - DNA, 23 bp, Homo sapiens
tatggggggaggggggagggctg

SEQ ID NO: 5443765 - DNA, 23 bp, Homo sapiens
tatggggggccaacaccagggat

SEQ ID NO: 5443766 - DNA, 20 bp, Homo sapiens
tatggggggggcaagaaaga

SEQ ID NO: 5443767 - DNA, 15 bp, Homo sapiens
tatgggtagcactac

SEQ ID NO: 5443768 - DNA, 15 bp, Homo sapiens
tatgggtcacaggaa

SEQ ID NO: 5443769 - DNA, 13 bp, Homo sapiens
tatgggtcctctg

SEQ ID NO: 5443770 - DNA, 14 bp, Homo sapiens
tatgggtcctctgg

SEQ ID NO: 5443771 - DNA, 14 bp, Homo sapiens
tatgggtctaggac

SEQ ID NO: 5443772 - DNA, 13 bp, Homo sapiens
tatgggtgctggc

SEQ ID NO: 5443773 - DNA, 14 bp, Homo sapiens
tatgggtgctggca

SEQ ID NO: 5443774 - DNA, 22 bp, Homo sapiens
tatgggtggctttcaaggctgg

SEQ ID NO: 5443775 - DNA, 19 bp, Homo sapiens
tatgggtgggattttgcaa

SEQ ID NO: 5443776 - DNA, 20 bp, Homo sapiens
tatgggtgggattttgcaaa

SEQ ID NO: 5443777 - DNA, 19 bp, Homo sapiens
tatgggttttgcttaaaga

SEQ ID NO: 5443778 - DNA, 18 bp, Homo sapiens
tatggtaaataactgtga

SEQ ID NO: 5443779 - DNA, 22 bp, Homo sapiens
tatggtaatagctttagtgaat

SEQ ID NO: 5443780 - DNA, 16 bp, Homo sapiens
tatggtaatcatatta

SEQ ID NO: 5443781 - DNA, 18 bp, Homo sapiens
tatggtaatcatattaga

SEQ ID NO: 5443782 - DNA, 19 bp, Homo sapiens
tatggtacctatttggtgc

SEQ ID NO: 5443783 - DNA, 16 bp, Homo sapiens
tatggtagaaaaattt

SEQ ID NO: 5443784 - DNA, 19 bp, Homo sapiens
tatggtagaaaaatttcac

SEQ ID NO: 5443785 - DNA, 22 bp, Homo sapiens
tatggtagaaaaatttcacgat

SEQ ID NO: 5443786 - DNA, 21 bp, Homo sapiens
tatggtaggaactgctgggct

SEQ ID NO: 5443787 - DNA, 18 bp, Homo sapiens
tatggtatgctggccagc

SEQ ID NO: 5443788 - DNA, 22 bp, Homo sapiens
tatggtatgctggccagcaccc

SEQ ID NO: 5443789 - DNA, 15 bp, Homo sapiens
tatggtattacaaaa

SEQ ID NO: 5443790 - DNA, 13 bp, Homo sapiens
tatggtattgtga

SEQ ID NO: 5443791 - DNA, 22 bp, Homo sapiens
tatggtattgtgagatgatttg

SEQ ID NO: 5443792 - DNA, 22 bp, Homo sapiens
tatggtcaacacttaagggttt

SEQ ID NO: 5443793 - DNA, 21 bp, Homo sapiens
tatggtcaatcccaaaagtca

SEQ ID NO: 5443794 - DNA, 20 bp, Homo sapiens
tatggtcatctttttctcta

SEQ ID NO: 5443795 - DNA, 16 bp, Homo sapiens
tatggtctaatgttta

SEQ ID NO: 5443796 - DNA, 23 bp, Homo sapiens
tatggtctaatgtttaagcagaa

SEQ ID NO: 5443797 - DNA, 19 bp, Homo sapiens
tatggtctggggtaaaatt

SEQ ID NO: 5443798 - DNA, 16 bp, Homo sapiens
tatggtgaacccacaa

SEQ ID NO: 5443799 - DNA, 22 bp, Homo sapiens
tatggtgacctctccggcctgg

SEQ ID NO: 5443800 - DNA, 12 bp, Homo sapiens
tatggtgagatg

SEQ ID NO: 5443801 - DNA, 20 bp, Homo sapiens
tatggtgagatgcagctgga

SEQ ID NO: 5443802 - DNA, 15 bp, Homo sapiens
tatggtgatgactta

SEQ ID NO: 5443803 - DNA, 20 bp, Homo sapiens
tatggtgcaatgtgtgtata

SEQ ID NO: 5443804 - DNA, 22 bp, Homo sapiens
tatggtgcaatgtgtgtatatg

SEQ ID NO: 5443805 - DNA, 19 bp, Homo sapiens
tatggtgccaatggaacct

SEQ ID NO: 5443806 - DNA, 18 bp, Homo sapiens
tatggtgcctagtattga

SEQ ID NO: 5443807 - DNA, 23 bp, Homo sapiens
tatggtgctctgtctacttgctc

SEQ ID NO: 5443808 - DNA, 16 bp, Homo sapiens
tatggtggccctgggg

SEQ ID NO: 5443809 - DNA, 17 bp, Homo sapiens
tatggtggccctgggga

SEQ ID NO: 5443810 - DNA, 13 bp, Homo sapiens
tatggtgtaatgc

SEQ ID NO: 5443811 - DNA, 20 bp, Homo sapiens
tatggtgtaatgcacaattt

SEQ ID NO: 5443812 - DNA, 16 bp, Homo sapiens
tatggtgtgttcctaa

SEQ ID NO: 5443813 - DNA, 22 bp, Homo sapiens
tatggttacgttggttaaataa

SEQ ID NO: 5443814 - DNA, 13 bp, Homo sapiens
tatggttatgaaa

SEQ ID NO: 5443815 - DNA, 20 bp, Homo sapiens
tatggttcccaataaaagtg

SEQ ID NO: 5443816 - DNA, 23 bp, Homo sapiens
tatggttctcagatcttgacagt

SEQ ID NO: 5443817 - DNA, 20 bp, Homo sapiens
tatggttgatagtttacctg

SEQ ID NO: 5443818 - DNA, 14 bp, Homo sapiens
tatggttgccaccc

SEQ ID NO: 5443819 - DNA, 20 bp, Homo sapiens
tatggttggagagccctgga

SEQ ID NO: 5443820 - DNA, 14 bp, Homo sapiens
tatggtttctgcgt

SEQ ID NO: 5443821 - DNA, 17 bp, Homo sapiens
tatggtttctgcgtgct

SEQ ID NO: 5443822 - DNA, 22 bp, Homo sapiens
tatggtttttgagatattaatg

SEQ ID NO: 5443823 - DNA, 23 bp, Homo sapiens
tatgtaaaaataaccttgcagaa

SEQ ID NO: 5443824 - DNA, 22 bp, Homo sapiens
tatgtaaaaggccaaacctctg

SEQ ID NO: 5443825 - DNA, 20 bp, Homo sapiens
tatgtaaaatgaattgaaaa

SEQ ID NO: 5443826 - DNA, 17 bp, Homo sapiens
tatgtaaacaaatcttt

SEQ ID NO: 5443827 - DNA, 15 bp, Homo sapiens
tatgtaaacaggaga

SEQ ID NO: 5443828 - DNA, 15 bp, Homo sapiens
tatgtaaacagtgag

SEQ ID NO: 5443829 - DNA, 18 bp, Homo sapiens
tatgtaaacataattctt

SEQ ID NO: 5443830 - DNA, 19 bp, Homo sapiens
tatgtaaactgcattagaa

SEQ ID NO: 5443831 - DNA, 23 bp, Homo sapiens
tatgtaaactgcattagaaatta

SEQ ID NO: 5443832 - DNA, 20 bp, Homo sapiens
tatgtaaagtatgtaaacag

SEQ ID NO: 5443833 - DNA, 16 bp, Homo sapiens
tatgtaaataactcta

SEQ ID NO: 5443834 - DNA, 14 bp, Homo sapiens
tatgtaaataattc

SEQ ID NO: 5443835 - DNA, 14 bp, Homo sapiens
tatgtaaatagctt

SEQ ID NO: 5443836 - DNA, 15 bp, Homo sapiens
tatgtaaatatacag

SEQ ID NO: 5443837 - DNA, 22 bp, Homo sapiens
tatgtaaatatacagcatgaga

SEQ ID NO: 5443838 - DNA, 15 bp, Homo sapiens
tatgtaaatcccatt

SEQ ID NO: 5443839 - DNA, 19 bp, Homo sapiens
tatgtaaatcccattattc

SEQ ID NO: 5443840 - DNA, 20 bp, Homo sapiens
tatgtaaatggtatgtcatt

SEQ ID NO: 5443841 - DNA, 14 bp, Homo sapiens
tatgtaaatgtata

SEQ ID NO: 5443842 - DNA, 16 bp, Homo sapiens
tatgtaaattaaatga

SEQ ID NO: 5443843 - DNA, 15 bp, Homo sapiens
tatgtaaattattgt

SEQ ID NO: 5443844 - DNA, 18 bp, Homo sapiens
tatgtaaattattgtaaa

SEQ ID NO: 5443845 - DNA, 15 bp, Homo sapiens
tatgtaaatttttca

SEQ ID NO: 5443846 - DNA, 22 bp, Homo sapiens
tatgtaacaaagtttgctgaaa

SEQ ID NO: 5443847 - DNA, 19 bp, Homo sapiens
tatgtaacaacaattattt

SEQ ID NO: 5443848 - DNA, 16 bp, Homo sapiens
tatgtaacaattgttt

SEQ ID NO: 5443849 - DNA, 21 bp, Homo sapiens
tatgtaacacaggataaagtt

SEQ ID NO: 5443850 - DNA, 22 bp, Homo sapiens
tatgtaacacaggataaagtta

SEQ ID NO: 5443851 - DNA, 18 bp, Homo sapiens
tatgtaacatgatgttaa

SEQ ID NO: 5443852 - DNA, 17 bp, Homo sapiens
tatgtaacatgtctaaa

SEQ ID NO: 5443853 - DNA, 24 bp, Homo sapiens
tatgtaactcctccatccatgtgt

SEQ ID NO: 5443854 - DNA, 24 bp, Homo sapiens
tatgtaactgcattgagaactgca

SEQ ID NO: 5443855 - DNA, 21 bp, Homo sapiens
tatgtaacttcagatgtttcc

SEQ ID NO: 5443856 - DNA, 14 bp, Homo sapiens
tatgtaacttgttg

SEQ ID NO: 5443857 - DNA, 15 bp, Homo sapiens
tatgtaagaagaaac

SEQ ID NO: 5443858 - DNA, 16 bp, Homo sapiens
tatgtaagagcacctt

SEQ ID NO: 5443859 - DNA, 20 bp, Homo sapiens
tatgtaagggctttaaataa

SEQ ID NO: 5443860 - DNA, 21 bp, Homo sapiens
tatgtaaggttttttttgtac

SEQ ID NO: 5443861 - DNA, 14 bp, Homo sapiens
tatgtaagtttcta

SEQ ID NO: 5443862 - DNA, 12 bp, Homo sapiens
tatgtaatactt

SEQ ID NO: 5443863 - DNA, 13 bp, Homo sapiens
tatgtaatataaa

SEQ ID NO: 5443864 - DNA, 18 bp, Homo sapiens
tatgtaatatatacatat

SEQ ID NO: 5443865 - DNA, 23 bp, Homo sapiens
tatgtaatatattgtacaaatgt

SEQ ID NO: 5443866 - DNA, 15 bp, Homo sapiens
tatgtaatatttaca

SEQ ID NO: 5443867 - DNA, 17 bp, Homo sapiens
tatgtaatatttacata

SEQ ID NO: 5443868 - DNA, 14 bp, Homo sapiens
tatgtaatgcaaaa

SEQ ID NO: 5443869 - DNA, 17 bp, Homo sapiens
tatgtaatgtaaaccag

SEQ ID NO: 5443870 - DNA, 12 bp, Homo sapiens
tatgtaattctt

SEQ ID NO: 5443871 - DNA, 16 bp, Homo sapiens
tatgtaatttaataaa

SEQ ID NO: 5443872 - DNA, 15 bp, Homo sapiens
tatgtaatttatgca

SEQ ID NO: 5443873 - DNA, 16 bp, Homo sapiens
tatgtaatttcaaaat

SEQ ID NO: 5443874 - DNA, 22 bp, Homo sapiens
tatgtaatttgtacaggggcca

SEQ ID NO: 5443875 - DNA, 15 bp, Homo sapiens
tatgtacaaaacttt

SEQ ID NO: 5443876 - DNA, 21 bp, Homo sapiens
tatgtacaaaatgaattgcct

SEQ ID NO: 5443877 - DNA, 19 bp, Homo sapiens
tatgtacaaacatgttgtt

SEQ ID NO: 5443878 - DNA, 15 bp, Homo sapiens
tatgtacaaccctga

SEQ ID NO: 5443879 - DNA, 23 bp, Homo sapiens
tatgtacaatattttaagcatta

SEQ ID NO: 5443880 - DNA, 21 bp, Homo sapiens
tatgtacagaaaacatgtata

SEQ ID NO: 5443881 - DNA, 13 bp, Homo sapiens
tatgtacagatga

SEQ ID NO: 5443882 - DNA, 12 bp, Homo sapiens
tatgtacagtta

SEQ ID NO: 5443883 - DNA, 17 bp, Homo sapiens
tatgtacagttatacat

SEQ ID NO: 5443884 - DNA, 18 bp, Homo sapiens
tatgtacagttatacata

SEQ ID NO: 5443885 - DNA, 17 bp, Homo sapiens
tatgtacatacatatat

SEQ ID NO: 5443886 - DNA, 15 bp, Homo sapiens
tatgtacatttctaa

SEQ ID NO: 5443887 - DNA, 15 bp, Homo sapiens
tatgtacatttgtct

SEQ ID NO: 5443888 - DNA, 16 bp, Homo sapiens
tatgtaccatgtacat

SEQ ID NO: 5443889 - DNA, 18 bp, Homo sapiens
tatgtaccctctgaaata

SEQ ID NO: 5443890 - DNA, 19 bp, Homo sapiens
tatgtaccctctgaaatac

SEQ ID NO: 5443891 - DNA, 20 bp, Homo sapiens
tatgtaccctctgaaataca

SEQ ID NO: 5443892 - DNA, 16 bp, Homo sapiens
tatgtacctcttttag

SEQ ID NO: 5443893 - DNA, 21 bp, Homo sapiens
tatgtacgtttgtatgtgtgt

SEQ ID NO: 5443894 - DNA, 22 bp, Homo sapiens
tatgtacgtttgtatgtgtgta

SEQ ID NO: 5443895 - DNA, 18 bp, Homo sapiens
tatgtactagtactgtgt

SEQ ID NO: 5443896 - DNA, 14 bp, Homo sapiens
tatgtactgtaaac

SEQ ID NO: 5443897 - DNA, 15 bp, Homo sapiens
tatgtactgtaaaca

SEQ ID NO: 5443898 - DNA, 20 bp, Homo sapiens
tatgtactgtaaacagttct

SEQ ID NO: 5443899 - DNA, 21 bp, Homo sapiens
tatgtactgttattgaaaata

SEQ ID NO: 5443900 - DNA, 15 bp, Homo sapiens
tatgtacttagctgt

SEQ ID NO: 5443901 - DNA, 17 bp, Homo sapiens
tatgtacttcatgctgt

SEQ ID NO: 5443902 - DNA, 23 bp, Homo sapiens
tatgtacttgaaaataataaagt

SEQ ID NO: 5443903 - DNA, 12 bp, Homo sapiens
tatgtacttgat

SEQ ID NO: 5443904 - DNA, 16 bp, Homo sapiens
tatgtacttgatactg

SEQ ID NO: 5443905 - DNA, 19 bp, Homo sapiens
tatgtacttgatactgaat

SEQ ID NO: 5443906 - DNA, 14 bp, Homo sapiens
tatgtacttgtttg

SEQ ID NO: 5443907 - DNA, 15 bp, Homo sapiens
tatgtacttgtttgc

SEQ ID NO: 5443908 - DNA, 23 bp, Homo sapiens
tatgtactttgatttacagtgcc

SEQ ID NO: 5443909 - DNA, 17 bp, Homo sapiens
tatgtagactatataca

SEQ ID NO: 5443910 - DNA, 19 bp, Homo sapiens
tatgtagactatatacatg

SEQ ID NO: 5443911 - DNA, 17 bp, Homo sapiens
tatgtagatatttggct

SEQ ID NO: 5443912 - DNA, 20 bp, Homo sapiens
tatgtagatgtatgcacaca

SEQ ID NO: 5443913 - DNA, 14 bp, Homo sapiens
tatgtagattgcct

SEQ ID NO: 5443914 - DNA, 15 bp, Homo sapiens
tatgtagctctttgt

SEQ ID NO: 5443915 - DNA, 17 bp, Homo sapiens
tatgtagctttatcctt

SEQ ID NO: 5443916 - DNA, 18 bp, Homo sapiens
tatgtaggaaaaaaatag

SEQ ID NO: 5443917 - DNA, 15 bp, Homo sapiens
tatgtaggaaaattt

SEQ ID NO: 5443918 - DNA, 23 bp, Homo sapiens
tatgtaggaaaattttcttcttt

SEQ ID NO: 5443919 - DNA, 23 bp, Homo sapiens
tatgtttctctttgattatttgc

SEQ ID NO: 5443920 - DNA, 12 bp, Homo sapiens
tatgtttcttct

SEQ ID NO: 5443921 - DNA, 15 bp, Homo sapiens
tatgtttgaaaatag

SEQ ID NO: 5443922 - DNA, 20 bp, Homo sapiens
tatgtttgaaaataggattt

SEQ ID NO: 5443923 - DNA, 23 bp, Homo sapiens
tatgtttgctcagaacacattct

SEQ ID NO: 5443924 - DNA, 18 bp, Homo sapiens
tatgtttgctgattattt

SEQ ID NO: 5443925 - DNA, 17 bp, Homo sapiens
tatgtttggctgaaatt

SEQ ID NO: 5443926 - DNA, 14 bp, Homo sapiens
tatgtttgtaactt

SEQ ID NO: 5443927 - DNA, 12 bp, Homo sapiens
tatgtttgtaca

SEQ ID NO: 5443928 - DNA, 21 bp, Homo sapiens
tatgttttaaagttaaaactg

SEQ ID NO: 5443929 - DNA, 17 bp, Homo sapiens
tatgttttaagaggcag

SEQ ID NO: 5443930 - DNA, 17 bp, Homo sapiens
tatgttttaatatccta

SEQ ID NO: 5443931 - DNA, 17 bp, Homo sapiens
tatgttttacactgtac

SEQ ID NO: 5443932 - DNA, 14 bp, Homo sapiens
tatgttttagcatg

SEQ ID NO: 5443933 - DNA, 17 bp, Homo sapiens
tatgttttatatcaaat

SEQ ID NO: 5443934 - DNA, 16 bp, Homo sapiens
tatgttttatttaaat

SEQ ID NO: 5443935 - DNA, 18 bp, Homo sapiens
tatgttttatttaaatgc

SEQ ID NO: 5443936 - DNA, 21 bp, Homo sapiens
tatgttttcaggctagatgta

SEQ ID NO: 5443937 - DNA, 17 bp, Homo sapiens
tatgttttccacataaa

SEQ ID NO: 5443938 - DNA, 18 bp, Homo sapiens
tatgttttcgaaaatcaa

SEQ ID NO: 5443939 - DNA, 22 bp, Homo sapiens
tatgttttgacatttttagttt

SEQ ID NO: 5443940 - DNA, 11 bp, Homo sapiens
tatgttttgga

SEQ ID NO: 5443941 - DNA, 21 bp, Homo sapiens
tatgttttgttttgtgttttt

SEQ ID NO: 5443942 - DNA, 21 bp, Homo sapiens
tatgtttttacattatgcaaa

SEQ ID NO: 5443943 - DNA, 22 bp, Homo sapiens
tatgtttttacattatgcaaat

SEQ ID NO: 5443944 - DNA, 11 bp, Homo sapiens
tatgtttttca

SEQ ID NO: 5443945 - DNA, 14 bp, Homo sapiens
tatgtttttcagtt

SEQ ID NO: 5443946 - DNA, 15 bp, Homo sapiens
tatgtttttcagttc

SEQ ID NO: 5443947 - DNA, 20 bp, Homo sapiens
tatgtttttcagttcaaagt

SEQ ID NO: 5443948 - DNA, 18 bp, Homo sapiens
tatgtttttgtgtatttg

SEQ ID NO: 5443949 - DNA, 23 bp, Homo sapiens
tatgtttttgttcagtttatctg

SEQ ID NO: 5443950 - DNA, 17 bp, Homo sapiens
tatgttttttagatcaa

SEQ ID NO: 5443951 - DNA, 18 bp, Homo sapiens
tatgttttttattatgct

SEQ ID NO: 5443952 - DNA, 22 bp, Homo sapiens
tatgttttttttctgctggaaa

SEQ ID NO: 5443953 - DNA, 21 bp, Homo sapiens
tattaaaaaaacacaaaaaaa

SEQ ID NO: 5443954 - DNA, 18 bp, Homo sapiens
tattaaaaaaactggcct

SEQ ID NO: 5443955 - DNA, 14 bp, Homo sapiens
tattaaaaaacaat

SEQ ID NO: 5443956 - DNA, 21 bp, Homo sapiens
tattaaaaaacaattaactgc

SEQ ID NO: 5443957 - DNA, 14 bp, Homo sapiens
tattaaaaacatga

SEQ ID NO: 5443958 - DNA, 16 bp, Homo sapiens
tattaaaaacatgacc

SEQ ID NO: 5443959 - DNA, 14 bp, Homo sapiens
tattaaaaagaagt

SEQ ID NO: 5443960 - DNA, 14 bp, Homo sapiens
tattaaaaatagat

SEQ ID NO: 5443961 - DNA, 13 bp, Homo sapiens
tattaaaaatata

SEQ ID NO: 5443962 - DNA, 15 bp, Homo sapiens
tattaaaaatataaa

SEQ ID NO: 5443963 - DNA, 18 bp, Homo sapiens
tattaaaaatctcaaatt

SEQ ID NO: 5443964 - DNA, 14 bp, Homo sapiens
tattaaaaatgttc

SEQ ID NO: 5443965 - DNA, 16 bp, Homo sapiens
tattaaaaatgttctc

SEQ ID NO: 5443966 - DNA, 17 bp, Homo sapiens
tattaaaaatgttctca

SEQ ID NO: 5443967 - DNA, 19 bp, Homo sapiens
tattaaaaattaattcttt

SEQ ID NO: 5443968 - DNA, 20 bp, Homo sapiens
tattaaaaattaattcttta

SEQ ID NO: 5443969 - DNA, 11 bp, Homo sapiens
tattaaaacac

SEQ ID NO: 5443970 - DNA, 17 bp, Homo sapiens
tattaaaacattggatt

SEQ ID NO: 5443971 - DNA, 13 bp, Homo sapiens
tattaaaacattt

SEQ ID NO: 5443972 - DNA, 16 bp, Homo sapiens
tattaaaactcagcct

SEQ ID NO: 5443973 - DNA, 22 bp, Homo sapiens
tattaaaagtcacaatgttctt

SEQ ID NO: 5443974 - DNA, 14 bp, Homo sapiens
tattaaaatatatt

SEQ ID NO: 5443975 - DNA, 11 bp, Homo sapiens
tattaaaatct

SEQ ID NO: 5443976 - DNA, 13 bp, Homo sapiens
tattaaaatctta

SEQ ID NO: 5443977 - DNA, 18 bp, Homo sapiens
tattaaaatgattgtaaa

SEQ ID NO: 5443978 - DNA, 19 bp, Homo sapiens
tattaaaatgattgtaaaa

SEQ ID NO: 5443979 - DNA, 22 bp, Homo sapiens
tattaaaatgattgtaaaatag

SEQ ID NO: 5443980 - DNA, 12 bp, Homo sapiens
tattaaaatgca

SEQ ID NO: 5443981 - DNA, 21 bp, Homo sapiens
tattaaaatgcatatttctat

SEQ ID NO: 5443982 - DNA, 15 bp, Homo sapiens
tattaaaatgtaact

SEQ ID NO: 5443983 - DNA, 15 bp, Homo sapiens
tattaaaattacaga

SEQ ID NO: 5443984 - DNA, 21 bp, Homo sapiens
tattaaaattacagatgtgaa

SEQ ID NO: 5443985 - DNA, 19 bp, Homo sapiens
tattaaaattccaaattca

SEQ ID NO: 5443986 - DNA, 15 bp, Homo sapiens
tattaaaattctgaa

SEQ ID NO: 5443987 - DNA, 19 bp, Homo sapiens
tattaaaattctgaatttt

SEQ ID NO: 5443988 - DNA, 22 bp, Homo sapiens
tattaaaattctgatgtttctg

SEQ ID NO: 5443989 - DNA, 23 bp, Homo sapiens
tattaaaattctgatgtttctgt

SEQ ID NO: 5443990 - DNA, 16 bp, Homo sapiens
tattaaaattgccatt

SEQ ID NO: 5443991 - DNA, 17 bp, Homo sapiens
tattaaaattgccattt

SEQ ID NO: 5443992 - DNA, 15 bp, Homo sapiens
tattaaaattgttgt

SEQ ID NO: 5443993 - DNA, 16 bp, Homo sapiens
tattaaaattgttgtc

SEQ ID NO: 5443994 - DNA, 13 bp, Homo sapiens
tattaaacaaagt

SEQ ID NO: 5443995 - DNA, 16 bp, Homo sapiens
tattaaacaattttgt

SEQ ID NO: 5443996 - DNA, 23 bp, Homo sapiens
tattaaacagatatcttcagttt

SEQ ID NO: 5443997 - DNA, 19 bp, Homo sapiens
tattaaacatgctgtacat

SEQ ID NO: 5443998 - DNA, 16 bp, Homo sapiens
tattaaacctttcagt

SEQ ID NO: 5443999 - DNA, 12 bp, Homo sapiens
tattaaactgaa

SEQ ID NO: 5444000 - DNA, 12 bp, Homo sapiens
tattaaactgta

SEQ ID NO: 5444001 - DNA, 18 bp, Homo sapiens
tattaaactgtaaatcat

SEQ ID NO: 5444002 - DNA, 15 bp, Homo sapiens
tattaaacttcagca

SEQ ID NO: 5444003 - DNA, 17 bp, Homo sapiens
tattaaacttgtcagaa

SEQ ID NO: 5444004 - DNA, 18 bp, Homo sapiens
tattaaacttgtcagaat

SEQ ID NO: 5444005 - DNA, 15 bp, Homo sapiens
tattaaacttttcat

SEQ ID NO: 5444006 - DNA, 13 bp, Homo sapiens
tattaaagaaaaa

SEQ ID NO: 5444007 - DNA, 14 bp, Homo sapiens
tattaaagaaaaac

SEQ ID NO: 5444008 - DNA, 16 bp, Homo sapiens
tattaaagaaaaatgc

SEQ ID NO: 5444009 - DNA, 13 bp, Homo sapiens
tattaaagaatgc

SEQ ID NO: 5444010 - DNA, 21 bp, Homo sapiens
tattaaagaatgctgcaactt

SEQ ID NO: 5444011 - DNA, 12 bp, Homo sapiens
tattaaagacag

SEQ ID NO: 5444012 - DNA, 12 bp, Homo sapiens
tattaaagataa

SEQ ID NO: 5444013 - DNA, 20 bp, Homo sapiens
tattaaagatatcaatacta

SEQ ID NO: 5444014 - DNA, 17 bp, Homo sapiens
tattaaagatatttctt

SEQ ID NO: 5444015 - DNA, 22 bp, Homo sapiens
tattaaagatatttctttaaat

SEQ ID NO: 5444016 - DNA, 17 bp, Homo sapiens
tattaaagattctcttt

SEQ ID NO: 5444017 - DNA, 20 bp, Homo sapiens
tattaaagattctctttaaa

SEQ ID NO: 5444018 - DNA, 20 bp, Homo sapiens
tattaaagatttatttagct

SEQ ID NO: 5444019 - DNA, 21 bp, Homo sapiens
tattaaagatttatttagcta

SEQ ID NO: 5444020 - DNA, 12 bp, Homo sapiens
tattaaaggctt

SEQ ID NO: 5444021 - DNA, 23 bp, Homo sapiens
tattaaaggtgaaaattgtataa

SEQ ID NO: 5444022 - DNA, 18 bp, Homo sapiens
tattaaaggttaaattgc

SEQ ID NO: 5444023 - DNA, 16 bp, Homo sapiens
tattaaagtaatttac

SEQ ID NO: 5444024 - DNA, 14 bp, Homo sapiens
tattaaagtattct

SEQ ID NO: 5444025 - DNA, 17 bp, Homo sapiens
tattaaagtctgagaaa

SEQ ID NO: 5444026 - DNA, 13 bp, Homo sapiens
tattaaagtgcca

SEQ ID NO: 5444027 - DNA, 14 bp, Homo sapiens
tattaaagtgccat

SEQ ID NO: 5444028 - DNA, 22 bp, Homo sapiens
tattaaagtgctaaggttctaa

SEQ ID NO: 5444029 - DNA, 16 bp, Homo sapiens
tattaaagtggagaag

SEQ ID NO: 5444030 - DNA, 15 bp, Homo sapiens
tattaaataaaatca

SEQ ID NO: 5444031 - DNA, 15 bp, Homo sapiens
tattaaataacatgt

SEQ ID NO: 5444032 - DNA, 18 bp, Homo sapiens
tattaaatacagacacta

SEQ ID NO: 5444033 - DNA, 23 bp, Homo sapiens
tattaaatatatgattagccagg

SEQ ID NO: 5444034 - DNA, 11 bp, Homo sapiens
tattaaatatt

SEQ ID NO: 5444035 - DNA, 15 bp, Homo sapiens
tattaaatatttaac

SEQ ID NO: 5444036 - DNA, 21 bp, Homo sapiens
tattaaatatttaacataggt

SEQ ID NO: 5444037 - DNA, 12 bp, Homo sapiens
tattaaatcaga

SEQ ID NO: 5444038 - DNA, 20 bp, Homo sapiens
tattaaatcagttttgtgta

SEQ ID NO: 5444039 - DNA, 20 bp, Homo sapiens
tattaaatcgtttaatgttt

SEQ ID NO: 5444040 - DNA, 20 bp, Homo sapiens
tattaaatcttaaacaatgt

SEQ ID NO: 5444041 - DNA, 21 bp, Homo sapiens
tattaaatcttaaacaatgta

SEQ ID NO: 5444042 - DNA, 13 bp, Homo sapiens
tattaaatctttt

SEQ ID NO: 5444043 - DNA, 15 bp, Homo sapiens
tattaaatgcccagc

SEQ ID NO: 5444044 - DNA, 17 bp, Homo sapiens
tattaaatggaaactga

SEQ ID NO: 5444045 - DNA, 19 bp, Homo sapiens
tattaaatggaaactgaaa

SEQ ID NO: 5444046 - DNA, 17 bp, Homo sapiens
tattaaatgtaagtcgt

SEQ ID NO: 5444047 - DNA, 13 bp, Homo sapiens
tattaaatgtatt

SEQ ID NO: 5444048 - DNA, 11 bp, Homo sapiens
tattaaatgtt

SEQ ID NO: 5444049 - DNA, 21 bp, Homo sapiens
tattaaatgttgcacatcatt

SEQ ID NO: 5444050 - DNA, 19 bp, Homo sapiens
tattaaatgtttcaaaata

SEQ ID NO: 5444051 - DNA, 19 bp, Homo sapiens
tattaaattaaattttgtg

SEQ ID NO: 5444052 - DNA, 20 bp, Homo sapiens
tattaaattacatttgtaat

SEQ ID NO: 5444053 - DNA, 21 bp, Homo sapiens
tattaaattagacttcctgta

SEQ ID NO: 5444054 - DNA, 12 bp, Homo sapiens
tattaaattatg

SEQ ID NO: 5444055 - DNA, 19 bp, Homo sapiens
tattaaattctgaatgcaa

SEQ ID NO: 5444056 - DNA, 19 bp, Homo sapiens
tattaaattgtgattgttt

SEQ ID NO: 5444057 - DNA, 20 bp, Homo sapiens
tattaaattgtgtacacttt

SEQ ID NO: 5444058 - DNA, 22 bp, Homo sapiens
tattaaatttgttgacaaaatt

SEQ ID NO: 5444059 - DNA, 19 bp, Homo sapiens
tattaaattttttgttgac

SEQ ID NO: 5444060 - DNA, 21 bp, Homo sapiens
tattaaatttttttgtatgaa

SEQ ID NO: 5444061 - DNA, 23 bp, Homo sapiens
tattaaatttttttgtatgaaaa

SEQ ID NO: 5444062 - DNA, 23 bp, Homo sapiens
tattaacaaacatcactctgctg

SEQ ID NO: 5444063 - DNA, 19 bp, Homo sapiens
tattaacaaattgcatttg

SEQ ID NO: 5444064 - DNA, 23 bp, Homo sapiens
tattaacaacaataacactgtct

SEQ ID NO: 5444065 - DNA, 16 bp, Homo sapiens
tattaacaactgtgaa

SEQ ID NO: 5444066 - DNA, 21 bp, Homo sapiens
tattaacaactgtgaatatga

SEQ ID NO: 5444067 - DNA, 19 bp, Homo sapiens
tattaacaattaattgtct

SEQ ID NO: 5444068 - DNA, 18 bp, Homo sapiens
tattaacacgctgcctgg

SEQ ID NO: 5444069 - DNA, 13 bp, Homo sapiens
tattaacatacct

SEQ ID NO: 5444070 - DNA, 18 bp, Homo sapiens
tattaacatattatttca

SEQ ID NO: 5444071 - DNA, 18 bp, Homo sapiens
tattaacatattctaaat

SEQ ID NO: 5444072 - DNA, 15 bp, Homo sapiens
tattaacatgcaata

SEQ ID NO: 5444073 - DNA, 16 bp, Homo sapiens
tattaacatgcaataa

SEQ ID NO: 5444074 - DNA, 16 bp, Homo sapiens
tattaacctacctgtg

SEQ ID NO: 5444075 - DNA, 17 bp, Homo sapiens
tattaacctcagcattt

SEQ ID NO: 5444076 - DNA, 14 bp, Homo sapiens
tattaacctcttaa

SEQ ID NO: 5444077 - DNA, 13 bp, Homo sapiens
tattaacgctaaa

SEQ ID NO: 5444078 - DNA, 15 bp, Homo sapiens
tattaacgctgagat

SEQ ID NO: 5444079 - DNA, 18 bp, Homo sapiens
tattaactacatttatga

SEQ ID NO: 5444080 - DNA, 17 bp, Homo sapiens
tattaactactgtagaa

SEQ ID NO: 5444081 - DNA, 17 bp, Homo sapiens
tattaactcaaaagttg

SEQ ID NO: 5444082 - DNA, 21 bp, Homo sapiens
tattaactctgtaaaagtgtc

SEQ ID NO: 5444083 - DNA, 12 bp, Homo sapiens
tattaactgaaa

SEQ ID NO: 5444084 - DNA, 18 bp, Homo sapiens
tattaacttaataatcaa

SEQ ID NO: 5444085 - DNA, 23 bp, Homo sapiens
tattaacttgtagattcagtggt

SEQ ID NO: 5444086 - DNA, 18 bp, Homo sapiens
tattaacttgtattttct

SEQ ID NO: 5444087 - DNA, 16 bp, Homo sapiens
tattaacttttaatgg

SEQ ID NO: 5444088 - DNA, 13 bp, Homo sapiens
tattaactttttt

SEQ ID NO: 5444089 - DNA, 15 bp, Homo sapiens
tattaagaaaatatt

SEQ ID NO: 5444090 - DNA, 18 bp, Homo sapiens
tattaagaaaatattcta

SEQ ID NO: 5444091 - DNA, 16 bp, Homo sapiens
tattaagaaagactat

SEQ ID NO: 5444092 - DNA, 14 bp, Homo sapiens
tattaagaaaggaa

SEQ ID NO: 5444093 - DNA, 16 bp, Homo sapiens
tattaagaacatttta

SEQ ID NO: 5444094 - DNA, 18 bp, Homo sapiens
tattaagaatagtctctg

SEQ ID NO: 5444095 - DNA, 21 bp, Homo sapiens
tattaagaatagtctctgggt

SEQ ID NO: 5444096 - DNA, 16 bp, Homo sapiens
tattaagaatgaaata

SEQ ID NO: 5444097 - DNA, 19 bp, Homo sapiens
tattaagaatttaagactt

SEQ ID NO: 5444098 - DNA, 17 bp, Homo sapiens
tattatgcaaaatttag

SEQ ID NO: 5444099 - DNA, 22 bp, Homo sapiens
tattatgcaaaatttagaagaa

SEQ ID NO: 5444100 - DNA, 20 bp, Homo sapiens
tattatgcataactgacaaa

SEQ ID NO: 5444101 - DNA, 19 bp, Homo sapiens
tattatgcattatatcaaa

SEQ ID NO: 5444102 - DNA, 24 bp, Homo sapiens
tattatgcccagtttctgcctctg

SEQ ID NO: 5444103 - DNA, 20 bp, Homo sapiens
tattatgccccagttcagaa

SEQ ID NO: 5444104 - DNA, 21 bp, Homo sapiens
tattatgccccagttcagaaa

SEQ ID NO: 5444105 - DNA, 16 bp, Homo sapiens
tattatgccttgagaa

SEQ ID NO: 5444106 - DNA, 18 bp, Homo sapiens
tattatgctgctttaaca

SEQ ID NO: 5444107 - DNA, 19 bp, Homo sapiens
tattatgctttattggaaa

SEQ ID NO: 5444108 - DNA, 15 bp, Homo sapiens
tattatggcaagtga

SEQ ID NO: 5444109 - DNA, 15 bp, Homo sapiens
tattatggcttgtga

SEQ ID NO: 5444110 - DNA, 20 bp, Homo sapiens
tattatggcttgtgaactgc

SEQ ID NO: 5444111 - DNA, 21 bp, Homo sapiens
tattatggcttgtgaactgct

SEQ ID NO: 5444112 - DNA, 18 bp, Homo sapiens
tattatggtgatactcca

SEQ ID NO: 5444113 - DNA, 22 bp, Homo sapiens
tattatggtgatactccaaggt

SEQ ID NO: 5444114 - DNA, 17 bp, Homo sapiens
tattatggtgtaatgca

SEQ ID NO: 5444115 - DNA, 19 bp, Homo sapiens
tattatggtgtaatgcaca

SEQ ID NO: 5444116 - DNA, 21 bp, Homo sapiens
tattatggtgtaatgcacaat

SEQ ID NO: 5444117 - DNA, 23 bp, Homo sapiens
tattatggtgtaatgcacaattt

SEQ ID NO: 5444118 - DNA, 12 bp, Homo sapiens
tattatgtaaat

SEQ ID NO: 5444119 - DNA, 15 bp, Homo sapiens
tattatgtaaatatg

SEQ ID NO: 5444120 - DNA, 15 bp, Homo sapiens
tattatgtagttgtt

SEQ ID NO: 5444121 - DNA, 17 bp, Homo sapiens
tattatgtctcttctga

SEQ ID NO: 5444122 - DNA, 15 bp, Homo sapiens
tattatgtcttattt

SEQ ID NO: 5444123 - DNA, 14 bp, Homo sapiens
tattatgtcttctt

SEQ ID NO: 5444124 - DNA, 16 bp, Homo sapiens
tattatgtgaagaatt

SEQ ID NO: 5444125 - DNA, 16 bp, Homo sapiens
tattatgttaaaactg

SEQ ID NO: 5444126 - DNA, 14 bp, Homo sapiens
tattatgttatgaa

SEQ ID NO: 5444127 - DNA, 22 bp, Homo sapiens
tattatgttcttagcaataaat

SEQ ID NO: 5444128 - DNA, 14 bp, Homo sapiens
tattatgttgttca

SEQ ID NO: 5444129 - DNA, 12 bp, Homo sapiens
tattatgtttaa

SEQ ID NO: 5444130 - DNA, 19 bp, Homo sapiens
tattattaaatcagttttg

SEQ ID NO: 5444131 - DNA, 14 bp, Homo sapiens
tattattaaatgta

SEQ ID NO: 5444132 - DNA, 21 bp, Homo sapiens
tattattaaggtaactactgc

SEQ ID NO: 5444133 - DNA, 14 bp, Homo sapiens
tattattaatgctt

SEQ ID NO: 5444134 - DNA, 16 bp, Homo sapiens
tattattaatgctttg

SEQ ID NO: 5444135 - DNA, 19 bp, Homo sapiens
tattattaatttattgggg

SEQ ID NO: 5444136 - DNA, 18 bp, Homo sapiens
tattattacttgtaaata

SEQ ID NO: 5444137 - DNA, 15 bp, Homo sapiens
tattattattactgt

SEQ ID NO: 5444138 - DNA, 13 bp, Homo sapiens
tattattattata

SEQ ID NO: 5444139 - DNA, 17 bp, Homo sapiens
tattattattatacttc

SEQ ID NO: 5444140 - DNA, 14 bp, Homo sapiens
tattattattatat

SEQ ID NO: 5444141 - DNA, 16 bp, Homo sapiens
tattattattattttc

SEQ ID NO: 5444142 - DNA, 14 bp, Homo sapiens
tattattatttatt

SEQ ID NO: 5444143 - DNA, 18 bp, Homo sapiens
tattattcaaaccaattt

SEQ ID NO: 5444144 - DNA, 18 bp, Homo sapiens
tattattcaccatgtaaa

SEQ ID NO: 5444145 - DNA, 21 bp, Homo sapiens
tattattccgtattacatttt

SEQ ID NO: 5444146 - DNA, 13 bp, Homo sapiens
tattattctgcag

SEQ ID NO: 5444147 - DNA, 16 bp, Homo sapiens
tattattgaaattgta

SEQ ID NO: 5444148 - DNA, 16 bp, Homo sapiens
tattattgctgttgct

SEQ ID NO: 5444149 - DNA, 18 bp, Homo sapiens
tattattgctgttgcttg

SEQ ID NO: 5444150 - DNA, 19 bp, Homo sapiens
tattattgctgttgcttga

SEQ ID NO: 5444151 - DNA, 21 bp, Homo sapiens
tattattgtggtaggcctttt

SEQ ID NO: 5444152 - DNA, 15 bp, Homo sapiens
tattattgtgtgtta

SEQ ID NO: 5444153 - DNA, 12 bp, Homo sapiens
tattattgttct

SEQ ID NO: 5444154 - DNA, 16 bp, Homo sapiens
tattatttacaatgca

SEQ ID NO: 5444155 - DNA, 22 bp, Homo sapiens
tattatttacatcactttgtga

SEQ ID NO: 5444156 - DNA, 23 bp, Homo sapiens
tattatttacatcactttgtgaa

SEQ ID NO: 5444157 - DNA, 22 bp, Homo sapiens
tattatttaccgttgcttgaaa

SEQ ID NO: 5444158 - DNA, 23 bp, Homo sapiens
tattatttagtaaaattatctgt

SEQ ID NO: 5444159 - DNA, 22 bp, Homo sapiens
tattatttattttttttaattg

SEQ ID NO: 5444160 - DNA, 18 bp, Homo sapiens
tattatttcaccagcagc

SEQ ID NO: 5444161 - DNA, 17 bp, Homo sapiens
tattatttcattggtct

SEQ ID NO: 5444162 - DNA, 13 bp, Homo sapiens
tattatttctaaa

SEQ ID NO: 5444163 - DNA, 22 bp, Homo sapiens
tattatttctgttcttacaaat

SEQ ID NO: 5444164 - DNA, 16 bp, Homo sapiens
tattatttcttctctt

SEQ ID NO: 5444165 - DNA, 15 bp, Homo sapiens
tattatttgaatgga

SEQ ID NO: 5444166 - DNA, 16 bp, Homo sapiens
tattatttgatgatac

SEQ ID NO: 5444167 - DNA, 17 bp, Homo sapiens
tattatttgatgatact

SEQ ID NO: 5444168 - DNA, 21 bp, Homo sapiens
tattatttgcagtgcagtata

SEQ ID NO: 5444169 - DNA, 15 bp, Homo sapiens
tattatttggagtta

SEQ ID NO: 5444170 - DNA, 22 bp, Homo sapiens
tattatttgggggaactggaca

SEQ ID NO: 5444171 - DNA, 16 bp, Homo sapiens
tattatttgtatgtat

SEQ ID NO: 5444172 - DNA, 18 bp, Homo sapiens
tattatttgtatgtatta

SEQ ID NO: 5444173 - DNA, 16 bp, Homo sapiens
tattatttgtcttaaa

SEQ ID NO: 5444174 - DNA, 17 bp, Homo sapiens
tattattttaaaaattg

SEQ ID NO: 5444175 - DNA, 15 bp, Homo sapiens
tattattttaaattt

SEQ ID NO: 5444176 - DNA, 13 bp, Homo sapiens
tattattttaata

SEQ ID NO: 5444177 - DNA, 13 bp, Homo sapiens
tattattttactg

SEQ ID NO: 5444178 - DNA, 22 bp, Homo sapiens
tattattttagcttcagttgtt

SEQ ID NO: 5444179 - DNA, 19 bp, Homo sapiens
tattattttagtgtgtaaa

SEQ ID NO: 5444180 - DNA, 21 bp, Homo sapiens
tattattttagtgtgtaaaat

SEQ ID NO: 5444181 - DNA, 23 bp, Homo sapiens
tattattttagtgtgtaaaatta

SEQ ID NO: 5444182 - DNA, 12 bp, Homo sapiens
tattattttcaa

SEQ ID NO: 5444183 - DNA, 13 bp, Homo sapiens
tattattttcaaa

SEQ ID NO: 5444184 - DNA, 13 bp, Homo sapiens
tattattttccaa

SEQ ID NO: 5444185 - DNA, 16 bp, Homo sapiens
tattattttctatagc

SEQ ID NO: 5444186 - DNA, 18 bp, Homo sapiens
tattattttggggtctct

SEQ ID NO: 5444187 - DNA, 20 bp, Homo sapiens
tattatttttacctaaagac

SEQ ID NO: 5444188 - DNA, 20 bp, Homo sapiens
tattatttttataattgtac

SEQ ID NO: 5444189 - DNA, 17 bp, Homo sapiens
tattatttttctctctc

SEQ ID NO: 5444190 - DNA, 18 bp, Homo sapiens
tattatttttttaaacaa

SEQ ID NO: 5444191 - DNA, 19 bp, Homo sapiens
tattatttttttaaacaaa

SEQ ID NO: 5444192 - DNA, 21 bp, Homo sapiens
tattcaaaaaatcatgtttat

SEQ ID NO: 5444193 - DNA, 15 bp, Homo sapiens
tattcaaaatatttt

SEQ ID NO: 5444194 - DNA, 15 bp, Homo sapiens
tattcaaacacacag

SEQ ID NO: 5444195 - DNA, 16 bp, Homo sapiens
tattcaaacacacagt

SEQ ID NO: 5444196 - DNA, 23 bp, Homo sapiens
tattcaaaccaatttcttccttc

SEQ ID NO: 5444197 - DNA, 14 bp, Homo sapiens
tattcaaactgaaa

SEQ ID NO: 5444198 - DNA, 16 bp, Homo sapiens
tattcaaagagaaaac

SEQ ID NO: 5444199 - DNA, 22 bp, Homo sapiens
tattcaaagatgataatttagt

SEQ ID NO: 5444200 - DNA, 14 bp, Homo sapiens
tattcaaagtatat

SEQ ID NO: 5444201 - DNA, 13 bp, Homo sapiens
tattcaaagttgc

SEQ ID NO: 5444202 - DNA, 21 bp, Homo sapiens
tattcaaagttgcctaaatcc

SEQ ID NO: 5444203 - DNA, 19 bp, Homo sapiens
tattcaaatgaaggtggtt

SEQ ID NO: 5444204 - DNA, 15 bp, Homo sapiens
tattcaaatttgatg

SEQ ID NO: 5444205 - DNA, 14 bp, Homo sapiens
tattcaaatttgta

SEQ ID NO: 5444206 - DNA, 16 bp, Homo sapiens
tattcaaatttgtaca

SEQ ID NO: 5444207 - DNA, 17 bp, Homo sapiens
tattcaaatttgtacag

SEQ ID NO: 5444208 - DNA, 14 bp, Homo sapiens
tattcaacacactg

SEQ ID NO: 5444209 - DNA, 19 bp, Homo sapiens
tattcaacacactgcctta

SEQ ID NO: 5444210 - DNA, 19 bp, Homo sapiens
tattcaactaatacatggt

SEQ ID NO: 5444211 - DNA, 18 bp, Homo sapiens
tattcaactattcttcat

SEQ ID NO: 5444212 - DNA, 20 bp, Homo sapiens
tattcaactattcttcattt

SEQ ID NO: 5444213 - DNA, 22 bp, Homo sapiens
tattcaagaaagccagtcttaa

SEQ ID NO: 5444214 - DNA, 23 bp, Homo sapiens
tattcaagaaagtgaaaaaaaca

SEQ ID NO: 5444215 - DNA, 17 bp, Homo sapiens
tattcaagaatgaaaaa

SEQ ID NO: 5444216 - DNA, 18 bp, Homo sapiens
tattcaaggagcaagaaa

SEQ ID NO: 5444217 - DNA, 16 bp, Homo sapiens
tattcaagtaacactt

SEQ ID NO: 5444218 - DNA, 17 bp, Homo sapiens
tattcaagtaacacttt

SEQ ID NO: 5444219 - DNA, 15 bp, Homo sapiens
tattcaagtgcctct

SEQ ID NO: 5444220 - DNA, 19 bp, Homo sapiens
tattcaataaagtatttaa

SEQ ID NO: 5444221 - DNA, 21 bp, Homo sapiens
tattcaataccgctcagtatt

SEQ ID NO: 5444222 - DNA, 23 bp, Homo sapiens
tattcaatgaacttccatttgta

SEQ ID NO: 5444223 - DNA, 14 bp, Homo sapiens
tattcaatgcaagt

SEQ ID NO: 5444224 - DNA, 13 bp, Homo sapiens
tattcaatgcaat

SEQ ID NO: 5444225 - DNA, 22 bp, Homo sapiens
tattcaatgcaatgcaattcaa

SEQ ID NO: 5444226 - DNA, 13 bp, Homo sapiens
tattcaatgcatt

SEQ ID NO: 5444227 - DNA, 19 bp, Homo sapiens
tattcaatgcatttaaaat

SEQ ID NO: 5444228 - DNA, 22 bp, Homo sapiens
tattcacaacctcaccaaacta

SEQ ID NO: 5444229 - DNA, 14 bp, Homo sapiens
tattcacacacaca

SEQ ID NO: 5444230 - DNA, 23 bp, Homo sapiens
tattcacagaaagctagatatgc

SEQ ID NO: 5444231 - DNA, 13 bp, Homo sapiens
tattcacagtttt

SEQ ID NO: 5444232 - DNA, 17 bp, Homo sapiens
tattcaccaatgttgta

SEQ ID NO: 5444233 - DNA, 13 bp, Homo sapiens
tattcaccaccct

SEQ ID NO: 5444234 - DNA, 16 bp, Homo sapiens
tattcaccatcatgta

SEQ ID NO: 5444235 - DNA, 19 bp, Homo sapiens
tattcaccatgtaaaacaa

SEQ ID NO: 5444236 - DNA, 16 bp, Homo sapiens
tattcaccctccactt

SEQ ID NO: 5444237 - DNA, 20 bp, Homo sapiens
tattcaccctccacttcccg

SEQ ID NO: 5444238 - DNA, 15 bp, Homo sapiens
tattcaccttcagtt

SEQ ID NO: 5444239 - DNA, 23 bp, Homo sapiens
tattcacgccattggttggaagc

SEQ ID NO: 5444240 - DNA, 19 bp, Homo sapiens
tattcacgccgtaattctt

SEQ ID NO: 5444241 - DNA, 23 bp, Homo sapiens
tattcacgtgcagcagcaacaca

SEQ ID NO: 5444242 - DNA, 14 bp, Homo sapiens
tattcactctccat

SEQ ID NO: 5444243 - DNA, 16 bp, Homo sapiens
tattcactctccatta

SEQ ID NO: 5444244 - DNA, 13 bp, Homo sapiens
tattcactgattt

SEQ ID NO: 5444245 - DNA, 19 bp, Homo sapiens
tattcactgatttgacata

SEQ ID NO: 5444246 - DNA, 22 bp, Homo sapiens
tattcactgatttgacatagtc

SEQ ID NO: 5444247 - DNA, 14 bp, Homo sapiens
tattcactgtaagt

SEQ ID NO: 5444248 - DNA, 15 bp, Homo sapiens
tattcagaaattaaa

SEQ ID NO: 5444249 - DNA, 18 bp, Homo sapiens
tattcagaaattaaaata

SEQ ID NO: 5444250 - DNA, 18 bp, Homo sapiens
tattcagaactatttaaa

SEQ ID NO: 5444251 - DNA, 17 bp, Homo sapiens
tattcagaagacacaga

SEQ ID NO: 5444252 - DNA, 19 bp, Homo sapiens
tattcagaatcaaaccttt

SEQ ID NO: 5444253 - DNA, 18 bp, Homo sapiens
tattcagaattatacaga

SEQ ID NO: 5444254 - DNA, 17 bp, Homo sapiens
tattcagagatgtacca

SEQ ID NO: 5444255 - DNA, 14 bp, Homo sapiens
tattcagaggcagt

SEQ ID NO: 5444256 - DNA, 21 bp, Homo sapiens
tattcagatcgtattaattat

SEQ ID NO: 5444257 - DNA, 15 bp, Homo sapiens
tattcagatgtatgt

SEQ ID NO: 5444258 - DNA, 18 bp, Homo sapiens
tattcagatgttggtctt

SEQ ID NO: 5444259 - DNA, 22 bp, Homo sapiens
tattcagcaaggcgctaacttg

SEQ ID NO: 5444260 - DNA, 23 bp, Homo sapiens
tattcagcagactttctctgtgt

SEQ ID NO: 5444261 - DNA, 20 bp, Homo sapiens
tattcagctagaatttctgg

SEQ ID NO: 5444262 - DNA, 15 bp, Homo sapiens
tattcagctcatgga

SEQ ID NO: 5444263 - DNA, 14 bp, Homo sapiens
tattcagcttcatt

SEQ ID NO: 5444264 - DNA, 19 bp, Homo sapiens
tattcagcttcatttgtgt

SEQ ID NO: 5444265 - DNA, 21 bp, Homo sapiens
tattcagcttcatttgtgtca

SEQ ID NO: 5444266 - DNA, 23 bp, Homo sapiens
tattcaggaagataaaaatcagt

SEQ ID NO: 5444267 - DNA, 14 bp, Homo sapiens
tattcaggaagctc

SEQ ID NO: 5444268 - DNA, 22 bp, Homo sapiens
tattcaggaagctcagggcctg

SEQ ID NO: 5444269 - DNA, 20 bp, Homo sapiens
tattcaggagttggaatgtt

SEQ ID NO: 5444270 - DNA, 18 bp, Homo sapiens
tattcaggcactgagaat

SEQ ID NO: 5444271 - DNA, 23 bp, Homo sapiens
tattcagggaaggaggagcctgt

SEQ ID NO: 5444272 - DNA, 15 bp, Homo sapiens
tattcagggtaaata

SEQ ID NO: 5444273 - DNA, 16 bp, Homo sapiens
tattcagtgaaaaaga

SEQ ID NO: 5444274 - DNA, 21 bp, Homo sapiens
tattcagtgaaaaagatattt

SEQ ID NO: 5444275 - DNA, 16 bp, Homo sapiens
tattgggccttttgga

SEQ ID NO: 5444276 - DNA, 21 bp, Homo sapiens
tattgggctcagagagtacac

SEQ ID NO: 5444277 - DNA, 18 bp, Homo sapiens
tattggggaattaaatag

SEQ ID NO: 5444278 - DNA, 20 bp, Homo sapiens
tattggggaattaaatagtg

SEQ ID NO: 5444279 - DNA, 22 bp, Homo sapiens
tattggggaccaaatcaaatga

SEQ ID NO: 5444280 - DNA, 18 bp, Homo sapiens
tattggggccatgagtaa

SEQ ID NO: 5444281 - DNA, 18 bp, Homo sapiens
tattggggttggggggga

SEQ ID NO: 5444282 - DNA, 16 bp, Homo sapiens
tattgggttcattatt

SEQ ID NO: 5444283 - DNA, 16 bp, Homo sapiens
tattgggtttggtcac

SEQ ID NO: 5444284 - DNA, 13 bp, Homo sapiens
tattggtaattaa

SEQ ID NO: 5444285 - DNA, 15 bp, Homo sapiens
tattggtaattaaaa

SEQ ID NO: 5444286 - DNA, 14 bp, Homo sapiens
tattggtatatttg

SEQ ID NO: 5444287 - DNA, 20 bp, Homo sapiens
tattggtattaaagaatgct

SEQ ID NO: 5444288 - DNA, 22 bp, Homo sapiens
tattggtccagcttgctcttca

SEQ ID NO: 5444289 - DNA, 19 bp, Homo sapiens
tattggtgcgtttttacag

SEQ ID NO: 5444290 - DNA, 14 bp, Homo sapiens
tattggtgcttgac

SEQ ID NO: 5444291 - DNA, 18 bp, Homo sapiens
tattggtgcttgactctc

SEQ ID NO: 5444292 - DNA, 13 bp, Homo sapiens
tattggtggaatc

SEQ ID NO: 5444293 - DNA, 14 bp, Homo sapiens
tattggttttatga

SEQ ID NO: 5444294 - DNA, 15 bp, Homo sapiens
tattggttttatgat

SEQ ID NO: 5444295 - DNA, 17 bp, Homo sapiens
tattgtaaaaaattcac

SEQ ID NO: 5444296 - DNA, 19 bp, Homo sapiens
tattgtaaaacagctaaat

SEQ ID NO: 5444297 - DNA, 15 bp, Homo sapiens
tattgtaaaacaggt

SEQ ID NO: 5444298 - DNA, 15 bp, Homo sapiens
tattgtaaaacattc

SEQ ID NO: 5444299 - DNA, 20 bp, Homo sapiens
tattgtaaaactttggtgca

SEQ ID NO: 5444300 - DNA, 16 bp, Homo sapiens
tattgtaaaagtgaca

SEQ ID NO: 5444301 - DNA, 16 bp, Homo sapiens
tattgtaaactttttc

SEQ ID NO: 5444302 - DNA, 18 bp, Homo sapiens
tattgtaaactttttcaa

SEQ ID NO: 5444303 - DNA, 20 bp, Homo sapiens
tattgtaaactttttcaatg

SEQ ID NO: 5444304 - DNA, 13 bp, Homo sapiens
tattgtaaataca

SEQ ID NO: 5444305 - DNA, 14 bp, Homo sapiens
tattgtaaatgcta

SEQ ID NO: 5444306 - DNA, 13 bp, Homo sapiens
tattgtaaattat

SEQ ID NO: 5444307 - DNA, 23 bp, Homo sapiens
tattgtaaatttggatttacgac

SEQ ID NO: 5444308 - DNA, 17 bp, Homo sapiens
tattgtaaattttagaa

SEQ ID NO: 5444309 - DNA, 16 bp, Homo sapiens
tattgtaacaggcttt

SEQ ID NO: 5444310 - DNA, 20 bp, Homo sapiens
tattgtaaccctgtctggat

SEQ ID NO: 5444311 - DNA, 11 bp, Homo sapiens
tattgtaagaa

SEQ ID NO: 5444312 - DNA, 15 bp, Homo sapiens
tattgtaaggtcttt

SEQ ID NO: 5444313 - DNA, 14 bp, Homo sapiens
tattgtaagtggaa

SEQ ID NO: 5444314 - DNA, 12 bp, Homo sapiens
tattgtaagttg

SEQ ID NO: 5444315 - DNA, 17 bp, Homo sapiens
tattgtaagttgtacaa

SEQ ID NO: 5444316 - DNA, 22 bp, Homo sapiens
tattgtaagttgtacaaatgta

SEQ ID NO: 5444317 - DNA, 23 bp, Homo sapiens
tattgtaatatagaaaaaaacat

SEQ ID NO: 5444318 - DNA, 18 bp, Homo sapiens
tattgtaatattaaaaag

SEQ ID NO: 5444319 - DNA, 20 bp, Homo sapiens
tattgtaatattaaaaagaa

SEQ ID NO: 5444320 - DNA, 19 bp, Homo sapiens
tattgtaatctatgtttat

SEQ ID NO: 5444321 - DNA, 16 bp, Homo sapiens
tattgtaatgaatatc

SEQ ID NO: 5444322 - DNA, 21 bp, Homo sapiens
tattgtaatgagtgaattgaa

SEQ ID NO: 5444323 - DNA, 15 bp, Homo sapiens
tattgtacaaagtat

SEQ ID NO: 5444324 - DNA, 23 bp, Homo sapiens
tattgtacaaagtattaagcata

SEQ ID NO: 5444325 - DNA, 20 bp, Homo sapiens
tattgtacactaacatattt

SEQ ID NO: 5444326 - DNA, 20 bp, Homo sapiens
tattgtacacttttttgggg

SEQ ID NO: 5444327 - DNA, 11 bp, Homo sapiens
tattgtacaga

SEQ ID NO: 5444328 - DNA, 15 bp, Homo sapiens
tattgtacagactgt

SEQ ID NO: 5444329 - DNA, 17 bp, Homo sapiens
tattgtacataaaagaa

SEQ ID NO: 5444330 - DNA, 16 bp, Homo sapiens
tattgtaccaaagctg

SEQ ID NO: 5444331 - DNA, 17 bp, Homo sapiens
tattgtaccattttcta

SEQ ID NO: 5444332 - DNA, 13 bp, Homo sapiens
tattgtagaaagc

SEQ ID NO: 5444333 - DNA, 23 bp, Homo sapiens
tattgtagaaagctaatacaaaa

SEQ ID NO: 5444334 - DNA, 18 bp, Homo sapiens
tattgtagcatcctggaa

SEQ ID NO: 5444335 - DNA, 13 bp, Homo sapiens
tattgtagtttga

SEQ ID NO: 5444336 - DNA, 15 bp, Homo sapiens
tattgtataaaaagt

SEQ ID NO: 5444337 - DNA, 14 bp, Homo sapiens
tattgtatattctg

SEQ ID NO: 5444338 - DNA, 20 bp, Homo sapiens
tattgtatctgaattcctgt

SEQ ID NO: 5444339 - DNA, 12 bp, Homo sapiens
tattgtatgtaa

SEQ ID NO: 5444340 - DNA, 13 bp, Homo sapiens
tattgtatgtaag

SEQ ID NO: 5444341 - DNA, 12 bp, Homo sapiens
tattgtattaag

SEQ ID NO: 5444342 - DNA, 16 bp, Homo sapiens
tattgtattaagggca

SEQ ID NO: 5444343 - DNA, 15 bp, Homo sapiens
tattgtattatcata

SEQ ID NO: 5444344 - DNA, 21 bp, Homo sapiens
tattgtattatcatatatgct

SEQ ID NO: 5444345 - DNA, 17 bp, Homo sapiens
tattgtattatttggag

SEQ ID NO: 5444346 - DNA, 16 bp, Homo sapiens
tattgtattgttagat

SEQ ID NO: 5444347 - DNA, 15 bp, Homo sapiens
tattgtatttattca

SEQ ID NO: 5444348 - DNA, 20 bp, Homo sapiens
tattgtatttattcaataaa

SEQ ID NO: 5444349 - DNA, 18 bp, Homo sapiens
tattgtatttattccata

SEQ ID NO: 5444350 - DNA, 20 bp, Homo sapiens
tattgtatttgagaaaataa

SEQ ID NO: 5444351 - DNA, 13 bp, Homo sapiens
tattgtcaaagtg

SEQ ID NO: 5444352 - DNA, 23 bp, Homo sapiens
tattgtcagccatcgtcctggga

SEQ ID NO: 5444353 - DNA, 18 bp, Homo sapiens
tattgtcatctttttcta

SEQ ID NO: 5444354 - DNA, 20 bp, Homo sapiens
tattgtcatctttttctaga

SEQ ID NO: 5444355 - DNA, 17 bp, Homo sapiens
tattgtccccactaaaa

SEQ ID NO: 5444356 - DNA, 20 bp, Homo sapiens
tattgtccctggcttcctta

SEQ ID NO: 5444357 - DNA, 17 bp, Homo sapiens
tattgtcctaagtgtca

SEQ ID NO: 5444358 - DNA, 18 bp, Homo sapiens
tattgtcctattagtgtt

SEQ ID NO: 5444359 - DNA, 16 bp, Homo sapiens
tattgtcctgtttctt

SEQ ID NO: 5444360 - DNA, 13 bp, Homo sapiens
tattgtctactct

SEQ ID NO: 5444361 - DNA, 18 bp, Homo sapiens
tattgtctgacttctcag

SEQ ID NO: 5444362 - DNA, 18 bp, Homo sapiens
tattgtctgattgaaaca

SEQ ID NO: 5444363 - DNA, 14 bp, Homo sapiens
tattgtctgtctac

SEQ ID NO: 5444364 - DNA, 13 bp, Homo sapiens
tattgtctgtctc

SEQ ID NO: 5444365 - DNA, 11 bp, Homo sapiens
tattgtcttta

SEQ ID NO: 5444366 - DNA, 14 bp, Homo sapiens
tattgtgaaatttg

SEQ ID NO: 5444367 - DNA, 17 bp, Homo sapiens
tattgtgaagtacatat

SEQ ID NO: 5444368 - DNA, 15 bp, Homo sapiens
tattgtgactcttct

SEQ ID NO: 5444369 - DNA, 15 bp, Homo sapiens
tattgtgacttcact

SEQ ID NO: 5444370 - DNA, 16 bp, Homo sapiens
tattgtgacttcactg

SEQ ID NO: 5444371 - DNA, 17 bp, Homo sapiens
tattgtgacttcactgt

SEQ ID NO: 5444372 - DNA, 19 bp, Homo sapiens
tattgtgacttcactgtat

SEQ ID NO: 5444373 - DNA, 22 bp, Homo sapiens
tattgtgatttcccgtggcccc

SEQ ID NO: 5444374 - DNA, 19 bp, Homo sapiens
tattgtgatttgactgttt

SEQ ID NO: 5444375 - DNA, 17 bp, Homo sapiens
tattgtgcaatgtaaat

SEQ ID NO: 5444376 - DNA, 14 bp, Homo sapiens
tattgtgcaatgtg

SEQ ID NO: 5444377 - DNA, 16 bp, Homo sapiens
tattgtgcaatgtgta

SEQ ID NO: 5444378 - DNA, 14 bp, Homo sapiens
tattgtgcacattt

SEQ ID NO: 5444379 - DNA, 22 bp, Homo sapiens
tattgtgcacatttaataatca

SEQ ID NO: 5444380 - DNA, 18 bp, Homo sapiens
tattgtgcatgctagtgt

SEQ ID NO: 5444381 - DNA, 22 bp, Homo sapiens
tattgtgccaactgccaggctg

SEQ ID NO: 5444382 - DNA, 17 bp, Homo sapiens
tattgtgccaagcgaaa

SEQ ID NO: 5444383 - DNA, 23 bp, Homo sapiens
tattgtgcgctaaacttttctga

SEQ ID NO: 5444384 - DNA, 15 bp, Homo sapiens
tattgtgctgttcta

SEQ ID NO: 5444385 - DNA, 19 bp, Homo sapiens
tattgtgctttctatctaa

SEQ ID NO: 5444386 - DNA, 16 bp, Homo sapiens
tattgtggctccctgg

SEQ ID NO: 5444387 - DNA, 14 bp, Homo sapiens
tattgtggttggtt

SEQ ID NO: 5444388 - DNA, 16 bp, Homo sapiens
tattgtgtaatttaag

SEQ ID NO: 5444389 - DNA, 19 bp, Homo sapiens
tattgtgtaatttaagtga

SEQ ID NO: 5444390 - DNA, 16 bp, Homo sapiens
tattgtgtcttttgca

SEQ ID NO: 5444391 - DNA, 12 bp, Homo sapiens
tattgtgtgaag

SEQ ID NO: 5444392 - DNA, 17 bp, Homo sapiens
tattgtgtgttatttaa

SEQ ID NO: 5444393 - DNA, 14 bp, Homo sapiens
tattgtgttgcctt

SEQ ID NO: 5444394 - DNA, 16 bp, Homo sapiens
tattgtgttggcttta

SEQ ID NO: 5444395 - DNA, 18 bp, Homo sapiens
tattgtgtttgtcattag

SEQ ID NO: 5444396 - DNA, 21 bp, Homo sapiens
tattgtgtttgtcattagcct

SEQ ID NO: 5444397 - DNA, 16 bp, Homo sapiens
tattgtgttttaacac

SEQ ID NO: 5444398 - DNA, 17 bp, Homo sapiens
tattgtgttttaacacc

SEQ ID NO: 5444399 - DNA, 16 bp, Homo sapiens
tattgttaaacaaatg

SEQ ID NO: 5444400 - DNA, 17 bp, Homo sapiens
tattgttaaacaaatga

SEQ ID NO: 5444401 - DNA, 17 bp, Homo sapiens
tattgttaaattacatt

SEQ ID NO: 5444402 - DNA, 22 bp, Homo sapiens
tattgttacgtagcctaaggct

SEQ ID NO: 5444403 - DNA, 16 bp, Homo sapiens
tattgttactagagtt

SEQ ID NO: 5444404 - DNA, 15 bp, Homo sapiens
tattgttactctggt

SEQ ID NO: 5444405 - DNA, 14 bp, Homo sapiens
tattgttactctta

SEQ ID NO: 5444406 - DNA, 18 bp, Homo sapiens
tattgttactcttacgaa

SEQ ID NO: 5444407 - DNA, 15 bp, Homo sapiens
tattgttagaaaatg

SEQ ID NO: 5444408 - DNA, 20 bp, Homo sapiens
tattgttagggtcagccatt

SEQ ID NO: 5444409 - DNA, 18 bp, Homo sapiens
tattgttatattacttgc

SEQ ID NO: 5444410 - DNA, 20 bp, Homo sapiens
tattgttccaagacattgtc

SEQ ID NO: 5444411 - DNA, 17 bp, Homo sapiens
tattgttccagcagttt

SEQ ID NO: 5444412 - DNA, 13 bp, Homo sapiens
tattgttcccagt

SEQ ID NO: 5444413 - DNA, 21 bp, Homo sapiens
tattgttcctaagttcttaga

SEQ ID NO: 5444414 - DNA, 13 bp, Homo sapiens
tattgttccttat

SEQ ID NO: 5444415 - DNA, 22 bp, Homo sapiens
tattgttcgatgcctgcatgct

SEQ ID NO: 5444416 - DNA, 15 bp, Homo sapiens
tattgttctgtttgt

SEQ ID NO: 5444417 - DNA, 15 bp, Homo sapiens
tattgttcttgtaaa

SEQ ID NO: 5444418 - DNA, 14 bp, Homo sapiens
tattgttgaaaaag

SEQ ID NO: 5444419 - DNA, 17 bp, Homo sapiens
tattgttgaaaaagttt

SEQ ID NO: 5444420 - DNA, 19 bp, Homo sapiens
tattgttgacaactgtgac

SEQ ID NO: 5444421 - DNA, 20 bp, Homo sapiens
tattgttgacaactgtgact

SEQ ID NO: 5444422 - DNA, 17 bp, Homo sapiens
tattgttgcattgcttt

SEQ ID NO: 5444423 - DNA, 13 bp, Homo sapiens
tattgttgccttt

SEQ ID NO: 5444424 - DNA, 16 bp, Homo sapiens
tattgttgctgctttg

SEQ ID NO: 5444425 - DNA, 16 bp, Homo sapiens
tattgttgtccttttc

SEQ ID NO: 5444426 - DNA, 18 bp, Homo sapiens
tattgttgtccttttcat

SEQ ID NO: 5444427 - DNA, 21 bp, Homo sapiens
tattgtttaaaaacaggaaaa

SEQ ID NO: 5444428 - DNA, 16 bp, Homo sapiens
tattgtttaaaattca

SEQ ID NO: 5444429 - DNA, 17 bp, Homo sapiens
tattgtttaaagcaact

SEQ ID NO: 5444430 - DNA, 12 bp, Homo sapiens
tattgtttacat

SEQ ID NO: 5444431 - DNA, 22 bp, Homo sapiens
tattgtttattctttttaaagt

SEQ ID NO: 5444432 - DNA, 14 bp, Homo sapiens
tattgtttccctcg

SEQ ID NO: 5444433 - DNA, 11 bp, Homo sapiens
tattgtttcta

SEQ ID NO: 5444434 - DNA, 14 bp, Homo sapiens
tattgtttctagaa

SEQ ID NO: 5444435 - DNA, 16 bp, Homo sapiens
tattgtttctctgaaa

SEQ ID NO: 5444436 - DNA, 17 bp, Homo sapiens
tattgtttctttatcac

SEQ ID NO: 5444437 - DNA, 17 bp, Homo sapiens
tattgtttgatgttttt

SEQ ID NO: 5444438 - DNA, 16 bp, Homo sapiens
tattgtttgctgttgg

SEQ ID NO: 5444439 - DNA, 15 bp, Homo sapiens
tattgtttggtaaat

SEQ ID NO: 5444440 - DNA, 16 bp, Homo sapiens
tattgtttggtaaatg

SEQ ID NO: 5444441 - DNA, 20 bp, Homo sapiens
tattgtttgttgcactaaaa

SEQ ID NO: 5444442 - DNA, 20 bp, Homo sapiens
tattgttttacaatagttct

SEQ ID NO: 5444443 - DNA, 18 bp, Homo sapiens
tattgttttatgttctag

SEQ ID NO: 5444444 - DNA, 12 bp, Homo sapiens
tattgttttcag

SEQ ID NO: 5444445 - DNA, 17 bp, Homo sapiens
tattgttttctgtaaat

SEQ ID NO: 5444446 - DNA, 18 bp, Homo sapiens
tattgttttctgtaaata

SEQ ID NO: 5444447 - DNA, 20 bp, Homo sapiens
tattgttttctgtaaataac

SEQ ID NO: 5444448 - DNA, 19 bp, Homo sapiens
tattgtttttattctgtat

SEQ ID NO: 5444449 - DNA, 17 bp, Homo sapiens
tatttaaaaaaaagaaa

SEQ ID NO: 5444450 - DNA, 20 bp, Homo sapiens
tatttaaaaaaaagaaactt

SEQ ID NO: 5444451 - DNA, 22 bp, Homo sapiens
tatttaaaaaaaagaaactttt

SEQ ID NO: 5444452 - DNA, 16 bp, Homo sapiens
tatttaaaaaaagaaa

SEQ ID NO: 5444453 - DNA, 21 bp, Homo sapiens
tatttaaaaaactaaaaacta

SEQ ID NO: 5444454 - DNA, 14 bp, Homo sapiens
tatttaaaaaactg

SEQ ID NO: 5444455 - DNA, 20 bp, Homo sapiens
tatttagatctcctgtattc

SEQ ID NO: 5444456 - DNA, 21 bp, Homo sapiens
tatttagatgataaagagaca

SEQ ID NO: 5444457 - DNA, 17 bp, Homo sapiens
tatttagattgttaaaa

SEQ ID NO: 5444458 - DNA, 19 bp, Homo sapiens
tatttagattgttaaaata

SEQ ID NO: 5444459 - DNA, 20 bp, Homo sapiens
tatttagcaccagggaaggg

SEQ ID NO: 5444460 - DNA, 11 bp, Homo sapiens
tatttagcatg

SEQ ID NO: 5444461 - DNA, 21 bp, Homo sapiens
tatttagcatgacaagcccca

SEQ ID NO: 5444462 - DNA, 18 bp, Homo sapiens
tatttagccattacccac

SEQ ID NO: 5444463 - DNA, 16 bp, Homo sapiens
tatttagcttctccca

SEQ ID NO: 5444464 - DNA, 17 bp, Homo sapiens
tatttagctttacatat

SEQ ID NO: 5444465 - DNA, 18 bp, Homo sapiens
tatttagctttacatatt

SEQ ID NO: 5444466 - DNA, 15 bp, Homo sapiens
tatttaggaaacacc

SEQ ID NO: 5444467 - DNA, 17 bp, Homo sapiens
tatttagggaactgctt

SEQ ID NO: 5444468 - DNA, 20 bp, Homo sapiens
tatttagggccttttctgtg

SEQ ID NO: 5444469 - DNA, 19 bp, Homo sapiens
tatttagtaaaattatctg

SEQ ID NO: 5444470 - DNA, 13 bp, Homo sapiens
tatttagtatctg

SEQ ID NO: 5444471 - DNA, 15 bp, Homo sapiens
tatttagtcaacata

SEQ ID NO: 5444472 - DNA, 14 bp, Homo sapiens
tatttagtcaattg

SEQ ID NO: 5444473 - DNA, 22 bp, Homo sapiens
tatttagtcaattgtttaatgt

SEQ ID NO: 5444474 - DNA, 20 bp, Homo sapiens
tatttagtgttagttataaa

SEQ ID NO: 5444475 - DNA, 19 bp, Homo sapiens
tatttagtgttcataaata

SEQ ID NO: 5444476 - DNA, 15 bp, Homo sapiens
tatttagttatagtt

SEQ ID NO: 5444477 - DNA, 16 bp, Homo sapiens
tatttagttatttaag

SEQ ID NO: 5444478 - DNA, 14 bp, Homo sapiens
tatttagttggaat

SEQ ID NO: 5444479 - DNA, 22 bp, Homo sapiens
tatttagttgtaaaccaagtga

SEQ ID NO: 5444480 - DNA, 14 bp, Homo sapiens
tatttagtttttaa

SEQ ID NO: 5444481 - DNA, 13 bp, Homo sapiens
tatttataaaaat

SEQ ID NO: 5444482 - DNA, 19 bp, Homo sapiens
tatttataaatatatttaa

SEQ ID NO: 5444483 - DNA, 21 bp, Homo sapiens
tatttataacaatgttaaatg

SEQ ID NO: 5444484 - DNA, 15 bp, Homo sapiens
tatttataacattgt

SEQ ID NO: 5444485 - DNA, 20 bp, Homo sapiens
tatttataagaaaaatgtga

SEQ ID NO: 5444486 - DNA, 14 bp, Homo sapiens
tatttataagcaga

SEQ ID NO: 5444487 - DNA, 17 bp, Homo sapiens
tatttataatcactttt

SEQ ID NO: 5444488 - DNA, 18 bp, Homo sapiens
tatttataattaaagaaa

SEQ ID NO: 5444489 - DNA, 17 bp, Homo sapiens
tatttatacagtgcctt

SEQ ID NO: 5444490 - DNA, 17 bp, Homo sapiens
tatttatactataaaat

SEQ ID NO: 5444491 - DNA, 15 bp, Homo sapiens
tatttatactctaga

SEQ ID NO: 5444492 - DNA, 17 bp, Homo sapiens
tatttatagaatgctga

SEQ ID NO: 5444493 - DNA, 17 bp, Homo sapiens
tatttatagaatttaat

SEQ ID NO: 5444494 - DNA, 17 bp, Homo sapiens
tatttatagagttatta

SEQ ID NO: 5444495 - DNA, 16 bp, Homo sapiens
tatttatagagttcat

SEQ ID NO: 5444496 - DNA, 23 bp, Homo sapiens
tatttatagagttcatagaaata

SEQ ID NO: 5444497 - DNA, 15 bp, Homo sapiens
tatttatagggcttt

SEQ ID NO: 5444498 - DNA, 16 bp, Homo sapiens
tatttatatatatgat

SEQ ID NO: 5444499 - DNA, 13 bp, Homo sapiens
tatttatatatca

SEQ ID NO: 5444500 - DNA, 16 bp, Homo sapiens
tatttatatatgtatt

SEQ ID NO: 5444501 - DNA, 15 bp, Homo sapiens
tatttatatcatata

SEQ ID NO: 5444502 - DNA, 13 bp, Homo sapiens
tatttatatcttg

SEQ ID NO: 5444503 - DNA, 14 bp, Homo sapiens
tatttatatgaagc

SEQ ID NO: 5444504 - DNA, 16 bp, Homo sapiens
tatttatatgtatgtg

SEQ ID NO: 5444505 - DNA, 21 bp, Homo sapiens
tatttatatgttaatttgtta

SEQ ID NO: 5444506 - DNA, 17 bp, Homo sapiens
tatttatatgttattaa

SEQ ID NO: 5444507 - DNA, 18 bp, Homo sapiens
tatttatatgttattaaa

SEQ ID NO: 5444508 - DNA, 12 bp, Homo sapiens
tatttatattca

SEQ ID NO: 5444509 - DNA, 23 bp, Homo sapiens
tatttatattcagagatgtacca

SEQ ID NO: 5444510 - DNA, 18 bp, Homo sapiens
tatttatattcatcaaat

SEQ ID NO: 5444511 - DNA, 19 bp, Homo sapiens
tatttatattcattcagat

SEQ ID NO: 5444512 - DNA, 20 bp, Homo sapiens
tatttatattcattcagata

SEQ ID NO: 5444513 - DNA, 13 bp, Homo sapiens
tatttatattccg

SEQ ID NO: 5444514 - DNA, 13 bp, Homo sapiens
tatttatatttca

SEQ ID NO: 5444515 - DNA, 15 bp, Homo sapiens
tatttatatttcact

SEQ ID NO: 5444516 - DNA, 21 bp, Homo sapiens
tatttatatttttattttatt

SEQ ID NO: 5444517 - DNA, 14 bp, Homo sapiens
tatttatcaaaatg

SEQ ID NO: 5444518 - DNA, 13 bp, Homo sapiens
tatttatcagtga

SEQ ID NO: 5444519 - DNA, 17 bp, Homo sapiens
tatttatcatatttaat

SEQ ID NO: 5444520 - DNA, 23 bp, Homo sapiens
tatttatccagaaaactgtgatt

SEQ ID NO: 5444521 - DNA, 15 bp, Homo sapiens
tatttatccatttgt

SEQ ID NO: 5444522 - DNA, 18 bp, Homo sapiens
tatttatccctcattcat

SEQ ID NO: 5444523 - DNA, 15 bp, Homo sapiens
tatttatccctttcc

SEQ ID NO: 5444524 - DNA, 20 bp, Homo sapiens
tatttatcctagtattccta

SEQ ID NO: 5444525 - DNA, 22 bp, Homo sapiens
tatttatcgcaacatgaatttt

SEQ ID NO: 5444526 - DNA, 17 bp, Homo sapiens
tatttatctattgtaag

SEQ ID NO: 5444527 - DNA, 19 bp, Homo sapiens
tatttatctattgtaagat

SEQ ID NO: 5444528 - DNA, 23 bp, Homo sapiens
tatttatctgagcaataacttct

SEQ ID NO: 5444529 - DNA, 16 bp, Homo sapiens
tatttatctgattaag

SEQ ID NO: 5444530 - DNA, 16 bp, Homo sapiens
tatttatcttcttcac

SEQ ID NO: 5444531 - DNA, 15 bp, Homo sapiens
tatttatgaagaaaa

SEQ ID NO: 5444532 - DNA, 13 bp, Homo sapiens
tatttatgaagtt

SEQ ID NO: 5444533 - DNA, 14 bp, Homo sapiens
tatttatgaagttt

SEQ ID NO: 5444534 - DNA, 22 bp, Homo sapiens
tatttatgaagtttaaaacagt

SEQ ID NO: 5444535 - DNA, 17 bp, Homo sapiens
tatttatgaatgtgcat

SEQ ID NO: 5444536 - DNA, 12 bp, Homo sapiens
tatttatgaatt

SEQ ID NO: 5444537 - DNA, 16 bp, Homo sapiens
tatttatgaccagagc

SEQ ID NO: 5444538 - DNA, 22 bp, Homo sapiens
tatttatgagatcactgaactt

SEQ ID NO: 5444539 - DNA, 14 bp, Homo sapiens
tatttatgataact

SEQ ID NO: 5444540 - DNA, 12 bp, Homo sapiens
tatttatgcaga

SEQ ID NO: 5444541 - DNA, 20 bp, Homo sapiens
tatttatgcctctgtattta

SEQ ID NO: 5444542 - DNA, 22 bp, Homo sapiens
tatttatgccttgatgatttaa

SEQ ID NO: 5444543 - DNA, 21 bp, Homo sapiens
tatttatgcgtaatttaatgg

SEQ ID NO: 5444544 - DNA, 20 bp, Homo sapiens
tatttatgcttaaaatatgt

SEQ ID NO: 5444545 - DNA, 21 bp, Homo sapiens
tatttatgcttaaaatatgta

SEQ ID NO: 5444546 - DNA, 22 bp, Homo sapiens
tatttatggaattaaccattta

SEQ ID NO: 5444547 - DNA, 20 bp, Homo sapiens
tatttatggatatcacacat

SEQ ID NO: 5444548 - DNA, 19 bp, Homo sapiens
tatttatggatgcaacacg

SEQ ID NO: 5444549 - DNA, 22 bp, Homo sapiens
tatttatggattaaaaactgct

SEQ ID NO: 5444550 - DNA, 12 bp, Homo sapiens
tatttatggctt

SEQ ID NO: 5444551 - DNA, 17 bp, Homo sapiens
tatttatggcttataaa

SEQ ID NO: 5444552 - DNA, 20 bp, Homo sapiens
tatttatggcttataaatgt

SEQ ID NO: 5444553 - DNA, 23 bp, Homo sapiens
tatttatggtttctgtctgaatt

SEQ ID NO: 5444554 - DNA, 19 bp, Homo sapiens
tatttatgtaaaatcaata

SEQ ID NO: 5444555 - DNA, 13 bp, Homo sapiens
tatttatgtaatt

SEQ ID NO: 5444556 - DNA, 20 bp, Homo sapiens
tatttatgtaatttgtacag

SEQ ID NO: 5444557 - DNA, 12 bp, Homo sapiens
tatttatgtatt

SEQ ID NO: 5444558 - DNA, 13 bp, Homo sapiens
tatttatgtgcaa

SEQ ID NO: 5444559 - DNA, 12 bp, Homo sapiens
tatttattaaac

SEQ ID NO: 5444560 - DNA, 14 bp, Homo sapiens
tatttattaaactt

SEQ ID NO: 5444561 - DNA, 21 bp, Homo sapiens
tatttattaaacttcagcaac

SEQ ID NO: 5444562 - DNA, 15 bp, Homo sapiens
tatttattaaataaa

SEQ ID NO: 5444563 - DNA, 14 bp, Homo sapiens
tatttattaaattt

SEQ ID NO: 5444564 - DNA, 15 bp, Homo sapiens
tatttattaaatttt

SEQ ID NO: 5444565 - DNA, 13 bp, Homo sapiens
tatttattaacag

SEQ ID NO: 5444566 - DNA, 18 bp, Homo sapiens
tatttattaatatttaac

SEQ ID NO: 5444567 - DNA, 15 bp, Homo sapiens
tatttattaatttga

SEQ ID NO: 5444568 - DNA, 22 bp, Homo sapiens
tatttattaccgataaatgaac

SEQ ID NO: 5444569 - DNA, 13 bp, Homo sapiens
tatttattacctc

SEQ ID NO: 5444570 - DNA, 13 bp, Homo sapiens
tatttattactgt

SEQ ID NO: 5444571 - DNA, 14 bp, Homo sapiens
tatttattactgta

SEQ ID NO: 5444572 - DNA, 17 bp, Homo sapiens
tatttattagccaactg

SEQ ID NO: 5444573 - DNA, 16 bp, Homo sapiens
tatttattagctgtaa

SEQ ID NO: 5444574 - DNA, 19 bp, Homo sapiens
tatttattattttcacctg

SEQ ID NO: 5444575 - DNA, 18 bp, Homo sapiens
tatttattcaataaagta

SEQ ID NO: 5444576 - DNA, 24 bp, Homo sapiens
tatttattcagcttcatttgtgtc

SEQ ID NO: 5444577 - DNA, 23 bp, Homo sapiens
tatttattcattatttgtcaaat

SEQ ID NO: 5444578 - DNA, 15 bp, Homo sapiens
tatttattcattcag

SEQ ID NO: 5444579 - DNA, 12 bp, Homo sapiens
tatttattccca

SEQ ID NO: 5444580 - DNA, 14 bp, Homo sapiens
tatttattgaaatg

SEQ ID NO: 5444581 - DNA, 20 bp, Homo sapiens
tatttattgaaatgatttca

SEQ ID NO: 5444582 - DNA, 12 bp, Homo sapiens
tatttattgact

SEQ ID NO: 5444583 - DNA, 14 bp, Homo sapiens
tatttattgatgtt

SEQ ID NO: 5444584 - DNA, 14 bp, Homo sapiens
tatttattgattaa

SEQ ID NO: 5444585 - DNA, 13 bp, Homo sapiens
tatttattgcatt

SEQ ID NO: 5444586 - DNA, 17 bp, Homo sapiens
tatttattgctacttcc

SEQ ID NO: 5444587 - DNA, 21 bp, Homo sapiens
tatttattgctacttcctgcc

SEQ ID NO: 5444588 - DNA, 11 bp, Homo sapiens
tatttattggg

SEQ ID NO: 5444589 - DNA, 22 bp, Homo sapiens
tatttattgtatatatggatat

SEQ ID NO: 5444590 - DNA, 15 bp, Homo sapiens
tatttattgtattag

SEQ ID NO: 5444591 - DNA, 21 bp, Homo sapiens
tatttattgtcattactgcct

SEQ ID NO: 5444592 - DNA, 11 bp, Homo sapiens
tatttattgtt

SEQ ID NO: 5444593 - DNA, 14 bp, Homo sapiens
tatttattgttgcc

SEQ ID NO: 5444594 - DNA, 15 bp, Homo sapiens
tatttatttaaaact

SEQ ID NO: 5444595 - DNA, 16 bp, Homo sapiens
tatttatttaaaactc

SEQ ID NO: 5444596 - DNA, 16 bp, Homo sapiens
tatttatttaaaagat

SEQ ID NO: 5444597 - DNA, 16 bp, Homo sapiens
tatttatttaaagcat

SEQ ID NO: 5444598 - DNA, 17 bp, Homo sapiens
tatttatttaaagcatt

SEQ ID NO: 5444599 - DNA, 14 bp, Homo sapiens
tatttatttagtat

SEQ ID NO: 5444600 - DNA, 15 bp, Homo sapiens
tatttatttatgcta

SEQ ID NO: 5444601 - DNA, 13 bp, Homo sapiens
tatttatttatgg

SEQ ID NO: 5444602 - DNA, 14 bp, Homo sapiens
tatttatttatgga

SEQ ID NO: 5444603 - DNA, 14 bp, Homo sapiens
tatttatttatgta

SEQ ID NO: 5444604 - DNA, 14 bp, Homo sapiens
tatttatttattta

SEQ ID NO: 5444605 - DNA, 18 bp, Homo sapiens
tatttatttcagatgttt

SEQ ID NO: 5444606 - DNA, 14 bp, Homo sapiens
tatttatttccaaa

SEQ ID NO: 5444607 - DNA, 15 bp, Homo sapiens
tatttatttccaaaa

SEQ ID NO: 5444608 - DNA, 14 bp, Homo sapiens
tatttatttccaga

SEQ ID NO: 5444609 - DNA, 13 bp, Homo sapiens
tatttatttcctg

SEQ ID NO: 5444610 - DNA, 11 bp, Homo sapiens
tatttatttct

SEQ ID NO: 5444611 - DNA, 12 bp, Homo sapiens
tatttatttcta

SEQ ID NO: 5444612 - DNA, 14 bp, Homo sapiens
tatttatttgaggt

SEQ ID NO: 5444613 - DNA, 23 bp, Homo sapiens
tatttattttcagtatactgtgt

SEQ ID NO: 5444614 - DNA, 12 bp, Homo sapiens
tatttattttgt

SEQ ID NO: 5444615 - DNA, 15 bp, Homo sapiens
tatttattttgtaat

SEQ ID NO: 5444616 - DNA, 18 bp, Homo sapiens
tatttatttttacaagaa

SEQ ID NO: 5444617 - DNA, 22 bp, Homo sapiens
tatttatttttacctgcttttt

SEQ ID NO: 5444618 - DNA, 14 bp, Homo sapiens
tatttcaaaaattt

SEQ ID NO: 5444619 - DNA, 13 bp, Homo sapiens
tatttcaaaatga

SEQ ID NO: 5444620 - DNA, 11 bp, Homo sapiens
tatttcaaatg

SEQ ID NO: 5444621 - DNA, 12 bp, Homo sapiens
tatttcaaatga

SEQ ID NO: 5444622 - DNA, 13 bp, Homo sapiens
tatttcaaatgat

SEQ ID NO: 5444623 - DNA, 17 bp, Homo sapiens
tatttcaaatgattatg

SEQ ID NO: 5444624 - DNA, 14 bp, Homo sapiens
tatttcaaggaata

SEQ ID NO: 5444625 - DNA, 15 bp, Homo sapiens
tatttcaagtgccta

SEQ ID NO: 5444626 - DNA, 18 bp, Homo sapiens
tatttcaatcttttaaat

SEQ ID NO: 5444627 - DNA, 20 bp, Homo sapiens
tatttcaatcttttaaattg

SEQ ID NO: 5444628 - DNA, 12 bp, Homo sapiens
tatttcaatgag

SEQ ID NO: 5444629 - DNA, 19 bp, Homo sapiens
tatttcaatgtaattaaac

SEQ ID NO: 5444630 - DNA, 16 bp, Homo sapiens
tatttcaatgttagcc

SEQ ID NO: 5444631 - DNA, 23 bp, Homo sapiens
tatttcaattgtttatatggata

SEQ ID NO: 5444632 - DNA, 20 bp, Homo sapiens
tatttcacaaataataggtg

SEQ ID NO: 5444633 - DNA, 16 bp, Homo sapiens
tatttcacaattatat

SEQ ID NO: 5444634 - DNA, 14 bp, Homo sapiens
tatttcacagagca

SEQ ID NO: 5444635 - DNA, 21 bp, Homo sapiens
tatttcacaggctgtaaattg

SEQ ID NO: 5444636 - DNA, 17 bp, Homo sapiens
tattttaaatataaata

SEQ ID NO: 5444637 - DNA, 23 bp, Homo sapiens
tattttaaatataaatagctaat

SEQ ID NO: 5444638 - DNA, 13 bp, Homo sapiens
tattttaaatatc

SEQ ID NO: 5444639 - DNA, 19 bp, Homo sapiens
tattttaaatcttaacatc

SEQ ID NO: 5444640 - DNA, 16 bp, Homo sapiens
tattttaaatgaagta

SEQ ID NO: 5444641 - DNA, 13 bp, Homo sapiens
tattttaaatgtg

SEQ ID NO: 5444642 - DNA, 17 bp, Homo sapiens
tattttaaatgtggaat

SEQ ID NO: 5444643 - DNA, 20 bp, Homo sapiens
tattttaaattataaggact

SEQ ID NO: 5444644 - DNA, 14 bp, Homo sapiens
tattttaacacttt

SEQ ID NO: 5444645 - DNA, 16 bp, Homo sapiens
tattttaacactttgt

SEQ ID NO: 5444646 - DNA, 17 bp, Homo sapiens
tattttaacactttgta

SEQ ID NO: 5444647 - DNA, 16 bp, Homo sapiens
tattttaacatagcag

SEQ ID NO: 5444648 - DNA, 15 bp, Homo sapiens
tattttaactatttt

SEQ ID NO: 5444649 - DNA, 18 bp, Homo sapiens
tattttaactatttttgt

SEQ ID NO: 5444650 - DNA, 12 bp, Homo sapiens
tattttaagaaa

SEQ ID NO: 5444651 - DNA, 14 bp, Homo sapiens
tattttaagaaaga

SEQ ID NO: 5444652 - DNA, 19 bp, Homo sapiens
tattttaagcattactctt

SEQ ID NO: 5444653 - DNA, 21 bp, Homo sapiens
tattttaaggttgcacacagt

SEQ ID NO: 5444654 - DNA, 15 bp, Homo sapiens
tattttaataaagta

SEQ ID NO: 5444655 - DNA, 19 bp, Homo sapiens
tattttaataatgtttcaa

SEQ ID NO: 5444656 - DNA, 18 bp, Homo sapiens
tattttaatacctttaaa

SEQ ID NO: 5444657 - DNA, 20 bp, Homo sapiens
tattttaatacctttaaata

SEQ ID NO: 5444658 - DNA, 23 bp, Homo sapiens
tattttaatacctttaaatatca

SEQ ID NO: 5444659 - DNA, 13 bp, Homo sapiens
tattttaatagaa

SEQ ID NO: 5444660 - DNA, 14 bp, Homo sapiens
tattttaatagaat

SEQ ID NO: 5444661 - DNA, 16 bp, Homo sapiens
tattttaatagaattt

SEQ ID NO: 5444662 - DNA, 20 bp, Homo sapiens
tattttaatagcctgtcata

SEQ ID NO: 5444663 - DNA, 14 bp, Homo sapiens
tattttaatattga

SEQ ID NO: 5444664 - DNA, 12 bp, Homo sapiens
tattttaatgta

SEQ ID NO: 5444665 - DNA, 13 bp, Homo sapiens
tattttaatgtac

SEQ ID NO: 5444666 - DNA, 21 bp, Homo sapiens
tattttaatgtatatttgctg

SEQ ID NO: 5444667 - DNA, 13 bp, Homo sapiens
tattttaatgtga

SEQ ID NO: 5444668 - DNA, 21 bp, Homo sapiens
tattttaatgtgatgatgtaa

SEQ ID NO: 5444669 - DNA, 22 bp, Homo sapiens
tattttaattaaaattggtaaa

SEQ ID NO: 5444670 - DNA, 19 bp, Homo sapiens
tattttaattaggttaact

SEQ ID NO: 5444671 - DNA, 13 bp, Homo sapiens
tattttaatttca

SEQ ID NO: 5444672 - DNA, 14 bp, Homo sapiens
tattttaatttcaa

SEQ ID NO: 5444673 - DNA, 16 bp, Homo sapiens
tattttaatttcaagc

SEQ ID NO: 5444674 - DNA, 16 bp, Homo sapiens
tattttacaaatatta

SEQ ID NO: 5444675 - DNA, 23 bp, Homo sapiens
tattttacacagaaacactgcct

SEQ ID NO: 5444676 - DNA, 21 bp, Homo sapiens
tattttacacagcaattttgt

SEQ ID NO: 5444677 - DNA, 21 bp, Homo sapiens
tattttacagctcattaaact

SEQ ID NO: 5444678 - DNA, 12 bp, Homo sapiens
tattttacagtc

SEQ ID NO: 5444679 - DNA, 15 bp, Homo sapiens
tattttacagtctct

SEQ ID NO: 5444680 - DNA, 20 bp, Homo sapiens
tattttacagtctctgttgt

SEQ ID NO: 5444681 - DNA, 16 bp, Homo sapiens
tattttacatgggcca

SEQ ID NO: 5444682 - DNA, 12 bp, Homo sapiens
tattttacattt

SEQ ID NO: 5444683 - DNA, 13 bp, Homo sapiens
tattttacattta

SEQ ID NO: 5444684 - DNA, 20 bp, Homo sapiens
tattttacatttagagtatt

SEQ ID NO: 5444685 - DNA, 18 bp, Homo sapiens
tattttaccactgctgtg

SEQ ID NO: 5444686 - DNA, 21 bp, Homo sapiens
tattttacccaaatactcaat

SEQ ID NO: 5444687 - DNA, 21 bp, Homo sapiens
tattttactagaaatgggaat

SEQ ID NO: 5444688 - DNA, 14 bp, Homo sapiens
tattttactgtctt

SEQ ID NO: 5444689 - DNA, 13 bp, Homo sapiens
tattttactttgt

SEQ ID NO: 5444690 - DNA, 14 bp, Homo sapiens
tattttactttgtg

SEQ ID NO: 5444691 - DNA, 19 bp, Homo sapiens
tattttactttgtgcaata

SEQ ID NO: 5444692 - DNA, 15 bp, Homo sapiens
tattttacttttaca

SEQ ID NO: 5444693 - DNA, 20 bp, Homo sapiens
tattttacttttctgccaaa

SEQ ID NO: 5444694 - DNA, 12 bp, Homo sapiens
tattttagaaat

SEQ ID NO: 5444695 - DNA, 20 bp, Homo sapiens
tattttagaaattataattt

SEQ ID NO: 5444696 - DNA, 20 bp, Homo sapiens
tattttagacaaccatagaa

SEQ ID NO: 5444697 - DNA, 13 bp, Homo sapiens
tattttagattac

SEQ ID NO: 5444698 - DNA, 22 bp, Homo sapiens
tattttagcagttctgcaaata

SEQ ID NO: 5444699 - DNA, 14 bp, Homo sapiens
tattttaggaaatt

SEQ ID NO: 5444700 - DNA, 17 bp, Homo sapiens
tattttaggagacagtc

SEQ ID NO: 5444701 - DNA, 22 bp, Homo sapiens
tattttaggcactgttcaatac

SEQ ID NO: 5444702 - DNA, 20 bp, Homo sapiens
tattttagggtcaatgagag

SEQ ID NO: 5444703 - DNA, 17 bp, Homo sapiens
tattttagggttctaaa

SEQ ID NO: 5444704 - DNA, 21 bp, Homo sapiens
tattttagggttctaaatgca

SEQ ID NO: 5444705 - DNA, 21 bp, Homo sapiens
tattttagtggaccctgaaat

SEQ ID NO: 5444706 - DNA, 15 bp, Homo sapiens
tattttagtgtgtaa

SEQ ID NO: 5444707 - DNA, 16 bp, Homo sapiens
tattttagtgtgtaaa

SEQ ID NO: 5444708 - DNA, 18 bp, Homo sapiens
tattttagtgtgtaaaat

SEQ ID NO: 5444709 - DNA, 14 bp, Homo sapiens
tattttagtttctg

SEQ ID NO: 5444710 - DNA, 16 bp, Homo sapiens
tattttagtttctgtt

SEQ ID NO: 5444711 - DNA, 16 bp, Homo sapiens
tattttagttttgcaa

SEQ ID NO: 5444712 - DNA, 21 bp, Homo sapiens
tattttataaaattaaagaaa

SEQ ID NO: 5444713 - DNA, 17 bp, Homo sapiens
tattttataagaaaaac

SEQ ID NO: 5444714 - DNA, 17 bp, Homo sapiens
tattttatatacaattt

SEQ ID NO: 5444715 - DNA, 16 bp, Homo sapiens
tattttatatcataca

SEQ ID NO: 5444716 - DNA, 22 bp, Homo sapiens
tattttatatctgagcaaggag

SEQ ID NO: 5444717 - DNA, 18 bp, Homo sapiens
tattttatatgaaatgtt

SEQ ID NO: 5444718 - DNA, 14 bp, Homo sapiens
tattttatatgaga

SEQ ID NO: 5444719 - DNA, 21 bp, Homo sapiens
tattttatcactacaagcttt

SEQ ID NO: 5444720 - DNA, 15 bp, Homo sapiens
tattttatcctctgg

SEQ ID NO: 5444721 - DNA, 15 bp, Homo sapiens
tattttatctgtgtt

SEQ ID NO: 5444722 - DNA, 15 bp, Homo sapiens
tattttatgaacatt

SEQ ID NO: 5444723 - DNA, 12 bp, Homo sapiens
tattttatgaga

SEQ ID NO: 5444724 - DNA, 15 bp, Homo sapiens
tattttatgagaaat

SEQ ID NO: 5444725 - DNA, 20 bp, Homo sapiens
tattttatgtcatagtttaa

SEQ ID NO: 5444726 - DNA, 13 bp, Homo sapiens
tattttatgtgta

SEQ ID NO: 5444727 - DNA, 15 bp, Homo sapiens
tattttatgtgtaaa

SEQ ID NO: 5444728 - DNA, 15 bp, Homo sapiens
tattttatgttattt

SEQ ID NO: 5444729 - DNA, 15 bp, Homo sapiens
tattttatgttgcat

SEQ ID NO: 5444730 - DNA, 17 bp, Homo sapiens
tattttatgttgcatag

SEQ ID NO: 5444731 - DNA, 21 bp, Homo sapiens
tattttattacatctttcaca

SEQ ID NO: 5444732 - DNA, 13 bp, Homo sapiens
tattttattattc

SEQ ID NO: 5444733 - DNA, 18 bp, Homo sapiens
tattttattatttctaaa

SEQ ID NO: 5444734 - DNA, 11 bp, Homo sapiens
tattttattca

SEQ ID NO: 5444735 - DNA, 14 bp, Homo sapiens
tattttattcagta

SEQ ID NO: 5444736 - DNA, 22 bp, Homo sapiens
tattttattgaatactgtctgt

SEQ ID NO: 5444737 - DNA, 20 bp, Homo sapiens
tattttatttccatcatgtc

SEQ ID NO: 5444738 - DNA, 16 bp, Homo sapiens
tattttatttctgatg

SEQ ID NO: 5444739 - DNA, 14 bp, Homo sapiens
tattttatttgctt

SEQ ID NO: 5444740 - DNA, 16 bp, Homo sapiens
tattttattttattga

SEQ ID NO: 5444741 - DNA, 20 bp, Homo sapiens
tattttatttttagaatttt

SEQ ID NO: 5444742 - DNA, 20 bp, Homo sapiens
tattttattttttttcaaaa

SEQ ID NO: 5444743 - DNA, 12 bp, Homo sapiens
tattttcaaaga

SEQ ID NO: 5444744 - DNA, 16 bp, Homo sapiens
tattttcaaaggaaaa

SEQ ID NO: 5444745 - DNA, 16 bp, Homo sapiens
tattttcaacaattag

SEQ ID NO: 5444746 - DNA, 22 bp, Homo sapiens
tattttcaaccataaaagaagt

SEQ ID NO: 5444747 - DNA, 19 bp, Homo sapiens
tattttcaacgcagccctg

SEQ ID NO: 5444748 - DNA, 16 bp, Homo sapiens
tattttcaagaaactg

SEQ ID NO: 5444749 - DNA, 12 bp, Homo sapiens
tattttcaagag

SEQ ID NO: 5444750 - DNA, 19 bp, Homo sapiens
tattttcaagtttttcata

SEQ ID NO: 5444751 - DNA, 19 bp, Homo sapiens
tattttcaatagccactaa

SEQ ID NO: 5444752 - DNA, 15 bp, Homo sapiens
tattttcacaggttt

SEQ ID NO: 5444753 - DNA, 13 bp, Homo sapiens
tattttcagaatc

SEQ ID NO: 5444754 - DNA, 23 bp, Homo sapiens
tattttcagaatctgaatgtaat

SEQ ID NO: 5444755 - DNA, 12 bp, Homo sapiens
tattttcagagc

SEQ ID NO: 5444756 - DNA, 23 bp, Homo sapiens
tattttcagctcaattgttaatg

SEQ ID NO: 5444757 - DNA, 18 bp, Homo sapiens
tattttcagtaatgttat

SEQ ID NO: 5444758 - DNA, 12 bp, Homo sapiens
tattttcagtac

SEQ ID NO: 5444759 - DNA, 20 bp, Homo sapiens
tattttcagtatactgtgtg

SEQ ID NO: 5444760 - DNA, 17 bp, Homo sapiens
tattttcagtgcatcat

SEQ ID NO: 5444761 - DNA, 19 bp, Homo sapiens
tattttcagtgcatcatta

SEQ ID NO: 5444762 - DNA, 22 bp, Homo sapiens
tattttcagtgctttgcccttg

SEQ ID NO: 5444763 - DNA, 16 bp, Homo sapiens
tattttcatacaaatt

SEQ ID NO: 5444764 - DNA, 19 bp, Homo sapiens
tattttcatccttgtctta

SEQ ID NO: 5444765 - DNA, 20 bp, Homo sapiens
tattttcatgaaaataccat

SEQ ID NO: 5444766 - DNA, 21 bp, Homo sapiens
tattttcatgacttttccatg

SEQ ID NO: 5444767 - DNA, 19 bp, Homo sapiens
tattttcatgtattttaca

SEQ ID NO: 5444768 - DNA, 17 bp, Homo sapiens
tattttcattacaatgg

SEQ ID NO: 5444769 - DNA, 21 bp, Homo sapiens
tattttcattacaatggaaac

SEQ ID NO: 5444770 - DNA, 14 bp, Homo sapiens
tattttcattcaaa

SEQ ID NO: 5444771 - DNA, 15 bp, Homo sapiens
tattttcattctcct

SEQ ID NO: 5444772 - DNA, 16 bp, Homo sapiens
tattttcattgtaaaa

SEQ ID NO: 5444773 - DNA, 19 bp, Homo sapiens
tattttcatttctaacata

SEQ ID NO: 5444774 - DNA, 14 bp, Homo sapiens
tattttcatttgta

SEQ ID NO: 5444775 - DNA, 15 bp, Homo sapiens
tattttcatttttgt

SEQ ID NO: 5444776 - DNA, 15 bp, Homo sapiens
tattttccaagtgtg

SEQ ID NO: 5444777 - DNA, 19 bp, Homo sapiens
tattttccaagtgtgcata

SEQ ID NO: 5444778 - DNA, 22 bp, Homo sapiens
tattttccataaatttggactg

SEQ ID NO: 5444779 - DNA, 16 bp, Homo sapiens
tattttccatatattg

SEQ ID NO: 5444780 - DNA, 16 bp, Homo sapiens
tattttccatgaaaat

SEQ ID NO: 5444781 - DNA, 18 bp, Homo sapiens
tattttcccccttttctg

SEQ ID NO: 5444782 - DNA, 21 bp, Homo sapiens
tattttcccctatcatttatt

SEQ ID NO: 5444783 - DNA, 20 bp, Homo sapiens
tattttccctacttgcagcg

SEQ ID NO: 5444784 - DNA, 20 bp, Homo sapiens
tattttccctctcttgcctt

SEQ ID NO: 5444785 - DNA, 16 bp, Homo sapiens
tattttccgtcactta

SEQ ID NO: 5444786 - DNA, 21 bp, Homo sapiens
tattttcctatattacggttt

SEQ ID NO: 5444787 - DNA, 12 bp, Homo sapiens
tattttcctccc

SEQ ID NO: 5444788 - DNA, 15 bp, Homo sapiens
tattttcctccccag

SEQ ID NO: 5444789 - DNA, 16 bp, Homo sapiens
tattttcctccccagc

SEQ ID NO: 5444790 - DNA, 14 bp, Homo sapiens
tattttcctgatag

SEQ ID NO: 5444791 - DNA, 18 bp, Homo sapiens
tattttcctgatagcata

SEQ ID NO: 5444792 - DNA, 19 bp, Homo sapiens
tattttcctgatagcatat

SEQ ID NO: 5444793 - DNA, 18 bp, Homo sapiens
tattttccttaatcaaac

SEQ ID NO: 5444794 - DNA, 14 bp, Homo sapiens
tattttccttccat

SEQ ID NO: 5444795 - DNA, 15 bp, Homo sapiens
tattttccttctgaa

SEQ ID NO: 5444796 - DNA, 15 bp, Homo sapiens
tattttcgcccacct

SEQ ID NO: 5444797 - DNA, 13 bp, Homo sapiens
tattttcgggatt

SEQ ID NO: 5444798 - DNA, 16 bp, Homo sapiens
tattttcgtatgaaaa

SEQ ID NO: 5444799 - DNA, 13 bp, Homo sapiens
tattttcgtgcat

SEQ ID NO: 5444800 - DNA, 19 bp, Homo sapiens
tattttcgtgcatttgtga

SEQ ID NO: 5444801 - DNA, 14 bp, Homo sapiens
tattttctaaagta

SEQ ID NO: 5444802 - DNA, 12 bp, Homo sapiens
tattttctaaat

SEQ ID NO: 5444803 - DNA, 14 bp, Homo sapiens
tattttctacagtg

SEQ ID NO: 5444804 - DNA, 21 bp, Homo sapiens
tattttctactttaaattgtg

SEQ ID NO: 5444805 - DNA, 18 bp, Homo sapiens
tattttctatatttgtaa

SEQ ID NO: 5444806 - DNA, 18 bp, Homo sapiens
tattttctcaatctcctc

SEQ ID NO: 5444807 - DNA, 17 bp, Homo sapiens
tattttctccaaataaa

SEQ ID NO: 5444808 - DNA, 20 bp, Homo sapiens
tattttctccaaataaaaat

SEQ ID NO: 5444809 - DNA, 17 bp, Homo sapiens
tattttctccaaatgtt

SEQ ID NO: 5444810 - DNA, 15 bp, Homo sapiens
tattttctccgaaag

SEQ ID NO: 5444811 - DNA, 14 bp, Homo sapiens
tattttctgaattc

SEQ ID NO: 5444812 - DNA, 19 bp, Homo sapiens
tattttctgaattcataaa

SEQ ID NO: 5444813 - DNA, 20 bp, Homo sapiens
tattttctgaattcataaaa

SEQ ID NO: 5444814 - DNA, 22 bp, Homo sapiens
tattttctgagtagcatatata

SEQ ID NO: 5444815 - DNA, 12 bp, Homo sapiens
tcaaaagcctgg

SEQ ID NO: 5444816 - DNA, 12 bp, Homo sapiens
tcaaaagctgct

SEQ ID NO: 5444817 - DNA, 21 bp, Homo sapiens
tcaaaaggaaccaggaggttt

SEQ ID NO: 5444818 - DNA, 17 bp, Homo sapiens
tcaaaaggaagattctt

SEQ ID NO: 5444819 - DNA, 21 bp, Homo sapiens
tcaaaaggaatgaacttgtta

SEQ ID NO: 5444820 - DNA, 19 bp, Homo sapiens
tcaaaaggagaactgtgct

SEQ ID NO: 5444821 - DNA, 20 bp, Homo sapiens
tcaaaaggagaactgtgctc

SEQ ID NO: 5444822 - DNA, 22 bp, Homo sapiens
tcaaaaggagaactgtgctctc

SEQ ID NO: 5444823 - DNA, 20 bp, Homo sapiens
tcaaaaggatttactttttg

SEQ ID NO: 5444824 - DNA, 12 bp, Homo sapiens
tcaaaaggcact

SEQ ID NO: 5444825 - DNA, 22 bp, Homo sapiens
tcaaaagggccccatggccaaa

SEQ ID NO: 5444826 - DNA, 13 bp, Homo sapiens
tcaaaaggtgcct

SEQ ID NO: 5444827 - DNA, 17 bp, Homo sapiens
tcaaaagtaagaatgca

SEQ ID NO: 5444828 - DNA, 14 bp, Homo sapiens
tcaaaagtattttc

SEQ ID NO: 5444829 - DNA, 18 bp, Homo sapiens
tcaaaagtattttcctgt

SEQ ID NO: 5444830 - DNA, 20 bp, Homo sapiens
tcaaaagtattttcctgtaa

SEQ ID NO: 5444831 - DNA, 14 bp, Homo sapiens
tcaaaagttccaag

SEQ ID NO: 5444832 - DNA, 15 bp, Homo sapiens
tcaaaagttggacta

SEQ ID NO: 5444833 - DNA, 14 bp, Homo sapiens
tcaaaagtttgttt

SEQ ID NO: 5444834 - DNA, 13 bp, Homo sapiens
tcaaaataaaaac

SEQ ID NO: 5444835 - DNA, 21 bp, Homo sapiens
tcaaaataaaaagtgacacag

SEQ ID NO: 5444836 - DNA, 20 bp, Homo sapiens
tcaaaataaagattctcaca

SEQ ID NO: 5444837 - DNA, 14 bp, Homo sapiens
tcaaaataaagctt

SEQ ID NO: 5444838 - DNA, 17 bp, Homo sapiens
tcaaaatacaacttcat

SEQ ID NO: 5444839 - DNA, 21 bp, Homo sapiens
tcaaaataccatgccatttaa

SEQ ID NO: 5444840 - DNA, 19 bp, Homo sapiens
tcaaaatacgtgttcaaaa

SEQ ID NO: 5444841 - DNA, 19 bp, Homo sapiens
tcaaaatacttctttttca

SEQ ID NO: 5444842 - DNA, 16 bp, Homo sapiens
tcaaaatactttttaa

SEQ ID NO: 5444843 - DNA, 17 bp, Homo sapiens
tcaaaatagacaagttt

SEQ ID NO: 5444844 - DNA, 21 bp, Homo sapiens
tcaaaataggatttcttaaat

SEQ ID NO: 5444845 - DNA, 17 bp, Homo sapiens
tcaaaataggtttttat

SEQ ID NO: 5444846 - DNA, 22 bp, Homo sapiens
tcaaaatagttctatttctatc

SEQ ID NO: 5444847 - DNA, 22 bp, Homo sapiens
tcaaaatagtttaggaaaatga

SEQ ID NO: 5444848 - DNA, 20 bp, Homo sapiens
tcaaaatataaaatgccaag

SEQ ID NO: 5444849 - DNA, 17 bp, Homo sapiens
tcaaaatatattttgta

SEQ ID NO: 5444850 - DNA, 16 bp, Homo sapiens
tcaaaatatcctaaga

SEQ ID NO: 5444851 - DNA, 22 bp, Homo sapiens
tcaaaatatgtaagaacacatt

SEQ ID NO: 5444852 - DNA, 13 bp, Homo sapiens
tcaaaatatgtca

SEQ ID NO: 5444853 - DNA, 12 bp, Homo sapiens
tcaaaatattta

SEQ ID NO: 5444854 - DNA, 13 bp, Homo sapiens
tcaaaatatttaa

SEQ ID NO: 5444855 - DNA, 19 bp, Homo sapiens
tcaaaatatttaaaaatgt

SEQ ID NO: 5444856 - DNA, 22 bp, Homo sapiens
tcaaaatatttaaaaatgtctt

SEQ ID NO: 5444857 - DNA, 16 bp, Homo sapiens
tcaaaatatttgtaca

SEQ ID NO: 5444858 - DNA, 23 bp, Homo sapiens
tcaaaatatttttaaaagatctt

SEQ ID NO: 5444859 - DNA, 11 bp, Homo sapiens
tcaaaatcaaa

SEQ ID NO: 5444860 - DNA, 16 bp, Homo sapiens
tcaaaatcagtttttc

SEQ ID NO: 5444861 - DNA, 21 bp, Homo sapiens
tcaaaatcagtttttcatact

SEQ ID NO: 5444862 - DNA, 18 bp, Homo sapiens
tcaaaatccttccaaaga

SEQ ID NO: 5444863 - DNA, 23 bp, Homo sapiens
tcaaaatctctccactttcagct

SEQ ID NO: 5444864 - DNA, 13 bp, Homo sapiens
tcaaaatcttcac

SEQ ID NO: 5444865 - DNA, 23 bp, Homo sapiens
tcaaaatcttcactgaatatcat

SEQ ID NO: 5444866 - DNA, 22 bp, Homo sapiens
tcaaaatctttgtataaataaa

SEQ ID NO: 5444867 - DNA, 11 bp, Homo sapiens
tcaaaatgaag

SEQ ID NO: 5444868 - DNA, 20 bp, Homo sapiens
tcaaaatgatgcaaccaaaa

SEQ ID NO: 5444869 - DNA, 13 bp, Homo sapiens
tcaaaatgcatac

SEQ ID NO: 5444870 - DNA, 13 bp, Homo sapiens
tcaaaatgcatgt

SEQ ID NO: 5444871 - DNA, 18 bp, Homo sapiens
tcaaaatgcatgtgattg

SEQ ID NO: 5444872 - DNA, 13 bp, Homo sapiens
tcaaaatgccttt

SEQ ID NO: 5444873 - DNA, 12 bp, Homo sapiens
tcaaaatgcttc

SEQ ID NO: 5444874 - DNA, 19 bp, Homo sapiens
tcaaaatggaaaattaatt

SEQ ID NO: 5444875 - DNA, 16 bp, Homo sapiens
tcaaaatggtgtgcta

SEQ ID NO: 5444876 - DNA, 13 bp, Homo sapiens
tcaaaatgtagct

SEQ ID NO: 5444877 - DNA, 14 bp, Homo sapiens
tcaaaatgtctaag

SEQ ID NO: 5444878 - DNA, 11 bp, Homo sapiens
tcaaaatgtgc

SEQ ID NO: 5444879 - DNA, 12 bp, Homo sapiens
tcaaaattaata

SEQ ID NO: 5444880 - DNA, 14 bp, Homo sapiens
tcaaaattatagga

SEQ ID NO: 5444881 - DNA, 13 bp, Homo sapiens
tcaaaattccaaa

SEQ ID NO: 5444882 - DNA, 17 bp, Homo sapiens
tcaaaattccaaatttt

SEQ ID NO: 5444883 - DNA, 18 bp, Homo sapiens
tcaaaattgcctttttct

SEQ ID NO: 5444884 - DNA, 15 bp, Homo sapiens
tcaaaattgcttcta

SEQ ID NO: 5444885 - DNA, 19 bp, Homo sapiens
tcaaaattgttacaaattg

SEQ ID NO: 5444886 - DNA, 19 bp, Homo sapiens
tcaaaattgtttaaaaatt

SEQ ID NO: 5444887 - DNA, 17 bp, Homo sapiens
tcaaacaaagccagaag

SEQ ID NO: 5444888 - DNA, 16 bp, Homo sapiens
tcaaacaaccttcagc

SEQ ID NO: 5444889 - DNA, 13 bp, Homo sapiens
tcaaacaagaatg

SEQ ID NO: 5444890 - DNA, 12 bp, Homo sapiens
tcaaacaagtat

SEQ ID NO: 5444891 - DNA, 22 bp, Homo sapiens
tcaaacaagtatgaatctagtt

SEQ ID NO: 5444892 - DNA, 21 bp, Homo sapiens
tcaaacaattcaatcaaagct

SEQ ID NO: 5444893 - DNA, 17 bp, Homo sapiens
tcaaacacaaatgcagg

SEQ ID NO: 5444894 - DNA, 15 bp, Homo sapiens
tcaaacacacacaca

SEQ ID NO: 5444895 - DNA, 14 bp, Homo sapiens
tcaaacacacagta

SEQ ID NO: 5444896 - DNA, 20 bp, Homo sapiens
tcaaacacagttacacttgt

SEQ ID NO: 5444897 - DNA, 16 bp, Homo sapiens
tcaaacactgcaggca

SEQ ID NO: 5444898 - DNA, 13 bp, Homo sapiens
tcaaacactgctt

SEQ ID NO: 5444899 - DNA, 19 bp, Homo sapiens
tcaaacactgcttaaggaa

SEQ ID NO: 5444900 - DNA, 17 bp, Homo sapiens
tcaaacacttgtgactt

SEQ ID NO: 5444901 - DNA, 19 bp, Homo sapiens
tcaaacacttgtgactttt

SEQ ID NO: 5444902 - DNA, 15 bp, Homo sapiens
tcaaacagcatcaaa

SEQ ID NO: 5444903 - DNA, 18 bp, Homo sapiens
tcaaacagcatcaaaata

SEQ ID NO: 5444904 - DNA, 17 bp, Homo sapiens
tcaaacaggaatttctg

SEQ ID NO: 5444905 - DNA, 16 bp, Homo sapiens
tcaaacaggctgtaat

SEQ ID NO: 5444906 - DNA, 22 bp, Homo sapiens
tcaaacagggacactacaaaca

SEQ ID NO: 5444907 - DNA, 22 bp, Homo sapiens
tcaaacaggtcgagctgtgctc

SEQ ID NO: 5444908 - DNA, 22 bp, Homo sapiens
tcaaacagtacactatcttaat

SEQ ID NO: 5444909 - DNA, 20 bp, Homo sapiens
tcaaacagtaggttggcagt

SEQ ID NO: 5444910 - DNA, 13 bp, Homo sapiens
tcaaacagtgcca

SEQ ID NO: 5444911 - DNA, 18 bp, Homo sapiens
tcaaacatcagctgaatt

SEQ ID NO: 5444912 - DNA, 17 bp, Homo sapiens
tcaaacatgaaaacatt

SEQ ID NO: 5444913 - DNA, 17 bp, Homo sapiens
tcaaacatgagatgtgt

SEQ ID NO: 5444914 - DNA, 16 bp, Homo sapiens
tcaaacatgccctcag

SEQ ID NO: 5444915 - DNA, 20 bp, Homo sapiens
tcaaacattcgtgagctggg

SEQ ID NO: 5444916 - DNA, 12 bp, Homo sapiens
tcaaacattttg

SEQ ID NO: 5444917 - DNA, 15 bp, Homo sapiens
tcaaacattttgaaa

SEQ ID NO: 5444918 - DNA, 13 bp, Homo sapiens
tcaaacattttgt

SEQ ID NO: 5444919 - DNA, 21 bp, Homo sapiens
tcaaacattttgtatcaagga

SEQ ID NO: 5444920 - DNA, 21 bp, Homo sapiens
tcaaaccaagggtacagatcc

SEQ ID NO: 5444921 - DNA, 18 bp, Homo sapiens
tcaaaccaatttcttcct

SEQ ID NO: 5444922 - DNA, 21 bp, Homo sapiens
tcaaaccagtatacaagataa

SEQ ID NO: 5444923 - DNA, 15 bp, Homo sapiens
tcaaaccagtcactt

SEQ ID NO: 5444924 - DNA, 20 bp, Homo sapiens
tcaaaccagtcacttttgtc

SEQ ID NO: 5444925 - DNA, 15 bp, Homo sapiens
tcaaaccataaactt

SEQ ID NO: 5444926 - DNA, 20 bp, Homo sapiens
tcaaaccatattttttatga

SEQ ID NO: 5444927 - DNA, 20 bp, Homo sapiens
tcaaaccatttaattcataa

SEQ ID NO: 5444928 - DNA, 15 bp, Homo sapiens
tcaaacccacatatt

SEQ ID NO: 5444929 - DNA, 13 bp, Homo sapiens
tcaaacccaggct

SEQ ID NO: 5444930 - DNA, 15 bp, Homo sapiens
tcaaacccctgacct

SEQ ID NO: 5444931 - DNA, 15 bp, Homo sapiens
tcaaaccctagcctt

SEQ ID NO: 5444932 - DNA, 16 bp, Homo sapiens
tcaaaccctagccttg

SEQ ID NO: 5444933 - DNA, 19 bp, Homo sapiens
tcaaaccctagccttgctt

SEQ ID NO: 5444934 - DNA, 18 bp, Homo sapiens
tcaaaccctccacttctc

SEQ ID NO: 5444935 - DNA, 17 bp, Homo sapiens
tcaaacctcctcttctg

SEQ ID NO: 5444936 - DNA, 23 bp, Homo sapiens
tcaaacctgcaaggcaaagtaaa

SEQ ID NO: 5444937 - DNA, 14 bp, Homo sapiens
tcaaacctgcatat

SEQ ID NO: 5444938 - DNA, 11 bp, Homo sapiens
tcaaacctgta

SEQ ID NO: 5444939 - DNA, 20 bp, Homo sapiens
tcaaacctgtagatgcagaa

SEQ ID NO: 5444940 - DNA, 17 bp, Homo sapiens
tcaaacctgtttaaata

SEQ ID NO: 5444941 - DNA, 18 bp, Homo sapiens
tcaaacctgtttaaatat

SEQ ID NO: 5444942 - DNA, 19 bp, Homo sapiens
tcaaacctgtttaaatatt

SEQ ID NO: 5444943 - DNA, 22 bp, Homo sapiens
tcaaacctgtttaaatatttca

SEQ ID NO: 5444944 - DNA, 15 bp, Homo sapiens
tcaaaccttaagata

SEQ ID NO: 5444945 - DNA, 22 bp, Homo sapiens
tcaaacctttctggcctgttat

SEQ ID NO: 5444946 - DNA, 20 bp, Homo sapiens
tcaaacctttgccaactcag

SEQ ID NO: 5444947 - DNA, 23 bp, Homo sapiens
tcaaacgatgtgcaatacatttt

SEQ ID NO: 5444948 - DNA, 20 bp, Homo sapiens
tcaaacggaggaagcccaca

SEQ ID NO: 5444949 - DNA, 23 bp, Homo sapiens
tcaaacggcctcactaggcttct

SEQ ID NO: 5444950 - DNA, 19 bp, Homo sapiens
tcaaacgtcaacccccaaa

SEQ ID NO: 5444951 - DNA, 16 bp, Homo sapiens
tcaaactaaattcaaa

SEQ ID NO: 5444952 - DNA, 13 bp, Homo sapiens
tcaaactaacagg

SEQ ID NO: 5444953 - DNA, 17 bp, Homo sapiens
tcaaactaattctcaca

SEQ ID NO: 5444954 - DNA, 21 bp, Homo sapiens
tcaaactacctatattccttg

SEQ ID NO: 5444955 - DNA, 16 bp, Homo sapiens
tcaaactactttgctg

SEQ ID NO: 5444956 - DNA, 20 bp, Homo sapiens
tcaaactactttgctgctaa

SEQ ID NO: 5444957 - DNA, 21 bp, Homo sapiens
tcaaactagatttataaatgc

SEQ ID NO: 5444958 - DNA, 14 bp, Homo sapiens
tcaaactaggagga

SEQ ID NO: 5444959 - DNA, 21 bp, Homo sapiens
tcaaactgaaaagctgagacc

SEQ ID NO: 5444960 - DNA, 16 bp, Homo sapiens
tcaaactgaagccaga

SEQ ID NO: 5444961 - DNA, 16 bp, Homo sapiens
tcaaactgcacatcta

SEQ ID NO: 5444962 - DNA, 16 bp, Homo sapiens
tcaaactgcactttta

SEQ ID NO: 5444963 - DNA, 15 bp, Homo sapiens
tcaaactgctccaag

SEQ ID NO: 5444964 - DNA, 17 bp, Homo sapiens
tcaaactgctgcatact

SEQ ID NO: 5444965 - DNA, 14 bp, Homo sapiens
tcaaactgtagaaa

SEQ ID NO: 5444966 - DNA, 17 bp, Homo sapiens
tcaaactgtagaaatga

SEQ ID NO: 5444967 - DNA, 18 bp, Homo sapiens
tcaaactgtgaagcattt

SEQ ID NO: 5444968 - DNA, 21 bp, Homo sapiens
tcaaactgtgggattctgatt

SEQ ID NO: 5444969 - DNA, 22 bp, Homo sapiens
tcaaacttgtcaagaatgagaa

SEQ ID NO: 5444970 - DNA, 18 bp, Homo sapiens
tcaaactttacagaaaga

SEQ ID NO: 5444971 - DNA, 17 bp, Homo sapiens
tcaaactttcacctcag

SEQ ID NO: 5444972 - DNA, 14 bp, Homo sapiens
tcaaactttcactt

SEQ ID NO: 5444973 - DNA, 12 bp, Homo sapiens
tcaaactttcag

SEQ ID NO: 5444974 - DNA, 14 bp, Homo sapiens
tcaaacttttgaaa

SEQ ID NO: 5444975 - DNA, 17 bp, Homo sapiens
tcaaacttttgaaagat

SEQ ID NO: 5444976 - DNA, 21 bp, Homo sapiens
tcaaactttttccagcaaaat

SEQ ID NO: 5444977 - DNA, 22 bp, Homo sapiens
tcaaagaaaaacaatgaaattg

SEQ ID NO: 5444978 - DNA, 23 bp, Homo sapiens
tcaaagaaaaacaatgaaattga

SEQ ID NO: 5444979 - DNA, 15 bp, Homo sapiens
tcaaagaaaacatag

SEQ ID NO: 5444980 - DNA, 12 bp, Homo sapiens
tcaaagaaaaga

SEQ ID NO: 5444981 - DNA, 20 bp, Homo sapiens
tcaaagaaacttgaagcttt

SEQ ID NO: 5444982 - DNA, 15 bp, Homo sapiens
tcaaagaaagactgt

SEQ ID NO: 5444983 - DNA, 15 bp, Homo sapiens
tcaaagaaatattaa

SEQ ID NO: 5444984 - DNA, 12 bp, Homo sapiens
tcaaagaaatgc

SEQ ID NO: 5444985 - DNA, 15 bp, Homo sapiens
tcaaagaaattcaga

SEQ ID NO: 5444986 - DNA, 20 bp, Homo sapiens
tcaaagaaattcagaacagc

SEQ ID NO: 5444987 - DNA, 21 bp, Homo sapiens
tcaaagaaccttgaagaagtg

SEQ ID NO: 5444988 - DNA, 17 bp, Homo sapiens
tcaaagaagctgtcttg

SEQ ID NO: 5444989 - DNA, 20 bp, Homo sapiens
tcaaagaagctgtcttggaa

SEQ ID NO: 5444990 - DNA, 22 bp, Homo sapiens
tcaaagaaggatggcacctaaa

SEQ ID NO: 5444991 - DNA, 23 bp, Homo sapiens
tcaaagaaggtttgtgtttttct

SEQ ID NO: 5444992 - DNA, 14 bp, Homo sapiens
tcaaagaagtactg

SEQ ID NO: 5444993 - DNA, 18 bp, Homo sapiens
tcaacaaagaaatattat

SEQ ID NO: 5444994 - DNA, 20 bp, Homo sapiens
tcaacaaagaagaaccatct

SEQ ID NO: 5444995 - DNA, 14 bp, Homo sapiens
tcaacaaagcacag

SEQ ID NO: 5444996 - DNA, 18 bp, Homo sapiens
tcaacaaagcacagtgtt

SEQ ID NO: 5444997 - DNA, 19 bp, Homo sapiens
tcaacaaagtgctttttca

SEQ ID NO: 5444998 - DNA, 19 bp, Homo sapiens
tcaacaaattaaataaatt

SEQ ID NO: 5444999 - DNA, 20 bp, Homo sapiens
tcaacaaatttcattgcact

SEQ ID NO: 5445000 - DNA, 16 bp, Homo sapiens
tcaacaacaaaccaaa

SEQ ID NO: 5445001 - DNA, 17 bp, Homo sapiens
tcaacaacaaaccaaaa

SEQ ID NO: 5445002 - DNA, 22 bp, Homo sapiens
tcaacaacaattttaaataaga

SEQ ID NO: 5445003 - DNA, 14 bp, Homo sapiens
tcaacaaccaggga

SEQ ID NO: 5445004 - DNA, 14 bp, Homo sapiens
tcaacaactactac

SEQ ID NO: 5445005 - DNA, 22 bp, Homo sapiens
tcaacaactttgtgctttcctg

SEQ ID NO: 5445006 - DNA, 15 bp, Homo sapiens
tcaacaagaaataat

SEQ ID NO: 5445007 - DNA, 15 bp, Homo sapiens
tcaacaagaagaatt

SEQ ID NO: 5445008 - DNA, 17 bp, Homo sapiens
tcaacaagaagaatttg

SEQ ID NO: 5445009 - DNA, 20 bp, Homo sapiens
tcaacaagatttccttgtgc

SEQ ID NO: 5445010 - DNA, 19 bp, Homo sapiens
tcaacaagggagagacctc

SEQ ID NO: 5445011 - DNA, 14 bp, Homo sapiens
tcaacaataaaaac

SEQ ID NO: 5445012 - DNA, 17 bp, Homo sapiens
tcaacaataaaattttt

SEQ ID NO: 5445013 - DNA, 13 bp, Homo sapiens
tcaacaatgattt

SEQ ID NO: 5445014 - DNA, 19 bp, Homo sapiens
tcaacaatggttgaatgaa

SEQ ID NO: 5445015 - DNA, 13 bp, Homo sapiens
tcaacaattagag

SEQ ID NO: 5445016 - DNA, 18 bp, Homo sapiens
tcaacaattggtgtcatt

SEQ ID NO: 5445017 - DNA, 19 bp, Homo sapiens
tcaacaattggtgtcattt

SEQ ID NO: 5445018 - DNA, 20 bp, Homo sapiens
tcaacaattggtgtcatttt

SEQ ID NO: 5445019 - DNA, 14 bp, Homo sapiens
tcaacacaaagaca

SEQ ID NO: 5445020 - DNA, 23 bp, Homo sapiens
tcaacacaaagacacaggaagaa

SEQ ID NO: 5445021 - DNA, 15 bp, Homo sapiens
tcaacacaaagacat

SEQ ID NO: 5445022 - DNA, 16 bp, Homo sapiens
tcaacacaaagacatg

SEQ ID NO: 5445023 - DNA, 21 bp, Homo sapiens
tcaacacaaagacatggaaga

SEQ ID NO: 5445024 - DNA, 11 bp, Homo sapiens
tcaacacacag

SEQ ID NO: 5445025 - DNA, 15 bp, Homo sapiens
tcaacacactgcctt

SEQ ID NO: 5445026 - DNA, 19 bp, Homo sapiens
tcaacacaggtagcacaga

SEQ ID NO: 5445027 - DNA, 14 bp, Homo sapiens
tcaacaccatgatt

SEQ ID NO: 5445028 - DNA, 22 bp, Homo sapiens
tcaacaccatgattcctttaac

SEQ ID NO: 5445029 - DNA, 14 bp, Homo sapiens
tcaacacccagttt

SEQ ID NO: 5445030 - DNA, 22 bp, Homo sapiens
tcaacacccagtttccttggga

SEQ ID NO: 5445031 - DNA, 14 bp, Homo sapiens
tcaacaccctgctt

SEQ ID NO: 5445032 - DNA, 15 bp, Homo sapiens
tcaacaccctgcttc

SEQ ID NO: 5445033 - DNA, 23 bp, Homo sapiens
tcaacactaccagcgtatatata

SEQ ID NO: 5445034 - DNA, 19 bp, Homo sapiens
tcaacactatatattttat

SEQ ID NO: 5445035 - DNA, 14 bp, Homo sapiens
tcaacactcttctt

SEQ ID NO: 5445036 - DNA, 23 bp, Homo sapiens
tcaacacttaagggttttagaaa

SEQ ID NO: 5445037 - DNA, 18 bp, Homo sapiens
tcaacacttattttctga

SEQ ID NO: 5445038 - DNA, 20 bp, Homo sapiens
tcaacacttattttctgaat

SEQ ID NO: 5445039 - DNA, 14 bp, Homo sapiens
tcaacagaagcatt

SEQ ID NO: 5445040 - DNA, 14 bp, Homo sapiens
tcaacagaatgaaa

SEQ ID NO: 5445041 - DNA, 15 bp, Homo sapiens
tcaacagaatgaaaa

SEQ ID NO: 5445042 - DNA, 19 bp, Homo sapiens
tcaacagaatgaaaaatga

SEQ ID NO: 5445043 - DNA, 12 bp, Homo sapiens
tcaacagagaag

SEQ ID NO: 5445044 - DNA, 17 bp, Homo sapiens
tcaacagagaaggcagg

SEQ ID NO: 5445045 - DNA, 16 bp, Homo sapiens
tcaacagagaggacca

SEQ ID NO: 5445046 - DNA, 15 bp, Homo sapiens
tcaacagagagggag

SEQ ID NO: 5445047 - DNA, 21 bp, Homo sapiens
tcaacagagccctattggctt

SEQ ID NO: 5445048 - DNA, 17 bp, Homo sapiens
tcaacagagggagttta

SEQ ID NO: 5445049 - DNA, 15 bp, Homo sapiens
tcaacagcaagtgtg

SEQ ID NO: 5445050 - DNA, 16 bp, Homo sapiens
tcaacagcaagtgtga

SEQ ID NO: 5445051 - DNA, 17 bp, Homo sapiens
tcaacagcatgtctact

SEQ ID NO: 5445052 - DNA, 12 bp, Homo sapiens
tcaacagccaag

SEQ ID NO: 5445053 - DNA, 18 bp, Homo sapiens
tcaacagccaagtgtgac

SEQ ID NO: 5445054 - DNA, 15 bp, Homo sapiens
tcaacagctccccat

SEQ ID NO: 5445055 - DNA, 14 bp, Homo sapiens
tcaacaggcccagg

SEQ ID NO: 5445056 - DNA, 16 bp, Homo sapiens
tcaacaggcccaggga

SEQ ID NO: 5445057 - DNA, 20 bp, Homo sapiens
tcaacaggcccagggaggga

SEQ ID NO: 5445058 - DNA, 17 bp, Homo sapiens
tcaacaggcctcagggc

SEQ ID NO: 5445059 - DNA, 22 bp, Homo sapiens
tcaacaggcctcagggctcctt

SEQ ID NO: 5445060 - DNA, 22 bp, Homo sapiens
tcaacagtaaaccactgaaaaa

SEQ ID NO: 5445061 - DNA, 21 bp, Homo sapiens
tcaacagtcttgctgaattaa

SEQ ID NO: 5445062 - DNA, 14 bp, Homo sapiens
tcaacagtgttttc

SEQ ID NO: 5445063 - DNA, 15 bp, Homo sapiens
tcaacataacataag

SEQ ID NO: 5445064 - DNA, 22 bp, Homo sapiens
tcaacatacattggttttgaaa

SEQ ID NO: 5445065 - DNA, 17 bp, Homo sapiens
tcaacataccttggcca

SEQ ID NO: 5445066 - DNA, 19 bp, Homo sapiens
tcaacatactgtaatcaaa

SEQ ID NO: 5445067 - DNA, 16 bp, Homo sapiens
tcaacatatactattt

SEQ ID NO: 5445068 - DNA, 15 bp, Homo sapiens
tcaacatcaatgttc

SEQ ID NO: 5445069 - DNA, 23 bp, Homo sapiens
tcaacatcaatgttcattgtaat

SEQ ID NO: 5445070 - DNA, 17 bp, Homo sapiens
tcaacatcactgaaacc

SEQ ID NO: 5445071 - DNA, 14 bp, Homo sapiens
tcaacatcctgcca

SEQ ID NO: 5445072 - DNA, 22 bp, Homo sapiens
tcaacatctcttgagtgtctat

SEQ ID NO: 5445073 - DNA, 12 bp, Homo sapiens
tcaacatctttt

SEQ ID NO: 5445074 - DNA, 23 bp, Homo sapiens
tcaacatgcattgccatgaattt

SEQ ID NO: 5445075 - DNA, 18 bp, Homo sapiens
tcaacatggaaaaatcct

SEQ ID NO: 5445076 - DNA, 19 bp, Homo sapiens
tcaacatggaaaaatcctg

SEQ ID NO: 5445077 - DNA, 13 bp, Homo sapiens
tcaacatgtaggg

SEQ ID NO: 5445078 - DNA, 14 bp, Homo sapiens
tcaacatgtctcct

SEQ ID NO: 5445079 - DNA, 15 bp, Homo sapiens
tcaacatgtgtgact

SEQ ID NO: 5445080 - DNA, 15 bp, Homo sapiens
tcaacatgtgtttct

SEQ ID NO: 5445081 - DNA, 16 bp, Homo sapiens
tcaacatgtgtttctg

SEQ ID NO: 5445082 - DNA, 19 bp, Homo sapiens
tcaacattcaaagcagcag

SEQ ID NO: 5445083 - DNA, 14 bp, Homo sapiens
tcaacattccaggg

SEQ ID NO: 5445084 - DNA, 14 bp, Homo sapiens
tcaacattctttgc

SEQ ID NO: 5445085 - DNA, 17 bp, Homo sapiens
tcaacatttcagtgttt

SEQ ID NO: 5445086 - DNA, 15 bp, Homo sapiens
tcaacatttccaaaa

SEQ ID NO: 5445087 - DNA, 17 bp, Homo sapiens
tcaacatttgctttttg

SEQ ID NO: 5445088 - DNA, 20 bp, Homo sapiens
tcaacatttttttttctcca

SEQ ID NO: 5445089 - DNA, 20 bp, Homo sapiens
tcaaccaaatggtacaaaac

SEQ ID NO: 5445090 - DNA, 13 bp, Homo sapiens
tcaaccaactgca

SEQ ID NO: 5445091 - DNA, 19 bp, Homo sapiens
tcaaccacacacacctgtc

SEQ ID NO: 5445092 - DNA, 18 bp, Homo sapiens
tcaaccacacctaaatta

SEQ ID NO: 5445093 - DNA, 14 bp, Homo sapiens
tcaaccaccatgga

SEQ ID NO: 5445094 - DNA, 15 bp, Homo sapiens
tcaaccactaaagta

SEQ ID NO: 5445095 - DNA, 14 bp, Homo sapiens
tcaaccactgtggc

SEQ ID NO: 5445096 - DNA, 14 bp, Homo sapiens
tcaaccagacagat

SEQ ID NO: 5445097 - DNA, 22 bp, Homo sapiens
tcaaccagagaacagctcccct

SEQ ID NO: 5445098 - DNA, 21 bp, Homo sapiens
tcaaccagcattttactactt

SEQ ID NO: 5445099 - DNA, 20 bp, Homo sapiens
tcaaccagggattgtttctg

SEQ ID NO: 5445100 - DNA, 13 bp, Homo sapiens
tcaaccatcctgg

SEQ ID NO: 5445101 - DNA, 15 bp, Homo sapiens
tcaaccattccccat

SEQ ID NO: 5445102 - DNA, 17 bp, Homo sapiens
tcaacccaagctctggg

SEQ ID NO: 5445103 - DNA, 20 bp, Homo sapiens
tcaaccccaccatatgaatt

SEQ ID NO: 5445104 - DNA, 13 bp, Homo sapiens
tcaaccccaccct

SEQ ID NO: 5445105 - DNA, 16 bp, Homo sapiens
tcaaccccagacactg

SEQ ID NO: 5445106 - DNA, 14 bp, Homo sapiens
tcaaccccagactc

SEQ ID NO: 5445107 - DNA, 14 bp, Homo sapiens
tcaacccccctccc

SEQ ID NO: 5445108 - DNA, 18 bp, Homo sapiens
tcaaccccctcgcctcct

SEQ ID NO: 5445109 - DNA, 21 bp, Homo sapiens
tcaacccctcccctccatccc

SEQ ID NO: 5445110 - DNA, 14 bp, Homo sapiens
tcaacccctctcag

SEQ ID NO: 5445111 - DNA, 18 bp, Homo sapiens
tcaaccccttcgctcctg

SEQ ID NO: 5445112 - DNA, 19 bp, Homo sapiens
tcaaccccttcgctcctgt

SEQ ID NO: 5445113 - DNA, 16 bp, Homo sapiens
tcaacccctttgtaat

SEQ ID NO: 5445114 - DNA, 16 bp, Homo sapiens
tcaacccgctgcttcc

SEQ ID NO: 5445115 - DNA, 20 bp, Homo sapiens
tcaacccgctgcttccaggt

SEQ ID NO: 5445116 - DNA, 22 bp, Homo sapiens
tcaaccctaaaaagcagagctt

SEQ ID NO: 5445117 - DNA, 23 bp, Homo sapiens
tcaaccctaaaaagcagagcttt

SEQ ID NO: 5445118 - DNA, 19 bp, Homo sapiens
tcaaccctcaggggaaaac

SEQ ID NO: 5445119 - DNA, 15 bp, Homo sapiens
tcaaccctccctcag

SEQ ID NO: 5445120 - DNA, 13 bp, Homo sapiens
tcaaccctgcaat

SEQ ID NO: 5445121 - DNA, 16 bp, Homo sapiens
tcaacccttctggaaa

SEQ ID NO: 5445122 - DNA, 22 bp, Homo sapiens
tcaaccgcacatgtgccactgt

SEQ ID NO: 5445123 - DNA, 23 bp, Homo sapiens
tcaacctaaaacaatctgtaatt

SEQ ID NO: 5445124 - DNA, 13 bp, Homo sapiens
tcaacctaaccac

SEQ ID NO: 5445125 - DNA, 16 bp, Homo sapiens
tcaacctaagcaacag

SEQ ID NO: 5445126 - DNA, 20 bp, Homo sapiens
tcaacctactttcatactga

SEQ ID NO: 5445127 - DNA, 15 bp, Homo sapiens
tcaacctaggagcag

SEQ ID NO: 5445128 - DNA, 12 bp, Homo sapiens
tcaacctcccaa

SEQ ID NO: 5445129 - DNA, 13 bp, Homo sapiens
tcaacctccctgg

SEQ ID NO: 5445130 - DNA, 13 bp, Homo sapiens
tcaacctcctgga

SEQ ID NO: 5445131 - DNA, 16 bp, Homo sapiens
tcaacctcctgggcta

SEQ ID NO: 5445132 - DNA, 16 bp, Homo sapiens
tcaacctcctgggttc

SEQ ID NO: 5445133 - DNA, 15 bp, Homo sapiens
tcaacctcctgtgga

SEQ ID NO: 5445134 - DNA, 19 bp, Homo sapiens
tcaacctctctccttctgg

SEQ ID NO: 5445135 - DNA, 20 bp, Homo sapiens
tcaacctctctccttctggc

SEQ ID NO: 5445136 - DNA, 16 bp, Homo sapiens
tcaacctgaattaaag

SEQ ID NO: 5445137 - DNA, 18 bp, Homo sapiens
tcaacctgaattaaagtc

SEQ ID NO: 5445138 - DNA, 19 bp, Homo sapiens
tcaacctgcacttcatatc

SEQ ID NO: 5445139 - DNA, 18 bp, Homo sapiens
tcaacctggcaaaaatgc

SEQ ID NO: 5445140 - DNA, 21 bp, Homo sapiens
tcaacctggtggcaccagatg

SEQ ID NO: 5445141 - DNA, 15 bp, Homo sapiens
tcaacctgtaaatta

SEQ ID NO: 5445142 - DNA, 16 bp, Homo sapiens
tcaacctgtaaattat

SEQ ID NO: 5445143 - DNA, 15 bp, Homo sapiens
tcaacctgtgatgag

SEQ ID NO: 5445144 - DNA, 20 bp, Homo sapiens
tcaacctgtgatgaggggag

SEQ ID NO: 5445145 - DNA, 23 bp, Homo sapiens
tcaaccttaagacctactgttct

SEQ ID NO: 5445146 - DNA, 15 bp, Homo sapiens
tcaaccttaccaaaa

SEQ ID NO: 5445147 - DNA, 19 bp, Homo sapiens
tcaaccttccaacttcctg

SEQ ID NO: 5445148 - DNA, 13 bp, Homo sapiens
tcaaccttctggg

SEQ ID NO: 5445149 - DNA, 13 bp, Homo sapiens
tcaaccttggcct

SEQ ID NO: 5445150 - DNA, 14 bp, Homo sapiens
tcaaccttggcctt

SEQ ID NO: 5445151 - DNA, 21 bp, Homo sapiens
tcaacctttgtaagaaaacca

SEQ ID NO: 5445152 - DNA, 15 bp, Homo sapiens
tcaacgcagccctgc

SEQ ID NO: 5445153 - DNA, 15 bp, Homo sapiens
tcaacgcctctcctc

SEQ ID NO: 5445154 - DNA, 22 bp, Homo sapiens
tcaacgcttaaaggtgtcttcc

SEQ ID NO: 5445155 - DNA, 23 bp, Homo sapiens
tcaacgcttaaaggtgtcttcct

SEQ ID NO: 5445156 - DNA, 16 bp, Homo sapiens
tcaacggtctggcagg

SEQ ID NO: 5445157 - DNA, 16 bp, Homo sapiens
tcaacgtatgtgtgtt

SEQ ID NO: 5445158 - DNA, 15 bp, Homo sapiens
tcaacgtattgtttc

SEQ ID NO: 5445159 - DNA, 15 bp, Homo sapiens
tcaacgttaataatt

SEQ ID NO: 5445160 - DNA, 20 bp, Homo sapiens
tcaactaaagttgtacttta

SEQ ID NO: 5445161 - DNA, 14 bp, Homo sapiens
tcaactaaatgaga

SEQ ID NO: 5445162 - DNA, 21 bp, Homo sapiens
tcaactaattttatttctatt

SEQ ID NO: 5445163 - DNA, 23 bp, Homo sapiens
tcaactaattttatttctatttt

SEQ ID NO: 5445164 - DNA, 16 bp, Homo sapiens
tcaactaatttttgta

SEQ ID NO: 5445165 - DNA, 19 bp, Homo sapiens
tcaactacggttgggagaa

SEQ ID NO: 5445166 - DNA, 14 bp, Homo sapiens
tcaactatgtaggt

SEQ ID NO: 5445167 - DNA, 16 bp, Homo sapiens
tcaactcacctaatgt

SEQ ID NO: 5445168 - DNA, 13 bp, Homo sapiens
tcaactcactaga

SEQ ID NO: 5445169 - DNA, 14 bp, Homo sapiens
tcaactcatcattt

SEQ ID NO: 5445170 - DNA, 22 bp, Homo sapiens
tcaactccaaactgactcttaa

SEQ ID NO: 5445171 - DNA, 13 bp, Homo sapiens
tcaactccaaggc

SEQ ID NO: 5445172 - DNA, 21 bp, Homo sapiens
tcaaggtggaaatggcccatt

SEQ ID NO: 5445173 - DNA, 20 bp, Homo sapiens
tcaaggtggccaaattattt

SEQ ID NO: 5445174 - DNA, 16 bp, Homo sapiens
tcaaggtgtaaaatat

SEQ ID NO: 5445175 - DNA, 22 bp, Homo sapiens
tcaaggttactgggagtgtggg

SEQ ID NO: 5445176 - DNA, 14 bp, Homo sapiens
tcaaggttctaacc

SEQ ID NO: 5445177 - DNA, 17 bp, Homo sapiens
tcaaggttctcatttct

SEQ ID NO: 5445178 - DNA, 20 bp, Homo sapiens
tcaaggttttaggttctaaa

SEQ ID NO: 5445179 - DNA, 21 bp, Homo sapiens
tcaaggttttaggttctaaag

SEQ ID NO: 5445180 - DNA, 19 bp, Homo sapiens
tcaagtaaaacaaatgaaa

SEQ ID NO: 5445181 - DNA, 17 bp, Homo sapiens
tcaagtaaaagaaaagc

SEQ ID NO: 5445182 - DNA, 21 bp, Homo sapiens
tcaagtaaaagaaaagccgaa

SEQ ID NO: 5445183 - DNA, 14 bp, Homo sapiens
tcaagtaacacttt

SEQ ID NO: 5445184 - DNA, 23 bp, Homo sapiens
tcaagtaagaagacatgaaccaa

SEQ ID NO: 5445185 - DNA, 19 bp, Homo sapiens
tcaagtaagtagatgcctg

SEQ ID NO: 5445186 - DNA, 17 bp, Homo sapiens
tcaagtaattctgctgt

SEQ ID NO: 5445187 - DNA, 20 bp, Homo sapiens
tcaagtaattttcatattaa

SEQ ID NO: 5445188 - DNA, 19 bp, Homo sapiens
tcaagtaccaccaagggat

SEQ ID NO: 5445189 - DNA, 16 bp, Homo sapiens
tcaagtactacatttt

SEQ ID NO: 5445190 - DNA, 18 bp, Homo sapiens
tcaagtagactactgttc

SEQ ID NO: 5445191 - DNA, 19 bp, Homo sapiens
tcaagtagatcatggcagc

SEQ ID NO: 5445192 - DNA, 13 bp, Homo sapiens
tcaagtagctggg

SEQ ID NO: 5445193 - DNA, 13 bp, Homo sapiens
tcaagtataaagt

SEQ ID NO: 5445194 - DNA, 21 bp, Homo sapiens
tcaagtataaagtcaggacct

SEQ ID NO: 5445195 - DNA, 16 bp, Homo sapiens
tcaagtatataaagtt

SEQ ID NO: 5445196 - DNA, 16 bp, Homo sapiens
tcaagtattaagcagt

SEQ ID NO: 5445197 - DNA, 12 bp, Homo sapiens
tcaagtattact

SEQ ID NO: 5445198 - DNA, 21 bp, Homo sapiens
tcaagtattatacctttttta

SEQ ID NO: 5445199 - DNA, 15 bp, Homo sapiens
tcaagtattggcaaa

SEQ ID NO: 5445200 - DNA, 22 bp, Homo sapiens
tcaagtatttaagcctaaagat

SEQ ID NO: 5445201 - DNA, 22 bp, Homo sapiens
tcaagtatttattattgaagat

SEQ ID NO: 5445202 - DNA, 18 bp, Homo sapiens
tcaagtcaatcatttctc

SEQ ID NO: 5445203 - DNA, 15 bp, Homo sapiens
tcaagtcacctcctt

SEQ ID NO: 5445204 - DNA, 15 bp, Homo sapiens
tcaagtcactcccaa

SEQ ID NO: 5445205 - DNA, 22 bp, Homo sapiens
tcaagtcattccacacatttcc

SEQ ID NO: 5445206 - DNA, 11 bp, Homo sapiens
tcaagtccaga

SEQ ID NO: 5445207 - DNA, 14 bp, Homo sapiens
tcaagtccatctga

SEQ ID NO: 5445208 - DNA, 21 bp, Homo sapiens
tcaagtcccgccctggctctt

SEQ ID NO: 5445209 - DNA, 16 bp, Homo sapiens
tcaagtcctgactggg

SEQ ID NO: 5445210 - DNA, 18 bp, Homo sapiens
tcaagtcctttgtgaata

SEQ ID NO: 5445211 - DNA, 18 bp, Homo sapiens
tcaagtctaccaattata

SEQ ID NO: 5445212 - DNA, 21 bp, Homo sapiens
tcaagtctaccctgatcacct

SEQ ID NO: 5445213 - DNA, 14 bp, Homo sapiens
tcaagtctgtgaaa

SEQ ID NO: 5445214 - DNA, 22 bp, Homo sapiens
tcaagtctttctctttccctgg

SEQ ID NO: 5445215 - DNA, 23 bp, Homo sapiens
tcaagtctttctctttccctggt

SEQ ID NO: 5445216 - DNA, 15 bp, Homo sapiens
tcaagtgaaaaagga

SEQ ID NO: 5445217 - DNA, 19 bp, Homo sapiens
tcaagtgaatctaaaagct

SEQ ID NO: 5445218 - DNA, 20 bp, Homo sapiens
tcaagtgaggggccctttgc

SEQ ID NO: 5445219 - DNA, 21 bp, Homo sapiens
tcaagtgatatatgtatttat

SEQ ID NO: 5445220 - DNA, 14 bp, Homo sapiens
tcaagtgatccacc

SEQ ID NO: 5445221 - DNA, 20 bp, Homo sapiens
tcaagtgatctgcccacctc

SEQ ID NO: 5445222 - DNA, 15 bp, Homo sapiens
tcaagtgatctttca

SEQ ID NO: 5445223 - DNA, 16 bp, Homo sapiens
tcaagtgattctcctg

SEQ ID NO: 5445224 - DNA, 18 bp, Homo sapiens
tcaagtgattctcctgcc

SEQ ID NO: 5445225 - DNA, 17 bp, Homo sapiens
tcaagtgcaatccatgt

SEQ ID NO: 5445226 - DNA, 20 bp, Homo sapiens
tcaagtgcaatgccccctcc

SEQ ID NO: 5445227 - DNA, 18 bp, Homo sapiens
tcaagtgcacctacacca

SEQ ID NO: 5445228 - DNA, 21 bp, Homo sapiens
tcaagtgcatgctctctgcag

SEQ ID NO: 5445229 - DNA, 19 bp, Homo sapiens
tcaagtgcatttctgggcc

SEQ ID NO: 5445230 - DNA, 15 bp, Homo sapiens
tcaagtgccattcat

SEQ ID NO: 5445231 - DNA, 23 bp, Homo sapiens
tcaagtgccctctccgagctggt

SEQ ID NO: 5445232 - DNA, 21 bp, Homo sapiens
tcaagtgccttttgctgcgca

SEQ ID NO: 5445233 - DNA, 22 bp, Homo sapiens
tcaagtggcaaagctgttcttc

SEQ ID NO: 5445234 - DNA, 14 bp, Homo sapiens
tcaagtgtaattag

SEQ ID NO: 5445235 - DNA, 17 bp, Homo sapiens
tcaagtgtaattagctt

SEQ ID NO: 5445236 - DNA, 19 bp, Homo sapiens
tcaagtgtccccagaccct

SEQ ID NO: 5445237 - DNA, 22 bp, Homo sapiens
tcaagtgtgcctgctatccagc

SEQ ID NO: 5445238 - DNA, 19 bp, Homo sapiens
tcaagtgttacagaggaca

SEQ ID NO: 5445239 - DNA, 22 bp, Homo sapiens
tcaagtgttacctaacaatgtt

SEQ ID NO: 5445240 - DNA, 18 bp, Homo sapiens
tcaagtgttttggagaaa

SEQ ID NO: 5445241 - DNA, 21 bp, Homo sapiens
tcaagtgttttggagaaaaaa

SEQ ID NO: 5445242 - DNA, 14 bp, Homo sapiens
tcaagttaaagtga

SEQ ID NO: 5445243 - DNA, 16 bp, Homo sapiens
tcaagttaccaatgta

SEQ ID NO: 5445244 - DNA, 15 bp, Homo sapiens
tcaagttagctcagg

SEQ ID NO: 5445245 - DNA, 15 bp, Homo sapiens
tcaagttataggaaa

SEQ ID NO: 5445246 - DNA, 20 bp, Homo sapiens
tcaagttattcaaatttgta

SEQ ID NO: 5445247 - DNA, 23 bp, Homo sapiens
tcaagttattcaaatttgtacag

SEQ ID NO: 5445248 - DNA, 13 bp, Homo sapiens
tcaagttattcag

SEQ ID NO: 5445249 - DNA, 14 bp, Homo sapiens
tcaagttattcaga

SEQ ID NO: 5445250 - DNA, 17 bp, Homo sapiens
tcaagttattcagaaat

SEQ ID NO: 5445251 - DNA, 13 bp, Homo sapiens
tcaagttattgta

SEQ ID NO: 5445252 - DNA, 16 bp, Homo sapiens
tcaagttcaaggacca

SEQ ID NO: 5445253 - DNA, 16 bp, Homo sapiens
tcaagttcacacctgc

SEQ ID NO: 5445254 - DNA, 20 bp, Homo sapiens
tcaagttcatagtttctgta

SEQ ID NO: 5445255 - DNA, 14 bp, Homo sapiens
tcaagttccagtgc

SEQ ID NO: 5445256 - DNA, 24 bp, Homo sapiens
tcaagttccctcctgcagcctgac

SEQ ID NO: 5445257 - DNA, 21 bp, Homo sapiens
tcaagttccgtctcctctcca

SEQ ID NO: 5445258 - DNA, 13 bp, Homo sapiens
tcaagttctaaga

SEQ ID NO: 5445259 - DNA, 14 bp, Homo sapiens
tcaagttctaagat

SEQ ID NO: 5445260 - DNA, 22 bp, Homo sapiens
tcaagttgagatttttaagaac

SEQ ID NO: 5445261 - DNA, 23 bp, Homo sapiens
tcaagttgagatttttaagaact

SEQ ID NO: 5445262 - DNA, 17 bp, Homo sapiens
tcaagttgaggggcttc

SEQ ID NO: 5445263 - DNA, 20 bp, Homo sapiens
tcaagttgtaaaaatgaaag

SEQ ID NO: 5445264 - DNA, 17 bp, Homo sapiens
tcaagttgtcaggttat

SEQ ID NO: 5445265 - DNA, 14 bp, Homo sapiens
tcaagttgtgtgct

SEQ ID NO: 5445266 - DNA, 23 bp, Homo sapiens
tcaagttgttccttaagtcagaa

SEQ ID NO: 5445267 - DNA, 19 bp, Homo sapiens
tcaagttgttgactgtgat

SEQ ID NO: 5445268 - DNA, 20 bp, Homo sapiens
tcaagttgttgactgtgatt

SEQ ID NO: 5445269 - DNA, 23 bp, Homo sapiens
tcaagttgttgactgtgattaga

SEQ ID NO: 5445270 - DNA, 18 bp, Homo sapiens
tcaagttgtttaactgtg

SEQ ID NO: 5445271 - DNA, 17 bp, Homo sapiens
tcaagtttaaaagccat

SEQ ID NO: 5445272 - DNA, 18 bp, Homo sapiens
tcaagtttgaccagtgca

SEQ ID NO: 5445273 - DNA, 15 bp, Homo sapiens
tcaagttttaaagtt

SEQ ID NO: 5445274 - DNA, 16 bp, Homo sapiens
tcaagtttttatagtt

SEQ ID NO: 5445275 - DNA, 16 bp, Homo sapiens
tcaagtttttcagaaa

SEQ ID NO: 5445276 - DNA, 16 bp, Homo sapiens
tcaataaaaaaaagaa

SEQ ID NO: 5445277 - DNA, 16 bp, Homo sapiens
tcaataaaatcatgta

SEQ ID NO: 5445278 - DNA, 14 bp, Homo sapiens
tcaataaaatccat

SEQ ID NO: 5445279 - DNA, 15 bp, Homo sapiens
tcaataaaatgtgat

SEQ ID NO: 5445280 - DNA, 19 bp, Homo sapiens
tcaataaaatgtgattttt

SEQ ID NO: 5445281 - DNA, 19 bp, Homo sapiens
tcaataaaattatagctct

SEQ ID NO: 5445282 - DNA, 13 bp, Homo sapiens
tcaataaaattct

SEQ ID NO: 5445283 - DNA, 20 bp, Homo sapiens
tcaataaaattctgtaattt

SEQ ID NO: 5445284 - DNA, 18 bp, Homo sapiens
tcaataaacaacagctga

SEQ ID NO: 5445285 - DNA, 14 bp, Homo sapiens
tcaataaacagctt

SEQ ID NO: 5445286 - DNA, 20 bp, Homo sapiens
tcaataaaccacaagcatct

SEQ ID NO: 5445287 - DNA, 13 bp, Homo sapiens
tcaataaacgatt

SEQ ID NO: 5445288 - DNA, 17 bp, Homo sapiens
tcaataaacgatttaat

SEQ ID NO: 5445289 - DNA, 23 bp, Homo sapiens
tcaataaacgatttaattctctt

SEQ ID NO: 5445290 - DNA, 15 bp, Homo sapiens
tcaataaacttgtag

SEQ ID NO: 5445291 - DNA, 17 bp, Homo sapiens
tcaataaacttgtgcct

SEQ ID NO: 5445292 - DNA, 15 bp, Homo sapiens
tcaataaagaaaact

SEQ ID NO: 5445293 - DNA, 14 bp, Homo sapiens
tcaataaagcagag

SEQ ID NO: 5445294 - DNA, 16 bp, Homo sapiens
tcaataaagcagagcc

SEQ ID NO: 5445295 - DNA, 23 bp, Homo sapiens
tcaataaagcagagccaaggcca

SEQ ID NO: 5445296 - DNA, 13 bp, Homo sapiens
tcaataaagctcg

SEQ ID NO: 5445297 - DNA, 15 bp, Homo sapiens
tcaataaaggaaata

SEQ ID NO: 5445298 - DNA, 13 bp, Homo sapiens
tcaataaaggtca

SEQ ID NO: 5445299 - DNA, 11 bp, Homo sapiens
tcaataaagta

SEQ ID NO: 5445300 - DNA, 14 bp, Homo sapiens
tcaataaagtattt

SEQ ID NO: 5445301 - DNA, 16 bp, Homo sapiens
tcaataaagtatttaa

SEQ ID NO: 5445302 - DNA, 12 bp, Homo sapiens
tcaataaagttg

SEQ ID NO: 5445303 - DNA, 13 bp, Homo sapiens
tcaataaagttgt

SEQ ID NO: 5445304 - DNA, 21 bp, Homo sapiens
tcaataaagttgttgcattcc

SEQ ID NO: 5445305 - DNA, 12 bp, Homo sapiens
tcaataaagttt

SEQ ID NO: 5445306 - DNA, 18 bp, Homo sapiens
tcaataaatcgtgctggg

SEQ ID NO: 5445307 - DNA, 17 bp, Homo sapiens
tcaataaatctttcaaa

SEQ ID NO: 5445308 - DNA, 13 bp, Homo sapiens
tcaataaatgaca

SEQ ID NO: 5445309 - DNA, 22 bp, Homo sapiens
tcaataaatgacacccagacct

SEQ ID NO: 5445310 - DNA, 16 bp, Homo sapiens
tcaataaatgatatat

SEQ ID NO: 5445311 - DNA, 15 bp, Homo sapiens
tcaataaatgtctgt

SEQ ID NO: 5445312 - DNA, 16 bp, Homo sapiens
tcaataaatgtctgtt

SEQ ID NO: 5445313 - DNA, 16 bp, Homo sapiens
tcaataaatgttgaaa

SEQ ID NO: 5445314 - DNA, 21 bp, Homo sapiens
tcaataaattgttttttaatt

SEQ ID NO: 5445315 - DNA, 23 bp, Homo sapiens
tcaataacagatggtgctgctaa

SEQ ID NO: 5445316 - DNA, 18 bp, Homo sapiens
tcaataacagccgctcca

SEQ ID NO: 5445317 - DNA, 14 bp, Homo sapiens
tcaataacgaagtt

SEQ ID NO: 5445318 - DNA, 16 bp, Homo sapiens
tcaataactattgctg

SEQ ID NO: 5445319 - DNA, 19 bp, Homo sapiens
tcaataactctgattttga

SEQ ID NO: 5445320 - DNA, 20 bp, Homo sapiens
tcaataactttatatgaagt

SEQ ID NO: 5445321 - DNA, 20 bp, Homo sapiens
tcaataagcatcaaactctt

SEQ ID NO: 5445322 - DNA, 22 bp, Homo sapiens
tcaataagcctcagctttctaa

SEQ ID NO: 5445323 - DNA, 23 bp, Homo sapiens
tcaataagtgttgtaccatatgt

SEQ ID NO: 5445324 - DNA, 14 bp, Homo sapiens
tcaataatataata

SEQ ID NO: 5445325 - DNA, 21 bp, Homo sapiens
tcaataattgtggagaggaga

SEQ ID NO: 5445326 - DNA, 16 bp, Homo sapiens
tcaatacacagtactt

SEQ ID NO: 5445327 - DNA, 23 bp, Homo sapiens
tcaatacagcctgaataaaccaa

SEQ ID NO: 5445328 - DNA, 14 bp, Homo sapiens
tcaatacagcttca

SEQ ID NO: 5445329 - DNA, 16 bp, Homo sapiens
tcaatacccctgttaa

SEQ ID NO: 5445330 - DNA, 18 bp, Homo sapiens
tcaataccgctcagtatt

SEQ ID NO: 5445331 - DNA, 20 bp, Homo sapiens
tcaataccgctcagtatttt

SEQ ID NO: 5445332 - DNA, 20 bp, Homo sapiens
tcaatacctggcctcattta

SEQ ID NO: 5445333 - DNA, 21 bp, Homo sapiens
tcaatacctggcctcatttaa

SEQ ID NO: 5445334 - DNA, 16 bp, Homo sapiens
tcaatactacctctga

SEQ ID NO: 5445335 - DNA, 14 bp, Homo sapiens
tcaatactctctga

SEQ ID NO: 5445336 - DNA, 18 bp, Homo sapiens
tcaatactcttaaatttt

SEQ ID NO: 5445337 - DNA, 19 bp, Homo sapiens
tcaatactcttaaatttta

SEQ ID NO: 5445338 - DNA, 15 bp, Homo sapiens
tcaatactcttgaaa

SEQ ID NO: 5445339 - DNA, 19 bp, Homo sapiens
tcaatactcttgaaatgta

SEQ ID NO: 5445340 - DNA, 13 bp, Homo sapiens
tcaatactgagcc

SEQ ID NO: 5445341 - DNA, 20 bp, Homo sapiens
tcaatactgagccatttata

SEQ ID NO: 5445342 - DNA, 13 bp, Homo sapiens
tcaatactgcctt

SEQ ID NO: 5445343 - DNA, 20 bp, Homo sapiens
tcaatactgtatgccttctg

SEQ ID NO: 5445344 - DNA, 21 bp, Homo sapiens
tcaatactgtatgccttctgt

SEQ ID NO: 5445345 - DNA, 15 bp, Homo sapiens
tcaatagaacatgca

SEQ ID NO: 5445346 - DNA, 14 bp, Homo sapiens
tcaatagaactgtt

SEQ ID NO: 5445347 - DNA, 17 bp, Homo sapiens
tcaatagactgtactta

SEQ ID NO: 5445348 - DNA, 20 bp, Homo sapiens
tcaatagatttaggagcaga

SEQ ID NO: 5445349 - DNA, 19 bp, Homo sapiens
tcacaaagggactttggaa

SEQ ID NO: 5445350 - DNA, 17 bp, Homo sapiens
tcacaaaggttttgtct

SEQ ID NO: 5445351 - DNA, 11 bp, Homo sapiens
tcacaaataaa

SEQ ID NO: 5445352 - DNA, 19 bp, Homo sapiens
tcacaaatagttgtaaata

SEQ ID NO: 5445353 - DNA, 22 bp, Homo sapiens
tcacaaatatagttgaacaaga

SEQ ID NO: 5445354 - DNA, 15 bp, Homo sapiens
tcacaaatattaaaa

SEQ ID NO: 5445355 - DNA, 17 bp, Homo sapiens
tcacaaatattaaaaag

SEQ ID NO: 5445356 - DNA, 20 bp, Homo sapiens
tcacaaatattaaaaagtct

SEQ ID NO: 5445357 - DNA, 21 bp, Homo sapiens
tcacaaatattaaaaagtctt

SEQ ID NO: 5445358 - DNA, 20 bp, Homo sapiens
tcacaaatcctaaaagaagc

SEQ ID NO: 5445359 - DNA, 12 bp, Homo sapiens
tcacaaatgact

SEQ ID NO: 5445360 - DNA, 14 bp, Homo sapiens
tcacaaatgacttt

SEQ ID NO: 5445361 - DNA, 19 bp, Homo sapiens
tcacaaatgactttattat

SEQ ID NO: 5445362 - DNA, 23 bp, Homo sapiens
tcacaaatgatattaaaaattgg

SEQ ID NO: 5445363 - DNA, 15 bp, Homo sapiens
tcacaaatgtcattg

SEQ ID NO: 5445364 - DNA, 20 bp, Homo sapiens
tcacaaattccgattagacc

SEQ ID NO: 5445365 - DNA, 16 bp, Homo sapiens
tcacaaattgatcaag

SEQ ID NO: 5445366 - DNA, 19 bp, Homo sapiens
tcacaaatttctctgttcc

SEQ ID NO: 5445367 - DNA, 15 bp, Homo sapiens
tcacaacaaaaggaa

SEQ ID NO: 5445368 - DNA, 16 bp, Homo sapiens
tcacaacaacctggtc

SEQ ID NO: 5445369 - DNA, 17 bp, Homo sapiens
tcacaacagatttctaa

SEQ ID NO: 5445370 - DNA, 15 bp, Homo sapiens
tcacaacagtcttgt

SEQ ID NO: 5445371 - DNA, 20 bp, Homo sapiens
tcacaacataaggagaatgt

SEQ ID NO: 5445372 - DNA, 13 bp, Homo sapiens
tcacaaccaagaa

SEQ ID NO: 5445373 - DNA, 18 bp, Homo sapiens
tcacaaccagccacacag

SEQ ID NO: 5445374 - DNA, 20 bp, Homo sapiens
tcacaaccagccacacagag

SEQ ID NO: 5445375 - DNA, 18 bp, Homo sapiens
tcacaacccttctctgtt

SEQ ID NO: 5445376 - DNA, 19 bp, Homo sapiens
tcacaacccttctctgttg

SEQ ID NO: 5445377 - DNA, 20 bp, Homo sapiens
tcacaacccttctctgttgg

SEQ ID NO: 5445378 - DNA, 12 bp, Homo sapiens
tcacaacctctc

SEQ ID NO: 5445379 - DNA, 14 bp, Homo sapiens
tcacaaccttctgt

SEQ ID NO: 5445380 - DNA, 16 bp, Homo sapiens
tcacaacgtgcattgt

SEQ ID NO: 5445381 - DNA, 19 bp, Homo sapiens
tcacaacgtgcattgtgct

SEQ ID NO: 5445382 - DNA, 13 bp, Homo sapiens
tcacaacttttct

SEQ ID NO: 5445383 - DNA, 15 bp, Homo sapiens
tcacaacttttctgc

SEQ ID NO: 5445384 - DNA, 16 bp, Homo sapiens
tcacaacttttctgct

SEQ ID NO: 5445385 - DNA, 20 bp, Homo sapiens
tcacaagaacacacacatat

SEQ ID NO: 5445386 - DNA, 14 bp, Homo sapiens
tcacaagaagacca

SEQ ID NO: 5445387 - DNA, 15 bp, Homo sapiens
tcacaagaagaccag

SEQ ID NO: 5445388 - DNA, 17 bp, Homo sapiens
tcacaagacccaaaagg

SEQ ID NO: 5445389 - DNA, 18 bp, Homo sapiens
tcacaagacccaaaaggc

SEQ ID NO: 5445390 - DNA, 17 bp, Homo sapiens
tcacaagagcccagcag

SEQ ID NO: 5445391 - DNA, 20 bp, Homo sapiens
tcacaagcaacagactctca

SEQ ID NO: 5445392 - DNA, 14 bp, Homo sapiens
tcacaagcaataat

SEQ ID NO: 5445393 - DNA, 16 bp, Homo sapiens
tcacaagcaataatta

SEQ ID NO: 5445394 - DNA, 12 bp, Homo sapiens
tcacaagcccag

SEQ ID NO: 5445395 - DNA, 16 bp, Homo sapiens
tcacaagcccaggctg

SEQ ID NO: 5445396 - DNA, 18 bp, Homo sapiens
tcacaagccgtgttttat

SEQ ID NO: 5445397 - DNA, 16 bp, Homo sapiens
tcacaagcctcctgta

SEQ ID NO: 5445398 - DNA, 16 bp, Homo sapiens
tcacaagcgctcccag

SEQ ID NO: 5445399 - DNA, 17 bp, Homo sapiens
tcacaagcgctcccagc

SEQ ID NO: 5445400 - DNA, 22 bp, Homo sapiens
tcacaagcgctcccagcctgcc

SEQ ID NO: 5445401 - DNA, 23 bp, Homo sapiens
tcacaagctgtagataacagcaa

SEQ ID NO: 5445402 - DNA, 16 bp, Homo sapiens
tcacaaggcagcaagg

SEQ ID NO: 5445403 - DNA, 22 bp, Homo sapiens
tcacaaggcagcaaggcccgag

SEQ ID NO: 5445404 - DNA, 16 bp, Homo sapiens
tcacaaggcccaggag

SEQ ID NO: 5445405 - DNA, 17 bp, Homo sapiens
tcacaaggcccaggaga

SEQ ID NO: 5445406 - DNA, 18 bp, Homo sapiens
tcacaagtaacagttgaa

SEQ ID NO: 5445407 - DNA, 16 bp, Homo sapiens
tcacaagtaggagaca

SEQ ID NO: 5445408 - DNA, 18 bp, Homo sapiens
tcacaagtcctgccaagt

SEQ ID NO: 5445409 - DNA, 14 bp, Homo sapiens
tcacaagtgagccc

SEQ ID NO: 5445410 - DNA, 20 bp, Homo sapiens
tcacaagtgggtacccccag

SEQ ID NO: 5445411 - DNA, 22 bp, Homo sapiens
tcacaataaagagaaccatgtg

SEQ ID NO: 5445412 - DNA, 14 bp, Homo sapiens
tcacaataaagttt

SEQ ID NO: 5445413 - DNA, 13 bp, Homo sapiens
tcacaataaatgg

SEQ ID NO: 5445414 - DNA, 17 bp, Homo sapiens
tcacaataaatggccag

SEQ ID NO: 5445415 - DNA, 14 bp, Homo sapiens
tcacaatacagata

SEQ ID NO: 5445416 - DNA, 19 bp, Homo sapiens
tcacaatccacaaatgatg

SEQ ID NO: 5445417 - DNA, 23 bp, Homo sapiens
tcacaatgaaatgctctcctttc

SEQ ID NO: 5445418 - DNA, 19 bp, Homo sapiens
tcacaatgagaaaaataaa

SEQ ID NO: 5445419 - DNA, 15 bp, Homo sapiens
tcacaatgagattga

SEQ ID NO: 5445420 - DNA, 13 bp, Homo sapiens
tcacaatgtgaaa

SEQ ID NO: 5445421 - DNA, 17 bp, Homo sapiens
tcacaatgtgaaactga

SEQ ID NO: 5445422 - DNA, 19 bp, Homo sapiens
tcacaatgtgaaactgaag

SEQ ID NO: 5445423 - DNA, 14 bp, Homo sapiens
tcacaatgttctgg

SEQ ID NO: 5445424 - DNA, 15 bp, Homo sapiens
tcacaattattaaat

SEQ ID NO: 5445425 - DNA, 22 bp, Homo sapiens
tcacaattccagactttctatt

SEQ ID NO: 5445426 - DNA, 23 bp, Homo sapiens
tcacaattcttagatctggtgtc

SEQ ID NO: 5445427 - DNA, 15 bp, Homo sapiens
tcacaattgtaaagt

SEQ ID NO: 5445428 - DNA, 19 bp, Homo sapiens
tcacaatttaaaatatttc

SEQ ID NO: 5445429 - DNA, 21 bp, Homo sapiens
tcacaattttcctgtggaata

SEQ ID NO: 5445430 - DNA, 18 bp, Homo sapiens
tcacaattttctgtgcca

SEQ ID NO: 5445431 - DNA, 18 bp, Homo sapiens
tcacacaaaggcatgctg

SEQ ID NO: 5445432 - DNA, 12 bp, Homo sapiens
tcacacaaagtg

SEQ ID NO: 5445433 - DNA, 17 bp, Homo sapiens
tcacacaaagtgaaatt

SEQ ID NO: 5445434 - DNA, 18 bp, Homo sapiens
tcacacaacactgatgtg

SEQ ID NO: 5445435 - DNA, 14 bp, Homo sapiens
tcacacaactactt

SEQ ID NO: 5445436 - DNA, 23 bp, Homo sapiens
tcacacaagcacacacacacagt

SEQ ID NO: 5445437 - DNA, 15 bp, Homo sapiens
tcacacaaggctggg

SEQ ID NO: 5445438 - DNA, 16 bp, Homo sapiens
tcacacaaggctgggc

SEQ ID NO: 5445439 - DNA, 17 bp, Homo sapiens
tcacacaaggctgggca

SEQ ID NO: 5445440 - DNA, 15 bp, Homo sapiens
tcacacaatatagtt

SEQ ID NO: 5445441 - DNA, 16 bp, Homo sapiens
tcacacaatatagttt

SEQ ID NO: 5445442 - DNA, 21 bp, Homo sapiens
tcacacaatatagttttttct

SEQ ID NO: 5445443 - DNA, 24 bp, Homo sapiens
tcacacacacaaaaaatgcacaaa

SEQ ID NO: 5445444 - DNA, 14 bp, Homo sapiens
tcacacacagactg

SEQ ID NO: 5445445 - DNA, 12 bp, Homo sapiens
tcacacacagcc

SEQ ID NO: 5445446 - DNA, 13 bp, Homo sapiens
tcacacacagcct

SEQ ID NO: 5445447 - DNA, 15 bp, Homo sapiens
tcacacacagcctgg

SEQ ID NO: 5445448 - DNA, 15 bp, Homo sapiens
tcacacaccagcact

SEQ ID NO: 5445449 - DNA, 15 bp, Homo sapiens
tcacacaccctgagg

SEQ ID NO: 5445450 - DNA, 16 bp, Homo sapiens
tcacacacctctgccc

SEQ ID NO: 5445451 - DNA, 13 bp, Homo sapiens
tcacacacgtgag

SEQ ID NO: 5445452 - DNA, 23 bp, Homo sapiens
tcacacactcacaatttaaaata

SEQ ID NO: 5445453 - DNA, 13 bp, Homo sapiens
tcacacactggac

SEQ ID NO: 5445454 - DNA, 19 bp, Homo sapiens
tcacacactggaccccact

SEQ ID NO: 5445455 - DNA, 21 bp, Homo sapiens
tcacacactggaccccactgg

SEQ ID NO: 5445456 - DNA, 22 bp, Homo sapiens
tcacacactggaccccactggc

SEQ ID NO: 5445457 - DNA, 11 bp, Homo sapiens
tcacacagaca

SEQ ID NO: 5445458 - DNA, 21 bp, Homo sapiens
tcacacagagcgcctcacctg

SEQ ID NO: 5445459 - DNA, 20 bp, Homo sapiens
tcacacagccaggtgccttg

SEQ ID NO: 5445460 - DNA, 19 bp, Homo sapiens
tcacacaggacccccttcc

SEQ ID NO: 5445461 - DNA, 23 bp, Homo sapiens
tcacacagggctctttgatggac

SEQ ID NO: 5445462 - DNA, 23 bp, Homo sapiens
tcacacagtgggtggtggatctg

SEQ ID NO: 5445463 - DNA, 15 bp, Homo sapiens
tcacacatcacattc

SEQ ID NO: 5445464 - DNA, 14 bp, Homo sapiens
tcacacatccagac

SEQ ID NO: 5445465 - DNA, 22 bp, Homo sapiens
tcacacatccagacatcatgaa

SEQ ID NO: 5445466 - DNA, 17 bp, Homo sapiens
tcacacatccccagcca

SEQ ID NO: 5445467 - DNA, 20 bp, Homo sapiens
tcacacatccccagccaggg

SEQ ID NO: 5445468 - DNA, 18 bp, Homo sapiens
tcacacatctgggtgccc

SEQ ID NO: 5445469 - DNA, 21 bp, Homo sapiens
tcacacatctgggtgccctga

SEQ ID NO: 5445470 - DNA, 23 bp, Homo sapiens
tcacacatgcacttttgggcctt

SEQ ID NO: 5445471 - DNA, 22 bp, Homo sapiens
tcacacatgcatcatcagccta

SEQ ID NO: 5445472 - DNA, 14 bp, Homo sapiens
tcacacatttgcct

SEQ ID NO: 5445473 - DNA, 14 bp, Homo sapiens
tcacaccaaggaag

SEQ ID NO: 5445474 - DNA, 12 bp, Homo sapiens
tcacaccactgc

SEQ ID NO: 5445475 - DNA, 23 bp, Homo sapiens
tcacaccaggcttgcctgcaggc

SEQ ID NO: 5445476 - DNA, 19 bp, Homo sapiens
tcacaccatcttaaatgac

SEQ ID NO: 5445477 - DNA, 20 bp, Homo sapiens
tcacacccaccccctgcctg

SEQ ID NO: 5445478 - DNA, 20 bp, Homo sapiens
tcacacccaccgtccgccct

SEQ ID NO: 5445479 - DNA, 24 bp, Homo sapiens
tcacacccaccgtccgccctgctc

SEQ ID NO: 5445480 - DNA, 18 bp, Homo sapiens
tcacacccacctgctgct

SEQ ID NO: 5445481 - DNA, 13 bp, Homo sapiens
tcacacccactcc

SEQ ID NO: 5445482 - DNA, 16 bp, Homo sapiens
tcacacccatttaaaa

SEQ ID NO: 5445483 - DNA, 15 bp, Homo sapiens
tcacaccccacctgc

SEQ ID NO: 5445484 - DNA, 20 bp, Homo sapiens
tcacaccccacctgcgcttc

SEQ ID NO: 5445485 - DNA, 14 bp, Homo sapiens
tcacaccccaggcc

SEQ ID NO: 5445486 - DNA, 20 bp, Homo sapiens
tcacaccccaggcccttcag

SEQ ID NO: 5445487 - DNA, 14 bp, Homo sapiens
tcacacccctgtcc

SEQ ID NO: 5445488 - DNA, 15 bp, Homo sapiens
tcacaccctaataag

SEQ ID NO: 5445489 - DNA, 13 bp, Homo sapiens
tcacaccctgcaa

SEQ ID NO: 5445490 - DNA, 17 bp, Homo sapiens
tcacaccctgcaaggcc

SEQ ID NO: 5445491 - DNA, 20 bp, Homo sapiens
tcacaccctgcaaggcccac

SEQ ID NO: 5445492 - DNA, 20 bp, Homo sapiens
tcacaccggcactgtgcact

SEQ ID NO: 5445493 - DNA, 23 bp, Homo sapiens
tcacaccgttcgtacgcccagga

SEQ ID NO: 5445494 - DNA, 20 bp, Homo sapiens
tcacacctagcgtcagtatt

SEQ ID NO: 5445495 - DNA, 22 bp, Homo sapiens
tcacacctcactgtcatctgcc

SEQ ID NO: 5445496 - DNA, 12 bp, Homo sapiens
tcacacctcctt

SEQ ID NO: 5445497 - DNA, 19 bp, Homo sapiens
tcacacctccttttcttct

SEQ ID NO: 5445498 - DNA, 20 bp, Homo sapiens
tcacacctccttttcttcta

SEQ ID NO: 5445499 - DNA, 15 bp, Homo sapiens
tcacacctctgggct

SEQ ID NO: 5445500 - DNA, 20 bp, Homo sapiens
tcacacctgaactgaacacc

SEQ ID NO: 5445501 - DNA, 20 bp, Homo sapiens
tcacacctgacaaatggaag

SEQ ID NO: 5445502 - DNA, 19 bp, Homo sapiens
tcacacctgactctgaaat

SEQ ID NO: 5445503 - DNA, 20 bp, Homo sapiens
tcacacctgactctgaaatc

SEQ ID NO: 5445504 - DNA, 23 bp, Homo sapiens
tcacacctgactctgaaatctga

SEQ ID NO: 5445505 - DNA, 19 bp, Homo sapiens
tcacacctgcaatcccagc

SEQ ID NO: 5445506 - DNA, 22 bp, Homo sapiens
tcacacctgcaatcccagcacc

SEQ ID NO: 5445507 - DNA, 23 bp, Homo sapiens
tcacacctgtaatgccagccctt

SEQ ID NO: 5445508 - DNA, 16 bp, Homo sapiens
tcacaccttacaaagc

SEQ ID NO: 5445509 - DNA, 19 bp, Homo sapiens
tcacaccttacaaagccag

SEQ ID NO: 5445510 - DNA, 16 bp, Homo sapiens
tcacacgaccggggcc

SEQ ID NO: 5445511 - DNA, 19 bp, Homo sapiens
tcacacgactgtcatctaa

SEQ ID NO: 5445512 - DNA, 20 bp, Homo sapiens
tcacacggatttagtcccac

SEQ ID NO: 5445513 - DNA, 18 bp, Homo sapiens
tcacacgggggcagctga

SEQ ID NO: 5445514 - DNA, 18 bp, Homo sapiens
tcacactaagagggcaga

SEQ ID NO: 5445515 - DNA, 17 bp, Homo sapiens
tcacactacagatcagg

SEQ ID NO: 5445516 - DNA, 13 bp, Homo sapiens
tcacactcagaaa

SEQ ID NO: 5445517 - DNA, 21 bp, Homo sapiens
tcacactcagttgtgactaac

SEQ ID NO: 5445518 - DNA, 12 bp, Homo sapiens
tcacactccaga

SEQ ID NO: 5445519 - DNA, 18 bp, Homo sapiens
tcacactccagtggcaga

SEQ ID NO: 5445520 - DNA, 22 bp, Homo sapiens
tcacactccagtggcagacaaa

SEQ ID NO: 5445521 - DNA, 14 bp, Homo sapiens
tcacactcctcctg

SEQ ID NO: 5445522 - DNA, 16 bp, Homo sapiens
tcacactcctcctgcc

SEQ ID NO: 5445523 - DNA, 21 bp, Homo sapiens
tcacactcctcctgccagctc

SEQ ID NO: 5445524 - DNA, 12 bp, Homo sapiens
tcacactcgaca

SEQ ID NO: 5445525 - DNA, 14 bp, Homo sapiens
tcacactctctgca

SEQ ID NO: 5445526 - DNA, 13 bp, Homo sapiens
tcacccacccctg

SEQ ID NO: 5445527 - DNA, 14 bp, Homo sapiens
tcacccaccctgtg

SEQ ID NO: 5445528 - DNA, 17 bp, Homo sapiens
tcacccaccctgtggct

SEQ ID NO: 5445529 - DNA, 11 bp, Homo sapiens
tcacccactcc

SEQ ID NO: 5445530 - DNA, 18 bp, Homo sapiens
tcacccactcccttgaag

SEQ ID NO: 5445531 - DNA, 13 bp, Homo sapiens
tcacccactccta

SEQ ID NO: 5445532 - DNA, 14 bp, Homo sapiens
tcacccactcctat

SEQ ID NO: 5445533 - DNA, 16 bp, Homo sapiens
tcacccactctggtgg

SEQ ID NO: 5445534 - DNA, 11 bp, Homo sapiens
tcacccagaag

SEQ ID NO: 5445535 - DNA, 18 bp, Homo sapiens
tcacccagaatccctcta

SEQ ID NO: 5445536 - DNA, 20 bp, Homo sapiens
tcacccagacagcctgtttc

SEQ ID NO: 5445537 - DNA, 16 bp, Homo sapiens
tcacccagacagctcc

SEQ ID NO: 5445538 - DNA, 15 bp, Homo sapiens
tcacccagacataaa

SEQ ID NO: 5445539 - DNA, 22 bp, Homo sapiens
tcacccagacataaaggaaaag

SEQ ID NO: 5445540 - DNA, 11 bp, Homo sapiens
tcacccagagc

SEQ ID NO: 5445541 - DNA, 16 bp, Homo sapiens
tcacccagagctgcct

SEQ ID NO: 5445542 - DNA, 17 bp, Homo sapiens
tcacccagagctgccta

SEQ ID NO: 5445543 - DNA, 14 bp, Homo sapiens
tcacccagcaaggc

SEQ ID NO: 5445544 - DNA, 16 bp, Homo sapiens
tcacccagccccaggg

SEQ ID NO: 5445545 - DNA, 17 bp, Homo sapiens
tcacccagctaatctgt

SEQ ID NO: 5445546 - DNA, 21 bp, Homo sapiens
tcacccagctaatctgtaggg

SEQ ID NO: 5445547 - DNA, 12 bp, Homo sapiens
tcacccaggctc

SEQ ID NO: 5445548 - DNA, 22 bp, Homo sapiens
tcacccaggctctggagccaga

SEQ ID NO: 5445549 - DNA, 14 bp, Homo sapiens
tcacccagtcccca

SEQ ID NO: 5445550 - DNA, 20 bp, Homo sapiens
tcacccagtccccacccgcc

SEQ ID NO: 5445551 - DNA, 13 bp, Homo sapiens
tcacccagtcctg

SEQ ID NO: 5445552 - DNA, 19 bp, Homo sapiens
tcacccagtcctgcccgcc

SEQ ID NO: 5445553 - DNA, 17 bp, Homo sapiens
tcacccagtcctggcca

SEQ ID NO: 5445554 - DNA, 21 bp, Homo sapiens
tcacccagttggtgactggga

SEQ ID NO: 5445555 - DNA, 15 bp, Homo sapiens
tcacccataaacagt

SEQ ID NO: 5445556 - DNA, 16 bp, Homo sapiens
tcacccatcccacccc

SEQ ID NO: 5445557 - DNA, 17 bp, Homo sapiens
tcacccatcctaggaac

SEQ ID NO: 5445558 - DNA, 20 bp, Homo sapiens
tcacccatcctaggaaccag

SEQ ID NO: 5445559 - DNA, 17 bp, Homo sapiens
tcacccatgaagacagg

SEQ ID NO: 5445560 - DNA, 19 bp, Homo sapiens
tcacccatgcaagcagagg

SEQ ID NO: 5445561 - DNA, 20 bp, Homo sapiens
tcacccatgcaagcagagga

SEQ ID NO: 5445562 - DNA, 17 bp, Homo sapiens
tcacccatggcctcaga

SEQ ID NO: 5445563 - DNA, 22 bp, Homo sapiens
tcaccccaacaaactcctctag

SEQ ID NO: 5445564 - DNA, 22 bp, Homo sapiens
tcaccccaagtagtctgctcac

SEQ ID NO: 5445565 - DNA, 23 bp, Homo sapiens
tcaccccaagtagtctgctcaca

SEQ ID NO: 5445566 - DNA, 17 bp, Homo sapiens
tcaccccaatccctgcc

SEQ ID NO: 5445567 - DNA, 12 bp, Homo sapiens
tcaccccactcc

SEQ ID NO: 5445568 - DNA, 15 bp, Homo sapiens
tcaccccactcctgt

SEQ ID NO: 5445569 - DNA, 12 bp, Homo sapiens
tcaccccagagc

SEQ ID NO: 5445570 - DNA, 18 bp, Homo sapiens
tcaccccagagccacaca

SEQ ID NO: 5445571 - DNA, 19 bp, Homo sapiens
tcaccccagagccacacat

SEQ ID NO: 5445572 - DNA, 14 bp, Homo sapiens
tcaccccagaggac

SEQ ID NO: 5445573 - DNA, 18 bp, Homo sapiens
tcaccccagaggccttgt

SEQ ID NO: 5445574 - DNA, 14 bp, Homo sapiens
tcaccccagccccc

SEQ ID NO: 5445575 - DNA, 15 bp, Homo sapiens
tcaccccagccccca

SEQ ID NO: 5445576 - DNA, 23 bp, Homo sapiens
tcaccccagcccccacagccctg

SEQ ID NO: 5445577 - DNA, 13 bp, Homo sapiens
tcaccccagcctc

SEQ ID NO: 5445578 - DNA, 14 bp, Homo sapiens
tcaccccagcctca

SEQ ID NO: 5445579 - DNA, 12 bp, Homo sapiens
tcaccccagggc

SEQ ID NO: 5445580 - DNA, 23 bp, Homo sapiens
tcaccccagtgcctgtctggagc

SEQ ID NO: 5445581 - DNA, 17 bp, Homo sapiens
tcacccccacccctgta

SEQ ID NO: 5445582 - DNA, 14 bp, Homo sapiens
tcacccccatggcc

SEQ ID NO: 5445583 - DNA, 15 bp, Homo sapiens
tcaccccccaatctc

SEQ ID NO: 5445584 - DNA, 18 bp, Homo sapiens
tcaccccccacactcact

SEQ ID NO: 5445585 - DNA, 13 bp, Homo sapiens
tcaccccccactc

SEQ ID NO: 5445586 - DNA, 18 bp, Homo sapiens
tcaccccccactcaccag

SEQ ID NO: 5445587 - DNA, 16 bp, Homo sapiens
tcacccccccaggcct

SEQ ID NO: 5445588 - DNA, 21 bp, Homo sapiens
tcacccccccaggcctccaga

SEQ ID NO: 5445589 - DNA, 15 bp, Homo sapiens
tcacccccctctgct

SEQ ID NO: 5445590 - DNA, 17 bp, Homo sapiens
tcacccccctctgctgc

SEQ ID NO: 5445591 - DNA, 14 bp, Homo sapiens
tcacccccctgctt

SEQ ID NO: 5445592 - DNA, 15 bp, Homo sapiens
tcacccccctgctta

SEQ ID NO: 5445593 - DNA, 16 bp, Homo sapiens
tcacccccctgcttag

SEQ ID NO: 5445594 - DNA, 20 bp, Homo sapiens
tcacccccctgtattctcag

SEQ ID NO: 5445595 - DNA, 17 bp, Homo sapiens
tcaccccctaccccaga

SEQ ID NO: 5445596 - DNA, 20 bp, Homo sapiens
tcaccccctcccacccccag

SEQ ID NO: 5445597 - DNA, 22 bp, Homo sapiens
tcaccccctcccacccccagcc

SEQ ID NO: 5445598 - DNA, 17 bp, Homo sapiens
tcaccccctcctggcaa

SEQ ID NO: 5445599 - DNA, 18 bp, Homo sapiens
tcaccccctcctggcaat

SEQ ID NO: 5445600 - DNA, 15 bp, Homo sapiens
tcaccccctccttca

SEQ ID NO: 5445601 - DNA, 15 bp, Homo sapiens
tcaccccctttgctg

SEQ ID NO: 5445602 - DNA, 18 bp, Homo sapiens
tcaccccgaggccctgca

SEQ ID NO: 5445603 - DNA, 14 bp, Homo sapiens
tcaccccgccagcc

SEQ ID NO: 5445604 - DNA, 15 bp, Homo sapiens
tcaccccgccagcct

SEQ ID NO: 5445605 - DNA, 15 bp, Homo sapiens
tcaccccggcaggcc

SEQ ID NO: 5445606 - DNA, 18 bp, Homo sapiens
tcaccccggcaggccctg

SEQ ID NO: 5445607 - DNA, 20 bp, Homo sapiens
tcaccccggcaggccctgca

SEQ ID NO: 5445608 - DNA, 22 bp, Homo sapiens
tcaccccggcaggccctgcagt

SEQ ID NO: 5445609 - DNA, 23 bp, Homo sapiens
tcaccccggcaggccctgcagtg

SEQ ID NO: 5445610 - DNA, 15 bp, Homo sapiens
tcaccccggccacct

SEQ ID NO: 5445611 - DNA, 14 bp, Homo sapiens
tcacccctagccct

SEQ ID NO: 5445612 - DNA, 16 bp, Homo sapiens
tcacccctagccctgg

SEQ ID NO: 5445613 - DNA, 20 bp, Homo sapiens
tcacccctagccctggttag

SEQ ID NO: 5445614 - DNA, 14 bp, Homo sapiens
tcacccctccagga

SEQ ID NO: 5445615 - DNA, 15 bp, Homo sapiens
tcacccctcccctgg

SEQ ID NO: 5445616 - DNA, 16 bp, Homo sapiens
tcacccctcccctggg

SEQ ID NO: 5445617 - DNA, 20 bp, Homo sapiens
tcacccctccctccctcttt

SEQ ID NO: 5445618 - DNA, 13 bp, Homo sapiens
tcacccctcgcca

SEQ ID NO: 5445619 - DNA, 15 bp, Homo sapiens
tcacccctctgcccc

SEQ ID NO: 5445620 - DNA, 16 bp, Homo sapiens
tcacccctctgcccct

SEQ ID NO: 5445621 - DNA, 18 bp, Homo sapiens
tcacccctctgcccctgc

SEQ ID NO: 5445622 - DNA, 19 bp, Homo sapiens
tcacccctctgcccctgca

SEQ ID NO: 5445623 - DNA, 17 bp, Homo sapiens
tcacccctctgtccagc

SEQ ID NO: 5445624 - DNA, 15 bp, Homo sapiens
tcacccctcttccca

SEQ ID NO: 5445625 - DNA, 19 bp, Homo sapiens
tcacccctgacatgtaccc

SEQ ID NO: 5445626 - DNA, 13 bp, Homo sapiens
tcacccctgcact

SEQ ID NO: 5445627 - DNA, 17 bp, Homo sapiens
tcacccctgcccctgtg

SEQ ID NO: 5445628 - DNA, 12 bp, Homo sapiens
tcacccctgggc

SEQ ID NO: 5445629 - DNA, 16 bp, Homo sapiens
tcacccctgggcaggc

SEQ ID NO: 5445630 - DNA, 18 bp, Homo sapiens
tcacccctggtggctgca

SEQ ID NO: 5445631 - DNA, 18 bp, Homo sapiens
tcacccctggttctcatc

SEQ ID NO: 5445632 - DNA, 22 bp, Homo sapiens
tcacccctggttctcatctttc

SEQ ID NO: 5445633 - DNA, 13 bp, Homo sapiens
tcacccctgtcct

SEQ ID NO: 5445634 - DNA, 14 bp, Homo sapiens
tcacccctgtcctc

SEQ ID NO: 5445635 - DNA, 12 bp, Homo sapiens
tcacccctgtct

SEQ ID NO: 5445636 - DNA, 17 bp, Homo sapiens
tcaccccttatcctgag

SEQ ID NO: 5445637 - DNA, 14 bp, Homo sapiens
tcaccccttcccca

SEQ ID NO: 5445638 - DNA, 15 bp, Homo sapiens
tcacccgcccctgga

SEQ ID NO: 5445639 - DNA, 19 bp, Homo sapiens
tcacccgctgcccagccct

SEQ ID NO: 5445640 - DNA, 20 bp, Homo sapiens
tcacccgctgcccagccctc

SEQ ID NO: 5445641 - DNA, 15 bp, Homo sapiens
tcacccgtccagacc

SEQ ID NO: 5445642 - DNA, 18 bp, Homo sapiens
tcacccgtccagaccttg

SEQ ID NO: 5445643 - DNA, 22 bp, Homo sapiens
tcaccctaacttcgtatttttt

SEQ ID NO: 5445644 - DNA, 14 bp, Homo sapiens
tcaccctatatata

SEQ ID NO: 5445645 - DNA, 15 bp, Homo sapiens
tcaccctccacctct

SEQ ID NO: 5445646 - DNA, 19 bp, Homo sapiens
tcaccctcctagcctgctc

SEQ ID NO: 5445647 - DNA, 23 bp, Homo sapiens
tcaccctcctgacccccatgtaa

SEQ ID NO: 5445648 - DNA, 13 bp, Homo sapiens
tcaccctcctgag

SEQ ID NO: 5445649 - DNA, 19 bp, Homo sapiens
tcaccctcctgagcctcac

SEQ ID NO: 5445650 - DNA, 23 bp, Homo sapiens
tcaccctctgggcagctgtcatg

SEQ ID NO: 5445651 - DNA, 12 bp, Homo sapiens
tcaccctctgtc

SEQ ID NO: 5445652 - DNA, 14 bp, Homo sapiens
tcaccctctgtccc

SEQ ID NO: 5445653 - DNA, 15 bp, Homo sapiens
tcaccctctgtcctt

SEQ ID NO: 5445654 - DNA, 16 bp, Homo sapiens
tcaccctctgtccttc

SEQ ID NO: 5445655 - DNA, 18 bp, Homo sapiens
tcaccctctgtccttccc

SEQ ID NO: 5445656 - DNA, 16 bp, Homo sapiens
tcaccctgactgtggg

SEQ ID NO: 5445657 - DNA, 23 bp, Homo sapiens
tcaccctgcagagctatggtgag

SEQ ID NO: 5445658 - DNA, 12 bp, Homo sapiens
tcaccctgcagg

SEQ ID NO: 5445659 - DNA, 17 bp, Homo sapiens
tcaccctgcaggacttg

SEQ ID NO: 5445660 - DNA, 16 bp, Homo sapiens
tcaccctgccaccctc

SEQ ID NO: 5445661 - DNA, 14 bp, Homo sapiens
tcaccctgcccgct

SEQ ID NO: 5445662 - DNA, 13 bp, Homo sapiens
tcaccctgcctta

SEQ ID NO: 5445663 - DNA, 21 bp, Homo sapiens
tcaccctgcttggggcctggc

SEQ ID NO: 5445664 - DNA, 17 bp, Homo sapiens
tcaccctggaggcacct

SEQ ID NO: 5445665 - DNA, 16 bp, Homo sapiens
tcaccctggccaccac

SEQ ID NO: 5445666 - DNA, 18 bp, Homo sapiens
tcaccctggccaccaccc

SEQ ID NO: 5445667 - DNA, 23 bp, Homo sapiens
tcaccctggccaccacccaacct

SEQ ID NO: 5445668 - DNA, 12 bp, Homo sapiens
tcaccctggcct

SEQ ID NO: 5445669 - DNA, 13 bp, Homo sapiens
tcaccctgggagc

SEQ ID NO: 5445670 - DNA, 17 bp, Homo sapiens
tcaccctgggagccagt

SEQ ID NO: 5445671 - DNA, 14 bp, Homo sapiens
tcaccctgggcagt

SEQ ID NO: 5445672 - DNA, 23 bp, Homo sapiens
tcaccctggggatagtccttcct

SEQ ID NO: 5445673 - DNA, 20 bp, Homo sapiens
tcaccctggggctaggaaat

SEQ ID NO: 5445674 - DNA, 20 bp, Homo sapiens
tcaccctgtgaccctctcac

SEQ ID NO: 5445675 - DNA, 23 bp, Homo sapiens
tcaccctgtgggaccgcctggcc

SEQ ID NO: 5445676 - DNA, 13 bp, Homo sapiens
tcaccctgtgggt

SEQ ID NO: 5445677 - DNA, 20 bp, Homo sapiens
tcaccctgtgggtgtctccc

SEQ ID NO: 5445678 - DNA, 21 bp, Homo sapiens
tcaccctgtgggtgtctccct

SEQ ID NO: 5445679 - DNA, 19 bp, Homo sapiens
tcacccttaacccaaggag

SEQ ID NO: 5445680 - DNA, 23 bp, Homo sapiens
tcacccttaacccaaggagcaca

SEQ ID NO: 5445681 - DNA, 18 bp, Homo sapiens
tcacccttaccatgtgcc

SEQ ID NO: 5445682 - DNA, 15 bp, Homo sapiens
tcacccttcctggcc

SEQ ID NO: 5445683 - DNA, 20 bp, Homo sapiens
tcacccttcctggcccaggc

SEQ ID NO: 5445684 - DNA, 12 bp, Homo sapiens
tcacccttctgg

SEQ ID NO: 5445685 - DNA, 13 bp, Homo sapiens
tcacccttctggg

SEQ ID NO: 5445686 - DNA, 22 bp, Homo sapiens
tcacccttgcaccgtcctcagc

SEQ ID NO: 5445687 - DNA, 18 bp, Homo sapiens
tcacccttggcccatccc

SEQ ID NO: 5445688 - DNA, 13 bp, Homo sapiens
tcacccttgtcct

SEQ ID NO: 5445689 - DNA, 22 bp, Homo sapiens
tcaccgaaaacgtggctgcttc

SEQ ID NO: 5445690 - DNA, 23 bp, Homo sapiens
tcaccgaaaacgtggctgcttca

SEQ ID NO: 5445691 - DNA, 15 bp, Homo sapiens
tcaccgaagccactt

SEQ ID NO: 5445692 - DNA, 15 bp, Homo sapiens
tcaccgacagcggcc

SEQ ID NO: 5445693 - DNA, 19 bp, Homo sapiens
tcaccgacagcggccttga

SEQ ID NO: 5445694 - DNA, 22 bp, Homo sapiens
tcaccgacccgacactctcacc

SEQ ID NO: 5445695 - DNA, 17 bp, Homo sapiens
tcaccgactcacctgcg

SEQ ID NO: 5445696 - DNA, 19 bp, Homo sapiens
tcaccgactcacctgcgca

SEQ ID NO: 5445697 - DNA, 22 bp, Homo sapiens
tcaccgagacggctggacctgc

SEQ ID NO: 5445698 - DNA, 23 bp, Homo sapiens
tcaccgagacggctggacctgca

SEQ ID NO: 5445699 - DNA, 20 bp, Homo sapiens
tcaccgagactcagcctctg

SEQ ID NO: 5445700 - DNA, 21 bp, Homo sapiens
tcaccgagactcagcctctgc

SEQ ID NO: 5445701 - DNA, 23 bp, Homo sapiens
tcaccgagaggaaaaaggcttct

SEQ ID NO: 5445702 - DNA, 20 bp, Homo sapiens
tcaccgagagtagccgagag

SEQ ID NO: 5445703 - DNA, 17 bp, Homo sapiens
tcaccgagcatgcttcc

SEQ ID NO: 5445704 - DNA, 17 bp, Homo sapiens
tcaccgatattagtcct

SEQ ID NO: 5445705 - DNA, 19 bp, Homo sapiens
tcactaggcccccacttgc

SEQ ID NO: 5445706 - DNA, 22 bp, Homo sapiens
tcactaggctaaactcaagatt

SEQ ID NO: 5445707 - DNA, 15 bp, Homo sapiens
tcactagggctgagg

SEQ ID NO: 5445708 - DNA, 23 bp, Homo sapiens
tcactagtgccaatgatgtgacc

SEQ ID NO: 5445709 - DNA, 18 bp, Homo sapiens
tcactagtgtcaggcccc

SEQ ID NO: 5445710 - DNA, 21 bp, Homo sapiens
tcactataaccatcagttact

SEQ ID NO: 5445711 - DNA, 13 bp, Homo sapiens
tcactatcaattt

SEQ ID NO: 5445712 - DNA, 14 bp, Homo sapiens
tcactatcaatttt

SEQ ID NO: 5445713 - DNA, 23 bp, Homo sapiens
tcactatcttcttcaaatacaaa

SEQ ID NO: 5445714 - DNA, 15 bp, Homo sapiens
tcactatgacactga

SEQ ID NO: 5445715 - DNA, 18 bp, Homo sapiens
tcactatgacactgagca

SEQ ID NO: 5445716 - DNA, 13 bp, Homo sapiens
tcactatgatttt

SEQ ID NO: 5445717 - DNA, 16 bp, Homo sapiens
tcactatgattttcta

SEQ ID NO: 5445718 - DNA, 22 bp, Homo sapiens
tcactatggtatgctggccagc

SEQ ID NO: 5445719 - DNA, 23 bp, Homo sapiens
tcactatggtatgctggccagca

SEQ ID NO: 5445720 - DNA, 14 bp, Homo sapiens
tcactatggtgcca

SEQ ID NO: 5445721 - DNA, 14 bp, Homo sapiens
tcactatgtttctc

SEQ ID NO: 5445722 - DNA, 18 bp, Homo sapiens
tcactattcctaggagga

SEQ ID NO: 5445723 - DNA, 13 bp, Homo sapiens
tcactattcctat

SEQ ID NO: 5445724 - DNA, 21 bp, Homo sapiens
tcactattcttaagcactttg

SEQ ID NO: 5445725 - DNA, 22 bp, Homo sapiens
tcactattcttaagcactttga

SEQ ID NO: 5445726 - DNA, 21 bp, Homo sapiens
tcactattcttggaccatgcc

SEQ ID NO: 5445727 - DNA, 15 bp, Homo sapiens
tcactattgaaaaat

SEQ ID NO: 5445728 - DNA, 20 bp, Homo sapiens
tcactatttttatttatatt

SEQ ID NO: 5445729 - DNA, 23 bp, Homo sapiens
tcactcaaaaaggtgtgtcaaag

SEQ ID NO: 5445730 - DNA, 23 bp, Homo sapiens
tcactcaacaacatctttgtgtt

SEQ ID NO: 5445731 - DNA, 21 bp, Homo sapiens
tcactcaaccataacacttga

SEQ ID NO: 5445732 - DNA, 17 bp, Homo sapiens
tcactcaagaagcacac

SEQ ID NO: 5445733 - DNA, 18 bp, Homo sapiens
tcactcaagaccaggctg

SEQ ID NO: 5445734 - DNA, 14 bp, Homo sapiens
tcactcaagcctga

SEQ ID NO: 5445735 - DNA, 21 bp, Homo sapiens
tcactcaagttcaaggaccaa

SEQ ID NO: 5445736 - DNA, 14 bp, Homo sapiens
tcactcacagagtc

SEQ ID NO: 5445737 - DNA, 13 bp, Homo sapiens
tcactcacatagc

SEQ ID NO: 5445738 - DNA, 15 bp, Homo sapiens
tcactcacattgaga

SEQ ID NO: 5445739 - DNA, 22 bp, Homo sapiens
tcactcaccactaccagccagc

SEQ ID NO: 5445740 - DNA, 13 bp, Homo sapiens
tcactcactcact

SEQ ID NO: 5445741 - DNA, 16 bp, Homo sapiens
tcactcactcactcca

SEQ ID NO: 5445742 - DNA, 16 bp, Homo sapiens
tcactcactcactccc

SEQ ID NO: 5445743 - DNA, 12 bp, Homo sapiens
tcactcactcca

SEQ ID NO: 5445744 - DNA, 15 bp, Homo sapiens
tcactcactccaaga

SEQ ID NO: 5445745 - DNA, 16 bp, Homo sapiens
tcactcactccaagac

SEQ ID NO: 5445746 - DNA, 19 bp, Homo sapiens
tcactcactccccactccc

SEQ ID NO: 5445747 - DNA, 14 bp, Homo sapiens
tcactcactgaggc

SEQ ID NO: 5445748 - DNA, 18 bp, Homo sapiens
tcactcactgaggccatc

SEQ ID NO: 5445749 - DNA, 15 bp, Homo sapiens
tcactcactgtttat

SEQ ID NO: 5445750 - DNA, 11 bp, Homo sapiens
tcactcagaaa

SEQ ID NO: 5445751 - DNA, 14 bp, Homo sapiens
tcactcagaattat

SEQ ID NO: 5445752 - DNA, 14 bp, Homo sapiens
tcactcagagcagt

SEQ ID NO: 5445753 - DNA, 14 bp, Homo sapiens
tcactcagatggaa

SEQ ID NO: 5445754 - DNA, 13 bp, Homo sapiens
tcactcagcacca

SEQ ID NO: 5445755 - DNA, 19 bp, Homo sapiens
tcactcagccaccctgagt

SEQ ID NO: 5445756 - DNA, 14 bp, Homo sapiens
tcactcagccccta

SEQ ID NO: 5445757 - DNA, 23 bp, Homo sapiens
tcactcagcccctacccctgccc

SEQ ID NO: 5445758 - DNA, 16 bp, Homo sapiens
tcactcagccccttcc

SEQ ID NO: 5445759 - DNA, 17 bp, Homo sapiens
tcactcagccccttccc

SEQ ID NO: 5445760 - DNA, 18 bp, Homo sapiens
tcactcagccccttcccg

SEQ ID NO: 5445761 - DNA, 21 bp, Homo sapiens
tcactcagcttaattctcctt

SEQ ID NO: 5445762 - DNA, 20 bp, Homo sapiens
tcactcaggaaccctggaga

SEQ ID NO: 5445763 - DNA, 21 bp, Homo sapiens
tcactcaggaaccctggagac

SEQ ID NO: 5445764 - DNA, 18 bp, Homo sapiens
tcactcaggcctctgcag

SEQ ID NO: 5445765 - DNA, 21 bp, Homo sapiens
tcactcaggcctctgcagaag

SEQ ID NO: 5445766 - DNA, 16 bp, Homo sapiens
tcactcagtaaaacat

SEQ ID NO: 5445767 - DNA, 17 bp, Homo sapiens
tcactcagtaaaacata

SEQ ID NO: 5445768 - DNA, 17 bp, Homo sapiens
tcactcatacatctggc

SEQ ID NO: 5445769 - DNA, 13 bp, Homo sapiens
tcactcatactgt

SEQ ID NO: 5445770 - DNA, 19 bp, Homo sapiens
tcactcatgcaaactgctt

SEQ ID NO: 5445771 - DNA, 20 bp, Homo sapiens
tcactcatgcaaactgcttt

SEQ ID NO: 5445772 - DNA, 21 bp, Homo sapiens
tcactcatgcaaactgcttta

SEQ ID NO: 5445773 - DNA, 23 bp, Homo sapiens
tcactcatgcaaactgctttatt

SEQ ID NO: 5445774 - DNA, 20 bp, Homo sapiens
tcactcattgacatgatata

SEQ ID NO: 5445775 - DNA, 17 bp, Homo sapiens
tcactcattgctgagcc

SEQ ID NO: 5445776 - DNA, 19 bp, Homo sapiens
tcactcatttatttccata

SEQ ID NO: 5445777 - DNA, 16 bp, Homo sapiens
tcactccaaaataggt

SEQ ID NO: 5445778 - DNA, 14 bp, Homo sapiens
tcactccaaagaga

SEQ ID NO: 5445779 - DNA, 18 bp, Homo sapiens
tcactccaaccctgcccc

SEQ ID NO: 5445780 - DNA, 14 bp, Homo sapiens
tcactccaagacca

SEQ ID NO: 5445781 - DNA, 17 bp, Homo sapiens
tcactccaagaccacca

SEQ ID NO: 5445782 - DNA, 15 bp, Homo sapiens
tcactccaccaccca

SEQ ID NO: 5445783 - DNA, 14 bp, Homo sapiens
tcactccactcccc

SEQ ID NO: 5445784 - DNA, 12 bp, Homo sapiens
tcactccagcca

SEQ ID NO: 5445785 - DNA, 17 bp, Homo sapiens
tcactccagccaaagaa

SEQ ID NO: 5445786 - DNA, 14 bp, Homo sapiens
tcactccagtcaac

SEQ ID NO: 5445787 - DNA, 18 bp, Homo sapiens
tcactccagtgctcagct

SEQ ID NO: 5445788 - DNA, 20 bp, Homo sapiens
tcactccataaaaagaaagc

SEQ ID NO: 5445789 - DNA, 18 bp, Homo sapiens
tcactccattctcagccc

SEQ ID NO: 5445790 - DNA, 17 bp, Homo sapiens
tcactccatttcccact

SEQ ID NO: 5445791 - DNA, 19 bp, Homo sapiens
tcactcccaagggacagca

SEQ ID NO: 5445792 - DNA, 14 bp, Homo sapiens
tcactcccagcact

SEQ ID NO: 5445793 - DNA, 18 bp, Homo sapiens
tcactcccagcactcccc

SEQ ID NO: 5445794 - DNA, 17 bp, Homo sapiens
tcactcccagttccctg

SEQ ID NO: 5445795 - DNA, 17 bp, Homo sapiens
tcactccccaaggaaga

SEQ ID NO: 5445796 - DNA, 18 bp, Homo sapiens
tcactccccaaggaagag

SEQ ID NO: 5445797 - DNA, 11 bp, Homo sapiens
tcactccccac

SEQ ID NO: 5445798 - DNA, 18 bp, Homo sapiens
tcactccccactccccca

SEQ ID NO: 5445799 - DNA, 14 bp, Homo sapiens
tcactccccagccc

SEQ ID NO: 5445800 - DNA, 14 bp, Homo sapiens
tcactccccaggga

SEQ ID NO: 5445801 - DNA, 19 bp, Homo sapiens
tcactccccagggagctct

SEQ ID NO: 5445802 - DNA, 22 bp, Homo sapiens
tcactccccagggagctctggg

SEQ ID NO: 5445803 - DNA, 21 bp, Homo sapiens
tcactccccatgccacgttcc

SEQ ID NO: 5445804 - DNA, 17 bp, Homo sapiens
tcactcccctcctttcc

SEQ ID NO: 5445805 - DNA, 23 bp, Homo sapiens
tcactcccgctgagcccactcta

SEQ ID NO: 5445806 - DNA, 22 bp, Homo sapiens
tcactccctaaagccctcttca

SEQ ID NO: 5445807 - DNA, 23 bp, Homo sapiens
tcactccctaaagccctcttcag

SEQ ID NO: 5445808 - DNA, 12 bp, Homo sapiens
tcactccctagg

SEQ ID NO: 5445809 - DNA, 14 bp, Homo sapiens
tcactccctcttgg

SEQ ID NO: 5445810 - DNA, 12 bp, Homo sapiens
tcactccctgga

SEQ ID NO: 5445811 - DNA, 15 bp, Homo sapiens
tcactccctgtcata

SEQ ID NO: 5445812 - DNA, 20 bp, Homo sapiens
tcactcccttctacctgcca

SEQ ID NO: 5445813 - DNA, 16 bp, Homo sapiens
tcactcccttctcctt

SEQ ID NO: 5445814 - DNA, 19 bp, Homo sapiens
tcactccctttgtggactt

SEQ ID NO: 5445815 - DNA, 20 bp, Homo sapiens
tcactccctttgtggacttt

SEQ ID NO: 5445816 - DNA, 22 bp, Homo sapiens
tcactccctttgtggactttat

SEQ ID NO: 5445817 - DNA, 19 bp, Homo sapiens
tcactccggtgtgcctgca

SEQ ID NO: 5445818 - DNA, 21 bp, Homo sapiens
tcactccggtgtgcctgcagc

SEQ ID NO: 5445819 - DNA, 15 bp, Homo sapiens
tcactcctacctggt

SEQ ID NO: 5445820 - DNA, 13 bp, Homo sapiens
tcactcctctcta

SEQ ID NO: 5445821 - DNA, 17 bp, Homo sapiens
tcactcctgaattcagt

SEQ ID NO: 5445822 - DNA, 17 bp, Homo sapiens
tcactcctgactgcccg

SEQ ID NO: 5445823 - DNA, 19 bp, Homo sapiens
tcactcctgagacccctgg

SEQ ID NO: 5445824 - DNA, 23 bp, Homo sapiens
tcactcctgagacccctggcctc

SEQ ID NO: 5445825 - DNA, 12 bp, Homo sapiens
tcactcctgcct

SEQ ID NO: 5445826 - DNA, 15 bp, Homo sapiens
tcactcctgcctccg

SEQ ID NO: 5445827 - DNA, 12 bp, Homo sapiens
tcactcctgctg

SEQ ID NO: 5445828 - DNA, 14 bp, Homo sapiens
tcactcctgctgta

SEQ ID NO: 5445829 - DNA, 19 bp, Homo sapiens
tcactcctgctgtaaattt

SEQ ID NO: 5445830 - DNA, 17 bp, Homo sapiens
tcactcctgcttctctc

SEQ ID NO: 5445831 - DNA, 20 bp, Homo sapiens
tcactcctgcttctctcagc

SEQ ID NO: 5445832 - DNA, 11 bp, Homo sapiens
tcactcctggg

SEQ ID NO: 5445833 - DNA, 12 bp, Homo sapiens
tcactcctgggg

SEQ ID NO: 5445834 - DNA, 16 bp, Homo sapiens
tcactccttttaaaga

SEQ ID NO: 5445835 - DNA, 23 bp, Homo sapiens
tcactcgaacccgggaggcagag

SEQ ID NO: 5445836 - DNA, 17 bp, Homo sapiens
tcactcggcaccctgca

SEQ ID NO: 5445837 - DNA, 19 bp, Homo sapiens
tcactcggctgtggagaac

SEQ ID NO: 5445838 - DNA, 23 bp, Homo sapiens
tcactcgggtgcgtgtgtttgta

SEQ ID NO: 5445839 - DNA, 13 bp, Homo sapiens
tcactctaaaaat

SEQ ID NO: 5445840 - DNA, 18 bp, Homo sapiens
tcactctaaaaatagaat

SEQ ID NO: 5445841 - DNA, 20 bp, Homo sapiens
tcactctacccccaacacca

SEQ ID NO: 5445842 - DNA, 21 bp, Homo sapiens
tcactctagtcaatgacatga

SEQ ID NO: 5445843 - DNA, 13 bp, Homo sapiens
tcactctccagca

SEQ ID NO: 5445844 - DNA, 23 bp, Homo sapiens
tcactctccagcagttaggcacc

SEQ ID NO: 5445845 - DNA, 18 bp, Homo sapiens
tcactctccatttaataa

SEQ ID NO: 5445846 - DNA, 23 bp, Homo sapiens
tcactctccgaagtctgatccct

SEQ ID NO: 5445847 - DNA, 14 bp, Homo sapiens
tcactctctattgt

SEQ ID NO: 5445848 - DNA, 13 bp, Homo sapiens
tcactctctgctg

SEQ ID NO: 5445849 - DNA, 14 bp, Homo sapiens
tcactctctgctgg

SEQ ID NO: 5445850 - DNA, 15 bp, Homo sapiens
tcactctctgctggc

SEQ ID NO: 5445851 - DNA, 18 bp, Homo sapiens
tcactctctgctggcagg

SEQ ID NO: 5445852 - DNA, 22 bp, Homo sapiens
tcactctctggggaagtcaggg

SEQ ID NO: 5445853 - DNA, 11 bp, Homo sapiens
tcactctcttc

SEQ ID NO: 5445854 - DNA, 18 bp, Homo sapiens
tcactctgaccttcacag

SEQ ID NO: 5445855 - DNA, 11 bp, Homo sapiens
tcactctgccc

SEQ ID NO: 5445856 - DNA, 13 bp, Homo sapiens
tcactctgcctct

SEQ ID NO: 5445857 - DNA, 22 bp, Homo sapiens
tcactctgcctctaaggccaag

SEQ ID NO: 5445858 - DNA, 14 bp, Homo sapiens
tcactctgctgctt

SEQ ID NO: 5445859 - DNA, 16 bp, Homo sapiens
tcactctggcagcctc

SEQ ID NO: 5445860 - DNA, 15 bp, Homo sapiens
tcactctggcagctc

SEQ ID NO: 5445861 - DNA, 16 bp, Homo sapiens
tcactctggcagctca

SEQ ID NO: 5445862 - DNA, 17 bp, Homo sapiens
tcactctggcagctcag

SEQ ID NO: 5445863 - DNA, 18 bp, Homo sapiens
tcactctggcagctcaga

SEQ ID NO: 5445864 - DNA, 20 bp, Homo sapiens
tcactctggcagctcagaga

SEQ ID NO: 5445865 - DNA, 22 bp, Homo sapiens
tcactctggcagctcagagagg

SEQ ID NO: 5445866 - DNA, 14 bp, Homo sapiens
tcactctggcctca

SEQ ID NO: 5445867 - DNA, 15 bp, Homo sapiens
tcactctgggcctgg

SEQ ID NO: 5445868 - DNA, 23 bp, Homo sapiens
tcactctgtccctgtccttccct

SEQ ID NO: 5445869 - DNA, 12 bp, Homo sapiens
tcactctgtcgc

SEQ ID NO: 5445870 - DNA, 21 bp, Homo sapiens
tcactctgtcgctcaggctgg

SEQ ID NO: 5445871 - DNA, 19 bp, Homo sapiens
tcactctgtgtctgagtgg

SEQ ID NO: 5445872 - DNA, 21 bp, Homo sapiens
tcactctgttcattcctccag

SEQ ID NO: 5445873 - DNA, 13 bp, Homo sapiens
tcactctgttgac

SEQ ID NO: 5445874 - DNA, 20 bp, Homo sapiens
tcactcttattgcccacgct

SEQ ID NO: 5445875 - DNA, 21 bp, Homo sapiens
tcactcttattgcccacgctg

SEQ ID NO: 5445876 - DNA, 20 bp, Homo sapiens
tcactcttattgtccttcta

SEQ ID NO: 5445877 - DNA, 16 bp, Homo sapiens
tcactcttcacttgag

SEQ ID NO: 5445878 - DNA, 20 bp, Homo sapiens
tcactcttcctcatcctgct

SEQ ID NO: 5445879 - DNA, 23 bp, Homo sapiens
tcactcttcctcatcctgcttct

SEQ ID NO: 5445880 - DNA, 18 bp, Homo sapiens
tcactcttcctgcaagga

SEQ ID NO: 5445881 - DNA, 19 bp, Homo sapiens
tcactcttcctgcaaggac

SEQ ID NO: 5445882 - DNA, 17 bp, Homo sapiens
tcactcttgaagtccag

SEQ ID NO: 5445883 - DNA, 12 bp, Homo sapiens
tcacttgcatgt

SEQ ID NO: 5445884 - DNA, 15 bp, Homo sapiens
tcacttgcatgtccc

SEQ ID NO: 5445885 - DNA, 12 bp, Homo sapiens
tcacttgccaat

SEQ ID NO: 5445886 - DNA, 14 bp, Homo sapiens
tcacttgccatgca

SEQ ID NO: 5445887 - DNA, 14 bp, Homo sapiens
tcacttgccgtgtc

SEQ ID NO: 5445888 - DNA, 18 bp, Homo sapiens
tcacttgctgctttttct

SEQ ID NO: 5445889 - DNA, 19 bp, Homo sapiens
tcacttgctggctgtgaaa

SEQ ID NO: 5445890 - DNA, 18 bp, Homo sapiens
tcacttggctgtctgacc

SEQ ID NO: 5445891 - DNA, 22 bp, Homo sapiens
tcacttgggagctgctgggcta

SEQ ID NO: 5445892 - DNA, 16 bp, Homo sapiens
tcacttgggcccagga

SEQ ID NO: 5445893 - DNA, 19 bp, Homo sapiens
tcacttgggcccaggaggt

SEQ ID NO: 5445894 - DNA, 23 bp, Homo sapiens
tcacttgggcccaggaggtcaag

SEQ ID NO: 5445895 - DNA, 23 bp, Homo sapiens
tcacttggggtcaccaccctccc

SEQ ID NO: 5445896 - DNA, 21 bp, Homo sapiens
tcacttggtctgccaggcccc

SEQ ID NO: 5445897 - DNA, 9 bp, Homo sapiens
tcacttgta

SEQ ID NO: 5445898 - DNA, 15 bp, Homo sapiens
tcacttgtaaataaa

SEQ ID NO: 5445899 - DNA, 16 bp, Homo sapiens
tcacttgtacaaaata

SEQ ID NO: 5445900 - DNA, 17 bp, Homo sapiens
tcacttgtacaaaataa

SEQ ID NO: 5445901 - DNA, 12 bp, Homo sapiens
tcacttgtattg

SEQ ID NO: 5445902 - DNA, 17 bp, Homo sapiens
tcacttgtcaataaaat

SEQ ID NO: 5445903 - DNA, 22 bp, Homo sapiens
tcacttgtcaggagtgtgtgtg

SEQ ID NO: 5445904 - DNA, 18 bp, Homo sapiens
tcacttgtcgggggccca

SEQ ID NO: 5445905 - DNA, 13 bp, Homo sapiens
tcacttgtctcct

SEQ ID NO: 5445906 - DNA, 17 bp, Homo sapiens
tcacttgtctcctttct

SEQ ID NO: 5445907 - DNA, 19 bp, Homo sapiens
tcacttgtgccaacactca

SEQ ID NO: 5445908 - DNA, 15 bp, Homo sapiens
tcacttgtgctttgc

SEQ ID NO: 5445909 - DNA, 22 bp, Homo sapiens
tcacttgtggcagcttccctga

SEQ ID NO: 5445910 - DNA, 22 bp, Homo sapiens
tcacttgtgtcaaccactaaag

SEQ ID NO: 5445911 - DNA, 13 bp, Homo sapiens
tcacttgtgtttg

SEQ ID NO: 5445912 - DNA, 18 bp, Homo sapiens
tcacttgtgtttgtatat

SEQ ID NO: 5445913 - DNA, 20 bp, Homo sapiens
tcacttgtgtttgtatataa

SEQ ID NO: 5445914 - DNA, 20 bp, Homo sapiens
tcacttgttgttttactaaa

SEQ ID NO: 5445915 - DNA, 21 bp, Homo sapiens
tcacttgttgttttactaaag

SEQ ID NO: 5445916 - DNA, 16 bp, Homo sapiens
tcacttgtttgtgttt

SEQ ID NO: 5445917 - DNA, 22 bp, Homo sapiens
tcactttaaagcaattgcataa

SEQ ID NO: 5445918 - DNA, 16 bp, Homo sapiens
tcactttaattctcat

SEQ ID NO: 5445919 - DNA, 21 bp, Homo sapiens
tcactttagaggcttgatcat

SEQ ID NO: 5445920 - DNA, 17 bp, Homo sapiens
tcactttagatgctgat

SEQ ID NO: 5445921 - DNA, 20 bp, Homo sapiens
tcactttattaccttctttc

SEQ ID NO: 5445922 - DNA, 15 bp, Homo sapiens
tcactttatttcatt

SEQ ID NO: 5445923 - DNA, 12 bp, Homo sapiens
tcactttcataa

SEQ ID NO: 5445924 - DNA, 13 bp, Homo sapiens
tcactttcatttt

SEQ ID NO: 5445925 - DNA, 21 bp, Homo sapiens
tcactttcccttgtgtcaaga

SEQ ID NO: 5445926 - DNA, 18 bp, Homo sapiens
tcactttcctcagttgat

SEQ ID NO: 5445927 - DNA, 14 bp, Homo sapiens
tcactttctcctgg

SEQ ID NO: 5445928 - DNA, 17 bp, Homo sapiens
tcactttctcctggtgt

SEQ ID NO: 5445929 - DNA, 18 bp, Homo sapiens
tcactttctcctggtgtt

SEQ ID NO: 5445930 - DNA, 17 bp, Homo sapiens
tcactttctctcttata

SEQ ID NO: 5445931 - DNA, 14 bp, Homo sapiens
tcactttctgtcta

SEQ ID NO: 5445932 - DNA, 16 bp, Homo sapiens
tcactttcttaagcaa

SEQ ID NO: 5445933 - DNA, 21 bp, Homo sapiens
tcactttgaaaagttggaagg

SEQ ID NO: 5445934 - DNA, 22 bp, Homo sapiens
tcactttgaaaagttggaagga

SEQ ID NO: 5445935 - DNA, 12 bp, Homo sapiens
tcactttgctct

SEQ ID NO: 5445936 - DNA, 14 bp, Homo sapiens
tcactttgctctgg

SEQ ID NO: 5445937 - DNA, 15 bp, Homo sapiens
tcactttgctctggg

SEQ ID NO: 5445938 - DNA, 17 bp, Homo sapiens
tcactttgctctgggtg

SEQ ID NO: 5445939 - DNA, 20 bp, Homo sapiens
tcactttgggagtttttgtt

SEQ ID NO: 5445940 - DNA, 23 bp, Homo sapiens
tcactttggggttcggcctgtgt

SEQ ID NO: 5445941 - DNA, 15 bp, Homo sapiens
tcactttgtaaataa

SEQ ID NO: 5445942 - DNA, 14 bp, Homo sapiens
tcactttgtattct

SEQ ID NO: 5445943 - DNA, 13 bp, Homo sapiens
tcactttgtctaa

SEQ ID NO: 5445944 - DNA, 15 bp, Homo sapiens
tcactttgtgaatta

SEQ ID NO: 5445945 - DNA, 13 bp, Homo sapiens
tcactttgtgtat

SEQ ID NO: 5445946 - DNA, 13 bp, Homo sapiens
tcactttgtttat

SEQ ID NO: 5445947 - DNA, 21 bp, Homo sapiens
tcacttttaatgaacaaatgg

SEQ ID NO: 5445948 - DNA, 13 bp, Homo sapiens
tcacttttcctcc

SEQ ID NO: 5445949 - DNA, 17 bp, Homo sapiens
tcacttttccttttctt

SEQ ID NO: 5445950 - DNA, 13 bp, Homo sapiens
tcacttttctgta

SEQ ID NO: 5445951 - DNA, 18 bp, Homo sapiens
tcacttttgaatctataa

SEQ ID NO: 5445952 - DNA, 21 bp, Homo sapiens
tcacttttgttaacagtattt

SEQ ID NO: 5445953 - DNA, 16 bp, Homo sapiens
tcacttttgttctgct

SEQ ID NO: 5445954 - DNA, 20 bp, Homo sapiens
tcactttttaaaccactgta

SEQ ID NO: 5445955 - DNA, 13 bp, Homo sapiens
tcactttttctga

SEQ ID NO: 5445956 - DNA, 17 bp, Homo sapiens
tcactttttctgataaa

SEQ ID NO: 5445957 - DNA, 18 bp, Homo sapiens
tcactttttgaactaaga

SEQ ID NO: 5445958 - DNA, 19 bp, Homo sapiens
tcactttttgaactaagaa

SEQ ID NO: 5445959 - DNA, 20 bp, Homo sapiens
tcactttttgaactaagaaa

SEQ ID NO: 5445960 - DNA, 22 bp, Homo sapiens
tcactttttgaactaagaaact

SEQ ID NO: 5445961 - DNA, 22 bp, Homo sapiens
tcactttttgaggcaaaagaag

SEQ ID NO: 5445962 - DNA, 15 bp, Homo sapiens
tcacttttttataaa

SEQ ID NO: 5445963 - DNA, 17 bp, Homo sapiens
tcacttttttataaatt

SEQ ID NO: 5445964 - DNA, 13 bp, Homo sapiens
tcacttttttcca

SEQ ID NO: 5445965 - DNA, 15 bp, Homo sapiens
tcacttttttccaca

SEQ ID NO: 5445966 - DNA, 16 bp, Homo sapiens
tcacttttttccacat

SEQ ID NO: 5445967 - DNA, 17 bp, Homo sapiens
tcacttttttcctgtca

SEQ ID NO: 5445968 - DNA, 21 bp, Homo sapiens
tcacttttttcctgtcaatat

SEQ ID NO: 5445969 - DNA, 17 bp, Homo sapiens
tcacttttttctgcctt

SEQ ID NO: 5445970 - DNA, 18 bp, Homo sapiens
tcacttttttctgccttg

SEQ ID NO: 5445971 - DNA, 16 bp, Homo sapiens
tcacttttttgaagga

SEQ ID NO: 5445972 - DNA, 18 bp, Homo sapiens
tcactttttttttttgtt

SEQ ID NO: 5445973 - DNA, 23 bp, Homo sapiens
tcagaaaaaatgtgaagtctact

SEQ ID NO: 5445974 - DNA, 13 bp, Homo sapiens
tcagaaaaattaa

SEQ ID NO: 5445975 - DNA, 11 bp, Homo sapiens
tcagaaaacag

SEQ ID NO: 5445976 - DNA, 16 bp, Homo sapiens
tcagaaaacagaaaaa

SEQ ID NO: 5445977 - DNA, 20 bp, Homo sapiens
tcagaaaacagaaaaaaaac

SEQ ID NO: 5445978 - DNA, 18 bp, Homo sapiens
tcagaaaacataatataa

SEQ ID NO: 5445979 - DNA, 18 bp, Homo sapiens
tcagaaaactttaaaaaa

SEQ ID NO: 5445980 - DNA, 18 bp, Homo sapiens
tcagaaaagaaaaccatt

SEQ ID NO: 5445981 - DNA, 15 bp, Homo sapiens
tcagaaaagacactt

SEQ ID NO: 5445982 - DNA, 12 bp, Homo sapiens
tcagaaaagcac

SEQ ID NO: 5445983 - DNA, 16 bp, Homo sapiens
tcagaaaagcacctct

SEQ ID NO: 5445984 - DNA, 13 bp, Homo sapiens
tcagaaaagctat

SEQ ID NO: 5445985 - DNA, 14 bp, Homo sapiens
tcagaaaagggaag

SEQ ID NO: 5445986 - DNA, 23 bp, Homo sapiens
tcagaaaagtagaattatatcta

SEQ ID NO: 5445987 - DNA, 20 bp, Homo sapiens
tcagaaaatatccctcctgt

SEQ ID NO: 5445988 - DNA, 20 bp, Homo sapiens
tcagaaaatattatgtgttt

SEQ ID NO: 5445989 - DNA, 18 bp, Homo sapiens
tcagaaaatgttctgttt

SEQ ID NO: 5445990 - DNA, 19 bp, Homo sapiens
tcagaaaatgttctgtttg

SEQ ID NO: 5445991 - DNA, 19 bp, Homo sapiens
tcagaaaattaaactacag

SEQ ID NO: 5445992 - DNA, 21 bp, Homo sapiens
tcagaaacaccctcacactgg

SEQ ID NO: 5445993 - DNA, 18 bp, Homo sapiens
tcagaaacactggggctg

SEQ ID NO: 5445994 - DNA, 20 bp, Homo sapiens
tcagaaacagtattttcttc

SEQ ID NO: 5445995 - DNA, 18 bp, Homo sapiens
tcagaaaccaaacagttt

SEQ ID NO: 5445996 - DNA, 19 bp, Homo sapiens
tcagaaaccattgttcaga

SEQ ID NO: 5445997 - DNA, 22 bp, Homo sapiens
tcagaaaccattgttcagaaga

SEQ ID NO: 5445998 - DNA, 21 bp, Homo sapiens
tcagaaaccctcattgtgttt

SEQ ID NO: 5445999 - DNA, 17 bp, Homo sapiens
tcagaaaccctggtctc

SEQ ID NO: 5446000 - DNA, 22 bp, Homo sapiens
tcagaaacgagatcgggaagca

SEQ ID NO: 5446001 - DNA, 24 bp, Homo sapiens
tcagaaacgagatcgggaagcaga

SEQ ID NO: 5446002 - DNA, 17 bp, Homo sapiens
tcagaaacttgtgaagt

SEQ ID NO: 5446003 - DNA, 13 bp, Homo sapiens
tcagaaacttttt

SEQ ID NO: 5446004 - DNA, 16 bp, Homo sapiens
tcagaaagaggtctcc

SEQ ID NO: 5446005 - DNA, 19 bp, Homo sapiens
tcagaaagaggtctcccca

SEQ ID NO: 5446006 - DNA, 20 bp, Homo sapiens
tcagaaaggaaaaacaaact

SEQ ID NO: 5446007 - DNA, 20 bp, Homo sapiens
tcagaaagggagggctctga

SEQ ID NO: 5446008 - DNA, 21 bp, Homo sapiens
tcagaaagggagggctctgag

SEQ ID NO: 5446009 - DNA, 22 bp, Homo sapiens
tcagaaagggagggctctgagg

SEQ ID NO: 5446010 - DNA, 19 bp, Homo sapiens
tcagaaaggggctcttctg

SEQ ID NO: 5446011 - DNA, 20 bp, Homo sapiens
tcagaaagtcaccaggactt

SEQ ID NO: 5446012 - DNA, 23 bp, Homo sapiens
tcagaaagtgcagcatggaggaa

SEQ ID NO: 5446013 - DNA, 23 bp, Homo sapiens
tcagaaagtgcctgacacactaa

SEQ ID NO: 5446014 - DNA, 12 bp, Homo sapiens
tcagaaagtgta

SEQ ID NO: 5446015 - DNA, 15 bp, Homo sapiens
tcagaaagtgtaaat

SEQ ID NO: 5446016 - DNA, 23 bp, Homo sapiens
tcagaaagtgtgctttatgctga

SEQ ID NO: 5446017 - DNA, 21 bp, Homo sapiens
tcagaaagtttgaagcaccat

SEQ ID NO: 5446018 - DNA, 20 bp, Homo sapiens
tcagaaataaaatgaaatgt

SEQ ID NO: 5446019 - DNA, 23 bp, Homo sapiens
tcagaaataaaatgaaatgtctt

SEQ ID NO: 5446020 - DNA, 16 bp, Homo sapiens
tcagaaataaatcaca

SEQ ID NO: 5446021 - DNA, 21 bp, Homo sapiens
tcagaaataaatcacagatgc

SEQ ID NO: 5446022 - DNA, 20 bp, Homo sapiens
tcagaaataataacctgtta

SEQ ID NO: 5446023 - DNA, 13 bp, Homo sapiens
tcagaaatacaga

SEQ ID NO: 5446024 - DNA, 22 bp, Homo sapiens
tcagaaatacagataaatgatt

SEQ ID NO: 5446025 - DNA, 16 bp, Homo sapiens
tcagaaatacagattt

SEQ ID NO: 5446026 - DNA, 20 bp, Homo sapiens
tcagaaatacagattttgat

SEQ ID NO: 5446027 - DNA, 22 bp, Homo sapiens
tcagaaatatccctcatttcat

SEQ ID NO: 5446028 - DNA, 16 bp, Homo sapiens
tcagaaatcctctgtt

SEQ ID NO: 5446029 - DNA, 18 bp, Homo sapiens
tcagaaatgattcagggt

SEQ ID NO: 5446030 - DNA, 14 bp, Homo sapiens
tcagaaatgctgcc

SEQ ID NO: 5446031 - DNA, 17 bp, Homo sapiens
tcagaaattaaaatatt

SEQ ID NO: 5446032 - DNA, 18 bp, Homo sapiens
tcagaaattaaaatatta

SEQ ID NO: 5446033 - DNA, 23 bp, Homo sapiens
tcagaaattaaaatattatttga

SEQ ID NO: 5446034 - DNA, 22 bp, Homo sapiens
tcagaaattccaactcctgatg

SEQ ID NO: 5446035 - DNA, 17 bp, Homo sapiens
tcagaaattctcaaaat

SEQ ID NO: 5446036 - DNA, 15 bp, Homo sapiens
tcagaaattgaaagc

SEQ ID NO: 5446037 - DNA, 18 bp, Homo sapiens
tcagaaattggaacagaa

SEQ ID NO: 5446038 - DNA, 13 bp, Homo sapiens
tcagaaatttaaa

SEQ ID NO: 5446039 - DNA, 22 bp, Homo sapiens
tcagaaattttctacagtacat

SEQ ID NO: 5446040 - DNA, 16 bp, Homo sapiens
tcagaacaaaacttct

SEQ ID NO: 5446041 - DNA, 17 bp, Homo sapiens
tcagaacaaaacttcta

SEQ ID NO: 5446042 - DNA, 20 bp, Homo sapiens
tcagaacaacttgctactta

SEQ ID NO: 5446043 - DNA, 21 bp, Homo sapiens
tcagaacacacagactttctg

SEQ ID NO: 5446044 - DNA, 12 bp, Homo sapiens
tcagaacacatt

SEQ ID NO: 5446045 - DNA, 18 bp, Homo sapiens
tcagaacaccaagtaaat

SEQ ID NO: 5446046 - DNA, 15 bp, Homo sapiens
tcagaacaccccgct

SEQ ID NO: 5446047 - DNA, 23 bp, Homo sapiens
tcagaacagcagactcagctctg

SEQ ID NO: 5446048 - DNA, 16 bp, Homo sapiens
tcagaacataaatgca

SEQ ID NO: 5446049 - DNA, 15 bp, Homo sapiens
tcagaacatgaaatg

SEQ ID NO: 5446050 - DNA, 15 bp, Homo sapiens
tcagaacatgctgga

SEQ ID NO: 5446051 - DNA, 13 bp, Homo sapiens
tcagaacatgtta

SEQ ID NO: 5446052 - DNA, 17 bp, Homo sapiens
tcagaacatgttaagat

SEQ ID NO: 5446053 - DNA, 23 bp, Homo sapiens
tcagaaccattcactggcaaatg

SEQ ID NO: 5446054 - DNA, 12 bp, Homo sapiens
tcagaaccattt

SEQ ID NO: 5446055 - DNA, 23 bp, Homo sapiens
tcagaacccagggctctgcccca

SEQ ID NO: 5446056 - DNA, 15 bp, Homo sapiens
tcagaacccttggct

SEQ ID NO: 5446057 - DNA, 18 bp, Homo sapiens
tcagaacccttggcttgc

SEQ ID NO: 5446058 - DNA, 24 bp, Homo sapiens
tcagaacccttggcttgcccacgt

SEQ ID NO: 5446059 - DNA, 16 bp, Homo sapiens
tcagaacctcttcccc

SEQ ID NO: 5446060 - DNA, 15 bp, Homo sapiens
tcagagcctgcagtt

SEQ ID NO: 5446061 - DNA, 13 bp, Homo sapiens
tcagagccttcca

SEQ ID NO: 5446062 - DNA, 16 bp, Homo sapiens
tcagagcgcacaggga

SEQ ID NO: 5446063 - DNA, 20 bp, Homo sapiens
tcagagcgccaggaagccag

SEQ ID NO: 5446064 - DNA, 21 bp, Homo sapiens
tcagagcgccaggaagccaga

SEQ ID NO: 5446065 - DNA, 18 bp, Homo sapiens
tcagagctaaactccttc

SEQ ID NO: 5446066 - DNA, 23 bp, Homo sapiens
tcagagctaagggtgggtgctca

SEQ ID NO: 5446067 - DNA, 9 bp, Homo sapiens
tcagagctc

SEQ ID NO: 5446068 - DNA, 12 bp, Homo sapiens
tcagagctcagg

SEQ ID NO: 5446069 - DNA, 20 bp, Homo sapiens
tcagagctctcgaggaaagt

SEQ ID NO: 5446070 - DNA, 13 bp, Homo sapiens
tcagagctcttaa

SEQ ID NO: 5446071 - DNA, 16 bp, Homo sapiens
tcagagctcttaatgt

SEQ ID NO: 5446072 - DNA, 14 bp, Homo sapiens
tcagagctgacaca

SEQ ID NO: 5446073 - DNA, 15 bp, Homo sapiens
tcagagctgcagcca

SEQ ID NO: 5446074 - DNA, 18 bp, Homo sapiens
tcagagctgcagccagtc

SEQ ID NO: 5446075 - DNA, 12 bp, Homo sapiens
tcagagctgccc

SEQ ID NO: 5446076 - DNA, 20 bp, Homo sapiens
tcagagctgccctctcctgg

SEQ ID NO: 5446077 - DNA, 14 bp, Homo sapiens
tcagagctgcgggc

SEQ ID NO: 5446078 - DNA, 17 bp, Homo sapiens
tcagagctgcgggctga

SEQ ID NO: 5446079 - DNA, 13 bp, Homo sapiens
tcagagctgctga

SEQ ID NO: 5446080 - DNA, 15 bp, Homo sapiens
tcagagctgctgagc

SEQ ID NO: 5446081 - DNA, 16 bp, Homo sapiens
tcagagctgttataaa

SEQ ID NO: 5446082 - DNA, 18 bp, Homo sapiens
tcagagctgttggcctcg

SEQ ID NO: 5446083 - DNA, 14 bp, Homo sapiens
tcagagcttcctgg

SEQ ID NO: 5446084 - DNA, 17 bp, Homo sapiens
tcagagcttcctgggga

SEQ ID NO: 5446085 - DNA, 20 bp, Homo sapiens
tcagagcttcctggggacca

SEQ ID NO: 5446086 - DNA, 14 bp, Homo sapiens
tcagagcttgaaga

SEQ ID NO: 5446087 - DNA, 20 bp, Homo sapiens
tcagagcttgattagaagcc

SEQ ID NO: 5446088 - DNA, 23 bp, Homo sapiens
tcagagctttaaaagtatcttta

SEQ ID NO: 5446089 - DNA, 16 bp, Homo sapiens
tcagagctttgtcact

SEQ ID NO: 5446090 - DNA, 17 bp, Homo sapiens
tcagagctttgtcactt

SEQ ID NO: 5446091 - DNA, 22 bp, Homo sapiens
tcagagctttgtcacttgccac

SEQ ID NO: 5446092 - DNA, 21 bp, Homo sapiens
tcagaggaacagtcctgttca

SEQ ID NO: 5446093 - DNA, 12 bp, Homo sapiens
tcagaggacccc

SEQ ID NO: 5446094 - DNA, 17 bp, Homo sapiens
tcagaggacctgtattt

SEQ ID NO: 5446095 - DNA, 13 bp, Homo sapiens
tcagaggagaaga

SEQ ID NO: 5446096 - DNA, 23 bp, Homo sapiens
tcagaggagagatagcctgtggc

SEQ ID NO: 5446097 - DNA, 14 bp, Homo sapiens
tcagaggagaggag

SEQ ID NO: 5446098 - DNA, 16 bp, Homo sapiens
tcagaggagaggagca

SEQ ID NO: 5446099 - DNA, 18 bp, Homo sapiens
tcagaggagcatcagctg

SEQ ID NO: 5446100 - DNA, 19 bp, Homo sapiens
tcagaggagcgcaggcagc

SEQ ID NO: 5446101 - DNA, 22 bp, Homo sapiens
tcagaggagctctaccctgctc

SEQ ID NO: 5446102 - DNA, 14 bp, Homo sapiens
tcagaggagtaaat

SEQ ID NO: 5446103 - DNA, 21 bp, Homo sapiens
tcagaggagtgattgaaccag

SEQ ID NO: 5446104 - DNA, 19 bp, Homo sapiens
tcagaggatggccagtgtc

SEQ ID NO: 5446105 - DNA, 14 bp, Homo sapiens
tcagaggcagcacc

SEQ ID NO: 5446106 - DNA, 13 bp, Homo sapiens
tcagaggcagtga

SEQ ID NO: 5446107 - DNA, 20 bp, Homo sapiens
tcagaggcatttgagcagct

SEQ ID NO: 5446108 - DNA, 17 bp, Homo sapiens
tcagaggcccccagtgg

SEQ ID NO: 5446109 - DNA, 18 bp, Homo sapiens
tcagaggcccccagtggg

SEQ ID NO: 5446110 - DNA, 19 bp, Homo sapiens
tcagaggcccccagtgggg

SEQ ID NO: 5446111 - DNA, 21 bp, Homo sapiens
tcagaggccccttgctgctgg

SEQ ID NO: 5446112 - DNA, 24 bp, Homo sapiens
tcagaggccctcctgtgctggtga

SEQ ID NO: 5446113 - DNA, 13 bp, Homo sapiens
tcagaggcctgct

SEQ ID NO: 5446114 - DNA, 16 bp, Homo sapiens
tcagaggccttgctgt

SEQ ID NO: 5446115 - DNA, 15 bp, Homo sapiens
tcagaggctcagaga

SEQ ID NO: 5446116 - DNA, 19 bp, Homo sapiens
tcagaggctgagccctgta

SEQ ID NO: 5446117 - DNA, 13 bp, Homo sapiens
tcagaggctgcag

SEQ ID NO: 5446118 - DNA, 14 bp, Homo sapiens
tcagaggctgcagg

SEQ ID NO: 5446119 - DNA, 16 bp, Homo sapiens
tcagaggctgggagca

SEQ ID NO: 5446120 - DNA, 17 bp, Homo sapiens
tcagagggactgtcagc

SEQ ID NO: 5446121 - DNA, 16 bp, Homo sapiens
tcagagggctgatgga

SEQ ID NO: 5446122 - DNA, 22 bp, Homo sapiens
tcagagggggactgctgctgcc

SEQ ID NO: 5446123 - DNA, 19 bp, Homo sapiens
tcagagggtgtcctgcacc

SEQ ID NO: 5446124 - DNA, 23 bp, Homo sapiens
tcagagggtgtcgtcctgcagtg

SEQ ID NO: 5446125 - DNA, 22 bp, Homo sapiens
tcagagggtttggaccacatct

SEQ ID NO: 5446126 - DNA, 23 bp, Homo sapiens
tcagaggtcatcccttcctcctc

SEQ ID NO: 5446127 - DNA, 17 bp, Homo sapiens
tcagaggtccaggcccc

SEQ ID NO: 5446128 - DNA, 18 bp, Homo sapiens
tcagaggtgctaaattgt

SEQ ID NO: 5446129 - DNA, 14 bp, Homo sapiens
tcagaggtgtacac

SEQ ID NO: 5446130 - DNA, 17 bp, Homo sapiens
tcagaggttctttgagg

SEQ ID NO: 5446131 - DNA, 23 bp, Homo sapiens
tcagaggtttacctagagaacag

SEQ ID NO: 5446132 - DNA, 22 bp, Homo sapiens
tcagagtaatccaagcaaatgt

SEQ ID NO: 5446133 - DNA, 18 bp, Homo sapiens
tcagagtacgtcctgcct

SEQ ID NO: 5446134 - DNA, 23 bp, Homo sapiens
tcagagtacgtcctgcctggcac

SEQ ID NO: 5446135 - DNA, 15 bp, Homo sapiens
tcagagtagaaataa

SEQ ID NO: 5446136 - DNA, 22 bp, Homo sapiens
tcagagtatattgttgaagaga

SEQ ID NO: 5446137 - DNA, 20 bp, Homo sapiens
tcagagtatctgaagggaat

SEQ ID NO: 5446138 - DNA, 15 bp, Homo sapiens
tcagagtatggagct

SEQ ID NO: 5446139 - DNA, 16 bp, Homo sapiens
tcagagtcagccagga

SEQ ID NO: 5446140 - DNA, 12 bp, Homo sapiens
tcagagtccagt

SEQ ID NO: 5446141 - DNA, 13 bp, Homo sapiens
tcagagtccagtg

SEQ ID NO: 5446142 - DNA, 13 bp, Homo sapiens
tcagagtcctgcc

SEQ ID NO: 5446143 - DNA, 18 bp, Homo sapiens
tcagagtccttaaaatgt

SEQ ID NO: 5446144 - DNA, 19 bp, Homo sapiens
tcagagtgacatccaggag

SEQ ID NO: 5446145 - DNA, 21 bp, Homo sapiens
tcagagtgacatccaggagga

SEQ ID NO: 5446146 - DNA, 19 bp, Homo sapiens
tcagagtgaccctcagctg

SEQ ID NO: 5446147 - DNA, 22 bp, Homo sapiens
tcagagtggccaatccctgtgt

SEQ ID NO: 5446148 - DNA, 18 bp, Homo sapiens
tcagagtggctcactggc

SEQ ID NO: 5446149 - DNA, 21 bp, Homo sapiens
tcagagtgtatttttgtaatt

SEQ ID NO: 5446150 - DNA, 17 bp, Homo sapiens
tcagagttaaaatatat

SEQ ID NO: 5446151 - DNA, 18 bp, Homo sapiens
tcagagttctgaagaaaa

SEQ ID NO: 5446152 - DNA, 21 bp, Homo sapiens
tcagagttgctgcaaacctga

SEQ ID NO: 5446153 - DNA, 17 bp, Homo sapiens
tcagagttgctttaaag

SEQ ID NO: 5446154 - DNA, 16 bp, Homo sapiens
tcagagttgcttttct

SEQ ID NO: 5446155 - DNA, 19 bp, Homo sapiens
tcagagttgttaaccagaa

SEQ ID NO: 5446156 - DNA, 23 bp, Homo sapiens
tcagagtttggttaatcagtgtt

SEQ ID NO: 5446157 - DNA, 22 bp, Homo sapiens
tcagagtttgtgtgtatttgta

SEQ ID NO: 5446158 - DNA, 13 bp, Homo sapiens
tcagagttttcta

SEQ ID NO: 5446159 - DNA, 17 bp, Homo sapiens
tcagataaagtgaccag

SEQ ID NO: 5446160 - DNA, 13 bp, Homo sapiens
tcagataaatcat

SEQ ID NO: 5446161 - DNA, 14 bp, Homo sapiens
tcagataaatcatg

SEQ ID NO: 5446162 - DNA, 14 bp, Homo sapiens
tcagataacaactg

SEQ ID NO: 5446163 - DNA, 15 bp, Homo sapiens
tcagataactgttat

SEQ ID NO: 5446164 - DNA, 20 bp, Homo sapiens
tcagataaggtaaaatgcca

SEQ ID NO: 5446165 - DNA, 22 bp, Homo sapiens
tcagataaggtaaaatgccatg

SEQ ID NO: 5446166 - DNA, 15 bp, Homo sapiens
tcagataagtgtaaa

SEQ ID NO: 5446167 - DNA, 16 bp, Homo sapiens
tcagataagtgtaaat

SEQ ID NO: 5446168 - DNA, 15 bp, Homo sapiens
tcagataatatgttt

SEQ ID NO: 5446169 - DNA, 19 bp, Homo sapiens
tcagataatcggtgcagcg

SEQ ID NO: 5446170 - DNA, 16 bp, Homo sapiens
tcagataatgatggaa

SEQ ID NO: 5446171 - DNA, 21 bp, Homo sapiens
tcagataatgccaccaaagga

SEQ ID NO: 5446172 - DNA, 20 bp, Homo sapiens
tcagataatggtaatttagt

SEQ ID NO: 5446173 - DNA, 15 bp, Homo sapiens
tcagatacaaaacta

SEQ ID NO: 5446174 - DNA, 14 bp, Homo sapiens
tcagatacatcact

SEQ ID NO: 5446175 - DNA, 17 bp, Homo sapiens
tcagatacatcactgct

SEQ ID NO: 5446176 - DNA, 19 bp, Homo sapiens
tcagatacatcactgcttg

SEQ ID NO: 5446177 - DNA, 15 bp, Homo sapiens
tcagatacttgtgaa

SEQ ID NO: 5446178 - DNA, 16 bp, Homo sapiens
tcagatacttgtgaac

SEQ ID NO: 5446179 - DNA, 15 bp, Homo sapiens
tcagatagacctgtg

SEQ ID NO: 5446180 - DNA, 17 bp, Homo sapiens
tcagataggattttctc

SEQ ID NO: 5446181 - DNA, 14 bp, Homo sapiens
tcagatataaaaga

SEQ ID NO: 5446182 - DNA, 20 bp, Homo sapiens
tcagatataaaagactgacc

SEQ ID NO: 5446183 - DNA, 22 bp, Homo sapiens
tcagatataagagaagtctcat

SEQ ID NO: 5446184 - DNA, 16 bp, Homo sapiens
tcagatataagatttg

SEQ ID NO: 5446185 - DNA, 18 bp, Homo sapiens
tcagatataagatttgta

SEQ ID NO: 5446186 - DNA, 20 bp, Homo sapiens
tcagatataagatttgtaca

SEQ ID NO: 5446187 - DNA, 20 bp, Homo sapiens
tcagatatagatcctgagct

SEQ ID NO: 5446188 - DNA, 18 bp, Homo sapiens
tcagatatatttttcaca

SEQ ID NO: 5446189 - DNA, 15 bp, Homo sapiens
tcagatatcaaaatt

SEQ ID NO: 5446190 - DNA, 21 bp, Homo sapiens
tcagatatcttggacaaatca

SEQ ID NO: 5446191 - DNA, 22 bp, Homo sapiens
tcagatatcttggacaaatcac

SEQ ID NO: 5446192 - DNA, 16 bp, Homo sapiens
tcagatatgcttacta

SEQ ID NO: 5446193 - DNA, 15 bp, Homo sapiens
tcagatattctgctc

SEQ ID NO: 5446194 - DNA, 14 bp, Homo sapiens
tcagatatttctta

SEQ ID NO: 5446195 - DNA, 15 bp, Homo sapiens
tcagatatttcttat

SEQ ID NO: 5446196 - DNA, 16 bp, Homo sapiens
tcagatattttgcacg

SEQ ID NO: 5446197 - DNA, 22 bp, Homo sapiens
tcagatattttttcagaaatat

SEQ ID NO: 5446198 - DNA, 16 bp, Homo sapiens
tcagatcaaaatgcct

SEQ ID NO: 5446199 - DNA, 15 bp, Homo sapiens
tcagatcactactgc

SEQ ID NO: 5446200 - DNA, 16 bp, Homo sapiens
tcagatcactactgca

SEQ ID NO: 5446201 - DNA, 17 bp, Homo sapiens
tcagatcactactgcag

SEQ ID NO: 5446202 - DNA, 13 bp, Homo sapiens
tcagatcagtgct

SEQ ID NO: 5446203 - DNA, 16 bp, Homo sapiens
tcagatccaggagctc

SEQ ID NO: 5446204 - DNA, 18 bp, Homo sapiens
tcagatccaggagctcca

SEQ ID NO: 5446205 - DNA, 15 bp, Homo sapiens
tcagatccagggaca

SEQ ID NO: 5446206 - DNA, 14 bp, Homo sapiens
tcagatcccagggt

SEQ ID NO: 5446207 - DNA, 15 bp, Homo sapiens
tcagatcccagggta

SEQ ID NO: 5446208 - DNA, 22 bp, Homo sapiens
tcagatccctcggtcagcaccg

SEQ ID NO: 5446209 - DNA, 14 bp, Homo sapiens
tcagatcctgctgc

SEQ ID NO: 5446210 - DNA, 18 bp, Homo sapiens
tcagatcctgctgccgcg

SEQ ID NO: 5446211 - DNA, 20 bp, Homo sapiens
tcagatcctgctgccgcgtg

SEQ ID NO: 5446212 - DNA, 19 bp, Homo sapiens
tcagatccttccaaactct

SEQ ID NO: 5446213 - DNA, 16 bp, Homo sapiens
tcagatcgtattaatt

SEQ ID NO: 5446214 - DNA, 15 bp, Homo sapiens
tcagatcgttcattg

SEQ ID NO: 5446215 - DNA, 19 bp, Homo sapiens
tcagatctcatagatgacc

SEQ ID NO: 5446216 - DNA, 19 bp, Homo sapiens
tcagatctgcactcctgtc

SEQ ID NO: 5446217 - DNA, 22 bp, Homo sapiens
tcagatctgcactcctgtctct

SEQ ID NO: 5446218 - DNA, 23 bp, Homo sapiens
tcagatctgcactcctgtctctt

SEQ ID NO: 5446219 - DNA, 22 bp, Homo sapiens
tcagatctggtctagttaacct

SEQ ID NO: 5446220 - DNA, 21 bp, Homo sapiens
tcagatcttaatataaattca

SEQ ID NO: 5446221 - DNA, 15 bp, Homo sapiens
tcagatcttacaagt

SEQ ID NO: 5446222 - DNA, 14 bp, Homo sapiens
tcagatcttctttt

SEQ ID NO: 5446223 - DNA, 15 bp, Homo sapiens
tcagatcttgacagt

SEQ ID NO: 5446224 - DNA, 16 bp, Homo sapiens
tcagatctttctcctt

SEQ ID NO: 5446225 - DNA, 19 bp, Homo sapiens
tcagatctttctccttgaa

SEQ ID NO: 5446226 - DNA, 13 bp, Homo sapiens
tcagatgaaaata

SEQ ID NO: 5446227 - DNA, 15 bp, Homo sapiens
tcagatgaaaataaa

SEQ ID NO: 5446228 - DNA, 18 bp, Homo sapiens
tcagatgaaaataaaata

SEQ ID NO: 5446229 - DNA, 16 bp, Homo sapiens
tcagatgaattgataa

SEQ ID NO: 5446230 - DNA, 23 bp, Homo sapiens
tcagatgactatgcagaggcctg

SEQ ID NO: 5446231 - DNA, 20 bp, Homo sapiens
tcagatgagaacaaagctgt

SEQ ID NO: 5446232 - DNA, 19 bp, Homo sapiens
tcagatgagcaaggacatt

SEQ ID NO: 5446233 - DNA, 22 bp, Homo sapiens
tcagatgagcaaggacattgcc

SEQ ID NO: 5446234 - DNA, 15 bp, Homo sapiens
tcagatgaggacaga

SEQ ID NO: 5446235 - DNA, 13 bp, Homo sapiens
tcagatgaggccc

SEQ ID NO: 5446236 - DNA, 17 bp, Homo sapiens
tcagatgaggccctgca

SEQ ID NO: 5446237 - DNA, 21 bp, Homo sapiens
tcagatgaggtcaacacaggt

SEQ ID NO: 5446238 - DNA, 18 bp, Homo sapiens
tcagccttggttcctgat

SEQ ID NO: 5446239 - DNA, 23 bp, Homo sapiens
tcagccttgtgtttggtcatgtg

SEQ ID NO: 5446240 - DNA, 21 bp, Homo sapiens
tcagcctttgttaaccttaaa

SEQ ID NO: 5446241 - DNA, 20 bp, Homo sapiens
tcagccttttatgtattttc

SEQ ID NO: 5446242 - DNA, 13 bp, Homo sapiens
tcagcgactggat

SEQ ID NO: 5446243 - DNA, 14 bp, Homo sapiens
tcagcgagaccctt

SEQ ID NO: 5446244 - DNA, 13 bp, Homo sapiens
tcagcgagaggca

SEQ ID NO: 5446245 - DNA, 15 bp, Homo sapiens
tcagcgagaggcagc

SEQ ID NO: 5446246 - DNA, 20 bp, Homo sapiens
tcagcgatgtatataagcca

SEQ ID NO: 5446247 - DNA, 18 bp, Homo sapiens
tcagcgatgtatgcagct

SEQ ID NO: 5446248 - DNA, 17 bp, Homo sapiens
tcagcgattcctgccaa

SEQ ID NO: 5446249 - DNA, 14 bp, Homo sapiens
tcagcgcaggctgc

SEQ ID NO: 5446250 - DNA, 16 bp, Homo sapiens
tcagcgcaggctgcag

SEQ ID NO: 5446251 - DNA, 20 bp, Homo sapiens
tcagcgcaggctgcagagcc

SEQ ID NO: 5446252 - DNA, 23 bp, Homo sapiens
tcagcgcccccaggcctgccctg

SEQ ID NO: 5446253 - DNA, 14 bp, Homo sapiens
tcagcgctcctcct

SEQ ID NO: 5446254 - DNA, 19 bp, Homo sapiens
tcagcgctcctcctgtgtg

SEQ ID NO: 5446255 - DNA, 14 bp, Homo sapiens
tcagcggagaggac

SEQ ID NO: 5446256 - DNA, 15 bp, Homo sapiens
tcagcggcctgggga

SEQ ID NO: 5446257 - DNA, 19 bp, Homo sapiens
tcagcggcgaccgccctcc

SEQ ID NO: 5446258 - DNA, 20 bp, Homo sapiens
tcagcggcgcgccctgcaga

SEQ ID NO: 5446259 - DNA, 23 bp, Homo sapiens
tcagcggcgcgccctgcagaggg

SEQ ID NO: 5446260 - DNA, 19 bp, Homo sapiens
tcagcgggcccaggcctac

SEQ ID NO: 5446261 - DNA, 19 bp, Homo sapiens
tcagcggggcagcggggct

SEQ ID NO: 5446262 - DNA, 18 bp, Homo sapiens
tcagcggggcgagctgag

SEQ ID NO: 5446263 - DNA, 15 bp, Homo sapiens
tcagcgggtctcctc

SEQ ID NO: 5446264 - DNA, 23 bp, Homo sapiens
tcagcgggtctcctcccagcggc

SEQ ID NO: 5446265 - DNA, 18 bp, Homo sapiens
tcagcggttgaggagaat

SEQ ID NO: 5446266 - DNA, 18 bp, Homo sapiens
tcagcgtgcttagcctcc

SEQ ID NO: 5446267 - DNA, 23 bp, Homo sapiens
tcagcgtggaggggtaggggctg

SEQ ID NO: 5446268 - DNA, 15 bp, Homo sapiens
tcagcgtggttttta

SEQ ID NO: 5446269 - DNA, 13 bp, Homo sapiens
tcagcgttgcatg

SEQ ID NO: 5446270 - DNA, 20 bp, Homo sapiens
tcagctaaagtaacagagca

SEQ ID NO: 5446271 - DNA, 17 bp, Homo sapiens
tcagctaaatgcaggga

SEQ ID NO: 5446272 - DNA, 14 bp, Homo sapiens
tcagctaagctcac

SEQ ID NO: 5446273 - DNA, 15 bp, Homo sapiens
tcagctaagctcacg

SEQ ID NO: 5446274 - DNA, 19 bp, Homo sapiens
tcagctaagggaagacatt

SEQ ID NO: 5446275 - DNA, 22 bp, Homo sapiens
tcagctaagggaagacatttct

SEQ ID NO: 5446276 - DNA, 22 bp, Homo sapiens
tcagctaatgtcacaacatggt

SEQ ID NO: 5446277 - DNA, 17 bp, Homo sapiens
tcagctacaattgtaaa

SEQ ID NO: 5446278 - DNA, 19 bp, Homo sapiens
tcagctacccactatcctt

SEQ ID NO: 5446279 - DNA, 15 bp, Homo sapiens
tcagctactaatgat

SEQ ID NO: 5446280 - DNA, 20 bp, Homo sapiens
tcagctactaatgatgtttt

SEQ ID NO: 5446281 - DNA, 19 bp, Homo sapiens
tcagctactctagttctgt

SEQ ID NO: 5446282 - DNA, 14 bp, Homo sapiens
tcagctactgattt

SEQ ID NO: 5446283 - DNA, 19 bp, Homo sapiens
tcagctactgatttttgtg

SEQ ID NO: 5446284 - DNA, 14 bp, Homo sapiens
tcagctactgccaa

SEQ ID NO: 5446285 - DNA, 20 bp, Homo sapiens
tcagctactgccaagggcag

SEQ ID NO: 5446286 - DNA, 20 bp, Homo sapiens
tcagctactttccatttggt

SEQ ID NO: 5446287 - DNA, 14 bp, Homo sapiens
tcagctagacaatg

SEQ ID NO: 5446288 - DNA, 18 bp, Homo sapiens
tcagctagcttttaggaa

SEQ ID NO: 5446289 - DNA, 20 bp, Homo sapiens
tcagctaggaacaaatcttc

SEQ ID NO: 5446290 - DNA, 21 bp, Homo sapiens
tcagctaggaacaaatcttcc

SEQ ID NO: 5446291 - DNA, 23 bp, Homo sapiens
tcagctaggaacaaatcttcctg

SEQ ID NO: 5446292 - DNA, 14 bp, Homo sapiens
tcagctagtggctc

SEQ ID NO: 5446293 - DNA, 23 bp, Homo sapiens
tcagctatacctgcacgttcata

SEQ ID NO: 5446294 - DNA, 21 bp, Homo sapiens
tcagctattcccttctgatct

SEQ ID NO: 5446295 - DNA, 18 bp, Homo sapiens
tcagctattggtaatata

SEQ ID NO: 5446296 - DNA, 19 bp, Homo sapiens
tcagctatttactgccaaa

SEQ ID NO: 5446297 - DNA, 20 bp, Homo sapiens
tcagctcaactcacagcttc

SEQ ID NO: 5446298 - DNA, 13 bp, Homo sapiens
tcagctcactgca

SEQ ID NO: 5446299 - DNA, 23 bp, Homo sapiens
tcagctcactgcaacctccgcat

SEQ ID NO: 5446300 - DNA, 19 bp, Homo sapiens
tcagctcactgcaagctcc

SEQ ID NO: 5446301 - DNA, 14 bp, Homo sapiens
tcagctcactgttc

SEQ ID NO: 5446302 - DNA, 22 bp, Homo sapiens
tcagctcagcattgtgtacaaa

SEQ ID NO: 5446303 - DNA, 17 bp, Homo sapiens
tcagctcagcctccccc

SEQ ID NO: 5446304 - DNA, 19 bp, Homo sapiens
tcagctcaggcagctcgag

SEQ ID NO: 5446305 - DNA, 19 bp, Homo sapiens
tcagctcatagtgaacaca

SEQ ID NO: 5446306 - DNA, 15 bp, Homo sapiens
tcagctcatccatgc

SEQ ID NO: 5446307 - DNA, 12 bp, Homo sapiens
tcagctcatgga

SEQ ID NO: 5446308 - DNA, 13 bp, Homo sapiens
tcagctcattatg

SEQ ID NO: 5446309 - DNA, 21 bp, Homo sapiens
tcagctcatttaatcccagga

SEQ ID NO: 5446310 - DNA, 18 bp, Homo sapiens
tcagctccactttcagtg

SEQ ID NO: 5446311 - DNA, 23 bp, Homo sapiens
tcagctccagacgtaggggaggg

SEQ ID NO: 5446312 - DNA, 22 bp, Homo sapiens
tcagctccagcccctttccaaa

SEQ ID NO: 5446313 - DNA, 24 bp, Homo sapiens
tcagctccagctcaccagccccag

SEQ ID NO: 5446314 - DNA, 22 bp, Homo sapiens
tcagctccagggaatccaagcc

SEQ ID NO: 5446315 - DNA, 23 bp, Homo sapiens
tcagctccagggaatccaagcct

SEQ ID NO: 5446316 - DNA, 14 bp, Homo sapiens
tcagctccaggtgg

SEQ ID NO: 5446317 - DNA, 20 bp, Homo sapiens
tcagctcccacaagcctctg

SEQ ID NO: 5446318 - DNA, 13 bp, Homo sapiens
tcagctcccaggc

SEQ ID NO: 5446319 - DNA, 22 bp, Homo sapiens
tcagctcccaggccaacagtag

SEQ ID NO: 5446320 - DNA, 12 bp, Homo sapiens
tcagctcccata

SEQ ID NO: 5446321 - DNA, 19 bp, Homo sapiens
tcagctcccatagcgctgg

SEQ ID NO: 5446322 - DNA, 22 bp, Homo sapiens
tcagctcccatagcgctggctc

SEQ ID NO: 5446323 - DNA, 16 bp, Homo sapiens
tcagctcccatttcta

SEQ ID NO: 5446324 - DNA, 19 bp, Homo sapiens
tcagctcccatttctactc

SEQ ID NO: 5446325 - DNA, 20 bp, Homo sapiens
tcagctcccatttctactct

SEQ ID NO: 5446326 - DNA, 21 bp, Homo sapiens
tcagctcccccaggctgttct

SEQ ID NO: 5446327 - DNA, 13 bp, Homo sapiens
tcagctccccctg

SEQ ID NO: 5446328 - DNA, 15 bp, Homo sapiens
tcagctccccctgtc

SEQ ID NO: 5446329 - DNA, 22 bp, Homo sapiens
tcagctcccctcggagaagagc

SEQ ID NO: 5446330 - DNA, 19 bp, Homo sapiens
tcagctccctgcctgtttc

SEQ ID NO: 5446331 - DNA, 18 bp, Homo sapiens
tcagctcctacctctgtg

SEQ ID NO: 5446332 - DNA, 20 bp, Homo sapiens
tcagctcctacctctgtgcc

SEQ ID NO: 5446333 - DNA, 22 bp, Homo sapiens
tcagctcctacctctgtgccag

SEQ ID NO: 5446334 - DNA, 23 bp, Homo sapiens
tcagctcctgagtagctgggcct

SEQ ID NO: 5446335 - DNA, 14 bp, Homo sapiens
tcagctccttcctg

SEQ ID NO: 5446336 - DNA, 15 bp, Homo sapiens
tcagctccttcctgg

SEQ ID NO: 5446337 - DNA, 17 bp, Homo sapiens
tcagctccttcctggag

SEQ ID NO: 5446338 - DNA, 12 bp, Homo sapiens
tcagctcctttc

SEQ ID NO: 5446339 - DNA, 14 bp, Homo sapiens
tcagctccttttcc

SEQ ID NO: 5446340 - DNA, 18 bp, Homo sapiens
tcagctcgctgcccaggg

SEQ ID NO: 5446341 - DNA, 19 bp, Homo sapiens
tcagctcgttacttcagcc

SEQ ID NO: 5446342 - DNA, 20 bp, Homo sapiens
tcagctctaaagcagagatg

SEQ ID NO: 5446343 - DNA, 20 bp, Homo sapiens
tcagctctaggctgttctgt

SEQ ID NO: 5446344 - DNA, 23 bp, Homo sapiens
tcagctctaggctgttctgtagc

SEQ ID NO: 5446345 - DNA, 20 bp, Homo sapiens
tcagctctcctggctccctc

SEQ ID NO: 5446346 - DNA, 12 bp, Homo sapiens
tcagctctctgc

SEQ ID NO: 5446347 - DNA, 13 bp, Homo sapiens
tcagctctctgca

SEQ ID NO: 5446348 - DNA, 15 bp, Homo sapiens
tcagctctctgcaga

SEQ ID NO: 5446349 - DNA, 20 bp, Homo sapiens
tcagctctctgccctgtgta

SEQ ID NO: 5446350 - DNA, 14 bp, Homo sapiens
tcagctctctgctg

SEQ ID NO: 5446351 - DNA, 16 bp, Homo sapiens
tcagctctctgctggg

SEQ ID NO: 5446352 - DNA, 17 bp, Homo sapiens
tcagctctctgctgggt

SEQ ID NO: 5446353 - DNA, 15 bp, Homo sapiens
tcagctctctgtata

SEQ ID NO: 5446354 - DNA, 21 bp, Homo sapiens
tcagctctgaaagagaaacac

SEQ ID NO: 5446355 - DNA, 13 bp, Homo sapiens
tcagctctgcata

SEQ ID NO: 5446356 - DNA, 14 bp, Homo sapiens
tcagctctgcataa

SEQ ID NO: 5446357 - DNA, 13 bp, Homo sapiens
tcagctctgcctt

SEQ ID NO: 5446358 - DNA, 21 bp, Homo sapiens
tcagctctgccttgcactgtg

SEQ ID NO: 5446359 - DNA, 19 bp, Homo sapiens
tcagctctgctttatctga

SEQ ID NO: 5446360 - DNA, 17 bp, Homo sapiens
tcagctctggctcacag

SEQ ID NO: 5446361 - DNA, 20 bp, Homo sapiens
tcagctctggctcacagact

SEQ ID NO: 5446362 - DNA, 11 bp, Homo sapiens
tcagctctggg

SEQ ID NO: 5446363 - DNA, 18 bp, Homo sapiens
tcagctctgggagaggat

SEQ ID NO: 5446364 - DNA, 19 bp, Homo sapiens
tcagctctgggccattctc

SEQ ID NO: 5446365 - DNA, 12 bp, Homo sapiens
tcagctcttcca

SEQ ID NO: 5446366 - DNA, 21 bp, Homo sapiens
tcagctgaatgcctcctgtgg

SEQ ID NO: 5446367 - DNA, 23 bp, Homo sapiens
tcagctgaatgcctcctgtgggg

SEQ ID NO: 5446368 - DNA, 18 bp, Homo sapiens
tcagctgacagctgctca

SEQ ID NO: 5446369 - DNA, 16 bp, Homo sapiens
tcagctgaccccctcc

SEQ ID NO: 5446370 - DNA, 17 bp, Homo sapiens
tcagctgaccccctccc

SEQ ID NO: 5446371 - DNA, 18 bp, Homo sapiens
tcagctgagcatggagac

SEQ ID NO: 5446372 - DNA, 16 bp, Homo sapiens
tcagctgagccctggg

SEQ ID NO: 5446373 - DNA, 18 bp, Homo sapiens
tcagctgagccctgggga

SEQ ID NO: 5446374 - DNA, 23 bp, Homo sapiens
tcagctgagccctggggactgtt

SEQ ID NO: 5446375 - DNA, 18 bp, Homo sapiens
tcagctgagccttctgag

SEQ ID NO: 5446376 - DNA, 21 bp, Homo sapiens
tcagctgagccttctgagctg

SEQ ID NO: 5446377 - DNA, 21 bp, Homo sapiens
tcagctgagcttgagctcccc

SEQ ID NO: 5446378 - DNA, 22 bp, Homo sapiens
tcagctgagcttgagctcccct

SEQ ID NO: 5446379 - DNA, 12 bp, Homo sapiens
tcagctgcaagg

SEQ ID NO: 5446380 - DNA, 15 bp, Homo sapiens
tcagctgcacattcc

SEQ ID NO: 5446381 - DNA, 16 bp, Homo sapiens
tcagctgcacattcct

SEQ ID NO: 5446382 - DNA, 17 bp, Homo sapiens
tcagctgcacattcctg

SEQ ID NO: 5446383 - DNA, 22 bp, Homo sapiens
tcagctgcacattcctggcccc

SEQ ID NO: 5446384 - DNA, 15 bp, Homo sapiens
tcagctgcatctgat

SEQ ID NO: 5446385 - DNA, 21 bp, Homo sapiens
tcagctgcatttcacatgcct

SEQ ID NO: 5446386 - DNA, 19 bp, Homo sapiens
tcagctgccacaacaccag

SEQ ID NO: 5446387 - DNA, 21 bp, Homo sapiens
tcagctgcccatcccagtccc

SEQ ID NO: 5446388 - DNA, 22 bp, Homo sapiens
tcagctgcccatcccagtccct

SEQ ID NO: 5446389 - DNA, 21 bp, Homo sapiens
tcagctgcccccgctcatggg

SEQ ID NO: 5446390 - DNA, 12 bp, Homo sapiens
tcagctgcctca

SEQ ID NO: 5446391 - DNA, 24 bp, Homo sapiens
tcagctgcctcacttcctacaaga

SEQ ID NO: 5446392 - DNA, 13 bp, Homo sapiens
tcagctgcctgaa

SEQ ID NO: 5446393 - DNA, 15 bp, Homo sapiens
tcagctgcctgaaac

SEQ ID NO: 5446394 - DNA, 17 bp, Homo sapiens
tcagctgcctgaaacag

SEQ ID NO: 5446395 - DNA, 15 bp, Homo sapiens
tcagctgccttcctg

SEQ ID NO: 5446396 - DNA, 15 bp, Homo sapiens
tcagctgctactact

SEQ ID NO: 5446397 - DNA, 16 bp, Homo sapiens
tcagctgctcagaatt

SEQ ID NO: 5446398 - DNA, 15 bp, Homo sapiens
tcagctgctccctgg

SEQ ID NO: 5446399 - DNA, 13 bp, Homo sapiens
tcagctgctgaaa

SEQ ID NO: 5446400 - DNA, 23 bp, Homo sapiens
tcagctgctgaagggagggggct

SEQ ID NO: 5446401 - DNA, 16 bp, Homo sapiens
tcagctgctgctatta

SEQ ID NO: 5446402 - DNA, 16 bp, Homo sapiens
tcagctgctggatgac

SEQ ID NO: 5446403 - DNA, 19 bp, Homo sapiens
tcagctgctgttgaacttt

SEQ ID NO: 5446404 - DNA, 23 bp, Homo sapiens
tcagctgctgttgaactttttaa

SEQ ID NO: 5446405 - DNA, 12 bp, Homo sapiens
tcagctgcttct

SEQ ID NO: 5446406 - DNA, 15 bp, Homo sapiens
tcagctgcttctccc

SEQ ID NO: 5446407 - DNA, 21 bp, Homo sapiens
tcagctgcttctgctgcctag

SEQ ID NO: 5446408 - DNA, 13 bp, Homo sapiens
tcagctgctttga

SEQ ID NO: 5446409 - DNA, 16 bp, Homo sapiens
tcagctgctttgttac

SEQ ID NO: 5446410 - DNA, 16 bp, Homo sapiens
tcagctggaaacttct

SEQ ID NO: 5446411 - DNA, 19 bp, Homo sapiens
tcagctggaagtctacctg

SEQ ID NO: 5446412 - DNA, 15 bp, Homo sapiens
tcagctggcagagtt

SEQ ID NO: 5446413 - DNA, 21 bp, Homo sapiens
tcagctggcggaacctggctg

SEQ ID NO: 5446414 - DNA, 12 bp, Homo sapiens
tcaggcctgtgc

SEQ ID NO: 5446415 - DNA, 14 bp, Homo sapiens
tcaggcgcagccct

SEQ ID NO: 5446416 - DNA, 16 bp, Homo sapiens
tcaggcgcagccctag

SEQ ID NO: 5446417 - DNA, 22 bp, Homo sapiens
tcaggcgcagccctagtgggag

SEQ ID NO: 5446418 - DNA, 23 bp, Homo sapiens
tcaggcgcttctccaatgctctg

SEQ ID NO: 5446419 - DNA, 14 bp, Homo sapiens
tcaggcggggagga

SEQ ID NO: 5446420 - DNA, 19 bp, Homo sapiens
tcaggcggggtgctgtggt

SEQ ID NO: 5446421 - DNA, 21 bp, Homo sapiens
tcaggctacaggtgccccacc

SEQ ID NO: 5446422 - DNA, 15 bp, Homo sapiens
tcaggctactagaat

SEQ ID NO: 5446423 - DNA, 22 bp, Homo sapiens
tcaggctactataggtccagaa

SEQ ID NO: 5446424 - DNA, 19 bp, Homo sapiens
tcaggctactgttcttgac

SEQ ID NO: 5446425 - DNA, 18 bp, Homo sapiens
tcaggctatatgcagtcc

SEQ ID NO: 5446426 - DNA, 22 bp, Homo sapiens
tcaggctatcatatatactgta

SEQ ID NO: 5446427 - DNA, 23 bp, Homo sapiens
tcaggctcaaccttccaacttcc

SEQ ID NO: 5446428 - DNA, 16 bp, Homo sapiens
tcaggctcaagttttt

SEQ ID NO: 5446429 - DNA, 15 bp, Homo sapiens
tcaggctccattagg

SEQ ID NO: 5446430 - DNA, 13 bp, Homo sapiens
tcaggctccccag

SEQ ID NO: 5446431 - DNA, 17 bp, Homo sapiens
tcaggctccccagaact

SEQ ID NO: 5446432 - DNA, 22 bp, Homo sapiens
tcaggctccgggcaccaggggc

SEQ ID NO: 5446433 - DNA, 11 bp, Homo sapiens
tcaggctccta

SEQ ID NO: 5446434 - DNA, 19 bp, Homo sapiens
tcaggctcgccaaggccta

SEQ ID NO: 5446435 - DNA, 20 bp, Homo sapiens
tcaggctcgccaaggcctag

SEQ ID NO: 5446436 - DNA, 22 bp, Homo sapiens
tcaggctctgcacagacaagca

SEQ ID NO: 5446437 - DNA, 14 bp, Homo sapiens
tcaggctctgccct

SEQ ID NO: 5446438 - DNA, 15 bp, Homo sapiens
tcaggctctgcctca

SEQ ID NO: 5446439 - DNA, 15 bp, Homo sapiens
tcaggctcttctcct

SEQ ID NO: 5446440 - DNA, 21 bp, Homo sapiens
tcaggctcttctcctttcaca

SEQ ID NO: 5446441 - DNA, 15 bp, Homo sapiens
tcaggctgaaaacaa

SEQ ID NO: 5446442 - DNA, 16 bp, Homo sapiens
tcaggctgagcccagc

SEQ ID NO: 5446443 - DNA, 21 bp, Homo sapiens
tcaggctgagggaggcagaaa

SEQ ID NO: 5446444 - DNA, 19 bp, Homo sapiens
tcaggctgcagctggacag

SEQ ID NO: 5446445 - DNA, 20 bp, Homo sapiens
tcaggctgcagctggacaga

SEQ ID NO: 5446446 - DNA, 16 bp, Homo sapiens
tcaggctgcccagcgg

SEQ ID NO: 5446447 - DNA, 22 bp, Homo sapiens
tcaggctgctgctctgccttca

SEQ ID NO: 5446448 - DNA, 15 bp, Homo sapiens
tcaggctgctggagg

SEQ ID NO: 5446449 - DNA, 17 bp, Homo sapiens
tcaggctgctggaggaa

SEQ ID NO: 5446450 - DNA, 19 bp, Homo sapiens
tcaggctgctggaggaaaa

SEQ ID NO: 5446451 - DNA, 13 bp, Homo sapiens
tcaggctgctggc

SEQ ID NO: 5446452 - DNA, 17 bp, Homo sapiens
tcaggctgctggcgcct

SEQ ID NO: 5446453 - DNA, 19 bp, Homo sapiens
tcaggctgctggcgcctct

SEQ ID NO: 5446454 - DNA, 17 bp, Homo sapiens
tcaggctggagtgcagt

SEQ ID NO: 5446455 - DNA, 21 bp, Homo sapiens
tcaggctggcatctcccccac

SEQ ID NO: 5446456 - DNA, 17 bp, Homo sapiens
tcaggctgggcagcccc

SEQ ID NO: 5446457 - DNA, 21 bp, Homo sapiens
tcaggctgggcagccccagag

SEQ ID NO: 5446458 - DNA, 14 bp, Homo sapiens
tcaggctggtctcg

SEQ ID NO: 5446459 - DNA, 22 bp, Homo sapiens
tcaggctggtctcgaactcctg

SEQ ID NO: 5446460 - DNA, 24 bp, Homo sapiens
tcaggctgtcccaagctcccaaga

SEQ ID NO: 5446461 - DNA, 17 bp, Homo sapiens
tcaggctgtgcttacct

SEQ ID NO: 5446462 - DNA, 14 bp, Homo sapiens
tcaggctgttatta

SEQ ID NO: 5446463 - DNA, 13 bp, Homo sapiens
tcaggctgttggc

SEQ ID NO: 5446464 - DNA, 22 bp, Homo sapiens
tcaggctgttggcgtgtcccag

SEQ ID NO: 5446465 - DNA, 18 bp, Homo sapiens
tcaggcttataacaaata

SEQ ID NO: 5446466 - DNA, 18 bp, Homo sapiens
tcaggcttcctggtgaga

SEQ ID NO: 5446467 - DNA, 14 bp, Homo sapiens
tcaggcttccttgg

SEQ ID NO: 5446468 - DNA, 17 bp, Homo sapiens
tcaggcttgagggaggg

SEQ ID NO: 5446469 - DNA, 23 bp, Homo sapiens
tcaggcttgcattaaaagactgt

SEQ ID NO: 5446470 - DNA, 18 bp, Homo sapiens
tcaggcttggggatgccc

SEQ ID NO: 5446471 - DNA, 20 bp, Homo sapiens
tcaggctttcactatttcct

SEQ ID NO: 5446472 - DNA, 17 bp, Homo sapiens
tcaggctttgtctgctc

SEQ ID NO: 5446473 - DNA, 19 bp, Homo sapiens
tcagggaaaagcagctctc

SEQ ID NO: 5446474 - DNA, 21 bp, Homo sapiens
tcagggaaactaagattcttt

SEQ ID NO: 5446475 - DNA, 13 bp, Homo sapiens
tcagggaaatgga

SEQ ID NO: 5446476 - DNA, 16 bp, Homo sapiens
tcagggaaatggaggg

SEQ ID NO: 5446477 - DNA, 20 bp, Homo sapiens
tcagggaaatggagggtggg

SEQ ID NO: 5446478 - DNA, 14 bp, Homo sapiens
tcagggaaatggcc

SEQ ID NO: 5446479 - DNA, 17 bp, Homo sapiens
tcagggaaatggccttc

SEQ ID NO: 5446480 - DNA, 22 bp, Homo sapiens
tcagggaaccgttattataatt

SEQ ID NO: 5446481 - DNA, 16 bp, Homo sapiens
tcagggaagataagtt

SEQ ID NO: 5446482 - DNA, 20 bp, Homo sapiens
tcagggaagataagttggaa

SEQ ID NO: 5446483 - DNA, 14 bp, Homo sapiens
tcagggaagcccag

SEQ ID NO: 5446484 - DNA, 16 bp, Homo sapiens
tcagggaagcccagct

SEQ ID NO: 5446485 - DNA, 19 bp, Homo sapiens
tcagggaagcccagctcca

SEQ ID NO: 5446486 - DNA, 17 bp, Homo sapiens
tcagggaaggaggagcc

SEQ ID NO: 5446487 - DNA, 23 bp, Homo sapiens
tcagggaaggaggagcctgtcct

SEQ ID NO: 5446488 - DNA, 22 bp, Homo sapiens
tcagggaatttcaggaactaga

SEQ ID NO: 5446489 - DNA, 18 bp, Homo sapiens
tcagggacacatcccctt

SEQ ID NO: 5446490 - DNA, 21 bp, Homo sapiens
tcagggacagagacacctgca

SEQ ID NO: 5446491 - DNA, 18 bp, Homo sapiens
tcagggacagcagcctcc

SEQ ID NO: 5446492 - DNA, 20 bp, Homo sapiens
tcagggaccaaggacccctc

SEQ ID NO: 5446493 - DNA, 23 bp, Homo sapiens
tcagggaccaaggacccctcacc

SEQ ID NO: 5446494 - DNA, 18 bp, Homo sapiens
tcagggaccagctttact

SEQ ID NO: 5446495 - DNA, 12 bp, Homo sapiens
tcagggacccct

SEQ ID NO: 5446496 - DNA, 16 bp, Homo sapiens
tcagggacccctgccc

SEQ ID NO: 5446497 - DNA, 16 bp, Homo sapiens
tcagggaccggtgctg

SEQ ID NO: 5446498 - DNA, 16 bp, Homo sapiens
tcagggaccgtccagg

SEQ ID NO: 5446499 - DNA, 14 bp, Homo sapiens
tcagggacctcagg

SEQ ID NO: 5446500 - DNA, 17 bp, Homo sapiens
tcagggacctcaggggc

SEQ ID NO: 5446501 - DNA, 20 bp, Homo sapiens
tcagggacctcaggggcacc

SEQ ID NO: 5446502 - DNA, 16 bp, Homo sapiens
tcagggacttggacag

SEQ ID NO: 5446503 - DNA, 18 bp, Homo sapiens
tcagggagaaactccaaa

SEQ ID NO: 5446504 - DNA, 13 bp, Homo sapiens
tcagggagagctg

SEQ ID NO: 5446505 - DNA, 14 bp, Homo sapiens
tcagggagaggtca

SEQ ID NO: 5446506 - DNA, 16 bp, Homo sapiens
tcagggagcaagaggt

SEQ ID NO: 5446507 - DNA, 21 bp, Homo sapiens
tcagggagcactggaggcctc

SEQ ID NO: 5446508 - DNA, 23 bp, Homo sapiens
tcagggagcactggaggcctctg

SEQ ID NO: 5446509 - DNA, 18 bp, Homo sapiens
tcagggagcctccccatc

SEQ ID NO: 5446510 - DNA, 22 bp, Homo sapiens
tcagggaggccctgtgcccctt

SEQ ID NO: 5446511 - DNA, 14 bp, Homo sapiens
tcagggagggaagg

SEQ ID NO: 5446512 - DNA, 16 bp, Homo sapiens
tcagggagggaagggg

SEQ ID NO: 5446513 - DNA, 20 bp, Homo sapiens
tcagggagggagggcggtgg

SEQ ID NO: 5446514 - DNA, 14 bp, Homo sapiens
tcagggaggggctg

SEQ ID NO: 5446515 - DNA, 21 bp, Homo sapiens
tcagggagggttagcctgcac

SEQ ID NO: 5446516 - DNA, 20 bp, Homo sapiens
tcagggaggtagtttcaaag

SEQ ID NO: 5446517 - DNA, 13 bp, Homo sapiens
tcagggagtgctg

SEQ ID NO: 5446518 - DNA, 20 bp, Homo sapiens
tcagggatcacactgccgtc

SEQ ID NO: 5446519 - DNA, 14 bp, Homo sapiens
tcagggatctcaga

SEQ ID NO: 5446520 - DNA, 19 bp, Homo sapiens
tcagggatcttctccctcc

SEQ ID NO: 5446521 - DNA, 17 bp, Homo sapiens
tcagggatgagttgagg

SEQ ID NO: 5446522 - DNA, 16 bp, Homo sapiens
tcagggcaaagccagg

SEQ ID NO: 5446523 - DNA, 22 bp, Homo sapiens
tcagggcaaagccaggtccctc

SEQ ID NO: 5446524 - DNA, 19 bp, Homo sapiens
tcagggcacagctgccctg

SEQ ID NO: 5446525 - DNA, 22 bp, Homo sapiens
tcagggcacagctgccctgctg

SEQ ID NO: 5446526 - DNA, 18 bp, Homo sapiens
tcagggcacgcaggacca

SEQ ID NO: 5446527 - DNA, 18 bp, Homo sapiens
tcagggcagacagccctc

SEQ ID NO: 5446528 - DNA, 18 bp, Homo sapiens
tcagggcagattttagtt

SEQ ID NO: 5446529 - DNA, 15 bp, Homo sapiens
tcagggcagcctgcc

SEQ ID NO: 5446530 - DNA, 18 bp, Homo sapiens
tcagggcagcctgcctgg

SEQ ID NO: 5446531 - DNA, 19 bp, Homo sapiens
tcagggcagctgcctggcc

SEQ ID NO: 5446532 - DNA, 13 bp, Homo sapiens
tcagggcagggct

SEQ ID NO: 5446533 - DNA, 14 bp, Homo sapiens
tcagggcaggtggg

SEQ ID NO: 5446534 - DNA, 18 bp, Homo sapiens
tcagggcatcggcagctg

SEQ ID NO: 5446535 - DNA, 22 bp, Homo sapiens
tcagggcatcggcagctgaacc

SEQ ID NO: 5446536 - DNA, 23 bp, Homo sapiens
tcagggcatgcttattagcagct

SEQ ID NO: 5446537 - DNA, 18 bp, Homo sapiens
tcagggcattgcctgtga

SEQ ID NO: 5446538 - DNA, 14 bp, Homo sapiens
tcagggccaagccg

SEQ ID NO: 5446539 - DNA, 17 bp, Homo sapiens
tcagggccaagccggcc

SEQ ID NO: 5446540 - DNA, 22 bp, Homo sapiens
tcagggccaagccggcccaacc

SEQ ID NO: 5446541 - DNA, 19 bp, Homo sapiens
tcagggccagaaggagggc

SEQ ID NO: 5446542 - DNA, 23 bp, Homo sapiens
tcagggccagaaggagggcagag

SEQ ID NO: 5446543 - DNA, 16 bp, Homo sapiens
tcagggccaggaagga

SEQ ID NO: 5446544 - DNA, 19 bp, Homo sapiens
tcagggccaggcccaggcc

SEQ ID NO: 5446545 - DNA, 17 bp, Homo sapiens
tcagggccaggcctctc

SEQ ID NO: 5446546 - DNA, 20 bp, Homo sapiens
tcagggccaggtgcagacct

SEQ ID NO: 5446547 - DNA, 13 bp, Homo sapiens
tcagggccatgct

SEQ ID NO: 5446548 - DNA, 12 bp, Homo sapiens
tcagggcccaga

SEQ ID NO: 5446549 - DNA, 18 bp, Homo sapiens
tcagggcccagaggctga

SEQ ID NO: 5446550 - DNA, 14 bp, Homo sapiens
tcagggccccagca

SEQ ID NO: 5446551 - DNA, 12 bp, Homo sapiens
tcagggccctgc

SEQ ID NO: 5446552 - DNA, 13 bp, Homo sapiens
tcagggccctgcc

SEQ ID NO: 5446553 - DNA, 14 bp, Homo sapiens
tcagggccctgccc

SEQ ID NO: 5446554 - DNA, 14 bp, Homo sapiens
tcagggcctgcccc

SEQ ID NO: 5446555 - DNA, 15 bp, Homo sapiens
tcagggcctgccccc

SEQ ID NO: 5446556 - DNA, 19 bp, Homo sapiens
tcagggcctggcaggccag

SEQ ID NO: 5446557 - DNA, 22 bp, Homo sapiens
tcagggcctggcaggccagtgt

SEQ ID NO: 5446558 - DNA, 19 bp, Homo sapiens
tcagggcctttctcctccc

SEQ ID NO: 5446559 - DNA, 14 bp, Homo sapiens
tcagggcgctcaga

SEQ ID NO: 5446560 - DNA, 15 bp, Homo sapiens
tcagggcgctcagac

SEQ ID NO: 5446561 - DNA, 16 bp, Homo sapiens
tcagggcgctcagacg

SEQ ID NO: 5446562 - DNA, 16 bp, Homo sapiens
tcagggcggcctccca

SEQ ID NO: 5446563 - DNA, 20 bp, Homo sapiens
tcagggcggcctcccaggtc

SEQ ID NO: 5446564 - DNA, 20 bp, Homo sapiens
tcagggctcagtcttttgag

SEQ ID NO: 5446565 - DNA, 14 bp, Homo sapiens
tcagggctcccagg

SEQ ID NO: 5446566 - DNA, 15 bp, Homo sapiens
tcagggctcctccca

SEQ ID NO: 5446567 - DNA, 17 bp, Homo sapiens
tcagggctcctcccagc

SEQ ID NO: 5446568 - DNA, 21 bp, Homo sapiens
tcagggctcctgccttctgtc

SEQ ID NO: 5446569 - DNA, 12 bp, Homo sapiens
tcagggctgaca

SEQ ID NO: 5446570 - DNA, 14 bp, Homo sapiens
tcagggctggcccg

SEQ ID NO: 5446571 - DNA, 13 bp, Homo sapiens
tcagggctgggca

SEQ ID NO: 5446572 - DNA, 19 bp, Homo sapiens
tcagggctgggcaggtcct

SEQ ID NO: 5446573 - DNA, 13 bp, Homo sapiens
tcagggctgtccc

SEQ ID NO: 5446574 - DNA, 17 bp, Homo sapiens
tcagggctgtcccagcc

SEQ ID NO: 5446575 - DNA, 16 bp, Homo sapiens
tcagggcttctagttt

SEQ ID NO: 5446576 - DNA, 18 bp, Homo sapiens
tcagggcttctcctctgc

SEQ ID NO: 5446577 - DNA, 23 bp, Homo sapiens
tcagggcttctcctctgctaggc

SEQ ID NO: 5446578 - DNA, 14 bp, Homo sapiens
tcaggggaagggca

SEQ ID NO: 5446579 - DNA, 15 bp, Homo sapiens
tcaggggacactggc

SEQ ID NO: 5446580 - DNA, 18 bp, Homo sapiens
tcaggggacactggcccc

SEQ ID NO: 5446581 - DNA, 20 bp, Homo sapiens
tcaggggacactggccccac

SEQ ID NO: 5446582 - DNA, 18 bp, Homo sapiens
tcaggggaccccactccc

SEQ ID NO: 5446583 - DNA, 20 bp, Homo sapiens
tcaggggactgttctcacct

SEQ ID NO: 5446584 - DNA, 18 bp, Homo sapiens
tcaggggagacttaggcc

SEQ ID NO: 5446585 - DNA, 16 bp, Homo sapiens
tcaggggagtcccgtc

SEQ ID NO: 5446586 - DNA, 15 bp, Homo sapiens
tcaggggatgggtgt

SEQ ID NO: 5446587 - DNA, 21 bp, Homo sapiens
tcaggggatgtacatctctcc

SEQ ID NO: 5446588 - DNA, 14 bp, Homo sapiens
tcaggggatgttta

SEQ ID NO: 5446589 - DNA, 15 bp, Homo sapiens
tcaggggatgtttac

SEQ ID NO: 5446590 - DNA, 13 bp, Homo sapiens
tcaggggcacctc

SEQ ID NO: 5446591 - DNA, 19 bp, Homo sapiens
tcagtgaagtctagaatca

SEQ ID NO: 5446592 - DNA, 17 bp, Homo sapiens
tcagtgaagttgctgct

SEQ ID NO: 5446593 - DNA, 20 bp, Homo sapiens
tcagtgaagttgctgcttct

SEQ ID NO: 5446594 - DNA, 18 bp, Homo sapiens
tcagtgaatataaatgta

SEQ ID NO: 5446595 - DNA, 16 bp, Homo sapiens
tcagtgaatatttttg

SEQ ID NO: 5446596 - DNA, 19 bp, Homo sapiens
tcagtgaatatttttgtat

SEQ ID NO: 5446597 - DNA, 20 bp, Homo sapiens
tcagtgacaaaatgggagga

SEQ ID NO: 5446598 - DNA, 19 bp, Homo sapiens
tcagtgacagagttcacta

SEQ ID NO: 5446599 - DNA, 22 bp, Homo sapiens
tcagtgacagcgaaggaagtta

SEQ ID NO: 5446600 - DNA, 21 bp, Homo sapiens
tcagtgacatcaaagcctggc

SEQ ID NO: 5446601 - DNA, 13 bp, Homo sapiens
tcagtgacatgtc

SEQ ID NO: 5446602 - DNA, 18 bp, Homo sapiens
tcagtgaccctggctcct

SEQ ID NO: 5446603 - DNA, 17 bp, Homo sapiens
tcagtgactcatgctgg

SEQ ID NO: 5446604 - DNA, 19 bp, Homo sapiens
tcagtgactgaaaccattt

SEQ ID NO: 5446605 - DNA, 15 bp, Homo sapiens
tcagtgactgttgta

SEQ ID NO: 5446606 - DNA, 21 bp, Homo sapiens
tcagtgactgttgtagcattt

SEQ ID NO: 5446607 - DNA, 17 bp, Homo sapiens
tcagtgacttctggctt

SEQ ID NO: 5446608 - DNA, 16 bp, Homo sapiens
tcagtgagcccctccc

SEQ ID NO: 5446609 - DNA, 19 bp, Homo sapiens
tcagtgagcccctccccag

SEQ ID NO: 5446610 - DNA, 20 bp, Homo sapiens
tcagtgagcccctccccagc

SEQ ID NO: 5446611 - DNA, 16 bp, Homo sapiens
tcagtgagcctcctgt

SEQ ID NO: 5446612 - DNA, 20 bp, Homo sapiens
tcagtgagcctcctgtgcct

SEQ ID NO: 5446613 - DNA, 22 bp, Homo sapiens
tcagtgaggagggatgtgggta

SEQ ID NO: 5446614 - DNA, 24 bp, Homo sapiens
tcagtgaggagggatgtgggtaag

SEQ ID NO: 5446615 - DNA, 14 bp, Homo sapiens
tcagtgaggcccag

SEQ ID NO: 5446616 - DNA, 17 bp, Homo sapiens
tcagtgaggcccaggga

SEQ ID NO: 5446617 - DNA, 18 bp, Homo sapiens
tcagtgaggcccagggag

SEQ ID NO: 5446618 - DNA, 16 bp, Homo sapiens
tcagtgagtaaataga

SEQ ID NO: 5446619 - DNA, 19 bp, Homo sapiens
tcagtgatatctttctcat

SEQ ID NO: 5446620 - DNA, 14 bp, Homo sapiens
tcagtgatctatgt

SEQ ID NO: 5446621 - DNA, 21 bp, Homo sapiens
tcagtgatctatgtttgtgtg

SEQ ID NO: 5446622 - DNA, 14 bp, Homo sapiens
tcagtgatcttcac

SEQ ID NO: 5446623 - DNA, 23 bp, Homo sapiens
tcagtgatgccctcagagctctt

SEQ ID NO: 5446624 - DNA, 15 bp, Homo sapiens
tcagtgatggaatat

SEQ ID NO: 5446625 - DNA, 17 bp, Homo sapiens
tcagtgatggcaacact

SEQ ID NO: 5446626 - DNA, 20 bp, Homo sapiens
tcagtgatggcaacactgaa

SEQ ID NO: 5446627 - DNA, 15 bp, Homo sapiens
tcagtgcaaaatgtc

SEQ ID NO: 5446628 - DNA, 18 bp, Homo sapiens
tcagtgcaaaatgtcttg

SEQ ID NO: 5446629 - DNA, 19 bp, Homo sapiens
tcagtgcaaaatgtcttgt

SEQ ID NO: 5446630 - DNA, 22 bp, Homo sapiens
tcagtgcaaaatgtcttgtgta

SEQ ID NO: 5446631 - DNA, 21 bp, Homo sapiens
tcagtgcaagagactttgtca

SEQ ID NO: 5446632 - DNA, 14 bp, Homo sapiens
tcagtgcacctgcc

SEQ ID NO: 5446633 - DNA, 20 bp, Homo sapiens
tcagtgcacctgtggcctct

SEQ ID NO: 5446634 - DNA, 17 bp, Homo sapiens
tcagtgcagcagaggac

SEQ ID NO: 5446635 - DNA, 17 bp, Homo sapiens
tcagtgcagcatataca

SEQ ID NO: 5446636 - DNA, 20 bp, Homo sapiens
tcagtgcagccccctcctga

SEQ ID NO: 5446637 - DNA, 18 bp, Homo sapiens
tcagtgcagggacagcct

SEQ ID NO: 5446638 - DNA, 16 bp, Homo sapiens
tcagtgcagtaatttc

SEQ ID NO: 5446639 - DNA, 23 bp, Homo sapiens
tcagtgcatccccacgacccctg

SEQ ID NO: 5446640 - DNA, 15 bp, Homo sapiens
tcagtgcattttcaa

SEQ ID NO: 5446641 - DNA, 17 bp, Homo sapiens
tcagtgcattttcaaca

SEQ ID NO: 5446642 - DNA, 16 bp, Homo sapiens
tcagtgccaaaaacaa

SEQ ID NO: 5446643 - DNA, 12 bp, Homo sapiens
tcagtgccaaag

SEQ ID NO: 5446644 - DNA, 18 bp, Homo sapiens
tcagtgccaactgtggct

SEQ ID NO: 5446645 - DNA, 23 bp, Homo sapiens
tcagtgccacctatgcctgtggt

SEQ ID NO: 5446646 - DNA, 12 bp, Homo sapiens
tcagtgccacta

SEQ ID NO: 5446647 - DNA, 18 bp, Homo sapiens
tcagtgccatttgttaaa

SEQ ID NO: 5446648 - DNA, 16 bp, Homo sapiens
tcagtgcccaactgtt

SEQ ID NO: 5446649 - DNA, 17 bp, Homo sapiens
tcagtgcccatgtgtat

SEQ ID NO: 5446650 - DNA, 19 bp, Homo sapiens
tcagtgcccatgtgtatgg

SEQ ID NO: 5446651 - DNA, 15 bp, Homo sapiens
tcagtgccctccagc

SEQ ID NO: 5446652 - DNA, 14 bp, Homo sapiens
tcagtgccgccgcc

SEQ ID NO: 5446653 - DNA, 9 bp, Homo sapiens
tcagtgcct

SEQ ID NO: 5446654 - DNA, 12 bp, Homo sapiens
tcagtgcctcct

SEQ ID NO: 5446655 - DNA, 13 bp, Homo sapiens
tcagtgcctcctg

SEQ ID NO: 5446656 - DNA, 11 bp, Homo sapiens
tcagtgcctgc

SEQ ID NO: 5446657 - DNA, 14 bp, Homo sapiens
tcagtgcctgctgt

SEQ ID NO: 5446658 - DNA, 22 bp, Homo sapiens
tcagtgcctggtgttctgaagt

SEQ ID NO: 5446659 - DNA, 10 bp, Homo sapiens
tcagtgcctt

SEQ ID NO: 5446660 - DNA, 18 bp, Homo sapiens
tcagtgccttatggaaca

SEQ ID NO: 5446661 - DNA, 19 bp, Homo sapiens
tcagtgccttatggaacac

SEQ ID NO: 5446662 - DNA, 20 bp, Homo sapiens
tcagtgccttatggaacact

SEQ ID NO: 5446663 - DNA, 22 bp, Homo sapiens
tcagtgccttatggaacactct

SEQ ID NO: 5446664 - DNA, 13 bp, Homo sapiens
tcagtgccttctc

SEQ ID NO: 5446665 - DNA, 21 bp, Homo sapiens
tcagtgccttctctcagctcc

SEQ ID NO: 5446666 - DNA, 14 bp, Homo sapiens
tcagtgccttttgg

SEQ ID NO: 5446667 - DNA, 17 bp, Homo sapiens
tcagtgctagcttattt

SEQ ID NO: 5446668 - DNA, 21 bp, Homo sapiens
tcagtgctataaatgccagag

SEQ ID NO: 5446669 - DNA, 12 bp, Homo sapiens
tcagtgctccct

SEQ ID NO: 5446670 - DNA, 13 bp, Homo sapiens
tcagtgctcctgg

SEQ ID NO: 5446671 - DNA, 18 bp, Homo sapiens
tcagtgctcgagacacag

SEQ ID NO: 5446672 - DNA, 13 bp, Homo sapiens
tcagtgctctcag

SEQ ID NO: 5446673 - DNA, 19 bp, Homo sapiens
tcagtgctgcctgtcccca

SEQ ID NO: 5446674 - DNA, 19 bp, Homo sapiens
tcagtgctgctgaactaat

SEQ ID NO: 5446675 - DNA, 16 bp, Homo sapiens
tcagtgctggagaaat

SEQ ID NO: 5446676 - DNA, 22 bp, Homo sapiens
tcagtgctggagaaatcttgaa

SEQ ID NO: 5446677 - DNA, 14 bp, Homo sapiens
tcagtgctgtgctg

SEQ ID NO: 5446678 - DNA, 22 bp, Homo sapiens
tcagtgctgtgctgtgctatgg

SEQ ID NO: 5446679 - DNA, 15 bp, Homo sapiens
tcagtgctgtggcct

SEQ ID NO: 5446680 - DNA, 17 bp, Homo sapiens
tcagtgctgtggcctgg

SEQ ID NO: 5446681 - DNA, 12 bp, Homo sapiens
tcagtgcttctt

SEQ ID NO: 5446682 - DNA, 19 bp, Homo sapiens
tcagtggaaaccctgagag

SEQ ID NO: 5446683 - DNA, 18 bp, Homo sapiens
tcagtggaacacaaatga

SEQ ID NO: 5446684 - DNA, 19 bp, Homo sapiens
tcagtggaacacaaatgaa

SEQ ID NO: 5446685 - DNA, 23 bp, Homo sapiens
tcagtggaactcaatatatagtt

SEQ ID NO: 5446686 - DNA, 21 bp, Homo sapiens
tcagtggaagaagcagatgag

SEQ ID NO: 5446687 - DNA, 19 bp, Homo sapiens
tcagtggaatagatgtctc

SEQ ID NO: 5446688 - DNA, 20 bp, Homo sapiens
tcagtggaatagatgtctca

SEQ ID NO: 5446689 - DNA, 20 bp, Homo sapiens
tcagtggacactcagaccag

SEQ ID NO: 5446690 - DNA, 16 bp, Homo sapiens
tcagtggacagtgctg

SEQ ID NO: 5446691 - DNA, 19 bp, Homo sapiens
tcagtggacagtgctgttg

SEQ ID NO: 5446692 - DNA, 16 bp, Homo sapiens
tcagtggacatttgtt

SEQ ID NO: 5446693 - DNA, 19 bp, Homo sapiens
tcagtggaccctgtggcca

SEQ ID NO: 5446694 - DNA, 20 bp, Homo sapiens
tcagtggaccctgtggccag

SEQ ID NO: 5446695 - DNA, 12 bp, Homo sapiens
tcagtggagcct

SEQ ID NO: 5446696 - DNA, 16 bp, Homo sapiens
tcagtggaggctggca

SEQ ID NO: 5446697 - DNA, 16 bp, Homo sapiens
tcagtggcaagaatga

SEQ ID NO: 5446698 - DNA, 15 bp, Homo sapiens
tcagtggcagcatcc

SEQ ID NO: 5446699 - DNA, 12 bp, Homo sapiens
tcagtggcagct

SEQ ID NO: 5446700 - DNA, 16 bp, Homo sapiens
tcagtggcagctgctt

SEQ ID NO: 5446701 - DNA, 15 bp, Homo sapiens
tcagtggcagggctc

SEQ ID NO: 5446702 - DNA, 19 bp, Homo sapiens
tcagtggcagggctcagga

SEQ ID NO: 5446703 - DNA, 20 bp, Homo sapiens
tcagtggcatggctccagtc

SEQ ID NO: 5446704 - DNA, 15 bp, Homo sapiens
tcagtggccaggtgc

SEQ ID NO: 5446705 - DNA, 17 bp, Homo sapiens
tcagtggcttcatctgt

SEQ ID NO: 5446706 - DNA, 20 bp, Homo sapiens
tcagtggcttcatctgtcaa

SEQ ID NO: 5446707 - DNA, 12 bp, Homo sapiens
tcagtggcttcc

SEQ ID NO: 5446708 - DNA, 15 bp, Homo sapiens
tcagtggctttgcat

SEQ ID NO: 5446709 - DNA, 19 bp, Homo sapiens
tcagtgggaacgtgactgc

SEQ ID NO: 5446710 - DNA, 20 bp, Homo sapiens
tcagtgggacaaaccagagc

SEQ ID NO: 5446711 - DNA, 23 bp, Homo sapiens
tcagtgggacaaaccagagcaga

SEQ ID NO: 5446712 - DNA, 23 bp, Homo sapiens
tcagtgggacatagccagcattt

SEQ ID NO: 5446713 - DNA, 19 bp, Homo sapiens
tcagtgggactcggtgagc

SEQ ID NO: 5446714 - DNA, 13 bp, Homo sapiens
tcagtgggagaaa

SEQ ID NO: 5446715 - DNA, 14 bp, Homo sapiens
tcagtgggagaaaa

SEQ ID NO: 5446716 - DNA, 15 bp, Homo sapiens
tcagtgggctccctg

SEQ ID NO: 5446717 - DNA, 22 bp, Homo sapiens
tcagtgggctccctggcccagc

SEQ ID NO: 5446718 - DNA, 17 bp, Homo sapiens
tcagtggggcagcctct

SEQ ID NO: 5446719 - DNA, 14 bp, Homo sapiens
tcagtggggcccca

SEQ ID NO: 5446720 - DNA, 23 bp, Homo sapiens
tcagtggggccccaaagcccagc

SEQ ID NO: 5446721 - DNA, 17 bp, Homo sapiens
tcagtggggctctctga

SEQ ID NO: 5446722 - DNA, 20 bp, Homo sapiens
tcagtggggctggcatcaag

SEQ ID NO: 5446723 - DNA, 17 bp, Homo sapiens
tcagtgggttaacatca

SEQ ID NO: 5446724 - DNA, 17 bp, Homo sapiens
tcagtggtagctctggc

SEQ ID NO: 5446725 - DNA, 21 bp, Homo sapiens
tcagtggtccacatcccggga

SEQ ID NO: 5446726 - DNA, 14 bp, Homo sapiens
tcagtggtgggaga

SEQ ID NO: 5446727 - DNA, 19 bp, Homo sapiens
tcagtggtgttacattttc

SEQ ID NO: 5446728 - DNA, 21 bp, Homo sapiens
tcagtggtttccctgcccgag

SEQ ID NO: 5446729 - DNA, 20 bp, Homo sapiens
tcagtggtttctacttcccc

SEQ ID NO: 5446730 - DNA, 21 bp, Homo sapiens
tcagtggtttctacttcccct

SEQ ID NO: 5446731 - DNA, 16 bp, Homo sapiens
tcagtgtaaaaaggaa

SEQ ID NO: 5446732 - DNA, 23 bp, Homo sapiens
tcagtgtaaatagttactccagt

SEQ ID NO: 5446733 - DNA, 16 bp, Homo sapiens
tcagtgtaatgtgact

SEQ ID NO: 5446734 - DNA, 15 bp, Homo sapiens
tcagtgtaatttctt

SEQ ID NO: 5446735 - DNA, 18 bp, Homo sapiens
tcagtgtaatttctttgc

SEQ ID NO: 5446736 - DNA, 18 bp, Homo sapiens
tcagtgtacactctgagt

SEQ ID NO: 5446737 - DNA, 15 bp, Homo sapiens
tcagtgtagccccaa

SEQ ID NO: 5446738 - DNA, 14 bp, Homo sapiens
tcagtgtagttaat

SEQ ID NO: 5446739 - DNA, 15 bp, Homo sapiens
tcagtgtagttaatt

SEQ ID NO: 5446740 - DNA, 17 bp, Homo sapiens
tcagtgtagttaattta

SEQ ID NO: 5446741 - DNA, 18 bp, Homo sapiens
tcagtgtagttaatttat

SEQ ID NO: 5446742 - DNA, 21 bp, Homo sapiens
tcagtgtatggaaataaatgt

SEQ ID NO: 5446743 - DNA, 13 bp, Homo sapiens
tcagtgtattgtt

SEQ ID NO: 5446744 - DNA, 17 bp, Homo sapiens
tcagtgtatttcagttc

SEQ ID NO: 5446745 - DNA, 15 bp, Homo sapiens
tcagtgtatttgtat

SEQ ID NO: 5446746 - DNA, 21 bp, Homo sapiens
tcagtgtcaaataaacactgt

SEQ ID NO: 5446747 - DNA, 16 bp, Homo sapiens
tcagtgtcattttctg

SEQ ID NO: 5446748 - DNA, 19 bp, Homo sapiens
tcagtgtcattttctgtta

SEQ ID NO: 5446749 - DNA, 16 bp, Homo sapiens
tcagtgtcccaggcag

SEQ ID NO: 5446750 - DNA, 19 bp, Homo sapiens
tcagtgtcctcttgctcaa

SEQ ID NO: 5446751 - DNA, 13 bp, Homo sapiens
tcagtgtctcaca

SEQ ID NO: 5446752 - DNA, 14 bp, Homo sapiens
tcagtgtctggctt

SEQ ID NO: 5446753 - DNA, 15 bp, Homo sapiens
tcagtgtctggcttt

SEQ ID NO: 5446754 - DNA, 15 bp, Homo sapiens
tcagtgtgaagcctg

SEQ ID NO: 5446755 - DNA, 18 bp, Homo sapiens
tcagtgtgactgatctct

SEQ ID NO: 5446756 - DNA, 19 bp, Homo sapiens
tcagtgtgataaggacttt

SEQ ID NO: 5446757 - DNA, 12 bp, Homo sapiens
tcagtgtgcata

SEQ ID NO: 5446758 - DNA, 20 bp, Homo sapiens
tcagtgtgccaccctctgca

SEQ ID NO: 5446759 - DNA, 23 bp, Homo sapiens
tcagtgtgccaccctctgcaggg

SEQ ID NO: 5446760 - DNA, 13 bp, Homo sapiens
tcagtgtgccccc

SEQ ID NO: 5446761 - DNA, 20 bp, Homo sapiens
tcagtgtgccccccatcctg

SEQ ID NO: 5446762 - DNA, 14 bp, Homo sapiens
tcagtgtgcccttc

SEQ ID NO: 5446763 - DNA, 13 bp, Homo sapiens
tcagtgtggaaaa

SEQ ID NO: 5446764 - DNA, 17 bp, Homo sapiens
tcagtgtggagaggggt

SEQ ID NO: 5446765 - DNA, 23 bp, Homo sapiens
tcagtgtggagaggggtgcaccc

SEQ ID NO: 5446766 - DNA, 11 bp, Homo sapiens
tcagtgtgtaa

SEQ ID NO: 5446767 - DNA, 16 bp, Homo sapiens
tcagtgtgtcagtttt

SEQ ID NO: 5446768 - DNA, 23 bp, Homo sapiens
tcagtgtgtgtgtgtggtccatg

SEQ ID NO: 5446769 - DNA, 14 bp, Homo sapiens
tcatagcccagtag

SEQ ID NO: 5446770 - DNA, 21 bp, Homo sapiens
tcatagccctcaccctggggc

SEQ ID NO: 5446771 - DNA, 18 bp, Homo sapiens
tcatagccctcagacatt

SEQ ID NO: 5446772 - DNA, 12 bp, Homo sapiens
tcatagctaaga

SEQ ID NO: 5446773 - DNA, 16 bp, Homo sapiens
tcatagctaagaaata

SEQ ID NO: 5446774 - DNA, 14 bp, Homo sapiens
tcatagctcactgc

SEQ ID NO: 5446775 - DNA, 18 bp, Homo sapiens
tcatagctcactgcagcc

SEQ ID NO: 5446776 - DNA, 21 bp, Homo sapiens
tcatagctcactgcagcctca

SEQ ID NO: 5446777 - DNA, 17 bp, Homo sapiens
tcatagctgagattcct

SEQ ID NO: 5446778 - DNA, 14 bp, Homo sapiens
tcatagcttgtttt

SEQ ID NO: 5446779 - DNA, 21 bp, Homo sapiens
tcataggaagtggctggtctg

SEQ ID NO: 5446780 - DNA, 13 bp, Homo sapiens
tcataggagactg

SEQ ID NO: 5446781 - DNA, 15 bp, Homo sapiens
tcataggagactgcg

SEQ ID NO: 5446782 - DNA, 22 bp, Homo sapiens
tcataggcaccttttactgtga

SEQ ID NO: 5446783 - DNA, 15 bp, Homo sapiens
tcataggcagagccc

SEQ ID NO: 5446784 - DNA, 22 bp, Homo sapiens
tcataggcggtcatgtgtgcat

SEQ ID NO: 5446785 - DNA, 13 bp, Homo sapiens
tcataggctgaca

SEQ ID NO: 5446786 - DNA, 19 bp, Homo sapiens
tcatagggacctttaaaaa

SEQ ID NO: 5446787 - DNA, 22 bp, Homo sapiens
tcatagggacctttaaaaagca

SEQ ID NO: 5446788 - DNA, 13 bp, Homo sapiens
tcataggggcagg

SEQ ID NO: 5446789 - DNA, 20 bp, Homo sapiens
tcatagggtctcttcaggtt

SEQ ID NO: 5446790 - DNA, 16 bp, Homo sapiens
tcataggtatttcaaa

SEQ ID NO: 5446791 - DNA, 14 bp, Homo sapiens
tcataggttaaaaa

SEQ ID NO: 5446792 - DNA, 17 bp, Homo sapiens
tcataggttgagcaatt

SEQ ID NO: 5446793 - DNA, 15 bp, Homo sapiens
tcataggttttaaat

SEQ ID NO: 5446794 - DNA, 15 bp, Homo sapiens
tcatagtaacttctt

SEQ ID NO: 5446795 - DNA, 18 bp, Homo sapiens
tcatagtaacttcttatg

SEQ ID NO: 5446796 - DNA, 18 bp, Homo sapiens
tcatagtaagtgcgaaga

SEQ ID NO: 5446797 - DNA, 16 bp, Homo sapiens
tcatagtagtttttac

SEQ ID NO: 5446798 - DNA, 18 bp, Homo sapiens
tcatagtagtttttacag

SEQ ID NO: 5446799 - DNA, 20 bp, Homo sapiens
tcatagtatcttcactgtgt

SEQ ID NO: 5446800 - DNA, 19 bp, Homo sapiens
tcatagtatggtggctggg

SEQ ID NO: 5446801 - DNA, 16 bp, Homo sapiens
tcatagtattggagca

SEQ ID NO: 5446802 - DNA, 15 bp, Homo sapiens
tcatagtcaatcaaa

SEQ ID NO: 5446803 - DNA, 18 bp, Homo sapiens
tcatagtcaatcaaacag

SEQ ID NO: 5446804 - DNA, 17 bp, Homo sapiens
tcatagtcttgaaatga

SEQ ID NO: 5446805 - DNA, 15 bp, Homo sapiens
tcatagtgccttttt

SEQ ID NO: 5446806 - DNA, 20 bp, Homo sapiens
tcatagttactgtgtaaact

SEQ ID NO: 5446807 - DNA, 21 bp, Homo sapiens
tcatagttattgtttctggtc

SEQ ID NO: 5446808 - DNA, 18 bp, Homo sapiens
tcatagttcagaatttag

SEQ ID NO: 5446809 - DNA, 14 bp, Homo sapiens
tcatagttctgtta

SEQ ID NO: 5446810 - DNA, 16 bp, Homo sapiens
tcatagttctgttaaa

SEQ ID NO: 5446811 - DNA, 13 bp, Homo sapiens
tcatagttgcaaa

SEQ ID NO: 5446812 - DNA, 22 bp, Homo sapiens
tcatagtttattattattaaag

SEQ ID NO: 5446813 - DNA, 14 bp, Homo sapiens
tcatagtttcttgg

SEQ ID NO: 5446814 - DNA, 14 bp, Homo sapiens
tcatagttttctaa

SEQ ID NO: 5446815 - DNA, 15 bp, Homo sapiens
tcatataaaaagcag

SEQ ID NO: 5446816 - DNA, 13 bp, Homo sapiens
tcatataaaaggt

SEQ ID NO: 5446817 - DNA, 13 bp, Homo sapiens
tcatataaaattt

SEQ ID NO: 5446818 - DNA, 20 bp, Homo sapiens
tcatataaactttttaaaga

SEQ ID NO: 5446819 - DNA, 13 bp, Homo sapiens
tcatataaataga

SEQ ID NO: 5446820 - DNA, 21 bp, Homo sapiens
tcatataaatagaatgtaaat

SEQ ID NO: 5446821 - DNA, 22 bp, Homo sapiens
tcatataaatagaatgtaaatg

SEQ ID NO: 5446822 - DNA, 21 bp, Homo sapiens
tcatataactgagatgaatgt

SEQ ID NO: 5446823 - DNA, 17 bp, Homo sapiens
tcatataatttaaagaa

SEQ ID NO: 5446824 - DNA, 22 bp, Homo sapiens
tcatataatttaaagaaacact

SEQ ID NO: 5446825 - DNA, 23 bp, Homo sapiens
tcatataatttaaagaaacacta

SEQ ID NO: 5446826 - DNA, 13 bp, Homo sapiens
tcatatacaaaca

SEQ ID NO: 5446827 - DNA, 14 bp, Homo sapiens
tcatatacaaacat

SEQ ID NO: 5446828 - DNA, 15 bp, Homo sapiens
tcatatacaaacatg

SEQ ID NO: 5446829 - DNA, 14 bp, Homo sapiens
tcatatacgtgaaa

SEQ ID NO: 5446830 - DNA, 14 bp, Homo sapiens
tcatatactataat

SEQ ID NO: 5446831 - DNA, 15 bp, Homo sapiens
tcatatactataatt

SEQ ID NO: 5446832 - DNA, 13 bp, Homo sapiens
tcatatagaaagg

SEQ ID NO: 5446833 - DNA, 23 bp, Homo sapiens
tcatatataagactgctgcagtc

SEQ ID NO: 5446834 - DNA, 16 bp, Homo sapiens
tcatatatacatacat

SEQ ID NO: 5446835 - DNA, 14 bp, Homo sapiens
tcatatatactgta

SEQ ID NO: 5446836 - DNA, 17 bp, Homo sapiens
tcatatatatcacccag

SEQ ID NO: 5446837 - DNA, 22 bp, Homo sapiens
tcatatatatcacccagacata

SEQ ID NO: 5446838 - DNA, 14 bp, Homo sapiens
tcatatatatctat

SEQ ID NO: 5446839 - DNA, 20 bp, Homo sapiens
tcatatatattttaaaaaca

SEQ ID NO: 5446840 - DNA, 15 bp, Homo sapiens
tcatatatcataaag

SEQ ID NO: 5446841 - DNA, 17 bp, Homo sapiens
tcatatatcataaagga

SEQ ID NO: 5446842 - DNA, 13 bp, Homo sapiens
tcatatatgcttc

SEQ ID NO: 5446843 - DNA, 19 bp, Homo sapiens
tcatatatgcttttttgca

SEQ ID NO: 5446844 - DNA, 18 bp, Homo sapiens
tcatatatggggggccaa

SEQ ID NO: 5446845 - DNA, 15 bp, Homo sapiens
tcatatattaaaaca

SEQ ID NO: 5446846 - DNA, 17 bp, Homo sapiens
tcatatattaaaacaat

SEQ ID NO: 5446847 - DNA, 17 bp, Homo sapiens
tcatatattaaacatcc

SEQ ID NO: 5446848 - DNA, 15 bp, Homo sapiens
tcatatattcatgta

SEQ ID NO: 5446849 - DNA, 16 bp, Homo sapiens
tcatatattcatgtaa

SEQ ID NO: 5446850 - DNA, 22 bp, Homo sapiens
tcatatattcatgtaataaatc

SEQ ID NO: 5446851 - DNA, 16 bp, Homo sapiens
tcatatattgctttat

SEQ ID NO: 5446852 - DNA, 15 bp, Homo sapiens
tcatatatttaacaa

SEQ ID NO: 5446853 - DNA, 16 bp, Homo sapiens
tcatatcaaacattaa

SEQ ID NO: 5446854 - DNA, 16 bp, Homo sapiens
tcatatcaagaaattg

SEQ ID NO: 5446855 - DNA, 18 bp, Homo sapiens
tcatatcactaaataaac

SEQ ID NO: 5446856 - DNA, 14 bp, Homo sapiens
tcatatcactgaag

SEQ ID NO: 5446857 - DNA, 13 bp, Homo sapiens
tcatatcatttct

SEQ ID NO: 5446858 - DNA, 14 bp, Homo sapiens
tcatatcatttctt

SEQ ID NO: 5446859 - DNA, 21 bp, Homo sapiens
tcatatccataaaattggatt

SEQ ID NO: 5446860 - DNA, 22 bp, Homo sapiens
tcatatcccctgtgccctgcac

SEQ ID NO: 5446861 - DNA, 15 bp, Homo sapiens
tcatatcccgtgaaa

SEQ ID NO: 5446862 - DNA, 21 bp, Homo sapiens
tcatatcctctataattgact

SEQ ID NO: 5446863 - DNA, 22 bp, Homo sapiens
tcatatccttcttacacgacta

SEQ ID NO: 5446864 - DNA, 17 bp, Homo sapiens
tcatatcctttgcccca

SEQ ID NO: 5446865 - DNA, 18 bp, Homo sapiens
tcatatcctttgccccaa

SEQ ID NO: 5446866 - DNA, 16 bp, Homo sapiens
tcatatctaactttgt

SEQ ID NO: 5446867 - DNA, 18 bp, Homo sapiens
tcatatctaactttgtaa

SEQ ID NO: 5446868 - DNA, 22 bp, Homo sapiens
tcatatctatgggaaaaatcta

SEQ ID NO: 5446869 - DNA, 15 bp, Homo sapiens
tcatatctctccctt

SEQ ID NO: 5446870 - DNA, 16 bp, Homo sapiens
tcatatctctcccttc

SEQ ID NO: 5446871 - DNA, 20 bp, Homo sapiens
tcatatctcttgcccttcct

SEQ ID NO: 5446872 - DNA, 12 bp, Homo sapiens
tcatatctggtc

SEQ ID NO: 5446873 - DNA, 19 bp, Homo sapiens
tcatatcttctttgttttg

SEQ ID NO: 5446874 - DNA, 11 bp, Homo sapiens
tcatatgaaaa

SEQ ID NO: 5446875 - DNA, 18 bp, Homo sapiens
tcatatgaattagccaaa

SEQ ID NO: 5446876 - DNA, 19 bp, Homo sapiens
tcatatgacatgccaccct

SEQ ID NO: 5446877 - DNA, 22 bp, Homo sapiens
tcatatgaccattgaaaaagga

SEQ ID NO: 5446878 - DNA, 19 bp, Homo sapiens
tcatatgaggggacccagc

SEQ ID NO: 5446879 - DNA, 20 bp, Homo sapiens
tcatatgaggggacccagcg

SEQ ID NO: 5446880 - DNA, 21 bp, Homo sapiens
tcatatgagtatctttaaata

SEQ ID NO: 5446881 - DNA, 15 bp, Homo sapiens
tcatatgattctgct

SEQ ID NO: 5446882 - DNA, 20 bp, Homo sapiens
tcatatgcagaacgtattta

SEQ ID NO: 5446883 - DNA, 23 bp, Homo sapiens
tcatatgcagaacgtatttagcc

SEQ ID NO: 5446884 - DNA, 21 bp, Homo sapiens
tcatatggaaaaaatgtatgt

SEQ ID NO: 5446885 - DNA, 20 bp, Homo sapiens
tcatatgtacttgtttgcta

SEQ ID NO: 5446886 - DNA, 20 bp, Homo sapiens
tcatatgtagccttcacaca

SEQ ID NO: 5446887 - DNA, 22 bp, Homo sapiens
tcatatgtatctaaatgaaaag

SEQ ID NO: 5446888 - DNA, 15 bp, Homo sapiens
tcatatgtggaaata

SEQ ID NO: 5446889 - DNA, 18 bp, Homo sapiens
tcatatgttgctcagtct

SEQ ID NO: 5446890 - DNA, 21 bp, Homo sapiens
tcatatgtttattcaaaatat

SEQ ID NO: 5446891 - DNA, 14 bp, Homo sapiens
tcatattaaaaata

SEQ ID NO: 5446892 - DNA, 14 bp, Homo sapiens
tcatattaagaatg

SEQ ID NO: 5446893 - DNA, 21 bp, Homo sapiens
tcatattaagacagtgtacaa

SEQ ID NO: 5446894 - DNA, 21 bp, Homo sapiens
tcatattaatataagtttctt

SEQ ID NO: 5446895 - DNA, 21 bp, Homo sapiens
tcatattaattattttccaaa

SEQ ID NO: 5446896 - DNA, 19 bp, Homo sapiens
tcatattaccagaaaatga

SEQ ID NO: 5446897 - DNA, 14 bp, Homo sapiens
tcatattattttag

SEQ ID NO: 5446898 - DNA, 21 bp, Homo sapiens
tcatattattttagtgtgtaa

SEQ ID NO: 5446899 - DNA, 22 bp, Homo sapiens
tcatattattttagtgtgtaaa

SEQ ID NO: 5446900 - DNA, 21 bp, Homo sapiens
tcatattcaagcaacagcact

SEQ ID NO: 5446901 - DNA, 14 bp, Homo sapiens
tcatattcatgcaa

SEQ ID NO: 5446902 - DNA, 18 bp, Homo sapiens
tcatattctaaaaccatt

SEQ ID NO: 5446903 - DNA, 13 bp, Homo sapiens
tcatattctcaga

SEQ ID NO: 5446904 - DNA, 18 bp, Homo sapiens
tcatattctcatggcttt

SEQ ID NO: 5446905 - DNA, 21 bp, Homo sapiens
tcatattgatgaaaagattta

SEQ ID NO: 5446906 - DNA, 13 bp, Homo sapiens
tcatattgcttct

SEQ ID NO: 5446907 - DNA, 17 bp, Homo sapiens
tcatattgcttctccct

SEQ ID NO: 5446908 - DNA, 18 bp, Homo sapiens
tcatattggaaaaatcac

SEQ ID NO: 5446909 - DNA, 21 bp, Homo sapiens
tcatattggtatatccttttc

SEQ ID NO: 5446910 - DNA, 22 bp, Homo sapiens
tcatattggtatatccttttct

SEQ ID NO: 5446911 - DNA, 14 bp, Homo sapiens
tcatattgtgccaa

SEQ ID NO: 5446912 - DNA, 20 bp, Homo sapiens
tcatattgtgccaatatgta

SEQ ID NO: 5446913 - DNA, 22 bp, Homo sapiens
tcatattgtgccaatatgtatt

SEQ ID NO: 5446914 - DNA, 21 bp, Homo sapiens
tcatatttaaagccaaatgta

SEQ ID NO: 5446915 - DNA, 13 bp, Homo sapiens
tcatatttgaaaa

SEQ ID NO: 5446916 - DNA, 20 bp, Homo sapiens
tcatatttgaggagtgttaa

SEQ ID NO: 5446917 - DNA, 17 bp, Homo sapiens
tcatatttgcaataaaa

SEQ ID NO: 5446918 - DNA, 20 bp, Homo sapiens
tcatatttgcaataaaaaag

SEQ ID NO: 5446919 - DNA, 14 bp, Homo sapiens
tcatatttgcacta

SEQ ID NO: 5446920 - DNA, 19 bp, Homo sapiens
tcatatttgggggctaagg

SEQ ID NO: 5446921 - DNA, 21 bp, Homo sapiens
tcatatttggtgatgagactt

SEQ ID NO: 5446922 - DNA, 19 bp, Homo sapiens
tcatatttgtactttctgt

SEQ ID NO: 5446923 - DNA, 22 bp, Homo sapiens
tcatattttaaaattactaact

SEQ ID NO: 5446924 - DNA, 17 bp, Homo sapiens
tcatattttaatttcaa

SEQ ID NO: 5446925 - DNA, 12 bp, Homo sapiens
tcatattttata

SEQ ID NO: 5446926 - DNA, 24 bp, Homo sapiens
tcatattttcctttatgtgatgta

SEQ ID NO: 5446927 - DNA, 15 bp, Homo sapiens
tcatattttctttca

SEQ ID NO: 5446928 - DNA, 14 bp, Homo sapiens
tcatatttttcctt

SEQ ID NO: 5446929 - DNA, 16 bp, Homo sapiens
tcatcaaaaagaaaaa

SEQ ID NO: 5446930 - DNA, 13 bp, Homo sapiens
tcatcaaaaagag

SEQ ID NO: 5446931 - DNA, 19 bp, Homo sapiens
tcatcaaaaagccttattt

SEQ ID NO: 5446932 - DNA, 19 bp, Homo sapiens
tcatcaaaacctgcgcagt

SEQ ID NO: 5446933 - DNA, 22 bp, Homo sapiens
tcatcaaagtgtttaattgtat

SEQ ID NO: 5446934 - DNA, 13 bp, Homo sapiens
tcatcaacaatga

SEQ ID NO: 5446935 - DNA, 13 bp, Homo sapiens
tcatcaagaaata

SEQ ID NO: 5446936 - DNA, 11 bp, Homo sapiens
tcatcaagaag

SEQ ID NO: 5446937 - DNA, 16 bp, Homo sapiens
tcatcaagaagggctg

SEQ ID NO: 5446938 - DNA, 19 bp, Homo sapiens
tcatcaagactggaaggtg

SEQ ID NO: 5446939 - DNA, 19 bp, Homo sapiens
tcatcaagagaatttgggg

SEQ ID NO: 5446940 - DNA, 21 bp, Homo sapiens
tcatcaagagaatttggggct

SEQ ID NO: 5446941 - DNA, 13 bp, Homo sapiens
tcatcaagagttt

SEQ ID NO: 5446942 - DNA, 19 bp, Homo sapiens
tcatcaaggcactgcctga

SEQ ID NO: 5446943 - DNA, 21 bp, Homo sapiens
tcatcaatagtgtcctatgca

SEQ ID NO: 5446944 - DNA, 13 bp, Homo sapiens
tcatcaatcaaat

SEQ ID NO: 5446945 - DNA, 21 bp, Homo sapiens
tcatcaatcaaataagtattt

SEQ ID NO: 5446946 - DNA, 19 bp, Homo sapiens
tcatcaatgggattttcta

SEQ ID NO: 5446947 - DNA, 17 bp, Homo sapiens
tcatctgtagatactag

SEQ ID NO: 5446948 - DNA, 19 bp, Homo sapiens
tcatctgtagggccacccc

SEQ ID NO: 5446949 - DNA, 15 bp, Homo sapiens
tcatctgtcattata

SEQ ID NO: 5446950 - DNA, 21 bp, Homo sapiens
tcatctgtccatggcctttct

SEQ ID NO: 5446951 - DNA, 16 bp, Homo sapiens
tcatctgtggagctgc

SEQ ID NO: 5446952 - DNA, 22 bp, Homo sapiens
tcatctgtggagctgccacaga

SEQ ID NO: 5446953 - DNA, 14 bp, Homo sapiens
tcatctgtgtgaaa

SEQ ID NO: 5446954 - DNA, 19 bp, Homo sapiens
tcatctgttagggccttgg

SEQ ID NO: 5446955 - DNA, 20 bp, Homo sapiens
tcatctgttctatgcttcct

SEQ ID NO: 5446956 - DNA, 12 bp, Homo sapiens
tcatcttaaact

SEQ ID NO: 5446957 - DNA, 13 bp, Homo sapiens
tcatcttaaacta

SEQ ID NO: 5446958 - DNA, 13 bp, Homo sapiens
tcatcttaacttg

SEQ ID NO: 5446959 - DNA, 20 bp, Homo sapiens
tcatcttagctttccacagg

SEQ ID NO: 5446960 - DNA, 16 bp, Homo sapiens
tcatcttattcagcac

SEQ ID NO: 5446961 - DNA, 19 bp, Homo sapiens
tcatcttcaccagaggaat

SEQ ID NO: 5446962 - DNA, 13 bp, Homo sapiens
tcatcttcactgc

SEQ ID NO: 5446963 - DNA, 18 bp, Homo sapiens
tcatcttcagttgtctct

SEQ ID NO: 5446964 - DNA, 16 bp, Homo sapiens
tcatcttccctgcccc

SEQ ID NO: 5446965 - DNA, 19 bp, Homo sapiens
tcatcttcctgtgtcctga

SEQ ID NO: 5446966 - DNA, 13 bp, Homo sapiens
tcatcttctcagc

SEQ ID NO: 5446967 - DNA, 13 bp, Homo sapiens
tcatcttctccca

SEQ ID NO: 5446968 - DNA, 11 bp, Homo sapiens
tcatcttctct

SEQ ID NO: 5446969 - DNA, 15 bp, Homo sapiens
tcatcttctggaata

SEQ ID NO: 5446970 - DNA, 16 bp, Homo sapiens
tcatcttcttctttaa

SEQ ID NO: 5446971 - DNA, 18 bp, Homo sapiens
tcatcttgaatatttgct

SEQ ID NO: 5446972 - DNA, 19 bp, Homo sapiens
tcatcttgacagagcctgc

SEQ ID NO: 5446973 - DNA, 21 bp, Homo sapiens
tcatcttgacagagcctgccc

SEQ ID NO: 5446974 - DNA, 13 bp, Homo sapiens
tcatcttgacatg

SEQ ID NO: 5446975 - DNA, 21 bp, Homo sapiens
tcatcttgaccaagcaggaag

SEQ ID NO: 5446976 - DNA, 22 bp, Homo sapiens
tcatcttgaccaagcaggaagc

SEQ ID NO: 5446977 - DNA, 17 bp, Homo sapiens
tcatcttgcaagcaaat

SEQ ID NO: 5446978 - DNA, 17 bp, Homo sapiens
tcatcttgctaccagta

SEQ ID NO: 5446979 - DNA, 22 bp, Homo sapiens
tcatcttggaaaggggaggagc

SEQ ID NO: 5446980 - DNA, 17 bp, Homo sapiens
tcatcttggagcttttt

SEQ ID NO: 5446981 - DNA, 13 bp, Homo sapiens
tcatcttgtaaat

SEQ ID NO: 5446982 - DNA, 21 bp, Homo sapiens
tcatcttgtaaataatgctta

SEQ ID NO: 5446983 - DNA, 14 bp, Homo sapiens
tcatcttgtgaaat

SEQ ID NO: 5446984 - DNA, 15 bp, Homo sapiens
tcatcttgtgtttta

SEQ ID NO: 5446985 - DNA, 18 bp, Homo sapiens
tcatctttatcctaaaaa

SEQ ID NO: 5446986 - DNA, 14 bp, Homo sapiens
tcatctttcagaaa

SEQ ID NO: 5446987 - DNA, 17 bp, Homo sapiens
tcatctttccctccttg

SEQ ID NO: 5446988 - DNA, 12 bp, Homo sapiens
tcatctttcttc

SEQ ID NO: 5446989 - DNA, 13 bp, Homo sapiens
tcatctttgattt

SEQ ID NO: 5446990 - DNA, 16 bp, Homo sapiens
tcatctttgccaagta

SEQ ID NO: 5446991 - DNA, 11 bp, Homo sapiens
tcatctttgct

SEQ ID NO: 5446992 - DNA, 23 bp, Homo sapiens
tcatctttgttggctcagaaaat

SEQ ID NO: 5446993 - DNA, 16 bp, Homo sapiens
tcatcttttaaagaaa

SEQ ID NO: 5446994 - DNA, 20 bp, Homo sapiens
tcatcttttaatcatgagcc

SEQ ID NO: 5446995 - DNA, 20 bp, Homo sapiens
tcatcttttattttggaact

SEQ ID NO: 5446996 - DNA, 18 bp, Homo sapiens
tcatcttttcctgcttag

SEQ ID NO: 5446997 - DNA, 12 bp, Homo sapiens
tcatgaaaatac

SEQ ID NO: 5446998 - DNA, 15 bp, Homo sapiens
tcatgaaaatgacat

SEQ ID NO: 5446999 - DNA, 11 bp, Homo sapiens
tcatgaaaatt

SEQ ID NO: 5447000 - DNA, 17 bp, Homo sapiens
tcatgaaacttgtttca

SEQ ID NO: 5447001 - DNA, 20 bp, Homo sapiens
tcatgaaacttgtttcactg

SEQ ID NO: 5447002 - DNA, 13 bp, Homo sapiens
tcatgaaagattc

SEQ ID NO: 5447003 - DNA, 19 bp, Homo sapiens
tcatgaaagcacctgccct

SEQ ID NO: 5447004 - DNA, 22 bp, Homo sapiens
tcatgaaagtagacagttttga

SEQ ID NO: 5447005 - DNA, 14 bp, Homo sapiens
tcatgaaatatgca

SEQ ID NO: 5447006 - DNA, 15 bp, Homo sapiens
tcatgaaatgtggaa

SEQ ID NO: 5447007 - DNA, 15 bp, Homo sapiens
tcatgaaatgtgttt

SEQ ID NO: 5447008 - DNA, 18 bp, Homo sapiens
tcatgaacaaaatgaagt

SEQ ID NO: 5447009 - DNA, 16 bp, Homo sapiens
tcatgaacagctctga

SEQ ID NO: 5447010 - DNA, 11 bp, Homo sapiens
tcatgaacctc

SEQ ID NO: 5447011 - DNA, 14 bp, Homo sapiens
tcatgaactggctt

SEQ ID NO: 5447012 - DNA, 22 bp, Homo sapiens
tcatgaactggcttgtacattt

SEQ ID NO: 5447013 - DNA, 18 bp, Homo sapiens
tcatgaacttcgcatcaa

SEQ ID NO: 5447014 - DNA, 18 bp, Homo sapiens
tcatgaagaatgtttctg

SEQ ID NO: 5447015 - DNA, 13 bp, Homo sapiens
tcatgaagcccaa

SEQ ID NO: 5447016 - DNA, 13 bp, Homo sapiens
tcatgaagccttg

SEQ ID NO: 5447017 - DNA, 19 bp, Homo sapiens
tcatgaaggacactctgca

SEQ ID NO: 5447018 - DNA, 22 bp, Homo sapiens
tcatgaaggacactctgcaggg

SEQ ID NO: 5447019 - DNA, 15 bp, Homo sapiens
tcatgaatattttca

SEQ ID NO: 5447020 - DNA, 21 bp, Homo sapiens
tcatgaatattttcaagtttt

SEQ ID NO: 5447021 - DNA, 19 bp, Homo sapiens
tcatgaatctttcatacat

SEQ ID NO: 5447022 - DNA, 15 bp, Homo sapiens
tcatgaatgctttta

SEQ ID NO: 5447023 - DNA, 21 bp, Homo sapiens
tcatgaatgcttttagtgtgt

SEQ ID NO: 5447024 - DNA, 21 bp, Homo sapiens
tcatgaatgtaaatttgtact

SEQ ID NO: 5447025 - DNA, 17 bp, Homo sapiens
tcatgaattatataatt

SEQ ID NO: 5447026 - DNA, 19 bp, Homo sapiens
tcatgaattatataatttt

SEQ ID NO: 5447027 - DNA, 21 bp, Homo sapiens
tcatgaattcatactctgttg

SEQ ID NO: 5447028 - DNA, 22 bp, Homo sapiens
tcatgaattcatactctgttgc

SEQ ID NO: 5447029 - DNA, 18 bp, Homo sapiens
tcatgaattttaaagtat

SEQ ID NO: 5447030 - DNA, 13 bp, Homo sapiens
tcatgaattttac

SEQ ID NO: 5447031 - DNA, 24 bp, Homo sapiens
tcatgacaacactacacgcaccca

SEQ ID NO: 5447032 - DNA, 19 bp, Homo sapiens
tcatgacaagatgggacag

SEQ ID NO: 5447033 - DNA, 17 bp, Homo sapiens
tcatgacagaatataca

SEQ ID NO: 5447034 - DNA, 13 bp, Homo sapiens
tcatgacagccag

SEQ ID NO: 5447035 - DNA, 15 bp, Homo sapiens
tcatgacagccagag

SEQ ID NO: 5447036 - DNA, 23 bp, Homo sapiens
tcatgacagtgcttgcatcctat

SEQ ID NO: 5447037 - DNA, 16 bp, Homo sapiens
tcatgacataataaag

SEQ ID NO: 5447038 - DNA, 14 bp, Homo sapiens
tcatgacatgttat

SEQ ID NO: 5447039 - DNA, 14 bp, Homo sapiens
tcatgacattatgt

SEQ ID NO: 5447040 - DNA, 18 bp, Homo sapiens
tcatgaccaatcctatgt

SEQ ID NO: 5447041 - DNA, 13 bp, Homo sapiens
tcatgaccactgg

SEQ ID NO: 5447042 - DNA, 18 bp, Homo sapiens
tcatgaccactgggcctg

SEQ ID NO: 5447043 - DNA, 19 bp, Homo sapiens
tcatgaccactgggcctgc

SEQ ID NO: 5447044 - DNA, 15 bp, Homo sapiens
tcatgaccagtaaag

SEQ ID NO: 5447045 - DNA, 20 bp, Homo sapiens
tcatgacccctcgtccaccc

SEQ ID NO: 5447046 - DNA, 18 bp, Homo sapiens
tcatgaccctcctgtcca

SEQ ID NO: 5447047 - DNA, 13 bp, Homo sapiens
tcatgaccttaca

SEQ ID NO: 5447048 - DNA, 23 bp, Homo sapiens
tcatgactagtgcctagaaagca

SEQ ID NO: 5447049 - DNA, 19 bp, Homo sapiens
tcatgactgagtctggcaa

SEQ ID NO: 5447050 - DNA, 14 bp, Homo sapiens
tcatgactttatag

SEQ ID NO: 5447051 - DNA, 12 bp, Homo sapiens
tcatgactttca

SEQ ID NO: 5447052 - DNA, 23 bp, Homo sapiens
tcatgactttcagattgtatctg

SEQ ID NO: 5447053 - DNA, 15 bp, Homo sapiens
tcatgagaattacag

SEQ ID NO: 5447054 - DNA, 16 bp, Homo sapiens
tcatgagaattacaga

SEQ ID NO: 5447055 - DNA, 17 bp, Homo sapiens
tcatgagaattacagaa

SEQ ID NO: 5447056 - DNA, 22 bp, Homo sapiens
tcatgagattggtcattaaata

SEQ ID NO: 5447057 - DNA, 13 bp, Homo sapiens
tcatgagcctgct

SEQ ID NO: 5447058 - DNA, 17 bp, Homo sapiens
tcatgagcctgtttatt

SEQ ID NO: 5447059 - DNA, 20 bp, Homo sapiens
tcatgagcctgtttattgcc

SEQ ID NO: 5447060 - DNA, 23 bp, Homo sapiens
tcatgagcctgtttattgccatt

SEQ ID NO: 5447061 - DNA, 21 bp, Homo sapiens
tcatgagcgtcaaagaaaatg

SEQ ID NO: 5447062 - DNA, 10 bp, Homo sapiens
tcatgagctc

SEQ ID NO: 5447063 - DNA, 20 bp, Homo sapiens
tcatgagctgggtactgact

SEQ ID NO: 5447064 - DNA, 17 bp, Homo sapiens
tcatgaggaaagacaca

SEQ ID NO: 5447065 - DNA, 19 bp, Homo sapiens
tcatgaggaaagacacaga

SEQ ID NO: 5447066 - DNA, 20 bp, Homo sapiens
tcatgaggaaagcagttgaa

SEQ ID NO: 5447067 - DNA, 20 bp, Homo sapiens
tcatgaggaccagggtggag

SEQ ID NO: 5447068 - DNA, 16 bp, Homo sapiens
tcatgaggagattctg

SEQ ID NO: 5447069 - DNA, 20 bp, Homo sapiens
tcatgaggagattctgcctt

SEQ ID NO: 5447070 - DNA, 22 bp, Homo sapiens
tcatgaggagattctgcctttg

SEQ ID NO: 5447071 - DNA, 19 bp, Homo sapiens
tcatgaggagggtggggga

SEQ ID NO: 5447072 - DNA, 16 bp, Homo sapiens
tcatgaggctgaggca

SEQ ID NO: 5447073 - DNA, 14 bp, Homo sapiens
tcatgagtggatgg

SEQ ID NO: 5447074 - DNA, 15 bp, Homo sapiens
tcatgagtggatgga

SEQ ID NO: 5447075 - DNA, 23 bp, Homo sapiens
tcatgagtggatggatggacaga

SEQ ID NO: 5447076 - DNA, 18 bp, Homo sapiens
tcatgataccacctttac

SEQ ID NO: 5447077 - DNA, 21 bp, Homo sapiens
tcatgatccacccacctcagc

SEQ ID NO: 5447078 - DNA, 15 bp, Homo sapiens
tcatgatctccctgc

SEQ ID NO: 5447079 - DNA, 22 bp, Homo sapiens
tcatgatctccctgccgcctca

SEQ ID NO: 5447080 - DNA, 16 bp, Homo sapiens
tcatgatcttgtgaca

SEQ ID NO: 5447081 - DNA, 15 bp, Homo sapiens
tcatgatgagaaatg

SEQ ID NO: 5447082 - DNA, 17 bp, Homo sapiens
tcatgatgcagtctcct

SEQ ID NO: 5447083 - DNA, 19 bp, Homo sapiens
tcatgatgcagtctcctct

SEQ ID NO: 5447084 - DNA, 23 bp, Homo sapiens
tcatgatgcagtctcctctttaa

SEQ ID NO: 5447085 - DNA, 19 bp, Homo sapiens
tcatgatgcgcttcaaagt

SEQ ID NO: 5447086 - DNA, 18 bp, Homo sapiens
tcatgatgctagttctta

SEQ ID NO: 5447087 - DNA, 18 bp, Homo sapiens
tcatgatgctctttccca

SEQ ID NO: 5447088 - DNA, 24 bp, Homo sapiens
tcatgatggatggaaatatgttct

SEQ ID NO: 5447089 - DNA, 22 bp, Homo sapiens
tcatgattatagcaactaatgt

SEQ ID NO: 5447090 - DNA, 13 bp, Homo sapiens
tcatgattcatga

SEQ ID NO: 5447091 - DNA, 20 bp, Homo sapiens
tcatgattcatgagctgggt

SEQ ID NO: 5447092 - DNA, 22 bp, Homo sapiens
tcatgattctatgtaatgtaaa

SEQ ID NO: 5447093 - DNA, 20 bp, Homo sapiens
tcatgattggcttaaagtga

SEQ ID NO: 5447094 - DNA, 13 bp, Homo sapiens
tcatgatttataa

SEQ ID NO: 5447095 - DNA, 17 bp, Homo sapiens
tcatgatttcatttcaa

SEQ ID NO: 5447096 - DNA, 14 bp, Homo sapiens
tcatgatttctgtg

SEQ ID NO: 5447097 - DNA, 21 bp, Homo sapiens
tcatgattttgaaatcatgaa

SEQ ID NO: 5447098 - DNA, 22 bp, Homo sapiens
tcatgcaaaaaaaaaaatgtca

SEQ ID NO: 5447099 - DNA, 11 bp, Homo sapiens
tcatgcaaaat

SEQ ID NO: 5447100 - DNA, 13 bp, Homo sapiens
tcatgcaaaatat

SEQ ID NO: 5447101 - DNA, 14 bp, Homo sapiens
tcatgcaaacttta

SEQ ID NO: 5447102 - DNA, 20 bp, Homo sapiens
tcatgcaaatgctgtattct

SEQ ID NO: 5447103 - DNA, 14 bp, Homo sapiens
tcatgcaagagttt

SEQ ID NO: 5447104 - DNA, 18 bp, Homo sapiens
tcatgcactcacaaagat

SEQ ID NO: 5447105 - DNA, 13 bp, Homo sapiens
tcatgcactgagg

SEQ ID NO: 5447106 - DNA, 16 bp, Homo sapiens
tcatgcactgcaaata

SEQ ID NO: 5447107 - DNA, 17 bp, Homo sapiens
tcatgcacttaaagaag

SEQ ID NO: 5447108 - DNA, 22 bp, Homo sapiens
tcatgcacttaaagaagtattt

SEQ ID NO: 5447109 - DNA, 12 bp, Homo sapiens
tcatgcagacaa

SEQ ID NO: 5447110 - DNA, 14 bp, Homo sapiens
tcatgcagctgtgg

SEQ ID NO: 5447111 - DNA, 12 bp, Homo sapiens
tcatgcaggaac

SEQ ID NO: 5447112 - DNA, 15 bp, Homo sapiens
tcatgcataaatatg

SEQ ID NO: 5447113 - DNA, 16 bp, Homo sapiens
tcatgcatctccacct

SEQ ID NO: 5447114 - DNA, 17 bp, Homo sapiens
tcatgcatgtcaaacat

SEQ ID NO: 5447115 - DNA, 14 bp, Homo sapiens
tcatgcattcacaa

SEQ ID NO: 5447116 - DNA, 15 bp, Homo sapiens
tcatgcatttcaagc

SEQ ID NO: 5447117 - DNA, 21 bp, Homo sapiens
tcatgccaagcatttaatgta

SEQ ID NO: 5447118 - DNA, 19 bp, Homo sapiens
tcatgccaccatggccagc

SEQ ID NO: 5447119 - DNA, 14 bp, Homo sapiens
tcatgccagcagca

SEQ ID NO: 5447120 - DNA, 19 bp, Homo sapiens
tcatgccagtgcatgccag

SEQ ID NO: 5447121 - DNA, 17 bp, Homo sapiens
tcatgccagtgccttat

SEQ ID NO: 5447122 - DNA, 19 bp, Homo sapiens
tcatgccatcatgcccagc

SEQ ID NO: 5447123 - DNA, 11 bp, Homo sapiens
tcatgccatct

SEQ ID NO: 5447124 - DNA, 18 bp, Homo sapiens
tcatgccatctgttttca

SEQ ID NO: 5447125 - DNA, 21 bp, Homo sapiens
tcatgccattccgaccttcac

SEQ ID NO: 5447126 - DNA, 19 bp, Homo sapiens
tcattctgcattgctagat

SEQ ID NO: 5447127 - DNA, 22 bp, Homo sapiens
tcattctgccaaagtaaaacaa

SEQ ID NO: 5447128 - DNA, 16 bp, Homo sapiens
tcattctgcctgccct

SEQ ID NO: 5447129 - DNA, 19 bp, Homo sapiens
tcattctgcctgccctgaa

SEQ ID NO: 5447130 - DNA, 16 bp, Homo sapiens
tcattctgctacttca

SEQ ID NO: 5447131 - DNA, 18 bp, Homo sapiens
tcattctgctacttcact

SEQ ID NO: 5447132 - DNA, 13 bp, Homo sapiens
tcattctggaaac

SEQ ID NO: 5447133 - DNA, 13 bp, Homo sapiens
tcattctggaggg

SEQ ID NO: 5447134 - DNA, 13 bp, Homo sapiens
tcattctggctta

SEQ ID NO: 5447135 - DNA, 19 bp, Homo sapiens
tcattctggcttaaacaac

SEQ ID NO: 5447136 - DNA, 21 bp, Homo sapiens
tcattctggttccctgctgcg

SEQ ID NO: 5447137 - DNA, 13 bp, Homo sapiens
tcattctgtgacc

SEQ ID NO: 5447138 - DNA, 16 bp, Homo sapiens
tcattctgtgccattt

SEQ ID NO: 5447139 - DNA, 11 bp, Homo sapiens
tcattctgtgt

SEQ ID NO: 5447140 - DNA, 20 bp, Homo sapiens
tcattctgttgcccaggctg

SEQ ID NO: 5447141 - DNA, 22 bp, Homo sapiens
tcattcttaatttatgtaaggt

SEQ ID NO: 5447142 - DNA, 21 bp, Homo sapiens
tcattcttacaattgcactgc

SEQ ID NO: 5447143 - DNA, 17 bp, Homo sapiens
tcattcttgaaagctgt

SEQ ID NO: 5447144 - DNA, 17 bp, Homo sapiens
tcattcttgaggagcat

SEQ ID NO: 5447145 - DNA, 20 bp, Homo sapiens
tcattcttgccctttgagaa

SEQ ID NO: 5447146 - DNA, 14 bp, Homo sapiens
tcattctttactgc

SEQ ID NO: 5447147 - DNA, 16 bp, Homo sapiens
tcattctttactgcac

SEQ ID NO: 5447148 - DNA, 22 bp, Homo sapiens
tcattctttataaaccataaaa

SEQ ID NO: 5447149 - DNA, 15 bp, Homo sapiens
tcattcttttcagct

SEQ ID NO: 5447150 - DNA, 21 bp, Homo sapiens
tcattctttttgaaatgtcaa

SEQ ID NO: 5447151 - DNA, 18 bp, Homo sapiens
tcattgaaacatttataa

SEQ ID NO: 5447152 - DNA, 20 bp, Homo sapiens
tcattgaaagcttcaaagtt

SEQ ID NO: 5447153 - DNA, 18 bp, Homo sapiens
tcattgaaagtaaaaaat

SEQ ID NO: 5447154 - DNA, 22 bp, Homo sapiens
tcattgaaatctttttgctttg

SEQ ID NO: 5447155 - DNA, 12 bp, Homo sapiens
tcattgaaatgt

SEQ ID NO: 5447156 - DNA, 21 bp, Homo sapiens
tcattgaaatgtaatttcagt

SEQ ID NO: 5447157 - DNA, 21 bp, Homo sapiens
tcattgaaatttactgtgaga

SEQ ID NO: 5447158 - DNA, 19 bp, Homo sapiens
tcattgaactttaagaagc

SEQ ID NO: 5447159 - DNA, 21 bp, Homo sapiens
tcattgaagtatattcttatt

SEQ ID NO: 5447160 - DNA, 20 bp, Homo sapiens
tcattgaattataaaagcca

SEQ ID NO: 5447161 - DNA, 22 bp, Homo sapiens
tcattgacctcatcattaataa

SEQ ID NO: 5447162 - DNA, 16 bp, Homo sapiens
tcattgacctctcagg

SEQ ID NO: 5447163 - DNA, 14 bp, Homo sapiens
tcattgacctgagg

SEQ ID NO: 5447164 - DNA, 15 bp, Homo sapiens
tcattgacctgaggc

SEQ ID NO: 5447165 - DNA, 19 bp, Homo sapiens
tcattgacctgaggccctt

SEQ ID NO: 5447166 - DNA, 20 bp, Homo sapiens
tcattgactatcaaactgaa

SEQ ID NO: 5447167 - DNA, 12 bp, Homo sapiens
tcattgacttca

SEQ ID NO: 5447168 - DNA, 22 bp, Homo sapiens
tcattgacttcaagatgcctct

SEQ ID NO: 5447169 - DNA, 16 bp, Homo sapiens
tcattgacttttataa

SEQ ID NO: 5447170 - DNA, 18 bp, Homo sapiens
tcattgagaaataaagca

SEQ ID NO: 5447171 - DNA, 14 bp, Homo sapiens
tcattgaggacaaa

SEQ ID NO: 5447172 - DNA, 17 bp, Homo sapiens
tcattgaggataaattg

SEQ ID NO: 5447173 - DNA, 22 bp, Homo sapiens
tcattgaggataaattgccata

SEQ ID NO: 5447174 - DNA, 18 bp, Homo sapiens
tcattgagggaccaaaaa

SEQ ID NO: 5447175 - DNA, 23 bp, Homo sapiens
tcattgatgggatttttgtttga

SEQ ID NO: 5447176 - DNA, 17 bp, Homo sapiens
tcattgatttcctgtgt

SEQ ID NO: 5447177 - DNA, 20 bp, Homo sapiens
tcattgattttataattggt

SEQ ID NO: 5447178 - DNA, 15 bp, Homo sapiens
tcattgcacaatata

SEQ ID NO: 5447179 - DNA, 18 bp, Homo sapiens
tcattgcacaatatattt

SEQ ID NO: 5447180 - DNA, 20 bp, Homo sapiens
tcattgcacctatctcagcc

SEQ ID NO: 5447181 - DNA, 21 bp, Homo sapiens
tcattgcacctatctcagcca

SEQ ID NO: 5447182 - DNA, 24 bp, Homo sapiens
tcattgcacctatctcagccatag

SEQ ID NO: 5447183 - DNA, 14 bp, Homo sapiens
tcattgcactgcag

SEQ ID NO: 5447184 - DNA, 19 bp, Homo sapiens
tcattgcactttcctttca

SEQ ID NO: 5447185 - DNA, 21 bp, Homo sapiens
tcattgcactttcctttcaat

SEQ ID NO: 5447186 - DNA, 22 bp, Homo sapiens
tcattgcactttcctttcaata

SEQ ID NO: 5447187 - DNA, 20 bp, Homo sapiens
tcattgcagatcccagccca

SEQ ID NO: 5447188 - DNA, 17 bp, Homo sapiens
tcattgcagcagataac

SEQ ID NO: 5447189 - DNA, 22 bp, Homo sapiens
tcattgcagcagataacttttt

SEQ ID NO: 5447190 - DNA, 20 bp, Homo sapiens
tcattgcagtatcagagggt

SEQ ID NO: 5447191 - DNA, 12 bp, Homo sapiens
tcattgcatttc

SEQ ID NO: 5447192 - DNA, 14 bp, Homo sapiens
tcattgcatttcca

SEQ ID NO: 5447193 - DNA, 22 bp, Homo sapiens
tcattgccaaggcatccccagt

SEQ ID NO: 5447194 - DNA, 14 bp, Homo sapiens
tcattgccagtggt

SEQ ID NO: 5447195 - DNA, 16 bp, Homo sapiens
tcattgcccacttctg

SEQ ID NO: 5447196 - DNA, 14 bp, Homo sapiens
tcattgcccccacc

SEQ ID NO: 5447197 - DNA, 21 bp, Homo sapiens
tcattgcccccacctctggtc

SEQ ID NO: 5447198 - DNA, 17 bp, Homo sapiens
tcattgcctcctgttct

SEQ ID NO: 5447199 - DNA, 21 bp, Homo sapiens
tcattgcctcttctacttgta

SEQ ID NO: 5447200 - DNA, 16 bp, Homo sapiens
tcattgcctgtgtatg

SEQ ID NO: 5447201 - DNA, 20 bp, Homo sapiens
tcattgccttaactggagcc

SEQ ID NO: 5447202 - DNA, 23 bp, Homo sapiens
tcattgccttaactggagcccca

SEQ ID NO: 5447203 - DNA, 14 bp, Homo sapiens
tcattgccttccta

SEQ ID NO: 5447204 - DNA, 19 bp, Homo sapiens
tcattgccttcgctccatg

SEQ ID NO: 5447205 - DNA, 14 bp, Homo sapiens
tcattgctaaaaaa

SEQ ID NO: 5447206 - DNA, 15 bp, Homo sapiens
tcattgctaaaaaat

SEQ ID NO: 5447207 - DNA, 17 bp, Homo sapiens
tcattgctaaaaaataa

SEQ ID NO: 5447208 - DNA, 22 bp, Homo sapiens
tcattgctacacttacaagtaa

SEQ ID NO: 5447209 - DNA, 18 bp, Homo sapiens
tcattgctaccacagact

SEQ ID NO: 5447210 - DNA, 17 bp, Homo sapiens
tcattgctgacagagcc

SEQ ID NO: 5447211 - DNA, 18 bp, Homo sapiens
tcattgctgacagagccc

SEQ ID NO: 5447212 - DNA, 15 bp, Homo sapiens
tcattgctgagcctc

SEQ ID NO: 5447213 - DNA, 17 bp, Homo sapiens
tcattgctgagcctctg

SEQ ID NO: 5447214 - DNA, 23 bp, Homo sapiens
tcattgctgagcctctgctcccc

SEQ ID NO: 5447215 - DNA, 14 bp, Homo sapiens
tcattgctgctgct

SEQ ID NO: 5447216 - DNA, 16 bp, Homo sapiens
tcattgctggaggtag

SEQ ID NO: 5447217 - DNA, 14 bp, Homo sapiens
tcattgctgtcttg

SEQ ID NO: 5447218 - DNA, 12 bp, Homo sapiens
tcattgcttctt

SEQ ID NO: 5447219 - DNA, 17 bp, Homo sapiens
tcattgcttcttctgag

SEQ ID NO: 5447220 - DNA, 12 bp, Homo sapiens
tcattgctttac

SEQ ID NO: 5447221 - DNA, 18 bp, Homo sapiens
tcattggaaacactgcct

SEQ ID NO: 5447222 - DNA, 14 bp, Homo sapiens
tcattggaaattta

SEQ ID NO: 5447223 - DNA, 15 bp, Homo sapiens
tcattggaaatttag

SEQ ID NO: 5447224 - DNA, 18 bp, Homo sapiens
tcattggaacaactgata

SEQ ID NO: 5447225 - DNA, 18 bp, Homo sapiens
tcattggataaatttgaa

SEQ ID NO: 5447226 - DNA, 21 bp, Homo sapiens
tcattggattctgagagctgt

SEQ ID NO: 5447227 - DNA, 20 bp, Homo sapiens
tcattggcagctcaaagact

SEQ ID NO: 5447228 - DNA, 21 bp, Homo sapiens
tcattggcagctcaaagactt

SEQ ID NO: 5447229 - DNA, 11 bp, Homo sapiens
tcattggccag

SEQ ID NO: 5447230 - DNA, 18 bp, Homo sapiens
tcattggcccaacaagaa

SEQ ID NO: 5447231 - DNA, 21 bp, Homo sapiens
tcattggctatataaaatgtg

SEQ ID NO: 5447232 - DNA, 14 bp, Homo sapiens
tcattggctcctgg

SEQ ID NO: 5447233 - DNA, 11 bp, Homo sapiens
tcattggcttt

SEQ ID NO: 5447234 - DNA, 16 bp, Homo sapiens
tcattgggagaagccg

SEQ ID NO: 5447235 - DNA, 17 bp, Homo sapiens
tcattgggttttatcag

SEQ ID NO: 5447236 - DNA, 20 bp, Homo sapiens
tcattgggtttttcctctgt

SEQ ID NO: 5447237 - DNA, 16 bp, Homo sapiens
tcattgtaaacaaact

SEQ ID NO: 5447238 - DNA, 19 bp, Homo sapiens
tcattgtaaacaaactctt

SEQ ID NO: 5447239 - DNA, 14 bp, Homo sapiens
tcattgtaaatcac

SEQ ID NO: 5447240 - DNA, 13 bp, Homo sapiens
tcattgtaaccat

SEQ ID NO: 5447241 - DNA, 20 bp, Homo sapiens
tcattgtaaccatttctcac

SEQ ID NO: 5447242 - DNA, 12 bp, Homo sapiens
tcattgtaatct

SEQ ID NO: 5447243 - DNA, 20 bp, Homo sapiens
tcattgtaatgttactgatc

SEQ ID NO: 5447244 - DNA, 19 bp, Homo sapiens
tcattgtaatgttgtgaat

SEQ ID NO: 5447245 - DNA, 19 bp, Homo sapiens
tcattgtagagcacattta

SEQ ID NO: 5447246 - DNA, 21 bp, Homo sapiens
tcattgtagagcacatttagt

SEQ ID NO: 5447247 - DNA, 16 bp, Homo sapiens
tcattgtagattttgt

SEQ ID NO: 5447248 - DNA, 21 bp, Homo sapiens
tcattgtagcacaatcctatt

SEQ ID NO: 5447249 - DNA, 14 bp, Homo sapiens
tcattgtataaaaa

SEQ ID NO: 5447250 - DNA, 16 bp, Homo sapiens
tcattgtataaaaata

SEQ ID NO: 5447251 - DNA, 16 bp, Homo sapiens
tcattgtatatatgtg

SEQ ID NO: 5447252 - DNA, 21 bp, Homo sapiens
tcattgtcagagatgttttca

SEQ ID NO: 5447253 - DNA, 14 bp, Homo sapiens
tcattgtccagctg

SEQ ID NO: 5447254 - DNA, 15 bp, Homo sapiens
tcattgtccagctgg

SEQ ID NO: 5447255 - DNA, 18 bp, Homo sapiens
tcattgtctgtgtagagt

SEQ ID NO: 5447256 - DNA, 17 bp, Homo sapiens
tcattgtgaaattattc

SEQ ID NO: 5447257 - DNA, 14 bp, Homo sapiens
tcattgtgaacaga

SEQ ID NO: 5447258 - DNA, 22 bp, Homo sapiens
tcattgtgaggtttaacattaa

SEQ ID NO: 5447259 - DNA, 16 bp, Homo sapiens
tcattgtgccaagcct

SEQ ID NO: 5447260 - DNA, 21 bp, Homo sapiens
tcattgtgccaagccttctgt

SEQ ID NO: 5447261 - DNA, 18 bp, Homo sapiens
tcattgtgcttaataata

SEQ ID NO: 5447262 - DNA, 18 bp, Homo sapiens
tcattgtggctatctgca

SEQ ID NO: 5447263 - DNA, 13 bp, Homo sapiens
tcattgtggttat

SEQ ID NO: 5447264 - DNA, 23 bp, Homo sapiens
tcattgtggttatttttatacag

SEQ ID NO: 5447265 - DNA, 20 bp, Homo sapiens
tcattgtgtatcagtttcca

SEQ ID NO: 5447266 - DNA, 22 bp, Homo sapiens
tcattgtgtatcagtttccatg

SEQ ID NO: 5447267 - DNA, 14 bp, Homo sapiens
tcattgtgtgtctt

SEQ ID NO: 5447268 - DNA, 14 bp, Homo sapiens
tcattgtgttttct

SEQ ID NO: 5447269 - DNA, 19 bp, Homo sapiens
tcattgtgttttcttcgtg

SEQ ID NO: 5447270 - DNA, 21 bp, Homo sapiens
tcattgtgttttcttcgtgga

SEQ ID NO: 5447271 - DNA, 15 bp, Homo sapiens
tcattgttaaaaaac

SEQ ID NO: 5447272 - DNA, 17 bp, Homo sapiens
tcattgttaaaaaacaa

SEQ ID NO: 5447273 - DNA, 21 bp, Homo sapiens
tcattgttaaatacacattat

SEQ ID NO: 5447274 - DNA, 21 bp, Homo sapiens
tcattgttacaggtgtactat

SEQ ID NO: 5447275 - DNA, 15 bp, Homo sapiens
tcattgttataaaga

SEQ ID NO: 5447276 - DNA, 15 bp, Homo sapiens
tcattgttatttata

SEQ ID NO: 5447277 - DNA, 12 bp, Homo sapiens
tcattgttctcc

SEQ ID NO: 5447278 - DNA, 14 bp, Homo sapiens
tcattgttgtgtat

SEQ ID NO: 5447279 - DNA, 15 bp, Homo sapiens
tcattgttgtgtata

SEQ ID NO: 5447280 - DNA, 20 bp, Homo sapiens
tcattgtttgtcctttatgt

SEQ ID NO: 5447281 - DNA, 19 bp, Homo sapiens
tcatttaaaaaaaaagaat

SEQ ID NO: 5447282 - DNA, 15 bp, Homo sapiens
tcatttaaaacaggc

SEQ ID NO: 5447283 - DNA, 16 bp, Homo sapiens
tcatttaaaatgatta

SEQ ID NO: 5447284 - DNA, 18 bp, Homo sapiens
tcatttaaaatgtaaact

SEQ ID NO: 5447285 - DNA, 18 bp, Homo sapiens
tcatttaaacatgcagaa

SEQ ID NO: 5447286 - DNA, 20 bp, Homo sapiens
tcatttaaagctaaattttg

SEQ ID NO: 5447287 - DNA, 23 bp, Homo sapiens
tcatttaacactgagtgaaatat

SEQ ID NO: 5447288 - DNA, 21 bp, Homo sapiens
tcatttaagaatttaccagaa

SEQ ID NO: 5447289 - DNA, 14 bp, Homo sapiens
tcatttaagggaaa

SEQ ID NO: 5447290 - DNA, 15 bp, Homo sapiens
tcatttaagggaaaa

SEQ ID NO: 5447291 - DNA, 22 bp, Homo sapiens
tcatttaatcctcccttcctcc

SEQ ID NO: 5447292 - DNA, 13 bp, Homo sapiens
tcatttaatttgt

SEQ ID NO: 5447293 - DNA, 19 bp, Homo sapiens
tcatttacaacttccagat

SEQ ID NO: 5447294 - DNA, 21 bp, Homo sapiens
tcatttacaagacaacattgt

SEQ ID NO: 5447295 - DNA, 12 bp, Homo sapiens
tcatttacacac

SEQ ID NO: 5447296 - DNA, 22 bp, Homo sapiens
tcatttaccataaaaatccttc

SEQ ID NO: 5447297 - DNA, 16 bp, Homo sapiens
tcatttactaaacata

SEQ ID NO: 5447298 - DNA, 22 bp, Homo sapiens
tcatttactaaacatatgattt

SEQ ID NO: 5447299 - DNA, 20 bp, Homo sapiens
tcatttactgatcatctgct

SEQ ID NO: 5447300 - DNA, 11 bp, Homo sapiens
tcatttactgt

SEQ ID NO: 5447301 - DNA, 13 bp, Homo sapiens
tcatttactgtgg

SEQ ID NO: 5447302 - DNA, 20 bp, Homo sapiens
tcatttactgtggcttctta

SEQ ID NO: 5447303 - DNA, 11 bp, Homo sapiens
tccaaatgtga

SEQ ID NO: 5447304 - DNA, 13 bp, Homo sapiens
tccaaatgtgaaa

SEQ ID NO: 5447305 - DNA, 21 bp, Homo sapiens
tccaaatgtgtataattttaa

SEQ ID NO: 5447306 - DNA, 17 bp, Homo sapiens
tccaaatgtgtcagaat

SEQ ID NO: 5447307 - DNA, 13 bp, Homo sapiens
tccaaatgtttat

SEQ ID NO: 5447308 - DNA, 17 bp, Homo sapiens
tccaaattattaattgt

SEQ ID NO: 5447309 - DNA, 21 bp, Homo sapiens
tccaaattattaattgtcctg

SEQ ID NO: 5447310 - DNA, 19 bp, Homo sapiens
tccaaattcaccttcccct

SEQ ID NO: 5447311 - DNA, 14 bp, Homo sapiens
tccaaattcagttt

SEQ ID NO: 5447312 - DNA, 16 bp, Homo sapiens
tccaaattcagtttca

SEQ ID NO: 5447313 - DNA, 19 bp, Homo sapiens
tccaaattcagtttcataa

SEQ ID NO: 5447314 - DNA, 13 bp, Homo sapiens
tccaaattccctc

SEQ ID NO: 5447315 - DNA, 15 bp, Homo sapiens
tccaaattccctctg

SEQ ID NO: 5447316 - DNA, 21 bp, Homo sapiens
tccaaattgtctgtctgctct

SEQ ID NO: 5447317 - DNA, 16 bp, Homo sapiens
tccaaattgtttgtac

SEQ ID NO: 5447318 - DNA, 17 bp, Homo sapiens
tccaaattgtttgtaca

SEQ ID NO: 5447319 - DNA, 23 bp, Homo sapiens
tccaaatttaaccataaatcaat

SEQ ID NO: 5447320 - DNA, 16 bp, Homo sapiens
tccaaatttaatgtag

SEQ ID NO: 5447321 - DNA, 22 bp, Homo sapiens
tccaacaaaagaaggtcaaact

SEQ ID NO: 5447322 - DNA, 15 bp, Homo sapiens
tccaacaagaagaaa

SEQ ID NO: 5447323 - DNA, 17 bp, Homo sapiens
tccaacaagaagaaata

SEQ ID NO: 5447324 - DNA, 14 bp, Homo sapiens
tccaacaagaatgc

SEQ ID NO: 5447325 - DNA, 15 bp, Homo sapiens
tccaacaagttgcct

SEQ ID NO: 5447326 - DNA, 15 bp, Homo sapiens
tccaacacaaggctc

SEQ ID NO: 5447327 - DNA, 22 bp, Homo sapiens
tccaacacatttcacttttctg

SEQ ID NO: 5447328 - DNA, 19 bp, Homo sapiens
tccaacaccacagacacac

SEQ ID NO: 5447329 - DNA, 20 bp, Homo sapiens
tccaacaccacagacacaca

SEQ ID NO: 5447330 - DNA, 18 bp, Homo sapiens
tccaacactgaagtgctt

SEQ ID NO: 5447331 - DNA, 16 bp, Homo sapiens
tccaacactttgagca

SEQ ID NO: 5447332 - DNA, 21 bp, Homo sapiens
tccaacagaaataaaatacac

SEQ ID NO: 5447333 - DNA, 16 bp, Homo sapiens
tccaacagacaccctc

SEQ ID NO: 5447334 - DNA, 17 bp, Homo sapiens
tccaacagacaccctcc

SEQ ID NO: 5447335 - DNA, 21 bp, Homo sapiens
tccaacagacaccctccactc

SEQ ID NO: 5447336 - DNA, 24 bp, Homo sapiens
tccaacagacaccctccactctga

SEQ ID NO: 5447337 - DNA, 12 bp, Homo sapiens
tccaacagcttg

SEQ ID NO: 5447338 - DNA, 21 bp, Homo sapiens
tccaacagcttgaccagacct

SEQ ID NO: 5447339 - DNA, 19 bp, Homo sapiens
tccaacaggggctggaggg

SEQ ID NO: 5447340 - DNA, 23 bp, Homo sapiens
tccaacagtttaatgaagatcta

SEQ ID NO: 5447341 - DNA, 19 bp, Homo sapiens
tccaacatacaatttactt

SEQ ID NO: 5447342 - DNA, 19 bp, Homo sapiens
tccaacatatatttattga

SEQ ID NO: 5447343 - DNA, 20 bp, Homo sapiens
tccaacatcacagcccagcc

SEQ ID NO: 5447344 - DNA, 11 bp, Homo sapiens
tccaacatgaa

SEQ ID NO: 5447345 - DNA, 15 bp, Homo sapiens
tccaacatgtgatgt

SEQ ID NO: 5447346 - DNA, 14 bp, Homo sapiens
tccaacatgtttta

SEQ ID NO: 5447347 - DNA, 16 bp, Homo sapiens
tccaacatgttttatg

SEQ ID NO: 5447348 - DNA, 19 bp, Homo sapiens
tccaacatttcctcaggca

SEQ ID NO: 5447349 - DNA, 18 bp, Homo sapiens
tccaacatttctcactga

SEQ ID NO: 5447350 - DNA, 14 bp, Homo sapiens
tccaacatttcttg

SEQ ID NO: 5447351 - DNA, 23 bp, Homo sapiens
tccaaccaaggaatttaaaactg

SEQ ID NO: 5447352 - DNA, 16 bp, Homo sapiens
tccaaccaagtggaaa

SEQ ID NO: 5447353 - DNA, 11 bp, Homo sapiens
tccaaccactg

SEQ ID NO: 5447354 - DNA, 12 bp, Homo sapiens
tccaaccactgt

SEQ ID NO: 5447355 - DNA, 16 bp, Homo sapiens
tccaaccactgtgcca

SEQ ID NO: 5447356 - DNA, 17 bp, Homo sapiens
tccaaccagacctggaa

SEQ ID NO: 5447357 - DNA, 16 bp, Homo sapiens
tccaaccagactttga

SEQ ID NO: 5447358 - DNA, 12 bp, Homo sapiens
tccaaccaggca

SEQ ID NO: 5447359 - DNA, 20 bp, Homo sapiens
tccaacccagcagttctctg

SEQ ID NO: 5447360 - DNA, 15 bp, Homo sapiens
tccaacccagcctga

SEQ ID NO: 5447361 - DNA, 16 bp, Homo sapiens
tccaacccagcctgag

SEQ ID NO: 5447362 - DNA, 18 bp, Homo sapiens
tccaacccaggtctgctt

SEQ ID NO: 5447363 - DNA, 15 bp, Homo sapiens
tccaacccatgatga

SEQ ID NO: 5447364 - DNA, 15 bp, Homo sapiens
tccaacccatgcatg

SEQ ID NO: 5447365 - DNA, 21 bp, Homo sapiens
tccaacccatgcatggcctcc

SEQ ID NO: 5447366 - DNA, 19 bp, Homo sapiens
tccaaccccaactccagta

SEQ ID NO: 5447367 - DNA, 16 bp, Homo sapiens
tccaaccccagctggc

SEQ ID NO: 5447368 - DNA, 19 bp, Homo sapiens
tccaacccctcgcccagtc

SEQ ID NO: 5447369 - DNA, 24 bp, Homo sapiens
tccaacccctcgcccagtcccagc

SEQ ID NO: 5447370 - DNA, 16 bp, Homo sapiens
tccaacccctttgctg

SEQ ID NO: 5447371 - DNA, 19 bp, Homo sapiens
tccaacccctttgctggtt

SEQ ID NO: 5447372 - DNA, 22 bp, Homo sapiens
tccaacccgtctggcccaccag

SEQ ID NO: 5447373 - DNA, 23 bp, Homo sapiens
tccaaccctcatcaccaacgtct

SEQ ID NO: 5447374 - DNA, 13 bp, Homo sapiens
tccaaccctgccg

SEQ ID NO: 5447375 - DNA, 22 bp, Homo sapiens
tccaaccctgccgtcaccacca

SEQ ID NO: 5447376 - DNA, 18 bp, Homo sapiens
tccaacctaacccctttc

SEQ ID NO: 5447377 - DNA, 21 bp, Homo sapiens
tccaacctaacccctttcctg

SEQ ID NO: 5447378 - DNA, 19 bp, Homo sapiens
tccaacctaacctgtgtct

SEQ ID NO: 5447379 - DNA, 13 bp, Homo sapiens
tccaacctcctgc

SEQ ID NO: 5447380 - DNA, 21 bp, Homo sapiens
tccaacctcctgctctgggac

SEQ ID NO: 5447381 - DNA, 22 bp, Homo sapiens
tccaacctcctgctctgggacg

SEQ ID NO: 5447382 - DNA, 23 bp, Homo sapiens
tccaacctctttcctctctggcc

SEQ ID NO: 5447383 - DNA, 17 bp, Homo sapiens
tccaacctggacaacaa

SEQ ID NO: 5447384 - DNA, 14 bp, Homo sapiens
tccaacctggaggc

SEQ ID NO: 5447385 - DNA, 18 bp, Homo sapiens
tccaacctggaggctgga

SEQ ID NO: 5447386 - DNA, 14 bp, Homo sapiens
tccaaccttcccaa

SEQ ID NO: 5447387 - DNA, 21 bp, Homo sapiens
tccaaccttctgccctcctgc

SEQ ID NO: 5447388 - DNA, 15 bp, Homo sapiens
tccaacgcccctgtg

SEQ ID NO: 5447389 - DNA, 18 bp, Homo sapiens
tccaacgcccctgtggcc

SEQ ID NO: 5447390 - DNA, 23 bp, Homo sapiens
tccaacgccgccttggccttgca

SEQ ID NO: 5447391 - DNA, 21 bp, Homo sapiens
tccaacgtaaattattacata

SEQ ID NO: 5447392 - DNA, 19 bp, Homo sapiens
tccaacgtggggcagcaca

SEQ ID NO: 5447393 - DNA, 22 bp, Homo sapiens
tccaactaatgccttactcttc

SEQ ID NO: 5447394 - DNA, 23 bp, Homo sapiens
tccaactactaatagaataaagg

SEQ ID NO: 5447395 - DNA, 19 bp, Homo sapiens
tccaactccaacatccact

SEQ ID NO: 5447396 - DNA, 14 bp, Homo sapiens
tccaactccagcaa

SEQ ID NO: 5447397 - DNA, 22 bp, Homo sapiens
tccaactccatactccactcca

SEQ ID NO: 5447398 - DNA, 23 bp, Homo sapiens
tccaactctacacagctcagcag

SEQ ID NO: 5447399 - DNA, 24 bp, Homo sapiens
tccaactcttccccctctcccagt

SEQ ID NO: 5447400 - DNA, 15 bp, Homo sapiens
tccaactgcatccag

SEQ ID NO: 5447401 - DNA, 16 bp, Homo sapiens
tccaactgctgcccca

SEQ ID NO: 5447402 - DNA, 20 bp, Homo sapiens
tccaactggaaattccagga

SEQ ID NO: 5447403 - DNA, 16 bp, Homo sapiens
tccaactggatgttga

SEQ ID NO: 5447404 - DNA, 21 bp, Homo sapiens
tccaactggattataaataaa

SEQ ID NO: 5447405 - DNA, 17 bp, Homo sapiens
tccaactggcactctgt

SEQ ID NO: 5447406 - DNA, 19 bp, Homo sapiens
tccaactggcactctgtgg

SEQ ID NO: 5447407 - DNA, 20 bp, Homo sapiens
tccaactgggcatttcaatc

SEQ ID NO: 5447408 - DNA, 20 bp, Homo sapiens
tccaactgtatatattccca

SEQ ID NO: 5447409 - DNA, 15 bp, Homo sapiens
tccaacttggctgca

SEQ ID NO: 5447410 - DNA, 23 bp, Homo sapiens
tccaacttggctgcaggaatctt

SEQ ID NO: 5447411 - DNA, 19 bp, Homo sapiens
tccaacttgtcacttgcca

SEQ ID NO: 5447412 - DNA, 13 bp, Homo sapiens
tccaactttcaca

SEQ ID NO: 5447413 - DNA, 17 bp, Homo sapiens
tccaacttttcatccag

SEQ ID NO: 5447414 - DNA, 12 bp, Homo sapiens
tccaagaaactt

SEQ ID NO: 5447415 - DNA, 22 bp, Homo sapiens
tccaagaaattttagatattat

SEQ ID NO: 5447416 - DNA, 12 bp, Homo sapiens
tccaagaacata

SEQ ID NO: 5447417 - DNA, 22 bp, Homo sapiens
tccaagaactctaaccagtgta

SEQ ID NO: 5447418 - DNA, 15 bp, Homo sapiens
tccaagaagcccagg

SEQ ID NO: 5447419 - DNA, 19 bp, Homo sapiens
tccaagaagcccaggaaag

SEQ ID NO: 5447420 - DNA, 20 bp, Homo sapiens
tccaagaagcccaggaaagg

SEQ ID NO: 5447421 - DNA, 22 bp, Homo sapiens
tccaagaagccctccttgccac

SEQ ID NO: 5447422 - DNA, 19 bp, Homo sapiens
tccaagaatccacatttct

SEQ ID NO: 5447423 - DNA, 18 bp, Homo sapiens
tccaagaatctatctgct

SEQ ID NO: 5447424 - DNA, 12 bp, Homo sapiens
tccaagaatgct

SEQ ID NO: 5447425 - DNA, 17 bp, Homo sapiens
tccaagaatgctgaaac

SEQ ID NO: 5447426 - DNA, 17 bp, Homo sapiens
tccaagaatggaagcct

SEQ ID NO: 5447427 - DNA, 13 bp, Homo sapiens
tccaagaatgttt

SEQ ID NO: 5447428 - DNA, 14 bp, Homo sapiens
tccaagaatttcta

SEQ ID NO: 5447429 - DNA, 18 bp, Homo sapiens
tccaagacaaactaaact

SEQ ID NO: 5447430 - DNA, 15 bp, Homo sapiens
tccaagacactgtgg

SEQ ID NO: 5447431 - DNA, 13 bp, Homo sapiens
tccaagacagcag

SEQ ID NO: 5447432 - DNA, 19 bp, Homo sapiens
tccaagacagcagcagcct

SEQ ID NO: 5447433 - DNA, 20 bp, Homo sapiens
tccaagacagccatacttcc

SEQ ID NO: 5447434 - DNA, 17 bp, Homo sapiens
tccaagacatgtctgtt

SEQ ID NO: 5447435 - DNA, 20 bp, Homo sapiens
tccaagacatgtctgttcta

SEQ ID NO: 5447436 - DNA, 16 bp, Homo sapiens
tccaagaccaccaggg

SEQ ID NO: 5447437 - DNA, 17 bp, Homo sapiens
tccaagaccaccagggt

SEQ ID NO: 5447438 - DNA, 12 bp, Homo sapiens
tccaagacctgg

SEQ ID NO: 5447439 - DNA, 18 bp, Homo sapiens
tccaagaccttacaacca

SEQ ID NO: 5447440 - DNA, 15 bp, Homo sapiens
tccaagactctagag

SEQ ID NO: 5447441 - DNA, 14 bp, Homo sapiens
tccaagactgaaga

SEQ ID NO: 5447442 - DNA, 17 bp, Homo sapiens
tccaagagaactaaagc

SEQ ID NO: 5447443 - DNA, 12 bp, Homo sapiens
tccaagagaatt

SEQ ID NO: 5447444 - DNA, 12 bp, Homo sapiens
tccaagagacat

SEQ ID NO: 5447445 - DNA, 20 bp, Homo sapiens
tccaagagacatggaagaga

SEQ ID NO: 5447446 - DNA, 14 bp, Homo sapiens
tccaagagcctgag

SEQ ID NO: 5447447 - DNA, 21 bp, Homo sapiens
tccaagagctacataatttag

SEQ ID NO: 5447448 - DNA, 12 bp, Homo sapiens
tccaagagctga

SEQ ID NO: 5447449 - DNA, 19 bp, Homo sapiens
tccaagaggctccctcctg

SEQ ID NO: 5447450 - DNA, 20 bp, Homo sapiens
tccaagaggctccctcctgt

SEQ ID NO: 5447451 - DNA, 22 bp, Homo sapiens
tccaagaggctccctcctgtct

SEQ ID NO: 5447452 - DNA, 14 bp, Homo sapiens
tccaagaggctgta

SEQ ID NO: 5447453 - DNA, 12 bp, Homo sapiens
tccaagagggac

SEQ ID NO: 5447454 - DNA, 16 bp, Homo sapiens
tccaagagggactcca

SEQ ID NO: 5447455 - DNA, 15 bp, Homo sapiens
tccaagagtctaaag

SEQ ID NO: 5447456 - DNA, 18 bp, Homo sapiens
tccaagagtctaaagatg

SEQ ID NO: 5447457 - DNA, 18 bp, Homo sapiens
tccaagataagcctgagc

SEQ ID NO: 5447458 - DNA, 22 bp, Homo sapiens
tccaagatattttaaaatctgt

SEQ ID NO: 5447459 - DNA, 19 bp, Homo sapiens
tccaagatgttctcctgat

SEQ ID NO: 5447460 - DNA, 19 bp, Homo sapiens
tccaagatgtttggacacc

SEQ ID NO: 5447461 - DNA, 12 bp, Homo sapiens
tccaagattcta

SEQ ID NO: 5447462 - DNA, 14 bp, Homo sapiens
tccaagattctaga

SEQ ID NO: 5447463 - DNA, 15 bp, Homo sapiens
tccaagattctagat

SEQ ID NO: 5447464 - DNA, 20 bp, Homo sapiens
tccaagatttaaatgccata

SEQ ID NO: 5447465 - DNA, 15 bp, Homo sapiens
tccaagatttcagaa

SEQ ID NO: 5447466 - DNA, 18 bp, Homo sapiens
tccaagcaaatgttacat

SEQ ID NO: 5447467 - DNA, 19 bp, Homo sapiens
tccaagcaagtagctttcc

SEQ ID NO: 5447468 - DNA, 21 bp, Homo sapiens
tccaagcactagccttcccag

SEQ ID NO: 5447469 - DNA, 14 bp, Homo sapiens
tccaagcagactcc

SEQ ID NO: 5447470 - DNA, 17 bp, Homo sapiens
tccaagcagactccagc

SEQ ID NO: 5447471 - DNA, 20 bp, Homo sapiens
tccaagcagactccagcccc

SEQ ID NO: 5447472 - DNA, 17 bp, Homo sapiens
tccaagcattactttaa

SEQ ID NO: 5447473 - DNA, 20 bp, Homo sapiens
tccaagccaagttttctcaa

SEQ ID NO: 5447474 - DNA, 17 bp, Homo sapiens
tccaagccactgagcaa

SEQ ID NO: 5447475 - DNA, 15 bp, Homo sapiens
tccaagccagcaagc

SEQ ID NO: 5447476 - DNA, 16 bp, Homo sapiens
tccaagccccctggca

SEQ ID NO: 5447477 - DNA, 14 bp, Homo sapiens
tccaagcctccaca

SEQ ID NO: 5447478 - DNA, 15 bp, Homo sapiens
tccaagcctccacag

SEQ ID NO: 5447479 - DNA, 16 bp, Homo sapiens
tccaagcctccacagc

SEQ ID NO: 5447480 - DNA, 17 bp, Homo sapiens
tccaagcctctgtcttt

SEQ ID NO: 5447481 - DNA, 13 bp, Homo sapiens
tccacctgtgaga

SEQ ID NO: 5447482 - DNA, 20 bp, Homo sapiens
tccacctgtgagaaaggaaa

SEQ ID NO: 5447483 - DNA, 15 bp, Homo sapiens
tccacctgtgccctc

SEQ ID NO: 5447484 - DNA, 16 bp, Homo sapiens
tccacctgtgctgctg

SEQ ID NO: 5447485 - DNA, 12 bp, Homo sapiens
tccacctgtggg

SEQ ID NO: 5447486 - DNA, 23 bp, Homo sapiens
tccacctgttactacttcttttt

SEQ ID NO: 5447487 - DNA, 18 bp, Homo sapiens
tccacctgttcaggagct

SEQ ID NO: 5447488 - DNA, 14 bp, Homo sapiens
tccaccttaaatta

SEQ ID NO: 5447489 - DNA, 22 bp, Homo sapiens
tccaccttaaattaaacaattt

SEQ ID NO: 5447490 - DNA, 14 bp, Homo sapiens
tccaccttccaaag

SEQ ID NO: 5447491 - DNA, 20 bp, Homo sapiens
tccaccttccaaagagtgct

SEQ ID NO: 5447492 - DNA, 13 bp, Homo sapiens
tccaccttccagg

SEQ ID NO: 5447493 - DNA, 12 bp, Homo sapiens
tccaccttccca

SEQ ID NO: 5447494 - DNA, 13 bp, Homo sapiens
tccaccttccctt

SEQ ID NO: 5447495 - DNA, 22 bp, Homo sapiens
tccaccttcccttctacaagga

SEQ ID NO: 5447496 - DNA, 17 bp, Homo sapiens
tccaccttcctgcccag

SEQ ID NO: 5447497 - DNA, 15 bp, Homo sapiens
tccaccttctcacat

SEQ ID NO: 5447498 - DNA, 16 bp, Homo sapiens
tccaccttctgccaag

SEQ ID NO: 5447499 - DNA, 18 bp, Homo sapiens
tccaccttctgccaaggc

SEQ ID NO: 5447500 - DNA, 20 bp, Homo sapiens
tccaccttgaacctgtcacc

SEQ ID NO: 5447501 - DNA, 13 bp, Homo sapiens
tccaccttgctct

SEQ ID NO: 5447502 - DNA, 14 bp, Homo sapiens
tccaccttggctct

SEQ ID NO: 5447503 - DNA, 23 bp, Homo sapiens
tccaccttggctgggaagactat

SEQ ID NO: 5447504 - DNA, 17 bp, Homo sapiens
tccacctttcagcccac

SEQ ID NO: 5447505 - DNA, 18 bp, Homo sapiens
tccacctttcagcccacg

SEQ ID NO: 5447506 - DNA, 14 bp, Homo sapiens
tccacctttcccaa

SEQ ID NO: 5447507 - DNA, 21 bp, Homo sapiens
tccacctttctctgttttatg

SEQ ID NO: 5447508 - DNA, 17 bp, Homo sapiens
tccaccttttaagttaa

SEQ ID NO: 5447509 - DNA, 13 bp, Homo sapiens
tccaccttttgtt

SEQ ID NO: 5447510 - DNA, 21 bp, Homo sapiens
tccaccttttgtttttccagt

SEQ ID NO: 5447511 - DNA, 20 bp, Homo sapiens
tccacgaagccttaagccat

SEQ ID NO: 5447512 - DNA, 22 bp, Homo sapiens
tccacgagctgtttactaggga

SEQ ID NO: 5447513 - DNA, 18 bp, Homo sapiens
tccacgatcctgccaccc

SEQ ID NO: 5447514 - DNA, 16 bp, Homo sapiens
tccacgatgcctttga

SEQ ID NO: 5447515 - DNA, 23 bp, Homo sapiens
tccacgcaaggctgtgctcttcc

SEQ ID NO: 5447516 - DNA, 15 bp, Homo sapiens
tccacgcacacatgg

SEQ ID NO: 5447517 - DNA, 15 bp, Homo sapiens
tccacgcagcaccct

SEQ ID NO: 5447518 - DNA, 19 bp, Homo sapiens
tccacgcagctggcagaga

SEQ ID NO: 5447519 - DNA, 14 bp, Homo sapiens
tccacgccactgcc

SEQ ID NO: 5447520 - DNA, 17 bp, Homo sapiens
tccacgccactgcctcc

SEQ ID NO: 5447521 - DNA, 14 bp, Homo sapiens
tccacgcccaccag

SEQ ID NO: 5447522 - DNA, 15 bp, Homo sapiens
tccacgcccaccagc

SEQ ID NO: 5447523 - DNA, 17 bp, Homo sapiens
tccacgcgcttcgactt

SEQ ID NO: 5447524 - DNA, 21 bp, Homo sapiens
tccacgcggccacctcaccct

SEQ ID NO: 5447525 - DNA, 15 bp, Homo sapiens
tccacgcgtgccgtg

SEQ ID NO: 5447526 - DNA, 16 bp, Homo sapiens
tccacgctgggcctag

SEQ ID NO: 5447527 - DNA, 15 bp, Homo sapiens
tccacgctgtctcca

SEQ ID NO: 5447528 - DNA, 16 bp, Homo sapiens
tccacgctgtctccag

SEQ ID NO: 5447529 - DNA, 18 bp, Homo sapiens
tccacgcttagggtctgt

SEQ ID NO: 5447530 - DNA, 16 bp, Homo sapiens
tccacggaaacagaac

SEQ ID NO: 5447531 - DNA, 17 bp, Homo sapiens
tccacggaaacagaact

SEQ ID NO: 5447532 - DNA, 13 bp, Homo sapiens
tccacggactcaa

SEQ ID NO: 5447533 - DNA, 21 bp, Homo sapiens
tccacggagccactcctctga

SEQ ID NO: 5447534 - DNA, 22 bp, Homo sapiens
tccacggcatcgcatccgtcct

SEQ ID NO: 5447535 - DNA, 23 bp, Homo sapiens
tccacggcctgcccagtcgaccc

SEQ ID NO: 5447536 - DNA, 20 bp, Homo sapiens
tccacggtccgcggcctgca

SEQ ID NO: 5447537 - DNA, 18 bp, Homo sapiens
tccacggtctgttcttga

SEQ ID NO: 5447538 - DNA, 23 bp, Homo sapiens
tccacggtgcgtggctgtggcac

SEQ ID NO: 5447539 - DNA, 15 bp, Homo sapiens
tccacgtaattcaat

SEQ ID NO: 5447540 - DNA, 16 bp, Homo sapiens
tccacgtaattcaatt

SEQ ID NO: 5447541 - DNA, 15 bp, Homo sapiens
tccacgtactgcagc

SEQ ID NO: 5447542 - DNA, 22 bp, Homo sapiens
tccacgtacttaatttacttaa

SEQ ID NO: 5447543 - DNA, 17 bp, Homo sapiens
tccacgtattccccttc

SEQ ID NO: 5447544 - DNA, 18 bp, Homo sapiens
tccacgtattccccttcc

SEQ ID NO: 5447545 - DNA, 16 bp, Homo sapiens
tccacgtccccctggg

SEQ ID NO: 5447546 - DNA, 17 bp, Homo sapiens
tccacgtccccctgggg

SEQ ID NO: 5447547 - DNA, 20 bp, Homo sapiens
tccacgtcctccaagctcac

SEQ ID NO: 5447548 - DNA, 19 bp, Homo sapiens
tccacgtctttcctgctac

SEQ ID NO: 5447549 - DNA, 13 bp, Homo sapiens
tccacgtggcctc

SEQ ID NO: 5447550 - DNA, 20 bp, Homo sapiens
tccacgtgtccgtccaccct

SEQ ID NO: 5447551 - DNA, 14 bp, Homo sapiens
tccacgtgtgtgtg

SEQ ID NO: 5447552 - DNA, 14 bp, Homo sapiens
tccactaaaaatat

SEQ ID NO: 5447553 - DNA, 21 bp, Homo sapiens
tccactaaatgagctcctgcg

SEQ ID NO: 5447554 - DNA, 19 bp, Homo sapiens
tccactaatattcagtcct

SEQ ID NO: 5447555 - DNA, 17 bp, Homo sapiens
tccactacacctggctg

SEQ ID NO: 5447556 - DNA, 18 bp, Homo sapiens
tccactacacctggctga

SEQ ID NO: 5447557 - DNA, 21 bp, Homo sapiens
tccactaccctccctcgcatc

SEQ ID NO: 5447558 - DNA, 22 bp, Homo sapiens
tccactactctcttcctccact

SEQ ID NO: 5447559 - DNA, 18 bp, Homo sapiens
tccactactgtgtagact

SEQ ID NO: 5447560 - DNA, 21 bp, Homo sapiens
tccactataattttacaaagt

SEQ ID NO: 5447561 - DNA, 23 bp, Homo sapiens
tccactatcccaatcaaagaatt

SEQ ID NO: 5447562 - DNA, 19 bp, Homo sapiens
tccactcaaagagggtgag

SEQ ID NO: 5447563 - DNA, 16 bp, Homo sapiens
tccactcactccagcc

SEQ ID NO: 5447564 - DNA, 21 bp, Homo sapiens
tccactcactccagcccaaca

SEQ ID NO: 5447565 - DNA, 14 bp, Homo sapiens
tccactcactgcat

SEQ ID NO: 5447566 - DNA, 15 bp, Homo sapiens
tccactcactgcatt

SEQ ID NO: 5447567 - DNA, 13 bp, Homo sapiens
tccactcactgct

SEQ ID NO: 5447568 - DNA, 12 bp, Homo sapiens
tccactcagcac

SEQ ID NO: 5447569 - DNA, 17 bp, Homo sapiens
tccactcagcactctgg

SEQ ID NO: 5447570 - DNA, 14 bp, Homo sapiens
tccactcagcttgg

SEQ ID NO: 5447571 - DNA, 15 bp, Homo sapiens
tccactcagggctgg

SEQ ID NO: 5447572 - DNA, 16 bp, Homo sapiens
tccactcagggctggc

SEQ ID NO: 5447573 - DNA, 22 bp, Homo sapiens
tccactcagggctggcccgggg

SEQ ID NO: 5447574 - DNA, 23 bp, Homo sapiens
tccactcagggcttctcctctgc

SEQ ID NO: 5447575 - DNA, 17 bp, Homo sapiens
tccactcaggtctgttt

SEQ ID NO: 5447576 - DNA, 15 bp, Homo sapiens
tccactcagttgcaa

SEQ ID NO: 5447577 - DNA, 16 bp, Homo sapiens
tccactcatataaaag

SEQ ID NO: 5447578 - DNA, 14 bp, Homo sapiens
tccactcatgtgac

SEQ ID NO: 5447579 - DNA, 12 bp, Homo sapiens
tccactccaagg

SEQ ID NO: 5447580 - DNA, 13 bp, Homo sapiens
tccactccactgc

SEQ ID NO: 5447581 - DNA, 14 bp, Homo sapiens
tccactccactgcc

SEQ ID NO: 5447582 - DNA, 18 bp, Homo sapiens
tccactccagctctgaga

SEQ ID NO: 5447583 - DNA, 14 bp, Homo sapiens
tccactcccaagcc

SEQ ID NO: 5447584 - DNA, 18 bp, Homo sapiens
tccactcccaagccacta

SEQ ID NO: 5447585 - DNA, 12 bp, Homo sapiens
tccactcccact

SEQ ID NO: 5447586 - DNA, 17 bp, Homo sapiens
tccactcccagcagctc

SEQ ID NO: 5447587 - DNA, 15 bp, Homo sapiens
tccactcccagtgct

SEQ ID NO: 5447588 - DNA, 16 bp, Homo sapiens
tccactcccccacctg

SEQ ID NO: 5447589 - DNA, 13 bp, Homo sapiens
tccactcccctca

SEQ ID NO: 5447590 - DNA, 14 bp, Homo sapiens
tccactcccctcat

SEQ ID NO: 5447591 - DNA, 16 bp, Homo sapiens
tccactccctgtctga

SEQ ID NO: 5447592 - DNA, 12 bp, Homo sapiens
tccactcctcca

SEQ ID NO: 5447593 - DNA, 12 bp, Homo sapiens
tccactcctccc

SEQ ID NO: 5447594 - DNA, 18 bp, Homo sapiens
tccactcctcccaactct

SEQ ID NO: 5447595 - DNA, 21 bp, Homo sapiens
tccactcctcctagccaccca

SEQ ID NO: 5447596 - DNA, 21 bp, Homo sapiens
tccactcctcctcactaaaaa

SEQ ID NO: 5447597 - DNA, 12 bp, Homo sapiens
tccactcctctc

SEQ ID NO: 5447598 - DNA, 15 bp, Homo sapiens
tccactcctgacccc

SEQ ID NO: 5447599 - DNA, 15 bp, Homo sapiens
tccactccttccaga

SEQ ID NO: 5447600 - DNA, 18 bp, Homo sapiens
tccactccttccatctct

SEQ ID NO: 5447601 - DNA, 12 bp, Homo sapiens
tccactccttct

SEQ ID NO: 5447602 - DNA, 18 bp, Homo sapiens
tccactcgacccagaatg

SEQ ID NO: 5447603 - DNA, 19 bp, Homo sapiens
tccactcgatgatgcttct

SEQ ID NO: 5447604 - DNA, 15 bp, Homo sapiens
tccactcgtgtgttt

SEQ ID NO: 5447605 - DNA, 21 bp, Homo sapiens
tccactctaccctcccacccc

SEQ ID NO: 5447606 - DNA, 12 bp, Homo sapiens
tccactctcccc

SEQ ID NO: 5447607 - DNA, 14 bp, Homo sapiens
tccactctccccca

SEQ ID NO: 5447608 - DNA, 17 bp, Homo sapiens
tccactctccttgctac

SEQ ID NO: 5447609 - DNA, 19 bp, Homo sapiens
tccactctccttgctaccc

SEQ ID NO: 5447610 - DNA, 21 bp, Homo sapiens
tccactctcggggcccttggg

SEQ ID NO: 5447611 - DNA, 17 bp, Homo sapiens
tccactctgaggtctca

SEQ ID NO: 5447612 - DNA, 19 bp, Homo sapiens
tccactctgatagaattat

SEQ ID NO: 5447613 - DNA, 14 bp, Homo sapiens
tccactctgcttct

SEQ ID NO: 5447614 - DNA, 15 bp, Homo sapiens
tccactctgcttctc

SEQ ID NO: 5447615 - DNA, 23 bp, Homo sapiens
tccactctgcttctctgacttct

SEQ ID NO: 5447616 - DNA, 24 bp, Homo sapiens
tccactctgcttctctgacttctg

SEQ ID NO: 5447617 - DNA, 19 bp, Homo sapiens
tccactctgtatctatgca

SEQ ID NO: 5447618 - DNA, 15 bp, Homo sapiens
tccactcttctctcc

SEQ ID NO: 5447619 - DNA, 19 bp, Homo sapiens
tccactcttgatctctctt

SEQ ID NO: 5447620 - DNA, 15 bp, Homo sapiens
tccactcttgttcaa

SEQ ID NO: 5447621 - DNA, 15 bp, Homo sapiens
tccactctttctttc

SEQ ID NO: 5447622 - DNA, 15 bp, Homo sapiens
tccactgaacaaaac

SEQ ID NO: 5447623 - DNA, 20 bp, Homo sapiens
tccactgacaaacgtcccca

SEQ ID NO: 5447624 - DNA, 18 bp, Homo sapiens
tccactgacaacgaaagt

SEQ ID NO: 5447625 - DNA, 20 bp, Homo sapiens
tccactgacctggaagagct

SEQ ID NO: 5447626 - DNA, 22 bp, Homo sapiens
tccactgacctggttgtccagg

SEQ ID NO: 5447627 - DNA, 18 bp, Homo sapiens
tccactgagcaagcaagg

SEQ ID NO: 5447628 - DNA, 15 bp, Homo sapiens
tccactgataagact

SEQ ID NO: 5447629 - DNA, 18 bp, Homo sapiens
tccactgcaaataaagcc

SEQ ID NO: 5447630 - DNA, 21 bp, Homo sapiens
tccactgcaaataaagccttt

SEQ ID NO: 5447631 - DNA, 22 bp, Homo sapiens
tccactgcaaataaagcctttt

SEQ ID NO: 5447632 - DNA, 17 bp, Homo sapiens
tccactgccctggcagc

SEQ ID NO: 5447633 - DNA, 16 bp, Homo sapiens
tccactgcctctgcct

SEQ ID NO: 5447634 - DNA, 18 bp, Homo sapiens
tccactgcctctgcctta

SEQ ID NO: 5447635 - DNA, 15 bp, Homo sapiens
tccactgccttcgat

SEQ ID NO: 5447636 - DNA, 14 bp, Homo sapiens
tccactgctggaca

SEQ ID NO: 5447637 - DNA, 13 bp, Homo sapiens
tccactggacaga

SEQ ID NO: 5447638 - DNA, 15 bp, Homo sapiens
tccactggacagacc

SEQ ID NO: 5447639 - DNA, 19 bp, Homo sapiens
tccactggacagacccagg

SEQ ID NO: 5447640 - DNA, 23 bp, Homo sapiens
tccactggacagacccaggtctt

SEQ ID NO: 5447641 - DNA, 14 bp, Homo sapiens
tccactggaccctt

SEQ ID NO: 5447642 - DNA, 16 bp, Homo sapiens
tccactggacttgagc

SEQ ID NO: 5447643 - DNA, 12 bp, Homo sapiens
tccactggcctg

SEQ ID NO: 5447644 - DNA, 23 bp, Homo sapiens
tccactggcttttgcctgtaaga

SEQ ID NO: 5447645 - DNA, 22 bp, Homo sapiens
tccactggggaggaatcctgga

SEQ ID NO: 5447646 - DNA, 22 bp, Homo sapiens
tccactggttcttcttggtctc

SEQ ID NO: 5447647 - DNA, 19 bp, Homo sapiens
tccactgtaattaaaacta

SEQ ID NO: 5447648 - DNA, 11 bp, Homo sapiens
tccactgtcct

SEQ ID NO: 5447649 - DNA, 13 bp, Homo sapiens
tccactgtcctcc

SEQ ID NO: 5447650 - DNA, 19 bp, Homo sapiens
tccactgtcttgcctgcca

SEQ ID NO: 5447651 - DNA, 12 bp, Homo sapiens
tccactgtgacg

SEQ ID NO: 5447652 - DNA, 22 bp, Homo sapiens
tccactgtgccatgtgccaggt

SEQ ID NO: 5447653 - DNA, 12 bp, Homo sapiens
tccactgtgcta

SEQ ID NO: 5447654 - DNA, 13 bp, Homo sapiens
tccactgtggcac

SEQ ID NO: 5447655 - DNA, 12 bp, Homo sapiens
tccactgtgtat

SEQ ID NO: 5447656 - DNA, 18 bp, Homo sapiens
tccactgtgtgttgacac

SEQ ID NO: 5447657 - DNA, 18 bp, Homo sapiens
tccactgttaaaataaag

SEQ ID NO: 5447658 - DNA, 18 bp, Homo sapiens
tccactgttagcacattg

SEQ ID NO: 5447659 - DNA, 23 bp, Homo sapiens
tccactgttgggtgggtgggccc

SEQ ID NO: 5447660 - DNA, 19 bp, Homo sapiens
tcccacacttgtgccagcc

SEQ ID NO: 5447661 - DNA, 15 bp, Homo sapiens
tcccacagacctgca

SEQ ID NO: 5447662 - DNA, 19 bp, Homo sapiens
tcccacagacctgcagtga

SEQ ID NO: 5447663 - DNA, 19 bp, Homo sapiens
tcccacagagtgctggact

SEQ ID NO: 5447664 - DNA, 20 bp, Homo sapiens
tcccacagagtgctggactg

SEQ ID NO: 5447665 - DNA, 21 bp, Homo sapiens
tcccacagagtgctggactgt

SEQ ID NO: 5447666 - DNA, 13 bp, Homo sapiens
tcccacagccagt

SEQ ID NO: 5447667 - DNA, 17 bp, Homo sapiens
tcccacagccccttgct

SEQ ID NO: 5447668 - DNA, 16 bp, Homo sapiens
tcccacagccctgaga

SEQ ID NO: 5447669 - DNA, 14 bp, Homo sapiens
tcccacaggagggc

SEQ ID NO: 5447670 - DNA, 13 bp, Homo sapiens
tcccacaggcagc

SEQ ID NO: 5447671 - DNA, 21 bp, Homo sapiens
tcccacaggcccttcctctcc

SEQ ID NO: 5447672 - DNA, 22 bp, Homo sapiens
tcccacaggcccttcctctcca

SEQ ID NO: 5447673 - DNA, 12 bp, Homo sapiens
tcccacagggac

SEQ ID NO: 5447674 - DNA, 14 bp, Homo sapiens
tcccacagggacca

SEQ ID NO: 5447675 - DNA, 20 bp, Homo sapiens
tcccacagtctctccctggg

SEQ ID NO: 5447676 - DNA, 21 bp, Homo sapiens
tcccacagtctctccctgggg

SEQ ID NO: 5447677 - DNA, 23 bp, Homo sapiens
tcccacagtgactcgggctcctg

SEQ ID NO: 5447678 - DNA, 15 bp, Homo sapiens
tcccacagtgctggg

SEQ ID NO: 5447679 - DNA, 19 bp, Homo sapiens
tcccacatccaactccagc

SEQ ID NO: 5447680 - DNA, 20 bp, Homo sapiens
tcccacatccaactccagca

SEQ ID NO: 5447681 - DNA, 15 bp, Homo sapiens
tcccacatcccactg

SEQ ID NO: 5447682 - DNA, 13 bp, Homo sapiens
tcccacatgaggc

SEQ ID NO: 5447683 - DNA, 14 bp, Homo sapiens
tcccacatgaggcc

SEQ ID NO: 5447684 - DNA, 23 bp, Homo sapiens
tcccacatggccatcttctttct

SEQ ID NO: 5447685 - DNA, 16 bp, Homo sapiens
tcccacatgggcccag

SEQ ID NO: 5447686 - DNA, 19 bp, Homo sapiens
tcccacatgggcccaggcc

SEQ ID NO: 5447687 - DNA, 22 bp, Homo sapiens
tcccacatgggcccaggcctca

SEQ ID NO: 5447688 - DNA, 19 bp, Homo sapiens
tcccacattaaagaagacc

SEQ ID NO: 5447689 - DNA, 16 bp, Homo sapiens
tcccacattccaaaag

SEQ ID NO: 5447690 - DNA, 19 bp, Homo sapiens
tcccacattcggaccctgc

SEQ ID NO: 5447691 - DNA, 23 bp, Homo sapiens
tcccacattttagaataccccac

SEQ ID NO: 5447692 - DNA, 21 bp, Homo sapiens
tcccaccaaatcatcctgaat

SEQ ID NO: 5447693 - DNA, 18 bp, Homo sapiens
tcccaccaacctccagtg

SEQ ID NO: 5447694 - DNA, 17 bp, Homo sapiens
tcccaccaactctctct

SEQ ID NO: 5447695 - DNA, 21 bp, Homo sapiens
tcccaccaactctctctgccc

SEQ ID NO: 5447696 - DNA, 14 bp, Homo sapiens
tcccaccaactctg

SEQ ID NO: 5447697 - DNA, 17 bp, Homo sapiens
tcccaccacagcaggtg

SEQ ID NO: 5447698 - DNA, 23 bp, Homo sapiens
tcccaccacagtccctcacctcc

SEQ ID NO: 5447699 - DNA, 21 bp, Homo sapiens
tcccaccaccctcccaccatg

SEQ ID NO: 5447700 - DNA, 21 bp, Homo sapiens
tcccaccaccttggactcctc

SEQ ID NO: 5447701 - DNA, 16 bp, Homo sapiens
tcccaccactccctgg

SEQ ID NO: 5447702 - DNA, 21 bp, Homo sapiens
tcccaccagaacgcaccccac

SEQ ID NO: 5447703 - DNA, 16 bp, Homo sapiens
tcccaccagagccggg

SEQ ID NO: 5447704 - DNA, 14 bp, Homo sapiens
tcccaccagcatgt

SEQ ID NO: 5447705 - DNA, 14 bp, Homo sapiens
tcccaccagcctcc

SEQ ID NO: 5447706 - DNA, 15 bp, Homo sapiens
tcccaccagctccca

SEQ ID NO: 5447707 - DNA, 15 bp, Homo sapiens
tcccaccagcttcac

SEQ ID NO: 5447708 - DNA, 22 bp, Homo sapiens
tcccaccaggctgctcagggct

SEQ ID NO: 5447709 - DNA, 11 bp, Homo sapiens
tcccaccaggg

SEQ ID NO: 5447710 - DNA, 20 bp, Homo sapiens
tcccaccataatccctgtct

SEQ ID NO: 5447711 - DNA, 14 bp, Homo sapiens
tcccaccattcctg

SEQ ID NO: 5447712 - DNA, 17 bp, Homo sapiens
tcccacccaacagctca

SEQ ID NO: 5447713 - DNA, 19 bp, Homo sapiens
tcccacccacacagctgcc

SEQ ID NO: 5447714 - DNA, 22 bp, Homo sapiens
tcccacccacacagctgcccta

SEQ ID NO: 5447715 - DNA, 16 bp, Homo sapiens
tcccacccacatgtga

SEQ ID NO: 5447716 - DNA, 15 bp, Homo sapiens
tcccacccagcctgg

SEQ ID NO: 5447717 - DNA, 14 bp, Homo sapiens
tcccacccaggaag

SEQ ID NO: 5447718 - DNA, 13 bp, Homo sapiens
tcccacccatctc

SEQ ID NO: 5447719 - DNA, 16 bp, Homo sapiens
tcccacccatctccag

SEQ ID NO: 5447720 - DNA, 21 bp, Homo sapiens
tcccaccccaacctgctctcc

SEQ ID NO: 5447721 - DNA, 14 bp, Homo sapiens
tcccaccccacaca

SEQ ID NO: 5447722 - DNA, 12 bp, Homo sapiens
tcccaccccacc

SEQ ID NO: 5447723 - DNA, 18 bp, Homo sapiens
tcccaccccacccccttc

SEQ ID NO: 5447724 - DNA, 22 bp, Homo sapiens
tcccaccccacccccttcagtg

SEQ ID NO: 5447725 - DNA, 15 bp, Homo sapiens
tcccaccccacctct

SEQ ID NO: 5447726 - DNA, 23 bp, Homo sapiens
tcccaccccagaaatcactgtga

SEQ ID NO: 5447727 - DNA, 18 bp, Homo sapiens
tcccaccccatcctccag

SEQ ID NO: 5447728 - DNA, 20 bp, Homo sapiens
tcccaccccattttctgtgg

SEQ ID NO: 5447729 - DNA, 21 bp, Homo sapiens
tcccacccccaacccccagag

SEQ ID NO: 5447730 - DNA, 22 bp, Homo sapiens
tcccacccccaacccccagagg

SEQ ID NO: 5447731 - DNA, 18 bp, Homo sapiens
tcccacccccacccccag

SEQ ID NO: 5447732 - DNA, 20 bp, Homo sapiens
tcccacccccacccccagct

SEQ ID NO: 5447733 - DNA, 22 bp, Homo sapiens
tcccacccccacccccagctca

SEQ ID NO: 5447734 - DNA, 18 bp, Homo sapiens
tcccacccccgaccctgc

SEQ ID NO: 5447735 - DNA, 14 bp, Homo sapiens
tcccaccccctcct

SEQ ID NO: 5447736 - DNA, 15 bp, Homo sapiens
tcccaccccctcctc

SEQ ID NO: 5447737 - DNA, 22 bp, Homo sapiens
tcccaccccctcctcccccagt

SEQ ID NO: 5447738 - DNA, 21 bp, Homo sapiens
tcccacccccttctctgctcc

SEQ ID NO: 5447739 - DNA, 15 bp, Homo sapiens
tcccaccccgccgtt

SEQ ID NO: 5447740 - DNA, 21 bp, Homo sapiens
tcccaccccgccgttccctgc

SEQ ID NO: 5447741 - DNA, 17 bp, Homo sapiens
tcccaccccggcctcca

SEQ ID NO: 5447742 - DNA, 13 bp, Homo sapiens
tcccacccctaca

SEQ ID NO: 5447743 - DNA, 19 bp, Homo sapiens
tcccacccctacacacaca

SEQ ID NO: 5447744 - DNA, 14 bp, Homo sapiens
tcccacccctagcc

SEQ ID NO: 5447745 - DNA, 20 bp, Homo sapiens
tcccacccctagccaccagt

SEQ ID NO: 5447746 - DNA, 23 bp, Homo sapiens
tcccacccctagccaccagtgtc

SEQ ID NO: 5447747 - DNA, 18 bp, Homo sapiens
tcccacccctcataccta

SEQ ID NO: 5447748 - DNA, 21 bp, Homo sapiens
tcccacccctccccactcatc

SEQ ID NO: 5447749 - DNA, 19 bp, Homo sapiens
tcccaccccttggcccctc

SEQ ID NO: 5447750 - DNA, 21 bp, Homo sapiens
tcccaccccttggcccctcac

SEQ ID NO: 5447751 - DNA, 15 bp, Homo sapiens
tcccacccgatgctg

SEQ ID NO: 5447752 - DNA, 17 bp, Homo sapiens
tcccaccctccacctct

SEQ ID NO: 5447753 - DNA, 13 bp, Homo sapiens
tcccaccctcctg

SEQ ID NO: 5447754 - DNA, 22 bp, Homo sapiens
tcccaccctgacccccttcctg

SEQ ID NO: 5447755 - DNA, 21 bp, Homo sapiens
tcccaccctgcgggccagggt

SEQ ID NO: 5447756 - DNA, 22 bp, Homo sapiens
tcccaccctgcgggccagggtc

SEQ ID NO: 5447757 - DNA, 22 bp, Homo sapiens
tcccaccgcagcgtcccccgcc

SEQ ID NO: 5447758 - DNA, 22 bp, Homo sapiens
tcccaccgcccccaccccttcc

SEQ ID NO: 5447759 - DNA, 18 bp, Homo sapiens
tcccaccgggagcctccc

SEQ ID NO: 5447760 - DNA, 16 bp, Homo sapiens
tcccaccggtgccaaa

SEQ ID NO: 5447761 - DNA, 23 bp, Homo sapiens
tcccaccggtgccaaacccagcc

SEQ ID NO: 5447762 - DNA, 21 bp, Homo sapiens
tcccaccggttgcttctggga

SEQ ID NO: 5447763 - DNA, 20 bp, Homo sapiens
tcccacctactgcactttcc

SEQ ID NO: 5447764 - DNA, 17 bp, Homo sapiens
tcccacctagcagcacc

SEQ ID NO: 5447765 - DNA, 15 bp, Homo sapiens
tcccacctagcccag

SEQ ID NO: 5447766 - DNA, 20 bp, Homo sapiens
tcccacctagtgccccagac

SEQ ID NO: 5447767 - DNA, 13 bp, Homo sapiens
tcccacctcaccc

SEQ ID NO: 5447768 - DNA, 14 bp, Homo sapiens
tcccacctcagcct

SEQ ID NO: 5447769 - DNA, 18 bp, Homo sapiens
tcccacctcagcctcccg

SEQ ID NO: 5447770 - DNA, 19 bp, Homo sapiens
tcccacctcagcctcctga

SEQ ID NO: 5447771 - DNA, 22 bp, Homo sapiens
tcccacctccagcccgggagcc

SEQ ID NO: 5447772 - DNA, 14 bp, Homo sapiens
tcccacctccagtc

SEQ ID NO: 5447773 - DNA, 17 bp, Homo sapiens
tcccacctccagtcccc

SEQ ID NO: 5447774 - DNA, 15 bp, Homo sapiens
tcccacctccccttg

SEQ ID NO: 5447775 - DNA, 18 bp, Homo sapiens
tcccacctccccttgggc

SEQ ID NO: 5447776 - DNA, 14 bp, Homo sapiens
tcccacctccctgc

SEQ ID NO: 5447777 - DNA, 17 bp, Homo sapiens
tcccacctccctgccca

SEQ ID NO: 5447778 - DNA, 15 bp, Homo sapiens
tcccacctcccttcc

SEQ ID NO: 5447779 - DNA, 16 bp, Homo sapiens
tcccacctcccttccc

SEQ ID NO: 5447780 - DNA, 21 bp, Homo sapiens
tcccacctcgcggcgcagccc

SEQ ID NO: 5447781 - DNA, 17 bp, Homo sapiens
tcccacctcggacacca

SEQ ID NO: 5447782 - DNA, 20 bp, Homo sapiens
tcccacctctctcactcctt

SEQ ID NO: 5447783 - DNA, 11 bp, Homo sapiens
tcccacctctg

SEQ ID NO: 5447784 - DNA, 21 bp, Homo sapiens
tcccacctctgtgacctcagg

SEQ ID NO: 5447785 - DNA, 13 bp, Homo sapiens
tcccacctggctc

SEQ ID NO: 5447786 - DNA, 14 bp, Homo sapiens
tcccacctggctcc

SEQ ID NO: 5447787 - DNA, 17 bp, Homo sapiens
tcccacctggctccccc

SEQ ID NO: 5447788 - DNA, 15 bp, Homo sapiens
tcccacctggctctg

SEQ ID NO: 5447789 - DNA, 16 bp, Homo sapiens
tcccacctggctctgt

SEQ ID NO: 5447790 - DNA, 15 bp, Homo sapiens
tcccacctgtcaacc

SEQ ID NO: 5447791 - DNA, 12 bp, Homo sapiens
tcccacctgtgc

SEQ ID NO: 5447792 - DNA, 12 bp, Homo sapiens
tcccaccttccc

SEQ ID NO: 5447793 - DNA, 15 bp, Homo sapiens
tcccaccttggcctc

SEQ ID NO: 5447794 - DNA, 19 bp, Homo sapiens
tcccaccttggctgcaggg

SEQ ID NO: 5447795 - DNA, 15 bp, Homo sapiens
tcccacgaatttgct

SEQ ID NO: 5447796 - DNA, 22 bp, Homo sapiens
tcccacgactgttgtacaagct

SEQ ID NO: 5447797 - DNA, 18 bp, Homo sapiens
tcccacgccctcctccct

SEQ ID NO: 5447798 - DNA, 20 bp, Homo sapiens
tcccacgccctcctccctcc

SEQ ID NO: 5447799 - DNA, 13 bp, Homo sapiens
tcccacgctggga

SEQ ID NO: 5447800 - DNA, 21 bp, Homo sapiens
tcccacgctgggacacagacc

SEQ ID NO: 5447801 - DNA, 20 bp, Homo sapiens
tcccacggaaaatgccaatc

SEQ ID NO: 5447802 - DNA, 23 bp, Homo sapiens
tcccacggaggagttttggcagc

SEQ ID NO: 5447803 - DNA, 15 bp, Homo sapiens
tcccacggcctttct

SEQ ID NO: 5447804 - DNA, 17 bp, Homo sapiens
tcccacggcctttctag

SEQ ID NO: 5447805 - DNA, 13 bp, Homo sapiens
tcccacggctctg

SEQ ID NO: 5447806 - DNA, 18 bp, Homo sapiens
tcccacggctctgtgccc

SEQ ID NO: 5447807 - DNA, 20 bp, Homo sapiens
tcccacggggaccactgggc

SEQ ID NO: 5447808 - DNA, 22 bp, Homo sapiens
tcccacggggaccactgggccc

SEQ ID NO: 5447809 - DNA, 19 bp, Homo sapiens
tcccacgtagcaaatcgta

SEQ ID NO: 5447810 - DNA, 15 bp, Homo sapiens
tcccacgtctggcca

SEQ ID NO: 5447811 - DNA, 19 bp, Homo sapiens
tcccacgtgcacagcttcc

SEQ ID NO: 5447812 - DNA, 14 bp, Homo sapiens
tcccacgtgggaga

SEQ ID NO: 5447813 - DNA, 14 bp, Homo sapiens
tcccacgtgtcttc

SEQ ID NO: 5447814 - DNA, 15 bp, Homo sapiens
tcccacgtgtcttcc

SEQ ID NO: 5447815 - DNA, 20 bp, Homo sapiens
tcccacgttgacaccaagaa

SEQ ID NO: 5447816 - DNA, 22 bp, Homo sapiens
tcccacgttgacaccaagaaac

SEQ ID NO: 5447817 - DNA, 14 bp, Homo sapiens
tcccactatctggg

SEQ ID NO: 5447818 - DNA, 20 bp, Homo sapiens
tcccactatctgggtgcatg

SEQ ID NO: 5447819 - DNA, 21 bp, Homo sapiens
tcccactcaccagccctagct

SEQ ID NO: 5447820 - DNA, 23 bp, Homo sapiens
tcccactcaccccggcagacgcc

SEQ ID NO: 5447821 - DNA, 12 bp, Homo sapiens
tcccactcacct

SEQ ID NO: 5447822 - DNA, 21 bp, Homo sapiens
tcccactcagaactctccagg

SEQ ID NO: 5447823 - DNA, 23 bp, Homo sapiens
tcccactcatgttgttcccacac

SEQ ID NO: 5447824 - DNA, 16 bp, Homo sapiens
tcccactccaagccag

SEQ ID NO: 5447825 - DNA, 19 bp, Homo sapiens
tcccactccaagccagcaa

SEQ ID NO: 5447826 - DNA, 17 bp, Homo sapiens
tcccactccaagcccag

SEQ ID NO: 5447827 - DNA, 12 bp, Homo sapiens
tcccactccagc

SEQ ID NO: 5447828 - DNA, 13 bp, Homo sapiens
tcccactccagct

SEQ ID NO: 5447829 - DNA, 18 bp, Homo sapiens
tcccactcccatctcctt

SEQ ID NO: 5447830 - DNA, 18 bp, Homo sapiens
tcccactcccatggctct

SEQ ID NO: 5447831 - DNA, 14 bp, Homo sapiens
tcccactccctggg

SEQ ID NO: 5447832 - DNA, 15 bp, Homo sapiens
tcccactccctgggg

SEQ ID NO: 5447833 - DNA, 13 bp, Homo sapiens
tcccactctgggc

SEQ ID NO: 5447834 - DNA, 23 bp, Homo sapiens
tcccactctgggcaaagcccctc

SEQ ID NO: 5447835 - DNA, 15 bp, Homo sapiens
tcccactctttgaat

SEQ ID NO: 5447836 - DNA, 19 bp, Homo sapiens
tcccactgatatcacgggc

SEQ ID NO: 5447837 - DNA, 14 bp, Homo sapiens
tcccaggtagctgg

SEQ ID NO: 5447838 - DNA, 16 bp, Homo sapiens
tcccaggtgagaattc

SEQ ID NO: 5447839 - DNA, 21 bp, Homo sapiens
tcccaggtggattttgtggag

SEQ ID NO: 5447840 - DNA, 15 bp, Homo sapiens
tcccaggtgttaaca

SEQ ID NO: 5447841 - DNA, 21 bp, Homo sapiens
tcccaggtgttaacattccaa

SEQ ID NO: 5447842 - DNA, 16 bp, Homo sapiens
tcccaggttcccccag

SEQ ID NO: 5447843 - DNA, 20 bp, Homo sapiens
tcccaggttcccccagcaag

SEQ ID NO: 5447844 - DNA, 17 bp, Homo sapiens
tcccaggttggaggccc

SEQ ID NO: 5447845 - DNA, 16 bp, Homo sapiens
tcccaggttggctctg

SEQ ID NO: 5447846 - DNA, 20 bp, Homo sapiens
tcccaggtttcttctctgga

SEQ ID NO: 5447847 - DNA, 20 bp, Homo sapiens
tcccagtaagggcgtggctc

SEQ ID NO: 5447848 - DNA, 18 bp, Homo sapiens
tcccagtacgatttgcag

SEQ ID NO: 5447849 - DNA, 19 bp, Homo sapiens
tcccagtagccaaggcccg

SEQ ID NO: 5447850 - DNA, 18 bp, Homo sapiens
tcccagtagtgtttggaa

SEQ ID NO: 5447851 - DNA, 20 bp, Homo sapiens
tcccagtagtgtttggaatt

SEQ ID NO: 5447852 - DNA, 15 bp, Homo sapiens
tcccagtatgtttta

SEQ ID NO: 5447853 - DNA, 14 bp, Homo sapiens
tcccagtcactcct

SEQ ID NO: 5447854 - DNA, 18 bp, Homo sapiens
tcccagtcactcctctct

SEQ ID NO: 5447855 - DNA, 16 bp, Homo sapiens
tcccagtcagaaataa

SEQ ID NO: 5447856 - DNA, 10 bp, Homo sapiens
tcccagtccc

SEQ ID NO: 5447857 - DNA, 13 bp, Homo sapiens
tcccagtccctcg

SEQ ID NO: 5447858 - DNA, 19 bp, Homo sapiens
tcccagtccggtgccttcc

SEQ ID NO: 5447859 - DNA, 20 bp, Homo sapiens
tcccagtccggtgccttcca

SEQ ID NO: 5447860 - DNA, 16 bp, Homo sapiens
tcccagtcctccagac

SEQ ID NO: 5447861 - DNA, 16 bp, Homo sapiens
tcccagtcgaggctgg

SEQ ID NO: 5447862 - DNA, 15 bp, Homo sapiens
tcccagtctacccag

SEQ ID NO: 5447863 - DNA, 17 bp, Homo sapiens
tcccagtctacccagag

SEQ ID NO: 5447864 - DNA, 17 bp, Homo sapiens
tcccagtctcatctcct

SEQ ID NO: 5447865 - DNA, 19 bp, Homo sapiens
tcccagtctcatctcctga

SEQ ID NO: 5447866 - DNA, 23 bp, Homo sapiens
tcccagtctcatctcctgaccct

SEQ ID NO: 5447867 - DNA, 16 bp, Homo sapiens
tcccagtctgatattc

SEQ ID NO: 5447868 - DNA, 14 bp, Homo sapiens
tcccagtgaataaa

SEQ ID NO: 5447869 - DNA, 20 bp, Homo sapiens
tcccagtgaatccctgggag

SEQ ID NO: 5447870 - DNA, 15 bp, Homo sapiens
tcccagtgaattctt

SEQ ID NO: 5447871 - DNA, 12 bp, Homo sapiens
tcccagtgacaa

SEQ ID NO: 5447872 - DNA, 20 bp, Homo sapiens
tcccagtgacacttcagaga

SEQ ID NO: 5447873 - DNA, 21 bp, Homo sapiens
tcccagtgagaagggcctgct

SEQ ID NO: 5447874 - DNA, 22 bp, Homo sapiens
tcccagtgagaagggcctgctc

SEQ ID NO: 5447875 - DNA, 15 bp, Homo sapiens
tcccagtgagactgc

SEQ ID NO: 5447876 - DNA, 19 bp, Homo sapiens
tcccagtgagactgcccca

SEQ ID NO: 5447877 - DNA, 14 bp, Homo sapiens
tcccagtgagcctc

SEQ ID NO: 5447878 - DNA, 15 bp, Homo sapiens
tcccagtgagcctct

SEQ ID NO: 5447879 - DNA, 16 bp, Homo sapiens
tcccagtgagcctctg

SEQ ID NO: 5447880 - DNA, 18 bp, Homo sapiens
tcccagtgagcctctgcg

SEQ ID NO: 5447881 - DNA, 19 bp, Homo sapiens
tcccagtgagtctctgggg

SEQ ID NO: 5447882 - DNA, 12 bp, Homo sapiens
tcccagtgcctt

SEQ ID NO: 5447883 - DNA, 20 bp, Homo sapiens
tcccagtggcctcaaccctc

SEQ ID NO: 5447884 - DNA, 14 bp, Homo sapiens
tcccagtggcctgg

SEQ ID NO: 5447885 - DNA, 16 bp, Homo sapiens
tcccagtggctgctgc

SEQ ID NO: 5447886 - DNA, 17 bp, Homo sapiens
tcccagtggctgctgcc

SEQ ID NO: 5447887 - DNA, 18 bp, Homo sapiens
tcccagtggctgctgccc

SEQ ID NO: 5447888 - DNA, 19 bp, Homo sapiens
tcccagtggctgctgccca

SEQ ID NO: 5447889 - DNA, 22 bp, Homo sapiens
tcccagtggctgctgcccaggc

SEQ ID NO: 5447890 - DNA, 20 bp, Homo sapiens
tcccagtgggagcttcccgg

SEQ ID NO: 5447891 - DNA, 20 bp, Homo sapiens
tcccagtgggaggggcaggc

SEQ ID NO: 5447892 - DNA, 22 bp, Homo sapiens
tcccagtgggaggggcaggctg

SEQ ID NO: 5447893 - DNA, 21 bp, Homo sapiens
tcccagtgtctggcccagcca

SEQ ID NO: 5447894 - DNA, 15 bp, Homo sapiens
tcccagtgtcttcct

SEQ ID NO: 5447895 - DNA, 20 bp, Homo sapiens
tcccagttctacaagcatat

SEQ ID NO: 5447896 - DNA, 16 bp, Homo sapiens
tcccagttcttcctgc

SEQ ID NO: 5447897 - DNA, 17 bp, Homo sapiens
tcccagttcttcctgca

SEQ ID NO: 5447898 - DNA, 18 bp, Homo sapiens
tcccagttcttcctgcaa

SEQ ID NO: 5447899 - DNA, 15 bp, Homo sapiens
tcccagttgctgtca

SEQ ID NO: 5447900 - DNA, 21 bp, Homo sapiens
tcccagttggagctccagcct

SEQ ID NO: 5447901 - DNA, 23 bp, Homo sapiens
tcccagttggggaagccaggtga

SEQ ID NO: 5447902 - DNA, 16 bp, Homo sapiens
tcccataaataaaagt

SEQ ID NO: 5447903 - DNA, 20 bp, Homo sapiens
tcccataaataaaagtacag

SEQ ID NO: 5447904 - DNA, 22 bp, Homo sapiens
tcccataattgctttgccaaaa

SEQ ID NO: 5447905 - DNA, 14 bp, Homo sapiens
tcccataccaccca

SEQ ID NO: 5447906 - DNA, 16 bp, Homo sapiens
tcccataccatcactg

SEQ ID NO: 5447907 - DNA, 13 bp, Homo sapiens
tcccatagatttg

SEQ ID NO: 5447908 - DNA, 14 bp, Homo sapiens
tcccatagcgctgg

SEQ ID NO: 5447909 - DNA, 16 bp, Homo sapiens
tcccatagtccctgcc

SEQ ID NO: 5447910 - DNA, 18 bp, Homo sapiens
tcccatagtccctgccac

SEQ ID NO: 5447911 - DNA, 22 bp, Homo sapiens
tcccatagtggggcctgggagg

SEQ ID NO: 5447912 - DNA, 22 bp, Homo sapiens
tcccatatgcctgggcagaagg

SEQ ID NO: 5447913 - DNA, 21 bp, Homo sapiens
tcccatattggcatggatttc

SEQ ID NO: 5447914 - DNA, 14 bp, Homo sapiens
tcccatcaaaactc

SEQ ID NO: 5447915 - DNA, 20 bp, Homo sapiens
tcccatcacgtgtactggct

SEQ ID NO: 5447916 - DNA, 12 bp, Homo sapiens
tcccatcactgc

SEQ ID NO: 5447917 - DNA, 15 bp, Homo sapiens
tcccatcagggaaga

SEQ ID NO: 5447918 - DNA, 12 bp, Homo sapiens
tcccatccaggc

SEQ ID NO: 5447919 - DNA, 20 bp, Homo sapiens
tcccatcccatcccatccca

SEQ ID NO: 5447920 - DNA, 14 bp, Homo sapiens
tcccatccccagcg

SEQ ID NO: 5447921 - DNA, 15 bp, Homo sapiens
tcccatccccagcga

SEQ ID NO: 5447922 - DNA, 14 bp, Homo sapiens
tcccatccccctgc

SEQ ID NO: 5447923 - DNA, 15 bp, Homo sapiens
tcccatccccctgcc

SEQ ID NO: 5447924 - DNA, 18 bp, Homo sapiens
tcccatccccctgccctc

SEQ ID NO: 5447925 - DNA, 15 bp, Homo sapiens
tcccatcccctcaac

SEQ ID NO: 5447926 - DNA, 20 bp, Homo sapiens
tcccatcccgctcttttcct

SEQ ID NO: 5447927 - DNA, 20 bp, Homo sapiens
tcccatccctttctaagcag

SEQ ID NO: 5447928 - DNA, 18 bp, Homo sapiens
tcccatcctaccctcggg

SEQ ID NO: 5447929 - DNA, 14 bp, Homo sapiens
tcccatcctggggc

SEQ ID NO: 5447930 - DNA, 18 bp, Homo sapiens
tcccatcctggggcagca

SEQ ID NO: 5447931 - DNA, 20 bp, Homo sapiens
tcccatcgtctcggccttca

SEQ ID NO: 5447932 - DNA, 17 bp, Homo sapiens
tcccatctaagctgcag

SEQ ID NO: 5447933 - DNA, 18 bp, Homo sapiens
tcccatctaagctgcagc

SEQ ID NO: 5447934 - DNA, 19 bp, Homo sapiens
tcccatctaagctgcagct

SEQ ID NO: 5447935 - DNA, 13 bp, Homo sapiens
tcccatctaggga

SEQ ID NO: 5447936 - DNA, 19 bp, Homo sapiens
tcccatctattctctgcct

SEQ ID NO: 5447937 - DNA, 14 bp, Homo sapiens
tcccatctcacaca

SEQ ID NO: 5447938 - DNA, 20 bp, Homo sapiens
tcccatctcacacatgagca

SEQ ID NO: 5447939 - DNA, 20 bp, Homo sapiens
tcccatctccttcccccagc

SEQ ID NO: 5447940 - DNA, 21 bp, Homo sapiens
tcccatctccttcccccagcc

SEQ ID NO: 5447941 - DNA, 23 bp, Homo sapiens
tcccatctccttcccccagccca

SEQ ID NO: 5447942 - DNA, 16 bp, Homo sapiens
tcccatctgaagagtg

SEQ ID NO: 5447943 - DNA, 19 bp, Homo sapiens
tcccatctgcaccccttct

SEQ ID NO: 5447944 - DNA, 15 bp, Homo sapiens
tcccatctgccctcc

SEQ ID NO: 5447945 - DNA, 20 bp, Homo sapiens
tcccatctgctcctcccatt

SEQ ID NO: 5447946 - DNA, 13 bp, Homo sapiens
tcccatctgcttc

SEQ ID NO: 5447947 - DNA, 13 bp, Homo sapiens
tcccatctggctt

SEQ ID NO: 5447948 - DNA, 14 bp, Homo sapiens
tcccatctgggagt

SEQ ID NO: 5447949 - DNA, 19 bp, Homo sapiens
tcccatctgggagtcccct

SEQ ID NO: 5447950 - DNA, 15 bp, Homo sapiens
tcccatctggtcatt

SEQ ID NO: 5447951 - DNA, 17 bp, Homo sapiens
tcccatctggtcatttg

SEQ ID NO: 5447952 - DNA, 20 bp, Homo sapiens
tcccatctggtcatttggtt

SEQ ID NO: 5447953 - DNA, 16 bp, Homo sapiens
tcccatcttcactctt

SEQ ID NO: 5447954 - DNA, 21 bp, Homo sapiens
tcccatctttttaacctctgt

SEQ ID NO: 5447955 - DNA, 23 bp, Homo sapiens
tcccatctttttaacctctgttc

SEQ ID NO: 5447956 - DNA, 13 bp, Homo sapiens
tcccatgaagcct

SEQ ID NO: 5447957 - DNA, 15 bp, Homo sapiens
tcccatgaagccttt

SEQ ID NO: 5447958 - DNA, 17 bp, Homo sapiens
tcccatgaagccttttg

SEQ ID NO: 5447959 - DNA, 19 bp, Homo sapiens
tcccatgaatatcaagaat

SEQ ID NO: 5447960 - DNA, 22 bp, Homo sapiens
tcccatgaatatcaagaatagt

SEQ ID NO: 5447961 - DNA, 15 bp, Homo sapiens
tcccatgacccaggc

SEQ ID NO: 5447962 - DNA, 16 bp, Homo sapiens
tcccatgacccaggct

SEQ ID NO: 5447963 - DNA, 20 bp, Homo sapiens
tcccatgacccaggctgggc

SEQ ID NO: 5447964 - DNA, 19 bp, Homo sapiens
tcccatgactgcacccagc

SEQ ID NO: 5447965 - DNA, 20 bp, Homo sapiens
tcccatgactgcacccagct

SEQ ID NO: 5447966 - DNA, 17 bp, Homo sapiens
tcccatgagactgccct

SEQ ID NO: 5447967 - DNA, 15 bp, Homo sapiens
tcccatgagcctcag

SEQ ID NO: 5447968 - DNA, 22 bp, Homo sapiens
tcccatgagcctcagcatcctg

SEQ ID NO: 5447969 - DNA, 23 bp, Homo sapiens
tcccatgagctccttaaggctct

SEQ ID NO: 5447970 - DNA, 14 bp, Homo sapiens
tcccatgatccaga

SEQ ID NO: 5447971 - DNA, 17 bp, Homo sapiens
tcccatgatccagaact

SEQ ID NO: 5447972 - DNA, 21 bp, Homo sapiens
tcccatgatgccgctcttctg

SEQ ID NO: 5447973 - DNA, 22 bp, Homo sapiens
tcccatgatttcatgtactgca

SEQ ID NO: 5447974 - DNA, 18 bp, Homo sapiens
tcccatgatttggggtga

SEQ ID NO: 5447975 - DNA, 18 bp, Homo sapiens
tcccatgcaacaccctct

SEQ ID NO: 5447976 - DNA, 19 bp, Homo sapiens
tcccatgcaacaccctctt

SEQ ID NO: 5447977 - DNA, 20 bp, Homo sapiens
tcccatgcacaactctccaa

SEQ ID NO: 5447978 - DNA, 13 bp, Homo sapiens
tcccatgcaggct

SEQ ID NO: 5447979 - DNA, 22 bp, Homo sapiens
tcccatgccggtacacagccag

SEQ ID NO: 5447980 - DNA, 16 bp, Homo sapiens
tcccatgcctggtccc

SEQ ID NO: 5447981 - DNA, 15 bp, Homo sapiens
tcccatgcctgtctc

SEQ ID NO: 5447982 - DNA, 19 bp, Homo sapiens
tcccatgcctgtctctgtt

SEQ ID NO: 5447983 - DNA, 14 bp, Homo sapiens
tcccatggacactc

SEQ ID NO: 5447984 - DNA, 18 bp, Homo sapiens
tcccatggagccccagcc

SEQ ID NO: 5447985 - DNA, 16 bp, Homo sapiens
tcccatggatgagtaa

SEQ ID NO: 5447986 - DNA, 14 bp, Homo sapiens
tcccatggcccagc

SEQ ID NO: 5447987 - DNA, 16 bp, Homo sapiens
tcccatggcccagcag

SEQ ID NO: 5447988 - DNA, 20 bp, Homo sapiens
tcccatggcccagcagcttg

SEQ ID NO: 5447989 - DNA, 20 bp, Homo sapiens
tcccatggcctgctgggctt

SEQ ID NO: 5447990 - DNA, 12 bp, Homo sapiens
tcccatggctct

SEQ ID NO: 5447991 - DNA, 14 bp, Homo sapiens
tcccatggctgaag

SEQ ID NO: 5447992 - DNA, 20 bp, Homo sapiens
tcccatggctgaagctggag

SEQ ID NO: 5447993 - DNA, 18 bp, Homo sapiens
tcccatggcttaatgctt

SEQ ID NO: 5447994 - DNA, 15 bp, Homo sapiens
tcccatgggctctgg

SEQ ID NO: 5447995 - DNA, 18 bp, Homo sapiens
tcccatgggctctggccc

SEQ ID NO: 5447996 - DNA, 17 bp, Homo sapiens
tcccatgggggctccag

SEQ ID NO: 5447997 - DNA, 18 bp, Homo sapiens
tcccatgggggctccaga

SEQ ID NO: 5447998 - DNA, 20 bp, Homo sapiens
tcccatgggggctccagaca

SEQ ID NO: 5447999 - DNA, 23 bp, Homo sapiens
tcccatgggggctccagacattg

SEQ ID NO: 5448000 - DNA, 21 bp, Homo sapiens
tcccatgggggtgctgcagcc

SEQ ID NO: 5448001 - DNA, 23 bp, Homo sapiens
tcccatgggggtgctgcagccag

SEQ ID NO: 5448002 - DNA, 12 bp, Homo sapiens
tcccatggtgta

SEQ ID NO: 5448003 - DNA, 15 bp, Homo sapiens
tcccatgtcacctca

SEQ ID NO: 5448004 - DNA, 20 bp, Homo sapiens
tcccatgtcacctcagctga

SEQ ID NO: 5448005 - DNA, 15 bp, Homo sapiens
tcccatgtcactgca

SEQ ID NO: 5448006 - DNA, 18 bp, Homo sapiens
tcccatgtcccaccctcc

SEQ ID NO: 5448007 - DNA, 13 bp, Homo sapiens
tcccatgtgcata

SEQ ID NO: 5448008 - DNA, 16 bp, Homo sapiens
tcccatgtgtgactcc

SEQ ID NO: 5448009 - DNA, 16 bp, Homo sapiens
tcccatgtgtgatgct

SEQ ID NO: 5448010 - DNA, 17 bp, Homo sapiens
tcccatgttgcatgcct

SEQ ID NO: 5448011 - DNA, 14 bp, Homo sapiens
tcccattaaaaatg

SEQ ID NO: 5448012 - DNA, 20 bp, Homo sapiens
tcccattaatcatttcccca

SEQ ID NO: 5448013 - DNA, 18 bp, Homo sapiens
tcccattattatttctgt

SEQ ID NO: 5448014 - DNA, 16 bp, Homo sapiens
tccccaggtgtgtgct

SEQ ID NO: 5448015 - DNA, 15 bp, Homo sapiens
tccccagtaaaattg

SEQ ID NO: 5448016 - DNA, 18 bp, Homo sapiens
tccccagtactgaggtgg

SEQ ID NO: 5448017 - DNA, 15 bp, Homo sapiens
tccccagtcctcagg

SEQ ID NO: 5448018 - DNA, 15 bp, Homo sapiens
tccccagtgaaaact

SEQ ID NO: 5448019 - DNA, 15 bp, Homo sapiens
tccccagtgactcca

SEQ ID NO: 5448020 - DNA, 21 bp, Homo sapiens
tccccagtgactccagggtga

SEQ ID NO: 5448021 - DNA, 13 bp, Homo sapiens
tccccagtgcccg

SEQ ID NO: 5448022 - DNA, 15 bp, Homo sapiens
tccccagtgcccggt

SEQ ID NO: 5448023 - DNA, 18 bp, Homo sapiens
tccccagtgcccggtgca

SEQ ID NO: 5448024 - DNA, 17 bp, Homo sapiens
tccccagtgcctgccac

SEQ ID NO: 5448025 - DNA, 15 bp, Homo sapiens
tccccagtgctcctg

SEQ ID NO: 5448026 - DNA, 20 bp, Homo sapiens
tccccagtgctcctggccct

SEQ ID NO: 5448027 - DNA, 22 bp, Homo sapiens
tccccagtgtggactctggact

SEQ ID NO: 5448028 - DNA, 23 bp, Homo sapiens
tccccagtgtggccccagcccga

SEQ ID NO: 5448029 - DNA, 17 bp, Homo sapiens
tccccagttccacagca

SEQ ID NO: 5448030 - DNA, 19 bp, Homo sapiens
tccccagttggcccttctg

SEQ ID NO: 5448031 - DNA, 17 bp, Homo sapiens
tccccataactcaatgg

SEQ ID NO: 5448032 - DNA, 22 bp, Homo sapiens
tccccataatacccttttccaa

SEQ ID NO: 5448033 - DNA, 17 bp, Homo sapiens
tccccataatgcttctt

SEQ ID NO: 5448034 - DNA, 14 bp, Homo sapiens
tccccatacacaca

SEQ ID NO: 5448035 - DNA, 16 bp, Homo sapiens
tccccatactctgtct

SEQ ID NO: 5448036 - DNA, 19 bp, Homo sapiens
tccccatactctgtctccc

SEQ ID NO: 5448037 - DNA, 17 bp, Homo sapiens
tccccatatataaatta

SEQ ID NO: 5448038 - DNA, 15 bp, Homo sapiens
tccccatatccaagt

SEQ ID NO: 5448039 - DNA, 14 bp, Homo sapiens
tccccatcatccca

SEQ ID NO: 5448040 - DNA, 16 bp, Homo sapiens
tccccatcatcccagc

SEQ ID NO: 5448041 - DNA, 17 bp, Homo sapiens
tccccatcatcccagct

SEQ ID NO: 5448042 - DNA, 18 bp, Homo sapiens
tccccatccccaccagct

SEQ ID NO: 5448043 - DNA, 18 bp, Homo sapiens
tccccatccccatgccct

SEQ ID NO: 5448044 - DNA, 14 bp, Homo sapiens
tccccatcctccag

SEQ ID NO: 5448045 - DNA, 19 bp, Homo sapiens
tccccatcgccagctgatg

SEQ ID NO: 5448046 - DNA, 16 bp, Homo sapiens
tccccatcgccttctg

SEQ ID NO: 5448047 - DNA, 18 bp, Homo sapiens
tccccatcgccttctggg

SEQ ID NO: 5448048 - DNA, 18 bp, Homo sapiens
tccccatcggccctgtcc

SEQ ID NO: 5448049 - DNA, 18 bp, Homo sapiens
tccccatcgttgccccca

SEQ ID NO: 5448050 - DNA, 22 bp, Homo sapiens
tccccatcgttgcccccatttc

SEQ ID NO: 5448051 - DNA, 13 bp, Homo sapiens
tccccatctcagg

SEQ ID NO: 5448052 - DNA, 12 bp, Homo sapiens
tccccatctcca

SEQ ID NO: 5448053 - DNA, 22 bp, Homo sapiens
tccccatctccatttcacacag

SEQ ID NO: 5448054 - DNA, 20 bp, Homo sapiens
tccccatctccctgcctggc

SEQ ID NO: 5448055 - DNA, 11 bp, Homo sapiens
tccccatctct

SEQ ID NO: 5448056 - DNA, 17 bp, Homo sapiens
tccccatctctgtctgg

SEQ ID NO: 5448057 - DNA, 14 bp, Homo sapiens
tccccatctgggtc

SEQ ID NO: 5448058 - DNA, 14 bp, Homo sapiens
tccccatctgtcca

SEQ ID NO: 5448059 - DNA, 15 bp, Homo sapiens
tccccatctgtgtgt

SEQ ID NO: 5448060 - DNA, 21 bp, Homo sapiens
tccccatctttgatccttctg

SEQ ID NO: 5448061 - DNA, 17 bp, Homo sapiens
tccccatgaaccctgcc

SEQ ID NO: 5448062 - DNA, 18 bp, Homo sapiens
tccccatgaaccctgccc

SEQ ID NO: 5448063 - DNA, 18 bp, Homo sapiens
tccccatgattccctcct

SEQ ID NO: 5448064 - DNA, 21 bp, Homo sapiens
tccccatgccacgttccacag

SEQ ID NO: 5448065 - DNA, 17 bp, Homo sapiens
tccccatgcctgtggct

SEQ ID NO: 5448066 - DNA, 19 bp, Homo sapiens
tccccatgcctgtggctgc

SEQ ID NO: 5448067 - DNA, 18 bp, Homo sapiens
tccccatgcttccttgcc

SEQ ID NO: 5448068 - DNA, 21 bp, Homo sapiens
tccccatggaacagccctgca

SEQ ID NO: 5448069 - DNA, 16 bp, Homo sapiens
tccccatggagccagc

SEQ ID NO: 5448070 - DNA, 23 bp, Homo sapiens
tccccatgggaagacgaggccct

SEQ ID NO: 5448071 - DNA, 17 bp, Homo sapiens
tccccatgggcacagtg

SEQ ID NO: 5448072 - DNA, 16 bp, Homo sapiens
tccccatggtagttta

SEQ ID NO: 5448073 - DNA, 17 bp, Homo sapiens
tccccatgtctcgactc

SEQ ID NO: 5448074 - DNA, 21 bp, Homo sapiens
tccccattagagtcagccttc

SEQ ID NO: 5448075 - DNA, 15 bp, Homo sapiens
tccccattagtatcc

SEQ ID NO: 5448076 - DNA, 14 bp, Homo sapiens
tccccattcacaga

SEQ ID NO: 5448077 - DNA, 17 bp, Homo sapiens
tccccattcacagagcc

SEQ ID NO: 5448078 - DNA, 18 bp, Homo sapiens
tccccattcacagagcct

SEQ ID NO: 5448079 - DNA, 15 bp, Homo sapiens
tccccattcagtgac

SEQ ID NO: 5448080 - DNA, 18 bp, Homo sapiens
tccccattcattcctgat

SEQ ID NO: 5448081 - DNA, 17 bp, Homo sapiens
tccccattctataaatt

SEQ ID NO: 5448082 - DNA, 15 bp, Homo sapiens
tccccattctgtgtc

SEQ ID NO: 5448083 - DNA, 22 bp, Homo sapiens
tccccattcttcctagttttct

SEQ ID NO: 5448084 - DNA, 20 bp, Homo sapiens
tccccatttcccatctgcac

SEQ ID NO: 5448085 - DNA, 15 bp, Homo sapiens
tccccatttcctctt

SEQ ID NO: 5448086 - DNA, 18 bp, Homo sapiens
tccccatttcctcttcct

SEQ ID NO: 5448087 - DNA, 21 bp, Homo sapiens
tccccatttcctcttccttct

SEQ ID NO: 5448088 - DNA, 16 bp, Homo sapiens
tccccatttctgcctc

SEQ ID NO: 5448089 - DNA, 17 bp, Homo sapiens
tccccatttctgcctcg

SEQ ID NO: 5448090 - DNA, 17 bp, Homo sapiens
tcccccaaaaatttgaa

SEQ ID NO: 5448091 - DNA, 16 bp, Homo sapiens
tcccccaaaccctgct

SEQ ID NO: 5448092 - DNA, 21 bp, Homo sapiens
tcccccaaaccctgcttctgc

SEQ ID NO: 5448093 - DNA, 15 bp, Homo sapiens
tcccccaaaggcatc

SEQ ID NO: 5448094 - DNA, 18 bp, Homo sapiens
tcccccaaaggcatccca

SEQ ID NO: 5448095 - DNA, 23 bp, Homo sapiens
tcccccaaaggcatcccagcctg

SEQ ID NO: 5448096 - DNA, 18 bp, Homo sapiens
tcccccaaagggcctcct

SEQ ID NO: 5448097 - DNA, 13 bp, Homo sapiens
tcccccaaagtgg

SEQ ID NO: 5448098 - DNA, 17 bp, Homo sapiens
tcccccaaagttcacaa

SEQ ID NO: 5448099 - DNA, 19 bp, Homo sapiens
tcccccaacacctgctgcg

SEQ ID NO: 5448100 - DNA, 12 bp, Homo sapiens
tcccccaacaga

SEQ ID NO: 5448101 - DNA, 14 bp, Homo sapiens
tcccccaaccaagg

SEQ ID NO: 5448102 - DNA, 19 bp, Homo sapiens
tcccccaaccaaggaagga

SEQ ID NO: 5448103 - DNA, 20 bp, Homo sapiens
tcccccaaccaaggaaggag

SEQ ID NO: 5448104 - DNA, 16 bp, Homo sapiens
tcccccaacccacctc

SEQ ID NO: 5448105 - DNA, 17 bp, Homo sapiens
tcccccaacccacctct

SEQ ID NO: 5448106 - DNA, 20 bp, Homo sapiens
tcccccaacccacctctggc

SEQ ID NO: 5448107 - DNA, 22 bp, Homo sapiens
tcccccaacccacctctggccc

SEQ ID NO: 5448108 - DNA, 15 bp, Homo sapiens
tcccccaacccccac

SEQ ID NO: 5448109 - DNA, 19 bp, Homo sapiens
tcccccaacccccacccca

SEQ ID NO: 5448110 - DNA, 22 bp, Homo sapiens
tcccccaacccccaccccacac

SEQ ID NO: 5448111 - DNA, 17 bp, Homo sapiens
tcccccaacctcagact

SEQ ID NO: 5448112 - DNA, 17 bp, Homo sapiens
tcccccaactctgagcc

SEQ ID NO: 5448113 - DNA, 22 bp, Homo sapiens
tcccccaacttcatctggaagt

SEQ ID NO: 5448114 - DNA, 14 bp, Homo sapiens
tcccccaacttgag

SEQ ID NO: 5448115 - DNA, 10 bp, Homo sapiens
tcccccaaga

SEQ ID NO: 5448116 - DNA, 22 bp, Homo sapiens
tcccccacaagagccccaaaga

SEQ ID NO: 5448117 - DNA, 17 bp, Homo sapiens
tcccccaccacactgaa

SEQ ID NO: 5448118 - DNA, 22 bp, Homo sapiens
tcccccaccagctaaggacatt

SEQ ID NO: 5448119 - DNA, 19 bp, Homo sapiens
tcccccaccagctgcagcc

SEQ ID NO: 5448120 - DNA, 20 bp, Homo sapiens
tcccccacccatggggagga

SEQ ID NO: 5448121 - DNA, 18 bp, Homo sapiens
tcccccaccccagagttg

SEQ ID NO: 5448122 - DNA, 17 bp, Homo sapiens
tcccccaccccttaggc

SEQ ID NO: 5448123 - DNA, 18 bp, Homo sapiens
tcccccaccccttaggcc

SEQ ID NO: 5448124 - DNA, 23 bp, Homo sapiens
tcccccaccccttaggccccgtg

SEQ ID NO: 5448125 - DNA, 11 bp, Homo sapiens
tcccccaccct

SEQ ID NO: 5448126 - DNA, 14 bp, Homo sapiens
tcccccaccctggg

SEQ ID NO: 5448127 - DNA, 21 bp, Homo sapiens
tcccccaccctgggtttggcc

SEQ ID NO: 5448128 - DNA, 13 bp, Homo sapiens
tcccccaccgccc

SEQ ID NO: 5448129 - DNA, 21 bp, Homo sapiens
tcccccaccgcccactctcca

SEQ ID NO: 5448130 - DNA, 19 bp, Homo sapiens
tcccccaccggtccagctg

SEQ ID NO: 5448131 - DNA, 20 bp, Homo sapiens
tcccccaccggtccagctgg

SEQ ID NO: 5448132 - DNA, 22 bp, Homo sapiens
tcccccaccggtccagctggcc

SEQ ID NO: 5448133 - DNA, 11 bp, Homo sapiens
tcccccacctc

SEQ ID NO: 5448134 - DNA, 20 bp, Homo sapiens
tcccccacctcggtcactcc

SEQ ID NO: 5448135 - DNA, 23 bp, Homo sapiens
tcccccacctgacaatggcagct

SEQ ID NO: 5448136 - DNA, 20 bp, Homo sapiens
tcccccacgcctccatccac

SEQ ID NO: 5448137 - DNA, 21 bp, Homo sapiens
tcccccacgcctccatccaca

SEQ ID NO: 5448138 - DNA, 17 bp, Homo sapiens
tcccccacggccgtccc

SEQ ID NO: 5448139 - DNA, 20 bp, Homo sapiens
tcccccacgtctctctgcct

SEQ ID NO: 5448140 - DNA, 22 bp, Homo sapiens
tcccccacgtggactctgtgct

SEQ ID NO: 5448141 - DNA, 11 bp, Homo sapiens
tcccccactcc

SEQ ID NO: 5448142 - DNA, 22 bp, Homo sapiens
tcccccactcctcttatttgct

SEQ ID NO: 5448143 - DNA, 21 bp, Homo sapiens
tcccccactctctcacccacc

SEQ ID NO: 5448144 - DNA, 16 bp, Homo sapiens
tcccccacttcccctc

SEQ ID NO: 5448145 - DNA, 16 bp, Homo sapiens
tcccccagacagagcc

SEQ ID NO: 5448146 - DNA, 15 bp, Homo sapiens
tcccccagagccact

SEQ ID NO: 5448147 - DNA, 14 bp, Homo sapiens
tcccccagagcccc

SEQ ID NO: 5448148 - DNA, 16 bp, Homo sapiens
tcccccagagtgctgt

SEQ ID NO: 5448149 - DNA, 21 bp, Homo sapiens
tcccccagagtgctgtcggga

SEQ ID NO: 5448150 - DNA, 11 bp, Homo sapiens
tcccccagcaa

SEQ ID NO: 5448151 - DNA, 20 bp, Homo sapiens
tcccccagcaacgcccctcc

SEQ ID NO: 5448152 - DNA, 17 bp, Homo sapiens
tcccccagcaaggcaga

SEQ ID NO: 5448153 - DNA, 12 bp, Homo sapiens
tcccccagcaca

SEQ ID NO: 5448154 - DNA, 16 bp, Homo sapiens
tcccccagcacaaagc

SEQ ID NO: 5448155 - DNA, 11 bp, Homo sapiens
tcccccagcca

SEQ ID NO: 5448156 - DNA, 13 bp, Homo sapiens
tcccccagccagg

SEQ ID NO: 5448157 - DNA, 11 bp, Homo sapiens
tcccccagccc

SEQ ID NO: 5448158 - DNA, 15 bp, Homo sapiens
tcccccagcccaata

SEQ ID NO: 5448159 - DNA, 19 bp, Homo sapiens
tcccccagcccaataaagg

SEQ ID NO: 5448160 - DNA, 13 bp, Homo sapiens
tcccccagcccca

SEQ ID NO: 5448161 - DNA, 16 bp, Homo sapiens
tcccccagccccatcc

SEQ ID NO: 5448162 - DNA, 12 bp, Homo sapiens
tcccccagccct

SEQ ID NO: 5448163 - DNA, 14 bp, Homo sapiens
tcccccagccctca

SEQ ID NO: 5448164 - DNA, 23 bp, Homo sapiens
tcccccagccctcaggccagtgc

SEQ ID NO: 5448165 - DNA, 13 bp, Homo sapiens
tcccccagctcct

SEQ ID NO: 5448166 - DNA, 22 bp, Homo sapiens
tcccccagctttccatctgagg

SEQ ID NO: 5448167 - DNA, 23 bp, Homo sapiens
tcccccaggaggcagctcaggat

SEQ ID NO: 5448168 - DNA, 13 bp, Homo sapiens
tcccccaggcctg

SEQ ID NO: 5448169 - DNA, 19 bp, Homo sapiens
tcccccaggcctgagctgc

SEQ ID NO: 5448170 - DNA, 21 bp, Homo sapiens
tcccccaggcctgagctgctt

SEQ ID NO: 5448171 - DNA, 23 bp, Homo sapiens
tcccccaggcctgagctgcttca

SEQ ID NO: 5448172 - DNA, 18 bp, Homo sapiens
tcccccaggctgcgcctg

SEQ ID NO: 5448173 - DNA, 19 bp, Homo sapiens
tcccccaggctgcgcctgc

SEQ ID NO: 5448174 - DNA, 11 bp, Homo sapiens
tcccccaggga

SEQ ID NO: 5448175 - DNA, 20 bp, Homo sapiens
tcccccaggggcgtgaggct

SEQ ID NO: 5448176 - DNA, 18 bp, Homo sapiens
tcccccagggtcccctgc

SEQ ID NO: 5448177 - DNA, 19 bp, Homo sapiens
tcccccagggtcccctgca

SEQ ID NO: 5448178 - DNA, 21 bp, Homo sapiens
tcccccagggtcccctgcatg

SEQ ID NO: 5448179 - DNA, 14 bp, Homo sapiens
tcccccagtacctc

SEQ ID NO: 5448180 - DNA, 16 bp, Homo sapiens
tcccccagtacctcca

SEQ ID NO: 5448181 - DNA, 21 bp, Homo sapiens
tcccccagtatgtccttttct

SEQ ID NO: 5448182 - DNA, 12 bp, Homo sapiens
tcccccagtgcg

SEQ ID NO: 5448183 - DNA, 17 bp, Homo sapiens
tcccccatagcaccctg

SEQ ID NO: 5448184 - DNA, 15 bp, Homo sapiens
tcccccatccctacc

SEQ ID NO: 5448185 - DNA, 18 bp, Homo sapiens
tcccccatccctaccact

SEQ ID NO: 5448186 - DNA, 20 bp, Homo sapiens
tcccccatccctaccactgt

SEQ ID NO: 5448187 - DNA, 18 bp, Homo sapiens
tcccccatcctccccttc

SEQ ID NO: 5448188 - DNA, 14 bp, Homo sapiens
tcccccatgccacc

SEQ ID NO: 5448189 - DNA, 17 bp, Homo sapiens
tcccccatgggggtgag

SEQ ID NO: 5448190 - DNA, 14 bp, Homo sapiens
tcccccatgtggct

SEQ ID NO: 5448191 - DNA, 17 bp, Homo sapiens
tcccccatgtggctgaa

SEQ ID NO: 5448192 - DNA, 15 bp, Homo sapiens
tcccctgcactgtaa

SEQ ID NO: 5448193 - DNA, 16 bp, Homo sapiens
tcccctgcactgtaaa

SEQ ID NO: 5448194 - DNA, 18 bp, Homo sapiens
tcccctgcactgtaaaat

SEQ ID NO: 5448195 - DNA, 13 bp, Homo sapiens
tcccctgcagcct

SEQ ID NO: 5448196 - DNA, 22 bp, Homo sapiens
tcccctgcagcctgggtctgga

SEQ ID NO: 5448197 - DNA, 14 bp, Homo sapiens
tcccctgcaggctg

SEQ ID NO: 5448198 - DNA, 16 bp, Homo sapiens
tcccctgcatggctga

SEQ ID NO: 5448199 - DNA, 12 bp, Homo sapiens
tcccctgccaca

SEQ ID NO: 5448200 - DNA, 13 bp, Homo sapiens
tcccctgccattt

SEQ ID NO: 5448201 - DNA, 13 bp, Homo sapiens
tcccctgccccag

SEQ ID NO: 5448202 - DNA, 15 bp, Homo sapiens
tcccctgccccagag

SEQ ID NO: 5448203 - DNA, 16 bp, Homo sapiens
tcccctgccccagagg

SEQ ID NO: 5448204 - DNA, 12 bp, Homo sapiens
tcccctgccccc

SEQ ID NO: 5448205 - DNA, 15 bp, Homo sapiens
tcccctgcccccagg

SEQ ID NO: 5448206 - DNA, 18 bp, Homo sapiens
tcccctgcccccaggact

SEQ ID NO: 5448207 - DNA, 19 bp, Homo sapiens
tcccctgcccccaggactg

SEQ ID NO: 5448208 - DNA, 18 bp, Homo sapiens
tcccctgccccctgcagg

SEQ ID NO: 5448209 - DNA, 23 bp, Homo sapiens
tcccctgccccctgcaggaagga

SEQ ID NO: 5448210 - DNA, 12 bp, Homo sapiens
tcccctgccctg

SEQ ID NO: 5448211 - DNA, 13 bp, Homo sapiens
tcccctgcccttc

SEQ ID NO: 5448212 - DNA, 18 bp, Homo sapiens
tcccctgccgcctcccgg

SEQ ID NO: 5448213 - DNA, 13 bp, Homo sapiens
tcccctgcctcct

SEQ ID NO: 5448214 - DNA, 20 bp, Homo sapiens
tcccctgcctcctactccag

SEQ ID NO: 5448215 - DNA, 14 bp, Homo sapiens
tcccctgcctcctg

SEQ ID NO: 5448216 - DNA, 15 bp, Homo sapiens
tcccctgcctggaac

SEQ ID NO: 5448217 - DNA, 23 bp, Homo sapiens
tcccctgccttaacctgggacca

SEQ ID NO: 5448218 - DNA, 19 bp, Homo sapiens
tcccctgcggtcaggctgg

SEQ ID NO: 5448219 - DNA, 19 bp, Homo sapiens
tcccctgctactcctgtgc

SEQ ID NO: 5448220 - DNA, 23 bp, Homo sapiens
tcccctgctactcctgtgctctg

SEQ ID NO: 5448221 - DNA, 16 bp, Homo sapiens
tcccctgctcccaggt

SEQ ID NO: 5448222 - DNA, 14 bp, Homo sapiens
tcccctgctgacct

SEQ ID NO: 5448223 - DNA, 15 bp, Homo sapiens
tcccctgctgacctt

SEQ ID NO: 5448224 - DNA, 21 bp, Homo sapiens
tcccctgctgcaggggctctg

SEQ ID NO: 5448225 - DNA, 23 bp, Homo sapiens
tcccctggaaacccacctctctg

SEQ ID NO: 5448226 - DNA, 18 bp, Homo sapiens
tcccctggaactgtctct

SEQ ID NO: 5448227 - DNA, 19 bp, Homo sapiens
tcccctggaagcagtgccc

SEQ ID NO: 5448228 - DNA, 17 bp, Homo sapiens
tcccctggacagaggcg

SEQ ID NO: 5448229 - DNA, 16 bp, Homo sapiens
tcccctggagccagca

SEQ ID NO: 5448230 - DNA, 21 bp, Homo sapiens
tcccctggagccagcagggct

SEQ ID NO: 5448231 - DNA, 11 bp, Homo sapiens
tcccctggcag

SEQ ID NO: 5448232 - DNA, 12 bp, Homo sapiens
tcccctggcagt

SEQ ID NO: 5448233 - DNA, 18 bp, Homo sapiens
tcccctggcccttccttc

SEQ ID NO: 5448234 - DNA, 12 bp, Homo sapiens
tcccctggctgg

SEQ ID NO: 5448235 - DNA, 20 bp, Homo sapiens
tcccctgggaactctcctgg

SEQ ID NO: 5448236 - DNA, 21 bp, Homo sapiens
tcccctgggaactctcctggc

SEQ ID NO: 5448237 - DNA, 22 bp, Homo sapiens
tcccctgggatgctgacccagg

SEQ ID NO: 5448238 - DNA, 22 bp, Homo sapiens
tcccctgggcatcttctggctt

SEQ ID NO: 5448239 - DNA, 13 bp, Homo sapiens
tcccctgggccac

SEQ ID NO: 5448240 - DNA, 17 bp, Homo sapiens
tcccctgggccaccctt

SEQ ID NO: 5448241 - DNA, 14 bp, Homo sapiens
tcccctggggaccc

SEQ ID NO: 5448242 - DNA, 12 bp, Homo sapiens
tcccctggggag

SEQ ID NO: 5448243 - DNA, 23 bp, Homo sapiens
tcccctggggagaacccttcctg

SEQ ID NO: 5448244 - DNA, 14 bp, Homo sapiens
tcccctggggctgg

SEQ ID NO: 5448245 - DNA, 15 bp, Homo sapiens
tcccctggggctggt

SEQ ID NO: 5448246 - DNA, 20 bp, Homo sapiens
tcccctgggggtttcacctg

SEQ ID NO: 5448247 - DNA, 16 bp, Homo sapiens
tcccctgggtcctcca

SEQ ID NO: 5448248 - DNA, 20 bp, Homo sapiens
tcccctgggtcctccaaaga

SEQ ID NO: 5448249 - DNA, 19 bp, Homo sapiens
tcccctgggttaacaaatg

SEQ ID NO: 5448250 - DNA, 20 bp, Homo sapiens
tcccctgggttaacaaatga

SEQ ID NO: 5448251 - DNA, 21 bp, Homo sapiens
tcccctgggttaacaaatgag

SEQ ID NO: 5448252 - DNA, 20 bp, Homo sapiens
tcccctggtcctgcactgtc

SEQ ID NO: 5448253 - DNA, 20 bp, Homo sapiens
tcccctgtcagtttcccctc

SEQ ID NO: 5448254 - DNA, 18 bp, Homo sapiens
tcccctgtcccctggggc

SEQ ID NO: 5448255 - DNA, 16 bp, Homo sapiens
tcccctgtcttcacct

SEQ ID NO: 5448256 - DNA, 22 bp, Homo sapiens
tcccctgtcttcacctgccacc

SEQ ID NO: 5448257 - DNA, 14 bp, Homo sapiens
tcccctgtgcagtc

SEQ ID NO: 5448258 - DNA, 15 bp, Homo sapiens
tcccctgttcactct

SEQ ID NO: 5448259 - DNA, 19 bp, Homo sapiens
tcccctgttgattatcttc

SEQ ID NO: 5448260 - DNA, 20 bp, Homo sapiens
tcccctgttgattatcttca

SEQ ID NO: 5448261 - DNA, 22 bp, Homo sapiens
tccccttactgagcgcaagcca

SEQ ID NO: 5448262 - DNA, 20 bp, Homo sapiens
tccccttagaggacctgagt

SEQ ID NO: 5448263 - DNA, 17 bp, Homo sapiens
tccccttatctttctaa

SEQ ID NO: 5448264 - DNA, 16 bp, Homo sapiens
tccccttcaccgctcc

SEQ ID NO: 5448265 - DNA, 21 bp, Homo sapiens
tccccttcactccctccctgg

SEQ ID NO: 5448266 - DNA, 13 bp, Homo sapiens
tccccttccactg

SEQ ID NO: 5448267 - DNA, 18 bp, Homo sapiens
tccccttccagctccctc

SEQ ID NO: 5448268 - DNA, 21 bp, Homo sapiens
tccccttccagctccctcccc

SEQ ID NO: 5448269 - DNA, 12 bp, Homo sapiens
tccccttcccag

SEQ ID NO: 5448270 - DNA, 13 bp, Homo sapiens
tccccttcccaga

SEQ ID NO: 5448271 - DNA, 16 bp, Homo sapiens
tccccttcccaggggc

SEQ ID NO: 5448272 - DNA, 17 bp, Homo sapiens
tccccttcccaggggcg

SEQ ID NO: 5448273 - DNA, 17 bp, Homo sapiens
tccccttcccctgctga

SEQ ID NO: 5448274 - DNA, 15 bp, Homo sapiens
tccccttccctgggg

SEQ ID NO: 5448275 - DNA, 10 bp, Homo sapiens
tccccttcct

SEQ ID NO: 5448276 - DNA, 17 bp, Homo sapiens
tccccttcctgcacccg

SEQ ID NO: 5448277 - DNA, 16 bp, Homo sapiens
tccccttcctggacac

SEQ ID NO: 5448278 - DNA, 15 bp, Homo sapiens
tccccttcctggcac

SEQ ID NO: 5448279 - DNA, 13 bp, Homo sapiens
tccccttcctgtt

SEQ ID NO: 5448280 - DNA, 17 bp, Homo sapiens
tccccttcctgttcttc

SEQ ID NO: 5448281 - DNA, 14 bp, Homo sapiens
tccccttcctgttt

SEQ ID NO: 5448282 - DNA, 15 bp, Homo sapiens
tccccttctctcatc

SEQ ID NO: 5448283 - DNA, 18 bp, Homo sapiens
tccccttctctcatctct

SEQ ID NO: 5448284 - DNA, 12 bp, Homo sapiens
tccccttctctg

SEQ ID NO: 5448285 - DNA, 18 bp, Homo sapiens
tccccttctctgcctcac

SEQ ID NO: 5448286 - DNA, 13 bp, Homo sapiens
tccccttctctgt

SEQ ID NO: 5448287 - DNA, 18 bp, Homo sapiens
tccccttcttcctggagt

SEQ ID NO: 5448288 - DNA, 14 bp, Homo sapiens
tccccttcttgtgt

SEQ ID NO: 5448289 - DNA, 18 bp, Homo sapiens
tccccttgaactcttcac

SEQ ID NO: 5448290 - DNA, 16 bp, Homo sapiens
tccccttgagctgaga

SEQ ID NO: 5448291 - DNA, 18 bp, Homo sapiens
tccccttgaggtctcagc

SEQ ID NO: 5448292 - DNA, 20 bp, Homo sapiens
tccccttgaggtctcagccc

SEQ ID NO: 5448293 - DNA, 21 bp, Homo sapiens
tccccttgaggtctcagcccc

SEQ ID NO: 5448294 - DNA, 23 bp, Homo sapiens
tccccttgatttaaacacacaga

SEQ ID NO: 5448295 - DNA, 14 bp, Homo sapiens
tccccttgcactgg

SEQ ID NO: 5448296 - DNA, 15 bp, Homo sapiens
tccccttgcagcctg

SEQ ID NO: 5448297 - DNA, 16 bp, Homo sapiens
tccccttgcccagggc

SEQ ID NO: 5448298 - DNA, 17 bp, Homo sapiens
tccccttgcccagggct

SEQ ID NO: 5448299 - DNA, 19 bp, Homo sapiens
tccccttgcccttgccctg

SEQ ID NO: 5448300 - DNA, 21 bp, Homo sapiens
tccccttgcccttgccctgac

SEQ ID NO: 5448301 - DNA, 22 bp, Homo sapiens
tccccttgccttcccctgtctt

SEQ ID NO: 5448302 - DNA, 17 bp, Homo sapiens
tccccttggacctccag

SEQ ID NO: 5448303 - DNA, 23 bp, Homo sapiens
tccccttggcaggtcctggccag

SEQ ID NO: 5448304 - DNA, 19 bp, Homo sapiens
tccccttgggatgggcaca

SEQ ID NO: 5448305 - DNA, 20 bp, Homo sapiens
tccccttgggatgggcacag

SEQ ID NO: 5448306 - DNA, 18 bp, Homo sapiens
tccccttgggcccacacc

SEQ ID NO: 5448307 - DNA, 22 bp, Homo sapiens
tccccttgggcccacacctcct

SEQ ID NO: 5448308 - DNA, 15 bp, Homo sapiens
tccccttgtccctgg

SEQ ID NO: 5448309 - DNA, 18 bp, Homo sapiens
tcccctttactcagccca

SEQ ID NO: 5448310 - DNA, 22 bp, Homo sapiens
tcccctttactcagcccagctg

SEQ ID NO: 5448311 - DNA, 23 bp, Homo sapiens
tcccctttactcagcccagctgg

SEQ ID NO: 5448312 - DNA, 20 bp, Homo sapiens
tcccctttatgtacaggatg

SEQ ID NO: 5448313 - DNA, 15 bp, Homo sapiens
tcccctttcagagat

SEQ ID NO: 5448314 - DNA, 22 bp, Homo sapiens
tcccctttcatcggtgcctggt

SEQ ID NO: 5448315 - DNA, 15 bp, Homo sapiens
tcccctttcccatca

SEQ ID NO: 5448316 - DNA, 22 bp, Homo sapiens
tcccctttcccatcaccccttc

SEQ ID NO: 5448317 - DNA, 23 bp, Homo sapiens
tcccctttcccatcaccccttcc

SEQ ID NO: 5448318 - DNA, 12 bp, Homo sapiens
tcccctttcctc

SEQ ID NO: 5448319 - DNA, 16 bp, Homo sapiens
tcccctttcgcccaca

SEQ ID NO: 5448320 - DNA, 17 bp, Homo sapiens
tcccctttgattcacag

SEQ ID NO: 5448321 - DNA, 16 bp, Homo sapiens
tcccctttgtcctgcg

SEQ ID NO: 5448322 - DNA, 17 bp, Homo sapiens
tccccttttaccactcc

SEQ ID NO: 5448323 - DNA, 16 bp, Homo sapiens
tccccttttccttcag

SEQ ID NO: 5448324 - DNA, 21 bp, Homo sapiens
tccccttttcttttctaccct

SEQ ID NO: 5448325 - DNA, 16 bp, Homo sapiens
tccccttttgcctggc

SEQ ID NO: 5448326 - DNA, 18 bp, Homo sapiens
tcccctttttctttccct

SEQ ID NO: 5448327 - DNA, 21 bp, Homo sapiens
tccccttttttttctgattct

SEQ ID NO: 5448328 - DNA, 23 bp, Homo sapiens
tcccgaaccccaaggagggagat

SEQ ID NO: 5448329 - DNA, 21 bp, Homo sapiens
tcccgaagaatggagaggaac

SEQ ID NO: 5448330 - DNA, 13 bp, Homo sapiens
tcccgaagccacc

SEQ ID NO: 5448331 - DNA, 15 bp, Homo sapiens
tcccgaatagctggg

SEQ ID NO: 5448332 - DNA, 18 bp, Homo sapiens
tcccgaatagctgggact

SEQ ID NO: 5448333 - DNA, 20 bp, Homo sapiens
tcccgaatagctgggactac

SEQ ID NO: 5448334 - DNA, 21 bp, Homo sapiens
tcccgaatctttttaggccac

SEQ ID NO: 5448335 - DNA, 16 bp, Homo sapiens
tcccgaatggagtcca

SEQ ID NO: 5448336 - DNA, 16 bp, Homo sapiens
tcccgacccagccagc

SEQ ID NO: 5448337 - DNA, 23 bp, Homo sapiens
tcccgacccagccagctgcaggg

SEQ ID NO: 5448338 - DNA, 14 bp, Homo sapiens
tcccgacctcttag

SEQ ID NO: 5448339 - DNA, 17 bp, Homo sapiens
tcccgacctcttagaaa

SEQ ID NO: 5448340 - DNA, 17 bp, Homo sapiens
tcccgactgaccactgg

SEQ ID NO: 5448341 - DNA, 19 bp, Homo sapiens
tcccgagcaaccctctgaa

SEQ ID NO: 5448342 - DNA, 22 bp, Homo sapiens
tcccgagcaatggcgcctgctc

SEQ ID NO: 5448343 - DNA, 18 bp, Homo sapiens
tcccgagccccctgtcct

SEQ ID NO: 5448344 - DNA, 21 bp, Homo sapiens
tcccgagctactctcttgcca

SEQ ID NO: 5448345 - DNA, 16 bp, Homo sapiens
tcccgaggaagcacag

SEQ ID NO: 5448346 - DNA, 17 bp, Homo sapiens
tcccgaggaagcacagc

SEQ ID NO: 5448347 - DNA, 15 bp, Homo sapiens
tcccgaggaggggcc

SEQ ID NO: 5448348 - DNA, 12 bp, Homo sapiens
tcccgaggcagc

SEQ ID NO: 5448349 - DNA, 18 bp, Homo sapiens
tcccgaggcttgctgccc

SEQ ID NO: 5448350 - DNA, 15 bp, Homo sapiens
tcccgagggagctgc

SEQ ID NO: 5448351 - DNA, 18 bp, Homo sapiens
tcccgaggtcagccaggc

SEQ ID NO: 5448352 - DNA, 18 bp, Homo sapiens
tcccgagtacagtctgta

SEQ ID NO: 5448353 - DNA, 18 bp, Homo sapiens
tcccgagtagctgggact

SEQ ID NO: 5448354 - DNA, 20 bp, Homo sapiens
tcccgagtagctgggactac

SEQ ID NO: 5448355 - DNA, 20 bp, Homo sapiens
tcccgagtagctgggattac

SEQ ID NO: 5448356 - DNA, 21 bp, Homo sapiens
tcccgagtagctgggattaca

SEQ ID NO: 5448357 - DNA, 20 bp, Homo sapiens
tcccgatacctcagccctgg

SEQ ID NO: 5448358 - DNA, 15 bp, Homo sapiens
tcccgatgagggaag

SEQ ID NO: 5448359 - DNA, 16 bp, Homo sapiens
tcccgatggtctctct

SEQ ID NO: 5448360 - DNA, 17 bp, Homo sapiens
tcccgatggtctctctc

SEQ ID NO: 5448361 - DNA, 21 bp, Homo sapiens
tcccgcaaaccccctttgtgc

SEQ ID NO: 5448362 - DNA, 22 bp, Homo sapiens
tcccgcaaaccccctttgtgct

SEQ ID NO: 5448363 - DNA, 16 bp, Homo sapiens
tcccgcactctgcccc

SEQ ID NO: 5448364 - DNA, 14 bp, Homo sapiens
tcccgcagcaccag

SEQ ID NO: 5448365 - DNA, 15 bp, Homo sapiens
tcccgcagcaccagc

SEQ ID NO: 5448366 - DNA, 21 bp, Homo sapiens
tcccgcagcaccagcctgagc

SEQ ID NO: 5448367 - DNA, 14 bp, Homo sapiens
tcccgcagcctcgc

SEQ ID NO: 5448368 - DNA, 19 bp, Homo sapiens
tcccgcagtgggagcaaac

SEQ ID NO: 5448369 - DNA, 20 bp, Homo sapiens
tcccgcagtgggagcaaact

SEQ ID NO: 5448370 - DNA, 15 bp, Homo sapiens
tccctccagagactc

SEQ ID NO: 5448371 - DNA, 14 bp, Homo sapiens
tccctccagcacaa

SEQ ID NO: 5448372 - DNA, 17 bp, Homo sapiens
tccctccagcacaaaca

SEQ ID NO: 5448373 - DNA, 22 bp, Homo sapiens
tccctccagcacaaacacaagg

SEQ ID NO: 5448374 - DNA, 14 bp, Homo sapiens
tccctccagctgcg

SEQ ID NO: 5448375 - DNA, 15 bp, Homo sapiens
tccctccagctgcga

SEQ ID NO: 5448376 - DNA, 15 bp, Homo sapiens
tccctccagggtcct

SEQ ID NO: 5448377 - DNA, 16 bp, Homo sapiens
tccctccagtaccata

SEQ ID NO: 5448378 - DNA, 22 bp, Homo sapiens
tccctccagtaccataatctta

SEQ ID NO: 5448379 - DNA, 23 bp, Homo sapiens
tccctccagtattgccccctctc

SEQ ID NO: 5448380 - DNA, 16 bp, Homo sapiens
tccctccattcatcct

SEQ ID NO: 5448381 - DNA, 18 bp, Homo sapiens
tccctcccacacttccca

SEQ ID NO: 5448382 - DNA, 21 bp, Homo sapiens
tccctcccacctctgtgacct

SEQ ID NO: 5448383 - DNA, 16 bp, Homo sapiens
tccctcccactccctg

SEQ ID NO: 5448384 - DNA, 17 bp, Homo sapiens
tccctcccactccctgg

SEQ ID NO: 5448385 - DNA, 12 bp, Homo sapiens
tccctcccagaa

SEQ ID NO: 5448386 - DNA, 23 bp, Homo sapiens
tccctcccagagcacctgctgtc

SEQ ID NO: 5448387 - DNA, 14 bp, Homo sapiens
tccctcccagatcc

SEQ ID NO: 5448388 - DNA, 12 bp, Homo sapiens
tccctcccagcg

SEQ ID NO: 5448389 - DNA, 12 bp, Homo sapiens
tccctcccagct

SEQ ID NO: 5448390 - DNA, 13 bp, Homo sapiens
tccctcccagctc

SEQ ID NO: 5448391 - DNA, 16 bp, Homo sapiens
tccctcccagctgcac

SEQ ID NO: 5448392 - DNA, 18 bp, Homo sapiens
tccctcccatcatgcccg

SEQ ID NO: 5448393 - DNA, 16 bp, Homo sapiens
tccctcccatcctcca

SEQ ID NO: 5448394 - DNA, 15 bp, Homo sapiens
tccctccccaaatgg

SEQ ID NO: 5448395 - DNA, 20 bp, Homo sapiens
tccctccccaaatggctgct

SEQ ID NO: 5448396 - DNA, 20 bp, Homo sapiens
tccctccccagatctgtcct

SEQ ID NO: 5448397 - DNA, 16 bp, Homo sapiens
tccctccccagctccg

SEQ ID NO: 5448398 - DNA, 15 bp, Homo sapiens
tccctccccagtgtt

SEQ ID NO: 5448399 - DNA, 16 bp, Homo sapiens
tccctccccctccttg

SEQ ID NO: 5448400 - DNA, 23 bp, Homo sapiens
tccctccccctgcagccatccca

SEQ ID NO: 5448401 - DNA, 18 bp, Homo sapiens
tccctccccctgcccctt

SEQ ID NO: 5448402 - DNA, 12 bp, Homo sapiens
tccctccccctt

SEQ ID NO: 5448403 - DNA, 13 bp, Homo sapiens
tccctcccctctc

SEQ ID NO: 5448404 - DNA, 16 bp, Homo sapiens
tccctcccctctcaga

SEQ ID NO: 5448405 - DNA, 21 bp, Homo sapiens
tccctcccctctcagaacata

SEQ ID NO: 5448406 - DNA, 15 bp, Homo sapiens
tccctcccctgccct

SEQ ID NO: 5448407 - DNA, 16 bp, Homo sapiens
tccctcccctgccctg

SEQ ID NO: 5448408 - DNA, 15 bp, Homo sapiens
tccctcccctgctca

SEQ ID NO: 5448409 - DNA, 17 bp, Homo sapiens
tccctcccctgctcaga

SEQ ID NO: 5448410 - DNA, 22 bp, Homo sapiens
tccctcccctggggacagcaag

SEQ ID NO: 5448411 - DNA, 13 bp, Homo sapiens
tccctccccttgc

SEQ ID NO: 5448412 - DNA, 17 bp, Homo sapiens
tccctcccggctgcccc

SEQ ID NO: 5448413 - DNA, 21 bp, Homo sapiens
tccctcccgtgtgtggttgga

SEQ ID NO: 5448414 - DNA, 18 bp, Homo sapiens
tccctccctagcccttcc

SEQ ID NO: 5448415 - DNA, 12 bp, Homo sapiens
tccctccctcca

SEQ ID NO: 5448416 - DNA, 16 bp, Homo sapiens
tccctccctccacacc

SEQ ID NO: 5448417 - DNA, 17 bp, Homo sapiens
tccctccctccacacct

SEQ ID NO: 5448418 - DNA, 17 bp, Homo sapiens
tccctccctccacctcc

SEQ ID NO: 5448419 - DNA, 15 bp, Homo sapiens
tccctccctcccaga

SEQ ID NO: 5448420 - DNA, 16 bp, Homo sapiens
tccctccctccctgct

SEQ ID NO: 5448421 - DNA, 14 bp, Homo sapiens
tccctccctctccg

SEQ ID NO: 5448422 - DNA, 15 bp, Homo sapiens
tccctccctctctca

SEQ ID NO: 5448423 - DNA, 14 bp, Homo sapiens
tccctccctctgcc

SEQ ID NO: 5448424 - DNA, 17 bp, Homo sapiens
tccctccctctttccca

SEQ ID NO: 5448425 - DNA, 13 bp, Homo sapiens
tccctccctgcag

SEQ ID NO: 5448426 - DNA, 12 bp, Homo sapiens
tccctccctgct

SEQ ID NO: 5448427 - DNA, 22 bp, Homo sapiens
tccctcccttctttccttcctt

SEQ ID NO: 5448428 - DNA, 14 bp, Homo sapiens
tccctcccttgctg

SEQ ID NO: 5448429 - DNA, 18 bp, Homo sapiens
tccctcccttgctgaaca

SEQ ID NO: 5448430 - DNA, 14 bp, Homo sapiens
tccctcccttgggg

SEQ ID NO: 5448431 - DNA, 18 bp, Homo sapiens
tccctccgaacgctgctc

SEQ ID NO: 5448432 - DNA, 19 bp, Homo sapiens
tccctccgaacgctgctcc

SEQ ID NO: 5448433 - DNA, 20 bp, Homo sapiens
tccctccgaacgctgctcca

SEQ ID NO: 5448434 - DNA, 17 bp, Homo sapiens
tccctccgactccagat

SEQ ID NO: 5448435 - DNA, 14 bp, Homo sapiens
tccctccgagcttg

SEQ ID NO: 5448436 - DNA, 20 bp, Homo sapiens
tccctccgcggcgggccctg

SEQ ID NO: 5448437 - DNA, 20 bp, Homo sapiens
tccctccgctaaggcttccg

SEQ ID NO: 5448438 - DNA, 13 bp, Homo sapiens
tccctccgggcag

SEQ ID NO: 5448439 - DNA, 16 bp, Homo sapiens
tccctccgggcagggg

SEQ ID NO: 5448440 - DNA, 15 bp, Homo sapiens
tccctccgtccctct

SEQ ID NO: 5448441 - DNA, 17 bp, Homo sapiens
tccctccgtccctctgt

SEQ ID NO: 5448442 - DNA, 17 bp, Homo sapiens
tccctcctcacactcca

SEQ ID NO: 5448443 - DNA, 19 bp, Homo sapiens
tccctcctcacactccaga

SEQ ID NO: 5448444 - DNA, 13 bp, Homo sapiens
tccctcctcacct

SEQ ID NO: 5448445 - DNA, 17 bp, Homo sapiens
tccctcctcacctctgg

SEQ ID NO: 5448446 - DNA, 18 bp, Homo sapiens
tccctcctcacctctgga

SEQ ID NO: 5448447 - DNA, 12 bp, Homo sapiens
tccctcctccca

SEQ ID NO: 5448448 - DNA, 13 bp, Homo sapiens
tccctcctcccat

SEQ ID NO: 5448449 - DNA, 15 bp, Homo sapiens
tccctcctcccatct

SEQ ID NO: 5448450 - DNA, 16 bp, Homo sapiens
tccctcctcccatgtc

SEQ ID NO: 5448451 - DNA, 13 bp, Homo sapiens
tccctcctctccc

SEQ ID NO: 5448452 - DNA, 14 bp, Homo sapiens
tccctcctctggca

SEQ ID NO: 5448453 - DNA, 15 bp, Homo sapiens
tccctcctctggcag

SEQ ID NO: 5448454 - DNA, 12 bp, Homo sapiens
tccctcctcttc

SEQ ID NO: 5448455 - DNA, 12 bp, Homo sapiens
tccctcctgagc

SEQ ID NO: 5448456 - DNA, 13 bp, Homo sapiens
tccctcctgagct

SEQ ID NO: 5448457 - DNA, 19 bp, Homo sapiens
tccctcctgagtgccccac

SEQ ID NO: 5448458 - DNA, 20 bp, Homo sapiens
tccctcctgagtgccccact

SEQ ID NO: 5448459 - DNA, 14 bp, Homo sapiens
tccctcctgcagct

SEQ ID NO: 5448460 - DNA, 16 bp, Homo sapiens
tccctcctgcaggctg

SEQ ID NO: 5448461 - DNA, 14 bp, Homo sapiens
tccctcctgcccag

SEQ ID NO: 5448462 - DNA, 15 bp, Homo sapiens
tccctcctgcccagg

SEQ ID NO: 5448463 - DNA, 16 bp, Homo sapiens
tccctcctgccgactc

SEQ ID NO: 5448464 - DNA, 13 bp, Homo sapiens
tccctcctgccgc

SEQ ID NO: 5448465 - DNA, 19 bp, Homo sapiens
tccctcctggagctctgtg

SEQ ID NO: 5448466 - DNA, 12 bp, Homo sapiens
tccctcctggcc

SEQ ID NO: 5448467 - DNA, 15 bp, Homo sapiens
tccctcctggccaga

SEQ ID NO: 5448468 - DNA, 24 bp, Homo sapiens
tccctcctggccagatgtcgctgg

SEQ ID NO: 5448469 - DNA, 14 bp, Homo sapiens
tccctcctggctca

SEQ ID NO: 5448470 - DNA, 17 bp, Homo sapiens
tccctcctggctcacag

SEQ ID NO: 5448471 - DNA, 20 bp, Homo sapiens
tccctcctggtcctggacac

SEQ ID NO: 5448472 - DNA, 19 bp, Homo sapiens
tccctcctgtgccccagct

SEQ ID NO: 5448473 - DNA, 14 bp, Homo sapiens
tccctcctgttgcc

SEQ ID NO: 5448474 - DNA, 17 bp, Homo sapiens
tccctcctgttgccaca

SEQ ID NO: 5448475 - DNA, 14 bp, Homo sapiens
tccctcctgttggg

SEQ ID NO: 5448476 - DNA, 11 bp, Homo sapiens
tccctccttgg

SEQ ID NO: 5448477 - DNA, 11 bp, Homo sapiens
tccctcctttc

SEQ ID NO: 5448478 - DNA, 13 bp, Homo sapiens
tccctcctttcct

SEQ ID NO: 5448479 - DNA, 16 bp, Homo sapiens
tccctcctttcctttt

SEQ ID NO: 5448480 - DNA, 23 bp, Homo sapiens
tccctcctttcctttttctttcc

SEQ ID NO: 5448481 - DNA, 14 bp, Homo sapiens
tccctccttttaaa

SEQ ID NO: 5448482 - DNA, 14 bp, Homo sapiens
tccctcgagctctg

SEQ ID NO: 5448483 - DNA, 15 bp, Homo sapiens
tccctcgagctctgt

SEQ ID NO: 5448484 - DNA, 22 bp, Homo sapiens
tccctcgagctctgtagcctgg

SEQ ID NO: 5448485 - DNA, 23 bp, Homo sapiens
tccctcgagctctgtagcctggt

SEQ ID NO: 5448486 - DNA, 22 bp, Homo sapiens
tccctcgatccccccattttct

SEQ ID NO: 5448487 - DNA, 17 bp, Homo sapiens
tccctcgcatccgcctc

SEQ ID NO: 5448488 - DNA, 18 bp, Homo sapiens
tccctcggagctgccagc

SEQ ID NO: 5448489 - DNA, 19 bp, Homo sapiens
tccctcggcgttagtccct

SEQ ID NO: 5448490 - DNA, 17 bp, Homo sapiens
tccctcgggggctcttc

SEQ ID NO: 5448491 - DNA, 19 bp, Homo sapiens
tccctcgggggctcttccc

SEQ ID NO: 5448492 - DNA, 15 bp, Homo sapiens
tccctcggtcacctg

SEQ ID NO: 5448493 - DNA, 16 bp, Homo sapiens
tccctcggtcagcacc

SEQ ID NO: 5448494 - DNA, 18 bp, Homo sapiens
tccctcggtcagcaccgt

SEQ ID NO: 5448495 - DNA, 18 bp, Homo sapiens
tccctcgtccacaggggc

SEQ ID NO: 5448496 - DNA, 19 bp, Homo sapiens
tccctcgtccacaggggca

SEQ ID NO: 5448497 - DNA, 15 bp, Homo sapiens
tccctcgtgggcttg

SEQ ID NO: 5448498 - DNA, 19 bp, Homo sapiens
tccctcgtgggcttgtgct

SEQ ID NO: 5448499 - DNA, 22 bp, Homo sapiens
tccctcgtgggcttgtgctcgg

SEQ ID NO: 5448500 - DNA, 16 bp, Homo sapiens
tccctctaacccagtg

SEQ ID NO: 5448501 - DNA, 20 bp, Homo sapiens
tccctctaaccccttgggtg

SEQ ID NO: 5448502 - DNA, 18 bp, Homo sapiens
tccctctaataaagctcc

SEQ ID NO: 5448503 - DNA, 23 bp, Homo sapiens
tccctctactgggagcctaccca

SEQ ID NO: 5448504 - DNA, 13 bp, Homo sapiens
tccctctagtgcc

SEQ ID NO: 5448505 - DNA, 16 bp, Homo sapiens
tccctctcaaccttgt

SEQ ID NO: 5448506 - DNA, 17 bp, Homo sapiens
tccctctcactccccag

SEQ ID NO: 5448507 - DNA, 15 bp, Homo sapiens
tccctctcagaggcc

SEQ ID NO: 5448508 - DNA, 19 bp, Homo sapiens
tccctctcagaggcctgct

SEQ ID NO: 5448509 - DNA, 20 bp, Homo sapiens
tccctctcaggcatgcctgt

SEQ ID NO: 5448510 - DNA, 16 bp, Homo sapiens
tccctctcagtgcctt

SEQ ID NO: 5448511 - DNA, 18 bp, Homo sapiens
tccctctcagtgccttct

SEQ ID NO: 5448512 - DNA, 13 bp, Homo sapiens
tccctctcatcca

SEQ ID NO: 5448513 - DNA, 22 bp, Homo sapiens
tccctctcatttagcctgtcct

SEQ ID NO: 5448514 - DNA, 12 bp, Homo sapiens
tccctctccaag

SEQ ID NO: 5448515 - DNA, 20 bp, Homo sapiens
tccctctccaagacagcagc

SEQ ID NO: 5448516 - DNA, 14 bp, Homo sapiens
tccctctccactct

SEQ ID NO: 5448517 - DNA, 21 bp, Homo sapiens
tccctctccactcttctctcc

SEQ ID NO: 5448518 - DNA, 16 bp, Homo sapiens
tccctctcccacccaa

SEQ ID NO: 5448519 - DNA, 18 bp, Homo sapiens
tccctctcccacccaagg

SEQ ID NO: 5448520 - DNA, 14 bp, Homo sapiens
tccctctcccaggc

SEQ ID NO: 5448521 - DNA, 17 bp, Homo sapiens
tccctctcccaggcccc

SEQ ID NO: 5448522 - DNA, 20 bp, Homo sapiens
tccctctcccaggccccatg

SEQ ID NO: 5448523 - DNA, 21 bp, Homo sapiens
tccctctcccaggccccatga

SEQ ID NO: 5448524 - DNA, 13 bp, Homo sapiens
tccctctcccagt

SEQ ID NO: 5448525 - DNA, 14 bp, Homo sapiens
tccctctccccgga

SEQ ID NO: 5448526 - DNA, 16 bp, Homo sapiens
tccctctccctctctc

SEQ ID NO: 5448527 - DNA, 12 bp, Homo sapiens
tccctctccctg

SEQ ID NO: 5448528 - DNA, 14 bp, Homo sapiens
tccctctccctgtc

SEQ ID NO: 5448529 - DNA, 20 bp, Homo sapiens
tccctctcctatgtggcagc

SEQ ID NO: 5448530 - DNA, 23 bp, Homo sapiens
tccctctcctctcctcctctgtg

SEQ ID NO: 5448531 - DNA, 19 bp, Homo sapiens
tccctctcctctgccctct

SEQ ID NO: 5448532 - DNA, 12 bp, Homo sapiens
tccctctcctgc

SEQ ID NO: 5448533 - DNA, 14 bp, Homo sapiens
tccctctcctgtcc

SEQ ID NO: 5448534 - DNA, 14 bp, Homo sapiens
tccctctccttcca

SEQ ID NO: 5448535 - DNA, 18 bp, Homo sapiens
tccctctccttgccccca

SEQ ID NO: 5448536 - DNA, 15 bp, Homo sapiens
tccctctcgctcccc

SEQ ID NO: 5448537 - DNA, 17 bp, Homo sapiens
tccctctcgctcccctc

SEQ ID NO: 5448538 - DNA, 14 bp, Homo sapiens
tccctctcgtaaga

SEQ ID NO: 5448539 - DNA, 19 bp, Homo sapiens
tccctctctcagcacagcc

SEQ ID NO: 5448540 - DNA, 16 bp, Homo sapiens
tccctctctcataccc

SEQ ID NO: 5448541 - DNA, 15 bp, Homo sapiens
tccctctctcatgag

SEQ ID NO: 5448542 - DNA, 17 bp, Homo sapiens
tccctctctcccatttc

SEQ ID NO: 5448543 - DNA, 18 bp, Homo sapiens
tccctctctccctgcctc

SEQ ID NO: 5448544 - DNA, 12 bp, Homo sapiens
tccctctctcct

SEQ ID NO: 5448545 - DNA, 17 bp, Homo sapiens
tccctctctcctggact

SEQ ID NO: 5448546 - DNA, 12 bp, Homo sapiens
tccctctctctt

SEQ ID NO: 5448547 - DNA, 16 bp, Homo sapiens
tccctctctcttctgc

SEQ ID NO: 5448548 - DNA, 19 bp, Homo sapiens
tccctctctcttctgctcc

SEQ ID NO: 5448549 - DNA, 21 bp, Homo sapiens
tccctctctcttctgctccac

SEQ ID NO: 5448550 - DNA, 12 bp, Homo sapiens
tccctctctgat

SEQ ID NO: 5448551 - DNA, 11 bp, Homo sapiens
tccctctctgc

SEQ ID NO: 5448552 - DNA, 23 bp, Homo sapiens
tccctgggcctcagcctccaggc

SEQ ID NO: 5448553 - DNA, 12 bp, Homo sapiens
tccctgggcctg

SEQ ID NO: 5448554 - DNA, 14 bp, Homo sapiens
tccctgggcctgct

SEQ ID NO: 5448555 - DNA, 19 bp, Homo sapiens
tccctgggcctgctgctga

SEQ ID NO: 5448556 - DNA, 18 bp, Homo sapiens
tccctgggcctgtctcag

SEQ ID NO: 5448557 - DNA, 11 bp, Homo sapiens
tccctgggctg

SEQ ID NO: 5448558 - DNA, 22 bp, Homo sapiens
tccctgggctgccaccagcccc

SEQ ID NO: 5448559 - DNA, 18 bp, Homo sapiens
tccctgggctggcatggg

SEQ ID NO: 5448560 - DNA, 21 bp, Homo sapiens
tccctgggctggcatggggag

SEQ ID NO: 5448561 - DNA, 17 bp, Homo sapiens
tccctggggaccaggag

SEQ ID NO: 5448562 - DNA, 19 bp, Homo sapiens
tccctggggaccaggagct

SEQ ID NO: 5448563 - DNA, 19 bp, Homo sapiens
tccctggggacggggctcc

SEQ ID NO: 5448564 - DNA, 18 bp, Homo sapiens
tccctggggagccctcag

SEQ ID NO: 5448565 - DNA, 19 bp, Homo sapiens
tccctggggagccctcagg

SEQ ID NO: 5448566 - DNA, 23 bp, Homo sapiens
tccctggggagccctcaggctcc

SEQ ID NO: 5448567 - DNA, 16 bp, Homo sapiens
tccctggggaggaccc

SEQ ID NO: 5448568 - DNA, 17 bp, Homo sapiens
tccctggggatatgcaa

SEQ ID NO: 5448569 - DNA, 15 bp, Homo sapiens
tccctggggcactcc

SEQ ID NO: 5448570 - DNA, 18 bp, Homo sapiens
tccctggggcactccccc

SEQ ID NO: 5448571 - DNA, 22 bp, Homo sapiens
tccctggggcactcccccagga

SEQ ID NO: 5448572 - DNA, 20 bp, Homo sapiens
tccctggggctagggggagc

SEQ ID NO: 5448573 - DNA, 14 bp, Homo sapiens
tccctggggctgtg

SEQ ID NO: 5448574 - DNA, 18 bp, Homo sapiens
tccctgggggaagccctg

SEQ ID NO: 5448575 - DNA, 21 bp, Homo sapiens
tccctgggggaagccctggat

SEQ ID NO: 5448576 - DNA, 19 bp, Homo sapiens
tccctgggggcatcctgct

SEQ ID NO: 5448577 - DNA, 21 bp, Homo sapiens
tccctgggggcatcctgcttc

SEQ ID NO: 5448578 - DNA, 15 bp, Homo sapiens
tccctgggggcccca

SEQ ID NO: 5448579 - DNA, 19 bp, Homo sapiens
tccctgggggccccaggat

SEQ ID NO: 5448580 - DNA, 19 bp, Homo sapiens
tccctgggggcgctgttcc

SEQ ID NO: 5448581 - DNA, 17 bp, Homo sapiens
tccctgggggcggccag

SEQ ID NO: 5448582 - DNA, 15 bp, Homo sapiens
tccctgggggtccca

SEQ ID NO: 5448583 - DNA, 15 bp, Homo sapiens
tccctgggggtgggg

SEQ ID NO: 5448584 - DNA, 16 bp, Homo sapiens
tccctggggttctcta

SEQ ID NO: 5448585 - DNA, 19 bp, Homo sapiens
tccctggggttctctacag

SEQ ID NO: 5448586 - DNA, 24 bp, Homo sapiens
tccctggggtttttttcatccctg

SEQ ID NO: 5448587 - DNA, 11 bp, Homo sapiens
tccctgggtgg

SEQ ID NO: 5448588 - DNA, 19 bp, Homo sapiens
tccctgggtggagcaggac

SEQ ID NO: 5448589 - DNA, 21 bp, Homo sapiens
tccctgggttagactgccagc

SEQ ID NO: 5448590 - DNA, 22 bp, Homo sapiens
tccctgggttagactgccagct

SEQ ID NO: 5448591 - DNA, 20 bp, Homo sapiens
tccctgggtttgggagccag

SEQ ID NO: 5448592 - DNA, 22 bp, Homo sapiens
tccctgggtttgggagccagga

SEQ ID NO: 5448593 - DNA, 17 bp, Homo sapiens
tccctggtaagaaaaag

SEQ ID NO: 5448594 - DNA, 15 bp, Homo sapiens
tccctggtcccctcc

SEQ ID NO: 5448595 - DNA, 14 bp, Homo sapiens
tccctggtcccttg

SEQ ID NO: 5448596 - DNA, 19 bp, Homo sapiens
tccctggtcccttggagac

SEQ ID NO: 5448597 - DNA, 14 bp, Homo sapiens
tccctggtccttca

SEQ ID NO: 5448598 - DNA, 13 bp, Homo sapiens
tccctggtgaaag

SEQ ID NO: 5448599 - DNA, 19 bp, Homo sapiens
tccctggtgagagggccgg

SEQ ID NO: 5448600 - DNA, 16 bp, Homo sapiens
tccctggtgcagaggt

SEQ ID NO: 5448601 - DNA, 16 bp, Homo sapiens
tccctggtgcctctgt

SEQ ID NO: 5448602 - DNA, 17 bp, Homo sapiens
tccctggtgcctctgtg

SEQ ID NO: 5448603 - DNA, 11 bp, Homo sapiens
tccctggtgct

SEQ ID NO: 5448604 - DNA, 17 bp, Homo sapiens
tccctggtggcagctca

SEQ ID NO: 5448605 - DNA, 19 bp, Homo sapiens
tccctggtggcagctcacc

SEQ ID NO: 5448606 - DNA, 23 bp, Homo sapiens
tccctggtggcagctcacctctc

SEQ ID NO: 5448607 - DNA, 17 bp, Homo sapiens
tccctggttctgatgat

SEQ ID NO: 5448608 - DNA, 17 bp, Homo sapiens
tccctggttgcctcatg

SEQ ID NO: 5448609 - DNA, 16 bp, Homo sapiens
tccctggttgcctctc

SEQ ID NO: 5448610 - DNA, 18 bp, Homo sapiens
tccctggtttgcagctgt

SEQ ID NO: 5448611 - DNA, 22 bp, Homo sapiens
tccctgtaaattgcagaattca

SEQ ID NO: 5448612 - DNA, 14 bp, Homo sapiens
tccctgtagctcag

SEQ ID NO: 5448613 - DNA, 14 bp, Homo sapiens
tccctgtagctctg

SEQ ID NO: 5448614 - DNA, 17 bp, Homo sapiens
tccctgtaggagtaaag

SEQ ID NO: 5448615 - DNA, 20 bp, Homo sapiens
tccctgtaggagtaaagata

SEQ ID NO: 5448616 - DNA, 19 bp, Homo sapiens
tccctgtagggtccaacca

SEQ ID NO: 5448617 - DNA, 23 bp, Homo sapiens
tccctgtagttgacaattctgca

SEQ ID NO: 5448618 - DNA, 20 bp, Homo sapiens
tccctgtatgtctacctctg

SEQ ID NO: 5448619 - DNA, 22 bp, Homo sapiens
tccctgtatgtctacctctgac

SEQ ID NO: 5448620 - DNA, 21 bp, Homo sapiens
tccctgtattttctttctcta

SEQ ID NO: 5448621 - DNA, 15 bp, Homo sapiens
tccctgtcaccaagc

SEQ ID NO: 5448622 - DNA, 22 bp, Homo sapiens
tccctgtcaccaagctcacagt

SEQ ID NO: 5448623 - DNA, 18 bp, Homo sapiens
tccctgtcacctcttccg

SEQ ID NO: 5448624 - DNA, 15 bp, Homo sapiens
tccctgtcacgctca

SEQ ID NO: 5448625 - DNA, 19 bp, Homo sapiens
tccctgtcacgctcatgtc

SEQ ID NO: 5448626 - DNA, 19 bp, Homo sapiens
tccctgtcaggacacatgg

SEQ ID NO: 5448627 - DNA, 13 bp, Homo sapiens
tccctgtccaccc

SEQ ID NO: 5448628 - DNA, 12 bp, Homo sapiens
tccctgtcccag

SEQ ID NO: 5448629 - DNA, 14 bp, Homo sapiens
tccctgtcccaggg

SEQ ID NO: 5448630 - DNA, 17 bp, Homo sapiens
tccctgtcccagggccc

SEQ ID NO: 5448631 - DNA, 14 bp, Homo sapiens
tccctgtcccagtt

SEQ ID NO: 5448632 - DNA, 20 bp, Homo sapiens
tccctgtccccaggcccagc

SEQ ID NO: 5448633 - DNA, 21 bp, Homo sapiens
tccctgtccccaggcccagcc

SEQ ID NO: 5448634 - DNA, 18 bp, Homo sapiens
tccctgtcccccagcatc

SEQ ID NO: 5448635 - DNA, 14 bp, Homo sapiens
tccctgtccctcta

SEQ ID NO: 5448636 - DNA, 14 bp, Homo sapiens
tccctgtccctgcc

SEQ ID NO: 5448637 - DNA, 15 bp, Homo sapiens
tccctgtccctgccc

SEQ ID NO: 5448638 - DNA, 23 bp, Homo sapiens
tccctgtcccttcgagtccagga

SEQ ID NO: 5448639 - DNA, 15 bp, Homo sapiens
tccctgtcctcctcg

SEQ ID NO: 5448640 - DNA, 14 bp, Homo sapiens
tccctgtcgcctgc

SEQ ID NO: 5448641 - DNA, 18 bp, Homo sapiens
tccctgtctccagctgcc

SEQ ID NO: 5448642 - DNA, 23 bp, Homo sapiens
tccctgtctccagggcccccacc

SEQ ID NO: 5448643 - DNA, 18 bp, Homo sapiens
tccctgtctgtgtcccag

SEQ ID NO: 5448644 - DNA, 20 bp, Homo sapiens
tccctgtctttcctaagacc

SEQ ID NO: 5448645 - DNA, 16 bp, Homo sapiens
tccctgtgatggccag

SEQ ID NO: 5448646 - DNA, 17 bp, Homo sapiens
tccctgtgatggccagg

SEQ ID NO: 5448647 - DNA, 13 bp, Homo sapiens
tccctgtgccact

SEQ ID NO: 5448648 - DNA, 14 bp, Homo sapiens
tccctgtgccccca

SEQ ID NO: 5448649 - DNA, 20 bp, Homo sapiens
tccctgtgctgacggaagcc

SEQ ID NO: 5448650 - DNA, 15 bp, Homo sapiens
tccctgtgctgatcc

SEQ ID NO: 5448651 - DNA, 14 bp, Homo sapiens
tccctgtgggctca

SEQ ID NO: 5448652 - DNA, 21 bp, Homo sapiens
tccctgtgggctcacaccggc

SEQ ID NO: 5448653 - DNA, 15 bp, Homo sapiens
tccctgtggggcagg

SEQ ID NO: 5448654 - DNA, 19 bp, Homo sapiens
tccctgtgggggtggccat

SEQ ID NO: 5448655 - DNA, 22 bp, Homo sapiens
tccctgtgggggtggccatccc

SEQ ID NO: 5448656 - DNA, 23 bp, Homo sapiens
tccctgtgggggtggccatccct

SEQ ID NO: 5448657 - DNA, 19 bp, Homo sapiens
tccctgtggtctacccgtg

SEQ ID NO: 5448658 - DNA, 22 bp, Homo sapiens
tccctgtgtccacctgtgggtg

SEQ ID NO: 5448659 - DNA, 16 bp, Homo sapiens
tccctgtgtctttttc

SEQ ID NO: 5448660 - DNA, 12 bp, Homo sapiens
tccctgtgtgga

SEQ ID NO: 5448661 - DNA, 20 bp, Homo sapiens
tccctgtgtggaccatgggg

SEQ ID NO: 5448662 - DNA, 21 bp, Homo sapiens
tccctgtgtggatgctgagct

SEQ ID NO: 5448663 - DNA, 23 bp, Homo sapiens
tccctgtgtggatgctgagctgt

SEQ ID NO: 5448664 - DNA, 19 bp, Homo sapiens
tccctgtgttctgggctgg

SEQ ID NO: 5448665 - DNA, 22 bp, Homo sapiens
tccctgtgttctgggctggggc

SEQ ID NO: 5448666 - DNA, 17 bp, Homo sapiens
tccctgttaataaacag

SEQ ID NO: 5448667 - DNA, 18 bp, Homo sapiens
tccctgttaataaacagc

SEQ ID NO: 5448668 - DNA, 23 bp, Homo sapiens
tccctgttagaaatgttagtgcc

SEQ ID NO: 5448669 - DNA, 15 bp, Homo sapiens
tccctgttattttca

SEQ ID NO: 5448670 - DNA, 22 bp, Homo sapiens
tccctgttatttttctgccctg

SEQ ID NO: 5448671 - DNA, 23 bp, Homo sapiens
tccctgttatttttctgccctgg

SEQ ID NO: 5448672 - DNA, 16 bp, Homo sapiens
tccctgttccccacag

SEQ ID NO: 5448673 - DNA, 17 bp, Homo sapiens
tccctgttccccacagg

SEQ ID NO: 5448674 - DNA, 15 bp, Homo sapiens
tccctgttccccaga

SEQ ID NO: 5448675 - DNA, 18 bp, Homo sapiens
tccctgttccccagagaa

SEQ ID NO: 5448676 - DNA, 10 bp, Homo sapiens
tccctgttct

SEQ ID NO: 5448677 - DNA, 16 bp, Homo sapiens
tccctgttctcagctc

SEQ ID NO: 5448678 - DNA, 15 bp, Homo sapiens
tccctgttctccctt

SEQ ID NO: 5448679 - DNA, 19 bp, Homo sapiens
tccctgttctccctttctc

SEQ ID NO: 5448680 - DNA, 15 bp, Homo sapiens
tccctgttctggaca

SEQ ID NO: 5448681 - DNA, 15 bp, Homo sapiens
tccctgttcttcctc

SEQ ID NO: 5448682 - DNA, 17 bp, Homo sapiens
tccctgttcttcctcca

SEQ ID NO: 5448683 - DNA, 13 bp, Homo sapiens
tccctgttgtcag

SEQ ID NO: 5448684 - DNA, 15 bp, Homo sapiens
tccctgtttaatatt

SEQ ID NO: 5448685 - DNA, 18 bp, Homo sapiens
tccctgtttaatatttaa

SEQ ID NO: 5448686 - DNA, 20 bp, Homo sapiens
tccctgtttgaagcctgccc

SEQ ID NO: 5448687 - DNA, 14 bp, Homo sapiens
tccctgtttgccta

SEQ ID NO: 5448688 - DNA, 20 bp, Homo sapiens
tccctgttttagtttctgaa

SEQ ID NO: 5448689 - DNA, 11 bp, Homo sapiens
tccctgttttc

SEQ ID NO: 5448690 - DNA, 19 bp, Homo sapiens
tccctgttttcccacgagg

SEQ ID NO: 5448691 - DNA, 18 bp, Homo sapiens
tcccttaaaatagaaata

SEQ ID NO: 5448692 - DNA, 22 bp, Homo sapiens
tcccttaaacaaaaattaaaat

SEQ ID NO: 5448693 - DNA, 19 bp, Homo sapiens
tcccttaaatacagataat

SEQ ID NO: 5448694 - DNA, 17 bp, Homo sapiens
tcccttaactccaagaa

SEQ ID NO: 5448695 - DNA, 17 bp, Homo sapiens
tcccttaacttttcctt

SEQ ID NO: 5448696 - DNA, 20 bp, Homo sapiens
tcccttaaggggtatcatgt

SEQ ID NO: 5448697 - DNA, 13 bp, Homo sapiens
tcccttaataaaa

SEQ ID NO: 5448698 - DNA, 14 bp, Homo sapiens
tcccttaatatcct

SEQ ID NO: 5448699 - DNA, 17 bp, Homo sapiens
tcccttaatatcctaaa

SEQ ID NO: 5448700 - DNA, 21 bp, Homo sapiens
tcccttaatatcctaaacatc

SEQ ID NO: 5448701 - DNA, 20 bp, Homo sapiens
tcccttaatattgaggctgc

SEQ ID NO: 5448702 - DNA, 16 bp, Homo sapiens
tcccttacccatcttg

SEQ ID NO: 5448703 - DNA, 16 bp, Homo sapiens
tcccttacctcctttc

SEQ ID NO: 5448704 - DNA, 22 bp, Homo sapiens
tcccttacgtgagtcctggcat

SEQ ID NO: 5448705 - DNA, 15 bp, Homo sapiens
tcccttagcctctcc

SEQ ID NO: 5448706 - DNA, 18 bp, Homo sapiens
tcccttagcctctcccac

SEQ ID NO: 5448707 - DNA, 20 bp, Homo sapiens
tcccttagcctctcccaccc

SEQ ID NO: 5448708 - DNA, 16 bp, Homo sapiens
tcccttaggcattatt

SEQ ID NO: 5448709 - DNA, 18 bp, Homo sapiens
tcccttaggcattattta

SEQ ID NO: 5448710 - DNA, 16 bp, Homo sapiens
tcccttagtactcttc

SEQ ID NO: 5448711 - DNA, 18 bp, Homo sapiens
tcccttatccaaaatgct

SEQ ID NO: 5448712 - DNA, 19 bp, Homo sapiens
tcccttatgcaggacatgt

SEQ ID NO: 5448713 - DNA, 21 bp, Homo sapiens
tcccttcaaccattccccatg

SEQ ID NO: 5448714 - DNA, 16 bp, Homo sapiens
tcccttcaaggcctcc

SEQ ID NO: 5448715 - DNA, 17 bp, Homo sapiens
tcccttcaaggcctccc

SEQ ID NO: 5448716 - DNA, 17 bp, Homo sapiens
tcccttcaagtataata

SEQ ID NO: 5448717 - DNA, 19 bp, Homo sapiens
tcccttcaatcctgtcaat

SEQ ID NO: 5448718 - DNA, 19 bp, Homo sapiens
tcccttcacaggggtacag

SEQ ID NO: 5448719 - DNA, 14 bp, Homo sapiens
tcccttcacctcct

SEQ ID NO: 5448720 - DNA, 13 bp, Homo sapiens
tcccttcagcccc

SEQ ID NO: 5448721 - DNA, 19 bp, Homo sapiens
tcccttcagggattccctg

SEQ ID NO: 5448722 - DNA, 20 bp, Homo sapiens
tcccttcagggattccctgt

SEQ ID NO: 5448723 - DNA, 18 bp, Homo sapiens
tcccttcagtaccctctc

SEQ ID NO: 5448724 - DNA, 23 bp, Homo sapiens
tcccttcagtaccctctcagctc

SEQ ID NO: 5448725 - DNA, 16 bp, Homo sapiens
tcccttcatacttgaa

SEQ ID NO: 5448726 - DNA, 21 bp, Homo sapiens
tcccttcatctggaaccatca

SEQ ID NO: 5448727 - DNA, 18 bp, Homo sapiens
tcccttcatgcatggaaa

SEQ ID NO: 5448728 - DNA, 20 bp, Homo sapiens
tcccttcatttaaactaaat

SEQ ID NO: 5448729 - DNA, 15 bp, Homo sapiens
tccgctgtcacccag

SEQ ID NO: 5448730 - DNA, 19 bp, Homo sapiens
tccgctgtcacccagcaag

SEQ ID NO: 5448731 - DNA, 18 bp, Homo sapiens
tccgctgtctccctcctg

SEQ ID NO: 5448732 - DNA, 20 bp, Homo sapiens
tccgctgtgcccgccctggg

SEQ ID NO: 5448733 - DNA, 12 bp, Homo sapiens
tccgcttccctg

SEQ ID NO: 5448734 - DNA, 13 bp, Homo sapiens
tccgcttctcctg

SEQ ID NO: 5448735 - DNA, 18 bp, Homo sapiens
tccgcttctcctgcagtg

SEQ ID NO: 5448736 - DNA, 15 bp, Homo sapiens
tccgctttcctggag

SEQ ID NO: 5448737 - DNA, 18 bp, Homo sapiens
tccgctttctacccagcg

SEQ ID NO: 5448738 - DNA, 21 bp, Homo sapiens
tccgctttctacccagcgagc

SEQ ID NO: 5448739 - DNA, 18 bp, Homo sapiens
tccgctttgaaagaagca

SEQ ID NO: 5448740 - DNA, 19 bp, Homo sapiens
tccgctttgaaagaagcaa

SEQ ID NO: 5448741 - DNA, 20 bp, Homo sapiens
tccgctttgaaagaagcaag

SEQ ID NO: 5448742 - DNA, 18 bp, Homo sapiens
tccggaaaaatggggttt

SEQ ID NO: 5448743 - DNA, 17 bp, Homo sapiens
tccggaacagccaaaga

SEQ ID NO: 5448744 - DNA, 22 bp, Homo sapiens
tccggaacagccaaagaaactc

SEQ ID NO: 5448745 - DNA, 21 bp, Homo sapiens
tccggaacgtagtcggcacag

SEQ ID NO: 5448746 - DNA, 22 bp, Homo sapiens
tccggaagtaaatacagcaatt

SEQ ID NO: 5448747 - DNA, 12 bp, Homo sapiens
tccggactggtg

SEQ ID NO: 5448748 - DNA, 14 bp, Homo sapiens
tccggagcgaccct

SEQ ID NO: 5448749 - DNA, 19 bp, Homo sapiens
tccggagcgaccctggctc

SEQ ID NO: 5448750 - DNA, 14 bp, Homo sapiens
tccggagcgccctg

SEQ ID NO: 5448751 - DNA, 15 bp, Homo sapiens
tccggagcgccctgc

SEQ ID NO: 5448752 - DNA, 19 bp, Homo sapiens
tccggagcgccctgcaggg

SEQ ID NO: 5448753 - DNA, 16 bp, Homo sapiens
tccggaggactgagcc

SEQ ID NO: 5448754 - DNA, 21 bp, Homo sapiens
tccggaggagaagaaggaaat

SEQ ID NO: 5448755 - DNA, 17 bp, Homo sapiens
tccggaggagcagcctc

SEQ ID NO: 5448756 - DNA, 21 bp, Homo sapiens
tccggaggatattaaaatgct

SEQ ID NO: 5448757 - DNA, 17 bp, Homo sapiens
tccggaggggacccagc

SEQ ID NO: 5448758 - DNA, 19 bp, Homo sapiens
tccggaggggacccagctc

SEQ ID NO: 5448759 - DNA, 21 bp, Homo sapiens
tccggaggggttgcgggggag

SEQ ID NO: 5448760 - DNA, 23 bp, Homo sapiens
tccggaggggttgcgggggagct

SEQ ID NO: 5448761 - DNA, 15 bp, Homo sapiens
tccggagtagctggg

SEQ ID NO: 5448762 - DNA, 20 bp, Homo sapiens
tccggatggaatcacagcca

SEQ ID NO: 5448763 - DNA, 13 bp, Homo sapiens
tccggatttctaa

SEQ ID NO: 5448764 - DNA, 18 bp, Homo sapiens
tccggcaccagtagcagg

SEQ ID NO: 5448765 - DNA, 12 bp, Homo sapiens
tccggcagaggc

SEQ ID NO: 5448766 - DNA, 21 bp, Homo sapiens
tccggcagaggcagggccctg

SEQ ID NO: 5448767 - DNA, 21 bp, Homo sapiens
tccggcagcctctcttcactg

SEQ ID NO: 5448768 - DNA, 19 bp, Homo sapiens
tccggcatgagggctgaga

SEQ ID NO: 5448769 - DNA, 19 bp, Homo sapiens
tccggcatggacaatggac

SEQ ID NO: 5448770 - DNA, 11 bp, Homo sapiens
tccggccaggt

SEQ ID NO: 5448771 - DNA, 16 bp, Homo sapiens
tccggccatactgcct

SEQ ID NO: 5448772 - DNA, 15 bp, Homo sapiens
tccggcccagtgcca

SEQ ID NO: 5448773 - DNA, 17 bp, Homo sapiens
tccggcccagtgccagc

SEQ ID NO: 5448774 - DNA, 19 bp, Homo sapiens
tccggcccagtgccagctc

SEQ ID NO: 5448775 - DNA, 23 bp, Homo sapiens
tccggccccgtctctcttggacc

SEQ ID NO: 5448776 - DNA, 14 bp, Homo sapiens
tccggcctctccct

SEQ ID NO: 5448777 - DNA, 15 bp, Homo sapiens
tccggcctctccctg

SEQ ID NO: 5448778 - DNA, 23 bp, Homo sapiens
tccggcctgcactcccccagttc

SEQ ID NO: 5448779 - DNA, 17 bp, Homo sapiens
tccggcctgcagcccag

SEQ ID NO: 5448780 - DNA, 18 bp, Homo sapiens
tccggcctgcagcccaga

SEQ ID NO: 5448781 - DNA, 15 bp, Homo sapiens
tccggcctgtaatca

SEQ ID NO: 5448782 - DNA, 24 bp, Homo sapiens
tccggcctgtaatcagctctcctg

SEQ ID NO: 5448783 - DNA, 14 bp, Homo sapiens
tccggcgcagacag

SEQ ID NO: 5448784 - DNA, 22 bp, Homo sapiens
tccggcgcagacaggcggggcc

SEQ ID NO: 5448785 - DNA, 17 bp, Homo sapiens
tccggcgccccgcaccc

SEQ ID NO: 5448786 - DNA, 21 bp, Homo sapiens
tccggcgccccgcacccccgc

SEQ ID NO: 5448787 - DNA, 20 bp, Homo sapiens
tccggcggccccgccgcaga

SEQ ID NO: 5448788 - DNA, 19 bp, Homo sapiens
tccggcggcgagctctggc

SEQ ID NO: 5448789 - DNA, 15 bp, Homo sapiens
tccggcgtcagcctc

SEQ ID NO: 5448790 - DNA, 15 bp, Homo sapiens
tccggctaagcaggc

SEQ ID NO: 5448791 - DNA, 12 bp, Homo sapiens
tccggctcccag

SEQ ID NO: 5448792 - DNA, 15 bp, Homo sapiens
tccggctcccagcct

SEQ ID NO: 5448793 - DNA, 14 bp, Homo sapiens
tccggctcctgtgc

SEQ ID NO: 5448794 - DNA, 16 bp, Homo sapiens
tccggctgagctgtgc

SEQ ID NO: 5448795 - DNA, 18 bp, Homo sapiens
tccggctgagctgtgcca

SEQ ID NO: 5448796 - DNA, 14 bp, Homo sapiens
tccggctgcctagc

SEQ ID NO: 5448797 - DNA, 22 bp, Homo sapiens
tccggctgctcctccagccctt

SEQ ID NO: 5448798 - DNA, 13 bp, Homo sapiens
tccggctggacct

SEQ ID NO: 5448799 - DNA, 21 bp, Homo sapiens
tccggcttgacctgtttctct

SEQ ID NO: 5448800 - DNA, 13 bp, Homo sapiens
tccgggaaaacag

SEQ ID NO: 5448801 - DNA, 16 bp, Homo sapiens
tccgggaaaacagcta

SEQ ID NO: 5448802 - DNA, 13 bp, Homo sapiens
tccgggaactttg

SEQ ID NO: 5448803 - DNA, 20 bp, Homo sapiens
tccgggacacctgggccggg

SEQ ID NO: 5448804 - DNA, 16 bp, Homo sapiens
tccgggacccccagga

SEQ ID NO: 5448805 - DNA, 21 bp, Homo sapiens
tccgggacctggtgctgcctc

SEQ ID NO: 5448806 - DNA, 15 bp, Homo sapiens
tccgggacgcttcca

SEQ ID NO: 5448807 - DNA, 16 bp, Homo sapiens
tccgggacgcttccag

SEQ ID NO: 5448808 - DNA, 18 bp, Homo sapiens
tccgggacgcttccagac

SEQ ID NO: 5448809 - DNA, 13 bp, Homo sapiens
tccgggactgacc

SEQ ID NO: 5448810 - DNA, 23 bp, Homo sapiens
tccgggagggtgcggctgtgcag

SEQ ID NO: 5448811 - DNA, 12 bp, Homo sapiens
tccgggcagaaa

SEQ ID NO: 5448812 - DNA, 22 bp, Homo sapiens
tccgggcaggcaaggtttacac

SEQ ID NO: 5448813 - DNA, 17 bp, Homo sapiens
tccgggcaggggagcca

SEQ ID NO: 5448814 - DNA, 20 bp, Homo sapiens
tccgggcctcggcctggctt

SEQ ID NO: 5448815 - DNA, 23 bp, Homo sapiens
tccgggctgggggggctgcctcc

SEQ ID NO: 5448816 - DNA, 18 bp, Homo sapiens
tccgggctttcccccagg

SEQ ID NO: 5448817 - DNA, 20 bp, Homo sapiens
tccggggaggagccttggag

SEQ ID NO: 5448818 - DNA, 18 bp, Homo sapiens
tccgggggccaaggacag

SEQ ID NO: 5448819 - DNA, 14 bp, Homo sapiens
tccgggggtacagc

SEQ ID NO: 5448820 - DNA, 15 bp, Homo sapiens
tccggggtctgtgct

SEQ ID NO: 5448821 - DNA, 20 bp, Homo sapiens
tccggggttcagcctcctgt

SEQ ID NO: 5448822 - DNA, 15 bp, Homo sapiens
tccgggtcactgctg

SEQ ID NO: 5448823 - DNA, 14 bp, Homo sapiens
tccgggtgccattc

SEQ ID NO: 5448824 - DNA, 14 bp, Homo sapiens
tccgggtgctcaat

SEQ ID NO: 5448825 - DNA, 14 bp, Homo sapiens
tccgggtgtagatt

SEQ ID NO: 5448826 - DNA, 20 bp, Homo sapiens
tccgggtttgagatggacac

SEQ ID NO: 5448827 - DNA, 23 bp, Homo sapiens
tccggtcccaaatgtagcaggtg

SEQ ID NO: 5448828 - DNA, 20 bp, Homo sapiens
tccggtcggatctctctcct

SEQ ID NO: 5448829 - DNA, 15 bp, Homo sapiens
tccggtgccttccac

SEQ ID NO: 5448830 - DNA, 22 bp, Homo sapiens
tccggtgtctggaaaagcactt

SEQ ID NO: 5448831 - DNA, 23 bp, Homo sapiens
tccggtgtctggaaaagcacttt

SEQ ID NO: 5448832 - DNA, 15 bp, Homo sapiens
tccggtgtgcctgca

SEQ ID NO: 5448833 - DNA, 19 bp, Homo sapiens
tccggtgtgcctgcagccc

SEQ ID NO: 5448834 - DNA, 14 bp, Homo sapiens
tccggtgtgtcaga

SEQ ID NO: 5448835 - DNA, 16 bp, Homo sapiens
tccggtgttctaagat

SEQ ID NO: 5448836 - DNA, 23 bp, Homo sapiens
tccggttccccgcaacccacagc

SEQ ID NO: 5448837 - DNA, 18 bp, Homo sapiens
tccggttgcatactggac

SEQ ID NO: 5448838 - DNA, 15 bp, Homo sapiens
tccgtaaaaatgatt

SEQ ID NO: 5448839 - DNA, 20 bp, Homo sapiens
tccgtaccatcggtcagcag

SEQ ID NO: 5448840 - DNA, 17 bp, Homo sapiens
tccgtacttgggtcaca

SEQ ID NO: 5448841 - DNA, 20 bp, Homo sapiens
tccgtagccagctgctcccc

SEQ ID NO: 5448842 - DNA, 21 bp, Homo sapiens
tccgtagccagctgctcccca

SEQ ID NO: 5448843 - DNA, 18 bp, Homo sapiens
tccgtagctcccctggct

SEQ ID NO: 5448844 - DNA, 17 bp, Homo sapiens
tccgtagctctgctgct

SEQ ID NO: 5448845 - DNA, 18 bp, Homo sapiens
tccgtagctctgctgctg

SEQ ID NO: 5448846 - DNA, 19 bp, Homo sapiens
tccgtagctctgctgctga

SEQ ID NO: 5448847 - DNA, 15 bp, Homo sapiens
tccgtagcttctagt

SEQ ID NO: 5448848 - DNA, 17 bp, Homo sapiens
tccgtaggacaagtttt

SEQ ID NO: 5448849 - DNA, 20 bp, Homo sapiens
tccgtagggtctttcttggg

SEQ ID NO: 5448850 - DNA, 16 bp, Homo sapiens
tccgtagttttgataa

SEQ ID NO: 5448851 - DNA, 17 bp, Homo sapiens
tccgtattctttgtgtt

SEQ ID NO: 5448852 - DNA, 18 bp, Homo sapiens
tccgtatttattttttta

SEQ ID NO: 5448853 - DNA, 22 bp, Homo sapiens
tccgtcaaaattggatttgtaa

SEQ ID NO: 5448854 - DNA, 15 bp, Homo sapiens
tccgtcaagctggtt

SEQ ID NO: 5448855 - DNA, 16 bp, Homo sapiens
tccgtcactacctggc

SEQ ID NO: 5448856 - DNA, 11 bp, Homo sapiens
tccgtcatcca

SEQ ID NO: 5448857 - DNA, 16 bp, Homo sapiens
tccgtcatccatgccc

SEQ ID NO: 5448858 - DNA, 20 bp, Homo sapiens
tccgtcatccatgccctccc

SEQ ID NO: 5448859 - DNA, 17 bp, Homo sapiens
tccgtcatctgcggggc

SEQ ID NO: 5448860 - DNA, 13 bp, Homo sapiens
tccgtcatgctcc

SEQ ID NO: 5448861 - DNA, 15 bp, Homo sapiens
tccgtccacccaggc

SEQ ID NO: 5448862 - DNA, 16 bp, Homo sapiens
tccgtccacccaggct

SEQ ID NO: 5448863 - DNA, 13 bp, Homo sapiens
tccgtccaccctt

SEQ ID NO: 5448864 - DNA, 19 bp, Homo sapiens
tccgtccacccttccatca

SEQ ID NO: 5448865 - DNA, 22 bp, Homo sapiens
tccgtccactacgctcctgtct

SEQ ID NO: 5448866 - DNA, 16 bp, Homo sapiens
tccgtcccaaacagag

SEQ ID NO: 5448867 - DNA, 17 bp, Homo sapiens
tccgtcccaaacagagg

SEQ ID NO: 5448868 - DNA, 22 bp, Homo sapiens
tccgtccccagggtgcaggcgc

SEQ ID NO: 5448869 - DNA, 16 bp, Homo sapiens
tccgtccccccccagg

SEQ ID NO: 5448870 - DNA, 20 bp, Homo sapiens
tccgtccccccccaggccct

SEQ ID NO: 5448871 - DNA, 24 bp, Homo sapiens
tccgtccctttttctccacactcc

SEQ ID NO: 5448872 - DNA, 12 bp, Homo sapiens
tccgtccgcccg

SEQ ID NO: 5448873 - DNA, 13 bp, Homo sapiens
tccgtccgcccgc

SEQ ID NO: 5448874 - DNA, 17 bp, Homo sapiens
tccgtccgcccgcccac

SEQ ID NO: 5448875 - DNA, 17 bp, Homo sapiens
tccgtccggtgtgtcag

SEQ ID NO: 5448876 - DNA, 16 bp, Homo sapiens
tccgtcctcgatggga

SEQ ID NO: 5448877 - DNA, 18 bp, Homo sapiens
tccgtcctctccccagcc

SEQ ID NO: 5448878 - DNA, 22 bp, Homo sapiens
tccgtcctctccccagcctggc

SEQ ID NO: 5448879 - DNA, 19 bp, Homo sapiens
tccgtcctgatgattttta

SEQ ID NO: 5448880 - DNA, 12 bp, Homo sapiens
tccgtcctgggc

SEQ ID NO: 5448881 - DNA, 16 bp, Homo sapiens
tccgtcctgtcactga

SEQ ID NO: 5448882 - DNA, 22 bp, Homo sapiens
tccgtcgggcccctgcctgcct

SEQ ID NO: 5448883 - DNA, 17 bp, Homo sapiens
tccgtctccctaaaata

SEQ ID NO: 5448884 - DNA, 19 bp, Homo sapiens
tccgtctccctaaaataaa

SEQ ID NO: 5448885 - DNA, 21 bp, Homo sapiens
tccgtctcctctccagcccta

SEQ ID NO: 5448886 - DNA, 18 bp, Homo sapiens
tccgtctctcttgcttga

SEQ ID NO: 5448887 - DNA, 17 bp, Homo sapiens
tccgtctgaccctctgc

SEQ ID NO: 5448888 - DNA, 21 bp, Homo sapiens
tccgtctgaccctctgcggcc

SEQ ID NO: 5448889 - DNA, 16 bp, Homo sapiens
tccgtctgtctcgatg

SEQ ID NO: 5448890 - DNA, 21 bp, Homo sapiens
tccgtctgtctcgatgcctga

SEQ ID NO: 5448891 - DNA, 22 bp, Homo sapiens
tccgtgaaaatatgtttggaat

SEQ ID NO: 5448892 - DNA, 13 bp, Homo sapiens
tccgtgaaagttg

SEQ ID NO: 5448893 - DNA, 20 bp, Homo sapiens
tccgtgaatggtctctgtca

SEQ ID NO: 5448894 - DNA, 15 bp, Homo sapiens
tccgtgaattgcttt

SEQ ID NO: 5448895 - DNA, 16 bp, Homo sapiens
tccgtgaattgcttta

SEQ ID NO: 5448896 - DNA, 19 bp, Homo sapiens
tccgtgaattgctttatgg

SEQ ID NO: 5448897 - DNA, 14 bp, Homo sapiens
tccgtgagacacaa

SEQ ID NO: 5448898 - DNA, 17 bp, Homo sapiens
tccgtgaggctgctgcc

SEQ ID NO: 5448899 - DNA, 18 bp, Homo sapiens
tccgtgaggctgctgcca

SEQ ID NO: 5448900 - DNA, 23 bp, Homo sapiens
tccgtgagttgggggagggaaga

SEQ ID NO: 5448901 - DNA, 18 bp, Homo sapiens
tccgtgatccatccatct

SEQ ID NO: 5448902 - DNA, 12 bp, Homo sapiens
tccgtgccaggc

SEQ ID NO: 5448903 - DNA, 23 bp, Homo sapiens
tccgtgcccaggcccttggctgc

SEQ ID NO: 5448904 - DNA, 20 bp, Homo sapiens
tccgtgccccttccctgggt

SEQ ID NO: 5448905 - DNA, 16 bp, Homo sapiens
tccgtgcctccaccac

SEQ ID NO: 5448906 - DNA, 14 bp, Homo sapiens
tcctcagctgccaa

SEQ ID NO: 5448907 - DNA, 14 bp, Homo sapiens
tcctcagctgcctc

SEQ ID NO: 5448908 - DNA, 15 bp, Homo sapiens
tcctcagctgcctcc

SEQ ID NO: 5448909 - DNA, 21 bp, Homo sapiens
tcctcagctgcctcctgcgcc

SEQ ID NO: 5448910 - DNA, 15 bp, Homo sapiens
tcctcagctgctccc

SEQ ID NO: 5448911 - DNA, 21 bp, Homo sapiens
tcctcagctggttactcaggg

SEQ ID NO: 5448912 - DNA, 23 bp, Homo sapiens
tcctcagctggttactcagggtt

SEQ ID NO: 5448913 - DNA, 22 bp, Homo sapiens
tcctcagcttgggcttcttcct

SEQ ID NO: 5448914 - DNA, 14 bp, Homo sapiens
tcctcagctttgct

SEQ ID NO: 5448915 - DNA, 13 bp, Homo sapiens
tcctcaggaacag

SEQ ID NO: 5448916 - DNA, 19 bp, Homo sapiens
tcctcaggaacagaacact

SEQ ID NO: 5448917 - DNA, 15 bp, Homo sapiens
tcctcaggaattcca

SEQ ID NO: 5448918 - DNA, 15 bp, Homo sapiens
tcctcaggaccctca

SEQ ID NO: 5448919 - DNA, 16 bp, Homo sapiens
tcctcaggaccctcag

SEQ ID NO: 5448920 - DNA, 19 bp, Homo sapiens
tcctcaggaccctcagccc

SEQ ID NO: 5448921 - DNA, 14 bp, Homo sapiens
tcctcaggagaagg

SEQ ID NO: 5448922 - DNA, 23 bp, Homo sapiens
tcctcaggagaaggggaagggaa

SEQ ID NO: 5448923 - DNA, 18 bp, Homo sapiens
tcctcaggatttcattga

SEQ ID NO: 5448924 - DNA, 15 bp, Homo sapiens
tcctcaggcacacag

SEQ ID NO: 5448925 - DNA, 22 bp, Homo sapiens
tcctcaggcacacagctactct

SEQ ID NO: 5448926 - DNA, 15 bp, Homo sapiens
tcctcaggcagtggc

SEQ ID NO: 5448927 - DNA, 13 bp, Homo sapiens
tcctcaggcccag

SEQ ID NO: 5448928 - DNA, 18 bp, Homo sapiens
tcctcaggcccagctgct

SEQ ID NO: 5448929 - DNA, 13 bp, Homo sapiens
tcctcaggctgct

SEQ ID NO: 5448930 - DNA, 19 bp, Homo sapiens
tcctcaggctgctggagga

SEQ ID NO: 5448931 - DNA, 19 bp, Homo sapiens
tcctcagggatcacactgc

SEQ ID NO: 5448932 - DNA, 17 bp, Homo sapiens
tcctcagggcagcctcc

SEQ ID NO: 5448933 - DNA, 16 bp, Homo sapiens
tcctcagggcccagca

SEQ ID NO: 5448934 - DNA, 17 bp, Homo sapiens
tcctcagggcccagcag

SEQ ID NO: 5448935 - DNA, 18 bp, Homo sapiens
tcctcagggcccagcagg

SEQ ID NO: 5448936 - DNA, 19 bp, Homo sapiens
tcctcagggcccagcaggc

SEQ ID NO: 5448937 - DNA, 19 bp, Homo sapiens
tcctcagggctcagtcttt

SEQ ID NO: 5448938 - DNA, 12 bp, Homo sapiens
tcctcagggggt

SEQ ID NO: 5448939 - DNA, 16 bp, Homo sapiens
tcctcaggggtggaga

SEQ ID NO: 5448940 - DNA, 19 bp, Homo sapiens
tcctcaggggtggagaagt

SEQ ID NO: 5448941 - DNA, 19 bp, Homo sapiens
tcctcagggtccctcagga

SEQ ID NO: 5448942 - DNA, 13 bp, Homo sapiens
tcctcagggtggg

SEQ ID NO: 5448943 - DNA, 13 bp, Homo sapiens
tcctcaggtcagc

SEQ ID NO: 5448944 - DNA, 22 bp, Homo sapiens
tcctcaggtcagctgggagcca

SEQ ID NO: 5448945 - DNA, 16 bp, Homo sapiens
tcctcagtccctcttc

SEQ ID NO: 5448946 - DNA, 14 bp, Homo sapiens
tcctcagtcctgga

SEQ ID NO: 5448947 - DNA, 16 bp, Homo sapiens
tcctcagtcctggaag

SEQ ID NO: 5448948 - DNA, 18 bp, Homo sapiens
tcctcagtctttggggga

SEQ ID NO: 5448949 - DNA, 17 bp, Homo sapiens
tcctcagtgcaaaatgt

SEQ ID NO: 5448950 - DNA, 17 bp, Homo sapiens
tcctcagttcctcacca

SEQ ID NO: 5448951 - DNA, 18 bp, Homo sapiens
tcctcagttcctgcagca

SEQ ID NO: 5448952 - DNA, 20 bp, Homo sapiens
tcctcagtttaatccttcta

SEQ ID NO: 5448953 - DNA, 15 bp, Homo sapiens
tcctcagtttacatc

SEQ ID NO: 5448954 - DNA, 20 bp, Homo sapiens
tcctcatcagtagatggtac

SEQ ID NO: 5448955 - DNA, 13 bp, Homo sapiens
tcctcatcagtgt

SEQ ID NO: 5448956 - DNA, 23 bp, Homo sapiens
tcctcatcagtgtcattttctgt

SEQ ID NO: 5448957 - DNA, 16 bp, Homo sapiens
tcctcatccagggctc

SEQ ID NO: 5448958 - DNA, 16 bp, Homo sapiens
tcctcatccatttctt

SEQ ID NO: 5448959 - DNA, 15 bp, Homo sapiens
tcctcatcccctcgt

SEQ ID NO: 5448960 - DNA, 12 bp, Homo sapiens
tcctcatccctg

SEQ ID NO: 5448961 - DNA, 14 bp, Homo sapiens
tcctcatccctgac

SEQ ID NO: 5448962 - DNA, 17 bp, Homo sapiens
tcctcatcctcagatgc

SEQ ID NO: 5448963 - DNA, 17 bp, Homo sapiens
tcctcatcctgcttctc

SEQ ID NO: 5448964 - DNA, 19 bp, Homo sapiens
tcctcatcctttccctctc

SEQ ID NO: 5448965 - DNA, 20 bp, Homo sapiens
tcctcatcctttccctctcc

SEQ ID NO: 5448966 - DNA, 21 bp, Homo sapiens
tcctcatctatggttctaaat

SEQ ID NO: 5448967 - DNA, 19 bp, Homo sapiens
tcctcatctccatgctctt

SEQ ID NO: 5448968 - DNA, 20 bp, Homo sapiens
tcctcatctctaacagctca

SEQ ID NO: 5448969 - DNA, 22 bp, Homo sapiens
tcctcatctctaacagctcagg

SEQ ID NO: 5448970 - DNA, 13 bp, Homo sapiens
tcctcatctgcag

SEQ ID NO: 5448971 - DNA, 14 bp, Homo sapiens
tcctcatctgggtc

SEQ ID NO: 5448972 - DNA, 18 bp, Homo sapiens
tcctcatctgtgcctgtc

SEQ ID NO: 5448973 - DNA, 15 bp, Homo sapiens
tcctcatgaatgtaa

SEQ ID NO: 5448974 - DNA, 22 bp, Homo sapiens
tcctcatggcagcctactctcc

SEQ ID NO: 5448975 - DNA, 23 bp, Homo sapiens
tcctcatggctgttatctgtctt

SEQ ID NO: 5448976 - DNA, 23 bp, Homo sapiens
tcctcatgggaagatgtctcaga

SEQ ID NO: 5448977 - DNA, 23 bp, Homo sapiens
tcctcatggtgcatataaatata

SEQ ID NO: 5448978 - DNA, 20 bp, Homo sapiens
tcctcatgtcttctcacaag

SEQ ID NO: 5448979 - DNA, 19 bp, Homo sapiens
tcctcatgtgagaaagcag

SEQ ID NO: 5448980 - DNA, 19 bp, Homo sapiens
tcctcatgttgctgaattt

SEQ ID NO: 5448981 - DNA, 22 bp, Homo sapiens
tcctcattaatagctgccttca

SEQ ID NO: 5448982 - DNA, 17 bp, Homo sapiens
tcctcattagcattttg

SEQ ID NO: 5448983 - DNA, 16 bp, Homo sapiens
tcctcattataaaatg

SEQ ID NO: 5448984 - DNA, 11 bp, Homo sapiens
tcctcattcac

SEQ ID NO: 5448985 - DNA, 23 bp, Homo sapiens
tcctcattccctcgtctttccca

SEQ ID NO: 5448986 - DNA, 21 bp, Homo sapiens
tcctcattcttctctcccaca

SEQ ID NO: 5448987 - DNA, 19 bp, Homo sapiens
tcctcattgcctcctgttc

SEQ ID NO: 5448988 - DNA, 21 bp, Homo sapiens
tcctcatttaatatttttcaa

SEQ ID NO: 5448989 - DNA, 16 bp, Homo sapiens
tcctcatttctccaga

SEQ ID NO: 5448990 - DNA, 23 bp, Homo sapiens
tcctcatttgcaaacctcagagg

SEQ ID NO: 5448991 - DNA, 21 bp, Homo sapiens
tcctcatttggggtagctaga

SEQ ID NO: 5448992 - DNA, 21 bp, Homo sapiens
tcctcattttactaaaatcgt

SEQ ID NO: 5448993 - DNA, 14 bp, Homo sapiens
tcctccaaagcctg

SEQ ID NO: 5448994 - DNA, 23 bp, Homo sapiens
tcctccaaaggaagtctaggagc

SEQ ID NO: 5448995 - DNA, 13 bp, Homo sapiens
tcctccaaagtaa

SEQ ID NO: 5448996 - DNA, 20 bp, Homo sapiens
tcctccaaatctgatttcat

SEQ ID NO: 5448997 - DNA, 21 bp, Homo sapiens
tcctccaacaataaagagctc

SEQ ID NO: 5448998 - DNA, 18 bp, Homo sapiens
tcctccaagaagccctcc

SEQ ID NO: 5448999 - DNA, 20 bp, Homo sapiens
tcctccaagaagccctcctt

SEQ ID NO: 5449000 - DNA, 22 bp, Homo sapiens
tcctccaagaagccctccttgc

SEQ ID NO: 5449001 - DNA, 14 bp, Homo sapiens
tcctccaagccagc

SEQ ID NO: 5449002 - DNA, 14 bp, Homo sapiens
tcctccaaggacag

SEQ ID NO: 5449003 - DNA, 13 bp, Homo sapiens
tcctccaagtgcc

SEQ ID NO: 5449004 - DNA, 17 bp, Homo sapiens
tcctccaagtgccccct

SEQ ID NO: 5449005 - DNA, 18 bp, Homo sapiens
tcctccaagtgccccctc

SEQ ID NO: 5449006 - DNA, 22 bp, Homo sapiens
tcctccaagtgccccctcacct

SEQ ID NO: 5449007 - DNA, 16 bp, Homo sapiens
tcctccaatccccact

SEQ ID NO: 5449008 - DNA, 16 bp, Homo sapiens
tcctccaatgtcctga

SEQ ID NO: 5449009 - DNA, 17 bp, Homo sapiens
tcctccaattccacagt

SEQ ID NO: 5449010 - DNA, 22 bp, Homo sapiens
tcctccaattccacagtctctg

SEQ ID NO: 5449011 - DNA, 23 bp, Homo sapiens
tcctccacagccccaacctccca

SEQ ID NO: 5449012 - DNA, 13 bp, Homo sapiens
tcctccacagtgc

SEQ ID NO: 5449013 - DNA, 19 bp, Homo sapiens
tcctccacatcctgtgtca

SEQ ID NO: 5449014 - DNA, 15 bp, Homo sapiens
tcctccacatccttt

SEQ ID NO: 5449015 - DNA, 16 bp, Homo sapiens
tcctccacatcctttc

SEQ ID NO: 5449016 - DNA, 22 bp, Homo sapiens
tcctccaccaccgcccgtctgt

SEQ ID NO: 5449017 - DNA, 17 bp, Homo sapiens
tcctccacccataataa

SEQ ID NO: 5449018 - DNA, 22 bp, Homo sapiens
tcctccaccggtgcctcctctg

SEQ ID NO: 5449019 - DNA, 14 bp, Homo sapiens
tcctccacgggctg

SEQ ID NO: 5449020 - DNA, 21 bp, Homo sapiens
tcctccacgttctgctcatca

SEQ ID NO: 5449021 - DNA, 16 bp, Homo sapiens
tcctccactcactcca

SEQ ID NO: 5449022 - DNA, 20 bp, Homo sapiens
tcctccactcactccagccc

SEQ ID NO: 5449023 - DNA, 13 bp, Homo sapiens
tcctccactccac

SEQ ID NO: 5449024 - DNA, 23 bp, Homo sapiens
tcctccactctcccccaccccct

SEQ ID NO: 5449025 - DNA, 13 bp, Homo sapiens
tcctccactctgt

SEQ ID NO: 5449026 - DNA, 10 bp, Homo sapiens
tcctccagaa

SEQ ID NO: 5449027 - DNA, 12 bp, Homo sapiens
tcctccagaact

SEQ ID NO: 5449028 - DNA, 14 bp, Homo sapiens
tcctccagaagcct

SEQ ID NO: 5449029 - DNA, 19 bp, Homo sapiens
tcctccagaagcctctggc

SEQ ID NO: 5449030 - DNA, 17 bp, Homo sapiens
tcctccagaccaccagc

SEQ ID NO: 5449031 - DNA, 18 bp, Homo sapiens
tcctccagacccctgtgg

SEQ ID NO: 5449032 - DNA, 22 bp, Homo sapiens
tcctccagacccctgtggcaga

SEQ ID NO: 5449033 - DNA, 13 bp, Homo sapiens
tcctccagagaca

SEQ ID NO: 5449034 - DNA, 15 bp, Homo sapiens
tcctccagagacact

SEQ ID NO: 5449035 - DNA, 16 bp, Homo sapiens
tcctccagagacactg

SEQ ID NO: 5449036 - DNA, 19 bp, Homo sapiens
tcctccagagacactgagc

SEQ ID NO: 5449037 - DNA, 14 bp, Homo sapiens
tcctccagagcctg

SEQ ID NO: 5449038 - DNA, 19 bp, Homo sapiens
tcctccagagcctgggcgc

SEQ ID NO: 5449039 - DNA, 12 bp, Homo sapiens
tcctccagagga

SEQ ID NO: 5449040 - DNA, 14 bp, Homo sapiens
tcctccagccacct

SEQ ID NO: 5449041 - DNA, 16 bp, Homo sapiens
tcctccagcccaccca

SEQ ID NO: 5449042 - DNA, 12 bp, Homo sapiens
tcctccagcccc

SEQ ID NO: 5449043 - DNA, 15 bp, Homo sapiens
tcctccagcccctgt

SEQ ID NO: 5449044 - DNA, 18 bp, Homo sapiens
tcctccagccctgcccac

SEQ ID NO: 5449045 - DNA, 12 bp, Homo sapiens
tcctccagcctc

SEQ ID NO: 5449046 - DNA, 13 bp, Homo sapiens
tcctccagctcct

SEQ ID NO: 5449047 - DNA, 15 bp, Homo sapiens
tcctccagctcctgc

SEQ ID NO: 5449048 - DNA, 13 bp, Homo sapiens
tcctccagctggg

SEQ ID NO: 5449049 - DNA, 15 bp, Homo sapiens
tcctccaggaagcct

SEQ ID NO: 5449050 - DNA, 17 bp, Homo sapiens
tcctccaggagcttctt

SEQ ID NO: 5449051 - DNA, 13 bp, Homo sapiens
tcctccaggcctg

SEQ ID NO: 5449052 - DNA, 22 bp, Homo sapiens
tcctccagggaaggtggccaca

SEQ ID NO: 5449053 - DNA, 14 bp, Homo sapiens
tcctccagggacag

SEQ ID NO: 5449054 - DNA, 16 bp, Homo sapiens
tcctccagggacagca

SEQ ID NO: 5449055 - DNA, 21 bp, Homo sapiens
tcctccagggatgatcaacag

SEQ ID NO: 5449056 - DNA, 13 bp, Homo sapiens
tcctccagggcca

SEQ ID NO: 5449057 - DNA, 20 bp, Homo sapiens
tcctccagggccacgtgcca

SEQ ID NO: 5449058 - DNA, 23 bp, Homo sapiens
tcctccagggccacgtgccaggc

SEQ ID NO: 5449059 - DNA, 12 bp, Homo sapiens
tcctccagggcg

SEQ ID NO: 5449060 - DNA, 23 bp, Homo sapiens
tcctccagggggcctgcaggccc

SEQ ID NO: 5449061 - DNA, 17 bp, Homo sapiens
tcctccagggtgatttt

SEQ ID NO: 5449062 - DNA, 12 bp, Homo sapiens
tcctccaggtcg

SEQ ID NO: 5449063 - DNA, 21 bp, Homo sapiens
tcctccaggtcggagtgcctg

SEQ ID NO: 5449064 - DNA, 13 bp, Homo sapiens
tcctccaggtttt

SEQ ID NO: 5449065 - DNA, 23 bp, Homo sapiens
tcctccaggtttttcaattaaac

SEQ ID NO: 5449066 - DNA, 15 bp, Homo sapiens
tcctccagtacaata

SEQ ID NO: 5449067 - DNA, 17 bp, Homo sapiens
tcctccagtaccttgct

SEQ ID NO: 5449068 - DNA, 18 bp, Homo sapiens
tcctccagtaccttgctt

SEQ ID NO: 5449069 - DNA, 10 bp, Homo sapiens
tcctccagtc

SEQ ID NO: 5449070 - DNA, 18 bp, Homo sapiens
tcctccagtctgttctca

SEQ ID NO: 5449071 - DNA, 15 bp, Homo sapiens
tcctccatcacccct

SEQ ID NO: 5449072 - DNA, 15 bp, Homo sapiens
tcctccatcacctga

SEQ ID NO: 5449073 - DNA, 20 bp, Homo sapiens
tcctccatcccaacagccat

SEQ ID NO: 5449074 - DNA, 22 bp, Homo sapiens
tcctccatctagagattttctt

SEQ ID NO: 5449075 - DNA, 19 bp, Homo sapiens
tcctccatctccaagaatg

SEQ ID NO: 5449076 - DNA, 15 bp, Homo sapiens
tcctccatcttctgg

SEQ ID NO: 5449077 - DNA, 14 bp, Homo sapiens
tcctccatgcctga

SEQ ID NO: 5449078 - DNA, 16 bp, Homo sapiens
tcctccatggcccatc

SEQ ID NO: 5449079 - DNA, 12 bp, Homo sapiens
tcctccatggga

SEQ ID NO: 5449080 - DNA, 21 bp, Homo sapiens
tcctccatgggggctcagcca

SEQ ID NO: 5449081 - DNA, 17 bp, Homo sapiens
tcctccatggtgctgca

SEQ ID NO: 5449082 - DNA, 17 bp, Homo sapiens
tcctccattcctgctct

SEQ ID NO: 5449083 - DNA, 19 bp, Homo sapiens
tcctccatttcaactccag

SEQ ID NO: 5449084 - DNA, 21 bp, Homo sapiens
tcctctgtcagtcacagccac

SEQ ID NO: 5449085 - DNA, 15 bp, Homo sapiens
tcctctgtcagtcat

SEQ ID NO: 5449086 - DNA, 19 bp, Homo sapiens
tcctctgtcagtttgtgaa

SEQ ID NO: 5449087 - DNA, 17 bp, Homo sapiens
tcctctgtccaggcact

SEQ ID NO: 5449088 - DNA, 21 bp, Homo sapiens
tcctctgtccgtctgtcctgc

SEQ ID NO: 5449089 - DNA, 17 bp, Homo sapiens
tcctctgtcctgcttct

SEQ ID NO: 5449090 - DNA, 15 bp, Homo sapiens
tcctctgtctcgagc

SEQ ID NO: 5449091 - DNA, 13 bp, Homo sapiens
tcctctgtctctg

SEQ ID NO: 5449092 - DNA, 14 bp, Homo sapiens
tcctctgtctctgc

SEQ ID NO: 5449093 - DNA, 14 bp, Homo sapiens
tcctctgtctgccc

SEQ ID NO: 5449094 - DNA, 18 bp, Homo sapiens
tcctctgtctgcccttca

SEQ ID NO: 5449095 - DNA, 23 bp, Homo sapiens
tcctctgtgaactgtgtgtgaat

SEQ ID NO: 5449096 - DNA, 21 bp, Homo sapiens
tcctctgtgaccaatgtcttg

SEQ ID NO: 5449097 - DNA, 14 bp, Homo sapiens
tcctctgtgcccac

SEQ ID NO: 5449098 - DNA, 15 bp, Homo sapiens
tcctctgtgctccct

SEQ ID NO: 5449099 - DNA, 15 bp, Homo sapiens
tcctctgtggccagc

SEQ ID NO: 5449100 - DNA, 24 bp, Homo sapiens
tcctctgtggccagctgcatctgt

SEQ ID NO: 5449101 - DNA, 22 bp, Homo sapiens
tcctctgtggtgtctgcctgtt

SEQ ID NO: 5449102 - DNA, 22 bp, Homo sapiens
tcctctgttacccgcagatcct

SEQ ID NO: 5449103 - DNA, 19 bp, Homo sapiens
tcctctgttcaaagctgcc

SEQ ID NO: 5449104 - DNA, 23 bp, Homo sapiens
tcctctgttcaaagctgcctgtc

SEQ ID NO: 5449105 - DNA, 17 bp, Homo sapiens
tcctctgttctatccca

SEQ ID NO: 5449106 - DNA, 21 bp, Homo sapiens
tcctctgtttagaacaccaaa

SEQ ID NO: 5449107 - DNA, 20 bp, Homo sapiens
tcctcttaaaaaataaaaac

SEQ ID NO: 5449108 - DNA, 16 bp, Homo sapiens
tcctcttaactgtggt

SEQ ID NO: 5449109 - DNA, 18 bp, Homo sapiens
tcctcttaatgtctcaaa

SEQ ID NO: 5449110 - DNA, 20 bp, Homo sapiens
tcctcttaccgtagcctccg

SEQ ID NO: 5449111 - DNA, 13 bp, Homo sapiens
tcctcttacctgt

SEQ ID NO: 5449112 - DNA, 18 bp, Homo sapiens
tcctcttactttcagttt

SEQ ID NO: 5449113 - DNA, 15 bp, Homo sapiens
tcctcttagaagaat

SEQ ID NO: 5449114 - DNA, 20 bp, Homo sapiens
tcctcttagaagaatattgt

SEQ ID NO: 5449115 - DNA, 17 bp, Homo sapiens
tcctcttagcctctgga

SEQ ID NO: 5449116 - DNA, 19 bp, Homo sapiens
tcctcttaggtcccgggag

SEQ ID NO: 5449117 - DNA, 16 bp, Homo sapiens
tcctcttagtccacaa

SEQ ID NO: 5449118 - DNA, 14 bp, Homo sapiens
tcctcttataactt

SEQ ID NO: 5449119 - DNA, 20 bp, Homo sapiens
tcctcttatatgtgcccctt

SEQ ID NO: 5449120 - DNA, 20 bp, Homo sapiens
tcctcttcaagtactgtttt

SEQ ID NO: 5449121 - DNA, 17 bp, Homo sapiens
tcctcttcaccaggtgc

SEQ ID NO: 5449122 - DNA, 20 bp, Homo sapiens
tcctcttcaccccggcaggc

SEQ ID NO: 5449123 - DNA, 22 bp, Homo sapiens
tcctcttccattaaccagtggc

SEQ ID NO: 5449124 - DNA, 17 bp, Homo sapiens
tcctcttcccagagtca

SEQ ID NO: 5449125 - DNA, 17 bp, Homo sapiens
tcctcttcccccaagat

SEQ ID NO: 5449126 - DNA, 16 bp, Homo sapiens
tcctcttccccttgcc

SEQ ID NO: 5449127 - DNA, 19 bp, Homo sapiens
tcctcttccccttgccctt

SEQ ID NO: 5449128 - DNA, 11 bp, Homo sapiens
tcctcttccct

SEQ ID NO: 5449129 - DNA, 20 bp, Homo sapiens
tcctcttcccttagcctctc

SEQ ID NO: 5449130 - DNA, 17 bp, Homo sapiens
tcctcttcctgcctctc

SEQ ID NO: 5449131 - DNA, 20 bp, Homo sapiens
tcctcttcctgcctctctca

SEQ ID NO: 5449132 - DNA, 23 bp, Homo sapiens
tcctcttcctgtagtgcccctcc

SEQ ID NO: 5449133 - DNA, 15 bp, Homo sapiens
tcctcttctgacgtg

SEQ ID NO: 5449134 - DNA, 12 bp, Homo sapiens
tcctcttctgct

SEQ ID NO: 5449135 - DNA, 15 bp, Homo sapiens
tcctcttctgctctt

SEQ ID NO: 5449136 - DNA, 18 bp, Homo sapiens
tcctcttctgctcttttc

SEQ ID NO: 5449137 - DNA, 23 bp, Homo sapiens
tcctcttctgcttaggagagacc

SEQ ID NO: 5449138 - DNA, 17 bp, Homo sapiens
tcctcttctgggcctga

SEQ ID NO: 5449139 - DNA, 16 bp, Homo sapiens
tcctcttgaccctgca

SEQ ID NO: 5449140 - DNA, 22 bp, Homo sapiens
tcctcttgagggtcattttcct

SEQ ID NO: 5449141 - DNA, 20 bp, Homo sapiens
tcctcttgatctcaaagcac

SEQ ID NO: 5449142 - DNA, 21 bp, Homo sapiens
tcctcttgccacatcttgaaa

SEQ ID NO: 5449143 - DNA, 19 bp, Homo sapiens
tcctcttgccactgcctct

SEQ ID NO: 5449144 - DNA, 14 bp, Homo sapiens
tcctcttggctgag

SEQ ID NO: 5449145 - DNA, 22 bp, Homo sapiens
tcctcttggtgggtgtggccag

SEQ ID NO: 5449146 - DNA, 21 bp, Homo sapiens
tcctcttggtgtcgtttccct

SEQ ID NO: 5449147 - DNA, 12 bp, Homo sapiens
tcctcttgtaaa

SEQ ID NO: 5449148 - DNA, 18 bp, Homo sapiens
tcctcttgtaaataaagc

SEQ ID NO: 5449149 - DNA, 21 bp, Homo sapiens
tcctcttgtaaataaagccct

SEQ ID NO: 5449150 - DNA, 21 bp, Homo sapiens
tcctcttgtatacttgtattc

SEQ ID NO: 5449151 - DNA, 14 bp, Homo sapiens
tcctcttgtcctgg

SEQ ID NO: 5449152 - DNA, 16 bp, Homo sapiens
tcctcttgtcctggcc

SEQ ID NO: 5449153 - DNA, 18 bp, Homo sapiens
tcctcttgtcctggccct

SEQ ID NO: 5449154 - DNA, 20 bp, Homo sapiens
tcctcttgtcctggcccttc

SEQ ID NO: 5449155 - DNA, 20 bp, Homo sapiens
tcctcttgtctgatttctta

SEQ ID NO: 5449156 - DNA, 18 bp, Homo sapiens
tcctcttgttcctgaaat

SEQ ID NO: 5449157 - DNA, 19 bp, Homo sapiens
tcctcttgttcctgaaatg

SEQ ID NO: 5449158 - DNA, 21 bp, Homo sapiens
tcctcttgttcctgaaatgtg

SEQ ID NO: 5449159 - DNA, 15 bp, Homo sapiens
tcctctttaaaacaa

SEQ ID NO: 5449160 - DNA, 17 bp, Homo sapiens
tcctctttaaaacaaaa

SEQ ID NO: 5449161 - DNA, 19 bp, Homo sapiens
tcctctttaaaacaaaaca

SEQ ID NO: 5449162 - DNA, 16 bp, Homo sapiens
tcctctttactctggg

SEQ ID NO: 5449163 - DNA, 18 bp, Homo sapiens
tcctctttactctgggca

SEQ ID NO: 5449164 - DNA, 17 bp, Homo sapiens
tcctctttcagctcctg

SEQ ID NO: 5449165 - DNA, 18 bp, Homo sapiens
tcctctttctctccttct

SEQ ID NO: 5449166 - DNA, 18 bp, Homo sapiens
tcctctttgaacatggtc

SEQ ID NO: 5449167 - DNA, 22 bp, Homo sapiens
tcctctttgagaccccagtgcc

SEQ ID NO: 5449168 - DNA, 15 bp, Homo sapiens
tcctctttgccctga

SEQ ID NO: 5449169 - DNA, 15 bp, Homo sapiens
tcctctttgctttgc

SEQ ID NO: 5449170 - DNA, 21 bp, Homo sapiens
tcctctttggtctacactgtg

SEQ ID NO: 5449171 - DNA, 18 bp, Homo sapiens
tcctcttttccttcccaa

SEQ ID NO: 5449172 - DNA, 15 bp, Homo sapiens
tcctcttttctctgc

SEQ ID NO: 5449173 - DNA, 15 bp, Homo sapiens
tcctcttttgtgaga

SEQ ID NO: 5449174 - DNA, 23 bp, Homo sapiens
tcctcttttgttgtttcttaatt

SEQ ID NO: 5449175 - DNA, 13 bp, Homo sapiens
tcctctttttcca

SEQ ID NO: 5449176 - DNA, 21 bp, Homo sapiens
tcctctttttccatcataatt

SEQ ID NO: 5449177 - DNA, 15 bp, Homo sapiens
tcctctttttttaaa

SEQ ID NO: 5449178 - DNA, 21 bp, Homo sapiens
tcctgaaaacccttgccatgt

SEQ ID NO: 5449179 - DNA, 22 bp, Homo sapiens
tcctgaaaacccttgccatgtg

SEQ ID NO: 5449180 - DNA, 18 bp, Homo sapiens
tcctgaaacatgaaccca

SEQ ID NO: 5449181 - DNA, 22 bp, Homo sapiens
tcctgaaacccaaagccctggt

SEQ ID NO: 5449182 - DNA, 17 bp, Homo sapiens
tcctgaaacctcttcct

SEQ ID NO: 5449183 - DNA, 18 bp, Homo sapiens
tcctgaaagaaacagtta

SEQ ID NO: 5449184 - DNA, 16 bp, Homo sapiens
tcctgaaagcggctgc

SEQ ID NO: 5449185 - DNA, 19 bp, Homo sapiens
tcctgaaagcggctgcctc

SEQ ID NO: 5449186 - DNA, 17 bp, Homo sapiens
tcctgaaagtcatttaa

SEQ ID NO: 5449187 - DNA, 22 bp, Homo sapiens
tcctgaaagttggggcccagtc

SEQ ID NO: 5449188 - DNA, 17 bp, Homo sapiens
tcctgaaataaacactg

SEQ ID NO: 5449189 - DNA, 18 bp, Homo sapiens
tcctgaaataaacactgg

SEQ ID NO: 5449190 - DNA, 13 bp, Homo sapiens
tcctgaaatataa

SEQ ID NO: 5449191 - DNA, 17 bp, Homo sapiens
tcctgaaatatccagga

SEQ ID NO: 5449192 - DNA, 22 bp, Homo sapiens
tcctgaaatgccaagtgcctgc

SEQ ID NO: 5449193 - DNA, 15 bp, Homo sapiens
tcctgaaatttcaga

SEQ ID NO: 5449194 - DNA, 14 bp, Homo sapiens
tcctgaacaagaaa

SEQ ID NO: 5449195 - DNA, 19 bp, Homo sapiens
tcctgaacaatattttctc

SEQ ID NO: 5449196 - DNA, 13 bp, Homo sapiens
tcctgaacagcat

SEQ ID NO: 5449197 - DNA, 22 bp, Homo sapiens
tcctgaacagcatggcactccc

SEQ ID NO: 5449198 - DNA, 20 bp, Homo sapiens
tcctgaaccagtcctgctgc

SEQ ID NO: 5449199 - DNA, 21 bp, Homo sapiens
tcctgaaccagtcctgctgcc

SEQ ID NO: 5449200 - DNA, 24 bp, Homo sapiens
tcctgaaccagtcctgctgcctgg

SEQ ID NO: 5449201 - DNA, 22 bp, Homo sapiens
tcctgaaccatgtggataactt

SEQ ID NO: 5449202 - DNA, 19 bp, Homo sapiens
tcctgaaccgactgaccct

SEQ ID NO: 5449203 - DNA, 20 bp, Homo sapiens
tcctgaaccgactgaccctg

SEQ ID NO: 5449204 - DNA, 22 bp, Homo sapiens
tcctgaaccgactgaccctgag

SEQ ID NO: 5449205 - DNA, 23 bp, Homo sapiens
tcctgaaccgactgaccctgagg

SEQ ID NO: 5449206 - DNA, 18 bp, Homo sapiens
tcctgaaccgcacagctc

SEQ ID NO: 5449207 - DNA, 22 bp, Homo sapiens
tcctgaaccgcacagctcagga

SEQ ID NO: 5449208 - DNA, 22 bp, Homo sapiens
tcctgaacctggaaatgatgtt

SEQ ID NO: 5449209 - DNA, 23 bp, Homo sapiens
tcctgaacctttcaaaatggaaa

SEQ ID NO: 5449210 - DNA, 17 bp, Homo sapiens
tcctgaactcctggctt

SEQ ID NO: 5449211 - DNA, 15 bp, Homo sapiens
tcctgaactttctcc

SEQ ID NO: 5449212 - DNA, 18 bp, Homo sapiens
tcctgaactttctccctc

SEQ ID NO: 5449213 - DNA, 14 bp, Homo sapiens
tcctgaagaaccag

SEQ ID NO: 5449214 - DNA, 18 bp, Homo sapiens
tcctgaagaaccagtccc

SEQ ID NO: 5449215 - DNA, 13 bp, Homo sapiens
tcctgaagaatta

SEQ ID NO: 5449216 - DNA, 17 bp, Homo sapiens
tcctgaagaggcgggcc

SEQ ID NO: 5449217 - DNA, 19 bp, Homo sapiens
tcctgaagaggcgggccag

SEQ ID NO: 5449218 - DNA, 18 bp, Homo sapiens
tcctgaagcagtgtcgcc

SEQ ID NO: 5449219 - DNA, 12 bp, Homo sapiens
tcctgaagccag

SEQ ID NO: 5449220 - DNA, 14 bp, Homo sapiens
tcctgaagcctctg

SEQ ID NO: 5449221 - DNA, 18 bp, Homo sapiens
tcctgaagctgaggctca

SEQ ID NO: 5449222 - DNA, 14 bp, Homo sapiens
tcctgaagctgctg

SEQ ID NO: 5449223 - DNA, 16 bp, Homo sapiens
tcctgaagctgctgtg

SEQ ID NO: 5449224 - DNA, 21 bp, Homo sapiens
tcctgaagggaaggcaaaggc

SEQ ID NO: 5449225 - DNA, 18 bp, Homo sapiens
tcctgaagggtgctcagt

SEQ ID NO: 5449226 - DNA, 17 bp, Homo sapiens
tcctgaaggtctgggtc

SEQ ID NO: 5449227 - DNA, 14 bp, Homo sapiens
tcctgaagtagatg

SEQ ID NO: 5449228 - DNA, 16 bp, Homo sapiens
tcctgaagtgacctca

SEQ ID NO: 5449229 - DNA, 23 bp, Homo sapiens
tcctgaagtgacctcactggcct

SEQ ID NO: 5449230 - DNA, 16 bp, Homo sapiens
tcctgaagttgctgct

SEQ ID NO: 5449231 - DNA, 11 bp, Homo sapiens
tcctgaataaa

SEQ ID NO: 5449232 - DNA, 21 bp, Homo sapiens
tcctgaatatcagtcactgtt

SEQ ID NO: 5449233 - DNA, 13 bp, Homo sapiens
tcctgaatatttt

SEQ ID NO: 5449234 - DNA, 16 bp, Homo sapiens
tcctgaatattttttg

SEQ ID NO: 5449235 - DNA, 22 bp, Homo sapiens
tcctgaatccaaactaatccat

SEQ ID NO: 5449236 - DNA, 14 bp, Homo sapiens
tcctgaatcccttt

SEQ ID NO: 5449237 - DNA, 16 bp, Homo sapiens
tcctgaatctgtgcaa

SEQ ID NO: 5449238 - DNA, 16 bp, Homo sapiens
tcctgaatgaggcgga

SEQ ID NO: 5449239 - DNA, 19 bp, Homo sapiens
tcctgaatgaggcggagct

SEQ ID NO: 5449240 - DNA, 16 bp, Homo sapiens
tcctgaatggctttgt

SEQ ID NO: 5449241 - DNA, 23 bp, Homo sapiens
tcctgaattcagttgctttgccc

SEQ ID NO: 5449242 - DNA, 22 bp, Homo sapiens
tcctgacaagttcctaggaaaa

SEQ ID NO: 5449243 - DNA, 17 bp, Homo sapiens
tcctgacacacctgcag

SEQ ID NO: 5449244 - DNA, 21 bp, Homo sapiens
tcctgacacacctgcagcctc

SEQ ID NO: 5449245 - DNA, 22 bp, Homo sapiens
tcctgacacacctgcagcctcc

SEQ ID NO: 5449246 - DNA, 22 bp, Homo sapiens
tcctgacaccaggcaagaaaag

SEQ ID NO: 5449247 - DNA, 19 bp, Homo sapiens
tcctgacaccccacttagc

SEQ ID NO: 5449248 - DNA, 22 bp, Homo sapiens
tcctgacacccttctcccactc

SEQ ID NO: 5449249 - DNA, 15 bp, Homo sapiens
tcctgacactgctgg

SEQ ID NO: 5449250 - DNA, 14 bp, Homo sapiens
tcctgacagaaggt

SEQ ID NO: 5449251 - DNA, 13 bp, Homo sapiens
tcctgacagatgc

SEQ ID NO: 5449252 - DNA, 15 bp, Homo sapiens
tcctgacagatgcct

SEQ ID NO: 5449253 - DNA, 19 bp, Homo sapiens
tcctgacagatgcctggtg

SEQ ID NO: 5449254 - DNA, 15 bp, Homo sapiens
tcctgacagccacac

SEQ ID NO: 5449255 - DNA, 20 bp, Homo sapiens
tcctgacagcgacagaaaac

SEQ ID NO: 5449256 - DNA, 14 bp, Homo sapiens
tcctgacatattca

SEQ ID NO: 5449257 - DNA, 18 bp, Homo sapiens
tcctgacatcacagcagc

SEQ ID NO: 5449258 - DNA, 19 bp, Homo sapiens
tcctgacatcacagcagcc

SEQ ID NO: 5449259 - DNA, 23 bp, Homo sapiens
tcctgcagaaagggccacccatg

SEQ ID NO: 5449260 - DNA, 11 bp, Homo sapiens
tcctgcagaca

SEQ ID NO: 5449261 - DNA, 20 bp, Homo sapiens
tcctgcagacacctggactg

SEQ ID NO: 5449262 - DNA, 21 bp, Homo sapiens
tcctgcagacacctggactga

SEQ ID NO: 5449263 - DNA, 18 bp, Homo sapiens
tcctgcagacctggctgg

SEQ ID NO: 5449264 - DNA, 21 bp, Homo sapiens
tcctgcagacctggctgggcc

SEQ ID NO: 5449265 - DNA, 22 bp, Homo sapiens
tcctgcagacctggctgggcct

SEQ ID NO: 5449266 - DNA, 12 bp, Homo sapiens
tcctgcagagct

SEQ ID NO: 5449267 - DNA, 22 bp, Homo sapiens
tcctgcagatactttgaagtgc

SEQ ID NO: 5449268 - DNA, 19 bp, Homo sapiens
tcctgcagcaaacactcca

SEQ ID NO: 5449269 - DNA, 22 bp, Homo sapiens
tcctgcagcaaacactccaccc

SEQ ID NO: 5449270 - DNA, 17 bp, Homo sapiens
tcctgcagcatggtccc

SEQ ID NO: 5449271 - DNA, 18 bp, Homo sapiens
tcctgcagccagaaagga

SEQ ID NO: 5449272 - DNA, 18 bp, Homo sapiens
tcctgcagccccagaaga

SEQ ID NO: 5449273 - DNA, 17 bp, Homo sapiens
tcctgcagcctggaggc

SEQ ID NO: 5449274 - DNA, 14 bp, Homo sapiens
tcctgcagcttatt

SEQ ID NO: 5449275 - DNA, 9 bp, Homo sapiens
tcctgcagg

SEQ ID NO: 5449276 - DNA, 23 bp, Homo sapiens
tcctgcaggaacgagcactggcc

SEQ ID NO: 5449277 - DNA, 24 bp, Homo sapiens
tcctgcaggaacgagcactggcca

SEQ ID NO: 5449278 - DNA, 20 bp, Homo sapiens
tcctgcaggactctatccct

SEQ ID NO: 5449279 - DNA, 13 bp, Homo sapiens
tcctgcaggcagc

SEQ ID NO: 5449280 - DNA, 19 bp, Homo sapiens
tcctgcaggcagccaggcc

SEQ ID NO: 5449281 - DNA, 22 bp, Homo sapiens
tcctgcaggcagccaggccaca

SEQ ID NO: 5449282 - DNA, 17 bp, Homo sapiens
tcctgcaggcaggaaca

SEQ ID NO: 5449283 - DNA, 19 bp, Homo sapiens
tcctgcaggccaggccagc

SEQ ID NO: 5449284 - DNA, 17 bp, Homo sapiens
tcctgcaggctggctgt

SEQ ID NO: 5449285 - DNA, 18 bp, Homo sapiens
tcctgcagggagccttct

SEQ ID NO: 5449286 - DNA, 20 bp, Homo sapiens
tcctgcagggagccttctgc

SEQ ID NO: 5449287 - DNA, 23 bp, Homo sapiens
tcctgcagggagccttctgccac

SEQ ID NO: 5449288 - DNA, 12 bp, Homo sapiens
tcctgcaggggg

SEQ ID NO: 5449289 - DNA, 16 bp, Homo sapiens
tcctgcagggggagga

SEQ ID NO: 5449290 - DNA, 24 bp, Homo sapiens
tcctgcagtagaaggtgccgtgag

SEQ ID NO: 5449291 - DNA, 17 bp, Homo sapiens
tcctgcagtcccacact

SEQ ID NO: 5449292 - DNA, 12 bp, Homo sapiens
tcctgcagtctc

SEQ ID NO: 5449293 - DNA, 17 bp, Homo sapiens
tcctgcagtctccgcct

SEQ ID NO: 5449294 - DNA, 16 bp, Homo sapiens
tcctgcagtctgtgga

SEQ ID NO: 5449295 - DNA, 16 bp, Homo sapiens
tcctgcagtgctcatt

SEQ ID NO: 5449296 - DNA, 22 bp, Homo sapiens
tcctgcatagcttttccctgtc

SEQ ID NO: 5449297 - DNA, 23 bp, Homo sapiens
tcctgcatagcttttccctgtcc

SEQ ID NO: 5449298 - DNA, 21 bp, Homo sapiens
tcctgcatccctccaccccag

SEQ ID NO: 5449299 - DNA, 16 bp, Homo sapiens
tcctgcatctctgtga

SEQ ID NO: 5449300 - DNA, 15 bp, Homo sapiens
tcctgcatctttcat

SEQ ID NO: 5449301 - DNA, 15 bp, Homo sapiens
tcctgcatggggcag

SEQ ID NO: 5449302 - DNA, 18 bp, Homo sapiens
tcctgcatggtagggaga

SEQ ID NO: 5449303 - DNA, 17 bp, Homo sapiens
tcctgcatgtgtatata

SEQ ID NO: 5449304 - DNA, 14 bp, Homo sapiens
tcctgcatgttctg

SEQ ID NO: 5449305 - DNA, 16 bp, Homo sapiens
tcctgcattcacccag

SEQ ID NO: 5449306 - DNA, 15 bp, Homo sapiens
tcctgcatttctctt

SEQ ID NO: 5449307 - DNA, 11 bp, Homo sapiens
tcctgccaaaa

SEQ ID NO: 5449308 - DNA, 23 bp, Homo sapiens
tcctgccaaaagatctggggagt

SEQ ID NO: 5449309 - DNA, 23 bp, Homo sapiens
tcctgccacaacagaataaagca

SEQ ID NO: 5449310 - DNA, 20 bp, Homo sapiens
tcctgccacatggagccccc

SEQ ID NO: 5449311 - DNA, 19 bp, Homo sapiens
tcctgccacattagaactt

SEQ ID NO: 5449312 - DNA, 16 bp, Homo sapiens
tcctgccaccacgccc

SEQ ID NO: 5449313 - DNA, 14 bp, Homo sapiens
tcctgccaccagtc

SEQ ID NO: 5449314 - DNA, 16 bp, Homo sapiens
tcctgccaccagtcac

SEQ ID NO: 5449315 - DNA, 22 bp, Homo sapiens
tcctgccacccagccccagcca

SEQ ID NO: 5449316 - DNA, 12 bp, Homo sapiens
tcctgccacccc

SEQ ID NO: 5449317 - DNA, 17 bp, Homo sapiens
tcctgccaccccttcct

SEQ ID NO: 5449318 - DNA, 19 bp, Homo sapiens
tcctgccaccccttcctcc

SEQ ID NO: 5449319 - DNA, 13 bp, Homo sapiens
tcctgccagcccc

SEQ ID NO: 5449320 - DNA, 15 bp, Homo sapiens
tcctgccagccccac

SEQ ID NO: 5449321 - DNA, 14 bp, Homo sapiens
tcctgccagcccct

SEQ ID NO: 5449322 - DNA, 16 bp, Homo sapiens
tcctgccagcccggct

SEQ ID NO: 5449323 - DNA, 15 bp, Homo sapiens
tcctgccagctctgt

SEQ ID NO: 5449324 - DNA, 17 bp, Homo sapiens
tcctgccagctctgtca

SEQ ID NO: 5449325 - DNA, 15 bp, Homo sapiens
tcctgccagctgcct

SEQ ID NO: 5449326 - DNA, 20 bp, Homo sapiens
tcctgccagctgccttcctc

SEQ ID NO: 5449327 - DNA, 22 bp, Homo sapiens
tcctgccagctggatcgctgca

SEQ ID NO: 5449328 - DNA, 22 bp, Homo sapiens
tcctgccaggcacacacagccc

SEQ ID NO: 5449329 - DNA, 13 bp, Homo sapiens
tcctgccaggcat

SEQ ID NO: 5449330 - DNA, 14 bp, Homo sapiens
tcctgccaggcatg

SEQ ID NO: 5449331 - DNA, 13 bp, Homo sapiens
tcctgccaggccg

SEQ ID NO: 5449332 - DNA, 20 bp, Homo sapiens
tcctgccagggtgagcaggg

SEQ ID NO: 5449333 - DNA, 12 bp, Homo sapiens
tcctgccatcct

SEQ ID NO: 5449334 - DNA, 22 bp, Homo sapiens
tcctgccatgggtgcagaccct

SEQ ID NO: 5449335 - DNA, 17 bp, Homo sapiens
tcctgcccaaaatgtga

SEQ ID NO: 5449336 - DNA, 14 bp, Homo sapiens
tcctgcccacccta

SEQ ID NO: 5449337 - DNA, 23 bp, Homo sapiens
tcctgcccacgcagacctgcagc

SEQ ID NO: 5449338 - DNA, 17 bp, Homo sapiens
tcctgcccacgggagga

SEQ ID NO: 5449339 - DNA, 21 bp, Homo sapiens
tcctgcccacgtgcagcacct

SEQ ID NO: 5449340 - DNA, 15 bp, Homo sapiens
tcctgcccagcctgg

SEQ ID NO: 5449341 - DNA, 16 bp, Homo sapiens
tcctgcccagctcctc

SEQ ID NO: 5449342 - DNA, 19 bp, Homo sapiens
tcctgcccagctcctcaca

SEQ ID NO: 5449343 - DNA, 14 bp, Homo sapiens
tcctgcccagctct

SEQ ID NO: 5449344 - DNA, 16 bp, Homo sapiens
tcctgcccagctctga

SEQ ID NO: 5449345 - DNA, 22 bp, Homo sapiens
tcctgcccagctctgaccctga

SEQ ID NO: 5449346 - DNA, 11 bp, Homo sapiens
tcctgcccagg

SEQ ID NO: 5449347 - DNA, 15 bp, Homo sapiens
tcctgcccaggactg

SEQ ID NO: 5449348 - DNA, 18 bp, Homo sapiens
tcctgcccaggactgcat

SEQ ID NO: 5449349 - DNA, 13 bp, Homo sapiens
tcctgcccaggag

SEQ ID NO: 5449350 - DNA, 14 bp, Homo sapiens
tcctgcccaggaga

SEQ ID NO: 5449351 - DNA, 19 bp, Homo sapiens
tcctgcccaggagcagctt

SEQ ID NO: 5449352 - DNA, 13 bp, Homo sapiens
tcctgcccaggcc

SEQ ID NO: 5449353 - DNA, 19 bp, Homo sapiens
tcctgcccaggccacagag

SEQ ID NO: 5449354 - DNA, 13 bp, Homo sapiens
tcctgcccagtgt

SEQ ID NO: 5449355 - DNA, 21 bp, Homo sapiens
tcctgccccaactccttccag

SEQ ID NO: 5449356 - DNA, 19 bp, Homo sapiens
tcctgccccaagggcccag

SEQ ID NO: 5449357 - DNA, 21 bp, Homo sapiens
tcctgccccaagggcccagac

SEQ ID NO: 5449358 - DNA, 14 bp, Homo sapiens
tcctgccccacact

SEQ ID NO: 5449359 - DNA, 22 bp, Homo sapiens
tcctgccccagatggctttgtg

SEQ ID NO: 5449360 - DNA, 21 bp, Homo sapiens
tcctgccccagcctactccac

SEQ ID NO: 5449361 - DNA, 14 bp, Homo sapiens
tcctgccccaggcc

SEQ ID NO: 5449362 - DNA, 17 bp, Homo sapiens
tcctgcccccaaggagg

SEQ ID NO: 5449363 - DNA, 15 bp, Homo sapiens
tcctgcccccaagtc

SEQ ID NO: 5449364 - DNA, 19 bp, Homo sapiens
tcctgcccccacacctggc

SEQ ID NO: 5449365 - DNA, 21 bp, Homo sapiens
tcctgcccccacacctggccc

SEQ ID NO: 5449366 - DNA, 22 bp, Homo sapiens
tcctgcccccaccccaggctgg

SEQ ID NO: 5449367 - DNA, 19 bp, Homo sapiens
tcctgcccccgacagccca

SEQ ID NO: 5449368 - DNA, 23 bp, Homo sapiens
tcctgcccccgacagcccagcct

SEQ ID NO: 5449369 - DNA, 13 bp, Homo sapiens
tcctgccccctgc

SEQ ID NO: 5449370 - DNA, 19 bp, Homo sapiens
tcctgccccggcccaacct

SEQ ID NO: 5449371 - DNA, 18 bp, Homo sapiens
tcctgcccctctttctct

SEQ ID NO: 5449372 - DNA, 18 bp, Homo sapiens
tcctgcccctgagcccat

SEQ ID NO: 5449373 - DNA, 16 bp, Homo sapiens
tcctgcccctgttctc

SEQ ID NO: 5449374 - DNA, 20 bp, Homo sapiens
tcctgcccgccctccctcct

SEQ ID NO: 5449375 - DNA, 14 bp, Homo sapiens
tcctgccctacaga

SEQ ID NO: 5449376 - DNA, 23 bp, Homo sapiens
tcctgccctacagaggtctctgc

SEQ ID NO: 5449377 - DNA, 22 bp, Homo sapiens
tcctgccctagcagtttgcctc

SEQ ID NO: 5449378 - DNA, 12 bp, Homo sapiens
tcctgccctccc

SEQ ID NO: 5449379 - DNA, 16 bp, Homo sapiens
tcctgccctccgcccc

SEQ ID NO: 5449380 - DNA, 18 bp, Homo sapiens
tcctgccctccggaggag

SEQ ID NO: 5449381 - DNA, 20 bp, Homo sapiens
tcctgccctccggaggagca

SEQ ID NO: 5449382 - DNA, 23 bp, Homo sapiens
tcctgccctccggaggagcagcc

SEQ ID NO: 5449383 - DNA, 20 bp, Homo sapiens
tcctgccctcgtctccctgg

SEQ ID NO: 5449384 - DNA, 22 bp, Homo sapiens
tcctgccctctgctctgcctgg

SEQ ID NO: 5449385 - DNA, 10 bp, Homo sapiens
tcctgccctg

SEQ ID NO: 5449386 - DNA, 14 bp, Homo sapiens
tcctgccctgcagc

SEQ ID NO: 5449387 - DNA, 15 bp, Homo sapiens
tcctgccctgcagca

SEQ ID NO: 5449388 - DNA, 16 bp, Homo sapiens
tcctgccctgctgttt

SEQ ID NO: 5449389 - DNA, 11 bp, Homo sapiens
tcctgccctgg

SEQ ID NO: 5449390 - DNA, 16 bp, Homo sapiens
tcctgccctggaggaa

SEQ ID NO: 5449391 - DNA, 23 bp, Homo sapiens
tcctgccctgtacctctctctgc

SEQ ID NO: 5449392 - DNA, 15 bp, Homo sapiens
tcctgccctgtccaa

SEQ ID NO: 5449393 - DNA, 18 bp, Homo sapiens
tcctgccctgtccctgtc

SEQ ID NO: 5449394 - DNA, 12 bp, Homo sapiens
tcctgccctgtt

SEQ ID NO: 5449395 - DNA, 14 bp, Homo sapiens
tcctgcccttccct

SEQ ID NO: 5449396 - DNA, 15 bp, Homo sapiens
tcctgcccttccctc

SEQ ID NO: 5449397 - DNA, 20 bp, Homo sapiens
tcctgcccttgctccagcct

SEQ ID NO: 5449398 - DNA, 21 bp, Homo sapiens
tcctgcccttgctccagcctg

SEQ ID NO: 5449399 - DNA, 22 bp, Homo sapiens
tcctgcccttgctccagcctga

SEQ ID NO: 5449400 - DNA, 13 bp, Homo sapiens
tcctgccgcagac

SEQ ID NO: 5449401 - DNA, 19 bp, Homo sapiens
tcctgccgcagacgggcac

SEQ ID NO: 5449402 - DNA, 15 bp, Homo sapiens
tcctgccgcagagct

SEQ ID NO: 5449403 - DNA, 17 bp, Homo sapiens
tcctgccgcagagctgg

SEQ ID NO: 5449404 - DNA, 23 bp, Homo sapiens
tcctgccgcccgaggtggctgcc

SEQ ID NO: 5449405 - DNA, 22 bp, Homo sapiens
tcctgccgctcctctctagaac

SEQ ID NO: 5449406 - DNA, 19 bp, Homo sapiens
tcctgccggagaggaagag

SEQ ID NO: 5449407 - DNA, 18 bp, Homo sapiens
tcctgccgtccctcctgt

SEQ ID NO: 5449408 - DNA, 23 bp, Homo sapiens
tcctgcctactgcccctgccctg

SEQ ID NO: 5449409 - DNA, 19 bp, Homo sapiens
tcctgcctattatctgtca

SEQ ID NO: 5449410 - DNA, 16 bp, Homo sapiens
tcctgcctcagcctcc

SEQ ID NO: 5449411 - DNA, 17 bp, Homo sapiens
tcctgcctcagcctccc

SEQ ID NO: 5449412 - DNA, 18 bp, Homo sapiens
tcctgcctcagcctccca

SEQ ID NO: 5449413 - DNA, 19 bp, Homo sapiens
tcctgcctcagcctcccat

SEQ ID NO: 5449414 - DNA, 21 bp, Homo sapiens
tcctgcctcagcctcccgagt

SEQ ID NO: 5449415 - DNA, 20 bp, Homo sapiens
tcctgcctcagcctccctgg

SEQ ID NO: 5449416 - DNA, 15 bp, Homo sapiens
tcctgcctcagcctt

SEQ ID NO: 5449417 - DNA, 20 bp, Homo sapiens
tcctgcctcagccttccaag

SEQ ID NO: 5449418 - DNA, 20 bp, Homo sapiens
tcctgcctcagccttctgag

SEQ ID NO: 5449419 - DNA, 18 bp, Homo sapiens
tcctgcctcagtctgctt

SEQ ID NO: 5449420 - DNA, 23 bp, Homo sapiens
tcctgcctcccgcctcccgccac

SEQ ID NO: 5449421 - DNA, 12 bp, Homo sapiens
tcctgcctccgc

SEQ ID NO: 5449422 - DNA, 13 bp, Homo sapiens
tcctgcctccgct

SEQ ID NO: 5449423 - DNA, 17 bp, Homo sapiens
tcctgcctccgctggct

SEQ ID NO: 5449424 - DNA, 18 bp, Homo sapiens
tcctgcctccgctggctt

SEQ ID NO: 5449425 - DNA, 20 bp, Homo sapiens
tcctgcctccgggcaggcaa

SEQ ID NO: 5449426 - DNA, 12 bp, Homo sapiens
tcctgcctcctc

SEQ ID NO: 5449427 - DNA, 16 bp, Homo sapiens
tcctgcctcctcatca

SEQ ID NO: 5449428 - DNA, 15 bp, Homo sapiens
tcctgcctctactgg

SEQ ID NO: 5449429 - DNA, 21 bp, Homo sapiens
tcctgcctctactgggaaggc

SEQ ID NO: 5449430 - DNA, 20 bp, Homo sapiens
tcctgcctctctgctccaga

SEQ ID NO: 5449431 - DNA, 22 bp, Homo sapiens
tcctgcctctctgctccagaga

SEQ ID NO: 5449432 - DNA, 20 bp, Homo sapiens
tcctgcctgagtttccagcc

SEQ ID NO: 5449433 - DNA, 14 bp, Homo sapiens
tcctgcctgccccc

SEQ ID NO: 5449434 - DNA, 19 bp, Homo sapiens
tcctgcctgccctgcctca

SEQ ID NO: 5449435 - DNA, 24 bp, Homo sapiens
tcctgcctggcacttactggtcct

SEQ ID NO: 5449436 - DNA, 17 bp, Homo sapiens
tcctgggagtgagctgg

SEQ ID NO: 5449437 - DNA, 16 bp, Homo sapiens
tcctgggatgtaaacc

SEQ ID NO: 5449438 - DNA, 18 bp, Homo sapiens
tcctgggatgtaaaccat

SEQ ID NO: 5449439 - DNA, 17 bp, Homo sapiens
tcctgggatgtggctgc

SEQ ID NO: 5449440 - DNA, 21 bp, Homo sapiens
tcctgggcaacagagtgagac

SEQ ID NO: 5449441 - DNA, 19 bp, Homo sapiens
tcctgggcaatcagacacc

SEQ ID NO: 5449442 - DNA, 15 bp, Homo sapiens
tcctgggcacacgct

SEQ ID NO: 5449443 - DNA, 19 bp, Homo sapiens
tcctgggcacacgctgctc

SEQ ID NO: 5449444 - DNA, 23 bp, Homo sapiens
tcctgggcacacgctgctctgcc

SEQ ID NO: 5449445 - DNA, 16 bp, Homo sapiens
tcctgggcaccccagg

SEQ ID NO: 5449446 - DNA, 18 bp, Homo sapiens
tcctgggcaccccaggca

SEQ ID NO: 5449447 - DNA, 14 bp, Homo sapiens
tcctgggcagccca

SEQ ID NO: 5449448 - DNA, 22 bp, Homo sapiens
tcctgggcagcctttccagcct

SEQ ID NO: 5449449 - DNA, 23 bp, Homo sapiens
tcctgggcagcctttccagcctc

SEQ ID NO: 5449450 - DNA, 12 bp, Homo sapiens
tcctgggcagct

SEQ ID NO: 5449451 - DNA, 13 bp, Homo sapiens
tcctgggcagctg

SEQ ID NO: 5449452 - DNA, 17 bp, Homo sapiens
tcctgggcagctgcctc

SEQ ID NO: 5449453 - DNA, 16 bp, Homo sapiens
tcctgggcatccccag

SEQ ID NO: 5449454 - DNA, 15 bp, Homo sapiens
tcctgggcatctggc

SEQ ID NO: 5449455 - DNA, 18 bp, Homo sapiens
tcctgggcatctggccct

SEQ ID NO: 5449456 - DNA, 20 bp, Homo sapiens
tcctgggcatctggccctgc

SEQ ID NO: 5449457 - DNA, 19 bp, Homo sapiens
tcctgggcatgggtccagg

SEQ ID NO: 5449458 - DNA, 22 bp, Homo sapiens
tcctgggcatgtccccagtgtg

SEQ ID NO: 5449459 - DNA, 20 bp, Homo sapiens
tcctgggcatgtttgtctgt

SEQ ID NO: 5449460 - DNA, 18 bp, Homo sapiens
tcctgggcattagcaagg

SEQ ID NO: 5449461 - DNA, 19 bp, Homo sapiens
tcctgggcattagcaaggc

SEQ ID NO: 5449462 - DNA, 15 bp, Homo sapiens
tcctgggccagggtc

SEQ ID NO: 5449463 - DNA, 15 bp, Homo sapiens
tcctgggcccaggca

SEQ ID NO: 5449464 - DNA, 15 bp, Homo sapiens
tcctgggcccccaga

SEQ ID NO: 5449465 - DNA, 14 bp, Homo sapiens
tcctgggcccctcc

SEQ ID NO: 5449466 - DNA, 18 bp, Homo sapiens
tcctgggcccctccctac

SEQ ID NO: 5449467 - DNA, 20 bp, Homo sapiens
tcctgggcccctccctacct

SEQ ID NO: 5449468 - DNA, 21 bp, Homo sapiens
tcctgggcccgctttgcctgc

SEQ ID NO: 5449469 - DNA, 22 bp, Homo sapiens
tcctgggcccgctttgcctgct

SEQ ID NO: 5449470 - DNA, 15 bp, Homo sapiens
tcctgggccctgggc

SEQ ID NO: 5449471 - DNA, 16 bp, Homo sapiens
tcctgggccctgggct

SEQ ID NO: 5449472 - DNA, 10 bp, Homo sapiens
tcctgggcct

SEQ ID NO: 5449473 - DNA, 15 bp, Homo sapiens
tcctgggcctgcaga

SEQ ID NO: 5449474 - DNA, 16 bp, Homo sapiens
tcctgggcctgtcccc

SEQ ID NO: 5449475 - DNA, 17 bp, Homo sapiens
tcctgggccttctcagc

SEQ ID NO: 5449476 - DNA, 14 bp, Homo sapiens
tcctgggcgccctg

SEQ ID NO: 5449477 - DNA, 18 bp, Homo sapiens
tcctgggcgccctggaag

SEQ ID NO: 5449478 - DNA, 19 bp, Homo sapiens
tcctgggcgccctggaagc

SEQ ID NO: 5449479 - DNA, 16 bp, Homo sapiens
tcctgggctatattcc

SEQ ID NO: 5449480 - DNA, 23 bp, Homo sapiens
tcctgggctcaaatgatcctccc

SEQ ID NO: 5449481 - DNA, 16 bp, Homo sapiens
tcctgggctcaagcaa

SEQ ID NO: 5449482 - DNA, 12 bp, Homo sapiens
tcctgggctcag

SEQ ID NO: 5449483 - DNA, 16 bp, Homo sapiens
tcctgggctccagagg

SEQ ID NO: 5449484 - DNA, 12 bp, Homo sapiens
tcctgggctggc

SEQ ID NO: 5449485 - DNA, 20 bp, Homo sapiens
tcctgggctgggtggcccct

SEQ ID NO: 5449486 - DNA, 19 bp, Homo sapiens
tcctgggcttggtaagtga

SEQ ID NO: 5449487 - DNA, 17 bp, Homo sapiens
tcctggggagctcctgg

SEQ ID NO: 5449488 - DNA, 20 bp, Homo sapiens
tcctggggagctcctgggac

SEQ ID NO: 5449489 - DNA, 19 bp, Homo sapiens
tcctggggatgtcatagcc

SEQ ID NO: 5449490 - DNA, 22 bp, Homo sapiens
tcctggggcagagaagttcctt

SEQ ID NO: 5449491 - DNA, 17 bp, Homo sapiens
tcctggggcagcactcc

SEQ ID NO: 5449492 - DNA, 13 bp, Homo sapiens
tcctggggccagg

SEQ ID NO: 5449493 - DNA, 15 bp, Homo sapiens
tcctggggccaggcc

SEQ ID NO: 5449494 - DNA, 16 bp, Homo sapiens
tcctggggccaggccg

SEQ ID NO: 5449495 - DNA, 15 bp, Homo sapiens
tcctggggccccgct

SEQ ID NO: 5449496 - DNA, 17 bp, Homo sapiens
tcctggggccccgctgg

SEQ ID NO: 5449497 - DNA, 18 bp, Homo sapiens
tcctggggccccgctggg

SEQ ID NO: 5449498 - DNA, 21 bp, Homo sapiens
tcctggggccccgctgggatt

SEQ ID NO: 5449499 - DNA, 15 bp, Homo sapiens
tcctggggccgcctg

SEQ ID NO: 5449500 - DNA, 22 bp, Homo sapiens
tcctggggccgcctgccctgcc

SEQ ID NO: 5449501 - DNA, 13 bp, Homo sapiens
tcctggggcctcg

SEQ ID NO: 5449502 - DNA, 21 bp, Homo sapiens
tcctggggcctcggagcctca

SEQ ID NO: 5449503 - DNA, 17 bp, Homo sapiens
tcctggggcgcgtgagg

SEQ ID NO: 5449504 - DNA, 16 bp, Homo sapiens
tcctggggctctgtgc

SEQ ID NO: 5449505 - DNA, 18 bp, Homo sapiens
tcctggggctctgtgcag

SEQ ID NO: 5449506 - DNA, 22 bp, Homo sapiens
tcctggggctggaatgctgggt

SEQ ID NO: 5449507 - DNA, 20 bp, Homo sapiens
tcctgggggatgcaaataaa

SEQ ID NO: 5449508 - DNA, 17 bp, Homo sapiens
tcctgggggatgtgcac

SEQ ID NO: 5449509 - DNA, 19 bp, Homo sapiens
tcctgggggatgtgcacgg

SEQ ID NO: 5449510 - DNA, 23 bp, Homo sapiens
tcctgggggcctgggttgggggc

SEQ ID NO: 5449511 - DNA, 14 bp, Homo sapiens
tcctgggggctgct

SEQ ID NO: 5449512 - DNA, 18 bp, Homo sapiens
tcctgggggtggcaggca

SEQ ID NO: 5449513 - DNA, 23 bp, Homo sapiens
tcctggggtataaaactttcctc

SEQ ID NO: 5449514 - DNA, 19 bp, Homo sapiens
tcctggggtggttggaggc

SEQ ID NO: 5449515 - DNA, 22 bp, Homo sapiens
tcctggggtggttggaggcctg

SEQ ID NO: 5449516 - DNA, 20 bp, Homo sapiens
tcctgggtaaatgtggtgag

SEQ ID NO: 5449517 - DNA, 15 bp, Homo sapiens
tcctgggtcctcctt

SEQ ID NO: 5449518 - DNA, 12 bp, Homo sapiens
tcctgggtgagt

SEQ ID NO: 5449519 - DNA, 21 bp, Homo sapiens
tcctgggtgagtctgccaact

SEQ ID NO: 5449520 - DNA, 18 bp, Homo sapiens
tcctgggtgagtttttct

SEQ ID NO: 5449521 - DNA, 13 bp, Homo sapiens
tcctgggtggcta

SEQ ID NO: 5449522 - DNA, 17 bp, Homo sapiens
tcctgggtggctactct

SEQ ID NO: 5449523 - DNA, 23 bp, Homo sapiens
tcctgggtggctactctgtgcca

SEQ ID NO: 5449524 - DNA, 22 bp, Homo sapiens
tcctgggtggtctgcaggcagg

SEQ ID NO: 5449525 - DNA, 18 bp, Homo sapiens
tcctgggtgttagaacct

SEQ ID NO: 5449526 - DNA, 23 bp, Homo sapiens
tcctgggttcaagcaatcctcct

SEQ ID NO: 5449527 - DNA, 18 bp, Homo sapiens
tcctgggttcaagtgatt

SEQ ID NO: 5449528 - DNA, 13 bp, Homo sapiens
tcctgggttcaca

SEQ ID NO: 5449529 - DNA, 20 bp, Homo sapiens
tcctgggttggagggaacca

SEQ ID NO: 5449530 - DNA, 13 bp, Homo sapiens
tcctgggttggcc

SEQ ID NO: 5449531 - DNA, 20 bp, Homo sapiens
tcctgggttgtttccaggag

SEQ ID NO: 5449532 - DNA, 19 bp, Homo sapiens
tcctgggtttcctgcaggc

SEQ ID NO: 5449533 - DNA, 23 bp, Homo sapiens
tcctgggttttcttaaccatctt

SEQ ID NO: 5449534 - DNA, 20 bp, Homo sapiens
tcctgggttttgtattctct

SEQ ID NO: 5449535 - DNA, 22 bp, Homo sapiens
tcctgggttttgtattctctga

SEQ ID NO: 5449536 - DNA, 21 bp, Homo sapiens
tcctggtaagaggcaaagaat

SEQ ID NO: 5449537 - DNA, 16 bp, Homo sapiens
tcctggtacccagcca

SEQ ID NO: 5449538 - DNA, 13 bp, Homo sapiens
tcctggtagaata

SEQ ID NO: 5449539 - DNA, 16 bp, Homo sapiens
tcctggtagcatgacc

SEQ ID NO: 5449540 - DNA, 22 bp, Homo sapiens
tcctggtattatttacaatgca

SEQ ID NO: 5449541 - DNA, 14 bp, Homo sapiens
tcctggtcaaagct

SEQ ID NO: 5449542 - DNA, 16 bp, Homo sapiens
tcctggtcacctagga

SEQ ID NO: 5449543 - DNA, 14 bp, Homo sapiens
tcctggtcagctgc

SEQ ID NO: 5449544 - DNA, 18 bp, Homo sapiens
tcctggtcagctgcccca

SEQ ID NO: 5449545 - DNA, 18 bp, Homo sapiens
tcctggtccctctgaggc

SEQ ID NO: 5449546 - DNA, 23 bp, Homo sapiens
tcctggtcctaggctggaaggag

SEQ ID NO: 5449547 - DNA, 14 bp, Homo sapiens
tcctggtcctgatg

SEQ ID NO: 5449548 - DNA, 13 bp, Homo sapiens
tcctggtcctgga

SEQ ID NO: 5449549 - DNA, 17 bp, Homo sapiens
tcctggtcctggctgca

SEQ ID NO: 5449550 - DNA, 14 bp, Homo sapiens
tcctggtcgaaagt

SEQ ID NO: 5449551 - DNA, 22 bp, Homo sapiens
tcctggtcggggcttggaagag

SEQ ID NO: 5449552 - DNA, 16 bp, Homo sapiens
tcctggtctgctcagg

SEQ ID NO: 5449553 - DNA, 20 bp, Homo sapiens
tcctggtctgtgctgccctg

SEQ ID NO: 5449554 - DNA, 17 bp, Homo sapiens
tcctggtcttgagatgt

SEQ ID NO: 5449555 - DNA, 17 bp, Homo sapiens
tcctggtctttgtttga

SEQ ID NO: 5449556 - DNA, 18 bp, Homo sapiens
tcctggtgaggcccagcc

SEQ ID NO: 5449557 - DNA, 20 bp, Homo sapiens
tcctggtgccaatttcaagt

SEQ ID NO: 5449558 - DNA, 21 bp, Homo sapiens
tcctggtgccaatttcaagtt

SEQ ID NO: 5449559 - DNA, 14 bp, Homo sapiens
tcctggtgccacct

SEQ ID NO: 5449560 - DNA, 15 bp, Homo sapiens
tcctggtgccacctc

SEQ ID NO: 5449561 - DNA, 12 bp, Homo sapiens
tcctggtgccct

SEQ ID NO: 5449562 - DNA, 22 bp, Homo sapiens
tcctggtgccctggatgcccag

SEQ ID NO: 5449563 - DNA, 22 bp, Homo sapiens
tcctggtgctgccgagggctgg

SEQ ID NO: 5449564 - DNA, 23 bp, Homo sapiens
tcctggtgctgccgagggctggc

SEQ ID NO: 5449565 - DNA, 16 bp, Homo sapiens
tcctggtggccttctg

SEQ ID NO: 5449566 - DNA, 14 bp, Homo sapiens
tcctggtggctggg

SEQ ID NO: 5449567 - DNA, 13 bp, Homo sapiens
tcctggtggggca

SEQ ID NO: 5449568 - DNA, 22 bp, Homo sapiens
tcctggtggggcagaaaggctg

SEQ ID NO: 5449569 - DNA, 19 bp, Homo sapiens
tcctggtggggctgagcct

SEQ ID NO: 5449570 - DNA, 21 bp, Homo sapiens
tcctggtggggctgagcctga

SEQ ID NO: 5449571 - DNA, 19 bp, Homo sapiens
tcctggtgggtcagcccag

SEQ ID NO: 5449572 - DNA, 16 bp, Homo sapiens
tcctggtgggtccagg

SEQ ID NO: 5449573 - DNA, 17 bp, Homo sapiens
tcctggtgggtccaggg

SEQ ID NO: 5449574 - DNA, 19 bp, Homo sapiens
tcctggtgggtccaggggc

SEQ ID NO: 5449575 - DNA, 21 bp, Homo sapiens
tcctggtggtattttcaatag

SEQ ID NO: 5449576 - DNA, 13 bp, Homo sapiens
tcctggtgtctag

SEQ ID NO: 5449577 - DNA, 16 bp, Homo sapiens
tcctggtgtctagttt

SEQ ID NO: 5449578 - DNA, 15 bp, Homo sapiens
tcctggtgtggaaga

SEQ ID NO: 5449579 - DNA, 23 bp, Homo sapiens
tcctggtgtgggtaaagggacag

SEQ ID NO: 5449580 - DNA, 17 bp, Homo sapiens
tcctggttcagtgggaa

SEQ ID NO: 5449581 - DNA, 22 bp, Homo sapiens
tcctggttccttcctatgccca

SEQ ID NO: 5449582 - DNA, 15 bp, Homo sapiens
tcctggttggtcaca

SEQ ID NO: 5449583 - DNA, 17 bp, Homo sapiens
tcctggttgtctgaacc

SEQ ID NO: 5449584 - DNA, 21 bp, Homo sapiens
tcctggttgtctgaacccagg

SEQ ID NO: 5449585 - DNA, 17 bp, Homo sapiens
tcctggttgttcctgca

SEQ ID NO: 5449586 - DNA, 20 bp, Homo sapiens
tcctggttgttcctgcatcc

SEQ ID NO: 5449587 - DNA, 16 bp, Homo sapiens
tcctggtttcctttct

SEQ ID NO: 5449588 - DNA, 18 bp, Homo sapiens
tcctggtttcctttctca

SEQ ID NO: 5449589 - DNA, 23 bp, Homo sapiens
tcctggttttgtacactgctgta

SEQ ID NO: 5449590 - DNA, 17 bp, Homo sapiens
tcctgtaaaatactatt

SEQ ID NO: 5449591 - DNA, 10 bp, Homo sapiens
tcctgtaaac

SEQ ID NO: 5449592 - DNA, 14 bp, Homo sapiens
tcctgtaaataaga

SEQ ID NO: 5449593 - DNA, 18 bp, Homo sapiens
tcctgtaaataagagttg

SEQ ID NO: 5449594 - DNA, 19 bp, Homo sapiens
tcctgtaaatggtgtacat

SEQ ID NO: 5449595 - DNA, 17 bp, Homo sapiens
tcctgtaacaggtgtgg

SEQ ID NO: 5449596 - DNA, 21 bp, Homo sapiens
tcctgtaagccaaagaaatga

SEQ ID NO: 5449597 - DNA, 12 bp, Homo sapiens
tcctgtaatata

SEQ ID NO: 5449598 - DNA, 23 bp, Homo sapiens
tcctgtaatatatttatatactt

SEQ ID NO: 5449599 - DNA, 15 bp, Homo sapiens
tcctgtaattcctac

SEQ ID NO: 5449600 - DNA, 16 bp, Homo sapiens
tcctgtaattttgtag

SEQ ID NO: 5449601 - DNA, 16 bp, Homo sapiens
tcctgtacactgaata

SEQ ID NO: 5449602 - DNA, 16 bp, Homo sapiens
tcctgtaccaaatctg

SEQ ID NO: 5449603 - DNA, 23 bp, Homo sapiens
tcctgtaccaaatctgacatatt

SEQ ID NO: 5449604 - DNA, 14 bp, Homo sapiens
tcctgtacctcagt

SEQ ID NO: 5449605 - DNA, 17 bp, Homo sapiens
tcctgtacgaacccctc

SEQ ID NO: 5449606 - DNA, 23 bp, Homo sapiens
tcctgtacgaacccctcccctcc

SEQ ID NO: 5449607 - DNA, 22 bp, Homo sapiens
tcctgtacttgtcctcagcttg

SEQ ID NO: 5449608 - DNA, 19 bp, Homo sapiens
tcctgtagagagagaccta

SEQ ID NO: 5449609 - DNA, 14 bp, Homo sapiens
tcctgtagcatctt

SEQ ID NO: 5449610 - DNA, 13 bp, Homo sapiens
tcctgtagcccta

SEQ ID NO: 5449611 - DNA, 22 bp, Homo sapiens
tcctgtagccttctgtaggaat

SEQ ID NO: 5449612 - DNA, 23 bp, Homo sapiens
tccttcagagctcttcaagctgt

SEQ ID NO: 5449613 - DNA, 13 bp, Homo sapiens
tccttcagcaatc

SEQ ID NO: 5449614 - DNA, 11 bp, Homo sapiens
tccttcagcac

SEQ ID NO: 5449615 - DNA, 13 bp, Homo sapiens
tccttcagcacag

SEQ ID NO: 5449616 - DNA, 15 bp, Homo sapiens
tccttcagcacttta

SEQ ID NO: 5449617 - DNA, 13 bp, Homo sapiens
tccttcaggactc

SEQ ID NO: 5449618 - DNA, 14 bp, Homo sapiens
tccttcaggactct

SEQ ID NO: 5449619 - DNA, 18 bp, Homo sapiens
tccttcagggtttaatag

SEQ ID NO: 5449620 - DNA, 17 bp, Homo sapiens
tccttcagtgagcccct

SEQ ID NO: 5449621 - DNA, 12 bp, Homo sapiens
tccttcagtgcc

SEQ ID NO: 5449622 - DNA, 20 bp, Homo sapiens
tccttcagtgccttatggaa

SEQ ID NO: 5449623 - DNA, 17 bp, Homo sapiens
tccttcagttctgcttg

SEQ ID NO: 5449624 - DNA, 23 bp, Homo sapiens
tccttcatatgaaaggtgccatg

SEQ ID NO: 5449625 - DNA, 15 bp, Homo sapiens
tccttcatcacagca

SEQ ID NO: 5449626 - DNA, 22 bp, Homo sapiens
tccttcatcatgagttctgctg

SEQ ID NO: 5449627 - DNA, 18 bp, Homo sapiens
tccttcatcgaatgctaa

SEQ ID NO: 5449628 - DNA, 14 bp, Homo sapiens
tccttcatctccca

SEQ ID NO: 5449629 - DNA, 18 bp, Homo sapiens
tccttcatgcctgggcct

SEQ ID NO: 5449630 - DNA, 17 bp, Homo sapiens
tccttcatgcttttctc

SEQ ID NO: 5449631 - DNA, 17 bp, Homo sapiens
tccttcatgtttggaaa

SEQ ID NO: 5449632 - DNA, 14 bp, Homo sapiens
tccttcattaatga

SEQ ID NO: 5449633 - DNA, 21 bp, Homo sapiens
tccttcatttccaccaggccg

SEQ ID NO: 5449634 - DNA, 22 bp, Homo sapiens
tccttcatttctgatatagaat

SEQ ID NO: 5449635 - DNA, 14 bp, Homo sapiens
tccttccaaactct

SEQ ID NO: 5449636 - DNA, 19 bp, Homo sapiens
tccttccaaagaattctta

SEQ ID NO: 5449637 - DNA, 18 bp, Homo sapiens
tccttccaactgctgccc

SEQ ID NO: 5449638 - DNA, 22 bp, Homo sapiens
tccttccaaggtcactcttggt

SEQ ID NO: 5449639 - DNA, 18 bp, Homo sapiens
tccttccaatgtctggag

SEQ ID NO: 5449640 - DNA, 23 bp, Homo sapiens
tccttccacagttatcttagctg

SEQ ID NO: 5449641 - DNA, 15 bp, Homo sapiens
tccttccacatgtac

SEQ ID NO: 5449642 - DNA, 15 bp, Homo sapiens
tccttccacctcagt

SEQ ID NO: 5449643 - DNA, 14 bp, Homo sapiens
tccttccacctgcc

SEQ ID NO: 5449644 - DNA, 16 bp, Homo sapiens
tccttccacggactca

SEQ ID NO: 5449645 - DNA, 17 bp, Homo sapiens
tccttccactgtagcta

SEQ ID NO: 5449646 - DNA, 19 bp, Homo sapiens
tccttccagatgcccgagc

SEQ ID NO: 5449647 - DNA, 12 bp, Homo sapiens
tccttccagccc

SEQ ID NO: 5449648 - DNA, 13 bp, Homo sapiens
tccttccagccca

SEQ ID NO: 5449649 - DNA, 23 bp, Homo sapiens
tccttccaggccccaggctggat

SEQ ID NO: 5449650 - DNA, 13 bp, Homo sapiens
tccttccatccat

SEQ ID NO: 5449651 - DNA, 17 bp, Homo sapiens
tccttccatccctaccc

SEQ ID NO: 5449652 - DNA, 18 bp, Homo sapiens
tccttccatcctgaggac

SEQ ID NO: 5449653 - DNA, 21 bp, Homo sapiens
tccttccatctagcagctggc

SEQ ID NO: 5449654 - DNA, 14 bp, Homo sapiens
tccttccatctctt

SEQ ID NO: 5449655 - DNA, 13 bp, Homo sapiens
tccttccatcttc

SEQ ID NO: 5449656 - DNA, 13 bp, Homo sapiens
tccttccatgaaa

SEQ ID NO: 5449657 - DNA, 18 bp, Homo sapiens
tccttccatgctcccaac

SEQ ID NO: 5449658 - DNA, 16 bp, Homo sapiens
tccttccattcagatg

SEQ ID NO: 5449659 - DNA, 20 bp, Homo sapiens
tccttccattgctcccagtg

SEQ ID NO: 5449660 - DNA, 14 bp, Homo sapiens
tccttccatttctt

SEQ ID NO: 5449661 - DNA, 15 bp, Homo sapiens
tccttccatttcttc

SEQ ID NO: 5449662 - DNA, 16 bp, Homo sapiens
tccttccatttcttct

SEQ ID NO: 5449663 - DNA, 10 bp, Homo sapiens
tccttcccaa

SEQ ID NO: 5449664 - DNA, 18 bp, Homo sapiens
tccttcccaaaggactcc

SEQ ID NO: 5449665 - DNA, 23 bp, Homo sapiens
tccttcccaactcactgtgctcc

SEQ ID NO: 5449666 - DNA, 17 bp, Homo sapiens
tccttcccaaggcagct

SEQ ID NO: 5449667 - DNA, 17 bp, Homo sapiens
tccttcccacaaaagac

SEQ ID NO: 5449668 - DNA, 17 bp, Homo sapiens
tccttcccacccctaca

SEQ ID NO: 5449669 - DNA, 20 bp, Homo sapiens
tccttcccacccctacacac

SEQ ID NO: 5449670 - DNA, 22 bp, Homo sapiens
tccttcccacccctacacacac

SEQ ID NO: 5449671 - DNA, 15 bp, Homo sapiens
tccttcccactctgt

SEQ ID NO: 5449672 - DNA, 16 bp, Homo sapiens
tccttcccactgtcct

SEQ ID NO: 5449673 - DNA, 20 bp, Homo sapiens
tccttcccactgtcctttct

SEQ ID NO: 5449674 - DNA, 21 bp, Homo sapiens
tccttcccactgtcctttctc

SEQ ID NO: 5449675 - DNA, 23 bp, Homo sapiens
tccttcccagaggggcctgccac

SEQ ID NO: 5449676 - DNA, 13 bp, Homo sapiens
tccttcccagctc

SEQ ID NO: 5449677 - DNA, 18 bp, Homo sapiens
tccttcccagctgcccct

SEQ ID NO: 5449678 - DNA, 12 bp, Homo sapiens
tccttcccaggc

SEQ ID NO: 5449679 - DNA, 14 bp, Homo sapiens
tccttcccaggccc

SEQ ID NO: 5449680 - DNA, 16 bp, Homo sapiens
tccttcccaggccctt

SEQ ID NO: 5449681 - DNA, 20 bp, Homo sapiens
tccttcccaggccctttggc

SEQ ID NO: 5449682 - DNA, 21 bp, Homo sapiens
tccttcccaggccctttggct

SEQ ID NO: 5449683 - DNA, 16 bp, Homo sapiens
tccttcccatgcctgt

SEQ ID NO: 5449684 - DNA, 23 bp, Homo sapiens
tccttcccatgcctgtctctgtt

SEQ ID NO: 5449685 - DNA, 15 bp, Homo sapiens
tccttccccaacttc

SEQ ID NO: 5449686 - DNA, 20 bp, Homo sapiens
tccttccccaacttccctag

SEQ ID NO: 5449687 - DNA, 17 bp, Homo sapiens
tccttccccaagtaatt

SEQ ID NO: 5449688 - DNA, 20 bp, Homo sapiens
tccttccccaccccataagc

SEQ ID NO: 5449689 - DNA, 12 bp, Homo sapiens
tccttccccaga

SEQ ID NO: 5449690 - DNA, 18 bp, Homo sapiens
tccttccccagctccccc

SEQ ID NO: 5449691 - DNA, 15 bp, Homo sapiens
tccttccccatttcc

SEQ ID NO: 5449692 - DNA, 14 bp, Homo sapiens
tccttcccccagca

SEQ ID NO: 5449693 - DNA, 22 bp, Homo sapiens
tccttcccccagcacaaagcac

SEQ ID NO: 5449694 - DNA, 14 bp, Homo sapiens
tccttcccccagcc

SEQ ID NO: 5449695 - DNA, 15 bp, Homo sapiens
tccttcccccagccc

SEQ ID NO: 5449696 - DNA, 16 bp, Homo sapiens
tccttcccccagccca

SEQ ID NO: 5449697 - DNA, 21 bp, Homo sapiens
tccttcccccagcccaataaa

SEQ ID NO: 5449698 - DNA, 18 bp, Homo sapiens
tccttcccccatcccctt

SEQ ID NO: 5449699 - DNA, 19 bp, Homo sapiens
tccttccccccatctctga

SEQ ID NO: 5449700 - DNA, 21 bp, Homo sapiens
tccttccccccatctctgagt

SEQ ID NO: 5449701 - DNA, 12 bp, Homo sapiens
tccttccccctc

SEQ ID NO: 5449702 - DNA, 22 bp, Homo sapiens
tccttccccctgtagactagtg

SEQ ID NO: 5449703 - DNA, 21 bp, Homo sapiens
tccttccccgagtgactctgg

SEQ ID NO: 5449704 - DNA, 11 bp, Homo sapiens
tccttcccctg

SEQ ID NO: 5449705 - DNA, 14 bp, Homo sapiens
tccttcccctgcac

SEQ ID NO: 5449706 - DNA, 15 bp, Homo sapiens
tccttcccctgtggt

SEQ ID NO: 5449707 - DNA, 15 bp, Homo sapiens
tccttccccttcccc

SEQ ID NO: 5449708 - DNA, 19 bp, Homo sapiens
tccttccccttgtccctgg

SEQ ID NO: 5449709 - DNA, 16 bp, Homo sapiens
tccttcccgcagcacc

SEQ ID NO: 5449710 - DNA, 18 bp, Homo sapiens
tccttcccgcagcaccag

SEQ ID NO: 5449711 - DNA, 22 bp, Homo sapiens
tccttcccgcagcaccagcctg

SEQ ID NO: 5449712 - DNA, 9 bp, Homo sapiens
tccttccct

SEQ ID NO: 5449713 - DNA, 15 bp, Homo sapiens
tccttccctcacccc

SEQ ID NO: 5449714 - DNA, 19 bp, Homo sapiens
tccttccctcacccccagc

SEQ ID NO: 5449715 - DNA, 17 bp, Homo sapiens
tccttccctcctgtgcc

SEQ ID NO: 5449716 - DNA, 16 bp, Homo sapiens
tccttccctcctttta

SEQ ID NO: 5449717 - DNA, 18 bp, Homo sapiens
tccttccctccttttaaa

SEQ ID NO: 5449718 - DNA, 14 bp, Homo sapiens
tccttccctctcct

SEQ ID NO: 5449719 - DNA, 17 bp, Homo sapiens
tccttccctctcctgct

SEQ ID NO: 5449720 - DNA, 17 bp, Homo sapiens
tccttccctctctgatg

SEQ ID NO: 5449721 - DNA, 23 bp, Homo sapiens
tccttccctctctgatgtcccag

SEQ ID NO: 5449722 - DNA, 12 bp, Homo sapiens
tccttccctgcc

SEQ ID NO: 5449723 - DNA, 15 bp, Homo sapiens
tccttccctggcttg

SEQ ID NO: 5449724 - DNA, 12 bp, Homo sapiens
tccttccctggg

SEQ ID NO: 5449725 - DNA, 14 bp, Homo sapiens
tccttccctgtaaa

SEQ ID NO: 5449726 - DNA, 19 bp, Homo sapiens
tccttccctgttctccctt

SEQ ID NO: 5449727 - DNA, 21 bp, Homo sapiens
tccttcccttctctccttccc

SEQ ID NO: 5449728 - DNA, 17 bp, Homo sapiens
tccttcccttgctacca

SEQ ID NO: 5449729 - DNA, 16 bp, Homo sapiens
tccttccgctccttta

SEQ ID NO: 5449730 - DNA, 17 bp, Homo sapiens
tccttcctatgcccagg

SEQ ID NO: 5449731 - DNA, 21 bp, Homo sapiens
tccttcctcacaccaggcttg

SEQ ID NO: 5449732 - DNA, 14 bp, Homo sapiens
tccttcctcagaat

SEQ ID NO: 5449733 - DNA, 19 bp, Homo sapiens
tccttcctccactgcgctt

SEQ ID NO: 5449734 - DNA, 14 bp, Homo sapiens
tccttcctcccctt

SEQ ID NO: 5449735 - DNA, 16 bp, Homo sapiens
tccttcctcctttcct

SEQ ID NO: 5449736 - DNA, 17 bp, Homo sapiens
tccttcctctgagcctt

SEQ ID NO: 5449737 - DNA, 16 bp, Homo sapiens
tccttcctctgaggct

SEQ ID NO: 5449738 - DNA, 14 bp, Homo sapiens
tccttcctcttggc

SEQ ID NO: 5449739 - DNA, 16 bp, Homo sapiens
tccttcctctttgctt

SEQ ID NO: 5449740 - DNA, 13 bp, Homo sapiens
tccttcctgcaga

SEQ ID NO: 5449741 - DNA, 17 bp, Homo sapiens
tccttcctgcagacctg

SEQ ID NO: 5449742 - DNA, 12 bp, Homo sapiens
tccttcctgccc

SEQ ID NO: 5449743 - DNA, 16 bp, Homo sapiens
tccttcctgccctgta

SEQ ID NO: 5449744 - DNA, 20 bp, Homo sapiens
tccttcctggagcccagagg

SEQ ID NO: 5449745 - DNA, 13 bp, Homo sapiens
tccttcctggcct

SEQ ID NO: 5449746 - DNA, 14 bp, Homo sapiens
tccttcctggcctg

SEQ ID NO: 5449747 - DNA, 12 bp, Homo sapiens
tccttcctggga

SEQ ID NO: 5449748 - DNA, 13 bp, Homo sapiens
tccttcctgggac

SEQ ID NO: 5449749 - DNA, 19 bp, Homo sapiens
tccttcctgggaccccctc

SEQ ID NO: 5449750 - DNA, 21 bp, Homo sapiens
tccttcctgggaccccctcgc

SEQ ID NO: 5449751 - DNA, 12 bp, Homo sapiens
tccttcctgtct

SEQ ID NO: 5449752 - DNA, 13 bp, Homo sapiens
tccttcctgtggg

SEQ ID NO: 5449753 - DNA, 21 bp, Homo sapiens
tccttcctgttagtggttgtg

SEQ ID NO: 5449754 - DNA, 13 bp, Homo sapiens
tccttcctgttct

SEQ ID NO: 5449755 - DNA, 18 bp, Homo sapiens
tccttccttcaggactct

SEQ ID NO: 5449756 - DNA, 15 bp, Homo sapiens
tccttccttcccacc

SEQ ID NO: 5449757 - DNA, 15 bp, Homo sapiens
tccttccttccctgg

SEQ ID NO: 5449758 - DNA, 23 bp, Homo sapiens
tccttccttgttacccatgaaaa

SEQ ID NO: 5449759 - DNA, 16 bp, Homo sapiens
tccttcgaaaggcctt

SEQ ID NO: 5449760 - DNA, 19 bp, Homo sapiens
tccttcgaaaggccttcag

SEQ ID NO: 5449761 - DNA, 20 bp, Homo sapiens
tccttcgaaaggccttcaga

SEQ ID NO: 5449762 - DNA, 20 bp, Homo sapiens
tccttcggggcgatgctccc

SEQ ID NO: 5449763 - DNA, 21 bp, Homo sapiens
tccttcggggcgatgctccct

SEQ ID NO: 5449764 - DNA, 16 bp, Homo sapiens
tccttcgggtgctgga

SEQ ID NO: 5449765 - DNA, 16 bp, Homo sapiens
tccttcgtgtctctcc

SEQ ID NO: 5449766 - DNA, 17 bp, Homo sapiens
tccttctaaagtgctgg

SEQ ID NO: 5449767 - DNA, 21 bp, Homo sapiens
tccttctaaagtgctgggatt

SEQ ID NO: 5449768 - DNA, 18 bp, Homo sapiens
tccttctaagataaaaat

SEQ ID NO: 5449769 - DNA, 20 bp, Homo sapiens
tccttctacagaacctgagg

SEQ ID NO: 5449770 - DNA, 16 bp, Homo sapiens
tccttctaccccaagg

SEQ ID NO: 5449771 - DNA, 17 bp, Homo sapiens
tccttctaccccaaggc

SEQ ID NO: 5449772 - DNA, 16 bp, Homo sapiens
tccttctactccagca

SEQ ID NO: 5449773 - DNA, 22 bp, Homo sapiens
tccttctcaggctggcatctcc

SEQ ID NO: 5449774 - DNA, 21 bp, Homo sapiens
tccttctcatcttgcctcatt

SEQ ID NO: 5449775 - DNA, 20 bp, Homo sapiens
tccttctcattacccacccg

SEQ ID NO: 5449776 - DNA, 19 bp, Homo sapiens
tccttctccaccgcacaga

SEQ ID NO: 5449777 - DNA, 13 bp, Homo sapiens
tccttctccccaa

SEQ ID NO: 5449778 - DNA, 13 bp, Homo sapiens
tccttctcccctc

SEQ ID NO: 5449779 - DNA, 17 bp, Homo sapiens
tccttctcccctccaga

SEQ ID NO: 5449780 - DNA, 18 bp, Homo sapiens
tccttctcccctccagac

SEQ ID NO: 5449781 - DNA, 19 bp, Homo sapiens
tccttctcccctccagacc

SEQ ID NO: 5449782 - DNA, 13 bp, Homo sapiens
tccttctcctcct

SEQ ID NO: 5449783 - DNA, 13 bp, Homo sapiens
tccttctcctctt

SEQ ID NO: 5449784 - DNA, 12 bp, Homo sapiens
tccttctccttc

SEQ ID NO: 5449785 - DNA, 19 bp, Homo sapiens
tccttctccttctcacaca

SEQ ID NO: 5449786 - DNA, 17 bp, Homo sapiens
tccttctcgtcttcctc

SEQ ID NO: 5449787 - DNA, 19 bp, Homo sapiens
tccttctcgtcttcctctc

SEQ ID NO: 5449788 - DNA, 24 bp, Homo sapiens
tccttctcgtcttcctctctctca

SEQ ID NO: 5449789 - DNA, 21 bp, Homo sapiens
tccttctcgtttgctctagtc

SEQ ID NO: 5449790 - DNA, 13 bp, Homo sapiens
tccttctctcact

SEQ ID NO: 5449791 - DNA, 22 bp, Homo sapiens
tccttctctgaacacaggcagc

SEQ ID NO: 5449792 - DNA, 23 bp, Homo sapiens
tcgaatagggaagtaaaaaaaca

SEQ ID NO: 5449793 - DNA, 16 bp, Homo sapiens
tcgaatatagttctgt

SEQ ID NO: 5449794 - DNA, 12 bp, Homo sapiens
tcgaatctctgc

SEQ ID NO: 5449795 - DNA, 15 bp, Homo sapiens
tcgaatctctgcccc

SEQ ID NO: 5449796 - DNA, 19 bp, Homo sapiens
tcgaatgtgtgggcccaag

SEQ ID NO: 5449797 - DNA, 16 bp, Homo sapiens
tcgaatttgaagagat

SEQ ID NO: 5449798 - DNA, 17 bp, Homo sapiens
tcgaatttgaagagatt

SEQ ID NO: 5449799 - DNA, 17 bp, Homo sapiens
tcgaattttatctgtgg

SEQ ID NO: 5449800 - DNA, 23 bp, Homo sapiens
tcgaattttgtctttaaaattca

SEQ ID NO: 5449801 - DNA, 20 bp, Homo sapiens
tcgaatttttattatttgtt

SEQ ID NO: 5449802 - DNA, 17 bp, Homo sapiens
tcgacaaaggccacagg

SEQ ID NO: 5449803 - DNA, 12 bp, Homo sapiens
tcgacacagagt

SEQ ID NO: 5449804 - DNA, 13 bp, Homo sapiens
tcgacaccccccc

SEQ ID NO: 5449805 - DNA, 18 bp, Homo sapiens
tcgacacccccccaaccc

SEQ ID NO: 5449806 - DNA, 12 bp, Homo sapiens
tcgacagacagc

SEQ ID NO: 5449807 - DNA, 21 bp, Homo sapiens
tcgacatcaccgtcattgatg

SEQ ID NO: 5449808 - DNA, 15 bp, Homo sapiens
tcgacatgctgccag

SEQ ID NO: 5449809 - DNA, 20 bp, Homo sapiens
tcgaccacaccagcctcctg

SEQ ID NO: 5449810 - DNA, 22 bp, Homo sapiens
tcgaccacagcaagccatcatc

SEQ ID NO: 5449811 - DNA, 19 bp, Homo sapiens
tcgacccagaatggagcct

SEQ ID NO: 5449812 - DNA, 20 bp, Homo sapiens
tcgacccagaatggagcctg

SEQ ID NO: 5449813 - DNA, 14 bp, Homo sapiens
tcgaccccaaagcc

SEQ ID NO: 5449814 - DNA, 18 bp, Homo sapiens
tcgacccccaagggaccc

SEQ ID NO: 5449815 - DNA, 23 bp, Homo sapiens
tcgacccctcctgcccctctctc

SEQ ID NO: 5449816 - DNA, 13 bp, Homo sapiens
tcgaccctggggc

SEQ ID NO: 5449817 - DNA, 14 bp, Homo sapiens
tcgaccctgtcccc

SEQ ID NO: 5449818 - DNA, 16 bp, Homo sapiens
tcgaccctgtccccta

SEQ ID NO: 5449819 - DNA, 19 bp, Homo sapiens
tcgaccctgtcccctaggg

SEQ ID NO: 5449820 - DNA, 15 bp, Homo sapiens
tcgaccgcacttatg

SEQ ID NO: 5449821 - DNA, 15 bp, Homo sapiens
tcgacggcacgcact

SEQ ID NO: 5449822 - DNA, 15 bp, Homo sapiens
tcgacgtcccttgga

SEQ ID NO: 5449823 - DNA, 16 bp, Homo sapiens
tcgactactgctcctg

SEQ ID NO: 5449824 - DNA, 19 bp, Homo sapiens
tcgactactgctcctgtgg

SEQ ID NO: 5449825 - DNA, 23 bp, Homo sapiens
tcgactactgctcctgtggcagg

SEQ ID NO: 5449826 - DNA, 12 bp, Homo sapiens
tcgactcagcac

SEQ ID NO: 5449827 - DNA, 14 bp, Homo sapiens
tcgactcagcctca

SEQ ID NO: 5449828 - DNA, 14 bp, Homo sapiens
tcgactcaggatcc

SEQ ID NO: 5449829 - DNA, 12 bp, Homo sapiens
tcgactcccccc

SEQ ID NO: 5449830 - DNA, 15 bp, Homo sapiens
tcgactctgctgctc

SEQ ID NO: 5449831 - DNA, 21 bp, Homo sapiens
tcgactctttgcaacagcact

SEQ ID NO: 5449832 - DNA, 12 bp, Homo sapiens
tcgactggtcca

SEQ ID NO: 5449833 - DNA, 15 bp, Homo sapiens
tcgactggtccagct

SEQ ID NO: 5449834 - DNA, 17 bp, Homo sapiens
tcgactggtccagctct

SEQ ID NO: 5449835 - DNA, 18 bp, Homo sapiens
tcgactggtccagctctg

SEQ ID NO: 5449836 - DNA, 20 bp, Homo sapiens
tcgactggtccagctctgac

SEQ ID NO: 5449837 - DNA, 14 bp, Homo sapiens
tcgactgttgttat

SEQ ID NO: 5449838 - DNA, 14 bp, Homo sapiens
tcgacttatttctt

SEQ ID NO: 5449839 - DNA, 16 bp, Homo sapiens
tcgacttatttcttaa

SEQ ID NO: 5449840 - DNA, 17 bp, Homo sapiens
tcgacttcgggctggcc

SEQ ID NO: 5449841 - DNA, 17 bp, Homo sapiens
tcgactttatacagaac

SEQ ID NO: 5449842 - DNA, 18 bp, Homo sapiens
tcgactttatacagaact

SEQ ID NO: 5449843 - DNA, 14 bp, Homo sapiens
tcgacttttcttaa

SEQ ID NO: 5449844 - DNA, 21 bp, Homo sapiens
tcgagaaagaggcaccaggaa

SEQ ID NO: 5449845 - DNA, 21 bp, Homo sapiens
tcgagaagctgctctggaatt

SEQ ID NO: 5449846 - DNA, 11 bp, Homo sapiens
tcgagaattgt

SEQ ID NO: 5449847 - DNA, 14 bp, Homo sapiens
tcgagacacttgcc

SEQ ID NO: 5449848 - DNA, 15 bp, Homo sapiens
tcgagaccagcctcg

SEQ ID NO: 5449849 - DNA, 14 bp, Homo sapiens
tcgagaccagcctg

SEQ ID NO: 5449850 - DNA, 18 bp, Homo sapiens
tcgagaccagcctgggca

SEQ ID NO: 5449851 - DNA, 14 bp, Homo sapiens
tcgagaccagtctg

SEQ ID NO: 5449852 - DNA, 15 bp, Homo sapiens
tcgagaccatcctgg

SEQ ID NO: 5449853 - DNA, 20 bp, Homo sapiens
tcgagaccatcctggccaac

SEQ ID NO: 5449854 - DNA, 19 bp, Homo sapiens
tcgagaccatcctggcccc

SEQ ID NO: 5449855 - DNA, 19 bp, Homo sapiens
tcgagaccatcctggctaa

SEQ ID NO: 5449856 - DNA, 20 bp, Homo sapiens
tcgagagaggcgggccccag

SEQ ID NO: 5449857 - DNA, 14 bp, Homo sapiens
tcgagagcagcctg

SEQ ID NO: 5449858 - DNA, 15 bp, Homo sapiens
tcgagagcagcctgg

SEQ ID NO: 5449859 - DNA, 16 bp, Homo sapiens
tcgagagcagcctggc

SEQ ID NO: 5449860 - DNA, 21 bp, Homo sapiens
tcgagagctggccaaagagcc

SEQ ID NO: 5449861 - DNA, 13 bp, Homo sapiens
tcgagagggctga

SEQ ID NO: 5449862 - DNA, 16 bp, Homo sapiens
tcgagagggctgagcc

SEQ ID NO: 5449863 - DNA, 17 bp, Homo sapiens
tcgagagggctgagccc

SEQ ID NO: 5449864 - DNA, 14 bp, Homo sapiens
tcgagatagttttt

SEQ ID NO: 5449865 - DNA, 17 bp, Homo sapiens
tcgagatcccaacactg

SEQ ID NO: 5449866 - DNA, 16 bp, Homo sapiens
tcgagattgcactgct

SEQ ID NO: 5449867 - DNA, 22 bp, Homo sapiens
tcgagcaaaattcaaaaagaac

SEQ ID NO: 5449868 - DNA, 17 bp, Homo sapiens
tcgagcagcattttatt

SEQ ID NO: 5449869 - DNA, 17 bp, Homo sapiens
tcgagcagtcctgcctc

SEQ ID NO: 5449870 - DNA, 14 bp, Homo sapiens
tcgagcatgcctgg

SEQ ID NO: 5449871 - DNA, 16 bp, Homo sapiens
tcgagcatgcctggat

SEQ ID NO: 5449872 - DNA, 13 bp, Homo sapiens
tcgagccaactct

SEQ ID NO: 5449873 - DNA, 13 bp, Homo sapiens
tcgagccactgca

SEQ ID NO: 5449874 - DNA, 17 bp, Homo sapiens
tcgagcccacccagcat

SEQ ID NO: 5449875 - DNA, 13 bp, Homo sapiens
tcgagccctgcag

SEQ ID NO: 5449876 - DNA, 16 bp, Homo sapiens
tcgagccctgcagcca

SEQ ID NO: 5449877 - DNA, 15 bp, Homo sapiens
tcgagcgccctgcag

SEQ ID NO: 5449878 - DNA, 19 bp, Homo sapiens
tcgagcgccctgcagaccc

SEQ ID NO: 5449879 - DNA, 15 bp, Homo sapiens
tcgagctcggggctg

SEQ ID NO: 5449880 - DNA, 20 bp, Homo sapiens
tcgagctctgtagcctggtc

SEQ ID NO: 5449881 - DNA, 17 bp, Homo sapiens
tcgaggaaccagagcca

SEQ ID NO: 5449882 - DNA, 12 bp, Homo sapiens
tcgaggacaagt

SEQ ID NO: 5449883 - DNA, 15 bp, Homo sapiens
tcgaggacagcaatg

SEQ ID NO: 5449884 - DNA, 21 bp, Homo sapiens
tcgaggacaggaaaggcccca

SEQ ID NO: 5449885 - DNA, 13 bp, Homo sapiens
tcgaggacaggga

SEQ ID NO: 5449886 - DNA, 14 bp, Homo sapiens
tcgaggacagggag

SEQ ID NO: 5449887 - DNA, 17 bp, Homo sapiens
tcgaggacagggaggtg

SEQ ID NO: 5449888 - DNA, 20 bp, Homo sapiens
tcgaggcaccggcgctgcag

SEQ ID NO: 5449889 - DNA, 19 bp, Homo sapiens
tcgaggccacattgctggc

SEQ ID NO: 5449890 - DNA, 14 bp, Homo sapiens
tcgaggcctacaga

SEQ ID NO: 5449891 - DNA, 10 bp, Homo sapiens
tcgaggcctg

SEQ ID NO: 5449892 - DNA, 11 bp, Homo sapiens
tcgaggcctga

SEQ ID NO: 5449893 - DNA, 14 bp, Homo sapiens
tcgaggcctgcaaa

SEQ ID NO: 5449894 - DNA, 22 bp, Homo sapiens
tcgaggcctgcaaaccttcctg

SEQ ID NO: 5449895 - DNA, 22 bp, Homo sapiens
tcgaggcggtttccaggaagag

SEQ ID NO: 5449896 - DNA, 14 bp, Homo sapiens
tcgaggctggtgcc

SEQ ID NO: 5449897 - DNA, 21 bp, Homo sapiens
tcgaggctggtggttttcaga

SEQ ID NO: 5449898 - DNA, 15 bp, Homo sapiens
tcgagggcagggact

SEQ ID NO: 5449899 - DNA, 23 bp, Homo sapiens
tcgaggtaggtggatcacctgag

SEQ ID NO: 5449900 - DNA, 15 bp, Homo sapiens
tcgaggtcagaggag

SEQ ID NO: 5449901 - DNA, 17 bp, Homo sapiens
tcgaggtcctcctggcc

SEQ ID NO: 5449902 - DNA, 17 bp, Homo sapiens
tcgaggtgccttcttca

SEQ ID NO: 5449903 - DNA, 20 bp, Homo sapiens
tcgaggtgccttcttcaggg

SEQ ID NO: 5449904 - DNA, 10 bp, Homo sapiens
tcgaggtggc

SEQ ID NO: 5449905 - DNA, 17 bp, Homo sapiens
tcgaggtgtcaccctgc

SEQ ID NO: 5449906 - DNA, 23 bp, Homo sapiens
tcgaggtgtcaccctgcagagct

SEQ ID NO: 5449907 - DNA, 22 bp, Homo sapiens
tcgaggtttctcaaagaaattt

SEQ ID NO: 5449908 - DNA, 16 bp, Homo sapiens
tcgagtaaacttgaaa

SEQ ID NO: 5449909 - DNA, 12 bp, Homo sapiens
tcgagtactgtg

SEQ ID NO: 5449910 - DNA, 20 bp, Homo sapiens
tcgagtactgtgggcaattt

SEQ ID NO: 5449911 - DNA, 18 bp, Homo sapiens
tcgagtcacattctgctt

SEQ ID NO: 5449912 - DNA, 14 bp, Homo sapiens
tcgagtccccccac

SEQ ID NO: 5449913 - DNA, 15 bp, Homo sapiens
tcgagtctttgtgtg

SEQ ID NO: 5449914 - DNA, 16 bp, Homo sapiens
tcgagtctttgtgtgt

SEQ ID NO: 5449915 - DNA, 22 bp, Homo sapiens
tcgagtgccgcatctcacagct

SEQ ID NO: 5449916 - DNA, 20 bp, Homo sapiens
tcgagtgttgtgttaaaagg

SEQ ID NO: 5449917 - DNA, 16 bp, Homo sapiens
tcgagtgtttaaatgc

SEQ ID NO: 5449918 - DNA, 17 bp, Homo sapiens
tcgagtgtttaaatgct

SEQ ID NO: 5449919 - DNA, 20 bp, Homo sapiens
tcgagtgtttaaatgctgtg

SEQ ID NO: 5449920 - DNA, 15 bp, Homo sapiens
tcgagttacagacaa

SEQ ID NO: 5449921 - DNA, 15 bp, Homo sapiens
tcgagttcccagggt

SEQ ID NO: 5449922 - DNA, 22 bp, Homo sapiens
tcgagttctcctatcttctcca

SEQ ID NO: 5449923 - DNA, 21 bp, Homo sapiens
tcgatacccaggaccaagcca

SEQ ID NO: 5449924 - DNA, 18 bp, Homo sapiens
tcgatataggcatttggt

SEQ ID NO: 5449925 - DNA, 18 bp, Homo sapiens
tcgatatcaccatgattt

SEQ ID NO: 5449926 - DNA, 13 bp, Homo sapiens
tcgatatgtatat

SEQ ID NO: 5449927 - DNA, 14 bp, Homo sapiens
tcgatattcccagg

SEQ ID NO: 5449928 - DNA, 14 bp, Homo sapiens
tcgatatttccatc

SEQ ID NO: 5449929 - DNA, 17 bp, Homo sapiens
tcgatcaagagaatcaa

SEQ ID NO: 5449930 - DNA, 14 bp, Homo sapiens
tcgatccaaattgt

SEQ ID NO: 5449931 - DNA, 19 bp, Homo sapiens
tcgatcctggattcactca

SEQ ID NO: 5449932 - DNA, 20 bp, Homo sapiens
tcgatctcattcagtattaa

SEQ ID NO: 5449933 - DNA, 15 bp, Homo sapiens
tcgatgaaggctgcc

SEQ ID NO: 5449934 - DNA, 19 bp, Homo sapiens
tcgatgatgatgatgatga

SEQ ID NO: 5449935 - DNA, 15 bp, Homo sapiens
tcgatgattcaggtg

SEQ ID NO: 5449936 - DNA, 22 bp, Homo sapiens
tcgatgcaagtgtttctgttct

SEQ ID NO: 5449937 - DNA, 12 bp, Homo sapiens
tcgatgcacagt

SEQ ID NO: 5449938 - DNA, 12 bp, Homo sapiens
tcgatgcactga

SEQ ID NO: 5449939 - DNA, 20 bp, Homo sapiens
tcgatgccactcctgcttct

SEQ ID NO: 5449940 - DNA, 20 bp, Homo sapiens
tcgatgccataatcagaaca

SEQ ID NO: 5449941 - DNA, 18 bp, Homo sapiens
tcgatgcctttgctgttt

SEQ ID NO: 5449942 - DNA, 16 bp, Homo sapiens
tcgatgcgtattctgt

SEQ ID NO: 5449943 - DNA, 12 bp, Homo sapiens
tcgatgctgctg

SEQ ID NO: 5449944 - DNA, 14 bp, Homo sapiens
tcgatgctgctggc

SEQ ID NO: 5449945 - DNA, 17 bp, Homo sapiens
tcgatgctgctggcctc

SEQ ID NO: 5449946 - DNA, 16 bp, Homo sapiens
tcgatggacctcagca

SEQ ID NO: 5449947 - DNA, 17 bp, Homo sapiens
tcgatgggggatgcttc

SEQ ID NO: 5449948 - DNA, 19 bp, Homo sapiens
tcgatgtcctcctctgtga

SEQ ID NO: 5449949 - DNA, 16 bp, Homo sapiens
tcgatgttatgtaaaa

SEQ ID NO: 5449950 - DNA, 16 bp, Homo sapiens
tcgatgtttgccatga

SEQ ID NO: 5449951 - DNA, 22 bp, Homo sapiens
tcgatgttttattatttctatt

SEQ ID NO: 5449952 - DNA, 14 bp, Homo sapiens
tcgattagactgga

SEQ ID NO: 5449953 - DNA, 21 bp, Homo sapiens
tcgattagactggacagcttg

SEQ ID NO: 5449954 - DNA, 22 bp, Homo sapiens
tcgattagactggacagcttgt

SEQ ID NO: 5449955 - DNA, 20 bp, Homo sapiens
tcgattattccctgtacaat

SEQ ID NO: 5449956 - DNA, 16 bp, Homo sapiens
tcgattcaaactgctc

SEQ ID NO: 5449957 - DNA, 17 bp, Homo sapiens
tcgattcccaagctccc

SEQ ID NO: 5449958 - DNA, 11 bp, Homo sapiens
tcgatttctac

SEQ ID NO: 5449959 - DNA, 15 bp, Homo sapiens
tcgatttctacctca

SEQ ID NO: 5449960 - DNA, 20 bp, Homo sapiens
tcgatttctacctcagcagc

SEQ ID NO: 5449961 - DNA, 18 bp, Homo sapiens
tcgatttgtattaatgta

SEQ ID NO: 5449962 - DNA, 17 bp, Homo sapiens
tcgattttgtatctgca

SEQ ID NO: 5449963 - DNA, 16 bp, Homo sapiens
tcgcaaaatgatgtga

SEQ ID NO: 5449964 - DNA, 15 bp, Homo sapiens
tcgcaaccctgcctg

SEQ ID NO: 5449965 - DNA, 15 bp, Homo sapiens
tcgcaactgaaggaa

SEQ ID NO: 5449966 - DNA, 14 bp, Homo sapiens
tcgcaagttaactt

SEQ ID NO: 5449967 - DNA, 17 bp, Homo sapiens
tcgcacaatctacactg

SEQ ID NO: 5449968 - DNA, 13 bp, Homo sapiens
tcgcacacacatt

SEQ ID NO: 5449969 - DNA, 22 bp, Homo sapiens
tcgcacacacatttggaatgca

SEQ ID NO: 5449970 - DNA, 14 bp, Homo sapiens
tcgcacacacccat

SEQ ID NO: 5449971 - DNA, 13 bp, Homo sapiens
tcgcacacagggc

SEQ ID NO: 5449972 - DNA, 22 bp, Homo sapiens
tcgcacagattacttcagggct

SEQ ID NO: 5449973 - DNA, 14 bp, Homo sapiens
tcggagtgtggcct

SEQ ID NO: 5449974 - DNA, 17 bp, Homo sapiens
tcggagtgtggcctgga

SEQ ID NO: 5449975 - DNA, 13 bp, Homo sapiens
tcggagtttctta

SEQ ID NO: 5449976 - DNA, 17 bp, Homo sapiens
tcggataattttcattt

SEQ ID NO: 5449977 - DNA, 18 bp, Homo sapiens
tcggataattttcatttt

SEQ ID NO: 5449978 - DNA, 19 bp, Homo sapiens
tcggatatgattgtttctc

SEQ ID NO: 5449979 - DNA, 21 bp, Homo sapiens
tcggatgacaccctggcctga

SEQ ID NO: 5449980 - DNA, 16 bp, Homo sapiens
tcggatggaccaacct

SEQ ID NO: 5449981 - DNA, 17 bp, Homo sapiens
tcggatgggtgtgggag

SEQ ID NO: 5449982 - DNA, 20 bp, Homo sapiens
tcggatgtgtcctttctgaa

SEQ ID NO: 5449983 - DNA, 14 bp, Homo sapiens
tcggattttttcca

SEQ ID NO: 5449984 - DNA, 16 bp, Homo sapiens
tcggattttttccaaa

SEQ ID NO: 5449985 - DNA, 17 bp, Homo sapiens
tcggattttttccaaaa

SEQ ID NO: 5449986 - DNA, 21 bp, Homo sapiens
tcggcaacagggcttctcttt

SEQ ID NO: 5449987 - DNA, 18 bp, Homo sapiens
tcggcaactaagcagtcc

SEQ ID NO: 5449988 - DNA, 11 bp, Homo sapiens
tcggcacacac

SEQ ID NO: 5449989 - DNA, 14 bp, Homo sapiens
tcggcacagcctgg

SEQ ID NO: 5449990 - DNA, 19 bp, Homo sapiens
tcggcacttttcattactt

SEQ ID NO: 5449991 - DNA, 16 bp, Homo sapiens
tcggcagaactctctg

SEQ ID NO: 5449992 - DNA, 20 bp, Homo sapiens
tcggcagaggaacccccacc

SEQ ID NO: 5449993 - DNA, 21 bp, Homo sapiens
tcggcagatgatgctttggaa

SEQ ID NO: 5449994 - DNA, 22 bp, Homo sapiens
tcggcagatgatgctttggaag

SEQ ID NO: 5449995 - DNA, 18 bp, Homo sapiens
tcggcagtattttctgtt

SEQ ID NO: 5449996 - DNA, 14 bp, Homo sapiens
tcggcagtggctgg

SEQ ID NO: 5449997 - DNA, 15 bp, Homo sapiens
tcggcagtggctggg

SEQ ID NO: 5449998 - DNA, 17 bp, Homo sapiens
tcggcagtggctggggg

SEQ ID NO: 5449999 - DNA, 16 bp, Homo sapiens
tcggcatagtccccag

SEQ ID NO: 5450000 - DNA, 19 bp, Homo sapiens
tcggcatagtccccagagc

SEQ ID NO: 5450001 - DNA, 19 bp, Homo sapiens
tcggcattcacacacagcc

SEQ ID NO: 5450002 - DNA, 21 bp, Homo sapiens
tcggcattcacacacagcctg

SEQ ID NO: 5450003 - DNA, 22 bp, Homo sapiens
tcggcattcacacacagcctgg

SEQ ID NO: 5450004 - DNA, 16 bp, Homo sapiens
tcggcatttcaaatgt

SEQ ID NO: 5450005 - DNA, 22 bp, Homo sapiens
tcggccaagaatacttgaagaa

SEQ ID NO: 5450006 - DNA, 13 bp, Homo sapiens
tcggccacaggca

SEQ ID NO: 5450007 - DNA, 18 bp, Homo sapiens
tcggccactgtgtctctg

SEQ ID NO: 5450008 - DNA, 12 bp, Homo sapiens
tcggcccacagc

SEQ ID NO: 5450009 - DNA, 19 bp, Homo sapiens
tcggcccacagctcccacc

SEQ ID NO: 5450010 - DNA, 13 bp, Homo sapiens
tcggcccagggcc

SEQ ID NO: 5450011 - DNA, 16 bp, Homo sapiens
tcggccccacatggga

SEQ ID NO: 5450012 - DNA, 18 bp, Homo sapiens
tcggccccaccagtgcct

SEQ ID NO: 5450013 - DNA, 19 bp, Homo sapiens
tcggccccaccagtgcctc

SEQ ID NO: 5450014 - DNA, 14 bp, Homo sapiens
tcggcccctcacca

SEQ ID NO: 5450015 - DNA, 19 bp, Homo sapiens
tcggcccctcaccacctct

SEQ ID NO: 5450016 - DNA, 15 bp, Homo sapiens
tcggcccggagcagc

SEQ ID NO: 5450017 - DNA, 11 bp, Homo sapiens
tcggccctgaa

SEQ ID NO: 5450018 - DNA, 19 bp, Homo sapiens
tcggccctgaaccacgagg

SEQ ID NO: 5450019 - DNA, 23 bp, Homo sapiens
tcggccctgaaccacgaggctgc

SEQ ID NO: 5450020 - DNA, 14 bp, Homo sapiens
tcggccctgcccaa

SEQ ID NO: 5450021 - DNA, 20 bp, Homo sapiens
tcggccctgcgtcggccctg

SEQ ID NO: 5450022 - DNA, 19 bp, Homo sapiens
tcggccctgtcccctggag

SEQ ID NO: 5450023 - DNA, 16 bp, Homo sapiens
tcggccgaccaggctg

SEQ ID NO: 5450024 - DNA, 15 bp, Homo sapiens
tcggccgagctggtt

SEQ ID NO: 5450025 - DNA, 17 bp, Homo sapiens
tcggccgagctggtttc

SEQ ID NO: 5450026 - DNA, 14 bp, Homo sapiens
tcggccgaggcctg

SEQ ID NO: 5450027 - DNA, 14 bp, Homo sapiens
tcggccgtgggccg

SEQ ID NO: 5450028 - DNA, 15 bp, Homo sapiens
tcggcctagggcccc

SEQ ID NO: 5450029 - DNA, 18 bp, Homo sapiens
tcggcctcccaaagtgct

SEQ ID NO: 5450030 - DNA, 20 bp, Homo sapiens
tcggcctcccaaagtgctgg

SEQ ID NO: 5450031 - DNA, 17 bp, Homo sapiens
tcggcctccgaggctcc

SEQ ID NO: 5450032 - DNA, 19 bp, Homo sapiens
tcggcctccgaggctcccc

SEQ ID NO: 5450033 - DNA, 20 bp, Homo sapiens
tcggcctccgaggctccccg

SEQ ID NO: 5450034 - DNA, 19 bp, Homo sapiens
tcggcctctaaccccaggc

SEQ ID NO: 5450035 - DNA, 21 bp, Homo sapiens
tcggcctctaaccccaggccc

SEQ ID NO: 5450036 - DNA, 19 bp, Homo sapiens
tcggcctggctggccagga

SEQ ID NO: 5450037 - DNA, 17 bp, Homo sapiens
tcggccttctgtggcct

SEQ ID NO: 5450038 - DNA, 22 bp, Homo sapiens
tcggccttggtgaacacacacg

SEQ ID NO: 5450039 - DNA, 23 bp, Homo sapiens
tcggcgcccaccaccccctcaag

SEQ ID NO: 5450040 - DNA, 13 bp, Homo sapiens
tcggctaaaaaga

SEQ ID NO: 5450041 - DNA, 14 bp, Homo sapiens
tcggctaaaaagaa

SEQ ID NO: 5450042 - DNA, 23 bp, Homo sapiens
tcggctaaaaagaatgcagagat

SEQ ID NO: 5450043 - DNA, 22 bp, Homo sapiens
tcggctactggttacctggaga

SEQ ID NO: 5450044 - DNA, 17 bp, Homo sapiens
tcggctatgtctcatgt

SEQ ID NO: 5450045 - DNA, 14 bp, Homo sapiens
tcggctcagcctcc

SEQ ID NO: 5450046 - DNA, 13 bp, Homo sapiens
tcggctcaggctc

SEQ ID NO: 5450047 - DNA, 12 bp, Homo sapiens
tcggctcctgat

SEQ ID NO: 5450048 - DNA, 21 bp, Homo sapiens
tcggctcctggactcattgct

SEQ ID NO: 5450049 - DNA, 22 bp, Homo sapiens
tcggctctgcatgttttccagg

SEQ ID NO: 5450050 - DNA, 13 bp, Homo sapiens
tcggctctgggtg

SEQ ID NO: 5450051 - DNA, 16 bp, Homo sapiens
tcggctgaccatgctc

SEQ ID NO: 5450052 - DNA, 19 bp, Homo sapiens
tcggctgccaggggctctg

SEQ ID NO: 5450053 - DNA, 16 bp, Homo sapiens
tcggctgggcagggcc

SEQ ID NO: 5450054 - DNA, 19 bp, Homo sapiens
tcggctggggactgctacc

SEQ ID NO: 5450055 - DNA, 21 bp, Homo sapiens
tcggctgtaaacagctctgtg

SEQ ID NO: 5450056 - DNA, 14 bp, Homo sapiens
tcggctgtctcctg

SEQ ID NO: 5450057 - DNA, 13 bp, Homo sapiens
tcggctgtggaga

SEQ ID NO: 5450058 - DNA, 14 bp, Homo sapiens
tcggcttcctcagg

SEQ ID NO: 5450059 - DNA, 21 bp, Homo sapiens
tcggctttgcccccttgccct

SEQ ID NO: 5450060 - DNA, 21 bp, Homo sapiens
tcgggaaaaggtagaggagtc

SEQ ID NO: 5450061 - DNA, 16 bp, Homo sapiens
tcgggaagagaggagt

SEQ ID NO: 5450062 - DNA, 20 bp, Homo sapiens
tcgggaagagaggagttcaa

SEQ ID NO: 5450063 - DNA, 24 bp, Homo sapiens
tcgggaagagaggagttcaatgat

SEQ ID NO: 5450064 - DNA, 22 bp, Homo sapiens
tcgggaagatcctccttccagg

SEQ ID NO: 5450065 - DNA, 14 bp, Homo sapiens
tcgggaagcagcca

SEQ ID NO: 5450066 - DNA, 19 bp, Homo sapiens
tcgggaagcagccagctcc

SEQ ID NO: 5450067 - DNA, 14 bp, Homo sapiens
tcgggaattttccc

SEQ ID NO: 5450068 - DNA, 18 bp, Homo sapiens
tcgggacagaccagcagc

SEQ ID NO: 5450069 - DNA, 16 bp, Homo sapiens
tcgggacagctgtgcc

SEQ ID NO: 5450070 - DNA, 10 bp, Homo sapiens
tcgggaccag

SEQ ID NO: 5450071 - DNA, 15 bp, Homo sapiens
tcgggaccctcccag

SEQ ID NO: 5450072 - DNA, 21 bp, Homo sapiens
tcgggagacagcatcagggtt

SEQ ID NO: 5450073 - DNA, 21 bp, Homo sapiens
tcgggagaggggacgcaggcc

SEQ ID NO: 5450074 - DNA, 13 bp, Homo sapiens
tcgggagcaccca

SEQ ID NO: 5450075 - DNA, 18 bp, Homo sapiens
tcgggagcacccagagca

SEQ ID NO: 5450076 - DNA, 15 bp, Homo sapiens
tcgggagcagtgtct

SEQ ID NO: 5450077 - DNA, 13 bp, Homo sapiens
tcgggagctgcac

SEQ ID NO: 5450078 - DNA, 16 bp, Homo sapiens
tcgggagctgcacaca

SEQ ID NO: 5450079 - DNA, 13 bp, Homo sapiens
tcgggaggctgag

SEQ ID NO: 5450080 - DNA, 16 bp, Homo sapiens
tcgggaggctgagaca

SEQ ID NO: 5450081 - DNA, 17 bp, Homo sapiens
tcgggaggtcgaggcag

SEQ ID NO: 5450082 - DNA, 13 bp, Homo sapiens
tcgggagtagcaa

SEQ ID NO: 5450083 - DNA, 21 bp, Homo sapiens
tcgggagtcctctagcaggcc

SEQ ID NO: 5450084 - DNA, 17 bp, Homo sapiens
tcgggatgaaaagccat

SEQ ID NO: 5450085 - DNA, 19 bp, Homo sapiens
tcgggatgaaaagccatat

SEQ ID NO: 5450086 - DNA, 15 bp, Homo sapiens
tcgggatggttggtt

SEQ ID NO: 5450087 - DNA, 12 bp, Homo sapiens
tcgggattccct

SEQ ID NO: 5450088 - DNA, 14 bp, Homo sapiens
tcgggattccctgg

SEQ ID NO: 5450089 - DNA, 15 bp, Homo sapiens
tcgggattccctggt

SEQ ID NO: 5450090 - DNA, 21 bp, Homo sapiens
tcgggcagcacaagtgtaatg

SEQ ID NO: 5450091 - DNA, 15 bp, Homo sapiens
tcgggcatgagtctg

SEQ ID NO: 5450092 - DNA, 16 bp, Homo sapiens
tcgggcatgagtctgt

SEQ ID NO: 5450093 - DNA, 14 bp, Homo sapiens
tcgggccacagggc

SEQ ID NO: 5450094 - DNA, 18 bp, Homo sapiens
tcgggccagggcgtggct

SEQ ID NO: 5450095 - DNA, 17 bp, Homo sapiens
tcgggcccaggccatct

SEQ ID NO: 5450096 - DNA, 20 bp, Homo sapiens
tcgggccccacctgcagctc

SEQ ID NO: 5450097 - DNA, 19 bp, Homo sapiens
tcgggcccctgcctgcctt

SEQ ID NO: 5450098 - DNA, 21 bp, Homo sapiens
tcgggcccgcactcaggagca

SEQ ID NO: 5450099 - DNA, 14 bp, Homo sapiens
tcgggccctgtggt

SEQ ID NO: 5450100 - DNA, 23 bp, Homo sapiens
tcgggcccttcttgctgccctgc

SEQ ID NO: 5450101 - DNA, 15 bp, Homo sapiens
tcgggcgctgtggct

SEQ ID NO: 5450102 - DNA, 17 bp, Homo sapiens
tcgggcgctgtggctcc

SEQ ID NO: 5450103 - DNA, 19 bp, Homo sapiens
tcgggcgtgggtctctggg

SEQ ID NO: 5450104 - DNA, 15 bp, Homo sapiens
tcgggctcagctctg

SEQ ID NO: 5450105 - DNA, 12 bp, Homo sapiens
tcgggctcctgt

SEQ ID NO: 5450106 - DNA, 20 bp, Homo sapiens
tcgggctgacccttttctga

SEQ ID NO: 5450107 - DNA, 16 bp, Homo sapiens
tcgggctgagaaggca

SEQ ID NO: 5450108 - DNA, 18 bp, Homo sapiens
tcgggctgccagcccagc

SEQ ID NO: 5450109 - DNA, 13 bp, Homo sapiens
tcgggctgtgccc

SEQ ID NO: 5450110 - DNA, 20 bp, Homo sapiens
tcgggctgttctggtggccc

SEQ ID NO: 5450111 - DNA, 14 bp, Homo sapiens
tcgggcttccctgg

SEQ ID NO: 5450112 - DNA, 17 bp, Homo sapiens
tcgggcttccctggcct

SEQ ID NO: 5450113 - DNA, 22 bp, Homo sapiens
tcggggaagctgcacatgtgcc

SEQ ID NO: 5450114 - DNA, 19 bp, Homo sapiens
tcggggaataaaacatttc

SEQ ID NO: 5450115 - DNA, 21 bp, Homo sapiens
tcggggaataaaacatttctc

SEQ ID NO: 5450116 - DNA, 23 bp, Homo sapiens
tcggggacaggtgacagtggctg

SEQ ID NO: 5450117 - DNA, 13 bp, Homo sapiens
tcggggagaaata

SEQ ID NO: 5450118 - DNA, 20 bp, Homo sapiens
tcggggagccgggagcctga

SEQ ID NO: 5450119 - DNA, 13 bp, Homo sapiens
tcggggagcctta

SEQ ID NO: 5450120 - DNA, 14 bp, Homo sapiens
tcggggcaggaagt

SEQ ID NO: 5450121 - DNA, 14 bp, Homo sapiens
tcggggcagggcag

SEQ ID NO: 5450122 - DNA, 16 bp, Homo sapiens
tcggggcatgctgggg

SEQ ID NO: 5450123 - DNA, 18 bp, Homo sapiens
tcggggcatgctggggca

SEQ ID NO: 5450124 - DNA, 14 bp, Homo sapiens
tcggggcccccatc

SEQ ID NO: 5450125 - DNA, 16 bp, Homo sapiens
tcggggcccccatctt

SEQ ID NO: 5450126 - DNA, 23 bp, Homo sapiens
tcggggcccttggggcctggctt

SEQ ID NO: 5450127 - DNA, 15 bp, Homo sapiens
tcggggcctgggaca

SEQ ID NO: 5450128 - DNA, 16 bp, Homo sapiens
tcggggcgacccctca

SEQ ID NO: 5450129 - DNA, 18 bp, Homo sapiens
tcggggcgatgctccctc

SEQ ID NO: 5450130 - DNA, 15 bp, Homo sapiens
tcggggctccaggct

SEQ ID NO: 5450131 - DNA, 12 bp, Homo sapiens
tcggggctgctg

SEQ ID NO: 5450132 - DNA, 14 bp, Homo sapiens
tcggggctgctgtg

SEQ ID NO: 5450133 - DNA, 11 bp, Homo sapiens
tcggggctggg

SEQ ID NO: 5450134 - DNA, 16 bp, Homo sapiens
tcggggctgggggctg

SEQ ID NO: 5450135 - DNA, 23 bp, Homo sapiens
tcggggctgggggctgcagggct

SEQ ID NO: 5450136 - DNA, 16 bp, Homo sapiens
tcgggggaggagcacc

SEQ ID NO: 5450137 - DNA, 18 bp, Homo sapiens
tcgggggaggagcacccc

SEQ ID NO: 5450138 - DNA, 21 bp, Homo sapiens
tcgggggaggagcacccccag

SEQ ID NO: 5450139 - DNA, 14 bp, Homo sapiens
tcgggggcctgcaa

SEQ ID NO: 5450140 - DNA, 15 bp, Homo sapiens
tcgggggcgcctgga

SEQ ID NO: 5450141 - DNA, 16 bp, Homo sapiens
tcgggggcgcctggag

SEQ ID NO: 5450142 - DNA, 18 bp, Homo sapiens
tcgggggcggctctggga

SEQ ID NO: 5450143 - DNA, 12 bp, Homo sapiens
tcgggggctctt

SEQ ID NO: 5450144 - DNA, 15 bp, Homo sapiens
tcgggggctgaccta

SEQ ID NO: 5450145 - DNA, 13 bp, Homo sapiens
tcgggggctggcc

SEQ ID NO: 5450146 - DNA, 15 bp, Homo sapiens
tcgggggctgtggat

SEQ ID NO: 5450147 - DNA, 20 bp, Homo sapiens
tcggggggcgagggagggga

SEQ ID NO: 5450148 - DNA, 15 bp, Homo sapiens
tcggggggctctgcc

SEQ ID NO: 5450149 - DNA, 23 bp, Homo sapiens
tcgggggggaccctccaaggcca

SEQ ID NO: 5450150 - DNA, 20 bp, Homo sapiens
tcggggggtcacaggcccag

SEQ ID NO: 5450151 - DNA, 16 bp, Homo sapiens
tcgggggtgctggggc

SEQ ID NO: 5450152 - DNA, 21 bp, Homo sapiens
tctaaacagaaattattttct

SEQ ID NO: 5450153 - DNA, 19 bp, Homo sapiens
tctaaacagatgtccctga

SEQ ID NO: 5450154 - DNA, 15 bp, Homo sapiens
tctaaaccagaagga

SEQ ID NO: 5450155 - DNA, 14 bp, Homo sapiens
tctaaaccatgaaa

SEQ ID NO: 5450156 - DNA, 16 bp, Homo sapiens
tctaaacccaatccaa

SEQ ID NO: 5450157 - DNA, 18 bp, Homo sapiens
tctaaacccagcaaaaca

SEQ ID NO: 5450158 - DNA, 15 bp, Homo sapiens
tctaaacctgtgcct

SEQ ID NO: 5450159 - DNA, 23 bp, Homo sapiens
tctaaactccctggctgttctga

SEQ ID NO: 5450160 - DNA, 21 bp, Homo sapiens
tctaaactgagctcgcagccc

SEQ ID NO: 5450161 - DNA, 14 bp, Homo sapiens
tctaaactgcatta

SEQ ID NO: 5450162 - DNA, 19 bp, Homo sapiens
tctaaactggtacaatttt

SEQ ID NO: 5450163 - DNA, 18 bp, Homo sapiens
tctaaacttagaaatatg

SEQ ID NO: 5450164 - DNA, 14 bp, Homo sapiens
tctaaagaaacttg

SEQ ID NO: 5450165 - DNA, 21 bp, Homo sapiens
tctaaagaagttcaaaccctg

SEQ ID NO: 5450166 - DNA, 18 bp, Homo sapiens
tctaaagaccaaacttca

SEQ ID NO: 5450167 - DNA, 22 bp, Homo sapiens
tctaaagaccaaacttcactct

SEQ ID NO: 5450168 - DNA, 20 bp, Homo sapiens
tctaaagagaacaagaggtg

SEQ ID NO: 5450169 - DNA, 14 bp, Homo sapiens
tctaaagagagtga

SEQ ID NO: 5450170 - DNA, 22 bp, Homo sapiens
tctaaagatcaagtgggccttg

SEQ ID NO: 5450171 - DNA, 22 bp, Homo sapiens
tctaaagatggagtttctaagg

SEQ ID NO: 5450172 - DNA, 20 bp, Homo sapiens
tctaaagattctatagttct

SEQ ID NO: 5450173 - DNA, 11 bp, Homo sapiens
tctaaagcaaa

SEQ ID NO: 5450174 - DNA, 20 bp, Homo sapiens
tctaaagcagtttattataa

SEQ ID NO: 5450175 - DNA, 18 bp, Homo sapiens
tctaaagccttaagtctt

SEQ ID NO: 5450176 - DNA, 14 bp, Homo sapiens
tctaaagctctgac

SEQ ID NO: 5450177 - DNA, 16 bp, Homo sapiens
tctaaagctgccagcc

SEQ ID NO: 5450178 - DNA, 13 bp, Homo sapiens
tctaaagctttat

SEQ ID NO: 5450179 - DNA, 21 bp, Homo sapiens
tctaaagctttatctttgtgt

SEQ ID NO: 5450180 - DNA, 23 bp, Homo sapiens
tctaaagctttatctttgtgtaa

SEQ ID NO: 5450181 - DNA, 18 bp, Homo sapiens
tctaaagctttggacaag

SEQ ID NO: 5450182 - DNA, 15 bp, Homo sapiens
tctaaaggatggaaa

SEQ ID NO: 5450183 - DNA, 23 bp, Homo sapiens
tctaaaggatggaaaaataaaac

SEQ ID NO: 5450184 - DNA, 13 bp, Homo sapiens
tctaaaggctacc

SEQ ID NO: 5450185 - DNA, 22 bp, Homo sapiens
tctaaaggggttttttgggaag

SEQ ID NO: 5450186 - DNA, 23 bp, Homo sapiens
tctaaaggggttttttgggaaga

SEQ ID NO: 5450187 - DNA, 14 bp, Homo sapiens
tctaaaggtccaca

SEQ ID NO: 5450188 - DNA, 15 bp, Homo sapiens
tctaaaggtccacag

SEQ ID NO: 5450189 - DNA, 23 bp, Homo sapiens
tctaaaggtccacaggtctagac

SEQ ID NO: 5450190 - DNA, 14 bp, Homo sapiens
tctaaagtaaaaag

SEQ ID NO: 5450191 - DNA, 20 bp, Homo sapiens
tctaaagtaaaattgaagca

SEQ ID NO: 5450192 - DNA, 22 bp, Homo sapiens
tctaaagtaaaattgaagcaac

SEQ ID NO: 5450193 - DNA, 17 bp, Homo sapiens
tctaaagtcactagtga

SEQ ID NO: 5450194 - DNA, 14 bp, Homo sapiens
tctaaagtgggaaa

SEQ ID NO: 5450195 - DNA, 12 bp, Homo sapiens
tctaaagtgttg

SEQ ID NO: 5450196 - DNA, 15 bp, Homo sapiens
tctaaagtgttggtc

SEQ ID NO: 5450197 - DNA, 16 bp, Homo sapiens
tctaaagttactactg

SEQ ID NO: 5450198 - DNA, 21 bp, Homo sapiens
tctaaagttagggcatttttc

SEQ ID NO: 5450199 - DNA, 11 bp, Homo sapiens
tctaaagttct

SEQ ID NO: 5450200 - DNA, 15 bp, Homo sapiens
tctaaagttctaaga

SEQ ID NO: 5450201 - DNA, 17 bp, Homo sapiens
tctaaagttctaagatt

SEQ ID NO: 5450202 - DNA, 21 bp, Homo sapiens
tctaaagttctaagattctga

SEQ ID NO: 5450203 - DNA, 19 bp, Homo sapiens
tctaaagttgttcacatat

SEQ ID NO: 5450204 - DNA, 13 bp, Homo sapiens
tctaaagtttaca

SEQ ID NO: 5450205 - DNA, 16 bp, Homo sapiens
tctaaagtttacagta

SEQ ID NO: 5450206 - DNA, 19 bp, Homo sapiens
tctaaagtttacagtaaat

SEQ ID NO: 5450207 - DNA, 15 bp, Homo sapiens
tctaaagttttgcaa

SEQ ID NO: 5450208 - DNA, 15 bp, Homo sapiens
tctaaataaaaatat

SEQ ID NO: 5450209 - DNA, 23 bp, Homo sapiens
tctaaataaatttcccagttaaa

SEQ ID NO: 5450210 - DNA, 19 bp, Homo sapiens
tctaaataaatttgctttt

SEQ ID NO: 5450211 - DNA, 14 bp, Homo sapiens
tctaaataatggcc

SEQ ID NO: 5450212 - DNA, 16 bp, Homo sapiens
tctaaatagaaatata

SEQ ID NO: 5450213 - DNA, 13 bp, Homo sapiens
tctaaatagccaa

SEQ ID NO: 5450214 - DNA, 21 bp, Homo sapiens
tctaaatagccaacacccatc

SEQ ID NO: 5450215 - DNA, 19 bp, Homo sapiens
tctaaatagcgattataat

SEQ ID NO: 5450216 - DNA, 22 bp, Homo sapiens
tctaaatatcccttggacattt

SEQ ID NO: 5450217 - DNA, 23 bp, Homo sapiens
tctaaatatgaatgaatgggata

SEQ ID NO: 5450218 - DNA, 16 bp, Homo sapiens
tctaaatatggactgc

SEQ ID NO: 5450219 - DNA, 17 bp, Homo sapiens
tctaaatattcagaatc

SEQ ID NO: 5450220 - DNA, 16 bp, Homo sapiens
tctaaatattgacact

SEQ ID NO: 5450221 - DNA, 14 bp, Homo sapiens
tctaaatcaaacca

SEQ ID NO: 5450222 - DNA, 17 bp, Homo sapiens
tctaaatcactttaatt

SEQ ID NO: 5450223 - DNA, 16 bp, Homo sapiens
tctaaatcataatcat

SEQ ID NO: 5450224 - DNA, 21 bp, Homo sapiens
tctaaatctatttattaatat

SEQ ID NO: 5450225 - DNA, 17 bp, Homo sapiens
tctaaatgaaaagagaa

SEQ ID NO: 5450226 - DNA, 13 bp, Homo sapiens
tctaaatgaagtg

SEQ ID NO: 5450227 - DNA, 12 bp, Homo sapiens
tctaaatgagct

SEQ ID NO: 5450228 - DNA, 19 bp, Homo sapiens
tctaaatgattatcttgaa

SEQ ID NO: 5450229 - DNA, 13 bp, Homo sapiens
tctaaatgcaata

SEQ ID NO: 5450230 - DNA, 14 bp, Homo sapiens
tctaaatgcaataa

SEQ ID NO: 5450231 - DNA, 13 bp, Homo sapiens
tctaaatgcccag

SEQ ID NO: 5450232 - DNA, 14 bp, Homo sapiens
tctaaatgcccagt

SEQ ID NO: 5450233 - DNA, 15 bp, Homo sapiens
tctaaatgcccagtt

SEQ ID NO: 5450234 - DNA, 16 bp, Homo sapiens
tctaaatgcccagttc

SEQ ID NO: 5450235 - DNA, 18 bp, Homo sapiens
tctaaatgttggaatgtt

SEQ ID NO: 5450236 - DNA, 14 bp, Homo sapiens
tctaaatgtttctt

SEQ ID NO: 5450237 - DNA, 12 bp, Homo sapiens
tctaaattaaaa

SEQ ID NO: 5450238 - DNA, 13 bp, Homo sapiens
tctaaattaaaaa

SEQ ID NO: 5450239 - DNA, 15 bp, Homo sapiens
tctaaattaagtccc

SEQ ID NO: 5450240 - DNA, 14 bp, Homo sapiens
tctaaattcactgt

SEQ ID NO: 5450241 - DNA, 17 bp, Homo sapiens
tctaaattgatcattca

SEQ ID NO: 5450242 - DNA, 22 bp, Homo sapiens
tctaaatttggaacttacaaag

SEQ ID NO: 5450243 - DNA, 19 bp, Homo sapiens
tctaaattttctaaataac

SEQ ID NO: 5450244 - DNA, 13 bp, Homo sapiens
tctaacaaaataa

SEQ ID NO: 5450245 - DNA, 15 bp, Homo sapiens
tctaacaaaataagg

SEQ ID NO: 5450246 - DNA, 13 bp, Homo sapiens
tctaacaaatgat

SEQ ID NO: 5450247 - DNA, 14 bp, Homo sapiens
tctaacaataatat

SEQ ID NO: 5450248 - DNA, 21 bp, Homo sapiens
tctaacaataatatttcaagt

SEQ ID NO: 5450249 - DNA, 13 bp, Homo sapiens
tctaacaatgaca

SEQ ID NO: 5450250 - DNA, 13 bp, Homo sapiens
tctaacagattag

SEQ ID NO: 5450251 - DNA, 22 bp, Homo sapiens
tctaacagcaccaaatcaaaat

SEQ ID NO: 5450252 - DNA, 12 bp, Homo sapiens
tctaacagccct

SEQ ID NO: 5450253 - DNA, 20 bp, Homo sapiens
tctaacagccctcctctgca

SEQ ID NO: 5450254 - DNA, 21 bp, Homo sapiens
tctaacagccctcctctgcac

SEQ ID NO: 5450255 - DNA, 17 bp, Homo sapiens
tctaacagctcaggatc

SEQ ID NO: 5450256 - DNA, 20 bp, Homo sapiens
tctaacagctccatacttct

SEQ ID NO: 5450257 - DNA, 20 bp, Homo sapiens
tctaacaggaaaagagggag

SEQ ID NO: 5450258 - DNA, 18 bp, Homo sapiens
tctaacaggggctggtgg

SEQ ID NO: 5450259 - DNA, 18 bp, Homo sapiens
tctaacagtttgcctgct

SEQ ID NO: 5450260 - DNA, 17 bp, Homo sapiens
tctaacataagtaagac

SEQ ID NO: 5450261 - DNA, 20 bp, Homo sapiens
tctaaccaaagagtctctgg

SEQ ID NO: 5450262 - DNA, 22 bp, Homo sapiens
tctaaccaaagagtctctggct

SEQ ID NO: 5450263 - DNA, 20 bp, Homo sapiens
tctaaccaaggctgtgttta

SEQ ID NO: 5450264 - DNA, 18 bp, Homo sapiens
tctaaccaattgtgagaa

SEQ ID NO: 5450265 - DNA, 20 bp, Homo sapiens
tctaaccacagctccttttc

SEQ ID NO: 5450266 - DNA, 17 bp, Homo sapiens
tctaaccacggttattt

SEQ ID NO: 5450267 - DNA, 19 bp, Homo sapiens
tctaaccacttaaggacct

SEQ ID NO: 5450268 - DNA, 18 bp, Homo sapiens
tctaaccagagcaagctt

SEQ ID NO: 5450269 - DNA, 13 bp, Homo sapiens
tctaaccagtgta

SEQ ID NO: 5450270 - DNA, 22 bp, Homo sapiens
tctaaccatagctgacctttgt

SEQ ID NO: 5450271 - DNA, 23 bp, Homo sapiens
tctaaccattaagtcatgtgtga

SEQ ID NO: 5450272 - DNA, 15 bp, Homo sapiens
tctaaccattcaaat

SEQ ID NO: 5450273 - DNA, 16 bp, Homo sapiens
tctaaccccaggcccc

SEQ ID NO: 5450274 - DNA, 15 bp, Homo sapiens
tctaacccccagctg

SEQ ID NO: 5450275 - DNA, 18 bp, Homo sapiens
tctaacccccagctgggt

SEQ ID NO: 5450276 - DNA, 22 bp, Homo sapiens
tctaacccccagtgccacagag

SEQ ID NO: 5450277 - DNA, 21 bp, Homo sapiens
tctaaccccctctgctctgtc

SEQ ID NO: 5450278 - DNA, 20 bp, Homo sapiens
tctaaccctcccatggcacc

SEQ ID NO: 5450279 - DNA, 13 bp, Homo sapiens
tctaaccctgtgg

SEQ ID NO: 5450280 - DNA, 14 bp, Homo sapiens
tctaaccctgtgga

SEQ ID NO: 5450281 - DNA, 15 bp, Homo sapiens
tctaaccctgtggaa

SEQ ID NO: 5450282 - DNA, 18 bp, Homo sapiens
tctaacctcgccctctcc

SEQ ID NO: 5450283 - DNA, 15 bp, Homo sapiens
tctaacctgatggca

SEQ ID NO: 5450284 - DNA, 13 bp, Homo sapiens
tctaacctggagg

SEQ ID NO: 5450285 - DNA, 17 bp, Homo sapiens
tctaaccttgaatgctg

SEQ ID NO: 5450286 - DNA, 13 bp, Homo sapiens
tctaacgcctgag

SEQ ID NO: 5450287 - DNA, 14 bp, Homo sapiens
tctaacgcctgagc

SEQ ID NO: 5450288 - DNA, 15 bp, Homo sapiens
tctaacgcctgagcc

SEQ ID NO: 5450289 - DNA, 16 bp, Homo sapiens
tctaacgcctgagccc

SEQ ID NO: 5450290 - DNA, 22 bp, Homo sapiens
tctaacggtctgttctgtttca

SEQ ID NO: 5450291 - DNA, 15 bp, Homo sapiens
tctaactaaggacag

SEQ ID NO: 5450292 - DNA, 16 bp, Homo sapiens
tctaactacaaggaca

SEQ ID NO: 5450293 - DNA, 16 bp, Homo sapiens
tctaactagtaatctt

SEQ ID NO: 5450294 - DNA, 17 bp, Homo sapiens
tctaactcactgcctag

SEQ ID NO: 5450295 - DNA, 16 bp, Homo sapiens
tctaactccctcctca

SEQ ID NO: 5450296 - DNA, 16 bp, Homo sapiens
tctaactcctgggctc

SEQ ID NO: 5450297 - DNA, 19 bp, Homo sapiens
tctaactgaaggtgcagtt

SEQ ID NO: 5450298 - DNA, 15 bp, Homo sapiens
tctaactgattcagg

SEQ ID NO: 5450299 - DNA, 14 bp, Homo sapiens
tctaactggacagc

SEQ ID NO: 5450300 - DNA, 16 bp, Homo sapiens
tctaactggacagcct

SEQ ID NO: 5450301 - DNA, 22 bp, Homo sapiens
tctaactggacagcctcttctg

SEQ ID NO: 5450302 - DNA, 16 bp, Homo sapiens
tctaactggacatgaa

SEQ ID NO: 5450303 - DNA, 17 bp, Homo sapiens
tctaactggacatgaag

SEQ ID NO: 5450304 - DNA, 18 bp, Homo sapiens
tctaactggacatgaagg

SEQ ID NO: 5450305 - DNA, 19 bp, Homo sapiens
tctaactgtaaatcacttg

SEQ ID NO: 5450306 - DNA, 21 bp, Homo sapiens
tctaactgtaaatcacttgta

SEQ ID NO: 5450307 - DNA, 17 bp, Homo sapiens
tctaactgtatatttgt

SEQ ID NO: 5450308 - DNA, 18 bp, Homo sapiens
tctaactgtatatttgta

SEQ ID NO: 5450309 - DNA, 14 bp, Homo sapiens
tctaactgtgcaaa

SEQ ID NO: 5450310 - DNA, 17 bp, Homo sapiens
tctaactgtgctcaaga

SEQ ID NO: 5450311 - DNA, 21 bp, Homo sapiens
tctaactgtgctcaagaggtt

SEQ ID NO: 5450312 - DNA, 17 bp, Homo sapiens
tctaactgtggaatata

SEQ ID NO: 5450313 - DNA, 12 bp, Homo sapiens
tctaacttaaat

SEQ ID NO: 5450314 - DNA, 16 bp, Homo sapiens
tctaacttaaatagct

SEQ ID NO: 5450315 - DNA, 21 bp, Homo sapiens
tctaacttaagaaataaatca

SEQ ID NO: 5450316 - DNA, 16 bp, Homo sapiens
tctaacttcaccatat

SEQ ID NO: 5450317 - DNA, 13 bp, Homo sapiens
tctaactttagaa

SEQ ID NO: 5450318 - DNA, 18 bp, Homo sapiens
tctaactttattctttgt

SEQ ID NO: 5450319 - DNA, 15 bp, Homo sapiens
tctaactttctttac

SEQ ID NO: 5450320 - DNA, 22 bp, Homo sapiens
tctaacttttttttacttatat

SEQ ID NO: 5450321 - DNA, 16 bp, Homo sapiens
tctaagaaacattgga

SEQ ID NO: 5450322 - DNA, 17 bp, Homo sapiens
tctaagaaacattggaa

SEQ ID NO: 5450323 - DNA, 15 bp, Homo sapiens
tctaagaaacattta

SEQ ID NO: 5450324 - DNA, 12 bp, Homo sapiens
tctaagaaagaa

SEQ ID NO: 5450325 - DNA, 19 bp, Homo sapiens
tctaagaaattgaatactt

SEQ ID NO: 5450326 - DNA, 24 bp, Homo sapiens
tctaagaaattgaatactttgaat

SEQ ID NO: 5450327 - DNA, 14 bp, Homo sapiens
tctaagaagacatt

SEQ ID NO: 5450328 - DNA, 19 bp, Homo sapiens
tctaagaagacattttgtt

SEQ ID NO: 5450329 - DNA, 22 bp, Homo sapiens
tctaagaagacattttgttaca

SEQ ID NO: 5450330 - DNA, 14 bp, Homo sapiens
tctaagaataataa

SEQ ID NO: 5450331 - DNA, 13 bp, Homo sapiens
tctaccctgggtc

SEQ ID NO: 5450332 - DNA, 14 bp, Homo sapiens
tctaccctgtcctt

SEQ ID NO: 5450333 - DNA, 21 bp, Homo sapiens
tctaccctgttgcaaaggaaa

SEQ ID NO: 5450334 - DNA, 17 bp, Homo sapiens
tctacccttggaaagaa

SEQ ID NO: 5450335 - DNA, 20 bp, Homo sapiens
tctacctaatgtctcactgt

SEQ ID NO: 5450336 - DNA, 23 bp, Homo sapiens
tctacctatacttaatctaagaa

SEQ ID NO: 5450337 - DNA, 15 bp, Homo sapiens
tctacctcaggcagc

SEQ ID NO: 5450338 - DNA, 19 bp, Homo sapiens
tctacctcaggcagctcaa

SEQ ID NO: 5450339 - DNA, 16 bp, Homo sapiens
tctacctccaccctgc

SEQ ID NO: 5450340 - DNA, 17 bp, Homo sapiens
tctacctccttagcttt

SEQ ID NO: 5450341 - DNA, 12 bp, Homo sapiens
tctacctctctt

SEQ ID NO: 5450342 - DNA, 14 bp, Homo sapiens
tctacctcttccag

SEQ ID NO: 5450343 - DNA, 12 bp, Homo sapiens
tctacctgaggg

SEQ ID NO: 5450344 - DNA, 16 bp, Homo sapiens
tctacctgcaacacaa

SEQ ID NO: 5450345 - DNA, 18 bp, Homo sapiens
tctacctgccctcaaggg

SEQ ID NO: 5450346 - DNA, 21 bp, Homo sapiens
tctacctggtctctccttgtt

SEQ ID NO: 5450347 - DNA, 23 bp, Homo sapiens
tctacctgtgtttttttctaaaa

SEQ ID NO: 5450348 - DNA, 14 bp, Homo sapiens
tctacctgttctgt

SEQ ID NO: 5450349 - DNA, 19 bp, Homo sapiens
tctacctgttctgtagctt

SEQ ID NO: 5450350 - DNA, 17 bp, Homo sapiens
tctaccttcctgtccct

SEQ ID NO: 5450351 - DNA, 23 bp, Homo sapiens
tctaccttctccccagctcccag

SEQ ID NO: 5450352 - DNA, 14 bp, Homo sapiens
tctaccttctgtag

SEQ ID NO: 5450353 - DNA, 16 bp, Homo sapiens
tctaccttctgtagtt

SEQ ID NO: 5450354 - DNA, 17 bp, Homo sapiens
tctaccttgaggtcttt

SEQ ID NO: 5450355 - DNA, 14 bp, Homo sapiens
tctacctttgtaaa

SEQ ID NO: 5450356 - DNA, 15 bp, Homo sapiens
tctacctttgtaaaa

SEQ ID NO: 5450357 - DNA, 15 bp, Homo sapiens
tctaccttttaaaat

SEQ ID NO: 5450358 - DNA, 15 bp, Homo sapiens
tctacgaagccacag

SEQ ID NO: 5450359 - DNA, 19 bp, Homo sapiens
tctacgaagccacaggcct

SEQ ID NO: 5450360 - DNA, 21 bp, Homo sapiens
tctacgaagccacaggcctgg

SEQ ID NO: 5450361 - DNA, 22 bp, Homo sapiens
tctacgaagccacaggcctggc

SEQ ID NO: 5450362 - DNA, 24 bp, Homo sapiens
tctacgaagccacaggcctggcct

SEQ ID NO: 5450363 - DNA, 19 bp, Homo sapiens
tctacgcaattgacaaacc

SEQ ID NO: 5450364 - DNA, 17 bp, Homo sapiens
tctacgctctcctttct

SEQ ID NO: 5450365 - DNA, 18 bp, Homo sapiens
tctacggatcatcaacaa

SEQ ID NO: 5450366 - DNA, 21 bp, Homo sapiens
tctacggatcatcaacaagat

SEQ ID NO: 5450367 - DNA, 20 bp, Homo sapiens
tctacgtatgcatgctaaat

SEQ ID NO: 5450368 - DNA, 22 bp, Homo sapiens
tctacgtatggctccacacctc

SEQ ID NO: 5450369 - DNA, 17 bp, Homo sapiens
tctacgttaagataaag

SEQ ID NO: 5450370 - DNA, 18 bp, Homo sapiens
tctacgttctccagccca

SEQ ID NO: 5450371 - DNA, 12 bp, Homo sapiens
tctacgtttctt

SEQ ID NO: 5450372 - DNA, 21 bp, Homo sapiens
tctactaaaaagaaggaaaat

SEQ ID NO: 5450373 - DNA, 18 bp, Homo sapiens
tctactaaaaataccaaa

SEQ ID NO: 5450374 - DNA, 21 bp, Homo sapiens
tctactaagtgatgctgtgat

SEQ ID NO: 5450375 - DNA, 15 bp, Homo sapiens
tctactaagttattt

SEQ ID NO: 5450376 - DNA, 20 bp, Homo sapiens
tctactaagttattttatga

SEQ ID NO: 5450377 - DNA, 16 bp, Homo sapiens
tctactaagtttcctt

SEQ ID NO: 5450378 - DNA, 20 bp, Homo sapiens
tctactaagtttccttttaa

SEQ ID NO: 5450379 - DNA, 23 bp, Homo sapiens
tctactaatttttagatattcat

SEQ ID NO: 5450380 - DNA, 20 bp, Homo sapiens
tctactacttttactacagt

SEQ ID NO: 5450381 - DNA, 17 bp, Homo sapiens
tctactagattgtgatc

SEQ ID NO: 5450382 - DNA, 16 bp, Homo sapiens
tctactatatacatat

SEQ ID NO: 5450383 - DNA, 18 bp, Homo sapiens
tctactatatacatatat

SEQ ID NO: 5450384 - DNA, 15 bp, Homo sapiens
tctactatgagggcc

SEQ ID NO: 5450385 - DNA, 14 bp, Homo sapiens
tctactcagaaatt

SEQ ID NO: 5450386 - DNA, 15 bp, Homo sapiens
tctactcatccagac

SEQ ID NO: 5450387 - DNA, 15 bp, Homo sapiens
tctactcattttaat

SEQ ID NO: 5450388 - DNA, 19 bp, Homo sapiens
tctactccatgcacatagt

SEQ ID NO: 5450389 - DNA, 15 bp, Homo sapiens
tctactcccagcgct

SEQ ID NO: 5450390 - DNA, 12 bp, Homo sapiens
tctactcctccc

SEQ ID NO: 5450391 - DNA, 15 bp, Homo sapiens
tctactcctgcctca

SEQ ID NO: 5450392 - DNA, 20 bp, Homo sapiens
tctactcgagttacagacaa

SEQ ID NO: 5450393 - DNA, 12 bp, Homo sapiens
tctactctagaa

SEQ ID NO: 5450394 - DNA, 13 bp, Homo sapiens
tctactctagaag

SEQ ID NO: 5450395 - DNA, 13 bp, Homo sapiens
tctactctcccat

SEQ ID NO: 5450396 - DNA, 18 bp, Homo sapiens
tctactctcccatggctt

SEQ ID NO: 5450397 - DNA, 19 bp, Homo sapiens
tctactctgtcttaaatga

SEQ ID NO: 5450398 - DNA, 21 bp, Homo sapiens
tctactcttaagtttctcagc

SEQ ID NO: 5450399 - DNA, 14 bp, Homo sapiens
tctactcttttgaa

SEQ ID NO: 5450400 - DNA, 21 bp, Homo sapiens
tctactgaattggcttccaga

SEQ ID NO: 5450401 - DNA, 16 bp, Homo sapiens
tctactgagcgagctg

SEQ ID NO: 5450402 - DNA, 19 bp, Homo sapiens
tctactgagcgagctgggc

SEQ ID NO: 5450403 - DNA, 22 bp, Homo sapiens
tctactgaggtgctatgttctt

SEQ ID NO: 5450404 - DNA, 19 bp, Homo sapiens
tctactgagtccctggcaa

SEQ ID NO: 5450405 - DNA, 22 bp, Homo sapiens
tctactgccaagcccctgccct

SEQ ID NO: 5450406 - DNA, 16 bp, Homo sapiens
tctactgccccagctc

SEQ ID NO: 5450407 - DNA, 16 bp, Homo sapiens
tctactgccttgaaaa

SEQ ID NO: 5450408 - DNA, 21 bp, Homo sapiens
tctactgccttgaaaaatgac

SEQ ID NO: 5450409 - DNA, 20 bp, Homo sapiens
tctactggaaatgtagcact

SEQ ID NO: 5450410 - DNA, 20 bp, Homo sapiens
tctactgggaaggctacttc

SEQ ID NO: 5450411 - DNA, 18 bp, Homo sapiens
tctactggtaggaagagg

SEQ ID NO: 5450412 - DNA, 20 bp, Homo sapiens
tctactggtcttgtggaatt

SEQ ID NO: 5450413 - DNA, 16 bp, Homo sapiens
tctactgtacacaatc

SEQ ID NO: 5450414 - DNA, 22 bp, Homo sapiens
tctactgtcaaatgatgtgcaa

SEQ ID NO: 5450415 - DNA, 12 bp, Homo sapiens
tctactgtgaca

SEQ ID NO: 5450416 - DNA, 17 bp, Homo sapiens
tctactgtgtgatcagg

SEQ ID NO: 5450417 - DNA, 16 bp, Homo sapiens
tctactgttgcacagc

SEQ ID NO: 5450418 - DNA, 22 bp, Homo sapiens
tctacttccaaactaattttta

SEQ ID NO: 5450419 - DNA, 15 bp, Homo sapiens
tctacttccaagact

SEQ ID NO: 5450420 - DNA, 14 bp, Homo sapiens
tctacttcccctgg

SEQ ID NO: 5450421 - DNA, 16 bp, Homo sapiens
tctacttcccctggga

SEQ ID NO: 5450422 - DNA, 17 bp, Homo sapiens
tctacttcccctgggat

SEQ ID NO: 5450423 - DNA, 18 bp, Homo sapiens
tctacttccccttcttgc

SEQ ID NO: 5450424 - DNA, 13 bp, Homo sapiens
tctacttcctaca

SEQ ID NO: 5450425 - DNA, 19 bp, Homo sapiens
tctacttctgtgtctgtca

SEQ ID NO: 5450426 - DNA, 20 bp, Homo sapiens
tctacttctgtgtctgtcac

SEQ ID NO: 5450427 - DNA, 22 bp, Homo sapiens
tctacttgccagaaccaaatta

SEQ ID NO: 5450428 - DNA, 14 bp, Homo sapiens
tctacttgctctgg

SEQ ID NO: 5450429 - DNA, 18 bp, Homo sapiens
tctacttgctctggacct

SEQ ID NO: 5450430 - DNA, 22 bp, Homo sapiens
tctacttgctctggacctgccc

SEQ ID NO: 5450431 - DNA, 22 bp, Homo sapiens
tctacttgcttattacatttaa

SEQ ID NO: 5450432 - DNA, 19 bp, Homo sapiens
tctacttggcaaggtcata

SEQ ID NO: 5450433 - DNA, 22 bp, Homo sapiens
tctacttgtcatatcactaaat

SEQ ID NO: 5450434 - DNA, 13 bp, Homo sapiens
tctactttaaatt

SEQ ID NO: 5450435 - DNA, 14 bp, Homo sapiens
tctactttaataaa

SEQ ID NO: 5450436 - DNA, 17 bp, Homo sapiens
tctactttcatcttaaa

SEQ ID NO: 5450437 - DNA, 17 bp, Homo sapiens
tctactttcctgatgtt

SEQ ID NO: 5450438 - DNA, 12 bp, Homo sapiens
tctactttctct

SEQ ID NO: 5450439 - DNA, 15 bp, Homo sapiens
tctactttctcttgt

SEQ ID NO: 5450440 - DNA, 17 bp, Homo sapiens
tctactttctcttgttt

SEQ ID NO: 5450441 - DNA, 20 bp, Homo sapiens
tctactttctcttgtttaaa

SEQ ID NO: 5450442 - DNA, 13 bp, Homo sapiens
tctactttgaaat

SEQ ID NO: 5450443 - DNA, 16 bp, Homo sapiens
tctactttgaggaaac

SEQ ID NO: 5450444 - DNA, 16 bp, Homo sapiens
tctactttgtttattt

SEQ ID NO: 5450445 - DNA, 14 bp, Homo sapiens
tctacttttaaaga

SEQ ID NO: 5450446 - DNA, 14 bp, Homo sapiens
tctacttttaaata

SEQ ID NO: 5450447 - DNA, 15 bp, Homo sapiens
tctacttttaactaa

SEQ ID NO: 5450448 - DNA, 15 bp, Homo sapiens
tctactttttgaact

SEQ ID NO: 5450449 - DNA, 23 bp, Homo sapiens
tctactttttgtatttagtagtt

SEQ ID NO: 5450450 - DNA, 17 bp, Homo sapiens
tctagaaaatgaaaaga

SEQ ID NO: 5450451 - DNA, 17 bp, Homo sapiens
tctagaaaattgagttt

SEQ ID NO: 5450452 - DNA, 17 bp, Homo sapiens
tctagaaactctggctc

SEQ ID NO: 5450453 - DNA, 16 bp, Homo sapiens
tctagaaagaaaagac

SEQ ID NO: 5450454 - DNA, 23 bp, Homo sapiens
tctagaaagaaaagaccctgaga

SEQ ID NO: 5450455 - DNA, 13 bp, Homo sapiens
tctagaaagaata

SEQ ID NO: 5450456 - DNA, 14 bp, Homo sapiens
tctagaaagcccct

SEQ ID NO: 5450457 - DNA, 20 bp, Homo sapiens
tctagaaagctttgaatgca

SEQ ID NO: 5450458 - DNA, 19 bp, Homo sapiens
tctagaaataggttaaact

SEQ ID NO: 5450459 - DNA, 13 bp, Homo sapiens
tctagaacacagg

SEQ ID NO: 5450460 - DNA, 16 bp, Homo sapiens
tctagaacacaggcaa

SEQ ID NO: 5450461 - DNA, 17 bp, Homo sapiens
tctagaacacaggcaaa

SEQ ID NO: 5450462 - DNA, 21 bp, Homo sapiens
tctagaacatccctgccagct

SEQ ID NO: 5450463 - DNA, 19 bp, Homo sapiens
tctagaacatccttaaatg

SEQ ID NO: 5450464 - DNA, 20 bp, Homo sapiens
tctagaacatccttaaatgt

SEQ ID NO: 5450465 - DNA, 19 bp, Homo sapiens
tctagaacatgcacattta

SEQ ID NO: 5450466 - DNA, 18 bp, Homo sapiens
tctagaacattcagattt

SEQ ID NO: 5450467 - DNA, 17 bp, Homo sapiens
tctagaacctgggctgt

SEQ ID NO: 5450468 - DNA, 19 bp, Homo sapiens
tctagaacctgggctgtgc

SEQ ID NO: 5450469 - DNA, 18 bp, Homo sapiens
tctagaagaaatgaaatt

SEQ ID NO: 5450470 - DNA, 19 bp, Homo sapiens
tctagaagaaatgaaattt

SEQ ID NO: 5450471 - DNA, 21 bp, Homo sapiens
tctagaagactgtcagcttcc

SEQ ID NO: 5450472 - DNA, 21 bp, Homo sapiens
tctagaagagtctattgtctc

SEQ ID NO: 5450473 - DNA, 13 bp, Homo sapiens
tctagaagcagaa

SEQ ID NO: 5450474 - DNA, 23 bp, Homo sapiens
tctagaagccaagggaaaggggt

SEQ ID NO: 5450475 - DNA, 13 bp, Homo sapiens
tctagaagctcag

SEQ ID NO: 5450476 - DNA, 23 bp, Homo sapiens
tctagaagctggtaaaaatgaca

SEQ ID NO: 5450477 - DNA, 17 bp, Homo sapiens
tctagaaggatgaacag

SEQ ID NO: 5450478 - DNA, 21 bp, Homo sapiens
tctagaaggatgaacagttct

SEQ ID NO: 5450479 - DNA, 14 bp, Homo sapiens
tctagaaggccagg

SEQ ID NO: 5450480 - DNA, 15 bp, Homo sapiens
tctagaaggccaggc

SEQ ID NO: 5450481 - DNA, 13 bp, Homo sapiens
tctagaaggggcg

SEQ ID NO: 5450482 - DNA, 16 bp, Homo sapiens
tctagaaggggcgagg

SEQ ID NO: 5450483 - DNA, 18 bp, Homo sapiens
tctagaagtgccatctca

SEQ ID NO: 5450484 - DNA, 20 bp, Homo sapiens
tctagaagttgtttgtcatc

SEQ ID NO: 5450485 - DNA, 20 bp, Homo sapiens
tctagaagtttcccttcctc

SEQ ID NO: 5450486 - DNA, 18 bp, Homo sapiens
tctagaatacatattaca

SEQ ID NO: 5450487 - DNA, 20 bp, Homo sapiens
tctagaatcccagcagcaga

SEQ ID NO: 5450488 - DNA, 23 bp, Homo sapiens
tctagaatctgcaattcaaaagt

SEQ ID NO: 5450489 - DNA, 12 bp, Homo sapiens
tctagaatggtt

SEQ ID NO: 5450490 - DNA, 18 bp, Homo sapiens
tctagaatgtaaagttat

SEQ ID NO: 5450491 - DNA, 22 bp, Homo sapiens
tctagaatgtggatttgattca

SEQ ID NO: 5450492 - DNA, 23 bp, Homo sapiens
tctagaattataagtcacaaaga

SEQ ID NO: 5450493 - DNA, 15 bp, Homo sapiens
tctagaatttagtga

SEQ ID NO: 5450494 - DNA, 19 bp, Homo sapiens
tctagaatttatcacactt

SEQ ID NO: 5450495 - DNA, 16 bp, Homo sapiens
tctagaattttaagcc

SEQ ID NO: 5450496 - DNA, 13 bp, Homo sapiens
tctagacaagata

SEQ ID NO: 5450497 - DNA, 17 bp, Homo sapiens
tctagacaagatattgt

SEQ ID NO: 5450498 - DNA, 23 bp, Homo sapiens
tctagacaatatacaagccaaag

SEQ ID NO: 5450499 - DNA, 23 bp, Homo sapiens
tctagacactttttctttacaaa

SEQ ID NO: 5450500 - DNA, 20 bp, Homo sapiens
tctagacagagttgcttaat

SEQ ID NO: 5450501 - DNA, 21 bp, Homo sapiens
tctagacagtattgccacctc

SEQ ID NO: 5450502 - DNA, 22 bp, Homo sapiens
tctagacagtattgccacctct

SEQ ID NO: 5450503 - DNA, 18 bp, Homo sapiens
tctagacatggaggttct

SEQ ID NO: 5450504 - DNA, 20 bp, Homo sapiens
tctagacccttcatctctta

SEQ ID NO: 5450505 - DNA, 18 bp, Homo sapiens
tctagacgcccctcccaa

SEQ ID NO: 5450506 - DNA, 24 bp, Homo sapiens
tctagactcaaggttcccagagat

SEQ ID NO: 5450507 - DNA, 23 bp, Homo sapiens
tctatataaaataactaaaatgt

SEQ ID NO: 5450508 - DNA, 21 bp, Homo sapiens
tctatataaaatgtattcaag

SEQ ID NO: 5450509 - DNA, 18 bp, Homo sapiens
tctatataaggaggaaaa

SEQ ID NO: 5450510 - DNA, 14 bp, Homo sapiens
tctatatagacttg

SEQ ID NO: 5450511 - DNA, 20 bp, Homo sapiens
tctatatataattctgtaca

SEQ ID NO: 5450512 - DNA, 21 bp, Homo sapiens
tctatatataattctgtacat

SEQ ID NO: 5450513 - DNA, 21 bp, Homo sapiens
tctatatatacatgtatagtg

SEQ ID NO: 5450514 - DNA, 22 bp, Homo sapiens
tctatatatacatgtatagtga

SEQ ID NO: 5450515 - DNA, 16 bp, Homo sapiens
tctatatatgtgtatg

SEQ ID NO: 5450516 - DNA, 19 bp, Homo sapiens
tctatatatgtgtatgtac

SEQ ID NO: 5450517 - DNA, 16 bp, Homo sapiens
tctatatcatatttct

SEQ ID NO: 5450518 - DNA, 15 bp, Homo sapiens
tctatatccaaaatt

SEQ ID NO: 5450519 - DNA, 15 bp, Homo sapiens
tctatatcctcaagg

SEQ ID NO: 5450520 - DNA, 22 bp, Homo sapiens
tctatatccttgacaccttact

SEQ ID NO: 5450521 - DNA, 13 bp, Homo sapiens
tctatatgaactt

SEQ ID NO: 5450522 - DNA, 21 bp, Homo sapiens
tctatatgaatttaaatataa

SEQ ID NO: 5450523 - DNA, 16 bp, Homo sapiens
tctatatgcatttaat

SEQ ID NO: 5450524 - DNA, 19 bp, Homo sapiens
tctatatggttctccaaga

SEQ ID NO: 5450525 - DNA, 14 bp, Homo sapiens
tctatatgtaactt

SEQ ID NO: 5450526 - DNA, 13 bp, Homo sapiens
tctatatgtctat

SEQ ID NO: 5450527 - DNA, 18 bp, Homo sapiens
tctatatgtctataagta

SEQ ID NO: 5450528 - DNA, 14 bp, Homo sapiens
tctatattaaatga

SEQ ID NO: 5450529 - DNA, 17 bp, Homo sapiens
tctatattagtttattg

SEQ ID NO: 5450530 - DNA, 13 bp, Homo sapiens
tctatattcttta

SEQ ID NO: 5450531 - DNA, 16 bp, Homo sapiens
tctatattggaatctg

SEQ ID NO: 5450532 - DNA, 11 bp, Homo sapiens
tctatatttca

SEQ ID NO: 5450533 - DNA, 21 bp, Homo sapiens
tctatatttcatattgagatc

SEQ ID NO: 5450534 - DNA, 16 bp, Homo sapiens
tctatatttgtaactt

SEQ ID NO: 5450535 - DNA, 18 bp, Homo sapiens
tctatatttgtcttccga

SEQ ID NO: 5450536 - DNA, 15 bp, Homo sapiens
tctatattttcattc

SEQ ID NO: 5450537 - DNA, 17 bp, Homo sapiens
tctatatttttatttca

SEQ ID NO: 5450538 - DNA, 12 bp, Homo sapiens
tctatcaaaatt

SEQ ID NO: 5450539 - DNA, 13 bp, Homo sapiens
tctatcaaatgaa

SEQ ID NO: 5450540 - DNA, 15 bp, Homo sapiens
tctatcaaatgaaac

SEQ ID NO: 5450541 - DNA, 19 bp, Homo sapiens
tctatcaaccccagacact

SEQ ID NO: 5450542 - DNA, 20 bp, Homo sapiens
tctatcaaccccagacactg

SEQ ID NO: 5450543 - DNA, 15 bp, Homo sapiens
tctatcaagtattat

SEQ ID NO: 5450544 - DNA, 22 bp, Homo sapiens
tctatcacattacatcatcctc

SEQ ID NO: 5450545 - DNA, 11 bp, Homo sapiens
tctatcacctg

SEQ ID NO: 5450546 - DNA, 16 bp, Homo sapiens
tctatcacctgtcatc

SEQ ID NO: 5450547 - DNA, 15 bp, Homo sapiens
tctatcagaaataca

SEQ ID NO: 5450548 - DNA, 16 bp, Homo sapiens
tctatcagaagttgta

SEQ ID NO: 5450549 - DNA, 14 bp, Homo sapiens
tctatcagagaaaa

SEQ ID NO: 5450550 - DNA, 18 bp, Homo sapiens
tctatcagcattgtttca

SEQ ID NO: 5450551 - DNA, 19 bp, Homo sapiens
tctatcagcattgtttcaa

SEQ ID NO: 5450552 - DNA, 13 bp, Homo sapiens
tctatcagttatc

SEQ ID NO: 5450553 - DNA, 14 bp, Homo sapiens
tctatcagttatcc

SEQ ID NO: 5450554 - DNA, 21 bp, Homo sapiens
tctatcagttatcctttgtga

SEQ ID NO: 5450555 - DNA, 13 bp, Homo sapiens
tctatcatatgaa

SEQ ID NO: 5450556 - DNA, 14 bp, Homo sapiens
tctatcatatgaag

SEQ ID NO: 5450557 - DNA, 21 bp, Homo sapiens
tctatcatggaatatttatag

SEQ ID NO: 5450558 - DNA, 22 bp, Homo sapiens
tctatcatgttgaagtcaaatt

SEQ ID NO: 5450559 - DNA, 21 bp, Homo sapiens
tctatcattccaattctaaat

SEQ ID NO: 5450560 - DNA, 14 bp, Homo sapiens
tctatcatttaata

SEQ ID NO: 5450561 - DNA, 19 bp, Homo sapiens
tctatcatttttgagcaac

SEQ ID NO: 5450562 - DNA, 19 bp, Homo sapiens
tctatcatttttgtacagt

SEQ ID NO: 5450563 - DNA, 22 bp, Homo sapiens
tctatccaaacatgtatttatg

SEQ ID NO: 5450564 - DNA, 16 bp, Homo sapiens
tctatccaaagtgtca

SEQ ID NO: 5450565 - DNA, 18 bp, Homo sapiens
tctatccaaatctgaaga

SEQ ID NO: 5450566 - DNA, 17 bp, Homo sapiens
tctatccacagagagtc

SEQ ID NO: 5450567 - DNA, 15 bp, Homo sapiens
tctatcccaagccaa

SEQ ID NO: 5450568 - DNA, 17 bp, Homo sapiens
tctatccccaagctggc

SEQ ID NO: 5450569 - DNA, 15 bp, Homo sapiens
tctatccccatccag

SEQ ID NO: 5450570 - DNA, 15 bp, Homo sapiens
tctatccctggcttc

SEQ ID NO: 5450571 - DNA, 21 bp, Homo sapiens
tctatcctagtcttcacaact

SEQ ID NO: 5450572 - DNA, 19 bp, Homo sapiens
tctatcctctctctctcta

SEQ ID NO: 5450573 - DNA, 14 bp, Homo sapiens
tctatcctctgtaa

SEQ ID NO: 5450574 - DNA, 15 bp, Homo sapiens
tctatccttccagaa

SEQ ID NO: 5450575 - DNA, 14 bp, Homo sapiens
tctatcggaagaac

SEQ ID NO: 5450576 - DNA, 18 bp, Homo sapiens
tctatctacataagtcct

SEQ ID NO: 5450577 - DNA, 13 bp, Homo sapiens
tctatctactaaa

SEQ ID NO: 5450578 - DNA, 17 bp, Homo sapiens
tctatctatataatgta

SEQ ID NO: 5450579 - DNA, 12 bp, Homo sapiens
tctatctcatct

SEQ ID NO: 5450580 - DNA, 15 bp, Homo sapiens
tctatctgggcctgg

SEQ ID NO: 5450581 - DNA, 14 bp, Homo sapiens
tctatctggtatta

SEQ ID NO: 5450582 - DNA, 13 bp, Homo sapiens
tctatctgtattt

SEQ ID NO: 5450583 - DNA, 15 bp, Homo sapiens
tctatcttgcatcta

SEQ ID NO: 5450584 - DNA, 19 bp, Homo sapiens
tctatcttgcatctacctg

SEQ ID NO: 5450585 - DNA, 21 bp, Homo sapiens
tctatcttgcatctacctgct

SEQ ID NO: 5450586 - DNA, 20 bp, Homo sapiens
tctatcttgctctgtaatct

SEQ ID NO: 5450587 - DNA, 19 bp, Homo sapiens
tctatcttgttccaaggcc

SEQ ID NO: 5450588 - DNA, 22 bp, Homo sapiens
tctatcttgttccaaggccagg

SEQ ID NO: 5450589 - DNA, 15 bp, Homo sapiens
tctatcttttccaca

SEQ ID NO: 5450590 - DNA, 13 bp, Homo sapiens
tctatgaaaagca

SEQ ID NO: 5450591 - DNA, 20 bp, Homo sapiens
tctatgaaaagcacaagggg

SEQ ID NO: 5450592 - DNA, 18 bp, Homo sapiens
tctatgaaatattatgtt

SEQ ID NO: 5450593 - DNA, 17 bp, Homo sapiens
tctatgaagtatataat

SEQ ID NO: 5450594 - DNA, 16 bp, Homo sapiens
tctatgaagttgctgt

SEQ ID NO: 5450595 - DNA, 17 bp, Homo sapiens
tctatgaagttgctgtt

SEQ ID NO: 5450596 - DNA, 20 bp, Homo sapiens
tctatgaattcctacacatg

SEQ ID NO: 5450597 - DNA, 15 bp, Homo sapiens
tctatgacaaattca

SEQ ID NO: 5450598 - DNA, 14 bp, Homo sapiens
tctatgacacatgc

SEQ ID NO: 5450599 - DNA, 17 bp, Homo sapiens
tctatgacacatgcaag

SEQ ID NO: 5450600 - DNA, 17 bp, Homo sapiens
tctatgacatgaaatga

SEQ ID NO: 5450601 - DNA, 17 bp, Homo sapiens
tctatgagaaaagaggc

SEQ ID NO: 5450602 - DNA, 21 bp, Homo sapiens
tctatgagacctcccccaggg

SEQ ID NO: 5450603 - DNA, 19 bp, Homo sapiens
tctatgagggtgtttcctc

SEQ ID NO: 5450604 - DNA, 21 bp, Homo sapiens
tctatgagggtgtttcctcta

SEQ ID NO: 5450605 - DNA, 22 bp, Homo sapiens
tctatgagggtgtttcctctaa

SEQ ID NO: 5450606 - DNA, 14 bp, Homo sapiens
tctatgagtctaga

SEQ ID NO: 5450607 - DNA, 15 bp, Homo sapiens
tctatgagtctagat

SEQ ID NO: 5450608 - DNA, 11 bp, Homo sapiens
tctatgatata

SEQ ID NO: 5450609 - DNA, 14 bp, Homo sapiens
tctatgatatacaa

SEQ ID NO: 5450610 - DNA, 15 bp, Homo sapiens
tctatgatgattgct

SEQ ID NO: 5450611 - DNA, 14 bp, Homo sapiens
tctatgattaaact

SEQ ID NO: 5450612 - DNA, 22 bp, Homo sapiens
tctatgcaaaatgtctgtttta

SEQ ID NO: 5450613 - DNA, 21 bp, Homo sapiens
tctatgcaaagcactctctgc

SEQ ID NO: 5450614 - DNA, 23 bp, Homo sapiens
tctatgcaaagcactctctgcag

SEQ ID NO: 5450615 - DNA, 23 bp, Homo sapiens
tctatgcaaagtctctcatttct

SEQ ID NO: 5450616 - DNA, 20 bp, Homo sapiens
tctatgcaattgtacaaaaa

SEQ ID NO: 5450617 - DNA, 14 bp, Homo sapiens
tctatgcaattttt

SEQ ID NO: 5450618 - DNA, 15 bp, Homo sapiens
tctatgcaattttta

SEQ ID NO: 5450619 - DNA, 22 bp, Homo sapiens
tctatgcaatttttaaactagt

SEQ ID NO: 5450620 - DNA, 20 bp, Homo sapiens
tctatgcagtattgccacaa

SEQ ID NO: 5450621 - DNA, 21 bp, Homo sapiens
tctatgcataaaaaaatgatg

SEQ ID NO: 5450622 - DNA, 18 bp, Homo sapiens
tctatgccaggctgtgct

SEQ ID NO: 5450623 - DNA, 13 bp, Homo sapiens
tctatgccctgca

SEQ ID NO: 5450624 - DNA, 14 bp, Homo sapiens
tctatgccctgcag

SEQ ID NO: 5450625 - DNA, 21 bp, Homo sapiens
tctatgccctgcagagcaata

SEQ ID NO: 5450626 - DNA, 23 bp, Homo sapiens
tctatgccctgcagagcaataac

SEQ ID NO: 5450627 - DNA, 15 bp, Homo sapiens
tctatgcctcagttt

SEQ ID NO: 5450628 - DNA, 14 bp, Homo sapiens
tctatgcctgcact

SEQ ID NO: 5450629 - DNA, 18 bp, Homo sapiens
tctatgctcataactgtg

SEQ ID NO: 5450630 - DNA, 14 bp, Homo sapiens
tctatgctccctct

SEQ ID NO: 5450631 - DNA, 14 bp, Homo sapiens
tctatgctgtgtgc

SEQ ID NO: 5450632 - DNA, 21 bp, Homo sapiens
tctatgctgtttgtagtgaaa

SEQ ID NO: 5450633 - DNA, 13 bp, Homo sapiens
tctatgctttcca

SEQ ID NO: 5450634 - DNA, 12 bp, Homo sapiens
tctatggaccaa

SEQ ID NO: 5450635 - DNA, 16 bp, Homo sapiens
tctatggaccaaatgt

SEQ ID NO: 5450636 - DNA, 19 bp, Homo sapiens
tctatggaccaaatgtaaa

SEQ ID NO: 5450637 - DNA, 14 bp, Homo sapiens
tctatggagacttt

SEQ ID NO: 5450638 - DNA, 18 bp, Homo sapiens
tctatggattatccactg

SEQ ID NO: 5450639 - DNA, 14 bp, Homo sapiens
tctatggattcact

SEQ ID NO: 5450640 - DNA, 15 bp, Homo sapiens
tctatggattcactt

SEQ ID NO: 5450641 - DNA, 19 bp, Homo sapiens
tctatggattcacttctat

SEQ ID NO: 5450642 - DNA, 22 bp, Homo sapiens
tctatggattcacttctattta

SEQ ID NO: 5450643 - DNA, 14 bp, Homo sapiens
tctatggcagtcca

SEQ ID NO: 5450644 - DNA, 16 bp, Homo sapiens
tctatggcagtccagc

SEQ ID NO: 5450645 - DNA, 19 bp, Homo sapiens
tctatggcagtccagccag

SEQ ID NO: 5450646 - DNA, 21 bp, Homo sapiens
tctatggcagtccagccagct

SEQ ID NO: 5450647 - DNA, 21 bp, Homo sapiens
tctatggctcatgtctgaaaa

SEQ ID NO: 5450648 - DNA, 21 bp, Homo sapiens
tctatggcttatttctatgac

SEQ ID NO: 5450649 - DNA, 17 bp, Homo sapiens
tctatggctttaaataa

SEQ ID NO: 5450650 - DNA, 18 bp, Homo sapiens
tctatggctttaaataaa

SEQ ID NO: 5450651 - DNA, 23 bp, Homo sapiens
tctatgggaagatacttattttt

SEQ ID NO: 5450652 - DNA, 13 bp, Homo sapiens
tctatgggcattt

SEQ ID NO: 5450653 - DNA, 15 bp, Homo sapiens
tctatgggcatttgg

SEQ ID NO: 5450654 - DNA, 21 bp, Homo sapiens
tctatgggccatattccgcac

SEQ ID NO: 5450655 - DNA, 15 bp, Homo sapiens
tctatgggtgttatc

SEQ ID NO: 5450656 - DNA, 14 bp, Homo sapiens
tctatggttatgaa

SEQ ID NO: 5450657 - DNA, 20 bp, Homo sapiens
tctatggttatgaaagaata

SEQ ID NO: 5450658 - DNA, 15 bp, Homo sapiens
tctatgtaaaaatat

SEQ ID NO: 5450659 - DNA, 13 bp, Homo sapiens
tctatgtaaatta

SEQ ID NO: 5450660 - DNA, 15 bp, Homo sapiens
tctatgtaaattatt

SEQ ID NO: 5450661 - DNA, 18 bp, Homo sapiens
tctatgtaaattattgta

SEQ ID NO: 5450662 - DNA, 20 bp, Homo sapiens
tctatgtaaattattgtaaa

SEQ ID NO: 5450663 - DNA, 23 bp, Homo sapiens
tctatgtaaattattgtaaactt

SEQ ID NO: 5450664 - DNA, 20 bp, Homo sapiens
tctatgtacagatgatgtaa

SEQ ID NO: 5450665 - DNA, 15 bp, Homo sapiens
tctatgtacgataaa

SEQ ID NO: 5450666 - DNA, 19 bp, Homo sapiens
tctatgtacgataaagtaa

SEQ ID NO: 5450667 - DNA, 20 bp, Homo sapiens
tctatgtactagtactgtgt

SEQ ID NO: 5450668 - DNA, 21 bp, Homo sapiens
tctatgtactagtactgtgta

SEQ ID NO: 5450669 - DNA, 22 bp, Homo sapiens
tctatgtactagtactgtgtac

SEQ ID NO: 5450670 - DNA, 14 bp, Homo sapiens
tctatgtagaactg

SEQ ID NO: 5450671 - DNA, 15 bp, Homo sapiens
tctatgtaggaaaaa

SEQ ID NO: 5450672 - DNA, 22 bp, Homo sapiens
tctatgtagtggttttaggata

SEQ ID NO: 5450673 - DNA, 16 bp, Homo sapiens
tctatgtatatacatt

SEQ ID NO: 5450674 - DNA, 19 bp, Homo sapiens
tctatgtatatacatttat

SEQ ID NO: 5450675 - DNA, 13 bp, Homo sapiens
tctatgtatgtta

SEQ ID NO: 5450676 - DNA, 19 bp, Homo sapiens
tctatgtatgttaatttat

SEQ ID NO: 5450677 - DNA, 23 bp, Homo sapiens
tctatgtatgttaatttatttag

SEQ ID NO: 5450678 - DNA, 21 bp, Homo sapiens
tctatgtcatttttaatgtat

SEQ ID NO: 5450679 - DNA, 23 bp, Homo sapiens
tctatgtcatttttaatgtatct

SEQ ID NO: 5450680 - DNA, 15 bp, Homo sapiens
tctatgtccaacaga

SEQ ID NO: 5450681 - DNA, 20 bp, Homo sapiens
tctatgtccaacagagtgga

SEQ ID NO: 5450682 - DNA, 12 bp, Homo sapiens
tctatgtcctgg

SEQ ID NO: 5450683 - DNA, 20 bp, Homo sapiens
tctatgtctagcacatgttg

SEQ ID NO: 5450684 - DNA, 18 bp, Homo sapiens
tctatgtgaatatttgta

SEQ ID NO: 5450685 - DNA, 10 bp, Homo sapiens
tctcactcca

SEQ ID NO: 5450686 - DNA, 17 bp, Homo sapiens
tctcactccaccaccca

SEQ ID NO: 5450687 - DNA, 14 bp, Homo sapiens
tctcactccagcca

SEQ ID NO: 5450688 - DNA, 18 bp, Homo sapiens
tctcactccagccaaaga

SEQ ID NO: 5450689 - DNA, 22 bp, Homo sapiens
tctcactccccagcctgggccc

SEQ ID NO: 5450690 - DNA, 15 bp, Homo sapiens
tctcactccctttgt

SEQ ID NO: 5450691 - DNA, 22 bp, Homo sapiens
tctcactccctttgtggacttt

SEQ ID NO: 5450692 - DNA, 14 bp, Homo sapiens
tctcactcctgcct

SEQ ID NO: 5450693 - DNA, 16 bp, Homo sapiens
tctcactcctgcctcc

SEQ ID NO: 5450694 - DNA, 17 bp, Homo sapiens
tctcactcctgcctccg

SEQ ID NO: 5450695 - DNA, 13 bp, Homo sapiens
tctcactccttga

SEQ ID NO: 5450696 - DNA, 20 bp, Homo sapiens
tctcactccttttggtgtgt

SEQ ID NO: 5450697 - DNA, 16 bp, Homo sapiens
tctcactctctgggga

SEQ ID NO: 5450698 - DNA, 12 bp, Homo sapiens
tctcactctctt

SEQ ID NO: 5450699 - DNA, 15 bp, Homo sapiens
tctcactctcttcct

SEQ ID NO: 5450700 - DNA, 13 bp, Homo sapiens
tctcactctggca

SEQ ID NO: 5450701 - DNA, 18 bp, Homo sapiens
tctcactctggcagcctc

SEQ ID NO: 5450702 - DNA, 21 bp, Homo sapiens
tctcactctggcagcctcaga

SEQ ID NO: 5450703 - DNA, 14 bp, Homo sapiens
tctcactctgtcac

SEQ ID NO: 5450704 - DNA, 21 bp, Homo sapiens
tctcactctgtcacccaggct

SEQ ID NO: 5450705 - DNA, 19 bp, Homo sapiens
tctcactctgtcgctcagg

SEQ ID NO: 5450706 - DNA, 22 bp, Homo sapiens
tctcactctgtcgctcaggctg

SEQ ID NO: 5450707 - DNA, 13 bp, Homo sapiens
tctcactcttgtc

SEQ ID NO: 5450708 - DNA, 22 bp, Homo sapiens
tctcactcttgtcacccaggct

SEQ ID NO: 5450709 - DNA, 22 bp, Homo sapiens
tctcactgaactccaccgacca

SEQ ID NO: 5450710 - DNA, 13 bp, Homo sapiens
tctcactgaagct

SEQ ID NO: 5450711 - DNA, 21 bp, Homo sapiens
tctcactgagaagattgtgaa

SEQ ID NO: 5450712 - DNA, 14 bp, Homo sapiens
tctcactgcagtct

SEQ ID NO: 5450713 - DNA, 20 bp, Homo sapiens
tctcactgccatgccagctt

SEQ ID NO: 5450714 - DNA, 14 bp, Homo sapiens
tctcactgctgtca

SEQ ID NO: 5450715 - DNA, 15 bp, Homo sapiens
tctcactgctgtcag

SEQ ID NO: 5450716 - DNA, 14 bp, Homo sapiens
tctcactgcttgaa

SEQ ID NO: 5450717 - DNA, 18 bp, Homo sapiens
tctcactgcttgaactag

SEQ ID NO: 5450718 - DNA, 14 bp, Homo sapiens
tctcactggcatct

SEQ ID NO: 5450719 - DNA, 12 bp, Homo sapiens
tctcactgtatt

SEQ ID NO: 5450720 - DNA, 22 bp, Homo sapiens
tctcactgtattaaagatgcag

SEQ ID NO: 5450721 - DNA, 22 bp, Homo sapiens
tctcactgtattagagcgccag

SEQ ID NO: 5450722 - DNA, 22 bp, Homo sapiens
tctcactgtcgcccaggctgga

SEQ ID NO: 5450723 - DNA, 21 bp, Homo sapiens
tctcactgtgggaaggccagc

SEQ ID NO: 5450724 - DNA, 17 bp, Homo sapiens
tctcactgtgtacataa

SEQ ID NO: 5450725 - DNA, 20 bp, Homo sapiens
tctcactgtgttactgcttt

SEQ ID NO: 5450726 - DNA, 16 bp, Homo sapiens
tctcactgtgttgccc

SEQ ID NO: 5450727 - DNA, 19 bp, Homo sapiens
tctcactgtgttgcccagg

SEQ ID NO: 5450728 - DNA, 13 bp, Homo sapiens
tctcactgttctg

SEQ ID NO: 5450729 - DNA, 15 bp, Homo sapiens
tctcactgttctgca

SEQ ID NO: 5450730 - DNA, 14 bp, Homo sapiens
tctcactgttgccc

SEQ ID NO: 5450731 - DNA, 18 bp, Homo sapiens
tctcactgttgcccaggc

SEQ ID NO: 5450732 - DNA, 21 bp, Homo sapiens
tctcactgttgcccaggctgg

SEQ ID NO: 5450733 - DNA, 15 bp, Homo sapiens
tctcactgtttgttt

SEQ ID NO: 5450734 - DNA, 18 bp, Homo sapiens
tctcacttaccccgagac

SEQ ID NO: 5450735 - DNA, 16 bp, Homo sapiens
tctcacttcaattaat

SEQ ID NO: 5450736 - DNA, 13 bp, Homo sapiens
tctcacttccaga

SEQ ID NO: 5450737 - DNA, 15 bp, Homo sapiens
tctcacttctaaatt

SEQ ID NO: 5450738 - DNA, 20 bp, Homo sapiens
tctcactttactttcaagta

SEQ ID NO: 5450739 - DNA, 21 bp, Homo sapiens
tctcactttccttttcttgtc

SEQ ID NO: 5450740 - DNA, 20 bp, Homo sapiens
tctcactttgacacccaggc

SEQ ID NO: 5450741 - DNA, 16 bp, Homo sapiens
tctcactttgtaaata

SEQ ID NO: 5450742 - DNA, 17 bp, Homo sapiens
tctcacttttaaaaaga

SEQ ID NO: 5450743 - DNA, 15 bp, Homo sapiens
tctcacttttttata

SEQ ID NO: 5450744 - DNA, 23 bp, Homo sapiens
tctcagaaaacttctcttctgag

SEQ ID NO: 5450745 - DNA, 19 bp, Homo sapiens
tctcagaaataaatcacag

SEQ ID NO: 5450746 - DNA, 19 bp, Homo sapiens
tctcagaaatgctgtccct

SEQ ID NO: 5450747 - DNA, 15 bp, Homo sapiens
tctcagaacagctga

SEQ ID NO: 5450748 - DNA, 23 bp, Homo sapiens
tctcagaactcctgtgtgtggaa

SEQ ID NO: 5450749 - DNA, 19 bp, Homo sapiens
tctcagaaggcaaatgact

SEQ ID NO: 5450750 - DNA, 22 bp, Homo sapiens
tctcagaaggcaaatgactttg

SEQ ID NO: 5450751 - DNA, 18 bp, Homo sapiens
tctcagaataactacctc

SEQ ID NO: 5450752 - DNA, 22 bp, Homo sapiens
tctcagaataactacctcctca

SEQ ID NO: 5450753 - DNA, 12 bp, Homo sapiens
tctcagaatcta

SEQ ID NO: 5450754 - DNA, 19 bp, Homo sapiens
tctcagaatctaaacgtgg

SEQ ID NO: 5450755 - DNA, 21 bp, Homo sapiens
tctcagaatctcaaataacta

SEQ ID NO: 5450756 - DNA, 14 bp, Homo sapiens
tctcagaattcggt

SEQ ID NO: 5450757 - DNA, 20 bp, Homo sapiens
tctcagaatttatctccctt

SEQ ID NO: 5450758 - DNA, 21 bp, Homo sapiens
tctcagacactaaatgcagac

SEQ ID NO: 5450759 - DNA, 16 bp, Homo sapiens
tctcagaccctgctta

SEQ ID NO: 5450760 - DNA, 17 bp, Homo sapiens
tctcagacccttgaaga

SEQ ID NO: 5450761 - DNA, 20 bp, Homo sapiens
tctcagacccttgaagatgt

SEQ ID NO: 5450762 - DNA, 20 bp, Homo sapiens
tctcagacgactagcccagg

SEQ ID NO: 5450763 - DNA, 20 bp, Homo sapiens
tctcagactggtctcgaact

SEQ ID NO: 5450764 - DNA, 17 bp, Homo sapiens
tctcagacttttgtaca

SEQ ID NO: 5450765 - DNA, 14 bp, Homo sapiens
tctcagagaccagc

SEQ ID NO: 5450766 - DNA, 17 bp, Homo sapiens
tctcagagactcccagg

SEQ ID NO: 5450767 - DNA, 16 bp, Homo sapiens
tctcagagcaagcctt

SEQ ID NO: 5450768 - DNA, 17 bp, Homo sapiens
tctcagagcaagccttt

SEQ ID NO: 5450769 - DNA, 22 bp, Homo sapiens
tctcagagcaagcctttgacct

SEQ ID NO: 5450770 - DNA, 17 bp, Homo sapiens
tctcagagcactgtgtt

SEQ ID NO: 5450771 - DNA, 14 bp, Homo sapiens
tctcagagcagcag

SEQ ID NO: 5450772 - DNA, 13 bp, Homo sapiens
tctcagagccaag

SEQ ID NO: 5450773 - DNA, 23 bp, Homo sapiens
tctcagagccttccatgacctcc

SEQ ID NO: 5450774 - DNA, 15 bp, Homo sapiens
tctcagaggcctgct

SEQ ID NO: 5450775 - DNA, 19 bp, Homo sapiens
tctcagaggctcagagact

SEQ ID NO: 5450776 - DNA, 19 bp, Homo sapiens
tctcagagtcaccacttcc

SEQ ID NO: 5450777 - DNA, 15 bp, Homo sapiens
tctcagagtccactg

SEQ ID NO: 5450778 - DNA, 18 bp, Homo sapiens
tctcagagtgacagtcat

SEQ ID NO: 5450779 - DNA, 16 bp, Homo sapiens
tctcagatatttatat

SEQ ID NO: 5450780 - DNA, 14 bp, Homo sapiens
tctcagatatttgc

SEQ ID NO: 5450781 - DNA, 20 bp, Homo sapiens
tctcagatcaccccagcctc

SEQ ID NO: 5450782 - DNA, 17 bp, Homo sapiens
tctcagatcactgcaac

SEQ ID NO: 5450783 - DNA, 20 bp, Homo sapiens
tctcagatccttgtttcaaa

SEQ ID NO: 5450784 - DNA, 18 bp, Homo sapiens
tctcagatgccccaaagt

SEQ ID NO: 5450785 - DNA, 14 bp, Homo sapiens
tctcagatgttaaa

SEQ ID NO: 5450786 - DNA, 18 bp, Homo sapiens
tctcagattcttcactgg

SEQ ID NO: 5450787 - DNA, 14 bp, Homo sapiens
tctcagatttctga

SEQ ID NO: 5450788 - DNA, 16 bp, Homo sapiens
tctcagattttctaag

SEQ ID NO: 5450789 - DNA, 17 bp, Homo sapiens
tctcagcaaagctacag

SEQ ID NO: 5450790 - DNA, 17 bp, Homo sapiens
tctcagcaaattcttga

SEQ ID NO: 5450791 - DNA, 14 bp, Homo sapiens
tctcagcaagagaa

SEQ ID NO: 5450792 - DNA, 16 bp, Homo sapiens
tctcagcaagtgccca

SEQ ID NO: 5450793 - DNA, 13 bp, Homo sapiens
tctcagcaagtgt

SEQ ID NO: 5450794 - DNA, 14 bp, Homo sapiens
tctcagcaagtgta

SEQ ID NO: 5450795 - DNA, 21 bp, Homo sapiens
tctcagcaatgattactcttt

SEQ ID NO: 5450796 - DNA, 15 bp, Homo sapiens
tctcagcagccagct

SEQ ID NO: 5450797 - DNA, 21 bp, Homo sapiens
tctcagcatagcctgcctgat

SEQ ID NO: 5450798 - DNA, 17 bp, Homo sapiens
tctcagcatatatataa

SEQ ID NO: 5450799 - DNA, 14 bp, Homo sapiens
tctcagcatccact

SEQ ID NO: 5450800 - DNA, 15 bp, Homo sapiens
tctcagccaacgagt

SEQ ID NO: 5450801 - DNA, 23 bp, Homo sapiens
tctcagccataaagtgccagttt

SEQ ID NO: 5450802 - DNA, 19 bp, Homo sapiens
tctcagccataggtgcagt

SEQ ID NO: 5450803 - DNA, 14 bp, Homo sapiens
tctcagccatccgc

SEQ ID NO: 5450804 - DNA, 20 bp, Homo sapiens
tctcagcccagaagaaaatt

SEQ ID NO: 5450805 - DNA, 22 bp, Homo sapiens
tctcagcccagaagaaaattct

SEQ ID NO: 5450806 - DNA, 12 bp, Homo sapiens
tctcagcccagg

SEQ ID NO: 5450807 - DNA, 17 bp, Homo sapiens
tctcagccccatcgccc

SEQ ID NO: 5450808 - DNA, 20 bp, Homo sapiens
tctcagccccgggcctgcct

SEQ ID NO: 5450809 - DNA, 20 bp, Homo sapiens
tctcagcccctttcccttgt

SEQ ID NO: 5450810 - DNA, 23 bp, Homo sapiens
tctcagccctccatggcctggca

SEQ ID NO: 5450811 - DNA, 18 bp, Homo sapiens
tctcagccgagcccaggg

SEQ ID NO: 5450812 - DNA, 16 bp, Homo sapiens
tctcagcctacagcag

SEQ ID NO: 5450813 - DNA, 17 bp, Homo sapiens
tctcagcctacagcagt

SEQ ID NO: 5450814 - DNA, 19 bp, Homo sapiens
tctcagcctacagcagtgt

SEQ ID NO: 5450815 - DNA, 13 bp, Homo sapiens
tctcagcctccca

SEQ ID NO: 5450816 - DNA, 14 bp, Homo sapiens
tctcagcctcccac

SEQ ID NO: 5450817 - DNA, 15 bp, Homo sapiens
tctcagcctcccaca

SEQ ID NO: 5450818 - DNA, 12 bp, Homo sapiens
tctcagcctcct

SEQ ID NO: 5450819 - DNA, 14 bp, Homo sapiens
tctcagcctcctga

SEQ ID NO: 5450820 - DNA, 15 bp, Homo sapiens
tctcagcctcctgag

SEQ ID NO: 5450821 - DNA, 16 bp, Homo sapiens
tctcagcctcctgagt

SEQ ID NO: 5450822 - DNA, 15 bp, Homo sapiens
tctcagcctctgcca

SEQ ID NO: 5450823 - DNA, 19 bp, Homo sapiens
tctcagcctctgccagcgc

SEQ ID NO: 5450824 - DNA, 14 bp, Homo sapiens
tctcagcctgggcc

SEQ ID NO: 5450825 - DNA, 15 bp, Homo sapiens
tctcagcctgggccc

SEQ ID NO: 5450826 - DNA, 22 bp, Homo sapiens
tctcagcctgggcccctcagcc

SEQ ID NO: 5450827 - DNA, 23 bp, Homo sapiens
tctcagcctgggcccctcagcca

SEQ ID NO: 5450828 - DNA, 22 bp, Homo sapiens
tctcagcgaggtgtaaagttgt

SEQ ID NO: 5450829 - DNA, 15 bp, Homo sapiens
tctcagctcactgtg

SEQ ID NO: 5450830 - DNA, 20 bp, Homo sapiens
tctcagctcatcttcactgc

SEQ ID NO: 5450831 - DNA, 15 bp, Homo sapiens
tctcagctccactct

SEQ ID NO: 5450832 - DNA, 20 bp, Homo sapiens
tctcagctccactctgaagt

SEQ ID NO: 5450833 - DNA, 21 bp, Homo sapiens
tctcagctccaggtggctctg

SEQ ID NO: 5450834 - DNA, 17 bp, Homo sapiens
tctcagctcccatttct

SEQ ID NO: 5450835 - DNA, 17 bp, Homo sapiens
tctcagctccccctgtc

SEQ ID NO: 5450836 - DNA, 18 bp, Homo sapiens
tctcagctccccctgtcc

SEQ ID NO: 5450837 - DNA, 16 bp, Homo sapiens
tctcagctctccaccc

SEQ ID NO: 5450838 - DNA, 22 bp, Homo sapiens
tctcagctgctggatgacttga

SEQ ID NO: 5450839 - DNA, 15 bp, Homo sapiens
tctcagctgtgcctt

SEQ ID NO: 5450840 - DNA, 16 bp, Homo sapiens
tctcagctgtgccttc

SEQ ID NO: 5450841 - DNA, 11 bp, Homo sapiens
tctcagcttca

SEQ ID NO: 5450842 - DNA, 13 bp, Homo sapiens
tctcagcttcatt

SEQ ID NO: 5450843 - DNA, 16 bp, Homo sapiens
tctcagcttcatttcc

SEQ ID NO: 5450844 - DNA, 22 bp, Homo sapiens
tctcagcttctaattttgtgct

SEQ ID NO: 5450845 - DNA, 13 bp, Homo sapiens
tctcagcttgtgc

SEQ ID NO: 5450846 - DNA, 23 bp, Homo sapiens
tctcaggaaatcaaatatgcaaa

SEQ ID NO: 5450847 - DNA, 19 bp, Homo sapiens
tctcaggaagtccagccac

SEQ ID NO: 5450848 - DNA, 16 bp, Homo sapiens
tctcaggacacaggcc

SEQ ID NO: 5450849 - DNA, 16 bp, Homo sapiens
tctcaggacagcatcc

SEQ ID NO: 5450850 - DNA, 23 bp, Homo sapiens
tctcaggacagcatcccttccca

SEQ ID NO: 5450851 - DNA, 20 bp, Homo sapiens
tctcaggacagtgatgttgg

SEQ ID NO: 5450852 - DNA, 14 bp, Homo sapiens
tctcaggaccaccc

SEQ ID NO: 5450853 - DNA, 20 bp, Homo sapiens
tctcaggaccaccctgccaa

SEQ ID NO: 5450854 - DNA, 22 bp, Homo sapiens
tctcaggacctctgtaggcagc

SEQ ID NO: 5450855 - DNA, 16 bp, Homo sapiens
tctcaggagagtgtgc

SEQ ID NO: 5450856 - DNA, 17 bp, Homo sapiens
tctcaggagagtgtgca

SEQ ID NO: 5450857 - DNA, 15 bp, Homo sapiens
tctcaggagatggag

SEQ ID NO: 5450858 - DNA, 21 bp, Homo sapiens
tctcaggagcaccctgtcttc

SEQ ID NO: 5450859 - DNA, 12 bp, Homo sapiens
tctcaggagctt

SEQ ID NO: 5450860 - DNA, 17 bp, Homo sapiens
tctcaggagcttcaatg

SEQ ID NO: 5450861 - DNA, 16 bp, Homo sapiens
tctcaggagcttgggc

SEQ ID NO: 5450862 - DNA, 19 bp, Homo sapiens
tctcaggaggcgcagcccg

SEQ ID NO: 5450863 - DNA, 15 bp, Homo sapiens
tctccctgccgcctc

SEQ ID NO: 5450864 - DNA, 13 bp, Homo sapiens
tctccctgcctca

SEQ ID NO: 5450865 - DNA, 21 bp, Homo sapiens
tctccctgcctcacatctccc

SEQ ID NO: 5450866 - DNA, 16 bp, Homo sapiens
tctccctgcctggccc

SEQ ID NO: 5450867 - DNA, 17 bp, Homo sapiens
tctccctgcctggcccc

SEQ ID NO: 5450868 - DNA, 17 bp, Homo sapiens
tctccctgcctttaaat

SEQ ID NO: 5450869 - DNA, 23 bp, Homo sapiens
tctccctgcgcaccaggctgagc

SEQ ID NO: 5450870 - DNA, 20 bp, Homo sapiens
tctccctggaatgagttgag

SEQ ID NO: 5450871 - DNA, 14 bp, Homo sapiens
tctccctggactct

SEQ ID NO: 5450872 - DNA, 23 bp, Homo sapiens
tctccctggactctgtggggcca

SEQ ID NO: 5450873 - DNA, 18 bp, Homo sapiens
tctccctggcaaggagaa

SEQ ID NO: 5450874 - DNA, 20 bp, Homo sapiens
tctccctggccacccttggc

SEQ ID NO: 5450875 - DNA, 14 bp, Homo sapiens
tctccctggcccca

SEQ ID NO: 5450876 - DNA, 19 bp, Homo sapiens
tctccctggcctcagggct

SEQ ID NO: 5450877 - DNA, 12 bp, Homo sapiens
tctccctgggca

SEQ ID NO: 5450878 - DNA, 13 bp, Homo sapiens
tctccctgggcct

SEQ ID NO: 5450879 - DNA, 16 bp, Homo sapiens
tctccctggggacggg

SEQ ID NO: 5450880 - DNA, 23 bp, Homo sapiens
tctccctggggacggggctcccc

SEQ ID NO: 5450881 - DNA, 18 bp, Homo sapiens
tctccctgggtctgggga

SEQ ID NO: 5450882 - DNA, 17 bp, Homo sapiens
tctccctggtgcctctg

SEQ ID NO: 5450883 - DNA, 20 bp, Homo sapiens
tctccctggtgcctctgtgc

SEQ ID NO: 5450884 - DNA, 19 bp, Homo sapiens
tctccctggttttacccca

SEQ ID NO: 5450885 - DNA, 18 bp, Homo sapiens
tctccctgtacagtgtta

SEQ ID NO: 5450886 - DNA, 21 bp, Homo sapiens
tctcccttacccatcttgctt

SEQ ID NO: 5450887 - DNA, 14 bp, Homo sapiens
tctcccttccacct

SEQ ID NO: 5450888 - DNA, 17 bp, Homo sapiens
tctcccttccacctcac

SEQ ID NO: 5450889 - DNA, 12 bp, Homo sapiens
tctcccttctct

SEQ ID NO: 5450890 - DNA, 19 bp, Homo sapiens
tctcccttcttgggtaggg

SEQ ID NO: 5450891 - DNA, 21 bp, Homo sapiens
tctcccttcttgggtctgccc

SEQ ID NO: 5450892 - DNA, 23 bp, Homo sapiens
tctcccttcttgggtctgccctg

SEQ ID NO: 5450893 - DNA, 18 bp, Homo sapiens
tctcccttctttaccttc

SEQ ID NO: 5450894 - DNA, 23 bp, Homo sapiens
tctcccttggccacggcctggga

SEQ ID NO: 5450895 - DNA, 19 bp, Homo sapiens
tctcccttggcccagagac

SEQ ID NO: 5450896 - DNA, 14 bp, Homo sapiens
tctcccttgggctc

SEQ ID NO: 5450897 - DNA, 16 bp, Homo sapiens
tctcccttgtcctgct

SEQ ID NO: 5450898 - DNA, 18 bp, Homo sapiens
tctccctttatgtatctc

SEQ ID NO: 5450899 - DNA, 15 bp, Homo sapiens
tctccctttcccttc

SEQ ID NO: 5450900 - DNA, 14 bp, Homo sapiens
tctccctttctctc

SEQ ID NO: 5450901 - DNA, 13 bp, Homo sapiens
tctcccttttaaa

SEQ ID NO: 5450902 - DNA, 14 bp, Homo sapiens
tctcccttttcaga

SEQ ID NO: 5450903 - DNA, 16 bp, Homo sapiens
tctccgaaagaagaca

SEQ ID NO: 5450904 - DNA, 17 bp, Homo sapiens
tctccgaaatgctgtct

SEQ ID NO: 5450905 - DNA, 24 bp, Homo sapiens
tctccgaagaaaagatatgtattc

SEQ ID NO: 5450906 - DNA, 17 bp, Homo sapiens
tctccgaccagacacct

SEQ ID NO: 5450907 - DNA, 16 bp, Homo sapiens
tctccgactctgcacc

SEQ ID NO: 5450908 - DNA, 17 bp, Homo sapiens
tctccgacttcccctgg

SEQ ID NO: 5450909 - DNA, 14 bp, Homo sapiens
tctccgagctctgg

SEQ ID NO: 5450910 - DNA, 17 bp, Homo sapiens
tctccgagctctggtgc

SEQ ID NO: 5450911 - DNA, 19 bp, Homo sapiens
tctccgagctctggtgctt

SEQ ID NO: 5450912 - DNA, 16 bp, Homo sapiens
tctccgcacacctctg

SEQ ID NO: 5450913 - DNA, 19 bp, Homo sapiens
tctccgcacacctctggct

SEQ ID NO: 5450914 - DNA, 13 bp, Homo sapiens
tctccgcagaggc

SEQ ID NO: 5450915 - DNA, 12 bp, Homo sapiens
tctccgcccccc

SEQ ID NO: 5450916 - DNA, 22 bp, Homo sapiens
tctccgccccccggcctggccc

SEQ ID NO: 5450917 - DNA, 23 bp, Homo sapiens
tctccgccccggacagggtggca

SEQ ID NO: 5450918 - DNA, 15 bp, Homo sapiens
tctccgcccctgagc

SEQ ID NO: 5450919 - DNA, 16 bp, Homo sapiens
tctccgcccctgagcc

SEQ ID NO: 5450920 - DNA, 19 bp, Homo sapiens
tctccgcccctgagcccac

SEQ ID NO: 5450921 - DNA, 21 bp, Homo sapiens
tctccgcccctgagcccactg

SEQ ID NO: 5450922 - DNA, 17 bp, Homo sapiens
tctccgcgccctccgac

SEQ ID NO: 5450923 - DNA, 18 bp, Homo sapiens
tctccgcgggagacccct

SEQ ID NO: 5450924 - DNA, 14 bp, Homo sapiens
tctccgcgggtggg

SEQ ID NO: 5450925 - DNA, 20 bp, Homo sapiens
tctccggatggaatcacagc

SEQ ID NO: 5450926 - DNA, 22 bp, Homo sapiens
tctccggatggaatcacagcca

SEQ ID NO: 5450927 - DNA, 23 bp, Homo sapiens
tctccggatggaatcacagccaa

SEQ ID NO: 5450928 - DNA, 21 bp, Homo sapiens
tctccggcctctccagcctca

SEQ ID NO: 5450929 - DNA, 16 bp, Homo sapiens
tctccggcctggcctt

SEQ ID NO: 5450930 - DNA, 20 bp, Homo sapiens
tctccggcctggccttttcc

SEQ ID NO: 5450931 - DNA, 15 bp, Homo sapiens
tctccggctcccagc

SEQ ID NO: 5450932 - DNA, 17 bp, Homo sapiens
tctccggctcccagcct

SEQ ID NO: 5450933 - DNA, 21 bp, Homo sapiens
tctccgggcctttctctggct

SEQ ID NO: 5450934 - DNA, 13 bp, Homo sapiens
tctccggggtctg

SEQ ID NO: 5450935 - DNA, 15 bp, Homo sapiens
tctccggggtctgtg

SEQ ID NO: 5450936 - DNA, 18 bp, Homo sapiens
tctccggggtctgtgctg

SEQ ID NO: 5450937 - DNA, 23 bp, Homo sapiens
tctccggggtctgtgctgtgcct

SEQ ID NO: 5450938 - DNA, 24 bp, Homo sapiens
tctccggggtggccacaggctaga

SEQ ID NO: 5450939 - DNA, 19 bp, Homo sapiens
tctccggtgtgagcccacc

SEQ ID NO: 5450940 - DNA, 19 bp, Homo sapiens
tctccgtatgatgtgatat

SEQ ID NO: 5450941 - DNA, 13 bp, Homo sapiens
tctccgtcactcc

SEQ ID NO: 5450942 - DNA, 18 bp, Homo sapiens
tctccgtctcccaaagtg

SEQ ID NO: 5450943 - DNA, 20 bp, Homo sapiens
tctccgtttattataaactg

SEQ ID NO: 5450944 - DNA, 23 bp, Homo sapiens
tctcctaaaacatgaaaattatc

SEQ ID NO: 5450945 - DNA, 19 bp, Homo sapiens
tctcctaagctggagtgca

SEQ ID NO: 5450946 - DNA, 14 bp, Homo sapiens
tctcctaattgtat

SEQ ID NO: 5450947 - DNA, 21 bp, Homo sapiens
tctcctaatttgtttcttctg

SEQ ID NO: 5450948 - DNA, 22 bp, Homo sapiens
tctcctaatttgtttcttctgt

SEQ ID NO: 5450949 - DNA, 15 bp, Homo sapiens
tctcctaccccacct

SEQ ID NO: 5450950 - DNA, 17 bp, Homo sapiens
tctcctaccccacctca

SEQ ID NO: 5450951 - DNA, 19 bp, Homo sapiens
tctcctaccccacctcatg

SEQ ID NO: 5450952 - DNA, 17 bp, Homo sapiens
tctcctacctgctgctg

SEQ ID NO: 5450953 - DNA, 16 bp, Homo sapiens
tctcctacgcaccatt

SEQ ID NO: 5450954 - DNA, 22 bp, Homo sapiens
tctcctacgcaccattttgtca

SEQ ID NO: 5450955 - DNA, 16 bp, Homo sapiens
tctcctactcctgact

SEQ ID NO: 5450956 - DNA, 15 bp, Homo sapiens
tctcctactgaggat

SEQ ID NO: 5450957 - DNA, 14 bp, Homo sapiens
tctcctagacactc

SEQ ID NO: 5450958 - DNA, 13 bp, Homo sapiens
tctcctagagctc

SEQ ID NO: 5450959 - DNA, 19 bp, Homo sapiens
tctcctaggcattctggac

SEQ ID NO: 5450960 - DNA, 23 bp, Homo sapiens
tctcctaggcattctggacctct

SEQ ID NO: 5450961 - DNA, 18 bp, Homo sapiens
tctcctaggggcttggtc

SEQ ID NO: 5450962 - DNA, 19 bp, Homo sapiens
tctcctataatctgtcaaa

SEQ ID NO: 5450963 - DNA, 20 bp, Homo sapiens
tctcctatacccagcagagg

SEQ ID NO: 5450964 - DNA, 15 bp, Homo sapiens
tctcctatatatttc

SEQ ID NO: 5450965 - DNA, 23 bp, Homo sapiens
tctcctatcctggtttttgtagc

SEQ ID NO: 5450966 - DNA, 21 bp, Homo sapiens
tctcctatcttttatttcatt

SEQ ID NO: 5450967 - DNA, 12 bp, Homo sapiens
tctcctattttt

SEQ ID NO: 5450968 - DNA, 17 bp, Homo sapiens
tctcctcaacccacatg

SEQ ID NO: 5450969 - DNA, 23 bp, Homo sapiens
tctcctcaagcctgtgggcagca

SEQ ID NO: 5450970 - DNA, 18 bp, Homo sapiens
tctcctcaccccagtgcc

SEQ ID NO: 5450971 - DNA, 15 bp, Homo sapiens
tctcctcactgccac

SEQ ID NO: 5450972 - DNA, 14 bp, Homo sapiens
tctcctcagactgc

SEQ ID NO: 5450973 - DNA, 19 bp, Homo sapiens
tctcctcaggacaaggcct

SEQ ID NO: 5450974 - DNA, 22 bp, Homo sapiens
tctcctcaggaccctcagccct

SEQ ID NO: 5450975 - DNA, 14 bp, Homo sapiens
tctcctcagtggct

SEQ ID NO: 5450976 - DNA, 17 bp, Homo sapiens
tctcctcagtggcttct

SEQ ID NO: 5450977 - DNA, 16 bp, Homo sapiens
tctcctcatgttctgc

SEQ ID NO: 5450978 - DNA, 19 bp, Homo sapiens
tctcctccaagacactgtg

SEQ ID NO: 5450979 - DNA, 18 bp, Homo sapiens
tctcctccagccctgggc

SEQ ID NO: 5450980 - DNA, 19 bp, Homo sapiens
tctcctcccaccagtggcc

SEQ ID NO: 5450981 - DNA, 15 bp, Homo sapiens
tctcctcccagcgtg

SEQ ID NO: 5450982 - DNA, 21 bp, Homo sapiens
tctcctcccagcgtgtgtatc

SEQ ID NO: 5450983 - DNA, 16 bp, Homo sapiens
tctcctcccagctgct

SEQ ID NO: 5450984 - DNA, 17 bp, Homo sapiens
tctcctcccagctgctt

SEQ ID NO: 5450985 - DNA, 20 bp, Homo sapiens
tctcctcccaggtttcttct

SEQ ID NO: 5450986 - DNA, 22 bp, Homo sapiens
tctcctcccaggtttcttctct

SEQ ID NO: 5450987 - DNA, 16 bp, Homo sapiens
tctcctcccatggcct

SEQ ID NO: 5450988 - DNA, 21 bp, Homo sapiens
tctcctccccacctgtagctg

SEQ ID NO: 5450989 - DNA, 11 bp, Homo sapiens
tctcctccccc

SEQ ID NO: 5450990 - DNA, 18 bp, Homo sapiens
tctcctcccgccccgccc

SEQ ID NO: 5450991 - DNA, 13 bp, Homo sapiens
tctcctccctcag

SEQ ID NO: 5450992 - DNA, 17 bp, Homo sapiens
tctcctccctcctgggg

SEQ ID NO: 5450993 - DNA, 22 bp, Homo sapiens
tctcctccctcctggggaaggt

SEQ ID NO: 5450994 - DNA, 12 bp, Homo sapiens
tctcctccctgg

SEQ ID NO: 5450995 - DNA, 13 bp, Homo sapiens
tctcctccctggg

SEQ ID NO: 5450996 - DNA, 23 bp, Homo sapiens
tctcctccctgttatctgctaga

SEQ ID NO: 5450997 - DNA, 17 bp, Homo sapiens
tctcctccgtggcacat

SEQ ID NO: 5450998 - DNA, 15 bp, Homo sapiens
tctcctcctatttat

SEQ ID NO: 5450999 - DNA, 12 bp, Homo sapiens
tctcctcctcca

SEQ ID NO: 5451000 - DNA, 12 bp, Homo sapiens
tctcctcctccc

SEQ ID NO: 5451001 - DNA, 14 bp, Homo sapiens
tctcctcctcgaag

SEQ ID NO: 5451002 - DNA, 17 bp, Homo sapiens
tctcctcctctgtcttt

SEQ ID NO: 5451003 - DNA, 16 bp, Homo sapiens
tctcctcgagccctcc

SEQ ID NO: 5451004 - DNA, 17 bp, Homo sapiens
tctcctcgagccctccc

SEQ ID NO: 5451005 - DNA, 18 bp, Homo sapiens
tctcctcggactgtgtgc

SEQ ID NO: 5451006 - DNA, 14 bp, Homo sapiens
tctcctcggccccc

SEQ ID NO: 5451007 - DNA, 22 bp, Homo sapiens
tctcctcgggccctgtggtgct

SEQ ID NO: 5451008 - DNA, 22 bp, Homo sapiens
tctcctcggtggcatttgctga

SEQ ID NO: 5451009 - DNA, 22 bp, Homo sapiens
tctcctcgtcaatccatcagca

SEQ ID NO: 5451010 - DNA, 15 bp, Homo sapiens
tctcctcgtccggcc

SEQ ID NO: 5451011 - DNA, 17 bp, Homo sapiens
tctcctcgtccggcctg

SEQ ID NO: 5451012 - DNA, 18 bp, Homo sapiens
tctcctcgtccggcctgc

SEQ ID NO: 5451013 - DNA, 20 bp, Homo sapiens
tctcctcgttcttatttaat

SEQ ID NO: 5451014 - DNA, 16 bp, Homo sapiens
tctcctctcagagtga

SEQ ID NO: 5451015 - DNA, 23 bp, Homo sapiens
tctcctctcagagtgacagtcat

SEQ ID NO: 5451016 - DNA, 12 bp, Homo sapiens
tctcctctcagc

SEQ ID NO: 5451017 - DNA, 15 bp, Homo sapiens
tctcctctcagcttc

SEQ ID NO: 5451018 - DNA, 16 bp, Homo sapiens
tctcctctcagcttct

SEQ ID NO: 5451019 - DNA, 12 bp, Homo sapiens
tctcctctccca

SEQ ID NO: 5451020 - DNA, 21 bp, Homo sapiens
tctcctctccccaacccttcc

SEQ ID NO: 5451021 - DNA, 15 bp, Homo sapiens
tctcctctcccccag

SEQ ID NO: 5451022 - DNA, 13 bp, Homo sapiens
tctcctctcccct

SEQ ID NO: 5451023 - DNA, 18 bp, Homo sapiens
tctcctctctctccctcc

SEQ ID NO: 5451024 - DNA, 19 bp, Homo sapiens
tctcctctctctttcctcc

SEQ ID NO: 5451025 - DNA, 11 bp, Homo sapiens
tctcctctctg

SEQ ID NO: 5451026 - DNA, 14 bp, Homo sapiens
tctcctctctgaga

SEQ ID NO: 5451027 - DNA, 15 bp, Homo sapiens
tctcctctctgcttc

SEQ ID NO: 5451028 - DNA, 14 bp, Homo sapiens
tctcctctctgggc

SEQ ID NO: 5451029 - DNA, 20 bp, Homo sapiens
tctcctctctgggcctttgt

SEQ ID NO: 5451030 - DNA, 14 bp, Homo sapiens
tctcctctcttggc

SEQ ID NO: 5451031 - DNA, 20 bp, Homo sapiens
tctcctctgctatgcatttt

SEQ ID NO: 5451032 - DNA, 19 bp, Homo sapiens
tctcctctgctcattaaac

SEQ ID NO: 5451033 - DNA, 14 bp, Homo sapiens
tctcctctgctcca

SEQ ID NO: 5451034 - DNA, 14 bp, Homo sapiens
tctcctctgctgct

SEQ ID NO: 5451035 - DNA, 16 bp, Homo sapiens
tctcctctgctgctgg

SEQ ID NO: 5451036 - DNA, 12 bp, Homo sapiens
tctcctctggct

SEQ ID NO: 5451037 - DNA, 11 bp, Homo sapiens
tctcctctgtc

SEQ ID NO: 5451038 - DNA, 12 bp, Homo sapiens
tctcctctgtca

SEQ ID NO: 5451039 - DNA, 12 bp, Homo sapiens
tctcctctgtcc

SEQ ID NO: 5451040 - DNA, 20 bp, Homo sapiens
tctcctcttctccctttcct

SEQ ID NO: 5451041 - DNA, 14 bp, Homo sapiens
tctctagttccctc

SEQ ID NO: 5451042 - DNA, 20 bp, Homo sapiens
tctctagttgacttcaaatg

SEQ ID NO: 5451043 - DNA, 23 bp, Homo sapiens
tctctagttgacttcaaatgtgt

SEQ ID NO: 5451044 - DNA, 14 bp, Homo sapiens
tctctagttggcca

SEQ ID NO: 5451045 - DNA, 16 bp, Homo sapiens
tctctagtttgattaa

SEQ ID NO: 5451046 - DNA, 21 bp, Homo sapiens
tctctataaagggtcaggccc

SEQ ID NO: 5451047 - DNA, 20 bp, Homo sapiens
tctctataagtgttcagtgt

SEQ ID NO: 5451048 - DNA, 14 bp, Homo sapiens
tctctatcagaaat

SEQ ID NO: 5451049 - DNA, 21 bp, Homo sapiens
tctctatcagaaatacaaaaa

SEQ ID NO: 5451050 - DNA, 17 bp, Homo sapiens
tctctatcattaaagtt

SEQ ID NO: 5451051 - DNA, 12 bp, Homo sapiens
tctctatcattt

SEQ ID NO: 5451052 - DNA, 15 bp, Homo sapiens
tctctatcatttaat

SEQ ID NO: 5451053 - DNA, 20 bp, Homo sapiens
tctctatcatttaataatat

SEQ ID NO: 5451054 - DNA, 22 bp, Homo sapiens
tctctatcatttaataatatac

SEQ ID NO: 5451055 - DNA, 14 bp, Homo sapiens
tctctatgtatcaa

SEQ ID NO: 5451056 - DNA, 15 bp, Homo sapiens
tctctatgtatcaaa

SEQ ID NO: 5451057 - DNA, 15 bp, Homo sapiens
tctctatgtgaatat

SEQ ID NO: 5451058 - DNA, 13 bp, Homo sapiens
tctctatgtttat

SEQ ID NO: 5451059 - DNA, 17 bp, Homo sapiens
tctctattcctgaccct

SEQ ID NO: 5451060 - DNA, 13 bp, Homo sapiens
tctctattctctg

SEQ ID NO: 5451061 - DNA, 18 bp, Homo sapiens
tctctattctctgcaatt

SEQ ID NO: 5451062 - DNA, 17 bp, Homo sapiens
tctctattggaggtgag

SEQ ID NO: 5451063 - DNA, 21 bp, Homo sapiens
tctctattggaggtgagatca

SEQ ID NO: 5451064 - DNA, 13 bp, Homo sapiens
tctctattgtaat

SEQ ID NO: 5451065 - DNA, 15 bp, Homo sapiens
tctctatttaaattc

SEQ ID NO: 5451066 - DNA, 16 bp, Homo sapiens
tctctatttaaattct

SEQ ID NO: 5451067 - DNA, 15 bp, Homo sapiens
tctctatttatgaga

SEQ ID NO: 5451068 - DNA, 21 bp, Homo sapiens
tctctatttatgagatcactg

SEQ ID NO: 5451069 - DNA, 23 bp, Homo sapiens
tctctatttccccctttcttcct

SEQ ID NO: 5451070 - DNA, 18 bp, Homo sapiens
tctctatttgaattattt

SEQ ID NO: 5451071 - DNA, 13 bp, Homo sapiens
tctctatttgaga

SEQ ID NO: 5451072 - DNA, 14 bp, Homo sapiens
tctctatttgagaa

SEQ ID NO: 5451073 - DNA, 17 bp, Homo sapiens
tctctatttgatttgca

SEQ ID NO: 5451074 - DNA, 18 bp, Homo sapiens
tctctatttgtattgtta

SEQ ID NO: 5451075 - DNA, 14 bp, Homo sapiens
tctctattttactt

SEQ ID NO: 5451076 - DNA, 14 bp, Homo sapiens
tctctcaaaacaat

SEQ ID NO: 5451077 - DNA, 16 bp, Homo sapiens
tctctcaaaatgtgcc

SEQ ID NO: 5451078 - DNA, 12 bp, Homo sapiens
tctctcaaactt

SEQ ID NO: 5451079 - DNA, 19 bp, Homo sapiens
tctctcaacaccatgattc

SEQ ID NO: 5451080 - DNA, 22 bp, Homo sapiens
tctctcaacaccatgattcctt

SEQ ID NO: 5451081 - DNA, 16 bp, Homo sapiens
tctctcaaccttggcc

SEQ ID NO: 5451082 - DNA, 19 bp, Homo sapiens
tctctcaaccttggccttc

SEQ ID NO: 5451083 - DNA, 19 bp, Homo sapiens
tctctcaatccctttgcaa

SEQ ID NO: 5451084 - DNA, 17 bp, Homo sapiens
tctctcaatttgaaaca

SEQ ID NO: 5451085 - DNA, 19 bp, Homo sapiens
tctctcaatttgaaacaca

SEQ ID NO: 5451086 - DNA, 20 bp, Homo sapiens
tctctcaatttgggtcccag

SEQ ID NO: 5451087 - DNA, 13 bp, Homo sapiens
tctctcacccacc

SEQ ID NO: 5451088 - DNA, 17 bp, Homo sapiens
tctctcacccaccagct

SEQ ID NO: 5451089 - DNA, 17 bp, Homo sapiens
tctctcacccagcctgg

SEQ ID NO: 5451090 - DNA, 13 bp, Homo sapiens
tctctcacccatc

SEQ ID NO: 5451091 - DNA, 13 bp, Homo sapiens
tctctcacctact

SEQ ID NO: 5451092 - DNA, 22 bp, Homo sapiens
tctctcacctacttcctcctcc

SEQ ID NO: 5451093 - DNA, 20 bp, Homo sapiens
tctctcacctagaccttgcc

SEQ ID NO: 5451094 - DNA, 15 bp, Homo sapiens
tctctcactcccctc

SEQ ID NO: 5451095 - DNA, 13 bp, Homo sapiens
tctctcactgcat

SEQ ID NO: 5451096 - DNA, 13 bp, Homo sapiens
tctctcactgtgt

SEQ ID NO: 5451097 - DNA, 20 bp, Homo sapiens
tctctcagaagggaggctgg

SEQ ID NO: 5451098 - DNA, 18 bp, Homo sapiens
tctctcagagcatctggc

SEQ ID NO: 5451099 - DNA, 14 bp, Homo sapiens
tctctcagcccagg

SEQ ID NO: 5451100 - DNA, 13 bp, Homo sapiens
tctctcagcccca

SEQ ID NO: 5451101 - DNA, 15 bp, Homo sapiens
tctctcagccccatc

SEQ ID NO: 5451102 - DNA, 17 bp, Homo sapiens
tctctcagccttacatt

SEQ ID NO: 5451103 - DNA, 16 bp, Homo sapiens
tctctcagctcccagg

SEQ ID NO: 5451104 - DNA, 19 bp, Homo sapiens
tctctcagctcccaggcca

SEQ ID NO: 5451105 - DNA, 15 bp, Homo sapiens
tctctcaggagcaca

SEQ ID NO: 5451106 - DNA, 21 bp, Homo sapiens
tctctcaggagcacaggcagc

SEQ ID NO: 5451107 - DNA, 17 bp, Homo sapiens
tctctcaggagtatctt

SEQ ID NO: 5451108 - DNA, 12 bp, Homo sapiens
tctctcaggtga

SEQ ID NO: 5451109 - DNA, 15 bp, Homo sapiens
tctctcatagaacat

SEQ ID NO: 5451110 - DNA, 17 bp, Homo sapiens
tctctcatatcactgaa

SEQ ID NO: 5451111 - DNA, 19 bp, Homo sapiens
tctctcatatcactgaagg

SEQ ID NO: 5451112 - DNA, 20 bp, Homo sapiens
tctctcatatcactgaagga

SEQ ID NO: 5451113 - DNA, 14 bp, Homo sapiens
tctctcatctctta

SEQ ID NO: 5451114 - DNA, 13 bp, Homo sapiens
tctctcatcttgt

SEQ ID NO: 5451115 - DNA, 17 bp, Homo sapiens
tctctcatgaacctcaa

SEQ ID NO: 5451116 - DNA, 16 bp, Homo sapiens
tctctcatgagaagcc

SEQ ID NO: 5451117 - DNA, 21 bp, Homo sapiens
tctctcatgcctcctgaggct

SEQ ID NO: 5451118 - DNA, 23 bp, Homo sapiens
tctctcatggcttgggctggagt

SEQ ID NO: 5451119 - DNA, 14 bp, Homo sapiens
tctctcatttgtgt

SEQ ID NO: 5451120 - DNA, 15 bp, Homo sapiens
tctctccacacggag

SEQ ID NO: 5451121 - DNA, 14 bp, Homo sapiens
tctctccacagtgt

SEQ ID NO: 5451122 - DNA, 18 bp, Homo sapiens
tctctccacagtgttgtg

SEQ ID NO: 5451123 - DNA, 15 bp, Homo sapiens
tctctccaccttagt

SEQ ID NO: 5451124 - DNA, 21 bp, Homo sapiens
tctctccacttctggtcccct

SEQ ID NO: 5451125 - DNA, 12 bp, Homo sapiens
tctctccacttt

SEQ ID NO: 5451126 - DNA, 16 bp, Homo sapiens
tctctccactttcagc

SEQ ID NO: 5451127 - DNA, 22 bp, Homo sapiens
tctctccactttcagctgtctt

SEQ ID NO: 5451128 - DNA, 14 bp, Homo sapiens
tctctccagaaaca

SEQ ID NO: 5451129 - DNA, 19 bp, Homo sapiens
tctctccagaaacagctgc

SEQ ID NO: 5451130 - DNA, 13 bp, Homo sapiens
tctctccagagag

SEQ ID NO: 5451131 - DNA, 14 bp, Homo sapiens
tctctccagcccct

SEQ ID NO: 5451132 - DNA, 17 bp, Homo sapiens
tctctccagcccctgga

SEQ ID NO: 5451133 - DNA, 12 bp, Homo sapiens
tctctccagcct

SEQ ID NO: 5451134 - DNA, 13 bp, Homo sapiens
tctctccagcctc

SEQ ID NO: 5451135 - DNA, 17 bp, Homo sapiens
tctctccagcctcacag

SEQ ID NO: 5451136 - DNA, 18 bp, Homo sapiens
tctctccagcctcacaga

SEQ ID NO: 5451137 - DNA, 24 bp, Homo sapiens
tctctccagcctcacagatgctgg

SEQ ID NO: 5451138 - DNA, 19 bp, Homo sapiens
tctctccagctgactaaac

SEQ ID NO: 5451139 - DNA, 11 bp, Homo sapiens
tctctccagga

SEQ ID NO: 5451140 - DNA, 14 bp, Homo sapiens
tctctccaggaagg

SEQ ID NO: 5451141 - DNA, 15 bp, Homo sapiens
tctctccaggaaggt

SEQ ID NO: 5451142 - DNA, 18 bp, Homo sapiens
tctctccaggagggctcg

SEQ ID NO: 5451143 - DNA, 20 bp, Homo sapiens
tctctccaggagggctcggg

SEQ ID NO: 5451144 - DNA, 13 bp, Homo sapiens
tctctccatcaga

SEQ ID NO: 5451145 - DNA, 20 bp, Homo sapiens
tctctccatcagaggacacc

SEQ ID NO: 5451146 - DNA, 21 bp, Homo sapiens
tctctccatccctctcctctg

SEQ ID NO: 5451147 - DNA, 17 bp, Homo sapiens
tctctccatctaccttc

SEQ ID NO: 5451148 - DNA, 15 bp, Homo sapiens
tctctcccaacgctg

SEQ ID NO: 5451149 - DNA, 22 bp, Homo sapiens
tctctcccaccccggcctccac

SEQ ID NO: 5451150 - DNA, 13 bp, Homo sapiens
tctctcccaccct

SEQ ID NO: 5451151 - DNA, 19 bp, Homo sapiens
tctctcccaccctaagggc

SEQ ID NO: 5451152 - DNA, 22 bp, Homo sapiens
tctctcccacgtgcacagcttc

SEQ ID NO: 5451153 - DNA, 12 bp, Homo sapiens
tctctcccagga

SEQ ID NO: 5451154 - DNA, 13 bp, Homo sapiens
tctctcccaggac

SEQ ID NO: 5451155 - DNA, 19 bp, Homo sapiens
tctctcccagtctacccag

SEQ ID NO: 5451156 - DNA, 19 bp, Homo sapiens
tctctcccatcctggggca

SEQ ID NO: 5451157 - DNA, 13 bp, Homo sapiens
tctctcccatgga

SEQ ID NO: 5451158 - DNA, 15 bp, Homo sapiens
tctctcccatggagc

SEQ ID NO: 5451159 - DNA, 16 bp, Homo sapiens
tctctccccagccccc

SEQ ID NO: 5451160 - DNA, 22 bp, Homo sapiens
tctctccccagccccctcccac

SEQ ID NO: 5451161 - DNA, 21 bp, Homo sapiens
tctctccccatatataaatta

SEQ ID NO: 5451162 - DNA, 23 bp, Homo sapiens
tctctccccatatataaattatt

SEQ ID NO: 5451163 - DNA, 19 bp, Homo sapiens
tctctccccctatttattg

SEQ ID NO: 5451164 - DNA, 16 bp, Homo sapiens
tctctccccctctgtc

SEQ ID NO: 5451165 - DNA, 17 bp, Homo sapiens
tctctccccctctgtct

SEQ ID NO: 5451166 - DNA, 20 bp, Homo sapiens
tctctcccctcaaagtctgc

SEQ ID NO: 5451167 - DNA, 21 bp, Homo sapiens
tctctcccctcaaagtctgca

SEQ ID NO: 5451168 - DNA, 16 bp, Homo sapiens
tctctcccctctgcaa

SEQ ID NO: 5451169 - DNA, 16 bp, Homo sapiens
tctctccccttttcct

SEQ ID NO: 5451170 - DNA, 23 bp, Homo sapiens
tctctccctaccctcttctcagc

SEQ ID NO: 5451171 - DNA, 13 bp, Homo sapiens
tctctccctacct

SEQ ID NO: 5451172 - DNA, 15 bp, Homo sapiens
tctctccctacctcc

SEQ ID NO: 5451173 - DNA, 23 bp, Homo sapiens
tctctccctacctccctcctcag

SEQ ID NO: 5451174 - DNA, 12 bp, Homo sapiens
tctctccctcca

SEQ ID NO: 5451175 - DNA, 21 bp, Homo sapiens
tctctccctccactcctccca

SEQ ID NO: 5451176 - DNA, 21 bp, Homo sapiens
tctctccctccctctctcatg

SEQ ID NO: 5451177 - DNA, 15 bp, Homo sapiens
tctctccctccttct

SEQ ID NO: 5451178 - DNA, 13 bp, Homo sapiens
tctctccctctgt

SEQ ID NO: 5451179 - DNA, 15 bp, Homo sapiens
tctctccctctgtct

SEQ ID NO: 5451180 - DNA, 15 bp, Homo sapiens
tctctccctctttct

SEQ ID NO: 5451181 - DNA, 16 bp, Homo sapiens
tctctccctctttcta

SEQ ID NO: 5451182 - DNA, 15 bp, Homo sapiens
tctctccctgccttt

SEQ ID NO: 5451183 - DNA, 16 bp, Homo sapiens
tctctccctggtctct

SEQ ID NO: 5451184 - DNA, 22 bp, Homo sapiens
tctctccctgtcacacactgga

SEQ ID NO: 5451185 - DNA, 19 bp, Homo sapiens
tctctccgacttcccctgg

SEQ ID NO: 5451186 - DNA, 17 bp, Homo sapiens
tctctccgccccggaca

SEQ ID NO: 5451187 - DNA, 24 bp, Homo sapiens
tctctccgccccggacagggtggc

SEQ ID NO: 5451188 - DNA, 12 bp, Homo sapiens
tctctcctagcc

SEQ ID NO: 5451189 - DNA, 14 bp, Homo sapiens
tctctcctagcccc

SEQ ID NO: 5451190 - DNA, 18 bp, Homo sapiens
tctctcctcaggaccctc

SEQ ID NO: 5451191 - DNA, 13 bp, Homo sapiens
tctctcctcccca

SEQ ID NO: 5451192 - DNA, 15 bp, Homo sapiens
tctctcctccctcct

SEQ ID NO: 5451193 - DNA, 11 bp, Homo sapiens
tctctcctctc

SEQ ID NO: 5451194 - DNA, 12 bp, Homo sapiens
tctctcctctcc

SEQ ID NO: 5451195 - DNA, 16 bp, Homo sapiens
tctctcctctctctcc

SEQ ID NO: 5451196 - DNA, 13 bp, Homo sapiens
tctctcctctctg

SEQ ID NO: 5451197 - DNA, 12 bp, Homo sapiens
tctctcctggac

SEQ ID NO: 5451198 - DNA, 13 bp, Homo sapiens
tctctcctggact

SEQ ID NO: 5451199 - DNA, 16 bp, Homo sapiens
tctctcctggctgggc

SEQ ID NO: 5451200 - DNA, 22 bp, Homo sapiens
tctctcctggtgtgggtaaagg

SEQ ID NO: 5451201 - DNA, 20 bp, Homo sapiens
tctctcctgtaagccaaaga

SEQ ID NO: 5451202 - DNA, 17 bp, Homo sapiens
tctctcctgtacctctt

SEQ ID NO: 5451203 - DNA, 22 bp, Homo sapiens
tctctcctgtacctcttgagcc

SEQ ID NO: 5451204 - DNA, 13 bp, Homo sapiens
tctctcctgtcca

SEQ ID NO: 5451205 - DNA, 15 bp, Homo sapiens
tctctcctgtcctcc

SEQ ID NO: 5451206 - DNA, 14 bp, Homo sapiens
tctctcctgtgtct

SEQ ID NO: 5451207 - DNA, 13 bp, Homo sapiens
tctctccttcctc

SEQ ID NO: 5451208 - DNA, 12 bp, Homo sapiens
tctctccttctg

SEQ ID NO: 5451209 - DNA, 13 bp, Homo sapiens
tctctccttgccc

SEQ ID NO: 5451210 - DNA, 23 bp, Homo sapiens
tctctccttggcctttcctggaa

SEQ ID NO: 5451211 - DNA, 19 bp, Homo sapiens
tctctccttgttgccccca

SEQ ID NO: 5451212 - DNA, 18 bp, Homo sapiens
tctctcctttctccctgc

SEQ ID NO: 5451213 - DNA, 11 bp, Homo sapiens
tctctcctttt

SEQ ID NO: 5451214 - DNA, 13 bp, Homo sapiens
tctctccttttct

SEQ ID NO: 5451215 - DNA, 17 bp, Homo sapiens
tctctcgaatactttga

SEQ ID NO: 5451216 - DNA, 18 bp, Homo sapiens
tctctcggcccctgtctg

SEQ ID NO: 5451217 - DNA, 15 bp, Homo sapiens
tctctcgggcccccc

SEQ ID NO: 5451218 - DNA, 15 bp, Homo sapiens
tctctcggttccacg

SEQ ID NO: 5451219 - DNA, 13 bp, Homo sapiens
tctctcgttaatt

SEQ ID NO: 5451220 - DNA, 17 bp, Homo sapiens
tctctctaacataacaa

SEQ ID NO: 5451221 - DNA, 17 bp, Homo sapiens
tctctctagctttgtca

SEQ ID NO: 5451222 - DNA, 13 bp, Homo sapiens
tctctgtgtggca

SEQ ID NO: 5451223 - DNA, 19 bp, Homo sapiens
tctctgtgtggcaaacatt

SEQ ID NO: 5451224 - DNA, 20 bp, Homo sapiens
tctctgtgtggcaaacattt

SEQ ID NO: 5451225 - DNA, 20 bp, Homo sapiens
tctctgtgtgtgtatgagag

SEQ ID NO: 5451226 - DNA, 20 bp, Homo sapiens
tctctgtgtttgttcctaca

SEQ ID NO: 5451227 - DNA, 22 bp, Homo sapiens
tctctgttacacactaacatca

SEQ ID NO: 5451228 - DNA, 19 bp, Homo sapiens
tctctgttcagatgtgcat

SEQ ID NO: 5451229 - DNA, 17 bp, Homo sapiens
tctctgttcatttcctc

SEQ ID NO: 5451230 - DNA, 21 bp, Homo sapiens
tctctgttccattgaatctgt

SEQ ID NO: 5451231 - DNA, 18 bp, Homo sapiens
tctctgttcccttcctca

SEQ ID NO: 5451232 - DNA, 11 bp, Homo sapiens
tctctgttcta

SEQ ID NO: 5451233 - DNA, 18 bp, Homo sapiens
tctctgttgactggctgt

SEQ ID NO: 5451234 - DNA, 22 bp, Homo sapiens
tctctgttggtccactgtgttt

SEQ ID NO: 5451235 - DNA, 15 bp, Homo sapiens
tctctgttggtctgc

SEQ ID NO: 5451236 - DNA, 15 bp, Homo sapiens
tctctgttgtaaata

SEQ ID NO: 5451237 - DNA, 21 bp, Homo sapiens
tctctgtttaccctccctgtc

SEQ ID NO: 5451238 - DNA, 15 bp, Homo sapiens
tctctgttttatgaa

SEQ ID NO: 5451239 - DNA, 21 bp, Homo sapiens
tctctgttttgtgccagtgct

SEQ ID NO: 5451240 - DNA, 19 bp, Homo sapiens
tctcttaaatattctgaat

SEQ ID NO: 5451241 - DNA, 13 bp, Homo sapiens
tctcttaagctgc

SEQ ID NO: 5451242 - DNA, 14 bp, Homo sapiens
tctcttaagctgcc

SEQ ID NO: 5451243 - DNA, 18 bp, Homo sapiens
tctcttaagctgcccaat

SEQ ID NO: 5451244 - DNA, 21 bp, Homo sapiens
tctcttaatattgagaatcag

SEQ ID NO: 5451245 - DNA, 18 bp, Homo sapiens
tctcttaatcactactgt

SEQ ID NO: 5451246 - DNA, 18 bp, Homo sapiens
tctcttaatgccacggca

SEQ ID NO: 5451247 - DNA, 17 bp, Homo sapiens
tctcttacatggccaca

SEQ ID NO: 5451248 - DNA, 21 bp, Homo sapiens
tctcttacccttctgtgccca

SEQ ID NO: 5451249 - DNA, 20 bp, Homo sapiens
tctcttaccgcgagactgag

SEQ ID NO: 5451250 - DNA, 15 bp, Homo sapiens
tctcttagaaatact

SEQ ID NO: 5451251 - DNA, 14 bp, Homo sapiens
tctcttagaagcca

SEQ ID NO: 5451252 - DNA, 22 bp, Homo sapiens
tctcttagaggttaatcagagt

SEQ ID NO: 5451253 - DNA, 11 bp, Homo sapiens
tctcttagatt

SEQ ID NO: 5451254 - DNA, 16 bp, Homo sapiens
tctcttagctactgta

SEQ ID NO: 5451255 - DNA, 20 bp, Homo sapiens
tctcttagctactgtatgca

SEQ ID NO: 5451256 - DNA, 17 bp, Homo sapiens
tctcttagctcccctcc

SEQ ID NO: 5451257 - DNA, 21 bp, Homo sapiens
tctcttaggaagccttttatt

SEQ ID NO: 5451258 - DNA, 18 bp, Homo sapiens
tctcttatagaatattta

SEQ ID NO: 5451259 - DNA, 16 bp, Homo sapiens
tctcttatggatgtcc

SEQ ID NO: 5451260 - DNA, 24 bp, Homo sapiens
tctcttatggtattatatctctgt

SEQ ID NO: 5451261 - DNA, 15 bp, Homo sapiens
tctcttattctaata

SEQ ID NO: 5451262 - DNA, 15 bp, Homo sapiens
tctcttattgcctca

SEQ ID NO: 5451263 - DNA, 22 bp, Homo sapiens
tctcttattgttctttcatatg

SEQ ID NO: 5451264 - DNA, 17 bp, Homo sapiens
tctcttcaagcatcctc

SEQ ID NO: 5451265 - DNA, 20 bp, Homo sapiens
tctcttcaagcatcctcaga

SEQ ID NO: 5451266 - DNA, 16 bp, Homo sapiens
tctcttcaataaacca

SEQ ID NO: 5451267 - DNA, 16 bp, Homo sapiens
tctcttcaatctctgg

SEQ ID NO: 5451268 - DNA, 18 bp, Homo sapiens
tctcttcacagtcacatt

SEQ ID NO: 5451269 - DNA, 16 bp, Homo sapiens
tctcttcactgctaca

SEQ ID NO: 5451270 - DNA, 19 bp, Homo sapiens
tctcttcagactctcagcc

SEQ ID NO: 5451271 - DNA, 19 bp, Homo sapiens
tctcttcagtgtgttgact

SEQ ID NO: 5451272 - DNA, 9 bp, Homo sapiens
tctcttcat

SEQ ID NO: 5451273 - DNA, 16 bp, Homo sapiens
tctcttcattcccact

SEQ ID NO: 5451274 - DNA, 15 bp, Homo sapiens
tctcttccacagtgg

SEQ ID NO: 5451275 - DNA, 21 bp, Homo sapiens
tctcttccagaagatgccctc

SEQ ID NO: 5451276 - DNA, 23 bp, Homo sapiens
tctcttccagaagatgccctcca

SEQ ID NO: 5451277 - DNA, 18 bp, Homo sapiens
tctcttccagcccagaca

SEQ ID NO: 5451278 - DNA, 18 bp, Homo sapiens
tctcttccaggcagccgc

SEQ ID NO: 5451279 - DNA, 18 bp, Homo sapiens
tctcttcccaggcctttg

SEQ ID NO: 5451280 - DNA, 17 bp, Homo sapiens
tctcttccccagagagg

SEQ ID NO: 5451281 - DNA, 14 bp, Homo sapiens
tctcttcccctctc

SEQ ID NO: 5451282 - DNA, 15 bp, Homo sapiens
tctcttcccctctca

SEQ ID NO: 5451283 - DNA, 19 bp, Homo sapiens
tctcttccccttagaaaca

SEQ ID NO: 5451284 - DNA, 16 bp, Homo sapiens
tctcttccccttcctg

SEQ ID NO: 5451285 - DNA, 15 bp, Homo sapiens
tctcttccctccttc

SEQ ID NO: 5451286 - DNA, 17 bp, Homo sapiens
tctcttcccttcccaga

SEQ ID NO: 5451287 - DNA, 18 bp, Homo sapiens
tctcttcccttcccagac

SEQ ID NO: 5451288 - DNA, 21 bp, Homo sapiens
tctcttcccttcccagaccag

SEQ ID NO: 5451289 - DNA, 13 bp, Homo sapiens
tctcttcctatcc

SEQ ID NO: 5451290 - DNA, 19 bp, Homo sapiens
tctcttcctccgaggccag

SEQ ID NO: 5451291 - DNA, 13 bp, Homo sapiens
tctcttcctctgt

SEQ ID NO: 5451292 - DNA, 22 bp, Homo sapiens
tctcttcctcttcccccaagat

SEQ ID NO: 5451293 - DNA, 13 bp, Homo sapiens
tctcttcctcttt

SEQ ID NO: 5451294 - DNA, 15 bp, Homo sapiens
tctcttcctgcccct

SEQ ID NO: 5451295 - DNA, 13 bp, Homo sapiens
tctcttcctgcct

SEQ ID NO: 5451296 - DNA, 11 bp, Homo sapiens
tctcttcctgt

SEQ ID NO: 5451297 - DNA, 12 bp, Homo sapiens
tctcttcctttc

SEQ ID NO: 5451298 - DNA, 20 bp, Homo sapiens
tctcttcctttgctctgagg

SEQ ID NO: 5451299 - DNA, 17 bp, Homo sapiens
tctcttctcagagtggt

SEQ ID NO: 5451300 - DNA, 13 bp, Homo sapiens
tctcttctccact

SEQ ID NO: 5451301 - DNA, 15 bp, Homo sapiens
tctcttctccactgg

SEQ ID NO: 5451302 - DNA, 21 bp, Homo sapiens
tctcttctccattccctagca

SEQ ID NO: 5451303 - DNA, 21 bp, Homo sapiens
tctcttctcccagaatcccag

SEQ ID NO: 5451304 - DNA, 14 bp, Homo sapiens
tctcttctcctgtg

SEQ ID NO: 5451305 - DNA, 13 bp, Homo sapiens
tctcttctcctta

SEQ ID NO: 5451306 - DNA, 18 bp, Homo sapiens
tctcttctctattcctga

SEQ ID NO: 5451307 - DNA, 12 bp, Homo sapiens
tctcttctctcc

SEQ ID NO: 5451308 - DNA, 14 bp, Homo sapiens
tctcttctctccag

SEQ ID NO: 5451309 - DNA, 19 bp, Homo sapiens
tctcttctctgcaatgctt

SEQ ID NO: 5451310 - DNA, 14 bp, Homo sapiens
tctcttctctgtta

SEQ ID NO: 5451311 - DNA, 22 bp, Homo sapiens
tctcttctgagctatttcatct

SEQ ID NO: 5451312 - DNA, 13 bp, Homo sapiens
tctcttctgctcc

SEQ ID NO: 5451313 - DNA, 17 bp, Homo sapiens
tctcttctgggcgtctg

SEQ ID NO: 5451314 - DNA, 19 bp, Homo sapiens
tctcttctgggttccttcc

SEQ ID NO: 5451315 - DNA, 20 bp, Homo sapiens
tctcttctgtccatcagtgc

SEQ ID NO: 5451316 - DNA, 13 bp, Homo sapiens
tctcttctgtgtt

SEQ ID NO: 5451317 - DNA, 13 bp, Homo sapiens
tctcttctgttct

SEQ ID NO: 5451318 - DNA, 14 bp, Homo sapiens
tctcttcttaatgt

SEQ ID NO: 5451319 - DNA, 11 bp, Homo sapiens
tctcttcttac

SEQ ID NO: 5451320 - DNA, 15 bp, Homo sapiens
tctcttcttgtttct

SEQ ID NO: 5451321 - DNA, 13 bp, Homo sapiens
tctcttctttaaa

SEQ ID NO: 5451322 - DNA, 23 bp, Homo sapiens
tctcttctttattgcactaggaa

SEQ ID NO: 5451323 - DNA, 23 bp, Homo sapiens
tctcttgaaaagttcagggaccg

SEQ ID NO: 5451324 - DNA, 16 bp, Homo sapiens
tctcttgaaccccaaa

SEQ ID NO: 5451325 - DNA, 20 bp, Homo sapiens
tctcttgaaggtgctgccac

SEQ ID NO: 5451326 - DNA, 21 bp, Homo sapiens
tctcttgaaggtgctgccacc

SEQ ID NO: 5451327 - DNA, 20 bp, Homo sapiens
tctcttgaattattttgcag

SEQ ID NO: 5451328 - DNA, 14 bp, Homo sapiens
tctcttgagagggt

SEQ ID NO: 5451329 - DNA, 21 bp, Homo sapiens
tctcttgagcatcaatcttgt

SEQ ID NO: 5451330 - DNA, 22 bp, Homo sapiens
tctcttgagcatcaatcttgtt

SEQ ID NO: 5451331 - DNA, 14 bp, Homo sapiens
tctcttgagcctgg

SEQ ID NO: 5451332 - DNA, 18 bp, Homo sapiens
tctcttgagcctgggagg

SEQ ID NO: 5451333 - DNA, 14 bp, Homo sapiens
tctcttgagctggc

SEQ ID NO: 5451334 - DNA, 14 bp, Homo sapiens
tctcttgaggcctg

SEQ ID NO: 5451335 - DNA, 17 bp, Homo sapiens
tctcttgaggcctgtgc

SEQ ID NO: 5451336 - DNA, 13 bp, Homo sapiens
tctcttgataaag

SEQ ID NO: 5451337 - DNA, 14 bp, Homo sapiens
tctcttgattcata

SEQ ID NO: 5451338 - DNA, 12 bp, Homo sapiens
tctcttgcaccc

SEQ ID NO: 5451339 - DNA, 14 bp, Homo sapiens
tctcttgcacccgc

SEQ ID NO: 5451340 - DNA, 17 bp, Homo sapiens
tctcttgcacccgcctc

SEQ ID NO: 5451341 - DNA, 22 bp, Homo sapiens
tctcttgcacccgcctctcccg

SEQ ID NO: 5451342 - DNA, 19 bp, Homo sapiens
tctcttgcataagcctcag

SEQ ID NO: 5451343 - DNA, 23 bp, Homo sapiens
tctcttgcataagcctcaggcct

SEQ ID NO: 5451344 - DNA, 13 bp, Homo sapiens
tctcttgcattgt

SEQ ID NO: 5451345 - DNA, 13 bp, Homo sapiens
tctcttgcccctt

SEQ ID NO: 5451346 - DNA, 22 bp, Homo sapiens
tctcttgcctaagtattccttt

SEQ ID NO: 5451347 - DNA, 22 bp, Homo sapiens
tctcttgcctcagcttccccag

SEQ ID NO: 5451348 - DNA, 12 bp, Homo sapiens
tctcttgccttt

SEQ ID NO: 5451349 - DNA, 22 bp, Homo sapiens
tctcttgctgtttaccgcccac

SEQ ID NO: 5451350 - DNA, 22 bp, Homo sapiens
tctcttggaattagatgtttat

SEQ ID NO: 5451351 - DNA, 16 bp, Homo sapiens
tctcttggacccacct

SEQ ID NO: 5451352 - DNA, 17 bp, Homo sapiens
tctcttggactccctcc

SEQ ID NO: 5451353 - DNA, 17 bp, Homo sapiens
tctcttggctctactcc

SEQ ID NO: 5451354 - DNA, 13 bp, Homo sapiens
tctcttggctgca

SEQ ID NO: 5451355 - DNA, 18 bp, Homo sapiens
tctcttggctggcttcct

SEQ ID NO: 5451356 - DNA, 23 bp, Homo sapiens
tctcttgggaagcagtttcagat

SEQ ID NO: 5451357 - DNA, 20 bp, Homo sapiens
tctcttgggagtcttgggtg

SEQ ID NO: 5451358 - DNA, 22 bp, Homo sapiens
tctcttgggagtcttgggtggc

SEQ ID NO: 5451359 - DNA, 14 bp, Homo sapiens
tctcttgggcaggc

SEQ ID NO: 5451360 - DNA, 20 bp, Homo sapiens
tctcttgggggccgggggga

SEQ ID NO: 5451361 - DNA, 20 bp, Homo sapiens
tctcttggtgttaaaacact

SEQ ID NO: 5451362 - DNA, 17 bp, Homo sapiens
tctcttggtttccttcc

SEQ ID NO: 5451363 - DNA, 13 bp, Homo sapiens
tctcttgtagaag

SEQ ID NO: 5451364 - DNA, 22 bp, Homo sapiens
tctcttgtataagatcctagat

SEQ ID NO: 5451365 - DNA, 16 bp, Homo sapiens
tctcttgtcatataaa

SEQ ID NO: 5451366 - DNA, 16 bp, Homo sapiens
tctcttgtctggctgc

SEQ ID NO: 5451367 - DNA, 22 bp, Homo sapiens
tctcttgtcttaaaatgggtat

SEQ ID NO: 5451368 - DNA, 19 bp, Homo sapiens
tctcttgtgacgtgcactg

SEQ ID NO: 5451369 - DNA, 20 bp, Homo sapiens
tctcttgtgacgtgcactgt

SEQ ID NO: 5451370 - DNA, 15 bp, Homo sapiens
tctcttgtgactcag

SEQ ID NO: 5451371 - DNA, 16 bp, Homo sapiens
tctcttgtttaaaaaa

SEQ ID NO: 5451372 - DNA, 16 bp, Homo sapiens
tctctttaaccctccc

SEQ ID NO: 5451373 - DNA, 23 bp, Homo sapiens
tctctttaactcaggactccagc

SEQ ID NO: 5451374 - DNA, 21 bp, Homo sapiens
tctctttaagggcatgccttg

SEQ ID NO: 5451375 - DNA, 22 bp, Homo sapiens
tctctttaatgtcacaggcagg

SEQ ID NO: 5451376 - DNA, 21 bp, Homo sapiens
tctctttaattttaactgatt

SEQ ID NO: 5451377 - DNA, 21 bp, Homo sapiens
tctctttaccttctaaaagcc

SEQ ID NO: 5451378 - DNA, 22 bp, Homo sapiens
tctctttacctttgccctacct

SEQ ID NO: 5451379 - DNA, 19 bp, Homo sapiens
tctctttatgtctgtggat

SEQ ID NO: 5451380 - DNA, 13 bp, Homo sapiens
tctctttattcct

SEQ ID NO: 5451381 - DNA, 16 bp, Homo sapiens
tctctttattttacta

SEQ ID NO: 5451382 - DNA, 12 bp, Homo sapiens
tctctttcagta

SEQ ID NO: 5451383 - DNA, 12 bp, Homo sapiens
tctctttcatct

SEQ ID NO: 5451384 - DNA, 12 bp, Homo sapiens
tctctttccatg

SEQ ID NO: 5451385 - DNA, 16 bp, Homo sapiens
tctctttccctggtcc

SEQ ID NO: 5451386 - DNA, 17 bp, Homo sapiens
tctctttccctggtccc

SEQ ID NO: 5451387 - DNA, 21 bp, Homo sapiens
tctctttcctacaagttaacc

SEQ ID NO: 5451388 - DNA, 23 bp, Homo sapiens
tctctttcctacaagttaaccag

SEQ ID NO: 5451389 - DNA, 13 bp, Homo sapiens
tctctttcctcat

SEQ ID NO: 5451390 - DNA, 12 bp, Homo sapiens
tctctttccttg

SEQ ID NO: 5451391 - DNA, 15 bp, Homo sapiens
tctctttccttgagc

SEQ ID NO: 5451392 - DNA, 22 bp, Homo sapiens
tctctttccttgagctgttgtg

SEQ ID NO: 5451393 - DNA, 18 bp, Homo sapiens
tctctttctcattagaga

SEQ ID NO: 5451394 - DNA, 16 bp, Homo sapiens
tctctttctctctcac

SEQ ID NO: 5451395 - DNA, 14 bp, Homo sapiens
tctctttctgtttc

SEQ ID NO: 5451396 - DNA, 21 bp, Homo sapiens
tctctttcttccactaccctc

SEQ ID NO: 5451397 - DNA, 15 bp, Homo sapiens
tctctttcttccttt

SEQ ID NO: 5451398 - DNA, 17 bp, Homo sapiens
tctctttcttcctttac

SEQ ID NO: 5451399 - DNA, 20 bp, Homo sapiens
tctctttcttcctttacttt

SEQ ID NO: 5451400 - DNA, 19 bp, Homo sapiens
tctgagggaaaccagagtc

SEQ ID NO: 5451401 - DNA, 22 bp, Homo sapiens
tctgagggaggaggccacctct

SEQ ID NO: 5451402 - DNA, 21 bp, Homo sapiens
tctgagggcactctctgccag

SEQ ID NO: 5451403 - DNA, 19 bp, Homo sapiens
tctgagggcttgtagttct

SEQ ID NO: 5451404 - DNA, 18 bp, Homo sapiens
tctgaggggaggcacctc

SEQ ID NO: 5451405 - DNA, 20 bp, Homo sapiens
tctgaggggaggcacctcca

SEQ ID NO: 5451406 - DNA, 23 bp, Homo sapiens
tctgaggggaggcacctccaggc

SEQ ID NO: 5451407 - DNA, 19 bp, Homo sapiens
tctgaggggcaactgagtc

SEQ ID NO: 5451408 - DNA, 21 bp, Homo sapiens
tctgaggggctaccaggaaag

SEQ ID NO: 5451409 - DNA, 22 bp, Homo sapiens
tctgaggggtgtccgagaggct

SEQ ID NO: 5451410 - DNA, 15 bp, Homo sapiens
tctgaggtaaaggtc

SEQ ID NO: 5451411 - DNA, 13 bp, Homo sapiens
tctgaggtcaata

SEQ ID NO: 5451412 - DNA, 16 bp, Homo sapiens
tctgaggtccctgtgt

SEQ ID NO: 5451413 - DNA, 15 bp, Homo sapiens
tctgaggtcctgagc

SEQ ID NO: 5451414 - DNA, 20 bp, Homo sapiens
tctgaggtcctgagcactgc

SEQ ID NO: 5451415 - DNA, 16 bp, Homo sapiens
tctgaggtgcactggg

SEQ ID NO: 5451416 - DNA, 20 bp, Homo sapiens
tctgagtaactggttgctgt

SEQ ID NO: 5451417 - DNA, 20 bp, Homo sapiens
tctgagtaattaataaagaa

SEQ ID NO: 5451418 - DNA, 14 bp, Homo sapiens
tctgagtagcttta

SEQ ID NO: 5451419 - DNA, 16 bp, Homo sapiens
tctgagtaggtctggg

SEQ ID NO: 5451420 - DNA, 14 bp, Homo sapiens
tctgagtagtggcc

SEQ ID NO: 5451421 - DNA, 15 bp, Homo sapiens
tctgagtagtggcca

SEQ ID NO: 5451422 - DNA, 15 bp, Homo sapiens
tctgagtcacaggtg

SEQ ID NO: 5451423 - DNA, 13 bp, Homo sapiens
tctgagtcagagg

SEQ ID NO: 5451424 - DNA, 15 bp, Homo sapiens
tctgagtccagctcc

SEQ ID NO: 5451425 - DNA, 13 bp, Homo sapiens
tctgagtcctgga

SEQ ID NO: 5451426 - DNA, 16 bp, Homo sapiens
tctgagtcctgtctct

SEQ ID NO: 5451427 - DNA, 15 bp, Homo sapiens
tctgagtctatgttc

SEQ ID NO: 5451428 - DNA, 22 bp, Homo sapiens
tctgagtctatgttcaaagact

SEQ ID NO: 5451429 - DNA, 14 bp, Homo sapiens
tctgagtctggact

SEQ ID NO: 5451430 - DNA, 17 bp, Homo sapiens
tctgagtctggactttg

SEQ ID NO: 5451431 - DNA, 13 bp, Homo sapiens
tctgagtgagttt

SEQ ID NO: 5451432 - DNA, 14 bp, Homo sapiens
tctgagtgcaaact

SEQ ID NO: 5451433 - DNA, 19 bp, Homo sapiens
tctgagtgccttctgtggg

SEQ ID NO: 5451434 - DNA, 22 bp, Homo sapiens
tctgagtgccttctgtggggac

SEQ ID NO: 5451435 - DNA, 22 bp, Homo sapiens
tctgagtggcttcactcctgct

SEQ ID NO: 5451436 - DNA, 14 bp, Homo sapiens
tctgagtgggcggc

SEQ ID NO: 5451437 - DNA, 16 bp, Homo sapiens
tctgagtggtggtctt

SEQ ID NO: 5451438 - DNA, 19 bp, Homo sapiens
tctgagtggtggttccttt

SEQ ID NO: 5451439 - DNA, 18 bp, Homo sapiens
tctgagtgtctctgcctg

SEQ ID NO: 5451440 - DNA, 19 bp, Homo sapiens
tctgagtgtctctgcctgg

SEQ ID NO: 5451441 - DNA, 23 bp, Homo sapiens
tctgagtgtctctgcctggagca

SEQ ID NO: 5451442 - DNA, 17 bp, Homo sapiens
tctgagttcctgcatgc

SEQ ID NO: 5451443 - DNA, 13 bp, Homo sapiens
tctgagttcttga

SEQ ID NO: 5451444 - DNA, 21 bp, Homo sapiens
tctgagtttaccatttgtaat

SEQ ID NO: 5451445 - DNA, 22 bp, Homo sapiens
tctgagtttaccatttgtaata

SEQ ID NO: 5451446 - DNA, 20 bp, Homo sapiens
tctgagtttcattctcctgc

SEQ ID NO: 5451447 - DNA, 20 bp, Homo sapiens
tctgagttttgtgtttgttg

SEQ ID NO: 5451448 - DNA, 15 bp, Homo sapiens
tctgataaaattgtg

SEQ ID NO: 5451449 - DNA, 15 bp, Homo sapiens
tctgataaacacaga

SEQ ID NO: 5451450 - DNA, 18 bp, Homo sapiens
tctgataaagttccttaa

SEQ ID NO: 5451451 - DNA, 19 bp, Homo sapiens
tctgataaagttccttaag

SEQ ID NO: 5451452 - DNA, 20 bp, Homo sapiens
tctgataactagatggtgct

SEQ ID NO: 5451453 - DNA, 19 bp, Homo sapiens
tctgataatatattttcaa

SEQ ID NO: 5451454 - DNA, 20 bp, Homo sapiens
tctgataatatattttcaag

SEQ ID NO: 5451455 - DNA, 15 bp, Homo sapiens
tctgataatgtattg

SEQ ID NO: 5451456 - DNA, 17 bp, Homo sapiens
tctgataatgtattgca

SEQ ID NO: 5451457 - DNA, 16 bp, Homo sapiens
tctgatacagaaaagt

SEQ ID NO: 5451458 - DNA, 17 bp, Homo sapiens
tctgatacagaaaagtt

SEQ ID NO: 5451459 - DNA, 16 bp, Homo sapiens
tctgatacccagagca

SEQ ID NO: 5451460 - DNA, 17 bp, Homo sapiens
tctgataccttcattta

SEQ ID NO: 5451461 - DNA, 15 bp, Homo sapiens
tctgatactgtatct

SEQ ID NO: 5451462 - DNA, 15 bp, Homo sapiens
tctgatactttagta

SEQ ID NO: 5451463 - DNA, 21 bp, Homo sapiens
tctgatagaaagcaagtgttt

SEQ ID NO: 5451464 - DNA, 18 bp, Homo sapiens
tctgatagctgtttcaaa

SEQ ID NO: 5451465 - DNA, 22 bp, Homo sapiens
tctgatagctgtttcaaatgtg

SEQ ID NO: 5451466 - DNA, 15 bp, Homo sapiens
tctgataggaaaaga

SEQ ID NO: 5451467 - DNA, 23 bp, Homo sapiens
tctgataggaatgtgaaagcacg

SEQ ID NO: 5451468 - DNA, 19 bp, Homo sapiens
tctgatagtagtctttaaa

SEQ ID NO: 5451469 - DNA, 18 bp, Homo sapiens
tctgatatcagcactgga

SEQ ID NO: 5451470 - DNA, 12 bp, Homo sapiens
tctgatatcagg

SEQ ID NO: 5451471 - DNA, 20 bp, Homo sapiens
tctgatatctatagtagaca

SEQ ID NO: 5451472 - DNA, 21 bp, Homo sapiens
tctgatatgtatccatcagga

SEQ ID NO: 5451473 - DNA, 13 bp, Homo sapiens
tctgatatgtgaa

SEQ ID NO: 5451474 - DNA, 20 bp, Homo sapiens
tctgatatgtgaatttgttt

SEQ ID NO: 5451475 - DNA, 14 bp, Homo sapiens
tctgatatgtttgt

SEQ ID NO: 5451476 - DNA, 19 bp, Homo sapiens
tctgatattaaagatttct

SEQ ID NO: 5451477 - DNA, 12 bp, Homo sapiens
tctgatattaat

SEQ ID NO: 5451478 - DNA, 15 bp, Homo sapiens
tctgatattaatcaa

SEQ ID NO: 5451479 - DNA, 22 bp, Homo sapiens
tctgatattaatttatcagatt

SEQ ID NO: 5451480 - DNA, 12 bp, Homo sapiens
tctgatattcac

SEQ ID NO: 5451481 - DNA, 17 bp, Homo sapiens
tctgatattccatgaat

SEQ ID NO: 5451482 - DNA, 17 bp, Homo sapiens
tctgatcacaacttttc

SEQ ID NO: 5451483 - DNA, 22 bp, Homo sapiens
tctgatcacattcttcaaagac

SEQ ID NO: 5451484 - DNA, 22 bp, Homo sapiens
tctgatcactgaaataaaagct

SEQ ID NO: 5451485 - DNA, 13 bp, Homo sapiens
tctgatcagaggt

SEQ ID NO: 5451486 - DNA, 20 bp, Homo sapiens
tctgatcagaggtgtacact

SEQ ID NO: 5451487 - DNA, 21 bp, Homo sapiens
tctgatccagttttgtttgga

SEQ ID NO: 5451488 - DNA, 20 bp, Homo sapiens
tctgatcccataaagaaagt

SEQ ID NO: 5451489 - DNA, 17 bp, Homo sapiens
tctgatcccatattctt

SEQ ID NO: 5451490 - DNA, 23 bp, Homo sapiens
tctgatccctcgcccccacaccc

SEQ ID NO: 5451491 - DNA, 21 bp, Homo sapiens
tctgatccctctacagagctt

SEQ ID NO: 5451492 - DNA, 23 bp, Homo sapiens
tctgatcctcagcccctccagtc

SEQ ID NO: 5451493 - DNA, 21 bp, Homo sapiens
tctgatcgggataacaaaatc

SEQ ID NO: 5451494 - DNA, 16 bp, Homo sapiens
tctgatcgtctcggcc

SEQ ID NO: 5451495 - DNA, 21 bp, Homo sapiens
tctgatcgtctcggcccctct

SEQ ID NO: 5451496 - DNA, 17 bp, Homo sapiens
tctgatcgttctttcta

SEQ ID NO: 5451497 - DNA, 15 bp, Homo sapiens
tctgatctaacaaaa

SEQ ID NO: 5451498 - DNA, 12 bp, Homo sapiens
tctgatctctgt

SEQ ID NO: 5451499 - DNA, 13 bp, Homo sapiens
tctgatctgggtt

SEQ ID NO: 5451500 - DNA, 23 bp, Homo sapiens
tctgatctgggttttgcctctgc

SEQ ID NO: 5451501 - DNA, 22 bp, Homo sapiens
tctgatctgtactttgtgttta

SEQ ID NO: 5451502 - DNA, 22 bp, Homo sapiens
tctgatctgtgctttccagctc

SEQ ID NO: 5451503 - DNA, 14 bp, Homo sapiens
tctgatcttcctca

SEQ ID NO: 5451504 - DNA, 20 bp, Homo sapiens
tctgatcttggaaaaacagc

SEQ ID NO: 5451505 - DNA, 15 bp, Homo sapiens
tctgatcttgtgctc

SEQ ID NO: 5451506 - DNA, 19 bp, Homo sapiens
tctgatcttgtgctcagca

SEQ ID NO: 5451507 - DNA, 17 bp, Homo sapiens
tctgatctttttataca

SEQ ID NO: 5451508 - DNA, 16 bp, Homo sapiens
tctgatgaagttgtac

SEQ ID NO: 5451509 - DNA, 13 bp, Homo sapiens
tctgatgaatctt

SEQ ID NO: 5451510 - DNA, 17 bp, Homo sapiens
tctgatgagaacaagct

SEQ ID NO: 5451511 - DNA, 11 bp, Homo sapiens
tctgatgatgt

SEQ ID NO: 5451512 - DNA, 12 bp, Homo sapiens
tctgatgatgtc

SEQ ID NO: 5451513 - DNA, 17 bp, Homo sapiens
tctgatgatgtcggtct

SEQ ID NO: 5451514 - DNA, 14 bp, Homo sapiens
tctgatgcagaact

SEQ ID NO: 5451515 - DNA, 16 bp, Homo sapiens
tctgatgcagcttata

SEQ ID NO: 5451516 - DNA, 17 bp, Homo sapiens
tctgatgcagcttatac

SEQ ID NO: 5451517 - DNA, 14 bp, Homo sapiens
tctgatgccaaagc

SEQ ID NO: 5451518 - DNA, 16 bp, Homo sapiens
tctgatggaactgtgt

SEQ ID NO: 5451519 - DNA, 22 bp, Homo sapiens
tctgatggaactgtgtatttat

SEQ ID NO: 5451520 - DNA, 22 bp, Homo sapiens
tctgatggaatgtgccacctgt

SEQ ID NO: 5451521 - DNA, 19 bp, Homo sapiens
tctgatggaccttctagaa

SEQ ID NO: 5451522 - DNA, 19 bp, Homo sapiens
tctgatggcacttttgagc

SEQ ID NO: 5451523 - DNA, 23 bp, Homo sapiens
tctgatggccttaatttcctttt

SEQ ID NO: 5451524 - DNA, 13 bp, Homo sapiens
tctgatggcttct

SEQ ID NO: 5451525 - DNA, 17 bp, Homo sapiens
tctgatgggcctggctg

SEQ ID NO: 5451526 - DNA, 23 bp, Homo sapiens
tctgatggtataaacaggagaca

SEQ ID NO: 5451527 - DNA, 12 bp, Homo sapiens
tctgatggtgag

SEQ ID NO: 5451528 - DNA, 16 bp, Homo sapiens
tctgatggtgagctgg

SEQ ID NO: 5451529 - DNA, 17 bp, Homo sapiens
tctgatggtgagctggg

SEQ ID NO: 5451530 - DNA, 16 bp, Homo sapiens
tctgatgtaaatgaag

SEQ ID NO: 5451531 - DNA, 18 bp, Homo sapiens
tctgatgtataatgtaat

SEQ ID NO: 5451532 - DNA, 14 bp, Homo sapiens
tctgatgtattaca

SEQ ID NO: 5451533 - DNA, 21 bp, Homo sapiens
tctgatgtattacatgactgt

SEQ ID NO: 5451534 - DNA, 21 bp, Homo sapiens
tctgatgtattttgtgagttt

SEQ ID NO: 5451535 - DNA, 13 bp, Homo sapiens
tctgatgtgtccc

SEQ ID NO: 5451536 - DNA, 17 bp, Homo sapiens
tctgatgtgtgcccaga

SEQ ID NO: 5451537 - DNA, 23 bp, Homo sapiens
tctgatgtttcctacaactaaaa

SEQ ID NO: 5451538 - DNA, 14 bp, Homo sapiens
tctgatgtttctgt

SEQ ID NO: 5451539 - DNA, 19 bp, Homo sapiens
tctgatgtttctgtgaaat

SEQ ID NO: 5451540 - DNA, 18 bp, Homo sapiens
tctgatgtttgttgctag

SEQ ID NO: 5451541 - DNA, 13 bp, Homo sapiens
tctgatgttttat

SEQ ID NO: 5451542 - DNA, 16 bp, Homo sapiens
tctgattaaaacaact

SEQ ID NO: 5451543 - DNA, 15 bp, Homo sapiens
tctgattaatccatt

SEQ ID NO: 5451544 - DNA, 18 bp, Homo sapiens
tctgattacacaaaacaa

SEQ ID NO: 5451545 - DNA, 14 bp, Homo sapiens
tctgattactgtcc

SEQ ID NO: 5451546 - DNA, 15 bp, Homo sapiens
tctgattagctttgt

SEQ ID NO: 5451547 - DNA, 16 bp, Homo sapiens
tctgattagctttgtg

SEQ ID NO: 5451548 - DNA, 21 bp, Homo sapiens
tctgattagctttgtgtttgg

SEQ ID NO: 5451549 - DNA, 21 bp, Homo sapiens
tctgattagttgacagtatta

SEQ ID NO: 5451550 - DNA, 22 bp, Homo sapiens
tctgattatacaccatttttga

SEQ ID NO: 5451551 - DNA, 19 bp, Homo sapiens
tctgattcacctcttcctc

SEQ ID NO: 5451552 - DNA, 19 bp, Homo sapiens
tctgattcagcatcactaa

SEQ ID NO: 5451553 - DNA, 11 bp, Homo sapiens
tctgattccac

SEQ ID NO: 5451554 - DNA, 13 bp, Homo sapiens
tctgattccatat

SEQ ID NO: 5451555 - DNA, 19 bp, Homo sapiens
tctgattccctgatttaat

SEQ ID NO: 5451556 - DNA, 20 bp, Homo sapiens
tctgattcgaatgacactgt

SEQ ID NO: 5451557 - DNA, 22 bp, Homo sapiens
tctgattctatgcctgtatttc

SEQ ID NO: 5451558 - DNA, 20 bp, Homo sapiens
tctgattctctttaactgtg

SEQ ID NO: 5451559 - DNA, 12 bp, Homo sapiens
tctgattcttct

SEQ ID NO: 5451560 - DNA, 20 bp, Homo sapiens
tctgattcttctaaattaaa

SEQ ID NO: 5451561 - DNA, 19 bp, Homo sapiens
tctgattgaaacatgaaac

SEQ ID NO: 5451562 - DNA, 19 bp, Homo sapiens
tctgattgcattaagtgaa

SEQ ID NO: 5451563 - DNA, 21 bp, Homo sapiens
tctgattggaatttctggcct

SEQ ID NO: 5451564 - DNA, 16 bp, Homo sapiens
tctgattggacatttt

SEQ ID NO: 5451565 - DNA, 19 bp, Homo sapiens
tctgattggacctggccca

SEQ ID NO: 5451566 - DNA, 16 bp, Homo sapiens
tctgattggcagatga

SEQ ID NO: 5451567 - DNA, 11 bp, Homo sapiens
tctgattggct

SEQ ID NO: 5451568 - DNA, 13 bp, Homo sapiens
tctgattggctca

SEQ ID NO: 5451569 - DNA, 17 bp, Homo sapiens
tctgattggctcaccca

SEQ ID NO: 5451570 - DNA, 14 bp, Homo sapiens
tctgattggctgct

SEQ ID NO: 5451571 - DNA, 16 bp, Homo sapiens
tctgattggctgctta

SEQ ID NO: 5451572 - DNA, 19 bp, Homo sapiens
tctgattgtgttgaagaag

SEQ ID NO: 5451573 - DNA, 23 bp, Homo sapiens
tctgattgttcccgatggtctct

SEQ ID NO: 5451574 - DNA, 14 bp, Homo sapiens
tctgatttaatgtt

SEQ ID NO: 5451575 - DNA, 16 bp, Homo sapiens
tctgatttaatgtttt

SEQ ID NO: 5451576 - DNA, 17 bp, Homo sapiens
tctgatttaatgttttc

SEQ ID NO: 5451577 - DNA, 22 bp, Homo sapiens
tctgcggagcacactggctcac

SEQ ID NO: 5451578 - DNA, 15 bp, Homo sapiens
tctgcggccactgcg

SEQ ID NO: 5451579 - DNA, 15 bp, Homo sapiens
tctgcggccttccac

SEQ ID NO: 5451580 - DNA, 18 bp, Homo sapiens
tctgcgggaggctggggc

SEQ ID NO: 5451581 - DNA, 18 bp, Homo sapiens
tctgcgggctccctcctc

SEQ ID NO: 5451582 - DNA, 17 bp, Homo sapiens
tctgcggggcagggcct

SEQ ID NO: 5451583 - DNA, 14 bp, Homo sapiens
tctgcggggcttct

SEQ ID NO: 5451584 - DNA, 16 bp, Homo sapiens
tctgcgtccaccaggc

SEQ ID NO: 5451585 - DNA, 22 bp, Homo sapiens
tctgcgtccaccaggcctcact

SEQ ID NO: 5451586 - DNA, 15 bp, Homo sapiens
tctgcgtcccccagc

SEQ ID NO: 5451587 - DNA, 16 bp, Homo sapiens
tctgcgtcccccagcc

SEQ ID NO: 5451588 - DNA, 21 bp, Homo sapiens
tctgcgtcccccagccctcag

SEQ ID NO: 5451589 - DNA, 20 bp, Homo sapiens
tctgcgtcggtcctggtgcc

SEQ ID NO: 5451590 - DNA, 22 bp, Homo sapiens
tctgcgtgactattttttaata

SEQ ID NO: 5451591 - DNA, 19 bp, Homo sapiens
tctgcgtgctttatttatg

SEQ ID NO: 5451592 - DNA, 23 bp, Homo sapiens
tctgcgtgtgatttgtctctgag

SEQ ID NO: 5451593 - DNA, 15 bp, Homo sapiens
tctgcgttacaacag

SEQ ID NO: 5451594 - DNA, 20 bp, Homo sapiens
tctgctaaattgatgttgat

SEQ ID NO: 5451595 - DNA, 20 bp, Homo sapiens
tctgctaaccatttatataa

SEQ ID NO: 5451596 - DNA, 22 bp, Homo sapiens
tctgctaacttggagccccagt

SEQ ID NO: 5451597 - DNA, 22 bp, Homo sapiens
tctgctaagctcaaggcgtgag

SEQ ID NO: 5451598 - DNA, 16 bp, Homo sapiens
tctgctaagttctccc

SEQ ID NO: 5451599 - DNA, 14 bp, Homo sapiens
tctgctaatgtaaa

SEQ ID NO: 5451600 - DNA, 18 bp, Homo sapiens
tctgctacccactgccag

SEQ ID NO: 5451601 - DNA, 19 bp, Homo sapiens
tctgctacctggttttcat

SEQ ID NO: 5451602 - DNA, 20 bp, Homo sapiens
tctgctacctggttttcatt

SEQ ID NO: 5451603 - DNA, 17 bp, Homo sapiens
tctgctaccttgcccca

SEQ ID NO: 5451604 - DNA, 21 bp, Homo sapiens
tctgctacgttcctattgtca

SEQ ID NO: 5451605 - DNA, 16 bp, Homo sapiens
tctgctactttgctgc

SEQ ID NO: 5451606 - DNA, 14 bp, Homo sapiens
tctgctagaaagtt

SEQ ID NO: 5451607 - DNA, 16 bp, Homo sapiens
tctgctagactcctca

SEQ ID NO: 5451608 - DNA, 17 bp, Homo sapiens
tctgctagactcctcag

SEQ ID NO: 5451609 - DNA, 23 bp, Homo sapiens
tctgctagactcctcaggagaga

SEQ ID NO: 5451610 - DNA, 16 bp, Homo sapiens
tctgctagatttctac

SEQ ID NO: 5451611 - DNA, 15 bp, Homo sapiens
tctgctagtagtgtt

SEQ ID NO: 5451612 - DNA, 15 bp, Homo sapiens
tctgctataaacttt

SEQ ID NO: 5451613 - DNA, 14 bp, Homo sapiens
tctgctatatataa

SEQ ID NO: 5451614 - DNA, 16 bp, Homo sapiens
tctgctatatataaaa

SEQ ID NO: 5451615 - DNA, 15 bp, Homo sapiens
tctgctatgcatttt

SEQ ID NO: 5451616 - DNA, 15 bp, Homo sapiens
tctgctatgcttgaa

SEQ ID NO: 5451617 - DNA, 16 bp, Homo sapiens
tctgctatgtctgtga

SEQ ID NO: 5451618 - DNA, 17 bp, Homo sapiens
tctgctatgtctgtgat

SEQ ID NO: 5451619 - DNA, 16 bp, Homo sapiens
tctgctcacatatctg

SEQ ID NO: 5451620 - DNA, 15 bp, Homo sapiens
tctgctcaccgccca

SEQ ID NO: 5451621 - DNA, 20 bp, Homo sapiens
tctgctcaccgcccatcagg

SEQ ID NO: 5451622 - DNA, 13 bp, Homo sapiens
tctgctcacttta

SEQ ID NO: 5451623 - DNA, 19 bp, Homo sapiens
tctgctcagaggccttgct

SEQ ID NO: 5451624 - DNA, 12 bp, Homo sapiens
tctgctcagcca

SEQ ID NO: 5451625 - DNA, 13 bp, Homo sapiens
tctgctcagccaa

SEQ ID NO: 5451626 - DNA, 15 bp, Homo sapiens
tctgctcagccaagc

SEQ ID NO: 5451627 - DNA, 23 bp, Homo sapiens
tctgctcagctgcgcccccttct

SEQ ID NO: 5451628 - DNA, 14 bp, Homo sapiens
tctgctcagtgatc

SEQ ID NO: 5451629 - DNA, 23 bp, Homo sapiens
tctgctcataggacctgcatcct

SEQ ID NO: 5451630 - DNA, 12 bp, Homo sapiens
tctgctcatcat

SEQ ID NO: 5451631 - DNA, 14 bp, Homo sapiens
tctgctcatcattc

SEQ ID NO: 5451632 - DNA, 18 bp, Homo sapiens
tctgctcatcattctctg

SEQ ID NO: 5451633 - DNA, 17 bp, Homo sapiens
tctgctcatgggtggct

SEQ ID NO: 5451634 - DNA, 13 bp, Homo sapiens
tctgctcattttg

SEQ ID NO: 5451635 - DNA, 22 bp, Homo sapiens
tctgctcattttgacaaagtgc

SEQ ID NO: 5451636 - DNA, 15 bp, Homo sapiens
tctgctccaaaggaa

SEQ ID NO: 5451637 - DNA, 17 bp, Homo sapiens
tctgctccaaattttca

SEQ ID NO: 5451638 - DNA, 23 bp, Homo sapiens
tctgctccaacagacaccctcca

SEQ ID NO: 5451639 - DNA, 14 bp, Homo sapiens
tctgctccaccaca

SEQ ID NO: 5451640 - DNA, 20 bp, Homo sapiens
tctgctccaccacatcctcc

SEQ ID NO: 5451641 - DNA, 18 bp, Homo sapiens
tctgctccacccttggcc

SEQ ID NO: 5451642 - DNA, 23 bp, Homo sapiens
tctgctccacccttggcctgtct

SEQ ID NO: 5451643 - DNA, 22 bp, Homo sapiens
tctgctccagactcacttgcca

SEQ ID NO: 5451644 - DNA, 13 bp, Homo sapiens
tctgctccagaga

SEQ ID NO: 5451645 - DNA, 12 bp, Homo sapiens
tctgctccagca

SEQ ID NO: 5451646 - DNA, 15 bp, Homo sapiens
tctgctccagctctg

SEQ ID NO: 5451647 - DNA, 16 bp, Homo sapiens
tctgctccataccttt

SEQ ID NO: 5451648 - DNA, 20 bp, Homo sapiens
tctgctccatagacatcagt

SEQ ID NO: 5451649 - DNA, 18 bp, Homo sapiens
tctgctccatgcagatct

SEQ ID NO: 5451650 - DNA, 23 bp, Homo sapiens
tctgctcccaaggggcctgagca

SEQ ID NO: 5451651 - DNA, 13 bp, Homo sapiens
tctgctcccagcc

SEQ ID NO: 5451652 - DNA, 13 bp, Homo sapiens
tctgctccctctg

SEQ ID NO: 5451653 - DNA, 16 bp, Homo sapiens
tctgctccggggtggt

SEQ ID NO: 5451654 - DNA, 18 bp, Homo sapiens
tctgctccgtgtgtctca

SEQ ID NO: 5451655 - DNA, 21 bp, Homo sapiens
tctgctccgtgtgtctcatgc

SEQ ID NO: 5451656 - DNA, 21 bp, Homo sapiens
tctgctcctcacccccacccc

SEQ ID NO: 5451657 - DNA, 13 bp, Homo sapiens
tctgctcctctcc

SEQ ID NO: 5451658 - DNA, 14 bp, Homo sapiens
tctgctcctctcca

SEQ ID NO: 5451659 - DNA, 15 bp, Homo sapiens
tctgctcctctccag

SEQ ID NO: 5451660 - DNA, 16 bp, Homo sapiens
tctgctcctctccagg

SEQ ID NO: 5451661 - DNA, 13 bp, Homo sapiens
tctgctcctcttg

SEQ ID NO: 5451662 - DNA, 21 bp, Homo sapiens
tctgctcctgaaaaatgactg

SEQ ID NO: 5451663 - DNA, 22 bp, Homo sapiens
tctgctcctgaaccagtcctgc

SEQ ID NO: 5451664 - DNA, 12 bp, Homo sapiens
tctgctcctgct

SEQ ID NO: 5451665 - DNA, 19 bp, Homo sapiens
tctgctcctgcttttctgt

SEQ ID NO: 5451666 - DNA, 23 bp, Homo sapiens
tctgctcctgcttttctgtcctg

SEQ ID NO: 5451667 - DNA, 19 bp, Homo sapiens
tctgctccttcactgttcc

SEQ ID NO: 5451668 - DNA, 23 bp, Homo sapiens
tctgctccttcactgttccctct

SEQ ID NO: 5451669 - DNA, 13 bp, Homo sapiens
tctgctccttcct

SEQ ID NO: 5451670 - DNA, 14 bp, Homo sapiens
tctgctcggccgtc

SEQ ID NO: 5451671 - DNA, 23 bp, Homo sapiens
tctgctcggcttcttggaccttg

SEQ ID NO: 5451672 - DNA, 15 bp, Homo sapiens
tctgctctaaataaa

SEQ ID NO: 5451673 - DNA, 20 bp, Homo sapiens
tctgctctaagaagctgcaa

SEQ ID NO: 5451674 - DNA, 22 bp, Homo sapiens
tctgctctaagaagctgcaata

SEQ ID NO: 5451675 - DNA, 19 bp, Homo sapiens
tctgctctagattcataaa

SEQ ID NO: 5451676 - DNA, 21 bp, Homo sapiens
tctgctctagattcataaata

SEQ ID NO: 5451677 - DNA, 12 bp, Homo sapiens
tctgctctagcc

SEQ ID NO: 5451678 - DNA, 13 bp, Homo sapiens
tctgctctagcca

SEQ ID NO: 5451679 - DNA, 14 bp, Homo sapiens
tctgctctagccag

SEQ ID NO: 5451680 - DNA, 20 bp, Homo sapiens
tctgctctagggaatctgga

SEQ ID NO: 5451681 - DNA, 15 bp, Homo sapiens
tctgctctccttcct

SEQ ID NO: 5451682 - DNA, 20 bp, Homo sapiens
tctgctctccttcctggagc

SEQ ID NO: 5451683 - DNA, 13 bp, Homo sapiens
tctgctctgcata

SEQ ID NO: 5451684 - DNA, 12 bp, Homo sapiens
tctgctctgcca

SEQ ID NO: 5451685 - DNA, 13 bp, Homo sapiens
tctgctctgccat

SEQ ID NO: 5451686 - DNA, 14 bp, Homo sapiens
tctgctctgccatc

SEQ ID NO: 5451687 - DNA, 18 bp, Homo sapiens
tctgctctgccatcttca

SEQ ID NO: 5451688 - DNA, 14 bp, Homo sapiens
tctgctctgcccat

SEQ ID NO: 5451689 - DNA, 19 bp, Homo sapiens
tctgctctgcccatgccta

SEQ ID NO: 5451690 - DNA, 14 bp, Homo sapiens
tctgctctgccctt

SEQ ID NO: 5451691 - DNA, 14 bp, Homo sapiens
tctgctctgcctgg

SEQ ID NO: 5451692 - DNA, 16 bp, Homo sapiens
tctgctctgcgtgtca

SEQ ID NO: 5451693 - DNA, 18 bp, Homo sapiens
tctgctctgctgctctga

SEQ ID NO: 5451694 - DNA, 21 bp, Homo sapiens
tctgctctgtccaattccaga

SEQ ID NO: 5451695 - DNA, 18 bp, Homo sapiens
tctgctctgtgcactcac

SEQ ID NO: 5451696 - DNA, 16 bp, Homo sapiens
tctgctcttttcctgg

SEQ ID NO: 5451697 - DNA, 14 bp, Homo sapiens
tctgctgaaagact

SEQ ID NO: 5451698 - DNA, 12 bp, Homo sapiens
tctgctgaacaa

SEQ ID NO: 5451699 - DNA, 16 bp, Homo sapiens
tctgctgaaggacaga

SEQ ID NO: 5451700 - DNA, 16 bp, Homo sapiens
tctgctgaatgtaaaa

SEQ ID NO: 5451701 - DNA, 20 bp, Homo sapiens
tctgctgacagacacaggcc

SEQ ID NO: 5451702 - DNA, 21 bp, Homo sapiens
tctgctgacagacacaggccc

SEQ ID NO: 5451703 - DNA, 11 bp, Homo sapiens
tctgctgacct

SEQ ID NO: 5451704 - DNA, 19 bp, Homo sapiens
tctgctgacctgctgacct

SEQ ID NO: 5451705 - DNA, 20 bp, Homo sapiens
tctgctgacctgctgacctg

SEQ ID NO: 5451706 - DNA, 20 bp, Homo sapiens
tctgctgactgtttcattca

SEQ ID NO: 5451707 - DNA, 20 bp, Homo sapiens
tctgctgagcagcccagcac

SEQ ID NO: 5451708 - DNA, 14 bp, Homo sapiens
tctgctgagctggg

SEQ ID NO: 5451709 - DNA, 23 bp, Homo sapiens
tctgctgagctgggcccagcccc

SEQ ID NO: 5451710 - DNA, 13 bp, Homo sapiens
tctgctgaggcca

SEQ ID NO: 5451711 - DNA, 22 bp, Homo sapiens
tctgctgaggccagaggaaggg

SEQ ID NO: 5451712 - DNA, 16 bp, Homo sapiens
tctgctgagggtccag

SEQ ID NO: 5451713 - DNA, 16 bp, Homo sapiens
tctgctgagtgctggg

SEQ ID NO: 5451714 - DNA, 22 bp, Homo sapiens
tctgctgagttggcctggccat

SEQ ID NO: 5451715 - DNA, 13 bp, Homo sapiens
tctgctgatataa

SEQ ID NO: 5451716 - DNA, 18 bp, Homo sapiens
tctgctgatataatatca

SEQ ID NO: 5451717 - DNA, 22 bp, Homo sapiens
tctgctgcacatagcagactag

SEQ ID NO: 5451718 - DNA, 15 bp, Homo sapiens
tctgctgcagagcag

SEQ ID NO: 5451719 - DNA, 22 bp, Homo sapiens
tctgctgcagagcagtaaggga

SEQ ID NO: 5451720 - DNA, 19 bp, Homo sapiens
tctgctgcagttaccacag

SEQ ID NO: 5451721 - DNA, 12 bp, Homo sapiens
tctgctgcatcg

SEQ ID NO: 5451722 - DNA, 12 bp, Homo sapiens
tctgctgccagc

SEQ ID NO: 5451723 - DNA, 12 bp, Homo sapiens
tctgctgcccac

SEQ ID NO: 5451724 - DNA, 13 bp, Homo sapiens
tctgctgcccacg

SEQ ID NO: 5451725 - DNA, 12 bp, Homo sapiens
tctgctgcccag

SEQ ID NO: 5451726 - DNA, 14 bp, Homo sapiens
tctgctgcccaggc

SEQ ID NO: 5451727 - DNA, 16 bp, Homo sapiens
tctgctgcccaggcca

SEQ ID NO: 5451728 - DNA, 13 bp, Homo sapiens
tctgctgccccca

SEQ ID NO: 5451729 - DNA, 13 bp, Homo sapiens
tctgctgccccct

SEQ ID NO: 5451730 - DNA, 15 bp, Homo sapiens
tctgctgcccccttc

SEQ ID NO: 5451731 - DNA, 13 bp, Homo sapiens
tctgctgcccctg

SEQ ID NO: 5451732 - DNA, 13 bp, Homo sapiens
tctgctgccctcc

SEQ ID NO: 5451733 - DNA, 21 bp, Homo sapiens
tctgctgccgccccacccaga

SEQ ID NO: 5451734 - DNA, 18 bp, Homo sapiens
tctgctgccgcccttcct

SEQ ID NO: 5451735 - DNA, 20 bp, Homo sapiens
tctgctgccgcccttcctgg

SEQ ID NO: 5451736 - DNA, 21 bp, Homo sapiens
tctgctgcctctgaaaatatt

SEQ ID NO: 5451737 - DNA, 16 bp, Homo sapiens
tctgctgcctctgtgg

SEQ ID NO: 5451738 - DNA, 17 bp, Homo sapiens
tctgctgcctctgtgga

SEQ ID NO: 5451739 - DNA, 23 bp, Homo sapiens
tctgctgcctgcccgcacagcag

SEQ ID NO: 5451740 - DNA, 15 bp, Homo sapiens
tctgctgcctgtaca

SEQ ID NO: 5451741 - DNA, 21 bp, Homo sapiens
tctgctgcctgtttggggagg

SEQ ID NO: 5451742 - DNA, 18 bp, Homo sapiens
tctgctgctgtccctccc

SEQ ID NO: 5451743 - DNA, 12 bp, Homo sapiens
tctgctgcttga

SEQ ID NO: 5451744 - DNA, 19 bp, Homo sapiens
tctgctggaaggggcagca

SEQ ID NO: 5451745 - DNA, 21 bp, Homo sapiens
tctgctggagaaagccacgcc

SEQ ID NO: 5451746 - DNA, 12 bp, Homo sapiens
tctgctggagga

SEQ ID NO: 5451747 - DNA, 13 bp, Homo sapiens
tctgctggatatt

SEQ ID NO: 5451748 - DNA, 21 bp, Homo sapiens
tctgctggattctaaattatg

SEQ ID NO: 5451749 - DNA, 22 bp, Homo sapiens
tctgctggcaggattcttcccg

SEQ ID NO: 5451750 - DNA, 12 bp, Homo sapiens
tctgctggccca

SEQ ID NO: 5451751 - DNA, 23 bp, Homo sapiens
tctgctggccgggcacagctgtg

SEQ ID NO: 5451752 - DNA, 13 bp, Homo sapiens
tctgctggcctct

SEQ ID NO: 5451753 - DNA, 14 bp, Homo sapiens
tctgctggcctgga

SEQ ID NO: 5451754 - DNA, 18 bp, Homo sapiens
tctgctggcctggatctc

SEQ ID NO: 5451755 - DNA, 16 bp, Homo sapiens
tctgctggctgatggg

SEQ ID NO: 5451756 - DNA, 15 bp, Homo sapiens
tctgggagtcacaca

SEQ ID NO: 5451757 - DNA, 18 bp, Homo sapiens
tctgggagtcacacagtg

SEQ ID NO: 5451758 - DNA, 17 bp, Homo sapiens
tctgggagtcaggcccg

SEQ ID NO: 5451759 - DNA, 16 bp, Homo sapiens
tctgggagtccccttt

SEQ ID NO: 5451760 - DNA, 17 bp, Homo sapiens
tctgggagtgttctgtt

SEQ ID NO: 5451761 - DNA, 19 bp, Homo sapiens
tctgggagttgctgttaat

SEQ ID NO: 5451762 - DNA, 18 bp, Homo sapiens
tctgggataagtaagttt

SEQ ID NO: 5451763 - DNA, 15 bp, Homo sapiens
tctgggatctgccaa

SEQ ID NO: 5451764 - DNA, 22 bp, Homo sapiens
tctgggatctgttttctggaag

SEQ ID NO: 5451765 - DNA, 23 bp, Homo sapiens
tctgggatgtagaacttcaagaa

SEQ ID NO: 5451766 - DNA, 15 bp, Homo sapiens
tctgggatgtcacag

SEQ ID NO: 5451767 - DNA, 22 bp, Homo sapiens
tctgggattactgacttttctt

SEQ ID NO: 5451768 - DNA, 16 bp, Homo sapiens
tctgggattattcttt

SEQ ID NO: 5451769 - DNA, 13 bp, Homo sapiens
tctgggcaagggc

SEQ ID NO: 5451770 - DNA, 14 bp, Homo sapiens
tctgggcaagggct

SEQ ID NO: 5451771 - DNA, 16 bp, Homo sapiens
tctgggcaagggctcc

SEQ ID NO: 5451772 - DNA, 17 bp, Homo sapiens
tctgggcacaagcaggg

SEQ ID NO: 5451773 - DNA, 14 bp, Homo sapiens
tctgggcacagtgc

SEQ ID NO: 5451774 - DNA, 15 bp, Homo sapiens
tctgggcacagtggg

SEQ ID NO: 5451775 - DNA, 16 bp, Homo sapiens
tctgggcacagtgggc

SEQ ID NO: 5451776 - DNA, 18 bp, Homo sapiens
tctgggcaccacaaaata

SEQ ID NO: 5451777 - DNA, 13 bp, Homo sapiens
tctgggcagacat

SEQ ID NO: 5451778 - DNA, 16 bp, Homo sapiens
tctgggcagacattat

SEQ ID NO: 5451779 - DNA, 19 bp, Homo sapiens
tctgggcagagcctgtccc

SEQ ID NO: 5451780 - DNA, 14 bp, Homo sapiens
tctgggcagcacct

SEQ ID NO: 5451781 - DNA, 20 bp, Homo sapiens
tctgggcagcacctctggtc

SEQ ID NO: 5451782 - DNA, 19 bp, Homo sapiens
tctgggcagcctgctttgg

SEQ ID NO: 5451783 - DNA, 23 bp, Homo sapiens
tctgggcagctaaaagcatccct

SEQ ID NO: 5451784 - DNA, 21 bp, Homo sapiens
tctgggcaggactcagctccc

SEQ ID NO: 5451785 - DNA, 23 bp, Homo sapiens
tctgggcagtaaatccacagcca

SEQ ID NO: 5451786 - DNA, 18 bp, Homo sapiens
tctgggcagtgccacagc

SEQ ID NO: 5451787 - DNA, 19 bp, Homo sapiens
tctgggcatggtggcacac

SEQ ID NO: 5451788 - DNA, 18 bp, Homo sapiens
tctgggccaagtcaaaga

SEQ ID NO: 5451789 - DNA, 19 bp, Homo sapiens
tctgggccagaagtcctcc

SEQ ID NO: 5451790 - DNA, 20 bp, Homo sapiens
tctgggccagatgctgggca

SEQ ID NO: 5451791 - DNA, 20 bp, Homo sapiens
tctgggccctgtcgcccctc

SEQ ID NO: 5451792 - DNA, 12 bp, Homo sapiens
tctgggcctctg

SEQ ID NO: 5451793 - DNA, 14 bp, Homo sapiens
tctgggcctctgaa

SEQ ID NO: 5451794 - DNA, 12 bp, Homo sapiens
tctgggcctggg

SEQ ID NO: 5451795 - DNA, 13 bp, Homo sapiens
tctgggcctgggc

SEQ ID NO: 5451796 - DNA, 15 bp, Homo sapiens
tctgggccttggcct

SEQ ID NO: 5451797 - DNA, 18 bp, Homo sapiens
tctgggccttggcctgga

SEQ ID NO: 5451798 - DNA, 21 bp, Homo sapiens
tctgggccttggcctggagca

SEQ ID NO: 5451799 - DNA, 17 bp, Homo sapiens
tctgggcgtctgagctg

SEQ ID NO: 5451800 - DNA, 19 bp, Homo sapiens
tctgggctaggtagaaaaa

SEQ ID NO: 5451801 - DNA, 13 bp, Homo sapiens
tctgggctcacac

SEQ ID NO: 5451802 - DNA, 14 bp, Homo sapiens
tctgggctcaggga

SEQ ID NO: 5451803 - DNA, 17 bp, Homo sapiens
tctgggctcagggctgg

SEQ ID NO: 5451804 - DNA, 13 bp, Homo sapiens
tctgggctccaga

SEQ ID NO: 5451805 - DNA, 21 bp, Homo sapiens
tctgggctcctggaaccaatc

SEQ ID NO: 5451806 - DNA, 14 bp, Homo sapiens
tctgggctctgagt

SEQ ID NO: 5451807 - DNA, 15 bp, Homo sapiens
tctgggctctggact

SEQ ID NO: 5451808 - DNA, 22 bp, Homo sapiens
tctgggctgatttgggtctctc

SEQ ID NO: 5451809 - DNA, 17 bp, Homo sapiens
tctgggctgctacccag

SEQ ID NO: 5451810 - DNA, 15 bp, Homo sapiens
tctgggcttcctgga

SEQ ID NO: 5451811 - DNA, 16 bp, Homo sapiens
tctgggcttcctggag

SEQ ID NO: 5451812 - DNA, 19 bp, Homo sapiens
tctgggcttggggcttcct

SEQ ID NO: 5451813 - DNA, 13 bp, Homo sapiens
tctgggctttctc

SEQ ID NO: 5451814 - DNA, 20 bp, Homo sapiens
tctgggctttctcctggaga

SEQ ID NO: 5451815 - DNA, 22 bp, Homo sapiens
tctgggctttgattccatctcc

SEQ ID NO: 5451816 - DNA, 19 bp, Homo sapiens
tctggggaaaaaaaagaga

SEQ ID NO: 5451817 - DNA, 23 bp, Homo sapiens
tctggggaaagacactgcctggg

SEQ ID NO: 5451818 - DNA, 22 bp, Homo sapiens
tctggggaaaggggacaaggaa

SEQ ID NO: 5451819 - DNA, 12 bp, Homo sapiens
tctggggaagga

SEQ ID NO: 5451820 - DNA, 19 bp, Homo sapiens
tctggggaagggaaccagc

SEQ ID NO: 5451821 - DNA, 21 bp, Homo sapiens
tctggggaagggaaccagccc

SEQ ID NO: 5451822 - DNA, 19 bp, Homo sapiens
tctggggaagtcaggggag

SEQ ID NO: 5451823 - DNA, 15 bp, Homo sapiens
tctggggaattctga

SEQ ID NO: 5451824 - DNA, 23 bp, Homo sapiens
tctggggaccagcttggctcagg

SEQ ID NO: 5451825 - DNA, 14 bp, Homo sapiens
tctggggaccccaa

SEQ ID NO: 5451826 - DNA, 18 bp, Homo sapiens
tctggggaccctccagag

SEQ ID NO: 5451827 - DNA, 20 bp, Homo sapiens
tctggggacctggtttgaat

SEQ ID NO: 5451828 - DNA, 21 bp, Homo sapiens
tctggggagcaggcagccagc

SEQ ID NO: 5451829 - DNA, 23 bp, Homo sapiens
tctggggagcgggtctgctccca

SEQ ID NO: 5451830 - DNA, 15 bp, Homo sapiens
tctggggagctcctg

SEQ ID NO: 5451831 - DNA, 17 bp, Homo sapiens
tctggggagctggacag

SEQ ID NO: 5451832 - DNA, 21 bp, Homo sapiens
tctggggaggcaggcattcct

SEQ ID NO: 5451833 - DNA, 20 bp, Homo sapiens
tctggggagggacacagagg

SEQ ID NO: 5451834 - DNA, 23 bp, Homo sapiens
tctggggatggagaatgccagcc

SEQ ID NO: 5451835 - DNA, 14 bp, Homo sapiens
tctggggatgggtg

SEQ ID NO: 5451836 - DNA, 13 bp, Homo sapiens
tctggggcagatc

SEQ ID NO: 5451837 - DNA, 17 bp, Homo sapiens
tctggggcagcccccat

SEQ ID NO: 5451838 - DNA, 15 bp, Homo sapiens
tctggggcagggtta

SEQ ID NO: 5451839 - DNA, 16 bp, Homo sapiens
tctggggccacacaga

SEQ ID NO: 5451840 - DNA, 13 bp, Homo sapiens
tctggggccagcc

SEQ ID NO: 5451841 - DNA, 16 bp, Homo sapiens
tctggggccagcccct

SEQ ID NO: 5451842 - DNA, 20 bp, Homo sapiens
tctggggcccaggaagccca

SEQ ID NO: 5451843 - DNA, 17 bp, Homo sapiens
tctggggcccgcctgcc

SEQ ID NO: 5451844 - DNA, 19 bp, Homo sapiens
tctggggccctgggcctca

SEQ ID NO: 5451845 - DNA, 14 bp, Homo sapiens
tctggggctctagg

SEQ ID NO: 5451846 - DNA, 15 bp, Homo sapiens
tctggggctctggga

SEQ ID NO: 5451847 - DNA, 17 bp, Homo sapiens
tctggggctcttggccc

SEQ ID NO: 5451848 - DNA, 19 bp, Homo sapiens
tctggggcttgtcctgtgc

SEQ ID NO: 5451849 - DNA, 18 bp, Homo sapiens
tctgggggaaaaagccat

SEQ ID NO: 5451850 - DNA, 19 bp, Homo sapiens
tctgggggactagaacaca

SEQ ID NO: 5451851 - DNA, 14 bp, Homo sapiens
tctgggggaggcag

SEQ ID NO: 5451852 - DNA, 16 bp, Homo sapiens
tctgggggaggcaggg

SEQ ID NO: 5451853 - DNA, 18 bp, Homo sapiens
tctgggggaggcagggct

SEQ ID NO: 5451854 - DNA, 13 bp, Homo sapiens
tctgggggctctg

SEQ ID NO: 5451855 - DNA, 15 bp, Homo sapiens
tctgggggctgagga

SEQ ID NO: 5451856 - DNA, 15 bp, Homo sapiens
tctgggggctgcagt

SEQ ID NO: 5451857 - DNA, 19 bp, Homo sapiens
tctggggggacccagtgca

SEQ ID NO: 5451858 - DNA, 21 bp, Homo sapiens
tctggggggacccagtgcaga

SEQ ID NO: 5451859 - DNA, 19 bp, Homo sapiens
tctggggggatatttccta

SEQ ID NO: 5451860 - DNA, 13 bp, Homo sapiens
tctggggggcagt

SEQ ID NO: 5451861 - DNA, 13 bp, Homo sapiens
tctggggggtggc

SEQ ID NO: 5451862 - DNA, 14 bp, Homo sapiens
tctggggggtgggg

SEQ ID NO: 5451863 - DNA, 13 bp, Homo sapiens
tctgggggtagga

SEQ ID NO: 5451864 - DNA, 18 bp, Homo sapiens
tctggggtatgtgtgtgt

SEQ ID NO: 5451865 - DNA, 22 bp, Homo sapiens
tctggggtatgtgtgtgtgggt

SEQ ID NO: 5451866 - DNA, 23 bp, Homo sapiens
tctggggtcaggtgccactgacc

SEQ ID NO: 5451867 - DNA, 22 bp, Homo sapiens
tctggggtctttttatgcattt

SEQ ID NO: 5451868 - DNA, 17 bp, Homo sapiens
tctggggtgagggagtt

SEQ ID NO: 5451869 - DNA, 19 bp, Homo sapiens
tctggggtggggcttggaa

SEQ ID NO: 5451870 - DNA, 16 bp, Homo sapiens
tctggggttcagcccc

SEQ ID NO: 5451871 - DNA, 15 bp, Homo sapiens
tctggggttggaagt

SEQ ID NO: 5451872 - DNA, 16 bp, Homo sapiens
tctgggtaagaagaaa

SEQ ID NO: 5451873 - DNA, 20 bp, Homo sapiens
tctgggtacctgcaagcaga

SEQ ID NO: 5451874 - DNA, 23 bp, Homo sapiens
tctgggtagaagccacccttccc

SEQ ID NO: 5451875 - DNA, 15 bp, Homo sapiens
tctgggtcaatactg

SEQ ID NO: 5451876 - DNA, 15 bp, Homo sapiens
tctgggtcagaacca

SEQ ID NO: 5451877 - DNA, 14 bp, Homo sapiens
tctgggtccaggga

SEQ ID NO: 5451878 - DNA, 18 bp, Homo sapiens
tctgggtccatcctggtc

SEQ ID NO: 5451879 - DNA, 13 bp, Homo sapiens
tctgggtccctgc

SEQ ID NO: 5451880 - DNA, 17 bp, Homo sapiens
tctgggtccctgctccc

SEQ ID NO: 5451881 - DNA, 14 bp, Homo sapiens
tctgggtctggcca

SEQ ID NO: 5451882 - DNA, 18 bp, Homo sapiens
tctgggtcttggccatga

SEQ ID NO: 5451883 - DNA, 13 bp, Homo sapiens
tctgggtcttttg

SEQ ID NO: 5451884 - DNA, 16 bp, Homo sapiens
tctgggtgaaagagtc

SEQ ID NO: 5451885 - DNA, 17 bp, Homo sapiens
tctgggtgagtggctga

SEQ ID NO: 5451886 - DNA, 21 bp, Homo sapiens
tctgggtgatggaaactgcca

SEQ ID NO: 5451887 - DNA, 18 bp, Homo sapiens
tctgggtgctccctacca

SEQ ID NO: 5451888 - DNA, 20 bp, Homo sapiens
tctgggtggaagtgcccagc

SEQ ID NO: 5451889 - DNA, 21 bp, Homo sapiens
tctgggtggatgtgagcagaa

SEQ ID NO: 5451890 - DNA, 13 bp, Homo sapiens
tctgggtggctcc

SEQ ID NO: 5451891 - DNA, 14 bp, Homo sapiens
tctgggtggctcct

SEQ ID NO: 5451892 - DNA, 16 bp, Homo sapiens
tctgggtggctcctgc

SEQ ID NO: 5451893 - DNA, 17 bp, Homo sapiens
tctgggtggctcctgcc

SEQ ID NO: 5451894 - DNA, 18 bp, Homo sapiens
tctgggtggctcctgcca

SEQ ID NO: 5451895 - DNA, 16 bp, Homo sapiens
tctgggtggggcccag

SEQ ID NO: 5451896 - DNA, 19 bp, Homo sapiens
tctgggtggggcccaggcc

SEQ ID NO: 5451897 - DNA, 19 bp, Homo sapiens
tctgggtgtgactgattcc

SEQ ID NO: 5451898 - DNA, 13 bp, Homo sapiens
tctgggtgtgtcc

SEQ ID NO: 5451899 - DNA, 20 bp, Homo sapiens
tctgggtgttgaccactcca

SEQ ID NO: 5451900 - DNA, 23 bp, Homo sapiens
tctgggttaggtggccgctcctc

SEQ ID NO: 5451901 - DNA, 17 bp, Homo sapiens
tctgggttccagcagag

SEQ ID NO: 5451902 - DNA, 23 bp, Homo sapiens
tctgggttccttcctctgagcct

SEQ ID NO: 5451903 - DNA, 19 bp, Homo sapiens
tctgggttcgttggggaca

SEQ ID NO: 5451904 - DNA, 22 bp, Homo sapiens
tctgggttgttgtttttttctt

SEQ ID NO: 5451905 - DNA, 16 bp, Homo sapiens
tctgggtttacaacaa

SEQ ID NO: 5451906 - DNA, 16 bp, Homo sapiens
tctgggtttgaagctg

SEQ ID NO: 5451907 - DNA, 20 bp, Homo sapiens
tctgggtttgaagctgctgt

SEQ ID NO: 5451908 - DNA, 18 bp, Homo sapiens
tctgggtttggcccaaga

SEQ ID NO: 5451909 - DNA, 18 bp, Homo sapiens
tctgggttttagaaattc

SEQ ID NO: 5451910 - DNA, 16 bp, Homo sapiens
tctgggttttctgaaa

SEQ ID NO: 5451911 - DNA, 21 bp, Homo sapiens
tctggtaaacattcctccagc

SEQ ID NO: 5451912 - DNA, 19 bp, Homo sapiens
tctggtaaagttacacttt

SEQ ID NO: 5451913 - DNA, 21 bp, Homo sapiens
tctggtaaagttacactttta

SEQ ID NO: 5451914 - DNA, 21 bp, Homo sapiens
tctggtaatattgacttgtat

SEQ ID NO: 5451915 - DNA, 21 bp, Homo sapiens
tctggtaatcggggtataata

SEQ ID NO: 5451916 - DNA, 20 bp, Homo sapiens
tctggtacgaatctcatccc

SEQ ID NO: 5451917 - DNA, 15 bp, Homo sapiens
tctggtactctccta

SEQ ID NO: 5451918 - DNA, 15 bp, Homo sapiens
tctggtactttctgt

SEQ ID NO: 5451919 - DNA, 18 bp, Homo sapiens
tctggtagaagggaaagc

SEQ ID NO: 5451920 - DNA, 23 bp, Homo sapiens
tctggtagaagggaaagcccata

SEQ ID NO: 5451921 - DNA, 13 bp, Homo sapiens
tctggtagacaca

SEQ ID NO: 5451922 - DNA, 14 bp, Homo sapiens
tctggtaggaagat

SEQ ID NO: 5451923 - DNA, 19 bp, Homo sapiens
tctggtaggttctgtctgt

SEQ ID NO: 5451924 - DNA, 13 bp, Homo sapiens
tctggtataattg

SEQ ID NO: 5451925 - DNA, 23 bp, Homo sapiens
tctggtatgaacttgaggacaca

SEQ ID NO: 5451926 - DNA, 20 bp, Homo sapiens
tctggtatgcattctttata

SEQ ID NO: 5451927 - DNA, 15 bp, Homo sapiens
tctggtatggtgcta

SEQ ID NO: 5451928 - DNA, 16 bp, Homo sapiens
tctggtatttcccctg

SEQ ID NO: 5451929 - DNA, 17 bp, Homo sapiens
tctggtatttcccctgt

SEQ ID NO: 5451930 - DNA, 17 bp, Homo sapiens
tctggtcaacctcctgg

SEQ ID NO: 5451931 - DNA, 21 bp, Homo sapiens
tctggtcaacctcctggacat

SEQ ID NO: 5451932 - DNA, 13 bp, Homo sapiens
tctggtcagagcc

SEQ ID NO: 5451933 - DNA, 14 bp, Homo sapiens
tctggtcagagcca

SEQ ID NO: 5451934 - DNA, 18 bp, Homo sapiens
tctgtagcctggtctgtg

SEQ ID NO: 5451935 - DNA, 19 bp, Homo sapiens
tctgtagcctggtctgtgc

SEQ ID NO: 5451936 - DNA, 18 bp, Homo sapiens
tctgtagctacactgtat

SEQ ID NO: 5451937 - DNA, 14 bp, Homo sapiens
tctgtagctcagtt

SEQ ID NO: 5451938 - DNA, 14 bp, Homo sapiens
tctgtagctccctc

SEQ ID NO: 5451939 - DNA, 17 bp, Homo sapiens
tctgtagctccctcctc

SEQ ID NO: 5451940 - DNA, 21 bp, Homo sapiens
tctgtagctccctcctcccat

SEQ ID NO: 5451941 - DNA, 14 bp, Homo sapiens
tctgtagctcctca

SEQ ID NO: 5451942 - DNA, 23 bp, Homo sapiens
tctgtagctcctcaactcaccta

SEQ ID NO: 5451943 - DNA, 17 bp, Homo sapiens
tctgtagcttatctgcc

SEQ ID NO: 5451944 - DNA, 18 bp, Homo sapiens
tctgtagcttatctgccc

SEQ ID NO: 5451945 - DNA, 16 bp, Homo sapiens
tctgtaggatcgtaaa

SEQ ID NO: 5451946 - DNA, 19 bp, Homo sapiens
tctgtaggcagcagagaga

SEQ ID NO: 5451947 - DNA, 23 bp, Homo sapiens
tctgtaggccagtagttctcaaa

SEQ ID NO: 5451948 - DNA, 21 bp, Homo sapiens
tctgtagggagtgaagccaca

SEQ ID NO: 5451949 - DNA, 23 bp, Homo sapiens
tctgtagggagtgaagccacaga

SEQ ID NO: 5451950 - DNA, 15 bp, Homo sapiens
tctgtaggtacgttt

SEQ ID NO: 5451951 - DNA, 21 bp, Homo sapiens
tctgtaggtgaaagaacaagt

SEQ ID NO: 5451952 - DNA, 15 bp, Homo sapiens
tctgtaggtgtctct

SEQ ID NO: 5451953 - DNA, 16 bp, Homo sapiens
tctgtaggtgtctctg

SEQ ID NO: 5451954 - DNA, 17 bp, Homo sapiens
tctgtaggtgtctctgg

SEQ ID NO: 5451955 - DNA, 19 bp, Homo sapiens
tctgtaggttgcacacttt

SEQ ID NO: 5451956 - DNA, 20 bp, Homo sapiens
tctgtaggttgcacactttg

SEQ ID NO: 5451957 - DNA, 22 bp, Homo sapiens
tctgtagtaaaatgttttcatt

SEQ ID NO: 5451958 - DNA, 16 bp, Homo sapiens
tctgtagtaatttatt

SEQ ID NO: 5451959 - DNA, 22 bp, Homo sapiens
tctgtagtatacagacaggaag

SEQ ID NO: 5451960 - DNA, 19 bp, Homo sapiens
tctgtagtattttttaaat

SEQ ID NO: 5451961 - DNA, 13 bp, Homo sapiens
tctgtagtggccc

SEQ ID NO: 5451962 - DNA, 16 bp, Homo sapiens
tctgtagttacattta

SEQ ID NO: 5451963 - DNA, 20 bp, Homo sapiens
tctgtagttcctaatggatt

SEQ ID NO: 5451964 - DNA, 15 bp, Homo sapiens
tctgtagttgcagct

SEQ ID NO: 5451965 - DNA, 15 bp, Homo sapiens
tctgtagttgctttg

SEQ ID NO: 5451966 - DNA, 14 bp, Homo sapiens
tctgtataaaaatg

SEQ ID NO: 5451967 - DNA, 22 bp, Homo sapiens
tctgtataaaatgcaaaataaa

SEQ ID NO: 5451968 - DNA, 23 bp, Homo sapiens
tctgtataaaatgcaaaataaat

SEQ ID NO: 5451969 - DNA, 22 bp, Homo sapiens
tctgtataaacattaaatgtct

SEQ ID NO: 5451970 - DNA, 19 bp, Homo sapiens
tctgtataaataagagcat

SEQ ID NO: 5451971 - DNA, 15 bp, Homo sapiens
tctgtataaataatg

SEQ ID NO: 5451972 - DNA, 13 bp, Homo sapiens
tctgtataaatgt

SEQ ID NO: 5451973 - DNA, 20 bp, Homo sapiens
tctgtataaatgtctttaat

SEQ ID NO: 5451974 - DNA, 21 bp, Homo sapiens
tctgtataaatgtgaaatttt

SEQ ID NO: 5451975 - DNA, 16 bp, Homo sapiens
tctgtataagtaagaa

SEQ ID NO: 5451976 - DNA, 17 bp, Homo sapiens
tctgtataagtaagaaa

SEQ ID NO: 5451977 - DNA, 22 bp, Homo sapiens
tctgtataagtaagaaaatatt

SEQ ID NO: 5451978 - DNA, 16 bp, Homo sapiens
tctgtataatactttg

SEQ ID NO: 5451979 - DNA, 19 bp, Homo sapiens
tctgtataatactttgtat

SEQ ID NO: 5451980 - DNA, 15 bp, Homo sapiens
tctgtataatagaga

SEQ ID NO: 5451981 - DNA, 13 bp, Homo sapiens
tctgtatacaagg

SEQ ID NO: 5451982 - DNA, 20 bp, Homo sapiens
tctgtatagacaggagaaga

SEQ ID NO: 5451983 - DNA, 16 bp, Homo sapiens
tctgtatagattagag

SEQ ID NO: 5451984 - DNA, 15 bp, Homo sapiens
tctgtatataaaata

SEQ ID NO: 5451985 - DNA, 15 bp, Homo sapiens
tctgtatataaatgg

SEQ ID NO: 5451986 - DNA, 16 bp, Homo sapiens
tctgtatataaatggg

SEQ ID NO: 5451987 - DNA, 23 bp, Homo sapiens
tctgtatataaatgggaacattt

SEQ ID NO: 5451988 - DNA, 15 bp, Homo sapiens
tctgtatatacaata

SEQ ID NO: 5451989 - DNA, 20 bp, Homo sapiens
tctgtatatagatgtctgtg

SEQ ID NO: 5451990 - DNA, 19 bp, Homo sapiens
tctgtatatgattctctgt

SEQ ID NO: 5451991 - DNA, 21 bp, Homo sapiens
tctgtatatgattctctgtgg

SEQ ID NO: 5451992 - DNA, 23 bp, Homo sapiens
tctgtatatgattctctgtggtt

SEQ ID NO: 5451993 - DNA, 21 bp, Homo sapiens
tctgtatatgttgtaataaaa

SEQ ID NO: 5451994 - DNA, 20 bp, Homo sapiens
tctgtatattccctgtggaa

SEQ ID NO: 5451995 - DNA, 23 bp, Homo sapiens
tctgtatattccctgtggaatgt

SEQ ID NO: 5451996 - DNA, 21 bp, Homo sapiens
tctgtatattgggctcagaga

SEQ ID NO: 5451997 - DNA, 22 bp, Homo sapiens
tctgtatcaagcccctgtctaa

SEQ ID NO: 5451998 - DNA, 13 bp, Homo sapiens
tctgtatccccag

SEQ ID NO: 5451999 - DNA, 21 bp, Homo sapiens
tctgtatccccagtgcccggt

SEQ ID NO: 5452000 - DNA, 12 bp, Homo sapiens
tctgtatccgtg

SEQ ID NO: 5452001 - DNA, 16 bp, Homo sapiens
tctgtatcctgggcct

SEQ ID NO: 5452002 - DNA, 19 bp, Homo sapiens
tctgtatcggagacagtga

SEQ ID NO: 5452003 - DNA, 21 bp, Homo sapiens
tctgtatcggagacagtgatc

SEQ ID NO: 5452004 - DNA, 14 bp, Homo sapiens
tctgtatgaatgtg

SEQ ID NO: 5452005 - DNA, 22 bp, Homo sapiens
tctgtatgaatgtgattggtaa

SEQ ID NO: 5452006 - DNA, 15 bp, Homo sapiens
tctgtatgcatcaga

SEQ ID NO: 5452007 - DNA, 12 bp, Homo sapiens
tctgtatgtgtt

SEQ ID NO: 5452008 - DNA, 22 bp, Homo sapiens
tctgtatgtgttcgtcagtgtt

SEQ ID NO: 5452009 - DNA, 18 bp, Homo sapiens
tctgtatgttaggtgaca

SEQ ID NO: 5452010 - DNA, 17 bp, Homo sapiens
tctgtattcatacagca

SEQ ID NO: 5452011 - DNA, 14 bp, Homo sapiens
tctgtattctgcaa

SEQ ID NO: 5452012 - DNA, 22 bp, Homo sapiens
tctgtattgcagctaagctcaa

SEQ ID NO: 5452013 - DNA, 20 bp, Homo sapiens
tctgtattgccatggtcttt

SEQ ID NO: 5452014 - DNA, 13 bp, Homo sapiens
tctgtattgctaa

SEQ ID NO: 5452015 - DNA, 18 bp, Homo sapiens
tctgtattggcagcacag

SEQ ID NO: 5452016 - DNA, 23 bp, Homo sapiens
tctgtatttatgtgtgaggagct

SEQ ID NO: 5452017 - DNA, 13 bp, Homo sapiens
tctgtatttcatg

SEQ ID NO: 5452018 - DNA, 18 bp, Homo sapiens
tctgtatttcatgtggct

SEQ ID NO: 5452019 - DNA, 12 bp, Homo sapiens
tctgtatttgaa

SEQ ID NO: 5452020 - DNA, 14 bp, Homo sapiens
tctgtatttgaaag

SEQ ID NO: 5452021 - DNA, 23 bp, Homo sapiens
tctgtatttgaatcagcctacag

SEQ ID NO: 5452022 - DNA, 15 bp, Homo sapiens
tctgtattttaagaa

SEQ ID NO: 5452023 - DNA, 23 bp, Homo sapiens
tctgtattttatttagacaagag

SEQ ID NO: 5452024 - DNA, 16 bp, Homo sapiens
tctgtattttccacct

SEQ ID NO: 5452025 - DNA, 22 bp, Homo sapiens
tctgtattttttcttgcattga

SEQ ID NO: 5452026 - DNA, 15 bp, Homo sapiens
tctgtattttttgtt

SEQ ID NO: 5452027 - DNA, 16 bp, Homo sapiens
tctgtcaaaacactgt

SEQ ID NO: 5452028 - DNA, 20 bp, Homo sapiens
tctgtcaaaacactgtggaa

SEQ ID NO: 5452029 - DNA, 13 bp, Homo sapiens
tctgtcaagaaga

SEQ ID NO: 5452030 - DNA, 20 bp, Homo sapiens
tctgtcaagagtagttatat

SEQ ID NO: 5452031 - DNA, 16 bp, Homo sapiens
tctgtcaatcacagtc

SEQ ID NO: 5452032 - DNA, 17 bp, Homo sapiens
tctgtcacaataaatgg

SEQ ID NO: 5452033 - DNA, 14 bp, Homo sapiens
tctgtcacactaaa

SEQ ID NO: 5452034 - DNA, 17 bp, Homo sapiens
tctgtcacaggctgggt

SEQ ID NO: 5452035 - DNA, 19 bp, Homo sapiens
tctgtcacaggctgggtca

SEQ ID NO: 5452036 - DNA, 19 bp, Homo sapiens
tctgtcacagtaaaaataa

SEQ ID NO: 5452037 - DNA, 17 bp, Homo sapiens
tctgtcacccaggctgg

SEQ ID NO: 5452038 - DNA, 17 bp, Homo sapiens
tctgtcaccctggccac

SEQ ID NO: 5452039 - DNA, 16 bp, Homo sapiens
tctgtcaccgccatgc

SEQ ID NO: 5452040 - DNA, 16 bp, Homo sapiens
tctgtcacgtgaaata

SEQ ID NO: 5452041 - DNA, 20 bp, Homo sapiens
tctgtcacgttctggaacat

SEQ ID NO: 5452042 - DNA, 15 bp, Homo sapiens
tctgtcactccaggc

SEQ ID NO: 5452043 - DNA, 17 bp, Homo sapiens
tctgtcactgcaggcac

SEQ ID NO: 5452044 - DNA, 22 bp, Homo sapiens
tctgtcactgtaggtatagaag

SEQ ID NO: 5452045 - DNA, 17 bp, Homo sapiens
tctgtcagaagacacta

SEQ ID NO: 5452046 - DNA, 15 bp, Homo sapiens
tctgtcagatgagaa

SEQ ID NO: 5452047 - DNA, 18 bp, Homo sapiens
tctgtcagatgagaacaa

SEQ ID NO: 5452048 - DNA, 22 bp, Homo sapiens
tctgtcagatgagaacaaagct

SEQ ID NO: 5452049 - DNA, 23 bp, Homo sapiens
tctgtcagatgagaacaaagctg

SEQ ID NO: 5452050 - DNA, 18 bp, Homo sapiens
tctgtcagatgggaagac

SEQ ID NO: 5452051 - DNA, 19 bp, Homo sapiens
tctgtcagatgggaagaca

SEQ ID NO: 5452052 - DNA, 22 bp, Homo sapiens
tctgtcagccagccgccctggg

SEQ ID NO: 5452053 - DNA, 16 bp, Homo sapiens
tctgtcagcttcccaa

SEQ ID NO: 5452054 - DNA, 17 bp, Homo sapiens
tctgtcaggagagcagc

SEQ ID NO: 5452055 - DNA, 19 bp, Homo sapiens
tctgtcagggccttggccc

SEQ ID NO: 5452056 - DNA, 17 bp, Homo sapiens
tctgtcaggggcttgga

SEQ ID NO: 5452057 - DNA, 19 bp, Homo sapiens
tctgtcagggttggaaagt

SEQ ID NO: 5452058 - DNA, 18 bp, Homo sapiens
tctgtcaggtttggtttt

SEQ ID NO: 5452059 - DNA, 19 bp, Homo sapiens
tctgtcagtcacagccacc

SEQ ID NO: 5452060 - DNA, 20 bp, Homo sapiens
tctgtcagtgtttgtatttg

SEQ ID NO: 5452061 - DNA, 12 bp, Homo sapiens
tctgtcagttct

SEQ ID NO: 5452062 - DNA, 16 bp, Homo sapiens
tctgtcagtttgtgaa

SEQ ID NO: 5452063 - DNA, 13 bp, Homo sapiens
tctgtcataatat

SEQ ID NO: 5452064 - DNA, 15 bp, Homo sapiens
tctgtcatcaccccg

SEQ ID NO: 5452065 - DNA, 12 bp, Homo sapiens
tctgtcatcccg

SEQ ID NO: 5452066 - DNA, 13 bp, Homo sapiens
tctgtcatctctc

SEQ ID NO: 5452067 - DNA, 22 bp, Homo sapiens
tctgtcatctctctggggccct

SEQ ID NO: 5452068 - DNA, 23 bp, Homo sapiens
tctgtcatctctctggggccctg

SEQ ID NO: 5452069 - DNA, 15 bp, Homo sapiens
tctgtcatgccaaaa

SEQ ID NO: 5452070 - DNA, 18 bp, Homo sapiens
tctgtcattatattctaa

SEQ ID NO: 5452071 - DNA, 21 bp, Homo sapiens
tctgtcattggttacaaattt

SEQ ID NO: 5452072 - DNA, 16 bp, Homo sapiens
tctgtccaaaggaggc

SEQ ID NO: 5452073 - DNA, 19 bp, Homo sapiens
tctgtccaaaggaggctgg

SEQ ID NO: 5452074 - DNA, 17 bp, Homo sapiens
tctgtccaccagaccca

SEQ ID NO: 5452075 - DNA, 14 bp, Homo sapiens
tctgtccacctcgg

SEQ ID NO: 5452076 - DNA, 15 bp, Homo sapiens
tctgtccacttgtgg

SEQ ID NO: 5452077 - DNA, 15 bp, Homo sapiens
tctgtccagaaaata

SEQ ID NO: 5452078 - DNA, 12 bp, Homo sapiens
tctgtccagaca

SEQ ID NO: 5452079 - DNA, 16 bp, Homo sapiens
tctgtccagataagtt

SEQ ID NO: 5452080 - DNA, 22 bp, Homo sapiens
tctgtccagataagttatttat

SEQ ID NO: 5452081 - DNA, 22 bp, Homo sapiens
tctgtccagccgtgtgtgcatg

SEQ ID NO: 5452082 - DNA, 21 bp, Homo sapiens
tctgtccagctcccgctgtgg

SEQ ID NO: 5452083 - DNA, 20 bp, Homo sapiens
tctgtccagctggggccaga

SEQ ID NO: 5452084 - DNA, 23 bp, Homo sapiens
tctgtccaggacatgatactgat

SEQ ID NO: 5452085 - DNA, 12 bp, Homo sapiens
tctgtccaggcc

SEQ ID NO: 5452086 - DNA, 18 bp, Homo sapiens
tctgtccaggcccttagg

SEQ ID NO: 5452087 - DNA, 20 bp, Homo sapiens
tctgtccaggcccttaggga

SEQ ID NO: 5452088 - DNA, 13 bp, Homo sapiens
tctgtccagggcc

SEQ ID NO: 5452089 - DNA, 14 bp, Homo sapiens
tctgtccagggctt

SEQ ID NO: 5452090 - DNA, 15 bp, Homo sapiens
tctgtccagtttcca

SEQ ID NO: 5452091 - DNA, 18 bp, Homo sapiens
tctgtccatcagtgcatg

SEQ ID NO: 5452092 - DNA, 14 bp, Homo sapiens
tctgtccatctgcc

SEQ ID NO: 5452093 - DNA, 18 bp, Homo sapiens
tctgtccatctgcccgcc

SEQ ID NO: 5452094 - DNA, 13 bp, Homo sapiens
tctgtccatctgt

SEQ ID NO: 5452095 - DNA, 20 bp, Homo sapiens
tctgtccatctgtctgtcct

SEQ ID NO: 5452096 - DNA, 16 bp, Homo sapiens
tctgtccatggccttt

SEQ ID NO: 5452097 - DNA, 12 bp, Homo sapiens
tctgtcccaagt

SEQ ID NO: 5452098 - DNA, 19 bp, Homo sapiens
tctgtcccaagtcctgctc

SEQ ID NO: 5452099 - DNA, 22 bp, Homo sapiens
tctgtcccaagtcctgctcctt

SEQ ID NO: 5452100 - DNA, 14 bp, Homo sapiens
tctgtcccaagtct

SEQ ID NO: 5452101 - DNA, 19 bp, Homo sapiens
tctgtcccacccctagcca

SEQ ID NO: 5452102 - DNA, 15 bp, Homo sapiens
tctgtcccactggga

SEQ ID NO: 5452103 - DNA, 16 bp, Homo sapiens
tctgtcccactgggac

SEQ ID NO: 5452104 - DNA, 17 bp, Homo sapiens
tctgtcccattccctgg

SEQ ID NO: 5452105 - DNA, 19 bp, Homo sapiens
tctgtcccattccctggga

SEQ ID NO: 5452106 - DNA, 15 bp, Homo sapiens
tctgtccccacgagg

SEQ ID NO: 5452107 - DNA, 20 bp, Homo sapiens
tctgtccccagccctgtcct

SEQ ID NO: 5452108 - DNA, 15 bp, Homo sapiens
tctgtccccagcctg

SEQ ID NO: 5452109 - DNA, 16 bp, Homo sapiens
tctgtccccagcctgg

SEQ ID NO: 5452110 - DNA, 16 bp, Homo sapiens
tctgtccccaggcctg

SEQ ID NO: 5452111 - DNA, 18 bp, Homo sapiens
tctgtttctctttccttg

SEQ ID NO: 5452112 - DNA, 21 bp, Homo sapiens
tctgtttctggaaatgttctt

SEQ ID NO: 5452113 - DNA, 18 bp, Homo sapiens
tctgtttctgtttataat

SEQ ID NO: 5452114 - DNA, 11 bp, Homo sapiens
tctgtttcttg

SEQ ID NO: 5452115 - DNA, 13 bp, Homo sapiens
tctgtttcttgct

SEQ ID NO: 5452116 - DNA, 13 bp, Homo sapiens
tctgtttgaaact

SEQ ID NO: 5452117 - DNA, 14 bp, Homo sapiens
tctgtttgccactt

SEQ ID NO: 5452118 - DNA, 21 bp, Homo sapiens
tctgtttgctcaaaattgctt

SEQ ID NO: 5452119 - DNA, 20 bp, Homo sapiens
tctgtttgctcacccaggac

SEQ ID NO: 5452120 - DNA, 18 bp, Homo sapiens
tctgtttgctgtggaact

SEQ ID NO: 5452121 - DNA, 18 bp, Homo sapiens
tctgtttggacccatggt

SEQ ID NO: 5452122 - DNA, 20 bp, Homo sapiens
tctgtttggcacttgtattt

SEQ ID NO: 5452123 - DNA, 15 bp, Homo sapiens
tctgtttgtaaatta

SEQ ID NO: 5452124 - DNA, 17 bp, Homo sapiens
tctgtttgtaaattatt

SEQ ID NO: 5452125 - DNA, 19 bp, Homo sapiens
tctgtttgtatatttgcaa

SEQ ID NO: 5452126 - DNA, 21 bp, Homo sapiens
tctgtttgttaaaactggcat

SEQ ID NO: 5452127 - DNA, 14 bp, Homo sapiens
tctgtttgttgact

SEQ ID NO: 5452128 - DNA, 13 bp, Homo sapiens
tctgtttgtttca

SEQ ID NO: 5452129 - DNA, 21 bp, Homo sapiens
tctgtttgtttggctgtccag

SEQ ID NO: 5452130 - DNA, 22 bp, Homo sapiens
tctgtttgtttggctgtccagc

SEQ ID NO: 5452131 - DNA, 16 bp, Homo sapiens
tctgttttaaaaacct

SEQ ID NO: 5452132 - DNA, 15 bp, Homo sapiens
tctgttttacaggaa

SEQ ID NO: 5452133 - DNA, 18 bp, Homo sapiens
tctgttttataattttgt

SEQ ID NO: 5452134 - DNA, 22 bp, Homo sapiens
tctgttttataattttgtgaag

SEQ ID NO: 5452135 - DNA, 15 bp, Homo sapiens
tctgttttatgactt

SEQ ID NO: 5452136 - DNA, 12 bp, Homo sapiens
tctgttttccaa

SEQ ID NO: 5452137 - DNA, 21 bp, Homo sapiens
tctgttttcccaacctcctgt

SEQ ID NO: 5452138 - DNA, 14 bp, Homo sapiens
tctgttttccccca

SEQ ID NO: 5452139 - DNA, 17 bp, Homo sapiens
tctgttttcctaatgtt

SEQ ID NO: 5452140 - DNA, 16 bp, Homo sapiens
tctgttttcctttctc

SEQ ID NO: 5452141 - DNA, 12 bp, Homo sapiens
tctgttttctct

SEQ ID NO: 5452142 - DNA, 11 bp, Homo sapiens
tctgttttctg

SEQ ID NO: 5452143 - DNA, 13 bp, Homo sapiens
tctgttttctgga

SEQ ID NO: 5452144 - DNA, 14 bp, Homo sapiens
tctgttttctggaa

SEQ ID NO: 5452145 - DNA, 15 bp, Homo sapiens
tctgttttctggaag

SEQ ID NO: 5452146 - DNA, 17 bp, Homo sapiens
tctgttttgaaggcaaa

SEQ ID NO: 5452147 - DNA, 20 bp, Homo sapiens
tctgttttgagttttgtagc

SEQ ID NO: 5452148 - DNA, 21 bp, Homo sapiens
tctgttttggtcccctccctc

SEQ ID NO: 5452149 - DNA, 19 bp, Homo sapiens
tctgttttgtggtttggaa

SEQ ID NO: 5452150 - DNA, 18 bp, Homo sapiens
tctgttttgtttcttgac

SEQ ID NO: 5452151 - DNA, 22 bp, Homo sapiens
tctgttttgttttgttttaatc

SEQ ID NO: 5452152 - DNA, 23 bp, Homo sapiens
tctgttttgttttgttttaatct

SEQ ID NO: 5452153 - DNA, 18 bp, Homo sapiens
tctgtttttatgttttat

SEQ ID NO: 5452154 - DNA, 15 bp, Homo sapiens
tctgtttttcacact

SEQ ID NO: 5452155 - DNA, 15 bp, Homo sapiens
tctgtttttctcaaa

SEQ ID NO: 5452156 - DNA, 19 bp, Homo sapiens
tctgtttttcttctgaaat

SEQ ID NO: 5452157 - DNA, 14 bp, Homo sapiens
tctgtttttctttt

SEQ ID NO: 5452158 - DNA, 20 bp, Homo sapiens
tctgtttttttttttttaac

SEQ ID NO: 5452159 - DNA, 13 bp, Homo sapiens
tcttaaaaaattt

SEQ ID NO: 5452160 - DNA, 20 bp, Homo sapiens
tcttaaaaacagctgtaact

SEQ ID NO: 5452161 - DNA, 13 bp, Homo sapiens
tcttaaaaactgt

SEQ ID NO: 5452162 - DNA, 14 bp, Homo sapiens
tcttaaaaactgtg

SEQ ID NO: 5452163 - DNA, 19 bp, Homo sapiens
tcttaaaaactgtgtatca

SEQ ID NO: 5452164 - DNA, 21 bp, Homo sapiens
tcttaaaaactgtgtatcatt

SEQ ID NO: 5452165 - DNA, 23 bp, Homo sapiens
tcttaaaaactgtgtatcattaa

SEQ ID NO: 5452166 - DNA, 19 bp, Homo sapiens
tcttaaaaagttgttcaac

SEQ ID NO: 5452167 - DNA, 15 bp, Homo sapiens
tcttaaaaatattgt

SEQ ID NO: 5452168 - DNA, 14 bp, Homo sapiens
tcttaaaaatgcat

SEQ ID NO: 5452169 - DNA, 18 bp, Homo sapiens
tcttaaaaattatcttta

SEQ ID NO: 5452170 - DNA, 19 bp, Homo sapiens
tcttaaaaatttatacacc

SEQ ID NO: 5452171 - DNA, 15 bp, Homo sapiens
tcttaaaacaaagcc

SEQ ID NO: 5452172 - DNA, 14 bp, Homo sapiens
tcttaaaacacatg

SEQ ID NO: 5452173 - DNA, 17 bp, Homo sapiens
tcttaaaacacatgata

SEQ ID NO: 5452174 - DNA, 18 bp, Homo sapiens
tcttaaaacacatgatac

SEQ ID NO: 5452175 - DNA, 14 bp, Homo sapiens
tcttaaaacagaaa

SEQ ID NO: 5452176 - DNA, 20 bp, Homo sapiens
tcttaaaaccagagaatctt

SEQ ID NO: 5452177 - DNA, 23 bp, Homo sapiens
tcttaaaaccagagaatcttaag

SEQ ID NO: 5452178 - DNA, 20 bp, Homo sapiens
tcttaaaacttgtggttgaa

SEQ ID NO: 5452179 - DNA, 24 bp, Homo sapiens
tcttaaaagctatcttcatgtaaa

SEQ ID NO: 5452180 - DNA, 21 bp, Homo sapiens
tcttaaaataacttatatcat

SEQ ID NO: 5452181 - DNA, 22 bp, Homo sapiens
tcttaaaataattcatatctaa

SEQ ID NO: 5452182 - DNA, 19 bp, Homo sapiens
tcttaaaatatatttcaga

SEQ ID NO: 5452183 - DNA, 17 bp, Homo sapiens
tcttaaaatcaaatgta

SEQ ID NO: 5452184 - DNA, 14 bp, Homo sapiens
tcttaaaatgcaat

SEQ ID NO: 5452185 - DNA, 16 bp, Homo sapiens
tcttaaaatgcaatat

SEQ ID NO: 5452186 - DNA, 15 bp, Homo sapiens
tcttaaaatgtccta

SEQ ID NO: 5452187 - DNA, 16 bp, Homo sapiens
tcttaaaatgtttcaa

SEQ ID NO: 5452188 - DNA, 10 bp, Homo sapiens
tcttaaaatt

SEQ ID NO: 5452189 - DNA, 17 bp, Homo sapiens
tcttaaacaaatgtatg

SEQ ID NO: 5452190 - DNA, 15 bp, Homo sapiens
tcttaaacaatgtat

SEQ ID NO: 5452191 - DNA, 16 bp, Homo sapiens
tcttaaacaatgtata

SEQ ID NO: 5452192 - DNA, 19 bp, Homo sapiens
tcttaaaccaacctttaaa

SEQ ID NO: 5452193 - DNA, 15 bp, Homo sapiens
tcttaaaccattttt

SEQ ID NO: 5452194 - DNA, 17 bp, Homo sapiens
tcttaaaccatttttgc

SEQ ID NO: 5452195 - DNA, 16 bp, Homo sapiens
tcttaaactaatacgt

SEQ ID NO: 5452196 - DNA, 17 bp, Homo sapiens
tcttaaactcctggcct

SEQ ID NO: 5452197 - DNA, 14 bp, Homo sapiens
tcttaaacttgtga

SEQ ID NO: 5452198 - DNA, 17 bp, Homo sapiens
tcttaaagaaacagctt

SEQ ID NO: 5452199 - DNA, 18 bp, Homo sapiens
tcttaaagaaacagcttt

SEQ ID NO: 5452200 - DNA, 17 bp, Homo sapiens
tcttaaagacaaatttt

SEQ ID NO: 5452201 - DNA, 22 bp, Homo sapiens
tcttaaagcaaagtcacttctc

SEQ ID NO: 5452202 - DNA, 16 bp, Homo sapiens
tcttaaagctgcctgt

SEQ ID NO: 5452203 - DNA, 20 bp, Homo sapiens
tcttaaagctgcctgtagtt

SEQ ID NO: 5452204 - DNA, 21 bp, Homo sapiens
tcttaaagctgcctgtagtta

SEQ ID NO: 5452205 - DNA, 14 bp, Homo sapiens
tcttaaaggcctgg

SEQ ID NO: 5452206 - DNA, 12 bp, Homo sapiens
tcttaaagttga

SEQ ID NO: 5452207 - DNA, 14 bp, Homo sapiens
tcttaaataaaact

SEQ ID NO: 5452208 - DNA, 19 bp, Homo sapiens
tcttaaataaaactattta

SEQ ID NO: 5452209 - DNA, 19 bp, Homo sapiens
tcttaaataaaagaaatgc

SEQ ID NO: 5452210 - DNA, 22 bp, Homo sapiens
tcttaaataaatcaagaatcat

SEQ ID NO: 5452211 - DNA, 15 bp, Homo sapiens
tcttaaataagaaac

SEQ ID NO: 5452212 - DNA, 16 bp, Homo sapiens
tcttaaataagaaact

SEQ ID NO: 5452213 - DNA, 18 bp, Homo sapiens
tcttaaataagaaacttt

SEQ ID NO: 5452214 - DNA, 15 bp, Homo sapiens
tcttaaataataaag

SEQ ID NO: 5452215 - DNA, 14 bp, Homo sapiens
tcttaaatatcttt

SEQ ID NO: 5452216 - DNA, 15 bp, Homo sapiens
tcttaaatcagttta

SEQ ID NO: 5452217 - DNA, 14 bp, Homo sapiens
tcttaaatctgtga

SEQ ID NO: 5452218 - DNA, 19 bp, Homo sapiens
tcttaaatctttcttcaaa

SEQ ID NO: 5452219 - DNA, 17 bp, Homo sapiens
tcttaaatgacagtgaa

SEQ ID NO: 5452220 - DNA, 16 bp, Homo sapiens
tcttaaatgagaagta

SEQ ID NO: 5452221 - DNA, 21 bp, Homo sapiens
tcttaaatgcaagtgcctaga

SEQ ID NO: 5452222 - DNA, 13 bp, Homo sapiens
tcttaaatgctca

SEQ ID NO: 5452223 - DNA, 17 bp, Homo sapiens
tcttaaatgctcataaa

SEQ ID NO: 5452224 - DNA, 19 bp, Homo sapiens
tcttaaatgctcattttct

SEQ ID NO: 5452225 - DNA, 19 bp, Homo sapiens
tcttaaattatatatttat

SEQ ID NO: 5452226 - DNA, 12 bp, Homo sapiens
tcttaaattatt

SEQ ID NO: 5452227 - DNA, 14 bp, Homo sapiens
tcttaaattcattt

SEQ ID NO: 5452228 - DNA, 18 bp, Homo sapiens
tcttaaattttgtgatat

SEQ ID NO: 5452229 - DNA, 14 bp, Homo sapiens
tcttaaatttttca

SEQ ID NO: 5452230 - DNA, 16 bp, Homo sapiens
tcttaacaaatcagat

SEQ ID NO: 5452231 - DNA, 19 bp, Homo sapiens
tcttaacaagttagaaaat

SEQ ID NO: 5452232 - DNA, 17 bp, Homo sapiens
tcttaacacagccttcc

SEQ ID NO: 5452233 - DNA, 22 bp, Homo sapiens
tcttaacacagccttccttctg

SEQ ID NO: 5452234 - DNA, 23 bp, Homo sapiens
tcttaacactgaaattgcctgaa

SEQ ID NO: 5452235 - DNA, 15 bp, Homo sapiens
tcttaacactggcaa

SEQ ID NO: 5452236 - DNA, 20 bp, Homo sapiens
tcttaacactggttaaatta

SEQ ID NO: 5452237 - DNA, 14 bp, Homo sapiens
tcttaacagtctcc

SEQ ID NO: 5452238 - DNA, 22 bp, Homo sapiens
tcttaaccagatcattgtgaaa

SEQ ID NO: 5452239 - DNA, 22 bp, Homo sapiens
tcttaaccagatggttgtgtat

SEQ ID NO: 5452240 - DNA, 14 bp, Homo sapiens
tcttaacgtaaatc

SEQ ID NO: 5452241 - DNA, 20 bp, Homo sapiens
tcttaactaaatttgtcttt

SEQ ID NO: 5452242 - DNA, 22 bp, Homo sapiens
tcttaactaaatttgtctttca

SEQ ID NO: 5452243 - DNA, 20 bp, Homo sapiens
tcttaactggcctaaatttc

SEQ ID NO: 5452244 - DNA, 22 bp, Homo sapiens
tcttaactggcctaaatttctt

SEQ ID NO: 5452245 - DNA, 18 bp, Homo sapiens
tcttaactgtatttcagt

SEQ ID NO: 5452246 - DNA, 15 bp, Homo sapiens
tcttaacttctcccc

SEQ ID NO: 5452247 - DNA, 23 bp, Homo sapiens
tcttaagaaaacaaactcttttt

SEQ ID NO: 5452248 - DNA, 14 bp, Homo sapiens
tcttaagaaataaa

SEQ ID NO: 5452249 - DNA, 16 bp, Homo sapiens
tcttaagacagcatgt

SEQ ID NO: 5452250 - DNA, 21 bp, Homo sapiens
tcttaagagaatccacataaa

SEQ ID NO: 5452251 - DNA, 21 bp, Homo sapiens
tcttaagataatatttaaaat

SEQ ID NO: 5452252 - DNA, 19 bp, Homo sapiens
tcttaagatacaaatggtg

SEQ ID NO: 5452253 - DNA, 16 bp, Homo sapiens
tcttaagcactttgaa

SEQ ID NO: 5452254 - DNA, 16 bp, Homo sapiens
tcttaagcagtaatct

SEQ ID NO: 5452255 - DNA, 18 bp, Homo sapiens
tcttaagcagtaatctgt

SEQ ID NO: 5452256 - DNA, 16 bp, Homo sapiens
tcttaagccatcttgg

SEQ ID NO: 5452257 - DNA, 22 bp, Homo sapiens
tcttaagccatcttggtaaatt

SEQ ID NO: 5452258 - DNA, 20 bp, Homo sapiens
tcttaagcctaaatgcctta

SEQ ID NO: 5452259 - DNA, 14 bp, Homo sapiens
tcttaagctgccca

SEQ ID NO: 5452260 - DNA, 23 bp, Homo sapiens
tcttaagctgcccaatttcacag

SEQ ID NO: 5452261 - DNA, 12 bp, Homo sapiens
tcttaagcttcc

SEQ ID NO: 5452262 - DNA, 22 bp, Homo sapiens
tcttaaggaacatctctgcttt

SEQ ID NO: 5452263 - DNA, 15 bp, Homo sapiens
tcttaaggaattttg

SEQ ID NO: 5452264 - DNA, 19 bp, Homo sapiens
tcttaaggacaaagtgcca

SEQ ID NO: 5452265 - DNA, 16 bp, Homo sapiens
tcttaaggacagtgtt

SEQ ID NO: 5452266 - DNA, 18 bp, Homo sapiens
tcttaaggacagtgttca

SEQ ID NO: 5452267 - DNA, 22 bp, Homo sapiens
tcttaaggacagtgttcaaatt

SEQ ID NO: 5452268 - DNA, 21 bp, Homo sapiens
tcttaaggcaataaaactagg

SEQ ID NO: 5452269 - DNA, 18 bp, Homo sapiens
tcttaaggtctaactgtg

SEQ ID NO: 5452270 - DNA, 20 bp, Homo sapiens
tcttaagtaccaatgggaag

SEQ ID NO: 5452271 - DNA, 18 bp, Homo sapiens
tcttaagtcagattttta

SEQ ID NO: 5452272 - DNA, 23 bp, Homo sapiens
tcttaagtcccagtatacctcat

SEQ ID NO: 5452273 - DNA, 16 bp, Homo sapiens
tcttaagtgtttctca

SEQ ID NO: 5452274 - DNA, 21 bp, Homo sapiens
tcttaagtgtttctcaaaaga

SEQ ID NO: 5452275 - DNA, 15 bp, Homo sapiens
tcttaagtttctcag

SEQ ID NO: 5452276 - DNA, 18 bp, Homo sapiens
tcttaagtttctcagctc

SEQ ID NO: 5452277 - DNA, 15 bp, Homo sapiens
tcttaatactgttat

SEQ ID NO: 5452278 - DNA, 19 bp, Homo sapiens
tcttaatactgttattctt

SEQ ID NO: 5452279 - DNA, 14 bp, Homo sapiens
tcttaatataaatt

SEQ ID NO: 5452280 - DNA, 17 bp, Homo sapiens
tcttaatatatacattt

SEQ ID NO: 5452281 - DNA, 15 bp, Homo sapiens
tcttaatatatttga

SEQ ID NO: 5452282 - DNA, 14 bp, Homo sapiens
tcttaatattctgg

SEQ ID NO: 5452283 - DNA, 18 bp, Homo sapiens
tcttaatattctggagtc

SEQ ID NO: 5452284 - DNA, 16 bp, Homo sapiens
tcttaatattgagaat

SEQ ID NO: 5452285 - DNA, 23 bp, Homo sapiens
tcttaatattgagaatcaggttg

SEQ ID NO: 5452286 - DNA, 20 bp, Homo sapiens
tcttaatcactactgtatgt

SEQ ID NO: 5452287 - DNA, 20 bp, Homo sapiens
tcttaatcattttttatata

SEQ ID NO: 5452288 - DNA, 15 bp, Homo sapiens
tcttaatccattaaa

SEQ ID NO: 5452289 - DNA, 19 bp, Homo sapiens
tcttccatatgacctcatg

SEQ ID NO: 5452290 - DNA, 18 bp, Homo sapiens
tcttccatcagctctctg

SEQ ID NO: 5452291 - DNA, 18 bp, Homo sapiens
tcttccatcatcactgta

SEQ ID NO: 5452292 - DNA, 19 bp, Homo sapiens
tcttccatcatgtccccaa

SEQ ID NO: 5452293 - DNA, 14 bp, Homo sapiens
tcttccatgatttt

SEQ ID NO: 5452294 - DNA, 23 bp, Homo sapiens
tcttccatgggatggttagtgtg

SEQ ID NO: 5452295 - DNA, 15 bp, Homo sapiens
tcttccattcagttt

SEQ ID NO: 5452296 - DNA, 16 bp, Homo sapiens
tcttccatttcttcca

SEQ ID NO: 5452297 - DNA, 14 bp, Homo sapiens
tcttcccaaggcca

SEQ ID NO: 5452298 - DNA, 20 bp, Homo sapiens
tcttcccaaggccagtctga

SEQ ID NO: 5452299 - DNA, 12 bp, Homo sapiens
tcttcccacagg

SEQ ID NO: 5452300 - DNA, 14 bp, Homo sapiens
tcttcccacaggag

SEQ ID NO: 5452301 - DNA, 20 bp, Homo sapiens
tcttcccaccaactctctct

SEQ ID NO: 5452302 - DNA, 17 bp, Homo sapiens
tcttcccactccagctg

SEQ ID NO: 5452303 - DNA, 21 bp, Homo sapiens
tcttcccactttcatctacct

SEQ ID NO: 5452304 - DNA, 13 bp, Homo sapiens
tcttcccagagtc

SEQ ID NO: 5452305 - DNA, 15 bp, Homo sapiens
tcttcccagagtcac

SEQ ID NO: 5452306 - DNA, 17 bp, Homo sapiens
tcttcccagagtcacaa

SEQ ID NO: 5452307 - DNA, 24 bp, Homo sapiens
tcttcccagcggttcctgtgcaga

SEQ ID NO: 5452308 - DNA, 22 bp, Homo sapiens
tcttcccagtgaatccctggga

SEQ ID NO: 5452309 - DNA, 13 bp, Homo sapiens
tcttcccataata

SEQ ID NO: 5452310 - DNA, 15 bp, Homo sapiens
tcttcccataataaa

SEQ ID NO: 5452311 - DNA, 21 bp, Homo sapiens
tcttcccatgcaacaccctct

SEQ ID NO: 5452312 - DNA, 17 bp, Homo sapiens
tcttcccatgcattctg

SEQ ID NO: 5452313 - DNA, 14 bp, Homo sapiens
tcttcccatggtgc

SEQ ID NO: 5452314 - DNA, 21 bp, Homo sapiens
tcttcccatttaacattgttt

SEQ ID NO: 5452315 - DNA, 15 bp, Homo sapiens
tcttcccatttgtaa

SEQ ID NO: 5452316 - DNA, 24 bp, Homo sapiens
tcttcccatttgtaatgtatctta

SEQ ID NO: 5452317 - DNA, 19 bp, Homo sapiens
tcttccccaaggcactgag

SEQ ID NO: 5452318 - DNA, 13 bp, Homo sapiens
tcttccccaaggg

SEQ ID NO: 5452319 - DNA, 15 bp, Homo sapiens
tcttccccaccgcag

SEQ ID NO: 5452320 - DNA, 15 bp, Homo sapiens
tcttccccaccttcc

SEQ ID NO: 5452321 - DNA, 14 bp, Homo sapiens
tcttccccactccc

SEQ ID NO: 5452322 - DNA, 20 bp, Homo sapiens
tcttccccagaaaggagact

SEQ ID NO: 5452323 - DNA, 21 bp, Homo sapiens
tcttccccagacgcctggctg

SEQ ID NO: 5452324 - DNA, 13 bp, Homo sapiens
tcttccccagggt

SEQ ID NO: 5452325 - DNA, 20 bp, Homo sapiens
tcttccccagggttctgtat

SEQ ID NO: 5452326 - DNA, 22 bp, Homo sapiens
tcttccccagggttctgtattg

SEQ ID NO: 5452327 - DNA, 14 bp, Homo sapiens
tcttcccccaccac

SEQ ID NO: 5452328 - DNA, 17 bp, Homo sapiens
tcttcccccctctcctc

SEQ ID NO: 5452329 - DNA, 23 bp, Homo sapiens
tcttcccccctctcctcccagct

SEQ ID NO: 5452330 - DNA, 18 bp, Homo sapiens
tcttcccccgctaattca

SEQ ID NO: 5452331 - DNA, 19 bp, Homo sapiens
tcttcccccgctaattcat

SEQ ID NO: 5452332 - DNA, 16 bp, Homo sapiens
tcttccccctctccca

SEQ ID NO: 5452333 - DNA, 15 bp, Homo sapiens
tcttcccccttcccg

SEQ ID NO: 5452334 - DNA, 21 bp, Homo sapiens
tcttcccccttcccgccttca

SEQ ID NO: 5452335 - DNA, 15 bp, Homo sapiens
tcttcccctccctcc

SEQ ID NO: 5452336 - DNA, 15 bp, Homo sapiens
tcttccccttcctgt

SEQ ID NO: 5452337 - DNA, 16 bp, Homo sapiens
tcttccccttgccctt

SEQ ID NO: 5452338 - DNA, 22 bp, Homo sapiens
tcttccccttgcccttgccctg

SEQ ID NO: 5452339 - DNA, 17 bp, Homo sapiens
tcttcccgaaccccaag

SEQ ID NO: 5452340 - DNA, 20 bp, Homo sapiens
tcttcccgccccacctccca

SEQ ID NO: 5452341 - DNA, 16 bp, Homo sapiens
tcttcccgcctcagcc

SEQ ID NO: 5452342 - DNA, 21 bp, Homo sapiens
tcttcccgcctcagcctctca

SEQ ID NO: 5452343 - DNA, 16 bp, Homo sapiens
tcttcccgctccccac

SEQ ID NO: 5452344 - DNA, 17 bp, Homo sapiens
tcttcccgtgtgtattt

SEQ ID NO: 5452345 - DNA, 15 bp, Homo sapiens
tcttccctaaaatgt

SEQ ID NO: 5452346 - DNA, 18 bp, Homo sapiens
tcttccctacccttcctg

SEQ ID NO: 5452347 - DNA, 16 bp, Homo sapiens
tcttccctcaaatgtg

SEQ ID NO: 5452348 - DNA, 22 bp, Homo sapiens
tcttccctctccctctctctgg

SEQ ID NO: 5452349 - DNA, 13 bp, Homo sapiens
tcttccctctcta

SEQ ID NO: 5452350 - DNA, 14 bp, Homo sapiens
tcttccctctgggc

SEQ ID NO: 5452351 - DNA, 22 bp, Homo sapiens
tcttccctctgggcctgttctc

SEQ ID NO: 5452352 - DNA, 20 bp, Homo sapiens
tcttccctgcccctgtgcct

SEQ ID NO: 5452353 - DNA, 14 bp, Homo sapiens
tcttccctgcctgt

SEQ ID NO: 5452354 - DNA, 12 bp, Homo sapiens
tcttccctgctt

SEQ ID NO: 5452355 - DNA, 21 bp, Homo sapiens
tcttccctgcttcacgattct

SEQ ID NO: 5452356 - DNA, 13 bp, Homo sapiens
tcttccctgcttt

SEQ ID NO: 5452357 - DNA, 21 bp, Homo sapiens
tcttccctggaaaccttccac

SEQ ID NO: 5452358 - DNA, 18 bp, Homo sapiens
tcttccctggtaagaaaa

SEQ ID NO: 5452359 - DNA, 19 bp, Homo sapiens
tcttccctggtaagaaaaa

SEQ ID NO: 5452360 - DNA, 14 bp, Homo sapiens
tcttcccttagcct

SEQ ID NO: 5452361 - DNA, 16 bp, Homo sapiens
tcttcccttagcctct

SEQ ID NO: 5452362 - DNA, 17 bp, Homo sapiens
tcttcccttagcctctc

SEQ ID NO: 5452363 - DNA, 18 bp, Homo sapiens
tcttcccttagcctctcc

SEQ ID NO: 5452364 - DNA, 15 bp, Homo sapiens
tcttcccttcaaggt

SEQ ID NO: 5452365 - DNA, 21 bp, Homo sapiens
tcttcccttcccagaccagga

SEQ ID NO: 5452366 - DNA, 14 bp, Homo sapiens
tcttcccttcctcc

SEQ ID NO: 5452367 - DNA, 12 bp, Homo sapiens
tcttcccttctt

SEQ ID NO: 5452368 - DNA, 13 bp, Homo sapiens
tcttcccttcttt

SEQ ID NO: 5452369 - DNA, 18 bp, Homo sapiens
tcttcccttgctcatgag

SEQ ID NO: 5452370 - DNA, 17 bp, Homo sapiens
tcttccctttccccagc

SEQ ID NO: 5452371 - DNA, 23 bp, Homo sapiens
tcttccctttcctcccttctgat

SEQ ID NO: 5452372 - DNA, 16 bp, Homo sapiens
tcttccctttgtgtat

SEQ ID NO: 5452373 - DNA, 17 bp, Homo sapiens
tcttccctttgtgtatc

SEQ ID NO: 5452374 - DNA, 19 bp, Homo sapiens
tcttcccttttacatactg

SEQ ID NO: 5452375 - DNA, 18 bp, Homo sapiens
tcttccgcccctgcctgc

SEQ ID NO: 5452376 - DNA, 21 bp, Homo sapiens
tcttccgcccctgcctgccat

SEQ ID NO: 5452377 - DNA, 18 bp, Homo sapiens
tcttccggagatgtagca

SEQ ID NO: 5452378 - DNA, 19 bp, Homo sapiens
tcttccggagatgtagcaa

SEQ ID NO: 5452379 - DNA, 23 bp, Homo sapiens
tcttccggcccctcccctccaaa

SEQ ID NO: 5452380 - DNA, 16 bp, Homo sapiens
tcttccgttggaaaga

SEQ ID NO: 5452381 - DNA, 22 bp, Homo sapiens
tcttccgttggaaagaacattt

SEQ ID NO: 5452382 - DNA, 17 bp, Homo sapiens
tcttcctacatcttctt

SEQ ID NO: 5452383 - DNA, 19 bp, Homo sapiens
tcttcctaccctccttcca

SEQ ID NO: 5452384 - DNA, 18 bp, Homo sapiens
tcttcctaccctgcctcc

SEQ ID NO: 5452385 - DNA, 22 bp, Homo sapiens
tcttcctactcttctctctgct

SEQ ID NO: 5452386 - DNA, 14 bp, Homo sapiens
tcttcctaggccac

SEQ ID NO: 5452387 - DNA, 19 bp, Homo sapiens
tcttcctagtatattagtt

SEQ ID NO: 5452388 - DNA, 16 bp, Homo sapiens
tcttcctagtgcctac

SEQ ID NO: 5452389 - DNA, 17 bp, Homo sapiens
tcttcctatccctctcc

SEQ ID NO: 5452390 - DNA, 14 bp, Homo sapiens
tcttcctatttcag

SEQ ID NO: 5452391 - DNA, 16 bp, Homo sapiens
tcttcctatttcagaa

SEQ ID NO: 5452392 - DNA, 13 bp, Homo sapiens
tcttcctcagcca

SEQ ID NO: 5452393 - DNA, 18 bp, Homo sapiens
tcttcctcagccagcctc

SEQ ID NO: 5452394 - DNA, 12 bp, Homo sapiens
tcttcctcagct

SEQ ID NO: 5452395 - DNA, 13 bp, Homo sapiens
tcttcctcagctg

SEQ ID NO: 5452396 - DNA, 14 bp, Homo sapiens
tcttcctcagctgg

SEQ ID NO: 5452397 - DNA, 15 bp, Homo sapiens
tcttcctcagctggt

SEQ ID NO: 5452398 - DNA, 21 bp, Homo sapiens
tcttcctcatcctgcttctct

SEQ ID NO: 5452399 - DNA, 16 bp, Homo sapiens
tcttcctccaaagcct

SEQ ID NO: 5452400 - DNA, 20 bp, Homo sapiens
tcttcctccaaggacagaag

SEQ ID NO: 5452401 - DNA, 13 bp, Homo sapiens
tcttcctccactt

SEQ ID NO: 5452402 - DNA, 19 bp, Homo sapiens
tcttcctccagtctgttct

SEQ ID NO: 5452403 - DNA, 12 bp, Homo sapiens
tcttcctcccct

SEQ ID NO: 5452404 - DNA, 14 bp, Homo sapiens
tcttcctccctccc

SEQ ID NO: 5452405 - DNA, 20 bp, Homo sapiens
tcttcctccctccctgcagg

SEQ ID NO: 5452406 - DNA, 17 bp, Homo sapiens
tcttcctccgaggccag

SEQ ID NO: 5452407 - DNA, 12 bp, Homo sapiens
tcttcctcctgg

SEQ ID NO: 5452408 - DNA, 17 bp, Homo sapiens
tcttcctctaacatttt

SEQ ID NO: 5452409 - DNA, 13 bp, Homo sapiens
tcttcctctccat

SEQ ID NO: 5452410 - DNA, 17 bp, Homo sapiens
tcttcctctccatacct

SEQ ID NO: 5452411 - DNA, 17 bp, Homo sapiens
tcttcctctccttccca

SEQ ID NO: 5452412 - DNA, 13 bp, Homo sapiens
tcttcctctctct

SEQ ID NO: 5452413 - DNA, 14 bp, Homo sapiens
tcttcctctgaggc

SEQ ID NO: 5452414 - DNA, 15 bp, Homo sapiens
tcttcctctgcaagt

SEQ ID NO: 5452415 - DNA, 12 bp, Homo sapiens
tcttcctctgct

SEQ ID NO: 5452416 - DNA, 11 bp, Homo sapiens
tcttcctctgg

SEQ ID NO: 5452417 - DNA, 12 bp, Homo sapiens
tcttcctctgga

SEQ ID NO: 5452418 - DNA, 20 bp, Homo sapiens
tcttcctctgggcagcgcta

SEQ ID NO: 5452419 - DNA, 20 bp, Homo sapiens
tcttcctctggttcctttca

SEQ ID NO: 5452420 - DNA, 18 bp, Homo sapiens
tcttcctcttagcctctg

SEQ ID NO: 5452421 - DNA, 14 bp, Homo sapiens
tcttcctcttcttt

SEQ ID NO: 5452422 - DNA, 15 bp, Homo sapiens
tcttcctcttgaccc

SEQ ID NO: 5452423 - DNA, 14 bp, Homo sapiens
tcttcctgagtggt

SEQ ID NO: 5452424 - DNA, 22 bp, Homo sapiens
tcttcctgcaaccactctgtgg

SEQ ID NO: 5452425 - DNA, 11 bp, Homo sapiens
tcttcctgccc

SEQ ID NO: 5452426 - DNA, 15 bp, Homo sapiens
tcttcctgcccctct

SEQ ID NO: 5452427 - DNA, 18 bp, Homo sapiens
tcttcctgcccctctttc

SEQ ID NO: 5452428 - DNA, 21 bp, Homo sapiens
tcttcctgcccctctttctct

SEQ ID NO: 5452429 - DNA, 13 bp, Homo sapiens
tcttcctgccctt

SEQ ID NO: 5452430 - DNA, 14 bp, Homo sapiens
tcttcctgcccttg

SEQ ID NO: 5452431 - DNA, 13 bp, Homo sapiens
tcttcctgcctcc

SEQ ID NO: 5452432 - DNA, 13 bp, Homo sapiens
tcttcctgctgct

SEQ ID NO: 5452433 - DNA, 13 bp, Homo sapiens
tcttcctggaata

SEQ ID NO: 5452434 - DNA, 22 bp, Homo sapiens
tcttcctggaataaacatctgt

SEQ ID NO: 5452435 - DNA, 13 bp, Homo sapiens
tcttcctggacag

SEQ ID NO: 5452436 - DNA, 19 bp, Homo sapiens
tcttcctggacaggccagg

SEQ ID NO: 5452437 - DNA, 18 bp, Homo sapiens
tcttcctggacctgagtc

SEQ ID NO: 5452438 - DNA, 12 bp, Homo sapiens
tcttcctggagc

SEQ ID NO: 5452439 - DNA, 23 bp, Homo sapiens
tcttcctggatggggcagagctt

SEQ ID NO: 5452440 - DNA, 14 bp, Homo sapiens
tcttcctggcacaa

SEQ ID NO: 5452441 - DNA, 13 bp, Homo sapiens
tcttcctggcttt

SEQ ID NO: 5452442 - DNA, 21 bp, Homo sapiens
tcttcctggtagactaggttt

SEQ ID NO: 5452443 - DNA, 20 bp, Homo sapiens
tcttcctggtcgaaagttag

SEQ ID NO: 5452444 - DNA, 22 bp, Homo sapiens
tcttcctgtaacacaagccaca

SEQ ID NO: 5452445 - DNA, 14 bp, Homo sapiens
tcttcctgtaatct

SEQ ID NO: 5452446 - DNA, 23 bp, Homo sapiens
tcttcctgtgaagtttaattgtc

SEQ ID NO: 5452447 - DNA, 17 bp, Homo sapiens
tcttcctgtggctccct

SEQ ID NO: 5452448 - DNA, 20 bp, Homo sapiens
tcttcctgtggctccctctc

SEQ ID NO: 5452449 - DNA, 12 bp, Homo sapiens
tcttcctgtggg

SEQ ID NO: 5452450 - DNA, 13 bp, Homo sapiens
tcttcctgtgggg

SEQ ID NO: 5452451 - DNA, 19 bp, Homo sapiens
tcttcctgtgggggaagag

SEQ ID NO: 5452452 - DNA, 21 bp, Homo sapiens
tcttcctgtgtacctctagaa

SEQ ID NO: 5452453 - DNA, 14 bp, Homo sapiens
tcttcctgtgtcct

SEQ ID NO: 5452454 - DNA, 15 bp, Homo sapiens
tcttcctgtgtcctg

SEQ ID NO: 5452455 - DNA, 19 bp, Homo sapiens
tcttcctgttaatgtattt

SEQ ID NO: 5452456 - DNA, 17 bp, Homo sapiens
tcttcctgttctgtgac

SEQ ID NO: 5452457 - DNA, 21 bp, Homo sapiens
tcttcctgttttgtacataga

SEQ ID NO: 5452458 - DNA, 11 bp, Homo sapiens
tcttccttaaa

SEQ ID NO: 5452459 - DNA, 19 bp, Homo sapiens
tcttccttaaatgactttt

SEQ ID NO: 5452460 - DNA, 20 bp, Homo sapiens
tcttccttactttttatata

SEQ ID NO: 5452461 - DNA, 14 bp, Homo sapiens
tcttccttccacag

SEQ ID NO: 5452462 - DNA, 15 bp, Homo sapiens
tcttccttccctgct

SEQ ID NO: 5452463 - DNA, 17 bp, Homo sapiens
tcttccttccctgctgt

SEQ ID NO: 5452464 - DNA, 12 bp, Homo sapiens
tcttccttcctt

SEQ ID NO: 5452465 - DNA, 23 bp, Homo sapiens
tcttccttctcagccttggttcc

SEQ ID NO: 5452466 - DNA, 23 bp, Homo sapiens
tcttccttctcattgctgcccgt

SEQ ID NO: 5452467 - DNA, 22 bp, Homo sapiens
tcttccttctttattgcccctt

SEQ ID NO: 5452468 - DNA, 17 bp, Homo sapiens
tcttgccttttgttaat

SEQ ID NO: 5452469 - DNA, 14 bp, Homo sapiens
tcttgcgatcctta

SEQ ID NO: 5452470 - DNA, 17 bp, Homo sapiens
tcttgcggcaccgccca

SEQ ID NO: 5452471 - DNA, 14 bp, Homo sapiens
tcttgcgggcctgg

SEQ ID NO: 5452472 - DNA, 18 bp, Homo sapiens
tcttgcgggcctggacaa

SEQ ID NO: 5452473 - DNA, 22 bp, Homo sapiens
tcttgcgtgtcaatttccctca

SEQ ID NO: 5452474 - DNA, 23 bp, Homo sapiens
tcttgcgtgtcaatttccctcag

SEQ ID NO: 5452475 - DNA, 14 bp, Homo sapiens
tcttgctaactttg

SEQ ID NO: 5452476 - DNA, 17 bp, Homo sapiens
tcttgctaatcagtgtc

SEQ ID NO: 5452477 - DNA, 23 bp, Homo sapiens
tcttgctaatcagtgtctcacac

SEQ ID NO: 5452478 - DNA, 20 bp, Homo sapiens
tcttgctaccagtatttaga

SEQ ID NO: 5452479 - DNA, 17 bp, Homo sapiens
tcttgctacctcagtca

SEQ ID NO: 5452480 - DNA, 20 bp, Homo sapiens
tcttgctacctcagtcagta

SEQ ID NO: 5452481 - DNA, 14 bp, Homo sapiens
tcttgctagctatt

SEQ ID NO: 5452482 - DNA, 24 bp, Homo sapiens
tcttgctatctctcaagagtgctg

SEQ ID NO: 5452483 - DNA, 16 bp, Homo sapiens
tcttgctatttgagca

SEQ ID NO: 5452484 - DNA, 15 bp, Homo sapiens
tcttgctcactccct

SEQ ID NO: 5452485 - DNA, 16 bp, Homo sapiens
tcttgctcagagctag

SEQ ID NO: 5452486 - DNA, 19 bp, Homo sapiens
tcttgctccaataaaggaa

SEQ ID NO: 5452487 - DNA, 21 bp, Homo sapiens
tcttgctccaataaaggaaca

SEQ ID NO: 5452488 - DNA, 18 bp, Homo sapiens
tcttgctccattgtcatg

SEQ ID NO: 5452489 - DNA, 18 bp, Homo sapiens
tcttgctctatctcacag

SEQ ID NO: 5452490 - DNA, 22 bp, Homo sapiens
tcttgctctcgaccggccctgc

SEQ ID NO: 5452491 - DNA, 14 bp, Homo sapiens
tcttgctctctctc

SEQ ID NO: 5452492 - DNA, 11 bp, Homo sapiens
tcttgctctgc

SEQ ID NO: 5452493 - DNA, 12 bp, Homo sapiens
tcttgctctgct

SEQ ID NO: 5452494 - DNA, 15 bp, Homo sapiens
tcttgctctgctgac

SEQ ID NO: 5452495 - DNA, 17 bp, Homo sapiens
tcttgctctgtaatctc

SEQ ID NO: 5452496 - DNA, 19 bp, Homo sapiens
tcttgctctttctactctg

SEQ ID NO: 5452497 - DNA, 21 bp, Homo sapiens
tcttgctctttctactctgaa

SEQ ID NO: 5452498 - DNA, 17 bp, Homo sapiens
tcttgctgaaagccaag

SEQ ID NO: 5452499 - DNA, 19 bp, Homo sapiens
tcttgctgaattaagcaga

SEQ ID NO: 5452500 - DNA, 21 bp, Homo sapiens
tcttgctgatggctgctagat

SEQ ID NO: 5452501 - DNA, 13 bp, Homo sapiens
tcttgctgcagcc

SEQ ID NO: 5452502 - DNA, 22 bp, Homo sapiens
tcttgctgcaggccctccctct

SEQ ID NO: 5452503 - DNA, 13 bp, Homo sapiens
tcttgctgcccac

SEQ ID NO: 5452504 - DNA, 13 bp, Homo sapiens
tcttgctgctaga

SEQ ID NO: 5452505 - DNA, 17 bp, Homo sapiens
tcttgctgctagaactt

SEQ ID NO: 5452506 - DNA, 22 bp, Homo sapiens
tcttgctgctagaactttttta

SEQ ID NO: 5452507 - DNA, 11 bp, Homo sapiens
tcttgctggct

SEQ ID NO: 5452508 - DNA, 18 bp, Homo sapiens
tcttgctggctctgagaa

SEQ ID NO: 5452509 - DNA, 19 bp, Homo sapiens
tcttgctggctctgagaat

SEQ ID NO: 5452510 - DNA, 20 bp, Homo sapiens
tcttgctgggaacacagcca

SEQ ID NO: 5452511 - DNA, 12 bp, Homo sapiens
tcttgctggtgc

SEQ ID NO: 5452512 - DNA, 13 bp, Homo sapiens
tcttgctgtctct

SEQ ID NO: 5452513 - DNA, 16 bp, Homo sapiens
tcttgctgtctctgct

SEQ ID NO: 5452514 - DNA, 11 bp, Homo sapiens
tcttgctgtga

SEQ ID NO: 5452515 - DNA, 13 bp, Homo sapiens
tcttgctgtgaaa

SEQ ID NO: 5452516 - DNA, 14 bp, Homo sapiens
tcttgctgtggtct

SEQ ID NO: 5452517 - DNA, 19 bp, Homo sapiens
tcttgctgttcagtgcttt

SEQ ID NO: 5452518 - DNA, 18 bp, Homo sapiens
tcttgctgttgacatatt

SEQ ID NO: 5452519 - DNA, 21 bp, Homo sapiens
tcttgctgttgacatatttaa

SEQ ID NO: 5452520 - DNA, 20 bp, Homo sapiens
tcttgctgtttaccgcccac

SEQ ID NO: 5452521 - DNA, 13 bp, Homo sapiens
tcttgcttccaag

SEQ ID NO: 5452522 - DNA, 22 bp, Homo sapiens
tcttgcttccaagaccatttgt

SEQ ID NO: 5452523 - DNA, 17 bp, Homo sapiens
tcttgcttctttctaga

SEQ ID NO: 5452524 - DNA, 20 bp, Homo sapiens
tcttgcttggggaacttgtg

SEQ ID NO: 5452525 - DNA, 16 bp, Homo sapiens
tcttgcttgtaaaaat

SEQ ID NO: 5452526 - DNA, 14 bp, Homo sapiens
tcttgcttgtacct

SEQ ID NO: 5452527 - DNA, 14 bp, Homo sapiens
tcttgctttcacaa

SEQ ID NO: 5452528 - DNA, 17 bp, Homo sapiens
tcttgctttcacaaata

SEQ ID NO: 5452529 - DNA, 12 bp, Homo sapiens
tcttgctttctc

SEQ ID NO: 5452530 - DNA, 17 bp, Homo sapiens
tcttgctttctctctca

SEQ ID NO: 5452531 - DNA, 14 bp, Homo sapiens
tcttgctttctttg

SEQ ID NO: 5452532 - DNA, 20 bp, Homo sapiens
tcttgctttctttgacctct

SEQ ID NO: 5452533 - DNA, 19 bp, Homo sapiens
tcttgctttgaatgcatgt

SEQ ID NO: 5452534 - DNA, 13 bp, Homo sapiens
tcttggaaaaaaa

SEQ ID NO: 5452535 - DNA, 19 bp, Homo sapiens
tcttggaaaaaaattacaa

SEQ ID NO: 5452536 - DNA, 15 bp, Homo sapiens
tcttggaaaaagtga

SEQ ID NO: 5452537 - DNA, 19 bp, Homo sapiens
tcttggaaaataagacaat

SEQ ID NO: 5452538 - DNA, 15 bp, Homo sapiens
tcttggaaatcaggt

SEQ ID NO: 5452539 - DNA, 18 bp, Homo sapiens
tcttggaaatgttaagaa

SEQ ID NO: 5452540 - DNA, 19 bp, Homo sapiens
tcttggaaatgttaagaaa

SEQ ID NO: 5452541 - DNA, 21 bp, Homo sapiens
tcttggaacattggaatgttc

SEQ ID NO: 5452542 - DNA, 16 bp, Homo sapiens
tcttggaactgcacca

SEQ ID NO: 5452543 - DNA, 20 bp, Homo sapiens
tcttggaactgtcccagcta

SEQ ID NO: 5452544 - DNA, 15 bp, Homo sapiens
tcttggaacttgcct

SEQ ID NO: 5452545 - DNA, 19 bp, Homo sapiens
tcttggaagtctgtctcag

SEQ ID NO: 5452546 - DNA, 16 bp, Homo sapiens
tcttggacactgtaca

SEQ ID NO: 5452547 - DNA, 18 bp, Homo sapiens
tcttggacacttaattct

SEQ ID NO: 5452548 - DNA, 21 bp, Homo sapiens
tcttggacacttaattctgtt

SEQ ID NO: 5452549 - DNA, 14 bp, Homo sapiens
tcttggacccacct

SEQ ID NO: 5452550 - DNA, 22 bp, Homo sapiens
tcttggacccctgaattcaatg

SEQ ID NO: 5452551 - DNA, 14 bp, Homo sapiens
tcttggaccttggc

SEQ ID NO: 5452552 - DNA, 17 bp, Homo sapiens
tcttggagaactttcca

SEQ ID NO: 5452553 - DNA, 18 bp, Homo sapiens
tcttggagacaattacaa

SEQ ID NO: 5452554 - DNA, 17 bp, Homo sapiens
tcttggagaccctgcaa

SEQ ID NO: 5452555 - DNA, 13 bp, Homo sapiens
tcttggagaggag

SEQ ID NO: 5452556 - DNA, 14 bp, Homo sapiens
tcttggagcctgca

SEQ ID NO: 5452557 - DNA, 12 bp, Homo sapiens
tcttggagctga

SEQ ID NO: 5452558 - DNA, 16 bp, Homo sapiens
tcttggatctttttgc

SEQ ID NO: 5452559 - DNA, 20 bp, Homo sapiens
tcttggcaaaagccttgtgt

SEQ ID NO: 5452560 - DNA, 16 bp, Homo sapiens
tcttggcaataaattt

SEQ ID NO: 5452561 - DNA, 20 bp, Homo sapiens
tcttggcaataaattttgaa

SEQ ID NO: 5452562 - DNA, 21 bp, Homo sapiens
tcttggcacatttaagagaca

SEQ ID NO: 5452563 - DNA, 13 bp, Homo sapiens
tcttggcagtcac

SEQ ID NO: 5452564 - DNA, 14 bp, Homo sapiens
tcttggcattaaac

SEQ ID NO: 5452565 - DNA, 13 bp, Homo sapiens
tcttggccagagc

SEQ ID NO: 5452566 - DNA, 22 bp, Homo sapiens
tcttggcccctgtgtgagttga

SEQ ID NO: 5452567 - DNA, 18 bp, Homo sapiens
tcttggcccgcacagagc

SEQ ID NO: 5452568 - DNA, 21 bp, Homo sapiens
tcttggcccgcacagagctgg

SEQ ID NO: 5452569 - DNA, 16 bp, Homo sapiens
tcttggccctcctcag

SEQ ID NO: 5452570 - DNA, 16 bp, Homo sapiens
tcttggccgactcagg

SEQ ID NO: 5452571 - DNA, 13 bp, Homo sapiens
tcttggcctccca

SEQ ID NO: 5452572 - DNA, 14 bp, Homo sapiens
tcttggcctcccaa

SEQ ID NO: 5452573 - DNA, 21 bp, Homo sapiens
tcttggcctgctagcggctga

SEQ ID NO: 5452574 - DNA, 20 bp, Homo sapiens
tcttggcctttgcatttatt

SEQ ID NO: 5452575 - DNA, 18 bp, Homo sapiens
tcttggcggcagcagcca

SEQ ID NO: 5452576 - DNA, 16 bp, Homo sapiens
tcttggcgttcctgcc

SEQ ID NO: 5452577 - DNA, 18 bp, Homo sapiens
tcttggctatttctgtgt

SEQ ID NO: 5452578 - DNA, 19 bp, Homo sapiens
tcttggctatttctgtgtc

SEQ ID NO: 5452579 - DNA, 14 bp, Homo sapiens
tcttggctgacccc

SEQ ID NO: 5452580 - DNA, 15 bp, Homo sapiens
tcttggctgacccct

SEQ ID NO: 5452581 - DNA, 19 bp, Homo sapiens
tcttggctgacccctctgg

SEQ ID NO: 5452582 - DNA, 21 bp, Homo sapiens
tcttggctgttctagacacag

SEQ ID NO: 5452583 - DNA, 16 bp, Homo sapiens
tcttggcttcccacca

SEQ ID NO: 5452584 - DNA, 14 bp, Homo sapiens
tcttggcttcctgg

SEQ ID NO: 5452585 - DNA, 15 bp, Homo sapiens
tcttggcttctcagc

SEQ ID NO: 5452586 - DNA, 20 bp, Homo sapiens
tcttggcttctcagcccctt

SEQ ID NO: 5452587 - DNA, 16 bp, Homo sapiens
tcttggcttctgggac

SEQ ID NO: 5452588 - DNA, 19 bp, Homo sapiens
tcttggcttctgggacctg

SEQ ID NO: 5452589 - DNA, 16 bp, Homo sapiens
tcttggcttcttaaaa

SEQ ID NO: 5452590 - DNA, 17 bp, Homo sapiens
tcttggcttcttaaaaa

SEQ ID NO: 5452591 - DNA, 23 bp, Homo sapiens
tcttggcttcttaaaaactgtgt

SEQ ID NO: 5452592 - DNA, 18 bp, Homo sapiens
tcttggctttcagagttt

SEQ ID NO: 5452593 - DNA, 12 bp, Homo sapiens
tcttgggaaata

SEQ ID NO: 5452594 - DNA, 19 bp, Homo sapiens
tcttgggaaatatgaatgc

SEQ ID NO: 5452595 - DNA, 20 bp, Homo sapiens
tcttgggaaatatgaatgcc

SEQ ID NO: 5452596 - DNA, 16 bp, Homo sapiens
tcttgggactgggttt

SEQ ID NO: 5452597 - DNA, 17 bp, Homo sapiens
tcttgggagtatgttgt

SEQ ID NO: 5452598 - DNA, 20 bp, Homo sapiens
tcttgggagtatgttgtcat

SEQ ID NO: 5452599 - DNA, 17 bp, Homo sapiens
tcttgggatacagatct

SEQ ID NO: 5452600 - DNA, 21 bp, Homo sapiens
tcttgggcaatattctctgta

SEQ ID NO: 5452601 - DNA, 20 bp, Homo sapiens
tcttgggcagagctggctct

SEQ ID NO: 5452602 - DNA, 23 bp, Homo sapiens
tcttgggcagagctggctctgag

SEQ ID NO: 5452603 - DNA, 22 bp, Homo sapiens
tcttgggccaagccagctgcct

SEQ ID NO: 5452604 - DNA, 15 bp, Homo sapiens
tcttgggccccagac

SEQ ID NO: 5452605 - DNA, 16 bp, Homo sapiens
tcttgggccccagacc

SEQ ID NO: 5452606 - DNA, 19 bp, Homo sapiens
tcttgggcctgacctccag

SEQ ID NO: 5452607 - DNA, 21 bp, Homo sapiens
tcttgggcctgacctccagtc

SEQ ID NO: 5452608 - DNA, 23 bp, Homo sapiens
tcttgggcctgacctccagtcct

SEQ ID NO: 5452609 - DNA, 14 bp, Homo sapiens
tcttgggcctggcc

SEQ ID NO: 5452610 - DNA, 14 bp, Homo sapiens
tcttgggctactgg

SEQ ID NO: 5452611 - DNA, 17 bp, Homo sapiens
tcttgggctgagtgcag

SEQ ID NO: 5452612 - DNA, 18 bp, Homo sapiens
tcttgggctgagtgcagc

SEQ ID NO: 5452613 - DNA, 20 bp, Homo sapiens
tcttgggctgagtgcagcca

SEQ ID NO: 5452614 - DNA, 21 bp, Homo sapiens
tcttggggaaggatctccccg

SEQ ID NO: 5452615 - DNA, 17 bp, Homo sapiens
tcttggggacatctctt

SEQ ID NO: 5452616 - DNA, 20 bp, Homo sapiens
tcttggggcaagactgcaaa

SEQ ID NO: 5452617 - DNA, 23 bp, Homo sapiens
tcttggggcaagactgcaaactt

SEQ ID NO: 5452618 - DNA, 16 bp, Homo sapiens
tcttgggggaaaatac

SEQ ID NO: 5452619 - DNA, 21 bp, Homo sapiens
tcttgggggacagggctggcc

SEQ ID NO: 5452620 - DNA, 23 bp, Homo sapiens
tcttgggggcagaccagagagct

SEQ ID NO: 5452621 - DNA, 11 bp, Homo sapiens
tcttgggggtc

SEQ ID NO: 5452622 - DNA, 20 bp, Homo sapiens
tcttgggggttgccattccc

SEQ ID NO: 5452623 - DNA, 14 bp, Homo sapiens
tcttggggtcccac

SEQ ID NO: 5452624 - DNA, 16 bp, Homo sapiens
tcttgggtagggcaga

SEQ ID NO: 5452625 - DNA, 17 bp, Homo sapiens
tcttgggtagggcagac

SEQ ID NO: 5452626 - DNA, 21 bp, Homo sapiens
tcttgggtctgccctgcccat

SEQ ID NO: 5452627 - DNA, 19 bp, Homo sapiens
tcttgggtgggacagggct

SEQ ID NO: 5452628 - DNA, 21 bp, Homo sapiens
tcttgggtgggacagggcttc

SEQ ID NO: 5452629 - DNA, 17 bp, Homo sapiens
tcttgggtggttcctaa

SEQ ID NO: 5452630 - DNA, 23 bp, Homo sapiens
tcttgggtggttcctaagggaaa

SEQ ID NO: 5452631 - DNA, 15 bp, Homo sapiens
tcttgggtgtattct

SEQ ID NO: 5452632 - DNA, 18 bp, Homo sapiens
tcttgggtgtattctctg

SEQ ID NO: 5452633 - DNA, 19 bp, Homo sapiens
tcttgggtgtattctctgt

SEQ ID NO: 5452634 - DNA, 20 bp, Homo sapiens
tcttgggtgttagtgtcagc

SEQ ID NO: 5452635 - DNA, 13 bp, Homo sapiens
tcttggtaacaaa

SEQ ID NO: 5452636 - DNA, 16 bp, Homo sapiens
tcttggtagttctgtg

SEQ ID NO: 5452637 - DNA, 18 bp, Homo sapiens
tcttggtagttctgtgcc

SEQ ID NO: 5452638 - DNA, 18 bp, Homo sapiens
tcttggtcaagtttttct

SEQ ID NO: 5452639 - DNA, 14 bp, Homo sapiens
tcttggtccctggt

SEQ ID NO: 5452640 - DNA, 15 bp, Homo sapiens
tcttggtcctgctgc

SEQ ID NO: 5452641 - DNA, 14 bp, Homo sapiens
tcttggtcctgtca

SEQ ID NO: 5452642 - DNA, 17 bp, Homo sapiens
tcttggtctcagcttca

SEQ ID NO: 5452643 - DNA, 21 bp, Homo sapiens
tcttggtctctatagcagtgt

SEQ ID NO: 5452644 - DNA, 12 bp, Homo sapiens
tcttggtctctt

SEQ ID NO: 5452645 - DNA, 17 bp, Homo sapiens
tcttggtgaaataataa

SEQ ID NO: 5452646 - DNA, 15 bp, Homo sapiens
tctttcttctcgcct

SEQ ID NO: 5452647 - DNA, 21 bp, Homo sapiens
tctttcttctcgcctaggatt

SEQ ID NO: 5452648 - DNA, 19 bp, Homo sapiens
tctttcttcttttttaagt

SEQ ID NO: 5452649 - DNA, 13 bp, Homo sapiens
tctttcttgaaat

SEQ ID NO: 5452650 - DNA, 14 bp, Homo sapiens
tctttcttgctccc

SEQ ID NO: 5452651 - DNA, 19 bp, Homo sapiens
tctttcttgctccctgact

SEQ ID NO: 5452652 - DNA, 22 bp, Homo sapiens
tctttcttgctggctctgagaa

SEQ ID NO: 5452653 - DNA, 15 bp, Homo sapiens
tctttcttgctttga

SEQ ID NO: 5452654 - DNA, 22 bp, Homo sapiens
tctttcttgggatagtgttctg

SEQ ID NO: 5452655 - DNA, 17 bp, Homo sapiens
tctttcttggtgcattc

SEQ ID NO: 5452656 - DNA, 13 bp, Homo sapiens
tctttcttgtttg

SEQ ID NO: 5452657 - DNA, 15 bp, Homo sapiens
tctttctttctctaa

SEQ ID NO: 5452658 - DNA, 18 bp, Homo sapiens
tctttctttgcaccaaag

SEQ ID NO: 5452659 - DNA, 15 bp, Homo sapiens
tctttctttgctgct

SEQ ID NO: 5452660 - DNA, 22 bp, Homo sapiens
tctttctttgggaatatttgaa

SEQ ID NO: 5452661 - DNA, 16 bp, Homo sapiens
tctttctttgtcattc

SEQ ID NO: 5452662 - DNA, 11 bp, Homo sapiens
tctttctttta

SEQ ID NO: 5452663 - DNA, 24 bp, Homo sapiens
tctttcttttcttttttaaagtaa

SEQ ID NO: 5452664 - DNA, 18 bp, Homo sapiens
tctttcttttgtgcatat

SEQ ID NO: 5452665 - DNA, 17 bp, Homo sapiens
tctttctttttccttca

SEQ ID NO: 5452666 - DNA, 13 bp, Homo sapiens
tctttctttttct

SEQ ID NO: 5452667 - DNA, 19 bp, Homo sapiens
tctttctttttctggaaat

SEQ ID NO: 5452668 - DNA, 15 bp, Homo sapiens
tctttctttttctgt

SEQ ID NO: 5452669 - DNA, 19 bp, Homo sapiens
tctttctttttctgtctct

SEQ ID NO: 5452670 - DNA, 18 bp, Homo sapiens
tctttgaaaacagatgac

SEQ ID NO: 5452671 - DNA, 14 bp, Homo sapiens
tctttgaaaactca

SEQ ID NO: 5452672 - DNA, 13 bp, Homo sapiens
tctttgaaaagaa

SEQ ID NO: 5452673 - DNA, 14 bp, Homo sapiens
tctttgaaaagaaa

SEQ ID NO: 5452674 - DNA, 23 bp, Homo sapiens
tctttgaaagacttccaaagaat

SEQ ID NO: 5452675 - DNA, 11 bp, Homo sapiens
tctttgaaata

SEQ ID NO: 5452676 - DNA, 12 bp, Homo sapiens
tctttgaaataa

SEQ ID NO: 5452677 - DNA, 21 bp, Homo sapiens
tctttgaaatagtctgtgtga

SEQ ID NO: 5452678 - DNA, 17 bp, Homo sapiens
tctttgaaatatgcatg

SEQ ID NO: 5452679 - DNA, 18 bp, Homo sapiens
tctttgaaatatgcatgt

SEQ ID NO: 5452680 - DNA, 22 bp, Homo sapiens
tctttgaaatatgcatgtactt

SEQ ID NO: 5452681 - DNA, 20 bp, Homo sapiens
tctttgaaatgctaaacttg

SEQ ID NO: 5452682 - DNA, 12 bp, Homo sapiens
tctttgaaatta

SEQ ID NO: 5452683 - DNA, 18 bp, Homo sapiens
tctttgaacgtacccaag

SEQ ID NO: 5452684 - DNA, 20 bp, Homo sapiens
tctttgaactccgctgcctt

SEQ ID NO: 5452685 - DNA, 22 bp, Homo sapiens
tctttgaactccgctgccttcc

SEQ ID NO: 5452686 - DNA, 15 bp, Homo sapiens
tctttgaagaaaaga

SEQ ID NO: 5452687 - DNA, 23 bp, Homo sapiens
tctttgaagaaaagaaaaaacaa

SEQ ID NO: 5452688 - DNA, 13 bp, Homo sapiens
tctttgaagttat

SEQ ID NO: 5452689 - DNA, 14 bp, Homo sapiens
tctttgaataaagt

SEQ ID NO: 5452690 - DNA, 16 bp, Homo sapiens
tctttgaataaagtct

SEQ ID NO: 5452691 - DNA, 16 bp, Homo sapiens
tctttgaatgacaaag

SEQ ID NO: 5452692 - DNA, 14 bp, Homo sapiens
tctttgaatgtatt

SEQ ID NO: 5452693 - DNA, 15 bp, Homo sapiens
tctttgaatgtattg

SEQ ID NO: 5452694 - DNA, 19 bp, Homo sapiens
tctttgaatttcctatctg

SEQ ID NO: 5452695 - DNA, 17 bp, Homo sapiens
tctttgaattttctgtg

SEQ ID NO: 5452696 - DNA, 19 bp, Homo sapiens
tctttgacaattctgggtg

SEQ ID NO: 5452697 - DNA, 18 bp, Homo sapiens
tctttgacatttttgcca

SEQ ID NO: 5452698 - DNA, 19 bp, Homo sapiens
tctttgaccagatctttct

SEQ ID NO: 5452699 - DNA, 14 bp, Homo sapiens
tctttgacctcaat

SEQ ID NO: 5452700 - DNA, 17 bp, Homo sapiens
tctttgacctcaatgga

SEQ ID NO: 5452701 - DNA, 21 bp, Homo sapiens
tctttgacgggaggcctcagt

SEQ ID NO: 5452702 - DNA, 22 bp, Homo sapiens
tctttgacgggaggcctcagtt

SEQ ID NO: 5452703 - DNA, 17 bp, Homo sapiens
tctttgactgtcagcaa

SEQ ID NO: 5452704 - DNA, 20 bp, Homo sapiens
tctttgagaccccagtgcct

SEQ ID NO: 5452705 - DNA, 22 bp, Homo sapiens
tctttgagcccattcttctggg

SEQ ID NO: 5452706 - DNA, 21 bp, Homo sapiens
tctttgagggactgcctctgc

SEQ ID NO: 5452707 - DNA, 16 bp, Homo sapiens
tctttgagtaatgtga

SEQ ID NO: 5452708 - DNA, 23 bp, Homo sapiens
tctttgagtgaagctgggagaac

SEQ ID NO: 5452709 - DNA, 12 bp, Homo sapiens
tctttgataaca

SEQ ID NO: 5452710 - DNA, 21 bp, Homo sapiens
tctttgataacaaaaaataaa

SEQ ID NO: 5452711 - DNA, 13 bp, Homo sapiens
tctttgataatgt

SEQ ID NO: 5452712 - DNA, 16 bp, Homo sapiens
tctttgataatgttaa

SEQ ID NO: 5452713 - DNA, 20 bp, Homo sapiens
tctttgatacttgttcaaaa

SEQ ID NO: 5452714 - DNA, 17 bp, Homo sapiens
tctttgatccagaggtg

SEQ ID NO: 5452715 - DNA, 15 bp, Homo sapiens
tctttgatccttctg

SEQ ID NO: 5452716 - DNA, 15 bp, Homo sapiens
tctttgatgttaaca

SEQ ID NO: 5452717 - DNA, 17 bp, Homo sapiens
tctttgattagaaaata

SEQ ID NO: 5452718 - DNA, 14 bp, Homo sapiens
tctttgattatgac

SEQ ID NO: 5452719 - DNA, 19 bp, Homo sapiens
tctttgattatttgcatgt

SEQ ID NO: 5452720 - DNA, 17 bp, Homo sapiens
tctttgattcagacagc

SEQ ID NO: 5452721 - DNA, 16 bp, Homo sapiens
tctttgattctccttc

SEQ ID NO: 5452722 - DNA, 23 bp, Homo sapiens
tctttgattctccttcagccctc

SEQ ID NO: 5452723 - DNA, 20 bp, Homo sapiens
tctttgattctccttttatg

SEQ ID NO: 5452724 - DNA, 13 bp, Homo sapiens
tctttgattctgt

SEQ ID NO: 5452725 - DNA, 15 bp, Homo sapiens
tctttgatttaactg

SEQ ID NO: 5452726 - DNA, 18 bp, Homo sapiens
tctttgatttgtaccatt

SEQ ID NO: 5452727 - DNA, 20 bp, Homo sapiens
tctttgcaaaggactgtaag

SEQ ID NO: 5452728 - DNA, 21 bp, Homo sapiens
tctttgcaaagtattgtaaat

SEQ ID NO: 5452729 - DNA, 22 bp, Homo sapiens
tctttgcaaagtattgtaaatt

SEQ ID NO: 5452730 - DNA, 18 bp, Homo sapiens
tctttgcaacagcagtgt

SEQ ID NO: 5452731 - DNA, 16 bp, Homo sapiens
tctttgcaacttccca

SEQ ID NO: 5452732 - DNA, 16 bp, Homo sapiens
tctttgcacaatgatt

SEQ ID NO: 5452733 - DNA, 13 bp, Homo sapiens
tctttgcacatgt

SEQ ID NO: 5452734 - DNA, 18 bp, Homo sapiens
tctttgcacatgtgacca

SEQ ID NO: 5452735 - DNA, 16 bp, Homo sapiens
tctttgcaccaaagac

SEQ ID NO: 5452736 - DNA, 19 bp, Homo sapiens
tctttgcaccaaagacatc

SEQ ID NO: 5452737 - DNA, 14 bp, Homo sapiens
tctttgcagacagg

SEQ ID NO: 5452738 - DNA, 13 bp, Homo sapiens
tctttgcagagcc

SEQ ID NO: 5452739 - DNA, 14 bp, Homo sapiens
tctttgcagttccc

SEQ ID NO: 5452740 - DNA, 12 bp, Homo sapiens
tctttgcatgga

SEQ ID NO: 5452741 - DNA, 15 bp, Homo sapiens
tctttgcatggaatt

SEQ ID NO: 5452742 - DNA, 18 bp, Homo sapiens
tctttgccaccctcatgc

SEQ ID NO: 5452743 - DNA, 20 bp, Homo sapiens
tctttgccaccctcatgctg

SEQ ID NO: 5452744 - DNA, 17 bp, Homo sapiens
tctttgccatctctgct

SEQ ID NO: 5452745 - DNA, 18 bp, Homo sapiens
tctttgccatctctgctc

SEQ ID NO: 5452746 - DNA, 15 bp, Homo sapiens
tctttgcccttctgg

SEQ ID NO: 5452747 - DNA, 13 bp, Homo sapiens
tctttgcccttta

SEQ ID NO: 5452748 - DNA, 20 bp, Homo sapiens
tctttgcctcaactccagga

SEQ ID NO: 5452749 - DNA, 12 bp, Homo sapiens
tctttgcctctc

SEQ ID NO: 5452750 - DNA, 15 bp, Homo sapiens
tctttgcctctgcag

SEQ ID NO: 5452751 - DNA, 17 bp, Homo sapiens
tctttgcctctgcagtc

SEQ ID NO: 5452752 - DNA, 14 bp, Homo sapiens
tctttgcctgtgtg

SEQ ID NO: 5452753 - DNA, 16 bp, Homo sapiens
tctttgcctgtgtgag

SEQ ID NO: 5452754 - DNA, 15 bp, Homo sapiens
tctttgcctgttcag

SEQ ID NO: 5452755 - DNA, 23 bp, Homo sapiens
tctttgcctgttcagttacagaa

SEQ ID NO: 5452756 - DNA, 21 bp, Homo sapiens
tctttgccttgggctgctcct

SEQ ID NO: 5452757 - DNA, 22 bp, Homo sapiens
tctttgcggggcctgtctcagt

SEQ ID NO: 5452758 - DNA, 16 bp, Homo sapiens
tctttgctacaataaa

SEQ ID NO: 5452759 - DNA, 18 bp, Homo sapiens
tctttgctacaataaatg

SEQ ID NO: 5452760 - DNA, 22 bp, Homo sapiens
tctttgctacaataaatgctga

SEQ ID NO: 5452761 - DNA, 16 bp, Homo sapiens
tctttgctcagtggat

SEQ ID NO: 5452762 - DNA, 20 bp, Homo sapiens
tctttgctgaagaagaccag

SEQ ID NO: 5452763 - DNA, 21 bp, Homo sapiens
tctttgctgaatgtcattatt

SEQ ID NO: 5452764 - DNA, 20 bp, Homo sapiens
tctttgctgacactgtgacc

SEQ ID NO: 5452765 - DNA, 21 bp, Homo sapiens
tctttgctgacactgtgaccc

SEQ ID NO: 5452766 - DNA, 22 bp, Homo sapiens
tctttgctgacactgtgaccct

SEQ ID NO: 5452767 - DNA, 13 bp, Homo sapiens
tctttgctgcaga

SEQ ID NO: 5452768 - DNA, 16 bp, Homo sapiens
tctttgctgcattcct

SEQ ID NO: 5452769 - DNA, 15 bp, Homo sapiens
tctttgctgcccctg

SEQ ID NO: 5452770 - DNA, 19 bp, Homo sapiens
tctttgctgctgctctcag

SEQ ID NO: 5452771 - DNA, 17 bp, Homo sapiens
tctttgctgctgtggaa

SEQ ID NO: 5452772 - DNA, 13 bp, Homo sapiens
tctttgctgcttt

SEQ ID NO: 5452773 - DNA, 19 bp, Homo sapiens
tctttgctgtaagatgtct

SEQ ID NO: 5452774 - DNA, 20 bp, Homo sapiens
tctttgctgtactcttgctg

SEQ ID NO: 5452775 - DNA, 23 bp, Homo sapiens
tctttgctgtactcttgctgatg

SEQ ID NO: 5452776 - DNA, 12 bp, Homo sapiens
tctttgctgtgc

SEQ ID NO: 5452777 - DNA, 22 bp, Homo sapiens
tctttgcttccttgcttttatg

SEQ ID NO: 5452778 - DNA, 13 bp, Homo sapiens
tctttgcttgcct

SEQ ID NO: 5452779 - DNA, 15 bp, Homo sapiens
tctttgcttgcctct

SEQ ID NO: 5452780 - DNA, 14 bp, Homo sapiens
tctttgctttctcg

SEQ ID NO: 5452781 - DNA, 18 bp, Homo sapiens
tctttgctttctcgtggg

SEQ ID NO: 5452782 - DNA, 13 bp, Homo sapiens
tctttgctttgct

SEQ ID NO: 5452783 - DNA, 20 bp, Homo sapiens
tctttgctttgtagtttgct

SEQ ID NO: 5452784 - DNA, 21 bp, Homo sapiens
tctttggaaaaggaaggtagt

SEQ ID NO: 5452785 - DNA, 16 bp, Homo sapiens
tctttggaaagtacac

SEQ ID NO: 5452786 - DNA, 18 bp, Homo sapiens
tctttggaaataaaagat

SEQ ID NO: 5452787 - DNA, 20 bp, Homo sapiens
tctttggaaataaaagataa

SEQ ID NO: 5452788 - DNA, 24 bp, Homo sapiens
tctttggaaggagtgagatcattt

SEQ ID NO: 5452789 - DNA, 21 bp, Homo sapiens
tctttggacaacaggaagtga

SEQ ID NO: 5452790 - DNA, 21 bp, Homo sapiens
tctttggacagaagcagctct

SEQ ID NO: 5452791 - DNA, 22 bp, Homo sapiens
tctttggacagaagcagctctt

SEQ ID NO: 5452792 - DNA, 16 bp, Homo sapiens
tctttggaccctgagg

SEQ ID NO: 5452793 - DNA, 15 bp, Homo sapiens
tctttggagagctca

SEQ ID NO: 5452794 - DNA, 16 bp, Homo sapiens
tctttggaggaacagc

SEQ ID NO: 5452795 - DNA, 16 bp, Homo sapiens
tctttggattctaaat

SEQ ID NO: 5452796 - DNA, 14 bp, Homo sapiens
tctttggcagttgc

SEQ ID NO: 5452797 - DNA, 18 bp, Homo sapiens
tctttggcatgatttaaa

SEQ ID NO: 5452798 - DNA, 18 bp, Homo sapiens
tctttggctctattggat

SEQ ID NO: 5452799 - DNA, 13 bp, Homo sapiens
tctttggcttcag

SEQ ID NO: 5452800 - DNA, 20 bp, Homo sapiens
tctttgggaatatttgaatc

SEQ ID NO: 5452801 - DNA, 23 bp, Homo sapiens
tctttgggacacctcagaaaact

SEQ ID NO: 5452802 - DNA, 22 bp, Homo sapiens
tctttgggaggtgtctgtgaag

SEQ ID NO: 5452803 - DNA, 19 bp, Homo sapiens
tctttgggatcttgaagaa

SEQ ID NO: 5452804 - DNA, 15 bp, Homo sapiens
tctttgggccagaca

SEQ ID NO: 5452805 - DNA, 16 bp, Homo sapiens
tctttgggccagacat

SEQ ID NO: 5452806 - DNA, 22 bp, Homo sapiens
tctttgggcctctcctgccctc

SEQ ID NO: 5452807 - DNA, 23 bp, Homo sapiens
tctttggggagagctggcagtgt

SEQ ID NO: 5452808 - DNA, 23 bp, Homo sapiens
tctttgggggattcaaatgcatg

SEQ ID NO: 5452809 - DNA, 18 bp, Homo sapiens
tctttggggtcagccagg

SEQ ID NO: 5452810 - DNA, 20 bp, Homo sapiens
tctttgggtacctattttca

SEQ ID NO: 5452811 - DNA, 21 bp, Homo sapiens
tctttggtctacactgtgctg

SEQ ID NO: 5452812 - DNA, 16 bp, Homo sapiens
tctttggtctattttc

SEQ ID NO: 5452813 - DNA, 22 bp, Homo sapiens
tctttggtctattttctgcaga

SEQ ID NO: 5452814 - DNA, 16 bp, Homo sapiens
tctttggtgaacattg

SEQ ID NO: 5452815 - DNA, 18 bp, Homo sapiens
tctttggtgcctttcctg

SEQ ID NO: 5452816 - DNA, 17 bp, Homo sapiens
tctttggtgtacagact

SEQ ID NO: 5452817 - DNA, 21 bp, Homo sapiens
tctttggtgttctggcctctg

SEQ ID NO: 5452818 - DNA, 18 bp, Homo sapiens
tctttggttcctcatggc

SEQ ID NO: 5452819 - DNA, 23 bp, Homo sapiens
tctttgtaaatatcggatgggtg

SEQ ID NO: 5452820 - DNA, 14 bp, Homo sapiens
tctttgtaaattat

SEQ ID NO: 5452821 - DNA, 15 bp, Homo sapiens
tctttgtaagagcaa

SEQ ID NO: 5452822 - DNA, 22 bp, Homo sapiens
tctttgtaagagtgtagaagca

SEQ ID NO: 5452823 - DNA, 19 bp, Homo sapiens
tgaaaagctaccctgaaac

SEQ ID NO: 5452824 - DNA, 13 bp, Homo sapiens
tgaaaagctatta

SEQ ID NO: 5452825 - DNA, 19 bp, Homo sapiens
tgaaaagctattagccagg

SEQ ID NO: 5452826 - DNA, 23 bp, Homo sapiens
tgaaaagctattagccaggatca

SEQ ID NO: 5452827 - DNA, 19 bp, Homo sapiens
tgaaaagctccatcaatga

SEQ ID NO: 5452828 - DNA, 16 bp, Homo sapiens
tgaaaagcttaataaa

SEQ ID NO: 5452829 - DNA, 15 bp, Homo sapiens
tgaaaagcttcttaa

SEQ ID NO: 5452830 - DNA, 19 bp, Homo sapiens
tgaaaagcttcttaattaa

SEQ ID NO: 5452831 - DNA, 12 bp, Homo sapiens
tgaaaaggaatc

SEQ ID NO: 5452832 - DNA, 16 bp, Homo sapiens
tgaaaaggactcttga

SEQ ID NO: 5452833 - DNA, 23 bp, Homo sapiens
tgaaaaggagagattaaaggtat

SEQ ID NO: 5452834 - DNA, 20 bp, Homo sapiens
tgaaaaggcagcatttgaat

SEQ ID NO: 5452835 - DNA, 17 bp, Homo sapiens
tgaaaaggctttttcag

SEQ ID NO: 5452836 - DNA, 17 bp, Homo sapiens
tgaaaagggcagaggca

SEQ ID NO: 5452837 - DNA, 18 bp, Homo sapiens
tgaaaagggcggaagagt

SEQ ID NO: 5452838 - DNA, 20 bp, Homo sapiens
tgaaaagggcggaagagtta

SEQ ID NO: 5452839 - DNA, 22 bp, Homo sapiens
tgaaaagggcggaagagttaca

SEQ ID NO: 5452840 - DNA, 16 bp, Homo sapiens
tgaaaaggtgaccttg

SEQ ID NO: 5452841 - DNA, 18 bp, Homo sapiens
tgaaaagtaatatttatt

SEQ ID NO: 5452842 - DNA, 19 bp, Homo sapiens
tgaaaagtaatatttatta

SEQ ID NO: 5452843 - DNA, 20 bp, Homo sapiens
tgaaaagtaatatttattaa

SEQ ID NO: 5452844 - DNA, 18 bp, Homo sapiens
tgaaaagtaattgaaaaa

SEQ ID NO: 5452845 - DNA, 16 bp, Homo sapiens
tgaaaagtagagcaat

SEQ ID NO: 5452846 - DNA, 12 bp, Homo sapiens
tgaaaagtcgtt

SEQ ID NO: 5452847 - DNA, 14 bp, Homo sapiens
tgaaaagtgtcctc

SEQ ID NO: 5452848 - DNA, 18 bp, Homo sapiens
tgaaaagtgtgtatatat

SEQ ID NO: 5452849 - DNA, 16 bp, Homo sapiens
tgaaaagtgttctgtg

SEQ ID NO: 5452850 - DNA, 18 bp, Homo sapiens
tgaaaagtgttctgtgcg

SEQ ID NO: 5452851 - DNA, 20 bp, Homo sapiens
tgaaaagttactacctgtca

SEQ ID NO: 5452852 - DNA, 22 bp, Homo sapiens
tgaaaagttactacctgtcaag

SEQ ID NO: 5452853 - DNA, 14 bp, Homo sapiens
tgaaaagttgaaat

SEQ ID NO: 5452854 - DNA, 13 bp, Homo sapiens
tgaaaagttggaa

SEQ ID NO: 5452855 - DNA, 23 bp, Homo sapiens
tgaaaagttggaaggatctgctg

SEQ ID NO: 5452856 - DNA, 19 bp, Homo sapiens
tgaaaagtttagtgtttct

SEQ ID NO: 5452857 - DNA, 12 bp, Homo sapiens
tgaaaagttttc

SEQ ID NO: 5452858 - DNA, 18 bp, Homo sapiens
tgaaaagttttcaagcat

SEQ ID NO: 5452859 - DNA, 15 bp, Homo sapiens
tgaaaataaaaagag

SEQ ID NO: 5452860 - DNA, 21 bp, Homo sapiens
tgaaaataaaaagatcacttt

SEQ ID NO: 5452861 - DNA, 15 bp, Homo sapiens
tgaaaataaaacaca

SEQ ID NO: 5452862 - DNA, 16 bp, Homo sapiens
tgaaaataaaacacac

SEQ ID NO: 5452863 - DNA, 20 bp, Homo sapiens
tgaaaataaaacacacctcg

SEQ ID NO: 5452864 - DNA, 13 bp, Homo sapiens
tgaaaataaagaa

SEQ ID NO: 5452865 - DNA, 14 bp, Homo sapiens
tgaaaataaagaat

SEQ ID NO: 5452866 - DNA, 15 bp, Homo sapiens
tgaaaataaagaatg

SEQ ID NO: 5452867 - DNA, 18 bp, Homo sapiens
tgaaaataactgaaccaa

SEQ ID NO: 5452868 - DNA, 19 bp, Homo sapiens
tgaaaataactgaaccaaa

SEQ ID NO: 5452869 - DNA, 21 bp, Homo sapiens
tgaaaataactgaatttggag

SEQ ID NO: 5452870 - DNA, 19 bp, Homo sapiens
tgaaaataagccatgagaa

SEQ ID NO: 5452871 - DNA, 20 bp, Homo sapiens
tgaaaataagccatgagaat

SEQ ID NO: 5452872 - DNA, 18 bp, Homo sapiens
tgaaaataatctctgatt

SEQ ID NO: 5452873 - DNA, 22 bp, Homo sapiens
tgaaaataatctctgattccct

SEQ ID NO: 5452874 - DNA, 17 bp, Homo sapiens
tgaaaataatgctgttc

SEQ ID NO: 5452875 - DNA, 12 bp, Homo sapiens
tgaaaataattg

SEQ ID NO: 5452876 - DNA, 19 bp, Homo sapiens
tgaaaatacaacttaaata

SEQ ID NO: 5452877 - DNA, 17 bp, Homo sapiens
tgaaaataccataggaa

SEQ ID NO: 5452878 - DNA, 19 bp, Homo sapiens
tgaaaataccataggaaga

SEQ ID NO: 5452879 - DNA, 20 bp, Homo sapiens
tgaaaataccataggaagac

SEQ ID NO: 5452880 - DNA, 18 bp, Homo sapiens
tgaaaatactggaattca

SEQ ID NO: 5452881 - DNA, 13 bp, Homo sapiens
tgaaaatactttt

SEQ ID NO: 5452882 - DNA, 18 bp, Homo sapiens
tgaaaatacttttgcatt

SEQ ID NO: 5452883 - DNA, 15 bp, Homo sapiens
tgaaaatagctattt

SEQ ID NO: 5452884 - DNA, 17 bp, Homo sapiens
tgaaaatagtgtaagaa

SEQ ID NO: 5452885 - DNA, 21 bp, Homo sapiens
tgaaaatagtgtaagaactgt

SEQ ID NO: 5452886 - DNA, 16 bp, Homo sapiens
tgaaaatataaccagc

SEQ ID NO: 5452887 - DNA, 19 bp, Homo sapiens
tgaaaatatacttgactct

SEQ ID NO: 5452888 - DNA, 20 bp, Homo sapiens
tgaaaatatacttgactcta

SEQ ID NO: 5452889 - DNA, 22 bp, Homo sapiens
tgaaaatatacttgactctaat

SEQ ID NO: 5452890 - DNA, 23 bp, Homo sapiens
tgaaaatatatattatatacata

SEQ ID NO: 5452891 - DNA, 22 bp, Homo sapiens
tgaaaatatatgactttgaata

SEQ ID NO: 5452892 - DNA, 17 bp, Homo sapiens
tgaaaatatatgatggc

SEQ ID NO: 5452893 - DNA, 22 bp, Homo sapiens
tgaaaatatctcttgtgctttt

SEQ ID NO: 5452894 - DNA, 18 bp, Homo sapiens
tgaaaatatctgctcaaa

SEQ ID NO: 5452895 - DNA, 23 bp, Homo sapiens
tgaaaatatctgctcaaaacttt

SEQ ID NO: 5452896 - DNA, 17 bp, Homo sapiens
tgaaaatatgtactgta

SEQ ID NO: 5452897 - DNA, 22 bp, Homo sapiens
tgaaaatatgttggaaaaaaga

SEQ ID NO: 5452898 - DNA, 19 bp, Homo sapiens
tgaaaatattatctttgta

SEQ ID NO: 5452899 - DNA, 20 bp, Homo sapiens
tgaaaatattctgattggtc

SEQ ID NO: 5452900 - DNA, 16 bp, Homo sapiens
tgaaaatattgtttta

SEQ ID NO: 5452901 - DNA, 16 bp, Homo sapiens
tgaaaatatttaacga

SEQ ID NO: 5452902 - DNA, 21 bp, Homo sapiens
tgaaaatatttgtatcacaaa

SEQ ID NO: 5452903 - DNA, 21 bp, Homo sapiens
tgaaaatattttttatatata

SEQ ID NO: 5452904 - DNA, 20 bp, Homo sapiens
tgaaaatatttttttctagc

SEQ ID NO: 5452905 - DNA, 17 bp, Homo sapiens
tgaaaatcaaagtaaaa

SEQ ID NO: 5452906 - DNA, 15 bp, Homo sapiens
tgaaaatcactggcc

SEQ ID NO: 5452907 - DNA, 21 bp, Homo sapiens
tgaaaatcatgaaaagaggaa

SEQ ID NO: 5452908 - DNA, 20 bp, Homo sapiens
tgaaaatcctatatctgttt

SEQ ID NO: 5452909 - DNA, 16 bp, Homo sapiens
tgaaaatcgtgacaac

SEQ ID NO: 5452910 - DNA, 15 bp, Homo sapiens
tgaaaatgaaagtgt

SEQ ID NO: 5452911 - DNA, 12 bp, Homo sapiens
tgaaaatgaact

SEQ ID NO: 5452912 - DNA, 20 bp, Homo sapiens
tgaaaatgaatagagagtat

SEQ ID NO: 5452913 - DNA, 15 bp, Homo sapiens
tgaaaatgaccaaaa

SEQ ID NO: 5452914 - DNA, 15 bp, Homo sapiens
tgaaaatgagccctg

SEQ ID NO: 5452915 - DNA, 22 bp, Homo sapiens
tgaaaatgagcctgtaatcctc

SEQ ID NO: 5452916 - DNA, 13 bp, Homo sapiens
tgaaaatgcaaag

SEQ ID NO: 5452917 - DNA, 18 bp, Homo sapiens
tgaaaatgcaaagctgaa

SEQ ID NO: 5452918 - DNA, 19 bp, Homo sapiens
tgaaaatgcaaagctgaag

SEQ ID NO: 5452919 - DNA, 18 bp, Homo sapiens
tgaaaatgcaacaacatg

SEQ ID NO: 5452920 - DNA, 20 bp, Homo sapiens
tgaaaatgcaacaacatgta

SEQ ID NO: 5452921 - DNA, 20 bp, Homo sapiens
tgaaaatgctttgaaaatgt

SEQ ID NO: 5452922 - DNA, 19 bp, Homo sapiens
tgaaaatgggatgtgctgt

SEQ ID NO: 5452923 - DNA, 16 bp, Homo sapiens
tgaaaatgggctcaac

SEQ ID NO: 5452924 - DNA, 15 bp, Homo sapiens
tgaaaatggtatttt

SEQ ID NO: 5452925 - DNA, 21 bp, Homo sapiens
tgaaaatggtattttccccct

SEQ ID NO: 5452926 - DNA, 14 bp, Homo sapiens
tgaaaatggtttca

SEQ ID NO: 5452927 - DNA, 12 bp, Homo sapiens
tgaaaatgtact

SEQ ID NO: 5452928 - DNA, 17 bp, Homo sapiens
tgaaaatgtatgtgtaa

SEQ ID NO: 5452929 - DNA, 17 bp, Homo sapiens
tgaaaatgtatttcctg

SEQ ID NO: 5452930 - DNA, 17 bp, Homo sapiens
tgaaaatgtcactgtta

SEQ ID NO: 5452931 - DNA, 21 bp, Homo sapiens
tgaaaatgtcagaaaccagtt

SEQ ID NO: 5452932 - DNA, 20 bp, Homo sapiens
tgaaaatgtccaggaaagtg

SEQ ID NO: 5452933 - DNA, 16 bp, Homo sapiens
tgaaaatgtccttgtg

SEQ ID NO: 5452934 - DNA, 11 bp, Homo sapiens
tgaaaatgtgg

SEQ ID NO: 5452935 - DNA, 21 bp, Homo sapiens
tgaaaatgtgtatacacttaa

SEQ ID NO: 5452936 - DNA, 12 bp, Homo sapiens
tgaaaatgtgtt

SEQ ID NO: 5452937 - DNA, 17 bp, Homo sapiens
tgaaaatgtttttaagt

SEQ ID NO: 5452938 - DNA, 14 bp, Homo sapiens
tgaaaattaacact

SEQ ID NO: 5452939 - DNA, 18 bp, Homo sapiens
tgaaaattaacactgctt

SEQ ID NO: 5452940 - DNA, 21 bp, Homo sapiens
tgaaaattacacccatgcaca

SEQ ID NO: 5452941 - DNA, 17 bp, Homo sapiens
tgaaaattacatgtttt

SEQ ID NO: 5452942 - DNA, 20 bp, Homo sapiens
tgaaaattagagatcatgaa

SEQ ID NO: 5452943 - DNA, 14 bp, Homo sapiens
tgaaaattatttaa

SEQ ID NO: 5452944 - DNA, 15 bp, Homo sapiens
tgaaaattattttaa

SEQ ID NO: 5452945 - DNA, 22 bp, Homo sapiens
tgaaaattattttgttcataca

SEQ ID NO: 5452946 - DNA, 23 bp, Homo sapiens
tgaaaattattttgttcatacat

SEQ ID NO: 5452947 - DNA, 17 bp, Homo sapiens
tgaaaattcaaaaagtg

SEQ ID NO: 5452948 - DNA, 16 bp, Homo sapiens
tgaaaattcaggtgct

SEQ ID NO: 5452949 - DNA, 13 bp, Homo sapiens
tgaaaattgaaaa

SEQ ID NO: 5452950 - DNA, 19 bp, Homo sapiens
tgaaaattgcctttctgtg

SEQ ID NO: 5452951 - DNA, 23 bp, Homo sapiens
tgaaaattgcctttctgtgttta

SEQ ID NO: 5452952 - DNA, 19 bp, Homo sapiens
tgaaaattgtataaattac

SEQ ID NO: 5452953 - DNA, 13 bp, Homo sapiens
tgaaaattgtatt

SEQ ID NO: 5452954 - DNA, 15 bp, Homo sapiens
tgaaaatttatataa

SEQ ID NO: 5452955 - DNA, 21 bp, Homo sapiens
tgaaaatttcacttgaaatta

SEQ ID NO: 5452956 - DNA, 16 bp, Homo sapiens
tgaaaatttgcctttg

SEQ ID NO: 5452957 - DNA, 18 bp, Homo sapiens
tgaaaatttgtttgacaa

SEQ ID NO: 5452958 - DNA, 20 bp, Homo sapiens
tgaaaattttaaaaatacat

SEQ ID NO: 5452959 - DNA, 21 bp, Homo sapiens
tgaaaattttaaaaatacata

SEQ ID NO: 5452960 - DNA, 22 bp, Homo sapiens
tgaaaattttaaaaatacatat

SEQ ID NO: 5452961 - DNA, 15 bp, Homo sapiens
tgaaaattttacttc

SEQ ID NO: 5452962 - DNA, 12 bp, Homo sapiens
tgaaaattttga

SEQ ID NO: 5452963 - DNA, 18 bp, Homo sapiens
tgaaaatttttacattca

SEQ ID NO: 5452964 - DNA, 15 bp, Homo sapiens
tgaaacaaaactgga

SEQ ID NO: 5452965 - DNA, 13 bp, Homo sapiens
tgaaacaaagaaa

SEQ ID NO: 5452966 - DNA, 18 bp, Homo sapiens
tgaaacaaagaaagagat

SEQ ID NO: 5452967 - DNA, 14 bp, Homo sapiens
tgaaacaaagagtt

SEQ ID NO: 5452968 - DNA, 17 bp, Homo sapiens
tgaaacaaagtactctt

SEQ ID NO: 5452969 - DNA, 20 bp, Homo sapiens
tgaaacaaagtactctttaa

SEQ ID NO: 5452970 - DNA, 22 bp, Homo sapiens
tgaaacaaatatactcatttgg

SEQ ID NO: 5452971 - DNA, 19 bp, Homo sapiens
tgaaacaactcatgtcttt

SEQ ID NO: 5452972 - DNA, 15 bp, Homo sapiens
tgaaacaacttggaa

SEQ ID NO: 5452973 - DNA, 19 bp, Homo sapiens
tgaaacaactttctcttgt

SEQ ID NO: 5452974 - DNA, 21 bp, Homo sapiens
tgaaacaagataactgagaat

SEQ ID NO: 5452975 - DNA, 23 bp, Homo sapiens
tgaaacaatactcataatgtgaa

SEQ ID NO: 5452976 - DNA, 14 bp, Homo sapiens
tgaaacaatcttcc

SEQ ID NO: 5452977 - DNA, 22 bp, Homo sapiens
tgaaacaatgttgtccaacaat

SEQ ID NO: 5452978 - DNA, 12 bp, Homo sapiens
tgaaacacacac

SEQ ID NO: 5452979 - DNA, 13 bp, Homo sapiens
tgaaacacacaca

SEQ ID NO: 5452980 - DNA, 19 bp, Homo sapiens
tgaaacacaccaggctgtg

SEQ ID NO: 5452981 - DNA, 17 bp, Homo sapiens
tgaaacacacgagcaaa

SEQ ID NO: 5452982 - DNA, 13 bp, Homo sapiens
tgaaacacagctg

SEQ ID NO: 5452983 - DNA, 20 bp, Homo sapiens
tgaaacacagtcatgtgtca

SEQ ID NO: 5452984 - DNA, 21 bp, Homo sapiens
tgaaacaccaagatgtctgtc

SEQ ID NO: 5452985 - DNA, 16 bp, Homo sapiens
tgaaacaccttctctg

SEQ ID NO: 5452986 - DNA, 13 bp, Homo sapiens
tgaaacactggac

SEQ ID NO: 5452987 - DNA, 16 bp, Homo sapiens
tgaaacactggacctg

SEQ ID NO: 5452988 - DNA, 19 bp, Homo sapiens
tgaaacactggacctgggg

SEQ ID NO: 5452989 - DNA, 20 bp, Homo sapiens
tgaaacactggttttaaata

SEQ ID NO: 5452990 - DNA, 20 bp, Homo sapiens
tgaaacactttgcctcctgt

SEQ ID NO: 5452991 - DNA, 15 bp, Homo sapiens
tgaaacacttttttg

SEQ ID NO: 5452992 - DNA, 13 bp, Homo sapiens
tgaaacagaaaaa

SEQ ID NO: 5452993 - DNA, 22 bp, Homo sapiens
tgaaacagaaaaataagtcaaa

SEQ ID NO: 5452994 - DNA, 23 bp, Homo sapiens
tgaaacagaaaaatatgtaccaa

SEQ ID NO: 5452995 - DNA, 16 bp, Homo sapiens
tgaaacagaaacaaaa

SEQ ID NO: 5452996 - DNA, 16 bp, Homo sapiens
tgaaacagacatgaaa

SEQ ID NO: 5452997 - DNA, 16 bp, Homo sapiens
tgaaacagagaaagaa

SEQ ID NO: 5452998 - DNA, 23 bp, Homo sapiens
tgaaacagagaaagaaaaggcaa

SEQ ID NO: 5452999 - DNA, 12 bp, Homo sapiens
tgaaatttatga

SEQ ID NO: 5453000 - DNA, 15 bp, Homo sapiens
tgaaatttatgacta

SEQ ID NO: 5453001 - DNA, 19 bp, Homo sapiens
tgaaatttatgactagcaa

SEQ ID NO: 5453002 - DNA, 17 bp, Homo sapiens
tgaaatttattcacata

SEQ ID NO: 5453003 - DNA, 14 bp, Homo sapiens
tgaaatttatttaa

SEQ ID NO: 5453004 - DNA, 13 bp, Homo sapiens
tgaaatttcatga

SEQ ID NO: 5453005 - DNA, 14 bp, Homo sapiens
tgaaatttcatgaa

SEQ ID NO: 5453006 - DNA, 16 bp, Homo sapiens
tgaaatttcatgaaaa

SEQ ID NO: 5453007 - DNA, 17 bp, Homo sapiens
tgaaatttcatgattgg

SEQ ID NO: 5453008 - DNA, 21 bp, Homo sapiens
tgaaatttcatgattggctta

SEQ ID NO: 5453009 - DNA, 21 bp, Homo sapiens
tgaaatttcctgggagctttt

SEQ ID NO: 5453010 - DNA, 13 bp, Homo sapiens
tgaaatttctcat

SEQ ID NO: 5453011 - DNA, 12 bp, Homo sapiens
tgaaatttgata

SEQ ID NO: 5453012 - DNA, 22 bp, Homo sapiens
tgaaatttgataaactgaattt

SEQ ID NO: 5453013 - DNA, 14 bp, Homo sapiens
tgaaatttgctata

SEQ ID NO: 5453014 - DNA, 12 bp, Homo sapiens
tgaaatttggaa

SEQ ID NO: 5453015 - DNA, 16 bp, Homo sapiens
tgaaatttgttaatat

SEQ ID NO: 5453016 - DNA, 20 bp, Homo sapiens
tgaaatttgttaatatatat

SEQ ID NO: 5453017 - DNA, 14 bp, Homo sapiens
tgaaattttaaatg

SEQ ID NO: 5453018 - DNA, 22 bp, Homo sapiens
tgaaattttaacctatgatatt

SEQ ID NO: 5453019 - DNA, 17 bp, Homo sapiens
tgaaattttccaatgtc

SEQ ID NO: 5453020 - DNA, 23 bp, Homo sapiens
tgaaattttccattacatgatct

SEQ ID NO: 5453021 - DNA, 16 bp, Homo sapiens
tgaaattttctagaat

SEQ ID NO: 5453022 - DNA, 18 bp, Homo sapiens
tgaaattttctagacttt

SEQ ID NO: 5453023 - DNA, 21 bp, Homo sapiens
tgaaattttctagactttctg

SEQ ID NO: 5453024 - DNA, 12 bp, Homo sapiens
tgaaattttgca

SEQ ID NO: 5453025 - DNA, 16 bp, Homo sapiens
tgaaattttgcaaata

SEQ ID NO: 5453026 - DNA, 19 bp, Homo sapiens
tgaaattttgcaaatataa

SEQ ID NO: 5453027 - DNA, 19 bp, Homo sapiens
tgaaatttttaaatcattt

SEQ ID NO: 5453028 - DNA, 22 bp, Homo sapiens
tgaaatttttaaatcatttcat

SEQ ID NO: 5453029 - DNA, 15 bp, Homo sapiens
tgaaatttttattaa

SEQ ID NO: 5453030 - DNA, 18 bp, Homo sapiens
tgaaatttttatttgtat

SEQ ID NO: 5453031 - DNA, 17 bp, Homo sapiens
tgaaatttttcatattt

SEQ ID NO: 5453032 - DNA, 21 bp, Homo sapiens
tgaaatttttcatattttaat

SEQ ID NO: 5453033 - DNA, 23 bp, Homo sapiens
tgaaatttttccacactatgtgt

SEQ ID NO: 5453034 - DNA, 19 bp, Homo sapiens
tgaaatttttctctttaaa

SEQ ID NO: 5453035 - DNA, 15 bp, Homo sapiens
tgaaatttttgtaaa

SEQ ID NO: 5453036 - DNA, 18 bp, Homo sapiens
tgaaatttttttcctaag

SEQ ID NO: 5453037 - DNA, 18 bp, Homo sapiens
tgaacaaaaaataaaaat

SEQ ID NO: 5453038 - DNA, 13 bp, Homo sapiens
tgaacaaaaattg

SEQ ID NO: 5453039 - DNA, 14 bp, Homo sapiens
tgaacaaaagattg

SEQ ID NO: 5453040 - DNA, 22 bp, Homo sapiens
tgaacaaaagcaggtttttata

SEQ ID NO: 5453041 - DNA, 14 bp, Homo sapiens
tgaacaaaataaat

SEQ ID NO: 5453042 - DNA, 18 bp, Homo sapiens
tgaacaaaataaattgga

SEQ ID NO: 5453043 - DNA, 15 bp, Homo sapiens
tgaacaaaattattt

SEQ ID NO: 5453044 - DNA, 22 bp, Homo sapiens
tgaacaaacactgaatcatgtt

SEQ ID NO: 5453045 - DNA, 17 bp, Homo sapiens
tgaacaaaccctttaaa

SEQ ID NO: 5453046 - DNA, 22 bp, Homo sapiens
tgaacaaagaaaaaaatatatt

SEQ ID NO: 5453047 - DNA, 19 bp, Homo sapiens
tgaacaaagaccaattttt

SEQ ID NO: 5453048 - DNA, 14 bp, Homo sapiens
tgaacaaagcagcc

SEQ ID NO: 5453049 - DNA, 18 bp, Homo sapiens
tgaacaaagctcaaagta

SEQ ID NO: 5453050 - DNA, 19 bp, Homo sapiens
tgaacaaagtctctgggtc

SEQ ID NO: 5453051 - DNA, 18 bp, Homo sapiens
tgaacaaatcaaattgct

SEQ ID NO: 5453052 - DNA, 15 bp, Homo sapiens
tgaacaaatggcctt

SEQ ID NO: 5453053 - DNA, 15 bp, Homo sapiens
tgaacaaatgtctta

SEQ ID NO: 5453054 - DNA, 16 bp, Homo sapiens
tgaacaaattctttag

SEQ ID NO: 5453055 - DNA, 18 bp, Homo sapiens
tgaacaaattctttagta

SEQ ID NO: 5453056 - DNA, 23 bp, Homo sapiens
tgaacaaattctttagtactcaa

SEQ ID NO: 5453057 - DNA, 13 bp, Homo sapiens
tgaacaaatttac

SEQ ID NO: 5453058 - DNA, 18 bp, Homo sapiens
tgaacaaattttctggtg

SEQ ID NO: 5453059 - DNA, 18 bp, Homo sapiens
tgaacaactcgaatcact

SEQ ID NO: 5453060 - DNA, 15 bp, Homo sapiens
tgaacaagaaagagt

SEQ ID NO: 5453061 - DNA, 14 bp, Homo sapiens
tgaacaagagaagc

SEQ ID NO: 5453062 - DNA, 16 bp, Homo sapiens
tgaacaagagaagcat

SEQ ID NO: 5453063 - DNA, 17 bp, Homo sapiens
tgaacaagcttcagtaa

SEQ ID NO: 5453064 - DNA, 22 bp, Homo sapiens
tgaacaagttgtttcattgact

SEQ ID NO: 5453065 - DNA, 22 bp, Homo sapiens
tgaacaatacgtgaaagatgca

SEQ ID NO: 5453066 - DNA, 19 bp, Homo sapiens
tgaacaatcccctaacaca

SEQ ID NO: 5453067 - DNA, 15 bp, Homo sapiens
tgaacaatgaagttg

SEQ ID NO: 5453068 - DNA, 23 bp, Homo sapiens
tgaacaatgaagttgaaaatcat

SEQ ID NO: 5453069 - DNA, 23 bp, Homo sapiens
tgaacaatgggagcacatagccc

SEQ ID NO: 5453070 - DNA, 13 bp, Homo sapiens
tgaacaattacct

SEQ ID NO: 5453071 - DNA, 13 bp, Homo sapiens
tgaacaattctct

SEQ ID NO: 5453072 - DNA, 20 bp, Homo sapiens
tgaacacaaatgtgtatttt

SEQ ID NO: 5453073 - DNA, 22 bp, Homo sapiens
tgaacacaaccagaggtggcag

SEQ ID NO: 5453074 - DNA, 23 bp, Homo sapiens
tgaacacaattgatacttcaggt

SEQ ID NO: 5453075 - DNA, 12 bp, Homo sapiens
tgaacacacaca

SEQ ID NO: 5453076 - DNA, 14 bp, Homo sapiens
tgaacacacacaca

SEQ ID NO: 5453077 - DNA, 16 bp, Homo sapiens
tgaacacacacgccag

SEQ ID NO: 5453078 - DNA, 19 bp, Homo sapiens
tgaacacacacgccagctc

SEQ ID NO: 5453079 - DNA, 20 bp, Homo sapiens
tgaacacacacgccagctcc

SEQ ID NO: 5453080 - DNA, 14 bp, Homo sapiens
tgaacacactgtgt

SEQ ID NO: 5453081 - DNA, 15 bp, Homo sapiens
tgaacacactgtgtc

SEQ ID NO: 5453082 - DNA, 17 bp, Homo sapiens
tgaacacagcagaccta

SEQ ID NO: 5453083 - DNA, 13 bp, Homo sapiens
tgaacacaggcaa

SEQ ID NO: 5453084 - DNA, 13 bp, Homo sapiens
tgaacacagtatt

SEQ ID NO: 5453085 - DNA, 17 bp, Homo sapiens
tgaacacatactagaaa

SEQ ID NO: 5453086 - DNA, 14 bp, Homo sapiens
tgaacacatcagct

SEQ ID NO: 5453087 - DNA, 19 bp, Homo sapiens
tgaacacattattaagcac

SEQ ID NO: 5453088 - DNA, 17 bp, Homo sapiens
tgaacacatttgcccaa

SEQ ID NO: 5453089 - DNA, 23 bp, Homo sapiens
tgaacaccactttgtctctgaga

SEQ ID NO: 5453090 - DNA, 22 bp, Homo sapiens
tgaacacgaaagaaatgtacct

SEQ ID NO: 5453091 - DNA, 19 bp, Homo sapiens
tgaacactcagccaggcct

SEQ ID NO: 5453092 - DNA, 16 bp, Homo sapiens
tgaacactcatgctga

SEQ ID NO: 5453093 - DNA, 17 bp, Homo sapiens
tgaacactcatgctgaa

SEQ ID NO: 5453094 - DNA, 19 bp, Homo sapiens
tgaacactccaattaagga

SEQ ID NO: 5453095 - DNA, 23 bp, Homo sapiens
tgaacactccaattaaggatttt

SEQ ID NO: 5453096 - DNA, 14 bp, Homo sapiens
tgaacactggggga

SEQ ID NO: 5453097 - DNA, 14 bp, Homo sapiens
tgaacactgtgacc

SEQ ID NO: 5453098 - DNA, 17 bp, Homo sapiens
tgaacacttaaattatg

SEQ ID NO: 5453099 - DNA, 20 bp, Homo sapiens
tgaacacttacctggaggct

SEQ ID NO: 5453100 - DNA, 15 bp, Homo sapiens
tgaacacttattgct

SEQ ID NO: 5453101 - DNA, 15 bp, Homo sapiens
tgaacacttggtgct

SEQ ID NO: 5453102 - DNA, 14 bp, Homo sapiens
tgaacagaaatatt

SEQ ID NO: 5453103 - DNA, 13 bp, Homo sapiens
tgaacagaaattt

SEQ ID NO: 5453104 - DNA, 17 bp, Homo sapiens
tgaacagaacctcccaa

SEQ ID NO: 5453105 - DNA, 16 bp, Homo sapiens
tgaacagaagctctta

SEQ ID NO: 5453106 - DNA, 11 bp, Homo sapiens
tgaacagagag

SEQ ID NO: 5453107 - DNA, 12 bp, Homo sapiens
tgaacagagaga

SEQ ID NO: 5453108 - DNA, 19 bp, Homo sapiens
tgaacagagagaaccagga

SEQ ID NO: 5453109 - DNA, 21 bp, Homo sapiens
tgaacagagagaaccaggagg

SEQ ID NO: 5453110 - DNA, 22 bp, Homo sapiens
tgaacagagagaaccaggaggg

SEQ ID NO: 5453111 - DNA, 21 bp, Homo sapiens
tgaacagagggagagactaac

SEQ ID NO: 5453112 - DNA, 23 bp, Homo sapiens
tgaacagatatttttaacttaat

SEQ ID NO: 5453113 - DNA, 22 bp, Homo sapiens
tgaacagatgaaaaggagcctg

SEQ ID NO: 5453114 - DNA, 14 bp, Homo sapiens
tgaacagatgtaaa

SEQ ID NO: 5453115 - DNA, 22 bp, Homo sapiens
tgaacagattgctacacacaca

SEQ ID NO: 5453116 - DNA, 17 bp, Homo sapiens
tgaacagcagaaagact

SEQ ID NO: 5453117 - DNA, 19 bp, Homo sapiens
tgaacagcagtaatcctgg

SEQ ID NO: 5453118 - DNA, 13 bp, Homo sapiens
tgaacagcataag

SEQ ID NO: 5453119 - DNA, 20 bp, Homo sapiens
tgaacagcatggcactccct

SEQ ID NO: 5453120 - DNA, 16 bp, Homo sapiens
tgaacagccatatctg

SEQ ID NO: 5453121 - DNA, 15 bp, Homo sapiens
tgaacagcggctgga

SEQ ID NO: 5453122 - DNA, 21 bp, Homo sapiens
tgaacagcggctggacttgga

SEQ ID NO: 5453123 - DNA, 19 bp, Homo sapiens
tgaacagctctgagatcct

SEQ ID NO: 5453124 - DNA, 16 bp, Homo sapiens
tgaacagctggtgcca

SEQ ID NO: 5453125 - DNA, 15 bp, Homo sapiens
tgaacagctggtgta

SEQ ID NO: 5453126 - DNA, 18 bp, Homo sapiens
tgaacagctggtgtagct

SEQ ID NO: 5453127 - DNA, 15 bp, Homo sapiens
tgaacagctgtgtct

SEQ ID NO: 5453128 - DNA, 15 bp, Homo sapiens
tgaacagcttcactt

SEQ ID NO: 5453129 - DNA, 21 bp, Homo sapiens
tgaacagcttgccagggatgg

SEQ ID NO: 5453130 - DNA, 14 bp, Homo sapiens
tgaacagctttgta

SEQ ID NO: 5453131 - DNA, 21 bp, Homo sapiens
tgaacagctttgtatgtttat

SEQ ID NO: 5453132 - DNA, 17 bp, Homo sapiens
tgaacaggaaactcctg

SEQ ID NO: 5453133 - DNA, 13 bp, Homo sapiens
tgaacaggaatcc

SEQ ID NO: 5453134 - DNA, 23 bp, Homo sapiens
tgaacaggaatccttactgatat

SEQ ID NO: 5453135 - DNA, 22 bp, Homo sapiens
tgaacaggccgcacatctcact

SEQ ID NO: 5453136 - DNA, 16 bp, Homo sapiens
tgaacaggctggggcc

SEQ ID NO: 5453137 - DNA, 21 bp, Homo sapiens
tgaacagggtccctggatcag

SEQ ID NO: 5453138 - DNA, 13 bp, Homo sapiens
tgaacaggtcaaa

SEQ ID NO: 5453139 - DNA, 19 bp, Homo sapiens
tgaacaggttctttaaaat

SEQ ID NO: 5453140 - DNA, 17 bp, Homo sapiens
tgaacagtaacatagct

SEQ ID NO: 5453141 - DNA, 17 bp, Homo sapiens
tgaacagtacagtattt

SEQ ID NO: 5453142 - DNA, 23 bp, Homo sapiens
tgaacagtactggttactttcaa

SEQ ID NO: 5453143 - DNA, 18 bp, Homo sapiens
tgaacagtcacgcctgaa

SEQ ID NO: 5453144 - DNA, 19 bp, Homo sapiens
tgaacagttgtgtttgaag

SEQ ID NO: 5453145 - DNA, 18 bp, Homo sapiens
tgaacataactgtaacat

SEQ ID NO: 5453146 - DNA, 15 bp, Homo sapiens
tgaacatacaaatgc

SEQ ID NO: 5453147 - DNA, 16 bp, Homo sapiens
tgaacatacaaatgca

SEQ ID NO: 5453148 - DNA, 19 bp, Homo sapiens
tgaacatactggctggtga

SEQ ID NO: 5453149 - DNA, 21 bp, Homo sapiens
tgaacatacttcaaaaataat

SEQ ID NO: 5453150 - DNA, 10 bp, Homo sapiens
tgaacatagg

SEQ ID NO: 5453151 - DNA, 16 bp, Homo sapiens
tgaacatattcatgaa

SEQ ID NO: 5453152 - DNA, 21 bp, Homo sapiens
tgaacatattcatgaaatgtg

SEQ ID NO: 5453153 - DNA, 17 bp, Homo sapiens
tgaacatattgttgaaa

SEQ ID NO: 5453154 - DNA, 22 bp, Homo sapiens
tgaacatccccactaggttctt

SEQ ID NO: 5453155 - DNA, 20 bp, Homo sapiens
tgaacatccctttttcaatg

SEQ ID NO: 5453156 - DNA, 17 bp, Homo sapiens
tgaacatccttccttcc

SEQ ID NO: 5453157 - DNA, 16 bp, Homo sapiens
tgaacatctcttgaaa

SEQ ID NO: 5453158 - DNA, 18 bp, Homo sapiens
tgaacatctcttgaaacc

SEQ ID NO: 5453159 - DNA, 13 bp, Homo sapiens
tgaacatgcaatt

SEQ ID NO: 5453160 - DNA, 22 bp, Homo sapiens
tgaacatgcagttcattatttt

SEQ ID NO: 5453161 - DNA, 17 bp, Homo sapiens
tgaacatgcctcctcct

SEQ ID NO: 5453162 - DNA, 14 bp, Homo sapiens
tgaacatgcctgcc

SEQ ID NO: 5453163 - DNA, 21 bp, Homo sapiens
tgaacatgcctgccaaagacg

SEQ ID NO: 5453164 - DNA, 22 bp, Homo sapiens
tgaacatgcctgccaaagacgt

SEQ ID NO: 5453165 - DNA, 15 bp, Homo sapiens
tgaacatgtacacaa

SEQ ID NO: 5453166 - DNA, 18 bp, Homo sapiens
tgaacatgtgccttttct

SEQ ID NO: 5453167 - DNA, 18 bp, Homo sapiens
tgaacatgtttaatgggt

SEQ ID NO: 5453168 - DNA, 14 bp, Homo sapiens
tgaacatgtttaca

SEQ ID NO: 5453169 - DNA, 17 bp, Homo sapiens
tgaacatgtttacaggt

SEQ ID NO: 5453170 - DNA, 16 bp, Homo sapiens
tgaacattaaaatata

SEQ ID NO: 5453171 - DNA, 23 bp, Homo sapiens
tgaacattaaaatatagagacag

SEQ ID NO: 5453172 - DNA, 18 bp, Homo sapiens
tgaacattagttgcacta

SEQ ID NO: 5453173 - DNA, 11 bp, Homo sapiens
tgaacattcca

SEQ ID NO: 5453174 - DNA, 13 bp, Homo sapiens
tgaacattccaga

SEQ ID NO: 5453175 - DNA, 18 bp, Homo sapiens
tgaacattcccagcccag

SEQ ID NO: 5453176 - DNA, 17 bp, Homo sapiens
tgaacattcctatcaat

SEQ ID NO: 5453177 - DNA, 21 bp, Homo sapiens
tgaagaaggaggaattttaga

SEQ ID NO: 5453178 - DNA, 13 bp, Homo sapiens
tgaagaaggcaag

SEQ ID NO: 5453179 - DNA, 17 bp, Homo sapiens
tgaagaaggcaaggctg

SEQ ID NO: 5453180 - DNA, 23 bp, Homo sapiens
tgaagaaggctagaaaaaaagaa

SEQ ID NO: 5453181 - DNA, 15 bp, Homo sapiens
tgaagaagggaaatt

SEQ ID NO: 5453182 - DNA, 14 bp, Homo sapiens
tgaagaagggggtg

SEQ ID NO: 5453183 - DNA, 15 bp, Homo sapiens
tgaagaagggggtgg

SEQ ID NO: 5453184 - DNA, 18 bp, Homo sapiens
tgaagaaggtggaccttt

SEQ ID NO: 5453185 - DNA, 21 bp, Homo sapiens
tgaagaaggtggaccttttaa

SEQ ID NO: 5453186 - DNA, 20 bp, Homo sapiens
tgaagaatacagttaggcac

SEQ ID NO: 5453187 - DNA, 20 bp, Homo sapiens
tgaagaatacatcagaaaat

SEQ ID NO: 5453188 - DNA, 22 bp, Homo sapiens
tgaagaatacatcagaaaataa

SEQ ID NO: 5453189 - DNA, 18 bp, Homo sapiens
tgaagaatagaaacaagc

SEQ ID NO: 5453190 - DNA, 19 bp, Homo sapiens
tgaagaatatttaagaaaa

SEQ ID NO: 5453191 - DNA, 11 bp, Homo sapiens
tgaagaatcac

SEQ ID NO: 5453192 - DNA, 23 bp, Homo sapiens
tgaagaatcacgatttcatcctt

SEQ ID NO: 5453193 - DNA, 15 bp, Homo sapiens
tgaagaatctaatga

SEQ ID NO: 5453194 - DNA, 20 bp, Homo sapiens
tgaagaatctgcccctgttg

SEQ ID NO: 5453195 - DNA, 12 bp, Homo sapiens
tgaagaatctta

SEQ ID NO: 5453196 - DNA, 13 bp, Homo sapiens
tgaagaatgaaga

SEQ ID NO: 5453197 - DNA, 22 bp, Homo sapiens
tgaagaatgcacaagaatggat

SEQ ID NO: 5453198 - DNA, 18 bp, Homo sapiens
tgaagaatggacttaatt

SEQ ID NO: 5453199 - DNA, 14 bp, Homo sapiens
tgaagaattaagat

SEQ ID NO: 5453200 - DNA, 21 bp, Homo sapiens
tgaagaattaatgacaacaaa

SEQ ID NO: 5453201 - DNA, 18 bp, Homo sapiens
tgaagaattgccaatctt

SEQ ID NO: 5453202 - DNA, 19 bp, Homo sapiens
tgaagaattgtagttctta

SEQ ID NO: 5453203 - DNA, 16 bp, Homo sapiens
tgaagaatttaaagaa

SEQ ID NO: 5453204 - DNA, 13 bp, Homo sapiens
tgaagaatttaga

SEQ ID NO: 5453205 - DNA, 22 bp, Homo sapiens
tgaagaatttagatcttatatt

SEQ ID NO: 5453206 - DNA, 18 bp, Homo sapiens
tgaagaatttgttcttgt

SEQ ID NO: 5453207 - DNA, 20 bp, Homo sapiens
tgaagaattttgagtgaatt

SEQ ID NO: 5453208 - DNA, 17 bp, Homo sapiens
tgaagacaaaaatactc

SEQ ID NO: 5453209 - DNA, 21 bp, Homo sapiens
tgaagacaaaccactgtacat

SEQ ID NO: 5453210 - DNA, 14 bp, Homo sapiens
tgaagacaataatt

SEQ ID NO: 5453211 - DNA, 13 bp, Homo sapiens
tgaagacaatgac

SEQ ID NO: 5453212 - DNA, 18 bp, Homo sapiens
tgaagacacagcctcccc

SEQ ID NO: 5453213 - DNA, 22 bp, Homo sapiens
tgaagacaccagagtgtatgca

SEQ ID NO: 5453214 - DNA, 17 bp, Homo sapiens
tgaagacactgtgcagg

SEQ ID NO: 5453215 - DNA, 19 bp, Homo sapiens
tgaagacagaaccacaggg

SEQ ID NO: 5453216 - DNA, 22 bp, Homo sapiens
tgaagacagagcaaagcgccca

SEQ ID NO: 5453217 - DNA, 13 bp, Homo sapiens
tgaagacagagct

SEQ ID NO: 5453218 - DNA, 14 bp, Homo sapiens
tgaagacaggatgg

SEQ ID NO: 5453219 - DNA, 22 bp, Homo sapiens
tgaagacaggcacaaaatgtga

SEQ ID NO: 5453220 - DNA, 19 bp, Homo sapiens
tgaagacaggtcaaatgct

SEQ ID NO: 5453221 - DNA, 21 bp, Homo sapiens
tgaagacatagccgattctct

SEQ ID NO: 5453222 - DNA, 18 bp, Homo sapiens
tgaagacatttctgctct

SEQ ID NO: 5453223 - DNA, 16 bp, Homo sapiens
tgaagaccaaagttgt

SEQ ID NO: 5453224 - DNA, 15 bp, Homo sapiens
tgaagaccagctttc

SEQ ID NO: 5453225 - DNA, 19 bp, Homo sapiens
tgaagacccaaaacagctt

SEQ ID NO: 5453226 - DNA, 21 bp, Homo sapiens
tgaagacccaaaacagctttg

SEQ ID NO: 5453227 - DNA, 13 bp, Homo sapiens
tgaagacccagca

SEQ ID NO: 5453228 - DNA, 22 bp, Homo sapiens
tgaagacccagcaggaagccag

SEQ ID NO: 5453229 - DNA, 20 bp, Homo sapiens
tgaagacccagtgtaaagaa

SEQ ID NO: 5453230 - DNA, 21 bp, Homo sapiens
tgaagaccctatctcccacaa

SEQ ID NO: 5453231 - DNA, 16 bp, Homo sapiens
tgaagacctaaagtgc

SEQ ID NO: 5453232 - DNA, 17 bp, Homo sapiens
tgaagacctaaatgacc

SEQ ID NO: 5453233 - DNA, 23 bp, Homo sapiens
tgaagacctaaccagggccagaa

SEQ ID NO: 5453234 - DNA, 22 bp, Homo sapiens
tgaagacctttattcacccctg

SEQ ID NO: 5453235 - DNA, 20 bp, Homo sapiens
tgaagacgagcatccccctc

SEQ ID NO: 5453236 - DNA, 16 bp, Homo sapiens
tgaagacggaaaacaa

SEQ ID NO: 5453237 - DNA, 17 bp, Homo sapiens
tgaagactatgaaaatg

SEQ ID NO: 5453238 - DNA, 20 bp, Homo sapiens
tgaagactcattcttctgta

SEQ ID NO: 5453239 - DNA, 13 bp, Homo sapiens
tgaagactccaga

SEQ ID NO: 5453240 - DNA, 13 bp, Homo sapiens
tgaagactgagaa

SEQ ID NO: 5453241 - DNA, 15 bp, Homo sapiens
tgaagacttcttggg

SEQ ID NO: 5453242 - DNA, 13 bp, Homo sapiens
tgaagacttgccc

SEQ ID NO: 5453243 - DNA, 14 bp, Homo sapiens
tgaagagaaaaaag

SEQ ID NO: 5453244 - DNA, 21 bp, Homo sapiens
tgaagagaaaaaagtcaccat

SEQ ID NO: 5453245 - DNA, 17 bp, Homo sapiens
tgaagagaaaaaggctg

SEQ ID NO: 5453246 - DNA, 19 bp, Homo sapiens
tgaagagaagcaattttgg

SEQ ID NO: 5453247 - DNA, 14 bp, Homo sapiens
tgaagagaagctga

SEQ ID NO: 5453248 - DNA, 15 bp, Homo sapiens
tgaagagaagctgag

SEQ ID NO: 5453249 - DNA, 17 bp, Homo sapiens
tgaagagaagctgagaa

SEQ ID NO: 5453250 - DNA, 21 bp, Homo sapiens
tgaagagaagctgagaagaag

SEQ ID NO: 5453251 - DNA, 23 bp, Homo sapiens
tgaagagaatgtattctgtatcc

SEQ ID NO: 5453252 - DNA, 19 bp, Homo sapiens
tgaagagacagagacaagt

SEQ ID NO: 5453253 - DNA, 17 bp, Homo sapiens
tgaagagacagttattt

SEQ ID NO: 5453254 - DNA, 16 bp, Homo sapiens
tgaagagactctgttt

SEQ ID NO: 5453255 - DNA, 22 bp, Homo sapiens
tgaagagacttctgcttttcaa

SEQ ID NO: 5453256 - DNA, 12 bp, Homo sapiens
tgaagagaggga

SEQ ID NO: 5453257 - DNA, 23 bp, Homo sapiens
tgaagagagggacaggcactcca

SEQ ID NO: 5453258 - DNA, 16 bp, Homo sapiens
tgaagagatccttctg

SEQ ID NO: 5453259 - DNA, 16 bp, Homo sapiens
tgaagagatgacaaca

SEQ ID NO: 5453260 - DNA, 20 bp, Homo sapiens
tgaagagatgagcagtgagt

SEQ ID NO: 5453261 - DNA, 17 bp, Homo sapiens
tgaagagatttcaacat

SEQ ID NO: 5453262 - DNA, 23 bp, Homo sapiens
tgaagagcaagagagcagcaagg

SEQ ID NO: 5453263 - DNA, 23 bp, Homo sapiens
tgaagagcacggtcccccaggag

SEQ ID NO: 5453264 - DNA, 22 bp, Homo sapiens
tgaagagccagaagtgaagagt

SEQ ID NO: 5453265 - DNA, 22 bp, Homo sapiens
tgaagagccggtggtgcccgtg

SEQ ID NO: 5453266 - DNA, 16 bp, Homo sapiens
tgaagagctcttggcc

SEQ ID NO: 5453267 - DNA, 11 bp, Homo sapiens
tgaagagctga

SEQ ID NO: 5453268 - DNA, 22 bp, Homo sapiens
tgaagagctgagtactcaggcc

SEQ ID NO: 5453269 - DNA, 18 bp, Homo sapiens
tgaagagctggggagaat

SEQ ID NO: 5453270 - DNA, 14 bp, Homo sapiens
tgaagagctgtctt

SEQ ID NO: 5453271 - DNA, 15 bp, Homo sapiens
tgaagagctgtcttc

SEQ ID NO: 5453272 - DNA, 17 bp, Homo sapiens
tgaagagctgtcttccc

SEQ ID NO: 5453273 - DNA, 16 bp, Homo sapiens
tgaagagcttgctttg

SEQ ID NO: 5453274 - DNA, 22 bp, Homo sapiens
tgaagaggaaaatgaataatac

SEQ ID NO: 5453275 - DNA, 13 bp, Homo sapiens
tgaagaggaacag

SEQ ID NO: 5453276 - DNA, 16 bp, Homo sapiens
tgaagaggaccagagg

SEQ ID NO: 5453277 - DNA, 20 bp, Homo sapiens
tgaagaggaccagaggagca

SEQ ID NO: 5453278 - DNA, 20 bp, Homo sapiens
tgaagaggagattggccagt

SEQ ID NO: 5453279 - DNA, 21 bp, Homo sapiens
tgaagaggatattcttctctt

SEQ ID NO: 5453280 - DNA, 15 bp, Homo sapiens
tgaagaggcgggcca

SEQ ID NO: 5453281 - DNA, 18 bp, Homo sapiens
tgaagaggcgggccagcc

SEQ ID NO: 5453282 - DNA, 20 bp, Homo sapiens
tgaagaggcgggccagccag

SEQ ID NO: 5453283 - DNA, 16 bp, Homo sapiens
tgaagagggaagccag

SEQ ID NO: 5453284 - DNA, 16 bp, Homo sapiens
tgaagagggacataag

SEQ ID NO: 5453285 - DNA, 20 bp, Homo sapiens
tgaagagggacataagataa

SEQ ID NO: 5453286 - DNA, 22 bp, Homo sapiens
tgaagagggacataagataaaa

SEQ ID NO: 5453287 - DNA, 22 bp, Homo sapiens
tgaagagggctctgatctaaca

SEQ ID NO: 5453288 - DNA, 14 bp, Homo sapiens
tgaagaggggcagc

SEQ ID NO: 5453289 - DNA, 15 bp, Homo sapiens
tgaagaggggcagcc

SEQ ID NO: 5453290 - DNA, 16 bp, Homo sapiens
tgaagaggggcagccc

SEQ ID NO: 5453291 - DNA, 17 bp, Homo sapiens
tgaagaggggcagccct

SEQ ID NO: 5453292 - DNA, 18 bp, Homo sapiens
tgaagaggggcagccctt

SEQ ID NO: 5453293 - DNA, 19 bp, Homo sapiens
tgaagaggggcagcccttg

SEQ ID NO: 5453294 - DNA, 20 bp, Homo sapiens
tgaagaggggcagcccttgc

SEQ ID NO: 5453295 - DNA, 14 bp, Homo sapiens
tgaagaggtctgat

SEQ ID NO: 5453296 - DNA, 19 bp, Homo sapiens
tgaagaggtctgattggct

SEQ ID NO: 5453297 - DNA, 16 bp, Homo sapiens
tgaagaggtgagagta

SEQ ID NO: 5453298 - DNA, 22 bp, Homo sapiens
tgaagagtagaacccaggtctg

SEQ ID NO: 5453299 - DNA, 17 bp, Homo sapiens
tgaagagtatccttcct

SEQ ID NO: 5453300 - DNA, 12 bp, Homo sapiens
tgaagagtcaga

SEQ ID NO: 5453301 - DNA, 14 bp, Homo sapiens
tgaagagtcagaac

SEQ ID NO: 5453302 - DNA, 17 bp, Homo sapiens
tgaagagtcctctgaat

SEQ ID NO: 5453303 - DNA, 20 bp, Homo sapiens
tgaagagtgaagagcatttg

SEQ ID NO: 5453304 - DNA, 19 bp, Homo sapiens
tgaagagtgggtttcacaa

SEQ ID NO: 5453305 - DNA, 23 bp, Homo sapiens
tgaagagtgttattttcattcaa

SEQ ID NO: 5453306 - DNA, 24 bp, Homo sapiens
tgaagagtttaactttgggcccag

SEQ ID NO: 5453307 - DNA, 20 bp, Homo sapiens
tgaagagtttgtaaatgact

SEQ ID NO: 5453308 - DNA, 22 bp, Homo sapiens
tgaagagtttgtaaatgacttt

SEQ ID NO: 5453309 - DNA, 18 bp, Homo sapiens
tgaagataaatgctttaa

SEQ ID NO: 5453310 - DNA, 17 bp, Homo sapiens
tgaagatacacaagagg

SEQ ID NO: 5453311 - DNA, 23 bp, Homo sapiens
tgaagataccatcagcaaagaat

SEQ ID NO: 5453312 - DNA, 18 bp, Homo sapiens
tgaagatactgaaataaa

SEQ ID NO: 5453313 - DNA, 14 bp, Homo sapiens
tgaagatactttgt

SEQ ID NO: 5453314 - DNA, 20 bp, Homo sapiens
tgaagataggagagatacct

SEQ ID NO: 5453315 - DNA, 17 bp, Homo sapiens
tgaagataggtttagca

SEQ ID NO: 5453316 - DNA, 22 bp, Homo sapiens
tgaagatcaagccagttctcct

SEQ ID NO: 5453317 - DNA, 16 bp, Homo sapiens
tgaagatccagctgcc

SEQ ID NO: 5453318 - DNA, 17 bp, Homo sapiens
tgaagatccagctgcct

SEQ ID NO: 5453319 - DNA, 18 bp, Homo sapiens
tgaagatccccaactgct

SEQ ID NO: 5453320 - DNA, 23 bp, Homo sapiens
tgaagatcggctttcatgtaatt

SEQ ID NO: 5453321 - DNA, 19 bp, Homo sapiens
tgaagatctaaacttttga

SEQ ID NO: 5453322 - DNA, 14 bp, Homo sapiens
tgaagatctaaata

SEQ ID NO: 5453323 - DNA, 22 bp, Homo sapiens
tgaagatctaaataaaatgcta

SEQ ID NO: 5453324 - DNA, 16 bp, Homo sapiens
tgaagatctttatatt

SEQ ID NO: 5453325 - DNA, 13 bp, Homo sapiens
tgaagatctttgt

SEQ ID NO: 5453326 - DNA, 19 bp, Homo sapiens
tgaagatgaagaagccttt

SEQ ID NO: 5453327 - DNA, 16 bp, Homo sapiens
tgaagatgaaggggct

SEQ ID NO: 5453328 - DNA, 15 bp, Homo sapiens
tgaagatgcagctca

SEQ ID NO: 5453329 - DNA, 22 bp, Homo sapiens
tgaagatgcattttaaatgtct

SEQ ID NO: 5453330 - DNA, 15 bp, Homo sapiens
tgaagatgccttgag

SEQ ID NO: 5453331 - DNA, 21 bp, Homo sapiens
tgaagatgctgaaacaggaga

SEQ ID NO: 5453332 - DNA, 16 bp, Homo sapiens
tgaagatgctgtaaat

SEQ ID NO: 5453333 - DNA, 17 bp, Homo sapiens
tgaagatgctgtaaata

SEQ ID NO: 5453334 - DNA, 20 bp, Homo sapiens
tgaagatggagggggctggg

SEQ ID NO: 5453335 - DNA, 21 bp, Homo sapiens
tgaagatggcatcctgtgaag

SEQ ID NO: 5453336 - DNA, 17 bp, Homo sapiens
tgaagatgtagaggaga

SEQ ID NO: 5453337 - DNA, 18 bp, Homo sapiens
tgaagatgtagaggagaa

SEQ ID NO: 5453338 - DNA, 13 bp, Homo sapiens
tgaagatgtagct

SEQ ID NO: 5453339 - DNA, 16 bp, Homo sapiens
tgaagatgtcccccag

SEQ ID NO: 5453340 - DNA, 16 bp, Homo sapiens
tgaagatgtctaatag

SEQ ID NO: 5453341 - DNA, 16 bp, Homo sapiens
tgaagatgttgagaaa

SEQ ID NO: 5453342 - DNA, 14 bp, Homo sapiens
tgaagatgtttact

SEQ ID NO: 5453343 - DNA, 23 bp, Homo sapiens
tgaagatgtttactcattgcccc

SEQ ID NO: 5453344 - DNA, 13 bp, Homo sapiens
tgaagatgtttgc

SEQ ID NO: 5453345 - DNA, 14 bp, Homo sapiens
tgaagattaacact

SEQ ID NO: 5453346 - DNA, 21 bp, Homo sapiens
tgaagattaccctcaaatgct

SEQ ID NO: 5453347 - DNA, 19 bp, Homo sapiens
tgaagattattttttatga

SEQ ID NO: 5453348 - DNA, 21 bp, Homo sapiens
tgaagattctttcccaattca

SEQ ID NO: 5453349 - DNA, 19 bp, Homo sapiens
tgaagatttaatattacag

SEQ ID NO: 5453350 - DNA, 17 bp, Homo sapiens
tgaagatttatttttaa

SEQ ID NO: 5453351 - DNA, 20 bp, Homo sapiens
tgaagatttcagaggctgca

SEQ ID NO: 5453352 - DNA, 14 bp, Homo sapiens
tgaagatttccatt

SEQ ID NO: 5453353 - DNA, 23 bp, Homo sapiens
tgaatacacatctctgtcagtgt

SEQ ID NO: 5453354 - DNA, 16 bp, Homo sapiens
tgaatacagcagcaag

SEQ ID NO: 5453355 - DNA, 21 bp, Homo sapiens
tgaatacagcagcaagaaaaa

SEQ ID NO: 5453356 - DNA, 14 bp, Homo sapiens
tgaatacattcttt

SEQ ID NO: 5453357 - DNA, 16 bp, Homo sapiens
tgaatacattctttgc

SEQ ID NO: 5453358 - DNA, 17 bp, Homo sapiens
tgaatacattctttgct

SEQ ID NO: 5453359 - DNA, 16 bp, Homo sapiens
tgaatacatttgtatt

SEQ ID NO: 5453360 - DNA, 13 bp, Homo sapiens
tgaatacattttg

SEQ ID NO: 5453361 - DNA, 17 bp, Homo sapiens
tgaataccactctgtaa

SEQ ID NO: 5453362 - DNA, 18 bp, Homo sapiens
tgaataccactctgtaat

SEQ ID NO: 5453363 - DNA, 17 bp, Homo sapiens
tgaataccattaaaact

SEQ ID NO: 5453364 - DNA, 21 bp, Homo sapiens
tgaataccattaaaactgctt

SEQ ID NO: 5453365 - DNA, 14 bp, Homo sapiens
tgaataccccaaga

SEQ ID NO: 5453366 - DNA, 17 bp, Homo sapiens
tgaatacccccagagac

SEQ ID NO: 5453367 - DNA, 19 bp, Homo sapiens
tgaataccccttctctgta

SEQ ID NO: 5453368 - DNA, 22 bp, Homo sapiens
tgaatacgctaagcctggaagc

SEQ ID NO: 5453369 - DNA, 13 bp, Homo sapiens
tgaatactaaatg

SEQ ID NO: 5453370 - DNA, 15 bp, Homo sapiens
tgaatactatccatg

SEQ ID NO: 5453371 - DNA, 14 bp, Homo sapiens
tgaatactctcaca

SEQ ID NO: 5453372 - DNA, 20 bp, Homo sapiens
tgaatactctgccctctaga

SEQ ID NO: 5453373 - DNA, 14 bp, Homo sapiens
tgaatactcttgaa

SEQ ID NO: 5453374 - DNA, 21 bp, Homo sapiens
tgaatactcttgaaaggccaa

SEQ ID NO: 5453375 - DNA, 16 bp, Homo sapiens
tgaatactgtattttg

SEQ ID NO: 5453376 - DNA, 13 bp, Homo sapiens
tgaatactgtgaa

SEQ ID NO: 5453377 - DNA, 13 bp, Homo sapiens
tgaatacttgaac

SEQ ID NO: 5453378 - DNA, 15 bp, Homo sapiens
tgaatacttgaacca

SEQ ID NO: 5453379 - DNA, 14 bp, Homo sapiens
tgaatactttgaat

SEQ ID NO: 5453380 - DNA, 15 bp, Homo sapiens
tgaatactttgaatg

SEQ ID NO: 5453381 - DNA, 16 bp, Homo sapiens
tgaatactttgaatgt

SEQ ID NO: 5453382 - DNA, 17 bp, Homo sapiens
tgaatactttgaatgtg

SEQ ID NO: 5453383 - DNA, 18 bp, Homo sapiens
tgaatactttgaatgtgt

SEQ ID NO: 5453384 - DNA, 19 bp, Homo sapiens
tgaatactttgaatgtgtt

SEQ ID NO: 5453385 - DNA, 18 bp, Homo sapiens
tgaatactttgagtaaac

SEQ ID NO: 5453386 - DNA, 23 bp, Homo sapiens
tgaatagacagaggtttcatttt

SEQ ID NO: 5453387 - DNA, 23 bp, Homo sapiens
tgaatagacataaattgtaattt

SEQ ID NO: 5453388 - DNA, 22 bp, Homo sapiens
tgaatagaggccaaattaatct

SEQ ID NO: 5453389 - DNA, 22 bp, Homo sapiens
tgaatagagggagtagaaagct

SEQ ID NO: 5453390 - DNA, 18 bp, Homo sapiens
tgaatagatatgaaagct

SEQ ID NO: 5453391 - DNA, 21 bp, Homo sapiens
tgaatagatatgaaagctgat

SEQ ID NO: 5453392 - DNA, 21 bp, Homo sapiens
tgaatagatggaatttggaac

SEQ ID NO: 5453393 - DNA, 22 bp, Homo sapiens
tgaatagatgtgcccttttata

SEQ ID NO: 5453394 - DNA, 18 bp, Homo sapiens
tgaatagcagtggcaaaa

SEQ ID NO: 5453395 - DNA, 20 bp, Homo sapiens
tgaatagccatatttgtaaa

SEQ ID NO: 5453396 - DNA, 15 bp, Homo sapiens
tgaatagcctggcca

SEQ ID NO: 5453397 - DNA, 20 bp, Homo sapiens
tgaatagcttgtttctgtca

SEQ ID NO: 5453398 - DNA, 21 bp, Homo sapiens
tgaatagcttgtttctgtcaa

SEQ ID NO: 5453399 - DNA, 19 bp, Homo sapiens
tgaataggaaataaaatta

SEQ ID NO: 5453400 - DNA, 17 bp, Homo sapiens
tgaataggcgatcacaa

SEQ ID NO: 5453401 - DNA, 16 bp, Homo sapiens
tgaataggtagtatca

SEQ ID NO: 5453402 - DNA, 17 bp, Homo sapiens
tgaataggttatatgca

SEQ ID NO: 5453403 - DNA, 15 bp, Homo sapiens
tgaatagtattgtgt

SEQ ID NO: 5453404 - DNA, 17 bp, Homo sapiens
tgaatagtcctaaaaag

SEQ ID NO: 5453405 - DNA, 17 bp, Homo sapiens
tgaatagtctgtgtgca

SEQ ID NO: 5453406 - DNA, 20 bp, Homo sapiens
tgaatagttaaaaattaaat

SEQ ID NO: 5453407 - DNA, 13 bp, Homo sapiens
tgaatagttgctt

SEQ ID NO: 5453408 - DNA, 16 bp, Homo sapiens
tgaatagtttatttct

SEQ ID NO: 5453409 - DNA, 17 bp, Homo sapiens
tgaatagtttatttctg

SEQ ID NO: 5453410 - DNA, 13 bp, Homo sapiens
tgaatataaaaaa

SEQ ID NO: 5453411 - DNA, 16 bp, Homo sapiens
tgaatataaacactat

SEQ ID NO: 5453412 - DNA, 23 bp, Homo sapiens
tgaatataaatgtactacatttg

SEQ ID NO: 5453413 - DNA, 14 bp, Homo sapiens
tgaatataagaaaa

SEQ ID NO: 5453414 - DNA, 19 bp, Homo sapiens
tgaatatactcattagaat

SEQ ID NO: 5453415 - DNA, 12 bp, Homo sapiens
tgaatatactgt

SEQ ID NO: 5453416 - DNA, 14 bp, Homo sapiens
tgaatatagcctgc

SEQ ID NO: 5453417 - DNA, 17 bp, Homo sapiens
tgaatatagcctgcctc

SEQ ID NO: 5453418 - DNA, 19 bp, Homo sapiens
tgaatatagcctgcctcag

SEQ ID NO: 5453419 - DNA, 23 bp, Homo sapiens
tgaatatatagaattcagaaaat

SEQ ID NO: 5453420 - DNA, 15 bp, Homo sapiens
tgaatatatggcatt

SEQ ID NO: 5453421 - DNA, 16 bp, Homo sapiens
tgaatatatggcattt

SEQ ID NO: 5453422 - DNA, 21 bp, Homo sapiens
tgaatatatggcatttgcaga

SEQ ID NO: 5453423 - DNA, 16 bp, Homo sapiens
tgaatatattttatct

SEQ ID NO: 5453424 - DNA, 12 bp, Homo sapiens
tgaatatcatat

SEQ ID NO: 5453425 - DNA, 22 bp, Homo sapiens
tgaatatgagaaatacagaaga

SEQ ID NO: 5453426 - DNA, 21 bp, Homo sapiens
tgaatatgattaaaaatatca

SEQ ID NO: 5453427 - DNA, 22 bp, Homo sapiens
tgaatatgattaaaaatatcaa

SEQ ID NO: 5453428 - DNA, 17 bp, Homo sapiens
tgaatatgccttaattt

SEQ ID NO: 5453429 - DNA, 19 bp, Homo sapiens
tgaatatgccttaatttag

SEQ ID NO: 5453430 - DNA, 20 bp, Homo sapiens
tgaatatgccttaatttaga

SEQ ID NO: 5453431 - DNA, 22 bp, Homo sapiens
tgaatatgccttaatttagaaa

SEQ ID NO: 5453432 - DNA, 19 bp, Homo sapiens
tgaatatggacaagaggta

SEQ ID NO: 5453433 - DNA, 23 bp, Homo sapiens
tgaatatggacagttagcattta

SEQ ID NO: 5453434 - DNA, 21 bp, Homo sapiens
tgaatatggactcagttttct

SEQ ID NO: 5453435 - DNA, 16 bp, Homo sapiens
tgaatatgtgccttct

SEQ ID NO: 5453436 - DNA, 19 bp, Homo sapiens
tgaatatgtgccttctaga

SEQ ID NO: 5453437 - DNA, 17 bp, Homo sapiens
tgaatattaatcccagc

SEQ ID NO: 5453438 - DNA, 19 bp, Homo sapiens
tgaatattactcctatttt

SEQ ID NO: 5453439 - DNA, 13 bp, Homo sapiens
tgaatattactct

SEQ ID NO: 5453440 - DNA, 15 bp, Homo sapiens
tgaatattggacatt

SEQ ID NO: 5453441 - DNA, 23 bp, Homo sapiens
tgaatattggtaattaaaagact

SEQ ID NO: 5453442 - DNA, 14 bp, Homo sapiens
tgaatattgttaca

SEQ ID NO: 5453443 - DNA, 14 bp, Homo sapiens
tgaatatttaagca

SEQ ID NO: 5453444 - DNA, 15 bp, Homo sapiens
tgaatatttaagcaa

SEQ ID NO: 5453445 - DNA, 20 bp, Homo sapiens
tgaatatttaagcaataaaa

SEQ ID NO: 5453446 - DNA, 11 bp, Homo sapiens
tgaatatttat

SEQ ID NO: 5453447 - DNA, 20 bp, Homo sapiens
tgaatatttatatttcacta

SEQ ID NO: 5453448 - DNA, 19 bp, Homo sapiens
tgaatatttcattttgaga

SEQ ID NO: 5453449 - DNA, 23 bp, Homo sapiens
tgaatatttcattttgagaacat

SEQ ID NO: 5453450 - DNA, 13 bp, Homo sapiens
tgaatatttctta

SEQ ID NO: 5453451 - DNA, 18 bp, Homo sapiens
tgaatatttggaattgaa

SEQ ID NO: 5453452 - DNA, 14 bp, Homo sapiens
tgaatatttgtaaa

SEQ ID NO: 5453453 - DNA, 20 bp, Homo sapiens
tgaatatttgtaaaaataat

SEQ ID NO: 5453454 - DNA, 18 bp, Homo sapiens
tgaatattttaattaaaa

SEQ ID NO: 5453455 - DNA, 17 bp, Homo sapiens
tgaatattttcaagttt

SEQ ID NO: 5453456 - DNA, 21 bp, Homo sapiens
tgaatattttcattaaaagct

SEQ ID NO: 5453457 - DNA, 15 bp, Homo sapiens
tgaatattttggaaa

SEQ ID NO: 5453458 - DNA, 23 bp, Homo sapiens
tgaatattttggaaactgctaaa

SEQ ID NO: 5453459 - DNA, 15 bp, Homo sapiens
tgaatatttttgtat

SEQ ID NO: 5453460 - DNA, 22 bp, Homo sapiens
tgaatattttttgaaggtttca

SEQ ID NO: 5453461 - DNA, 16 bp, Homo sapiens
tgaatcaaaagtgcct

SEQ ID NO: 5453462 - DNA, 13 bp, Homo sapiens
tgaatcaaagaat

SEQ ID NO: 5453463 - DNA, 22 bp, Homo sapiens
tgaatcaaagacatttcatcca

SEQ ID NO: 5453464 - DNA, 12 bp, Homo sapiens
tgaatcaaagtg

SEQ ID NO: 5453465 - DNA, 16 bp, Homo sapiens
tgaatcaaagtgtcta

SEQ ID NO: 5453466 - DNA, 17 bp, Homo sapiens
tgaatcaagcacactgt

SEQ ID NO: 5453467 - DNA, 18 bp, Homo sapiens
tgaatcaagcacactgta

SEQ ID NO: 5453468 - DNA, 18 bp, Homo sapiens
tgaatcaagggtcaggcc

SEQ ID NO: 5453469 - DNA, 16 bp, Homo sapiens
tgaatcaataatatat

SEQ ID NO: 5453470 - DNA, 17 bp, Homo sapiens
tgaatcaataatatatt

SEQ ID NO: 5453471 - DNA, 22 bp, Homo sapiens
tgaatcaataatatattttctg

SEQ ID NO: 5453472 - DNA, 13 bp, Homo sapiens
tgaatcaatcctg

SEQ ID NO: 5453473 - DNA, 15 bp, Homo sapiens
tgaatcaatgaaaaa

SEQ ID NO: 5453474 - DNA, 13 bp, Homo sapiens
tgaatcacctggc

SEQ ID NO: 5453475 - DNA, 20 bp, Homo sapiens
tgaatcacctggctgagcag

SEQ ID NO: 5453476 - DNA, 17 bp, Homo sapiens
tgaatcacgtaaagcta

SEQ ID NO: 5453477 - DNA, 17 bp, Homo sapiens
tgaatcactgtgctcag

SEQ ID NO: 5453478 - DNA, 19 bp, Homo sapiens
tgaatcactgtgctcagcc

SEQ ID NO: 5453479 - DNA, 20 bp, Homo sapiens
tgaatcactgtgctcagcca

SEQ ID NO: 5453480 - DNA, 22 bp, Homo sapiens
tgaatcactgtgctcagccacc

SEQ ID NO: 5453481 - DNA, 16 bp, Homo sapiens
tgaatcactgttttta

SEQ ID NO: 5453482 - DNA, 13 bp, Homo sapiens
tgaatcagaacag

SEQ ID NO: 5453483 - DNA, 17 bp, Homo sapiens
tgaatcagacagtggat

SEQ ID NO: 5453484 - DNA, 16 bp, Homo sapiens
tgaatcagaccctacc

SEQ ID NO: 5453485 - DNA, 18 bp, Homo sapiens
tgaatcagaccctacccc

SEQ ID NO: 5453486 - DNA, 21 bp, Homo sapiens
tgaatcagaccctaccccacc

SEQ ID NO: 5453487 - DNA, 22 bp, Homo sapiens
tgaatcagaccctaccccacca

SEQ ID NO: 5453488 - DNA, 17 bp, Homo sapiens
tgaatcagccagtctca

SEQ ID NO: 5453489 - DNA, 14 bp, Homo sapiens
tgaatcaggcaaag

SEQ ID NO: 5453490 - DNA, 15 bp, Homo sapiens
tgaatcaggcaaagt

SEQ ID NO: 5453491 - DNA, 19 bp, Homo sapiens
tgaatcagtataaacaaag

SEQ ID NO: 5453492 - DNA, 20 bp, Homo sapiens
tgaatcagtataaacaaagt

SEQ ID NO: 5453493 - DNA, 22 bp, Homo sapiens
tgaatcagtataaacaaagtta

SEQ ID NO: 5453494 - DNA, 20 bp, Homo sapiens
tgaatcagtttccaattatt

SEQ ID NO: 5453495 - DNA, 23 bp, Homo sapiens
tgaatcagtttccaattatttga

SEQ ID NO: 5453496 - DNA, 19 bp, Homo sapiens
tgaatcagttttggaatct

SEQ ID NO: 5453497 - DNA, 17 bp, Homo sapiens
tgaatcagtttttaaaa

SEQ ID NO: 5453498 - DNA, 14 bp, Homo sapiens
tgaatcatgagcct

SEQ ID NO: 5453499 - DNA, 19 bp, Homo sapiens
tgaatcatgtagtatcaaa

SEQ ID NO: 5453500 - DNA, 21 bp, Homo sapiens
tgaatcatgtagtatcaaata

SEQ ID NO: 5453501 - DNA, 13 bp, Homo sapiens
tgaatcatgtctg

SEQ ID NO: 5453502 - DNA, 12 bp, Homo sapiens
tgaatcattgtt

SEQ ID NO: 5453503 - DNA, 12 bp, Homo sapiens
tgaatcatttct

SEQ ID NO: 5453504 - DNA, 14 bp, Homo sapiens
tgaatcatttctta

SEQ ID NO: 5453505 - DNA, 18 bp, Homo sapiens
tgaatccaaaagaaaaac

SEQ ID NO: 5453506 - DNA, 21 bp, Homo sapiens
tgaatccaaaagaaaaacagc

SEQ ID NO: 5453507 - DNA, 19 bp, Homo sapiens
tgaatccaaatctgtcctc

SEQ ID NO: 5453508 - DNA, 20 bp, Homo sapiens
tgaatccaaatctgtcctct

SEQ ID NO: 5453509 - DNA, 14 bp, Homo sapiens
tgaatccaaatgtg

SEQ ID NO: 5453510 - DNA, 16 bp, Homo sapiens
tgaatccaaatgtgaa

SEQ ID NO: 5453511 - DNA, 19 bp, Homo sapiens
tgaatccaaatgtgaaaga

SEQ ID NO: 5453512 - DNA, 17 bp, Homo sapiens
tgaatccacctcggagc

SEQ ID NO: 5453513 - DNA, 17 bp, Homo sapiens
tgaatccatcaggactt

SEQ ID NO: 5453514 - DNA, 15 bp, Homo sapiens
tgaatccatcgattt

SEQ ID NO: 5453515 - DNA, 22 bp, Homo sapiens
tgaatccatcttgctttttccc

SEQ ID NO: 5453516 - DNA, 17 bp, Homo sapiens
tgaatccattgaaagtg

SEQ ID NO: 5453517 - DNA, 21 bp, Homo sapiens
tgaatcccccttgccacccca

SEQ ID NO: 5453518 - DNA, 15 bp, Homo sapiens
tgaatccccgacccc

SEQ ID NO: 5453519 - DNA, 17 bp, Homo sapiens
tgaatccccgacccccc

SEQ ID NO: 5453520 - DNA, 22 bp, Homo sapiens
tgaatcccctatcccattctgc

SEQ ID NO: 5453521 - DNA, 15 bp, Homo sapiens
tgaatccctgggagc

SEQ ID NO: 5453522 - DNA, 17 bp, Homo sapiens
tgaatccgtacttgggt

SEQ ID NO: 5453523 - DNA, 14 bp, Homo sapiens
tgaatcctctctct

SEQ ID NO: 5453524 - DNA, 21 bp, Homo sapiens
tgaatcctctctctgtgttac

SEQ ID NO: 5453525 - DNA, 13 bp, Homo sapiens
tgaatcctctgtt

SEQ ID NO: 5453526 - DNA, 18 bp, Homo sapiens
tgaatccttccattccac

SEQ ID NO: 5453527 - DNA, 19 bp, Homo sapiens
tgaatccttccatttcttc

SEQ ID NO: 5453528 - DNA, 21 bp, Homo sapiens
tgaatcgcaaggcctgtgctg

SEQ ID NO: 5453529 - DNA, 23 bp, Homo sapiens
tgaatcgggctaaggtccctggg

SEQ ID NO: 5453530 - DNA, 16 bp, Homo sapiens
tgacaaggaaaatcta

SEQ ID NO: 5453531 - DNA, 18 bp, Homo sapiens
tgacaaggattgctactg

SEQ ID NO: 5453532 - DNA, 23 bp, Homo sapiens
tgacaaggattgctactgtccta

SEQ ID NO: 5453533 - DNA, 21 bp, Homo sapiens
tgacaaggcacttcatgtaaa

SEQ ID NO: 5453534 - DNA, 12 bp, Homo sapiens
tgacaaggccag

SEQ ID NO: 5453535 - DNA, 22 bp, Homo sapiens
tgacaaggccagcacccaaagg

SEQ ID NO: 5453536 - DNA, 15 bp, Homo sapiens
tgacaaggccccaga

SEQ ID NO: 5453537 - DNA, 17 bp, Homo sapiens
tgacaaggccccagaga

SEQ ID NO: 5453538 - DNA, 20 bp, Homo sapiens
tgacaaggtgtttctctgta

SEQ ID NO: 5453539 - DNA, 14 bp, Homo sapiens
tgacaagtcatttt

SEQ ID NO: 5453540 - DNA, 21 bp, Homo sapiens
tgacaagtggggtctttcaga

SEQ ID NO: 5453541 - DNA, 17 bp, Homo sapiens
tgacaataaaacattaa

SEQ ID NO: 5453542 - DNA, 16 bp, Homo sapiens
tgacaataactaaagc

SEQ ID NO: 5453543 - DNA, 18 bp, Homo sapiens
tgacaataatattgttgt

SEQ ID NO: 5453544 - DNA, 19 bp, Homo sapiens
tgacaataatattgttgta

SEQ ID NO: 5453545 - DNA, 17 bp, Homo sapiens
tgacaataatctcacaa

SEQ ID NO: 5453546 - DNA, 22 bp, Homo sapiens
tgacaatactgctgccttaccc

SEQ ID NO: 5453547 - DNA, 19 bp, Homo sapiens
tgacaatagggctaaatgt

SEQ ID NO: 5453548 - DNA, 20 bp, Homo sapiens
tgacaatagggctaaatgtt

SEQ ID NO: 5453549 - DNA, 15 bp, Homo sapiens
tgacaatatgatttt

SEQ ID NO: 5453550 - DNA, 21 bp, Homo sapiens
tgacaatcaaagaaaagactt

SEQ ID NO: 5453551 - DNA, 18 bp, Homo sapiens
tgacaatcaactctaata

SEQ ID NO: 5453552 - DNA, 22 bp, Homo sapiens
tgacaatcatctccaatggaaa

SEQ ID NO: 5453553 - DNA, 18 bp, Homo sapiens
tgacaatcatgtgtgtta

SEQ ID NO: 5453554 - DNA, 20 bp, Homo sapiens
tgacaatcctgaagaaacca

SEQ ID NO: 5453555 - DNA, 18 bp, Homo sapiens
tgacaatgactaagccaa

SEQ ID NO: 5453556 - DNA, 19 bp, Homo sapiens
tgacaatgcaatgaaacag

SEQ ID NO: 5453557 - DNA, 17 bp, Homo sapiens
tgacaatgcttatggaa

SEQ ID NO: 5453558 - DNA, 23 bp, Homo sapiens
tgacaatggacctctcagcagaa

SEQ ID NO: 5453559 - DNA, 14 bp, Homo sapiens
tgacaatggcagct

SEQ ID NO: 5453560 - DNA, 15 bp, Homo sapiens
tgacaatggcagcta

SEQ ID NO: 5453561 - DNA, 14 bp, Homo sapiens
tgacaatgttgtag

SEQ ID NO: 5453562 - DNA, 14 bp, Homo sapiens
tgacaatgtttaca

SEQ ID NO: 5453563 - DNA, 19 bp, Homo sapiens
tgacaattaacatacatca

SEQ ID NO: 5453564 - DNA, 15 bp, Homo sapiens
tgacaattatgaaaa

SEQ ID NO: 5453565 - DNA, 13 bp, Homo sapiens
tgacaattctgca

SEQ ID NO: 5453566 - DNA, 20 bp, Homo sapiens
tgacaattctgcatgtacta

SEQ ID NO: 5453567 - DNA, 22 bp, Homo sapiens
tgacaattctgcatgtactagt

SEQ ID NO: 5453568 - DNA, 16 bp, Homo sapiens
tgacaattctgggtgc

SEQ ID NO: 5453569 - DNA, 19 bp, Homo sapiens
tgacaattgtgaacatgat

SEQ ID NO: 5453570 - DNA, 15 bp, Homo sapiens
tgacaatttcaaaat

SEQ ID NO: 5453571 - DNA, 15 bp, Homo sapiens
tgacaattttaccta

SEQ ID NO: 5453572 - DNA, 20 bp, Homo sapiens
tgacaattttacctattctg

SEQ ID NO: 5453573 - DNA, 15 bp, Homo sapiens
tgacaattttgtctt

SEQ ID NO: 5453574 - DNA, 17 bp, Homo sapiens
tgacacaaacctgcctg

SEQ ID NO: 5453575 - DNA, 16 bp, Homo sapiens
tgacacaaagcttcta

SEQ ID NO: 5453576 - DNA, 13 bp, Homo sapiens
tgacacaaaggaa

SEQ ID NO: 5453577 - DNA, 23 bp, Homo sapiens
tgacacaaaggacaaaaatataa

SEQ ID NO: 5453578 - DNA, 20 bp, Homo sapiens
tgacacaaataccagagcac

SEQ ID NO: 5453579 - DNA, 22 bp, Homo sapiens
tgacacaaataccagagcacag

SEQ ID NO: 5453580 - DNA, 20 bp, Homo sapiens
tgacacaaattgaagcatgt

SEQ ID NO: 5453581 - DNA, 17 bp, Homo sapiens
tgacacaactcatccag

SEQ ID NO: 5453582 - DNA, 23 bp, Homo sapiens
tgacacaagtgtattatttctgg

SEQ ID NO: 5453583 - DNA, 18 bp, Homo sapiens
tgacacaatctcggctca

SEQ ID NO: 5453584 - DNA, 16 bp, Homo sapiens
tgacacaatgctgggt

SEQ ID NO: 5453585 - DNA, 17 bp, Homo sapiens
tgacacaatggtagctc

SEQ ID NO: 5453586 - DNA, 13 bp, Homo sapiens
tgacacacagcac

SEQ ID NO: 5453587 - DNA, 19 bp, Homo sapiens
tgacacacagcactctcta

SEQ ID NO: 5453588 - DNA, 16 bp, Homo sapiens
tgacacacagctctgt

SEQ ID NO: 5453589 - DNA, 20 bp, Homo sapiens
tgacacacagctctgtcctg

SEQ ID NO: 5453590 - DNA, 20 bp, Homo sapiens
tgacacacgtatttatattt

SEQ ID NO: 5453591 - DNA, 23 bp, Homo sapiens
tgacacacgtatttatatttgga

SEQ ID NO: 5453592 - DNA, 12 bp, Homo sapiens
tgacacactaac

SEQ ID NO: 5453593 - DNA, 20 bp, Homo sapiens
tgacacactaaccaagctga

SEQ ID NO: 5453594 - DNA, 17 bp, Homo sapiens
tgacacagaaaaaggat

SEQ ID NO: 5453595 - DNA, 19 bp, Homo sapiens
tgacacagaaaatgttgag

SEQ ID NO: 5453596 - DNA, 13 bp, Homo sapiens
tgacacagacatt

SEQ ID NO: 5453597 - DNA, 17 bp, Homo sapiens
tgacacagacattttgt

SEQ ID NO: 5453598 - DNA, 18 bp, Homo sapiens
tgacacagacattttgtg

SEQ ID NO: 5453599 - DNA, 21 bp, Homo sapiens
tgacacagacattttgtgtga

SEQ ID NO: 5453600 - DNA, 11 bp, Homo sapiens
tgacacagact

SEQ ID NO: 5453601 - DNA, 19 bp, Homo sapiens
tgacacagactcatcctga

SEQ ID NO: 5453602 - DNA, 22 bp, Homo sapiens
tgacacagcagcttcaccagag

SEQ ID NO: 5453603 - DNA, 16 bp, Homo sapiens
tgacacagcttgtgaa

SEQ ID NO: 5453604 - DNA, 13 bp, Homo sapiens
tgacacaggccag

SEQ ID NO: 5453605 - DNA, 18 bp, Homo sapiens
tgacacaggccagcccca

SEQ ID NO: 5453606 - DNA, 21 bp, Homo sapiens
tgacacaggccagccttggca

SEQ ID NO: 5453607 - DNA, 15 bp, Homo sapiens
tgacacaggtcaggg

SEQ ID NO: 5453608 - DNA, 17 bp, Homo sapiens
tgacacaggtcagggct

SEQ ID NO: 5453609 - DNA, 20 bp, Homo sapiens
tgacacaggtcagggctcag

SEQ ID NO: 5453610 - DNA, 16 bp, Homo sapiens
tgacacagtcagcatg

SEQ ID NO: 5453611 - DNA, 22 bp, Homo sapiens
tgacacataaaagtaattaatt

SEQ ID NO: 5453612 - DNA, 18 bp, Homo sapiens
tgacacataaatctgtct

SEQ ID NO: 5453613 - DNA, 15 bp, Homo sapiens
tgacacatatgaaca

SEQ ID NO: 5453614 - DNA, 18 bp, Homo sapiens
tgacacatcgttttgggg

SEQ ID NO: 5453615 - DNA, 20 bp, Homo sapiens
tgacacatgcaaggtcattt

SEQ ID NO: 5453616 - DNA, 21 bp, Homo sapiens
tgacacatgctctcaatatat

SEQ ID NO: 5453617 - DNA, 16 bp, Homo sapiens
tgacacattaatgaat

SEQ ID NO: 5453618 - DNA, 15 bp, Homo sapiens
tgacaccaaaatgaa

SEQ ID NO: 5453619 - DNA, 14 bp, Homo sapiens
tgacaccaaagcca

SEQ ID NO: 5453620 - DNA, 16 bp, Homo sapiens
tgacaccaaagccacc

SEQ ID NO: 5453621 - DNA, 18 bp, Homo sapiens
tgacaccaaccagacagc

SEQ ID NO: 5453622 - DNA, 16 bp, Homo sapiens
tgacaccaagaaacca

SEQ ID NO: 5453623 - DNA, 19 bp, Homo sapiens
tgacaccaataaatgtttg

SEQ ID NO: 5453624 - DNA, 20 bp, Homo sapiens
tgacaccaataaatgtttgt

SEQ ID NO: 5453625 - DNA, 23 bp, Homo sapiens
tgacaccaataaatgtttgttat

SEQ ID NO: 5453626 - DNA, 20 bp, Homo sapiens
tgacaccacacttgttttct

SEQ ID NO: 5453627 - DNA, 19 bp, Homo sapiens
tgacaccaccactgtgtcc

SEQ ID NO: 5453628 - DNA, 22 bp, Homo sapiens
tgacaccagaaagccctcttgg

SEQ ID NO: 5453629 - DNA, 17 bp, Homo sapiens
tgacaccatcttttatt

SEQ ID NO: 5453630 - DNA, 21 bp, Homo sapiens
tgacaccatcttttattcttt

SEQ ID NO: 5453631 - DNA, 16 bp, Homo sapiens
tgacaccatttgtcct

SEQ ID NO: 5453632 - DNA, 17 bp, Homo sapiens
tgacacccaagagggct

SEQ ID NO: 5453633 - DNA, 19 bp, Homo sapiens
tgacacccaagagggctgc

SEQ ID NO: 5453634 - DNA, 17 bp, Homo sapiens
tgacaccccacttagcc

SEQ ID NO: 5453635 - DNA, 12 bp, Homo sapiens
tgacaccccctc

SEQ ID NO: 5453636 - DNA, 14 bp, Homo sapiens
tgacaccccctccc

SEQ ID NO: 5453637 - DNA, 15 bp, Homo sapiens
tgacacccctggcct

SEQ ID NO: 5453638 - DNA, 14 bp, Homo sapiens
tgacaccctggcct

SEQ ID NO: 5453639 - DNA, 14 bp, Homo sapiens
tgacacccttctcc

SEQ ID NO: 5453640 - DNA, 21 bp, Homo sapiens
tgacacccttctcccactctc

SEQ ID NO: 5453641 - DNA, 15 bp, Homo sapiens
tgacaccctttaatg

SEQ ID NO: 5453642 - DNA, 20 bp, Homo sapiens
tgacaccctttaatgttcta

SEQ ID NO: 5453643 - DNA, 21 bp, Homo sapiens
tgacaccggggtggtgggaac

SEQ ID NO: 5453644 - DNA, 19 bp, Homo sapiens
tgacaccgtccctcagtga

SEQ ID NO: 5453645 - DNA, 21 bp, Homo sapiens
tgacaccgtccctcagtgata

SEQ ID NO: 5453646 - DNA, 16 bp, Homo sapiens
tgacacctccatttct

SEQ ID NO: 5453647 - DNA, 13 bp, Homo sapiens
tgacacctccccc

SEQ ID NO: 5453648 - DNA, 19 bp, Homo sapiens
tgacaccttagagaagcta

SEQ ID NO: 5453649 - DNA, 16 bp, Homo sapiens
tgacacctttaaaaag

SEQ ID NO: 5453650 - DNA, 19 bp, Homo sapiens
tgacacctttgcaggcatg

SEQ ID NO: 5453651 - DNA, 16 bp, Homo sapiens
tgacaccttttcaggt

SEQ ID NO: 5453652 - DNA, 17 bp, Homo sapiens
tgacacgcgctctccac

SEQ ID NO: 5453653 - DNA, 23 bp, Homo sapiens
tgacacgcgctctccaccaccca

SEQ ID NO: 5453654 - DNA, 16 bp, Homo sapiens
tgacacggccatgacc

SEQ ID NO: 5453655 - DNA, 20 bp, Homo sapiens
tgacacgtgatggaccaaag

SEQ ID NO: 5453656 - DNA, 19 bp, Homo sapiens
tgacactaaaacaagagga

SEQ ID NO: 5453657 - DNA, 20 bp, Homo sapiens
tgacactaaaacaagaggac

SEQ ID NO: 5453658 - DNA, 21 bp, Homo sapiens
tgacactaaactccatgatat

SEQ ID NO: 5453659 - DNA, 17 bp, Homo sapiens
tgacactaagaaaatag

SEQ ID NO: 5453660 - DNA, 20 bp, Homo sapiens
tgacactaccttatcaggca

SEQ ID NO: 5453661 - DNA, 19 bp, Homo sapiens
tgacactagcccaatgaaa

SEQ ID NO: 5453662 - DNA, 21 bp, Homo sapiens
tgacactagcccaatgaaatg

SEQ ID NO: 5453663 - DNA, 22 bp, Homo sapiens
tgacactagcccaatgaaatga

SEQ ID NO: 5453664 - DNA, 20 bp, Homo sapiens
tgacactatatatttcttaa

SEQ ID NO: 5453665 - DNA, 19 bp, Homo sapiens
tgacactcaataaacagtc

SEQ ID NO: 5453666 - DNA, 23 bp, Homo sapiens
tgacactcaataaacagtcactg

SEQ ID NO: 5453667 - DNA, 22 bp, Homo sapiens
tgacactcatataattatatgt

SEQ ID NO: 5453668 - DNA, 16 bp, Homo sapiens
tgacactcccacccag

SEQ ID NO: 5453669 - DNA, 19 bp, Homo sapiens
tgacactctagtgacttcc

SEQ ID NO: 5453670 - DNA, 22 bp, Homo sapiens
tgacactctagtgacttcctgg

SEQ ID NO: 5453671 - DNA, 17 bp, Homo sapiens
tgacactctccttgcag

SEQ ID NO: 5453672 - DNA, 19 bp, Homo sapiens
tgacactgaaagttttgta

SEQ ID NO: 5453673 - DNA, 14 bp, Homo sapiens
tgacactgacattt

SEQ ID NO: 5453674 - DNA, 18 bp, Homo sapiens
tgacactgactagagtga

SEQ ID NO: 5453675 - DNA, 13 bp, Homo sapiens
tgacactgagaac

SEQ ID NO: 5453676 - DNA, 15 bp, Homo sapiens
tgacactgagcccca

SEQ ID NO: 5453677 - DNA, 13 bp, Homo sapiens
tgacactgctcta

SEQ ID NO: 5453678 - DNA, 16 bp, Homo sapiens
tgacactgtctgctgc

SEQ ID NO: 5453679 - DNA, 18 bp, Homo sapiens
tgacactgtctgctgccc

SEQ ID NO: 5453680 - DNA, 16 bp, Homo sapiens
tgacactgtgaccctg

SEQ ID NO: 5453681 - DNA, 15 bp, Homo sapiens
tgacactgtttcctg

SEQ ID NO: 5453682 - DNA, 21 bp, Homo sapiens
tgacacttatctcactgtttt

SEQ ID NO: 5453683 - DNA, 15 bp, Homo sapiens
tgacacttcaaggtg

SEQ ID NO: 5453684 - DNA, 18 bp, Homo sapiens
tgacacttcaaggtgaca

SEQ ID NO: 5453685 - DNA, 16 bp, Homo sapiens
tgacacttcagagagc

SEQ ID NO: 5453686 - DNA, 17 bp, Homo sapiens
tgacacttcagagagct

SEQ ID NO: 5453687 - DNA, 23 bp, Homo sapiens
tgacacttcagagagctggtagt

SEQ ID NO: 5453688 - DNA, 24 bp, Homo sapiens
tgacacttcagagagctggtagtt

SEQ ID NO: 5453689 - DNA, 15 bp, Homo sapiens
tgacacttccaaaga

SEQ ID NO: 5453690 - DNA, 16 bp, Homo sapiens
tgacacttcccagtgg

SEQ ID NO: 5453691 - DNA, 17 bp, Homo sapiens
tgacacttgtacaatta

SEQ ID NO: 5453692 - DNA, 15 bp, Homo sapiens
tgacacttgtcccca

SEQ ID NO: 5453693 - DNA, 20 bp, Homo sapiens
tgacacttttcatatcattt

SEQ ID NO: 5453694 - DNA, 22 bp, Homo sapiens
tgacagaaaaaaaaatgtttta

SEQ ID NO: 5453695 - DNA, 13 bp, Homo sapiens
tgacagaaagcag

SEQ ID NO: 5453696 - DNA, 23 bp, Homo sapiens
tgacagaaagcagttctgatgct

SEQ ID NO: 5453697 - DNA, 14 bp, Homo sapiens
tgacagaaatgcaa

SEQ ID NO: 5453698 - DNA, 17 bp, Homo sapiens
tgacagaacactgtctt

SEQ ID NO: 5453699 - DNA, 20 bp, Homo sapiens
tgacagaaggcccgaggagg

SEQ ID NO: 5453700 - DNA, 21 bp, Homo sapiens
tgacagaaggcccgaggaggc

SEQ ID NO: 5453701 - DNA, 14 bp, Homo sapiens
tgacagaatataca

SEQ ID NO: 5453702 - DNA, 19 bp, Homo sapiens
tgacagaatatacacattt

SEQ ID NO: 5453703 - DNA, 13 bp, Homo sapiens
tgacagacacagg

SEQ ID NO: 5453704 - DNA, 20 bp, Homo sapiens
tgacagacacaggcccggct

SEQ ID NO: 5453705 - DNA, 16 bp, Homo sapiens
tgacagacagccctcc

SEQ ID NO: 5453706 - DNA, 21 bp, Homo sapiens
tgacccacactgccagaagag

SEQ ID NO: 5453707 - DNA, 11 bp, Homo sapiens
tgacccacagc

SEQ ID NO: 5453708 - DNA, 18 bp, Homo sapiens
tgacccacagcctccaag

SEQ ID NO: 5453709 - DNA, 13 bp, Homo sapiens
tgacccacagctc

SEQ ID NO: 5453710 - DNA, 16 bp, Homo sapiens
tgacccacagctctgg

SEQ ID NO: 5453711 - DNA, 17 bp, Homo sapiens
tgacccacagctctggg

SEQ ID NO: 5453712 - DNA, 23 bp, Homo sapiens
tgacccacagctctgggcctctt

SEQ ID NO: 5453713 - DNA, 14 bp, Homo sapiens
tgacccacatgcca

SEQ ID NO: 5453714 - DNA, 15 bp, Homo sapiens
tgacccaccagtgcc

SEQ ID NO: 5453715 - DNA, 17 bp, Homo sapiens
tgacccaccagtgcctt

SEQ ID NO: 5453716 - DNA, 17 bp, Homo sapiens
tgacccacccctgtgct

SEQ ID NO: 5453717 - DNA, 13 bp, Homo sapiens
tgacccactaaag

SEQ ID NO: 5453718 - DNA, 16 bp, Homo sapiens
tgacccactaaagagt

SEQ ID NO: 5453719 - DNA, 22 bp, Homo sapiens
tgacccactggttccttcttcc

SEQ ID NO: 5453720 - DNA, 19 bp, Homo sapiens
tgacccacttctcatcaca

SEQ ID NO: 5453721 - DNA, 22 bp, Homo sapiens
tgacccacttctcatcacacac

SEQ ID NO: 5453722 - DNA, 22 bp, Homo sapiens
tgacccagagccaccaaagtca

SEQ ID NO: 5453723 - DNA, 11 bp, Homo sapiens
tgacccagagg

SEQ ID NO: 5453724 - DNA, 22 bp, Homo sapiens
tgacccagagtggagtctgagt

SEQ ID NO: 5453725 - DNA, 14 bp, Homo sapiens
tgacccagcctgaa

SEQ ID NO: 5453726 - DNA, 14 bp, Homo sapiens
tgacccagctactg

SEQ ID NO: 5453727 - DNA, 21 bp, Homo sapiens
tgacccagctcttctccccca

SEQ ID NO: 5453728 - DNA, 22 bp, Homo sapiens
tgacccaggccgcagctcttgc

SEQ ID NO: 5453729 - DNA, 17 bp, Homo sapiens
tgacccaggctgggcaa

SEQ ID NO: 5453730 - DNA, 14 bp, Homo sapiens
tgacccagtccctg

SEQ ID NO: 5453731 - DNA, 16 bp, Homo sapiens
tgacccagtgccccca

SEQ ID NO: 5453732 - DNA, 17 bp, Homo sapiens
tgacccagtgcccccac

SEQ ID NO: 5453733 - DNA, 17 bp, Homo sapiens
tgacccagtgtgtgctc

SEQ ID NO: 5453734 - DNA, 21 bp, Homo sapiens
tgacccagtgtgtgctcagca

SEQ ID NO: 5453735 - DNA, 14 bp, Homo sapiens
tgacccatcccttt

SEQ ID NO: 5453736 - DNA, 18 bp, Homo sapiens
tgacccatcccttttcct

SEQ ID NO: 5453737 - DNA, 14 bp, Homo sapiens
tgacccatctgtag

SEQ ID NO: 5453738 - DNA, 17 bp, Homo sapiens
tgacccatgctgccctg

SEQ ID NO: 5453739 - DNA, 19 bp, Homo sapiens
tgacccatgctgccctgtg

SEQ ID NO: 5453740 - DNA, 16 bp, Homo sapiens
tgacccatgttccctt

SEQ ID NO: 5453741 - DNA, 18 bp, Homo sapiens
tgacccatttcaggaggt

SEQ ID NO: 5453742 - DNA, 13 bp, Homo sapiens
tgaccccacacgc

SEQ ID NO: 5453743 - DNA, 18 bp, Homo sapiens
tgaccccactgccaagtg

SEQ ID NO: 5453744 - DNA, 14 bp, Homo sapiens
tgaccccagaaact

SEQ ID NO: 5453745 - DNA, 15 bp, Homo sapiens
tgaccccagcccaga

SEQ ID NO: 5453746 - DNA, 20 bp, Homo sapiens
tgaccccagcccagacagca

SEQ ID NO: 5453747 - DNA, 13 bp, Homo sapiens
tgaccccagctcc

SEQ ID NO: 5453748 - DNA, 14 bp, Homo sapiens
tgaccccaggaagt

SEQ ID NO: 5453749 - DNA, 11 bp, Homo sapiens
tgaccccaggg

SEQ ID NO: 5453750 - DNA, 13 bp, Homo sapiens
tgaccccagggca

SEQ ID NO: 5453751 - DNA, 17 bp, Homo sapiens
tgaccccagggcacagg

SEQ ID NO: 5453752 - DNA, 20 bp, Homo sapiens
tgaccccagggcacaggagc

SEQ ID NO: 5453753 - DNA, 13 bp, Homo sapiens
tgaccccagggcc

SEQ ID NO: 5453754 - DNA, 14 bp, Homo sapiens
tgaccccagggcct

SEQ ID NO: 5453755 - DNA, 12 bp, Homo sapiens
tgaccccatgct

SEQ ID NO: 5453756 - DNA, 22 bp, Homo sapiens
tgacccccactgccgcctcctt

SEQ ID NO: 5453757 - DNA, 17 bp, Homo sapiens
tgacccccatctgagct

SEQ ID NO: 5453758 - DNA, 19 bp, Homo sapiens
tgacccccccagcttcact

SEQ ID NO: 5453759 - DNA, 15 bp, Homo sapiens
tgacccccctcagga

SEQ ID NO: 5453760 - DNA, 21 bp, Homo sapiens
tgaccccctccccccaatccc

SEQ ID NO: 5453761 - DNA, 14 bp, Homo sapiens
tgacccccttcctg

SEQ ID NO: 5453762 - DNA, 17 bp, Homo sapiens
tgaccccgagaagtgct

SEQ ID NO: 5453763 - DNA, 19 bp, Homo sapiens
tgacccctcatagccctca

SEQ ID NO: 5453764 - DNA, 23 bp, Homo sapiens
tgacccctcatagccctcaccct

SEQ ID NO: 5453765 - DNA, 18 bp, Homo sapiens
tgacccctcatctgaaag

SEQ ID NO: 5453766 - DNA, 19 bp, Homo sapiens
tgacccctcatctgaaagg

SEQ ID NO: 5453767 - DNA, 11 bp, Homo sapiens
tgacccctcct

SEQ ID NO: 5453768 - DNA, 12 bp, Homo sapiens
tgacccctcctg

SEQ ID NO: 5453769 - DNA, 14 bp, Homo sapiens
tgacccctcctggg

SEQ ID NO: 5453770 - DNA, 16 bp, Homo sapiens
tgacccctcctggggc

SEQ ID NO: 5453771 - DNA, 19 bp, Homo sapiens
tgacccctcctggggccag

SEQ ID NO: 5453772 - DNA, 20 bp, Homo sapiens
tgacccctcctggggccagg

SEQ ID NO: 5453773 - DNA, 14 bp, Homo sapiens
tgacccctccttgt

SEQ ID NO: 5453774 - DNA, 16 bp, Homo sapiens
tgacccctctcctcaa

SEQ ID NO: 5453775 - DNA, 20 bp, Homo sapiens
tgacccctgcccagatcagc

SEQ ID NO: 5453776 - DNA, 13 bp, Homo sapiens
tgacccctgctca

SEQ ID NO: 5453777 - DNA, 17 bp, Homo sapiens
tgacccctgctgatgcc

SEQ ID NO: 5453778 - DNA, 17 bp, Homo sapiens
tgacccctgctttgccc

SEQ ID NO: 5453779 - DNA, 17 bp, Homo sapiens
tgaccccttcctgtctg

SEQ ID NO: 5453780 - DNA, 17 bp, Homo sapiens
tgaccccttctctctcc

SEQ ID NO: 5453781 - DNA, 12 bp, Homo sapiens
tgacccctttcc

SEQ ID NO: 5453782 - DNA, 19 bp, Homo sapiens
tgacccctttcccccaccc

SEQ ID NO: 5453783 - DNA, 21 bp, Homo sapiens
tgaccccttttcagcttctgc

SEQ ID NO: 5453784 - DNA, 22 bp, Homo sapiens
tgaccccttttcagcttctgct

SEQ ID NO: 5453785 - DNA, 23 bp, Homo sapiens
tgacccgctcggacttactgcct

SEQ ID NO: 5453786 - DNA, 17 bp, Homo sapiens
tgacccggaggccacat

SEQ ID NO: 5453787 - DNA, 20 bp, Homo sapiens
tgacccggcaccccctgcag

SEQ ID NO: 5453788 - DNA, 22 bp, Homo sapiens
tgacccggcccccgccctctgc

SEQ ID NO: 5453789 - DNA, 16 bp, Homo sapiens
tgacccggcccctacc

SEQ ID NO: 5453790 - DNA, 19 bp, Homo sapiens
tgacccggcccctaccagc

SEQ ID NO: 5453791 - DNA, 16 bp, Homo sapiens
tgacccggggcagctg

SEQ ID NO: 5453792 - DNA, 17 bp, Homo sapiens
tgacccggttgcagtca

SEQ ID NO: 5453793 - DNA, 17 bp, Homo sapiens
tgaccctatgaccaaaa

SEQ ID NO: 5453794 - DNA, 13 bp, Homo sapiens
tgaccctattttt

SEQ ID NO: 5453795 - DNA, 18 bp, Homo sapiens
tgaccctcaggcacacct

SEQ ID NO: 5453796 - DNA, 22 bp, Homo sapiens
tgaccctccaccgcagaaggaa

SEQ ID NO: 5453797 - DNA, 17 bp, Homo sapiens
tgaccctcccactccca

SEQ ID NO: 5453798 - DNA, 13 bp, Homo sapiens
tgaccctcccagt

SEQ ID NO: 5453799 - DNA, 13 bp, Homo sapiens
tgaccctcccggc

SEQ ID NO: 5453800 - DNA, 21 bp, Homo sapiens
tgaccctcccggcctggcttc

SEQ ID NO: 5453801 - DNA, 13 bp, Homo sapiens
tgaccctcccttc

SEQ ID NO: 5453802 - DNA, 16 bp, Homo sapiens
tgaccctcccttcctg

SEQ ID NO: 5453803 - DNA, 22 bp, Homo sapiens
tgaccctccttctattttccct

SEQ ID NO: 5453804 - DNA, 23 bp, Homo sapiens
tgaccctccttctattttcccta

SEQ ID NO: 5453805 - DNA, 12 bp, Homo sapiens
tgaccctctcac

SEQ ID NO: 5453806 - DNA, 21 bp, Homo sapiens
tgaccctctgctgaagacttg

SEQ ID NO: 5453807 - DNA, 16 bp, Homo sapiens
tgaccctctgtcccca

SEQ ID NO: 5453808 - DNA, 21 bp, Homo sapiens
tgaccctctgtccccaggcct

SEQ ID NO: 5453809 - DNA, 17 bp, Homo sapiens
tgaccctgaaatatttt

SEQ ID NO: 5453810 - DNA, 18 bp, Homo sapiens
tgaccctgagggctcctc

SEQ ID NO: 5453811 - DNA, 22 bp, Homo sapiens
tgaccctgagggctcctccatg

SEQ ID NO: 5453812 - DNA, 24 bp, Homo sapiens
tgaccctgagggctcctccatggt

SEQ ID NO: 5453813 - DNA, 22 bp, Homo sapiens
tgaccctgcctctcccaggcag

SEQ ID NO: 5453814 - DNA, 21 bp, Homo sapiens
tgaccctgcgaaggggccctg

SEQ ID NO: 5453815 - DNA, 22 bp, Homo sapiens
tgaccctgcgaaggggccctgg

SEQ ID NO: 5453816 - DNA, 17 bp, Homo sapiens
tgaccctgctcctagca

SEQ ID NO: 5453817 - DNA, 23 bp, Homo sapiens
tgaccctggagcggctctcctga

SEQ ID NO: 5453818 - DNA, 15 bp, Homo sapiens
tgaccctggagctag

SEQ ID NO: 5453819 - DNA, 16 bp, Homo sapiens
tgaccctggagctagg

SEQ ID NO: 5453820 - DNA, 13 bp, Homo sapiens
tgaccctggctcc

SEQ ID NO: 5453821 - DNA, 15 bp, Homo sapiens
tgaccctgggcaagt

SEQ ID NO: 5453822 - DNA, 15 bp, Homo sapiens
tgaccctgggcctgg

SEQ ID NO: 5453823 - DNA, 16 bp, Homo sapiens
tgaccctgggcctgga

SEQ ID NO: 5453824 - DNA, 18 bp, Homo sapiens
tgaccctgggcctggagg

SEQ ID NO: 5453825 - DNA, 12 bp, Homo sapiens
tgaccctgggct

SEQ ID NO: 5453826 - DNA, 18 bp, Homo sapiens
tgaccctggggctggctt

SEQ ID NO: 5453827 - DNA, 18 bp, Homo sapiens
tgaccctgtatatagccc

SEQ ID NO: 5453828 - DNA, 18 bp, Homo sapiens
tgaccctgtgatgcctga

SEQ ID NO: 5453829 - DNA, 12 bp, Homo sapiens
tgaccctgtgcc

SEQ ID NO: 5453830 - DNA, 13 bp, Homo sapiens
tgaccctgtgccc

SEQ ID NO: 5453831 - DNA, 15 bp, Homo sapiens
tgacccttcagggcc

SEQ ID NO: 5453832 - DNA, 19 bp, Homo sapiens
tgacccttcccaatcagca

SEQ ID NO: 5453833 - DNA, 20 bp, Homo sapiens
tgacccttctacatttgagg

SEQ ID NO: 5453834 - DNA, 18 bp, Homo sapiens
tgacccttctccaaaggc

SEQ ID NO: 5453835 - DNA, 14 bp, Homo sapiens
tgacccttgtcatc

SEQ ID NO: 5453836 - DNA, 12 bp, Homo sapiens
tgaccctttcct

SEQ ID NO: 5453837 - DNA, 13 bp, Homo sapiens
tgacccttttcat

SEQ ID NO: 5453838 - DNA, 14 bp, Homo sapiens
tgacccttttctga

SEQ ID NO: 5453839 - DNA, 14 bp, Homo sapiens
tgaccgaagggacg

SEQ ID NO: 5453840 - DNA, 18 bp, Homo sapiens
tgaccgacagctttccag

SEQ ID NO: 5453841 - DNA, 20 bp, Homo sapiens
tgaccgacagctttccagta

SEQ ID NO: 5453842 - DNA, 22 bp, Homo sapiens
tgaccgacgatccctcgaccag

SEQ ID NO: 5453843 - DNA, 20 bp, Homo sapiens
tgaccgactaccccagtccc

SEQ ID NO: 5453844 - DNA, 16 bp, Homo sapiens
tgaccgagccctggag

SEQ ID NO: 5453845 - DNA, 23 bp, Homo sapiens
tgaccgagccctggagagcccca

SEQ ID NO: 5453846 - DNA, 19 bp, Homo sapiens
tgaccgatggtgtttggga

SEQ ID NO: 5453847 - DNA, 18 bp, Homo sapiens
tgaccgcccagctctccc

SEQ ID NO: 5453848 - DNA, 19 bp, Homo sapiens
tgaccgccgcttccagctt

SEQ ID NO: 5453849 - DNA, 19 bp, Homo sapiens
tgaccgcctcctgctctgc

SEQ ID NO: 5453850 - DNA, 16 bp, Homo sapiens
tgaccgctctcccttt

SEQ ID NO: 5453851 - DNA, 15 bp, Homo sapiens
tgaccgctgcccagg

SEQ ID NO: 5453852 - DNA, 17 bp, Homo sapiens
tgaccgcttccccgatg

SEQ ID NO: 5453853 - DNA, 19 bp, Homo sapiens
tgaccggacttttctgcaa

SEQ ID NO: 5453854 - DNA, 14 bp, Homo sapiens
tgaccggaggcaaa

SEQ ID NO: 5453855 - DNA, 19 bp, Homo sapiens
tgaccggcccgccaccttg

SEQ ID NO: 5453856 - DNA, 21 bp, Homo sapiens
tgaccggcccgccaccttgta

SEQ ID NO: 5453857 - DNA, 20 bp, Homo sapiens
tgaccggcctggaccttggc

SEQ ID NO: 5453858 - DNA, 19 bp, Homo sapiens
tgaccgggacttcaaagcc

SEQ ID NO: 5453859 - DNA, 16 bp, Homo sapiens
tgaccgggagacagag

SEQ ID NO: 5453860 - DNA, 15 bp, Homo sapiens
tgaccgtactctcac

SEQ ID NO: 5453861 - DNA, 20 bp, Homo sapiens
tgaccgtactctcacatgtg

SEQ ID NO: 5453862 - DNA, 14 bp, Homo sapiens
tgaccgtatgatga

SEQ ID NO: 5453863 - DNA, 14 bp, Homo sapiens
tgaccgtgaggcca

SEQ ID NO: 5453864 - DNA, 13 bp, Homo sapiens
tgaccgtgtacaa

SEQ ID NO: 5453865 - DNA, 14 bp, Homo sapiens
tgaccgttaaaaaa

SEQ ID NO: 5453866 - DNA, 16 bp, Homo sapiens
tgaccgttttcacttg

SEQ ID NO: 5453867 - DNA, 18 bp, Homo sapiens
tgacctaaatccattttc

SEQ ID NO: 5453868 - DNA, 13 bp, Homo sapiens
tgacctaaattag

SEQ ID NO: 5453869 - DNA, 15 bp, Homo sapiens
tgacctaacctagga

SEQ ID NO: 5453870 - DNA, 15 bp, Homo sapiens
tgacctaccccagcc

SEQ ID NO: 5453871 - DNA, 17 bp, Homo sapiens
tgacctaccccagccag

SEQ ID NO: 5453872 - DNA, 21 bp, Homo sapiens
tgacctaccccagccaggctc

SEQ ID NO: 5453873 - DNA, 22 bp, Homo sapiens
tgacctaccccagccaggctcc

SEQ ID NO: 5453874 - DNA, 21 bp, Homo sapiens
tgacctacctcaaagggcagt

SEQ ID NO: 5453875 - DNA, 17 bp, Homo sapiens
tgacctactcgagggac

SEQ ID NO: 5453876 - DNA, 23 bp, Homo sapiens
tgacctagctctttgggcctctc

SEQ ID NO: 5453877 - DNA, 15 bp, Homo sapiens
tgacctcaacaaaga

SEQ ID NO: 5453878 - DNA, 20 bp, Homo sapiens
tgacctcaagtgatccaccc

SEQ ID NO: 5453879 - DNA, 23 bp, Homo sapiens
tgacctcaatttcaattttgtct

SEQ ID NO: 5453880 - DNA, 14 bp, Homo sapiens
tgacctcacacacc

SEQ ID NO: 5453881 - DNA, 19 bp, Homo sapiens
tgacctcacacacctctgc

SEQ ID NO: 5453882 - DNA, 18 bp, Homo sapiens
tgacctcacagtgaccct

SEQ ID NO: 5453883 - DNA, 18 bp, Homo sapiens
tgacctcacctaggaagt

SEQ ID NO: 5453884 - DNA, 16 bp, Homo sapiens
tgacctcactcagaag

SEQ ID NO: 5453885 - DNA, 21 bp, Homo sapiens
tgactgggggcctctgcctcc

SEQ ID NO: 5453886 - DNA, 20 bp, Homo sapiens
tgactggggtgggaggtctt

SEQ ID NO: 5453887 - DNA, 17 bp, Homo sapiens
tgactgggtcagccttc

SEQ ID NO: 5453888 - DNA, 17 bp, Homo sapiens
tgactgggtgagaccca

SEQ ID NO: 5453889 - DNA, 19 bp, Homo sapiens
tgactggtgcgttcctaaa

SEQ ID NO: 5453890 - DNA, 14 bp, Homo sapiens
tgactggttgtcag

SEQ ID NO: 5453891 - DNA, 15 bp, Homo sapiens
tgactggttgtcaga

SEQ ID NO: 5453892 - DNA, 21 bp, Homo sapiens
tgactggttgtcagaatggaa

SEQ ID NO: 5453893 - DNA, 14 bp, Homo sapiens
tgactggttgttca

SEQ ID NO: 5453894 - DNA, 16 bp, Homo sapiens
tgactggttgttcaaa

SEQ ID NO: 5453895 - DNA, 17 bp, Homo sapiens
tgactggtttctcctgg

SEQ ID NO: 5453896 - DNA, 20 bp, Homo sapiens
tgactggtttctcctggtag

SEQ ID NO: 5453897 - DNA, 16 bp, Homo sapiens
tgactgtacagagact

SEQ ID NO: 5453898 - DNA, 21 bp, Homo sapiens
tgactgtacttgatttttcaa

SEQ ID NO: 5453899 - DNA, 16 bp, Homo sapiens
tgactgtagccacagc

SEQ ID NO: 5453900 - DNA, 18 bp, Homo sapiens
tgactgtaggcgcccctg

SEQ ID NO: 5453901 - DNA, 22 bp, Homo sapiens
tgactgtaggcgcccctggggt

SEQ ID NO: 5453902 - DNA, 16 bp, Homo sapiens
tgactgtagtttttgt

SEQ ID NO: 5453903 - DNA, 23 bp, Homo sapiens
tgactgtagtttttgttcacctt

SEQ ID NO: 5453904 - DNA, 15 bp, Homo sapiens
tgactgtatctgtgt

SEQ ID NO: 5453905 - DNA, 17 bp, Homo sapiens
tgactgtatctgtgtag

SEQ ID NO: 5453906 - DNA, 12 bp, Homo sapiens
tgactgtatggc

SEQ ID NO: 5453907 - DNA, 21 bp, Homo sapiens
tgactgtcacggaacagatct

SEQ ID NO: 5453908 - DNA, 16 bp, Homo sapiens
tgactgtcactgttcc

SEQ ID NO: 5453909 - DNA, 14 bp, Homo sapiens
tgactgtcagcaag

SEQ ID NO: 5453910 - DNA, 18 bp, Homo sapiens
tgactgtcagggagggcc

SEQ ID NO: 5453911 - DNA, 22 bp, Homo sapiens
tgactgtcccaccgggagcctc

SEQ ID NO: 5453912 - DNA, 17 bp, Homo sapiens
tgactgtcccattctcc

SEQ ID NO: 5453913 - DNA, 17 bp, Homo sapiens
tgactgtcgtgtttaca

SEQ ID NO: 5453914 - DNA, 20 bp, Homo sapiens
tgactgtctagccactccct

SEQ ID NO: 5453915 - DNA, 21 bp, Homo sapiens
tgactgtctagccactccctc

SEQ ID NO: 5453916 - DNA, 14 bp, Homo sapiens
tgactgtctgggga

SEQ ID NO: 5453917 - DNA, 15 bp, Homo sapiens
tgactgtctttccta

SEQ ID NO: 5453918 - DNA, 14 bp, Homo sapiens
tgactgtgaactgg

SEQ ID NO: 5453919 - DNA, 16 bp, Homo sapiens
tgactgtgaccacctt

SEQ ID NO: 5453920 - DNA, 17 bp, Homo sapiens
tgactgtgattagatca

SEQ ID NO: 5453921 - DNA, 13 bp, Homo sapiens
tgactgtgattta

SEQ ID NO: 5453922 - DNA, 12 bp, Homo sapiens
tgactgtgctgt

SEQ ID NO: 5453923 - DNA, 23 bp, Homo sapiens
tgactgtggagttccattcttgg

SEQ ID NO: 5453924 - DNA, 11 bp, Homo sapiens
tgactgtgtca

SEQ ID NO: 5453925 - DNA, 22 bp, Homo sapiens
tgactgtgttcagtgccttgga

SEQ ID NO: 5453926 - DNA, 21 bp, Homo sapiens
tgactgtgtttgcattgtcta

SEQ ID NO: 5453927 - DNA, 18 bp, Homo sapiens
tgactgttatctcggact

SEQ ID NO: 5453928 - DNA, 16 bp, Homo sapiens
tgactgttctcttact

SEQ ID NO: 5453929 - DNA, 14 bp, Homo sapiens
tgactgttgatgaa

SEQ ID NO: 5453930 - DNA, 17 bp, Homo sapiens
tgactgttgatgaagta

SEQ ID NO: 5453931 - DNA, 15 bp, Homo sapiens
tgactgttgcccccc

SEQ ID NO: 5453932 - DNA, 14 bp, Homo sapiens
tgactgttggctct

SEQ ID NO: 5453933 - DNA, 12 bp, Homo sapiens
tgactgttgtac

SEQ ID NO: 5453934 - DNA, 15 bp, Homo sapiens
tgactgttgttctta

SEQ ID NO: 5453935 - DNA, 14 bp, Homo sapiens
tgactgtttattta

SEQ ID NO: 5453936 - DNA, 15 bp, Homo sapiens
tgactgtttatttaa

SEQ ID NO: 5453937 - DNA, 18 bp, Homo sapiens
tgactgtttatttaagga

SEQ ID NO: 5453938 - DNA, 22 bp, Homo sapiens
tgactgtttatttaaggatgga

SEQ ID NO: 5453939 - DNA, 23 bp, Homo sapiens
tgactgtttatttaaggatggat

SEQ ID NO: 5453940 - DNA, 16 bp, Homo sapiens
tgactgtttggcttat

SEQ ID NO: 5453941 - DNA, 11 bp, Homo sapiens
tgactgttttt

SEQ ID NO: 5453942 - DNA, 19 bp, Homo sapiens
tgacttaagcaaaagaaaa

SEQ ID NO: 5453943 - DNA, 14 bp, Homo sapiens
tgacttaaggagaa

SEQ ID NO: 5453944 - DNA, 14 bp, Homo sapiens
tgacttaaggtgaa

SEQ ID NO: 5453945 - DNA, 12 bp, Homo sapiens
tgacttacaatt

SEQ ID NO: 5453946 - DNA, 18 bp, Homo sapiens
tgacttacctgttcagta

SEQ ID NO: 5453947 - DNA, 15 bp, Homo sapiens
tgacttactgtacat

SEQ ID NO: 5453948 - DNA, 16 bp, Homo sapiens
tgacttactgtacatg

SEQ ID NO: 5453949 - DNA, 19 bp, Homo sapiens
tgacttactgtacatgaaa

SEQ ID NO: 5453950 - DNA, 14 bp, Homo sapiens
tgacttactgtttc

SEQ ID NO: 5453951 - DNA, 23 bp, Homo sapiens
tgacttactttaattactggaat

SEQ ID NO: 5453952 - DNA, 13 bp, Homo sapiens
tgacttagatatt

SEQ ID NO: 5453953 - DNA, 17 bp, Homo sapiens
tgacttagatattaaaa

SEQ ID NO: 5453954 - DNA, 18 bp, Homo sapiens
tgacttagatattaaaat

SEQ ID NO: 5453955 - DNA, 16 bp, Homo sapiens
tgacttagcagatgct

SEQ ID NO: 5453956 - DNA, 14 bp, Homo sapiens
tgacttagcctaaa

SEQ ID NO: 5453957 - DNA, 16 bp, Homo sapiens
tgacttaggaggctga

SEQ ID NO: 5453958 - DNA, 16 bp, Homo sapiens
tgacttaggtttttag

SEQ ID NO: 5453959 - DNA, 14 bp, Homo sapiens
tgacttagtacaaa

SEQ ID NO: 5453960 - DNA, 19 bp, Homo sapiens
tgacttagtacaaagtttc

SEQ ID NO: 5453961 - DNA, 23 bp, Homo sapiens
tgacttagttcttagaagctcac

SEQ ID NO: 5453962 - DNA, 17 bp, Homo sapiens
tgacttatagtacatga

SEQ ID NO: 5453963 - DNA, 17 bp, Homo sapiens
tgacttatcccattttc

SEQ ID NO: 5453964 - DNA, 16 bp, Homo sapiens
tgacttatctaccatt

SEQ ID NO: 5453965 - DNA, 14 bp, Homo sapiens
tgacttatgggccc

SEQ ID NO: 5453966 - DNA, 15 bp, Homo sapiens
tgacttattgattaa

SEQ ID NO: 5453967 - DNA, 19 bp, Homo sapiens
tgacttatttagtattctg

SEQ ID NO: 5453968 - DNA, 23 bp, Homo sapiens
tgacttatttagtattctgcctc

SEQ ID NO: 5453969 - DNA, 17 bp, Homo sapiens
tgacttatttatataaa

SEQ ID NO: 5453970 - DNA, 21 bp, Homo sapiens
tgacttatttatataaatttt

SEQ ID NO: 5453971 - DNA, 12 bp, Homo sapiens
tgacttatttct

SEQ ID NO: 5453972 - DNA, 16 bp, Homo sapiens
tgacttatttgctcat

SEQ ID NO: 5453973 - DNA, 18 bp, Homo sapiens
tgacttattttctctgtg

SEQ ID NO: 5453974 - DNA, 18 bp, Homo sapiens
tgacttattttgtcttat

SEQ ID NO: 5453975 - DNA, 21 bp, Homo sapiens
tgacttattttgtcttattct

SEQ ID NO: 5453976 - DNA, 17 bp, Homo sapiens
tgacttcactgtatata

SEQ ID NO: 5453977 - DNA, 13 bp, Homo sapiens
tgacttcaggggc

SEQ ID NO: 5453978 - DNA, 12 bp, Homo sapiens
tgacttcaggtg

SEQ ID NO: 5453979 - DNA, 18 bp, Homo sapiens
tgacttcaggtgatccac

SEQ ID NO: 5453980 - DNA, 21 bp, Homo sapiens
tgacttcagtgaatatttttg

SEQ ID NO: 5453981 - DNA, 15 bp, Homo sapiens
tgacttcatgctata

SEQ ID NO: 5453982 - DNA, 13 bp, Homo sapiens
tgacttcatggaa

SEQ ID NO: 5453983 - DNA, 13 bp, Homo sapiens
tgacttcatttgt

SEQ ID NO: 5453984 - DNA, 17 bp, Homo sapiens
tgacttcatttgtgcca

SEQ ID NO: 5453985 - DNA, 22 bp, Homo sapiens
tgacttcccagctggcagcgcc

SEQ ID NO: 5453986 - DNA, 23 bp, Homo sapiens
tgacttccccgcattccaggctc

SEQ ID NO: 5453987 - DNA, 16 bp, Homo sapiens
tgacttccctccaccc

SEQ ID NO: 5453988 - DNA, 20 bp, Homo sapiens
tgacttccctggaggagaag

SEQ ID NO: 5453989 - DNA, 21 bp, Homo sapiens
tgacttccctggaggagaagt

SEQ ID NO: 5453990 - DNA, 15 bp, Homo sapiens
tgacttccctggtca

SEQ ID NO: 5453991 - DNA, 20 bp, Homo sapiens
tgacttcctagggatctgaa

SEQ ID NO: 5453992 - DNA, 17 bp, Homo sapiens
tgacttcctccaatccc

SEQ ID NO: 5453993 - DNA, 21 bp, Homo sapiens
tgacttcctcgcctctcccac

SEQ ID NO: 5453994 - DNA, 12 bp, Homo sapiens
tgacttcctctg

SEQ ID NO: 5453995 - DNA, 17 bp, Homo sapiens
tgacttcctctggtgtt

SEQ ID NO: 5453996 - DNA, 17 bp, Homo sapiens
tgacttccttatttctg

SEQ ID NO: 5453997 - DNA, 19 bp, Homo sapiens
tgacttccttatttctgaa

SEQ ID NO: 5453998 - DNA, 18 bp, Homo sapiens
tgacttcgcagccccggg

SEQ ID NO: 5453999 - DNA, 22 bp, Homo sapiens
tgacttcgcagccccgggcgga

SEQ ID NO: 5454000 - DNA, 15 bp, Homo sapiens
tgacttctaagtaaa

SEQ ID NO: 5454001 - DNA, 19 bp, Homo sapiens
tgacttctaatttatatta

SEQ ID NO: 5454002 - DNA, 18 bp, Homo sapiens
tgacttctagcagagacc

SEQ ID NO: 5454003 - DNA, 20 bp, Homo sapiens
tgacttctatcctgttaaca

SEQ ID NO: 5454004 - DNA, 15 bp, Homo sapiens
tgacttctcaagtaa

SEQ ID NO: 5454005 - DNA, 11 bp, Homo sapiens
tgacttctcca

SEQ ID NO: 5454006 - DNA, 23 bp, Homo sapiens
tgacttctcccccgccctgcccc

SEQ ID NO: 5454007 - DNA, 14 bp, Homo sapiens
tgacttctcccggg

SEQ ID NO: 5454008 - DNA, 14 bp, Homo sapiens
tgacttctcttgaa

SEQ ID NO: 5454009 - DNA, 13 bp, Homo sapiens
tgacttctgagat

SEQ ID NO: 5454010 - DNA, 20 bp, Homo sapiens
tgacttctgccccagcttta

SEQ ID NO: 5454011 - DNA, 16 bp, Homo sapiens
tgacttctgcctggag

SEQ ID NO: 5454012 - DNA, 18 bp, Homo sapiens
tgacttctgcctggagac

SEQ ID NO: 5454013 - DNA, 13 bp, Homo sapiens
tgacttctgctgc

SEQ ID NO: 5454014 - DNA, 13 bp, Homo sapiens
tgacttctgtgag

SEQ ID NO: 5454015 - DNA, 21 bp, Homo sapiens
tgacttcttggtttggggaga

SEQ ID NO: 5454016 - DNA, 23 bp, Homo sapiens
tgacttcttggtttggggagaaa

SEQ ID NO: 5454017 - DNA, 11 bp, Homo sapiens
tgacttcttgt

SEQ ID NO: 5454018 - DNA, 17 bp, Homo sapiens
tgacttctttttggcat

SEQ ID NO: 5454019 - DNA, 22 bp, Homo sapiens
tgacttgaaaagaaagaaacca

SEQ ID NO: 5454020 - DNA, 20 bp, Homo sapiens
tgacttgaaccacaagtgaa

SEQ ID NO: 5454021 - DNA, 12 bp, Homo sapiens
tgacttgaatgt

SEQ ID NO: 5454022 - DNA, 16 bp, Homo sapiens
tgacttgactttagtc

SEQ ID NO: 5454023 - DNA, 15 bp, Homo sapiens
tgacttgagatgaaa

SEQ ID NO: 5454024 - DNA, 13 bp, Homo sapiens
tgacttgagccac

SEQ ID NO: 5454025 - DNA, 14 bp, Homo sapiens
tgacttgagccact

SEQ ID NO: 5454026 - DNA, 21 bp, Homo sapiens
tgacttgaggcacaaatcact

SEQ ID NO: 5454027 - DNA, 14 bp, Homo sapiens
tgacttgataatga

SEQ ID NO: 5454028 - DNA, 24 bp, Homo sapiens
tgacttgcaaagacctacctccag

SEQ ID NO: 5454029 - DNA, 18 bp, Homo sapiens
tgacttgcaatccaggct

SEQ ID NO: 5454030 - DNA, 21 bp, Homo sapiens
tgacttgcagagttcatggaa

SEQ ID NO: 5454031 - DNA, 15 bp, Homo sapiens
tgacttgcagatgaa

SEQ ID NO: 5454032 - DNA, 23 bp, Homo sapiens
tgacttgcatgaagagaagcaat

SEQ ID NO: 5454033 - DNA, 16 bp, Homo sapiens
tgacttgcctggggcc

SEQ ID NO: 5454034 - DNA, 14 bp, Homo sapiens
tgacttgctgtcca

SEQ ID NO: 5454035 - DNA, 15 bp, Homo sapiens
tgacttgctgtccag

SEQ ID NO: 5454036 - DNA, 21 bp, Homo sapiens
tgacttgctgtccaggcagct

SEQ ID NO: 5454037 - DNA, 15 bp, Homo sapiens
tgacttgctttagtt

SEQ ID NO: 5454038 - DNA, 18 bp, Homo sapiens
tgacttggagagagattc

SEQ ID NO: 5454039 - DNA, 19 bp, Homo sapiens
tgacttggcacttaagtgc

SEQ ID NO: 5454040 - DNA, 14 bp, Homo sapiens
tgacttggccccag

SEQ ID NO: 5454041 - DNA, 12 bp, Homo sapiens
tgacttggctgg

SEQ ID NO: 5454042 - DNA, 23 bp, Homo sapiens
tgacttgggcacccccagcctgg

SEQ ID NO: 5454043 - DNA, 23 bp, Homo sapiens
tgacttgggctccgctgtgcccg

SEQ ID NO: 5454044 - DNA, 18 bp, Homo sapiens
tgacttggggagatggag

SEQ ID NO: 5454045 - DNA, 21 bp, Homo sapiens
tgacttggtagagttcctttc

SEQ ID NO: 5454046 - DNA, 21 bp, Homo sapiens
tgacttggtggcttttccttg

SEQ ID NO: 5454047 - DNA, 19 bp, Homo sapiens
tgacttggttctgaagcca

SEQ ID NO: 5454048 - DNA, 22 bp, Homo sapiens
tgacttggttctgaagccatgt

SEQ ID NO: 5454049 - DNA, 19 bp, Homo sapiens
tgacttgtacaaacagtat

SEQ ID NO: 5454050 - DNA, 19 bp, Homo sapiens
tgacttgtatattttaaga

SEQ ID NO: 5454051 - DNA, 18 bp, Homo sapiens
tgacttgtctgcctcctg

SEQ ID NO: 5454052 - DNA, 22 bp, Homo sapiens
tgacttgtctgcctcctgcttt

SEQ ID NO: 5454053 - DNA, 13 bp, Homo sapiens
tgacttgttctga

SEQ ID NO: 5454054 - DNA, 14 bp, Homo sapiens
tgacttgtttgttt

SEQ ID NO: 5454055 - DNA, 19 bp, Homo sapiens
tgactttaaactttccctt

SEQ ID NO: 5454056 - DNA, 14 bp, Homo sapiens
tgactttaaagatg

SEQ ID NO: 5454057 - DNA, 20 bp, Homo sapiens
tgactttaagtaatcaggat

SEQ ID NO: 5454058 - DNA, 13 bp, Homo sapiens
tgactttaattgt

SEQ ID NO: 5454059 - DNA, 18 bp, Homo sapiens
tgactttacgcccatctc

SEQ ID NO: 5454060 - DNA, 15 bp, Homo sapiens
tgactttatgttgta

SEQ ID NO: 5454061 - DNA, 19 bp, Homo sapiens
tgactttatgttgtatgat

SEQ ID NO: 5454062 - DNA, 21 bp, Homo sapiens
tgactttattgcttaatttct

SEQ ID NO: 5454063 - DNA, 23 bp, Homo sapiens
tgactttatttattgcttagtga

SEQ ID NO: 5454064 - DNA, 15 bp, Homo sapiens
tgagagttccttctc

SEQ ID NO: 5454065 - DNA, 18 bp, Homo sapiens
tgagagttcgtgaagagg

SEQ ID NO: 5454066 - DNA, 12 bp, Homo sapiens
tgagagttgtct

SEQ ID NO: 5454067 - DNA, 16 bp, Homo sapiens
tgagagtttagttgta

SEQ ID NO: 5454068 - DNA, 14 bp, Homo sapiens
tgagagtttcctca

SEQ ID NO: 5454069 - DNA, 15 bp, Homo sapiens
tgagagtttcctcag

SEQ ID NO: 5454070 - DNA, 17 bp, Homo sapiens
tgagagttttggatgca

SEQ ID NO: 5454071 - DNA, 22 bp, Homo sapiens
tgagagttttggatgcagtgct

SEQ ID NO: 5454072 - DNA, 21 bp, Homo sapiens
tgagataaagtcaaatgccaa

SEQ ID NO: 5454073 - DNA, 20 bp, Homo sapiens
tgagataaatgcacatttca

SEQ ID NO: 5454074 - DNA, 13 bp, Homo sapiens
tgagataagaaaa

SEQ ID NO: 5454075 - DNA, 14 bp, Homo sapiens
tgagataagaaaag

SEQ ID NO: 5454076 - DNA, 15 bp, Homo sapiens
tgagataaggtttta

SEQ ID NO: 5454077 - DNA, 17 bp, Homo sapiens
tgagataatacattccg

SEQ ID NO: 5454078 - DNA, 17 bp, Homo sapiens
tgagataatatctgtga

SEQ ID NO: 5454079 - DNA, 14 bp, Homo sapiens
tgagataatatgag

SEQ ID NO: 5454080 - DNA, 17 bp, Homo sapiens
tgagataatgatactta

SEQ ID NO: 5454081 - DNA, 16 bp, Homo sapiens
tgagataatgttagag

SEQ ID NO: 5454082 - DNA, 21 bp, Homo sapiens
tgagatacatacagaattact

SEQ ID NO: 5454083 - DNA, 17 bp, Homo sapiens
tgagatacatttgatct

SEQ ID NO: 5454084 - DNA, 17 bp, Homo sapiens
tgagatacccagagaga

SEQ ID NO: 5454085 - DNA, 22 bp, Homo sapiens
tgagatactttgcattgtctgt

SEQ ID NO: 5454086 - DNA, 16 bp, Homo sapiens
tgagatagaagaactg

SEQ ID NO: 5454087 - DNA, 19 bp, Homo sapiens
tgagatagaagatgtttgc

SEQ ID NO: 5454088 - DNA, 14 bp, Homo sapiens
tgagatagttttca

SEQ ID NO: 5454089 - DNA, 15 bp, Homo sapiens
tgagatagttttcat

SEQ ID NO: 5454090 - DNA, 16 bp, Homo sapiens
tgagatagttttcatc

SEQ ID NO: 5454091 - DNA, 19 bp, Homo sapiens
tgagatagttttcatttta

SEQ ID NO: 5454092 - DNA, 14 bp, Homo sapiens
tgagatatacaaat

SEQ ID NO: 5454093 - DNA, 19 bp, Homo sapiens
tgagatataggataaaata

SEQ ID NO: 5454094 - DNA, 19 bp, Homo sapiens
tgagatatatctttatact

SEQ ID NO: 5454095 - DNA, 21 bp, Homo sapiens
tgagatatatctttatactta

SEQ ID NO: 5454096 - DNA, 23 bp, Homo sapiens
tgagatatgcaataaatattatt

SEQ ID NO: 5454097 - DNA, 14 bp, Homo sapiens
tgagatattaaaga

SEQ ID NO: 5454098 - DNA, 15 bp, Homo sapiens
tgagatattaaattc

SEQ ID NO: 5454099 - DNA, 18 bp, Homo sapiens
tgagatattaaattctca

SEQ ID NO: 5454100 - DNA, 13 bp, Homo sapiens
tgagatattaatg

SEQ ID NO: 5454101 - DNA, 19 bp, Homo sapiens
tgagatattaatgcccaga

SEQ ID NO: 5454102 - DNA, 17 bp, Homo sapiens
tgagatcactgaacttt

SEQ ID NO: 5454103 - DNA, 21 bp, Homo sapiens
tgagatcactgaacttttcaa

SEQ ID NO: 5454104 - DNA, 22 bp, Homo sapiens
tgagatcactgaacttttcaaa

SEQ ID NO: 5454105 - DNA, 19 bp, Homo sapiens
tgagatcagcattcaaaat

SEQ ID NO: 5454106 - DNA, 20 bp, Homo sapiens
tgagatcagcattcaaaata

SEQ ID NO: 5454107 - DNA, 21 bp, Homo sapiens
tgagatcagcattcaaaatag

SEQ ID NO: 5454108 - DNA, 14 bp, Homo sapiens
tgagatcagcctgg

SEQ ID NO: 5454109 - DNA, 19 bp, Homo sapiens
tgagatcagggcctgcccc

SEQ ID NO: 5454110 - DNA, 20 bp, Homo sapiens
tgagatcagggcctgccccc

SEQ ID NO: 5454111 - DNA, 11 bp, Homo sapiens
tgagatccagt

SEQ ID NO: 5454112 - DNA, 23 bp, Homo sapiens
tgagatcccgtctccgaagaaaa

SEQ ID NO: 5454113 - DNA, 16 bp, Homo sapiens
tgagatcctctttact

SEQ ID NO: 5454114 - DNA, 19 bp, Homo sapiens
tgagatcctctttactctg

SEQ ID NO: 5454115 - DNA, 23 bp, Homo sapiens
tgagatcctctttactctgggca

SEQ ID NO: 5454116 - DNA, 18 bp, Homo sapiens
tgagatcgtccactgtca

SEQ ID NO: 5454117 - DNA, 18 bp, Homo sapiens
tgagatcgtgccactgca

SEQ ID NO: 5454118 - DNA, 12 bp, Homo sapiens
tgagatctaaaa

SEQ ID NO: 5454119 - DNA, 23 bp, Homo sapiens
tgagatctaaaaataactgtaat

SEQ ID NO: 5454120 - DNA, 20 bp, Homo sapiens
tgagatctaagcctttccat

SEQ ID NO: 5454121 - DNA, 16 bp, Homo sapiens
tgagatctaatgtgaa

SEQ ID NO: 5454122 - DNA, 14 bp, Homo sapiens
tgagatctgcacag

SEQ ID NO: 5454123 - DNA, 19 bp, Homo sapiens
tgagatctgcacagtcaga

SEQ ID NO: 5454124 - DNA, 14 bp, Homo sapiens
tgagatcttcctgc

SEQ ID NO: 5454125 - DNA, 15 bp, Homo sapiens
tgagatgaaaactag

SEQ ID NO: 5454126 - DNA, 13 bp, Homo sapiens
tgagatgagcccc

SEQ ID NO: 5454127 - DNA, 17 bp, Homo sapiens
tgagatgatttaattct

SEQ ID NO: 5454128 - DNA, 21 bp, Homo sapiens
tgagatgatttccaagcctct

SEQ ID NO: 5454129 - DNA, 16 bp, Homo sapiens
tgagatgatttggtca

SEQ ID NO: 5454130 - DNA, 12 bp, Homo sapiens
tgagatgcacca

SEQ ID NO: 5454131 - DNA, 13 bp, Homo sapiens
tgagatgcaccaa

SEQ ID NO: 5454132 - DNA, 21 bp, Homo sapiens
tgagatgcaccaagtacagcc

SEQ ID NO: 5454133 - DNA, 18 bp, Homo sapiens
tgagatgcagctggaaaa

SEQ ID NO: 5454134 - DNA, 23 bp, Homo sapiens
tgagatgccccgagcccaggcag

SEQ ID NO: 5454135 - DNA, 19 bp, Homo sapiens
tgagatgctggagaagaga

SEQ ID NO: 5454136 - DNA, 21 bp, Homo sapiens
tgagatgctggtaatggccat

SEQ ID NO: 5454137 - DNA, 13 bp, Homo sapiens
tgagatgctggtt

SEQ ID NO: 5454138 - DNA, 12 bp, Homo sapiens
tgagatgctgta

SEQ ID NO: 5454139 - DNA, 13 bp, Homo sapiens
tgagatggacaca

SEQ ID NO: 5454140 - DNA, 16 bp, Homo sapiens
tgagatggagaggctg

SEQ ID NO: 5454141 - DNA, 18 bp, Homo sapiens
tgagatggagtcttgctc

SEQ ID NO: 5454142 - DNA, 20 bp, Homo sapiens
tgagatggagtttctctctt

SEQ ID NO: 5454143 - DNA, 17 bp, Homo sapiens
tgagatggatgtatttg

SEQ ID NO: 5454144 - DNA, 12 bp, Homo sapiens
tgagatggccct

SEQ ID NO: 5454145 - DNA, 16 bp, Homo sapiens
tgagatggccctctgg

SEQ ID NO: 5454146 - DNA, 14 bp, Homo sapiens
tgagatgggaaagc

SEQ ID NO: 5454147 - DNA, 14 bp, Homo sapiens
tgagatgggaaggg

SEQ ID NO: 5454148 - DNA, 17 bp, Homo sapiens
tgagatgggaagggctt

SEQ ID NO: 5454149 - DNA, 21 bp, Homo sapiens
tgagatggggtctcgctctgt

SEQ ID NO: 5454150 - DNA, 17 bp, Homo sapiens
tgagatgggtgtacaaa

SEQ ID NO: 5454151 - DNA, 13 bp, Homo sapiens
tgagatggtaaca

SEQ ID NO: 5454152 - DNA, 21 bp, Homo sapiens
tgagatggtaacagatttgct

SEQ ID NO: 5454153 - DNA, 17 bp, Homo sapiens
tgagatggtatgaaata

SEQ ID NO: 5454154 - DNA, 16 bp, Homo sapiens
tgagatggtgaggctg

SEQ ID NO: 5454155 - DNA, 20 bp, Homo sapiens
tgagatggtgccccctgggg

SEQ ID NO: 5454156 - DNA, 19 bp, Homo sapiens
tgagatggttaaaaaggcc

SEQ ID NO: 5454157 - DNA, 22 bp, Homo sapiens
tgagatggttaaaaaggccaaa

SEQ ID NO: 5454158 - DNA, 13 bp, Homo sapiens
tgagatgtaaaaa

SEQ ID NO: 5454159 - DNA, 23 bp, Homo sapiens
tgagatgtaagtctcaactctgt

SEQ ID NO: 5454160 - DNA, 21 bp, Homo sapiens
tgagatgtagcaaattccaat

SEQ ID NO: 5454161 - DNA, 12 bp, Homo sapiens
tgagatgtatga

SEQ ID NO: 5454162 - DNA, 23 bp, Homo sapiens
tgagatgtcttcaatggaataca

SEQ ID NO: 5454163 - DNA, 13 bp, Homo sapiens
tgagatgtgaaca

SEQ ID NO: 5454164 - DNA, 12 bp, Homo sapiens
tgagatgtgagc

SEQ ID NO: 5454165 - DNA, 12 bp, Homo sapiens
tgagatgtggac

SEQ ID NO: 5454166 - DNA, 20 bp, Homo sapiens
tgagatgtgtatcagtgttt

SEQ ID NO: 5454167 - DNA, 18 bp, Homo sapiens
tgagatgtgttcctcctg

SEQ ID NO: 5454168 - DNA, 20 bp, Homo sapiens
tgagatgtgttcctcctgct

SEQ ID NO: 5454169 - DNA, 19 bp, Homo sapiens
tgagatgtttagtagctga

SEQ ID NO: 5454170 - DNA, 12 bp, Homo sapiens
tgagatgtttgg

SEQ ID NO: 5454171 - DNA, 21 bp, Homo sapiens
tgagatgtttggcaagaaatc

SEQ ID NO: 5454172 - DNA, 15 bp, Homo sapiens
tgagattacagagga

SEQ ID NO: 5454173 - DNA, 17 bp, Homo sapiens
tgagattacgctgcctt

SEQ ID NO: 5454174 - DNA, 15 bp, Homo sapiens
tgagattattttaat

SEQ ID NO: 5454175 - DNA, 17 bp, Homo sapiens
tgagattcaagacaaga

SEQ ID NO: 5454176 - DNA, 21 bp, Homo sapiens
tgagattcaagacaagagctg

SEQ ID NO: 5454177 - DNA, 16 bp, Homo sapiens
tgagattcacatgctg

SEQ ID NO: 5454178 - DNA, 20 bp, Homo sapiens
tgagattcacatgctggctc

SEQ ID NO: 5454179 - DNA, 23 bp, Homo sapiens
tgagattcacatgctggctcctg

SEQ ID NO: 5454180 - DNA, 23 bp, Homo sapiens
tgagattccagaacgccctgtgt

SEQ ID NO: 5454181 - DNA, 17 bp, Homo sapiens
tgagattccctctcctc

SEQ ID NO: 5454182 - DNA, 17 bp, Homo sapiens
tgagattctgaagtatg

SEQ ID NO: 5454183 - DNA, 16 bp, Homo sapiens
tgagattctgggaaag

SEQ ID NO: 5454184 - DNA, 13 bp, Homo sapiens
tgagattctttaa

SEQ ID NO: 5454185 - DNA, 15 bp, Homo sapiens
tgagattctttaagg

SEQ ID NO: 5454186 - DNA, 20 bp, Homo sapiens
tgagattctttaaggagata

SEQ ID NO: 5454187 - DNA, 21 bp, Homo sapiens
tgagattctttaaggagatag

SEQ ID NO: 5454188 - DNA, 17 bp, Homo sapiens
tgagattgaatttcact

SEQ ID NO: 5454189 - DNA, 18 bp, Homo sapiens
tgagattggaaaaaatta

SEQ ID NO: 5454190 - DNA, 17 bp, Homo sapiens
tgagattggtcattaaa

SEQ ID NO: 5454191 - DNA, 14 bp, Homo sapiens
tgagattgtactgt

SEQ ID NO: 5454192 - DNA, 15 bp, Homo sapiens
tgagattgtactgtt

SEQ ID NO: 5454193 - DNA, 20 bp, Homo sapiens
tgagatttaagttcctgctg

SEQ ID NO: 5454194 - DNA, 16 bp, Homo sapiens
tgagatttactgctct

SEQ ID NO: 5454195 - DNA, 21 bp, Homo sapiens
tgagatttactgctctagaaa

SEQ ID NO: 5454196 - DNA, 18 bp, Homo sapiens
tgagatttcagctatgct

SEQ ID NO: 5454197 - DNA, 14 bp, Homo sapiens
tgagatttcatctg

SEQ ID NO: 5454198 - DNA, 18 bp, Homo sapiens
tgagatttcatctgctct

SEQ ID NO: 5454199 - DNA, 15 bp, Homo sapiens
tgagatttcctcctg

SEQ ID NO: 5454200 - DNA, 17 bp, Homo sapiens
tgagatttcttaaatct

SEQ ID NO: 5454201 - DNA, 15 bp, Homo sapiens
tgagatttcttattt

SEQ ID NO: 5454202 - DNA, 14 bp, Homo sapiens
tgagatttgccagc

SEQ ID NO: 5454203 - DNA, 20 bp, Homo sapiens
tgagatttgccagcacaggg

SEQ ID NO: 5454204 - DNA, 22 bp, Homo sapiens
tgagatttgccagcacaggggc

SEQ ID NO: 5454205 - DNA, 13 bp, Homo sapiens
tgagatttgtaaa

SEQ ID NO: 5454206 - DNA, 18 bp, Homo sapiens
tgagatttgtaaatcttt

SEQ ID NO: 5454207 - DNA, 14 bp, Homo sapiens
tgagatttgtattt

SEQ ID NO: 5454208 - DNA, 13 bp, Homo sapiens
tgagatttttaag

SEQ ID NO: 5454209 - DNA, 17 bp, Homo sapiens
tgagatttttaagaact

SEQ ID NO: 5454210 - DNA, 18 bp, Homo sapiens
tgagatttttaagaactt

SEQ ID NO: 5454211 - DNA, 22 bp, Homo sapiens
tgagatttttcatgtatcttat

SEQ ID NO: 5454212 - DNA, 17 bp, Homo sapiens
tgagatttttgatatct

SEQ ID NO: 5454213 - DNA, 20 bp, Homo sapiens
tgagatttttgttttccact

SEQ ID NO: 5454214 - DNA, 17 bp, Homo sapiens
tgagattttttattgct

SEQ ID NO: 5454215 - DNA, 20 bp, Homo sapiens
tgagatttttttgtgtatgt

SEQ ID NO: 5454216 - DNA, 20 bp, Homo sapiens
tgagcaaaaatgccaggcag

SEQ ID NO: 5454217 - DNA, 15 bp, Homo sapiens
tgagcaaacagagga

SEQ ID NO: 5454218 - DNA, 21 bp, Homo sapiens
tgagcaaactgaagcccacag

SEQ ID NO: 5454219 - DNA, 23 bp, Homo sapiens
tgagcaaagcatcggtcatgtgt

SEQ ID NO: 5454220 - DNA, 17 bp, Homo sapiens
tgagcaaaggccctggg

SEQ ID NO: 5454221 - DNA, 20 bp, Homo sapiens
tgagcaaagggaacagtgag

SEQ ID NO: 5454222 - DNA, 20 bp, Homo sapiens
tgagcaaataaacttacaga

SEQ ID NO: 5454223 - DNA, 15 bp, Homo sapiens
tgagcaacaagaatc

SEQ ID NO: 5454224 - DNA, 20 bp, Homo sapiens
tgagcaaccacatttagaaa

SEQ ID NO: 5454225 - DNA, 19 bp, Homo sapiens
tgagcaactgcgacaaaac

SEQ ID NO: 5454226 - DNA, 18 bp, Homo sapiens
tgagcaactgtgcagcac

SEQ ID NO: 5454227 - DNA, 20 bp, Homo sapiens
tgagcaactgtgcagcaccc

SEQ ID NO: 5454228 - DNA, 19 bp, Homo sapiens
tgagcaagaccctgtctct

SEQ ID NO: 5454229 - DNA, 18 bp, Homo sapiens
tgagcaagacgccctctc

SEQ ID NO: 5454230 - DNA, 19 bp, Homo sapiens
tgagcaagactctttcaaa

SEQ ID NO: 5454231 - DNA, 16 bp, Homo sapiens
tgagcaagagccaggg

SEQ ID NO: 5454232 - DNA, 19 bp, Homo sapiens
tgagcaagatcttgtctcc

SEQ ID NO: 5454233 - DNA, 17 bp, Homo sapiens
tgagcaagcaccaacct

SEQ ID NO: 5454234 - DNA, 20 bp, Homo sapiens
tgagcaagcaccaacctcca

SEQ ID NO: 5454235 - DNA, 21 bp, Homo sapiens
tgagcaagcaccaacctccag

SEQ ID NO: 5454236 - DNA, 23 bp, Homo sapiens
tgagcaagcaccaacctccagac

SEQ ID NO: 5454237 - DNA, 17 bp, Homo sapiens
tgagcaaggacattgcc

SEQ ID NO: 5454238 - DNA, 19 bp, Homo sapiens
tgagcaaggacattgcccc

SEQ ID NO: 5454239 - DNA, 22 bp, Homo sapiens
tgagcaaggacattgccccaag

SEQ ID NO: 5454240 - DNA, 18 bp, Homo sapiens
tgagcaagtcccatctca

SEQ ID NO: 5454241 - DNA, 15 bp, Homo sapiens
tgaggagtcttgtgt

SEQ ID NO: 5454242 - DNA, 12 bp, Homo sapiens
tgaggagtggtt

SEQ ID NO: 5454243 - DNA, 15 bp, Homo sapiens
tgaggagttgcctga

SEQ ID NO: 5454244 - DNA, 14 bp, Homo sapiens
tgaggagtttccta

SEQ ID NO: 5454245 - DNA, 18 bp, Homo sapiens
tgaggataaaaaggaagg

SEQ ID NO: 5454246 - DNA, 13 bp, Homo sapiens
tgaggataacttt

SEQ ID NO: 5454247 - DNA, 14 bp, Homo sapiens
tgaggataactttt

SEQ ID NO: 5454248 - DNA, 15 bp, Homo sapiens
tgaggatacagctct

SEQ ID NO: 5454249 - DNA, 19 bp, Homo sapiens
tgaggatacagctcttctc

SEQ ID NO: 5454250 - DNA, 20 bp, Homo sapiens
tgaggatatggcagggaagc

SEQ ID NO: 5454251 - DNA, 21 bp, Homo sapiens
tgaggatatggcagggaagct

SEQ ID NO: 5454252 - DNA, 15 bp, Homo sapiens
tgaggatcagaaagt

SEQ ID NO: 5454253 - DNA, 17 bp, Homo sapiens
tgaggatcagaaagtaa

SEQ ID NO: 5454254 - DNA, 14 bp, Homo sapiens
tgaggatccagggc

SEQ ID NO: 5454255 - DNA, 22 bp, Homo sapiens
tgaggatcccctgtcccctggg

SEQ ID NO: 5454256 - DNA, 23 bp, Homo sapiens
tgaggatcccctgtcccctgggg

SEQ ID NO: 5454257 - DNA, 17 bp, Homo sapiens
tgaggatcctcacagga

SEQ ID NO: 5454258 - DNA, 18 bp, Homo sapiens
tgaggatcctcacaggag

SEQ ID NO: 5454259 - DNA, 23 bp, Homo sapiens
tgaggatcctcacaggagcagac

SEQ ID NO: 5454260 - DNA, 24 bp, Homo sapiens
tgaggatcctcacaggagcagaca

SEQ ID NO: 5454261 - DNA, 15 bp, Homo sapiens
tgaggatctagcttc

SEQ ID NO: 5454262 - DNA, 12 bp, Homo sapiens
tgaggatctatt

SEQ ID NO: 5454263 - DNA, 13 bp, Homo sapiens
tgaggatgacaga

SEQ ID NO: 5454264 - DNA, 14 bp, Homo sapiens
tgaggatgacagag

SEQ ID NO: 5454265 - DNA, 17 bp, Homo sapiens
tgaggatgacagtgaca

SEQ ID NO: 5454266 - DNA, 22 bp, Homo sapiens
tgaggatgacccggggcagctg

SEQ ID NO: 5454267 - DNA, 16 bp, Homo sapiens
tgaggatgagctggaa

SEQ ID NO: 5454268 - DNA, 14 bp, Homo sapiens
tgaggatgaggccg

SEQ ID NO: 5454269 - DNA, 22 bp, Homo sapiens
tgaggatgattattttcaaggc

SEQ ID NO: 5454270 - DNA, 18 bp, Homo sapiens
tgaggatgcactggcctg

SEQ ID NO: 5454271 - DNA, 13 bp, Homo sapiens
tgaggatggagag

SEQ ID NO: 5454272 - DNA, 12 bp, Homo sapiens
tgaggatgggaa

SEQ ID NO: 5454273 - DNA, 16 bp, Homo sapiens
tgaggatgggaaggag

SEQ ID NO: 5454274 - DNA, 18 bp, Homo sapiens
tgaggatgggtcagagct

SEQ ID NO: 5454275 - DNA, 16 bp, Homo sapiens
tgaggatgtatgtgta

SEQ ID NO: 5454276 - DNA, 17 bp, Homo sapiens
tgaggatgtgagcctga

SEQ ID NO: 5454277 - DNA, 21 bp, Homo sapiens
tgaggattagtttagaacagg

SEQ ID NO: 5454278 - DNA, 20 bp, Homo sapiens
tgaggattattataaaaggg

SEQ ID NO: 5454279 - DNA, 13 bp, Homo sapiens
tgaggattcctga

SEQ ID NO: 5454280 - DNA, 13 bp, Homo sapiens
tgaggattgtgga

SEQ ID NO: 5454281 - DNA, 17 bp, Homo sapiens
tgaggattgtggaaaac

SEQ ID NO: 5454282 - DNA, 20 bp, Homo sapiens
tgaggattgtggaaaaccag

SEQ ID NO: 5454283 - DNA, 16 bp, Homo sapiens
tgaggatttagaagtg

SEQ ID NO: 5454284 - DNA, 14 bp, Homo sapiens
tgaggatttcctgg

SEQ ID NO: 5454285 - DNA, 15 bp, Homo sapiens
tgaggatttcctgga

SEQ ID NO: 5454286 - DNA, 16 bp, Homo sapiens
tgaggattttgagtat

SEQ ID NO: 5454287 - DNA, 20 bp, Homo sapiens
tgaggcaaaggccagcagca

SEQ ID NO: 5454288 - DNA, 15 bp, Homo sapiens
tgaggcaaccccctc

SEQ ID NO: 5454289 - DNA, 13 bp, Homo sapiens
tgaggcaactcag

SEQ ID NO: 5454290 - DNA, 15 bp, Homo sapiens
tgaggcaactcagca

SEQ ID NO: 5454291 - DNA, 18 bp, Homo sapiens
tgaggcaactcagcaggc

SEQ ID NO: 5454292 - DNA, 22 bp, Homo sapiens
tgaggcaactcagcaggctaag

SEQ ID NO: 5454293 - DNA, 14 bp, Homo sapiens
tgaggcaagagaat

SEQ ID NO: 5454294 - DNA, 21 bp, Homo sapiens
tgaggcaagccatggagtgag

SEQ ID NO: 5454295 - DNA, 15 bp, Homo sapiens
tgaggcaagtgtggg

SEQ ID NO: 5454296 - DNA, 16 bp, Homo sapiens
tgaggcaagtgtgggc

SEQ ID NO: 5454297 - DNA, 16 bp, Homo sapiens
tgaggcaatgtcagga

SEQ ID NO: 5454298 - DNA, 22 bp, Homo sapiens
tgaggcacaagaatcacttgaa

SEQ ID NO: 5454299 - DNA, 16 bp, Homo sapiens
tgaggcacatgacagt

SEQ ID NO: 5454300 - DNA, 17 bp, Homo sapiens
tgaggcacatgtcagca

SEQ ID NO: 5454301 - DNA, 20 bp, Homo sapiens
tgaggcacatgtcagcaagt

SEQ ID NO: 5454302 - DNA, 18 bp, Homo sapiens
tgaggcaccgtccaggcc

SEQ ID NO: 5454303 - DNA, 15 bp, Homo sapiens
tgaggcactggcgag

SEQ ID NO: 5454304 - DNA, 13 bp, Homo sapiens
tgaggcagaacct

SEQ ID NO: 5454305 - DNA, 20 bp, Homo sapiens
tgaggcagaacctggtggct

SEQ ID NO: 5454306 - DNA, 12 bp, Homo sapiens
tgaggcagacag

SEQ ID NO: 5454307 - DNA, 13 bp, Homo sapiens
tgaggcagacagc

SEQ ID NO: 5454308 - DNA, 23 bp, Homo sapiens
tgaggcagacagcagctcaggca

SEQ ID NO: 5454309 - DNA, 21 bp, Homo sapiens
tgaggcagcagtgtgaggcca

SEQ ID NO: 5454310 - DNA, 13 bp, Homo sapiens
tgaggcagcccag

SEQ ID NO: 5454311 - DNA, 17 bp, Homo sapiens
tgaggcagccttgggga

SEQ ID NO: 5454312 - DNA, 12 bp, Homo sapiens
tgaggcaggaga

SEQ ID NO: 5454313 - DNA, 13 bp, Homo sapiens
tgaggcaggagaa

SEQ ID NO: 5454314 - DNA, 14 bp, Homo sapiens
tgaggcaggagaat

SEQ ID NO: 5454315 - DNA, 20 bp, Homo sapiens
tgaggcaggagaattgcttg

SEQ ID NO: 5454316 - DNA, 20 bp, Homo sapiens
tgaggcaggaggatcccctg

SEQ ID NO: 5454317 - DNA, 22 bp, Homo sapiens
tgaggcaggaggatcccctgag

SEQ ID NO: 5454318 - DNA, 24 bp, Homo sapiens
tgaggcaggaggatcccctgaggt

SEQ ID NO: 5454319 - DNA, 20 bp, Homo sapiens
tgaggcaggagggcatgtgc

SEQ ID NO: 5454320 - DNA, 22 bp, Homo sapiens
tgaggcaggagggcatgtgcag

SEQ ID NO: 5454321 - DNA, 19 bp, Homo sapiens
tgaggcaggcaatcacttg

SEQ ID NO: 5454322 - DNA, 14 bp, Homo sapiens
tgaggcagggaagt

SEQ ID NO: 5454323 - DNA, 18 bp, Homo sapiens
tgaggcagggcaaatgac

SEQ ID NO: 5454324 - DNA, 13 bp, Homo sapiens
tgaggcaggggag

SEQ ID NO: 5454325 - DNA, 18 bp, Homo sapiens
tgaggcaggggagtagtg

SEQ ID NO: 5454326 - DNA, 17 bp, Homo sapiens
tgaggcaggggagtctg

SEQ ID NO: 5454327 - DNA, 13 bp, Homo sapiens
tgaggcaggtccc

SEQ ID NO: 5454328 - DNA, 16 bp, Homo sapiens
tgaggcaggtccccag

SEQ ID NO: 5454329 - DNA, 17 bp, Homo sapiens
tgaggcaggtccccaga

SEQ ID NO: 5454330 - DNA, 22 bp, Homo sapiens
tgaggcagtgggtcccacttcc

SEQ ID NO: 5454331 - DNA, 21 bp, Homo sapiens
tgaggcatgactaatgctttt

SEQ ID NO: 5454332 - DNA, 21 bp, Homo sapiens
tgaggcatgcacatctggaat

SEQ ID NO: 5454333 - DNA, 19 bp, Homo sapiens
tgaggcattcggggaagct

SEQ ID NO: 5454334 - DNA, 17 bp, Homo sapiens
tgaggcattgcacaggg

SEQ ID NO: 5454335 - DNA, 12 bp, Homo sapiens
tgaggcatttgt

SEQ ID NO: 5454336 - DNA, 21 bp, Homo sapiens
tgaggcatttgtttgaactga

SEQ ID NO: 5454337 - DNA, 23 bp, Homo sapiens
tgaggcatttgtttgaactgata

SEQ ID NO: 5454338 - DNA, 22 bp, Homo sapiens
tgaggccaaacgttttgaacta

SEQ ID NO: 5454339 - DNA, 17 bp, Homo sapiens
tgaggccaaatattgat

SEQ ID NO: 5454340 - DNA, 15 bp, Homo sapiens
tgaggccaaatgagt

SEQ ID NO: 5454341 - DNA, 20 bp, Homo sapiens
tgaggccaaatgagttccct

SEQ ID NO: 5454342 - DNA, 12 bp, Homo sapiens
tgaggccaagga

SEQ ID NO: 5454343 - DNA, 13 bp, Homo sapiens
tgaggccacactc

SEQ ID NO: 5454344 - DNA, 19 bp, Homo sapiens
tgaggccacactcagcaca

SEQ ID NO: 5454345 - DNA, 23 bp, Homo sapiens
tgaggccaccagtaaaagacatt

SEQ ID NO: 5454346 - DNA, 16 bp, Homo sapiens
tgaggccacccagagg

SEQ ID NO: 5454347 - DNA, 18 bp, Homo sapiens
tgaggccactgaagagga

SEQ ID NO: 5454348 - DNA, 13 bp, Homo sapiens
tgaggccagagga

SEQ ID NO: 5454349 - DNA, 14 bp, Homo sapiens
tgaggccagaggaa

SEQ ID NO: 5454350 - DNA, 15 bp, Homo sapiens
tgaggccagaggaag

SEQ ID NO: 5454351 - DNA, 23 bp, Homo sapiens
tgaggccagaggaagggaggcct

SEQ ID NO: 5454352 - DNA, 24 bp, Homo sapiens
tgaggccagaggaagggaggcctg

SEQ ID NO: 5454353 - DNA, 13 bp, Homo sapiens
tgaggccagcctg

SEQ ID NO: 5454354 - DNA, 12 bp, Homo sapiens
tgaggccaggag

SEQ ID NO: 5454355 - DNA, 17 bp, Homo sapiens
tgaggccaggagttcaa

SEQ ID NO: 5454356 - DNA, 14 bp, Homo sapiens
tgaggccagggcag

SEQ ID NO: 5454357 - DNA, 15 bp, Homo sapiens
tgaggccagggcaga

SEQ ID NO: 5454358 - DNA, 12 bp, Homo sapiens
tgaggccagtgg

SEQ ID NO: 5454359 - DNA, 13 bp, Homo sapiens
tgaggccagtggc

SEQ ID NO: 5454360 - DNA, 18 bp, Homo sapiens
tgaggccatacttgtgaa

SEQ ID NO: 5454361 - DNA, 17 bp, Homo sapiens
tgaggccatcagggccc

SEQ ID NO: 5454362 - DNA, 14 bp, Homo sapiens
tgaggccatctcag

SEQ ID NO: 5454363 - DNA, 10 bp, Homo sapiens
tgaggcccaa

SEQ ID NO: 5454364 - DNA, 20 bp, Homo sapiens
tgaggcccacggtttcagct

SEQ ID NO: 5454365 - DNA, 13 bp, Homo sapiens
tgaggcccagaga

SEQ ID NO: 5454366 - DNA, 17 bp, Homo sapiens
tgaggcccagagaggga

SEQ ID NO: 5454367 - DNA, 18 bp, Homo sapiens
tgaggcccagagagggaa

SEQ ID NO: 5454368 - DNA, 20 bp, Homo sapiens
tgaggcccagagggcctgca

SEQ ID NO: 5454369 - DNA, 22 bp, Homo sapiens
tgaggcccagagggcctgcaag

SEQ ID NO: 5454370 - DNA, 14 bp, Homo sapiens
tgaggcccagcaga

SEQ ID NO: 5454371 - DNA, 16 bp, Homo sapiens
tgaggcccagcagagc

SEQ ID NO: 5454372 - DNA, 17 bp, Homo sapiens
tgaggcccagcagagcc

SEQ ID NO: 5454373 - DNA, 16 bp, Homo sapiens
tgaggcccagcctgtc

SEQ ID NO: 5454374 - DNA, 15 bp, Homo sapiens
tgaggcccagtgcat

SEQ ID NO: 5454375 - DNA, 24 bp, Homo sapiens
tgaggccccaactcaagtgtcacc

SEQ ID NO: 5454376 - DNA, 13 bp, Homo sapiens
tgaggccccaggc

SEQ ID NO: 5454377 - DNA, 15 bp, Homo sapiens
tgaggcccccggagg

SEQ ID NO: 5454378 - DNA, 21 bp, Homo sapiens
tgaggcccccgtcagggagag

SEQ ID NO: 5454379 - DNA, 14 bp, Homo sapiens
tgaggcccctaggt

SEQ ID NO: 5454380 - DNA, 16 bp, Homo sapiens
tgaggcccctgtgcag

SEQ ID NO: 5454381 - DNA, 21 bp, Homo sapiens
tgaggccccttctaggtggca

SEQ ID NO: 5454382 - DNA, 21 bp, Homo sapiens
tgaggccctccacacctgcgg

SEQ ID NO: 5454383 - DNA, 23 bp, Homo sapiens
tgaggccctccacacctgcggcc

SEQ ID NO: 5454384 - DNA, 12 bp, Homo sapiens
tgaggccctgca

SEQ ID NO: 5454385 - DNA, 13 bp, Homo sapiens
tgaggccctgcac

SEQ ID NO: 5454386 - DNA, 14 bp, Homo sapiens
tgaggccctgccca

SEQ ID NO: 5454387 - DNA, 14 bp, Homo sapiens
tgaggccctgggct

SEQ ID NO: 5454388 - DNA, 16 bp, Homo sapiens
tgaggccctgggctgg

SEQ ID NO: 5454389 - DNA, 18 bp, Homo sapiens
tgaggcccttctctccag

SEQ ID NO: 5454390 - DNA, 22 bp, Homo sapiens
tgaggcccttctctccagcccc

SEQ ID NO: 5454391 - DNA, 13 bp, Homo sapiens
tgaggccggacag

SEQ ID NO: 5454392 - DNA, 18 bp, Homo sapiens
tgaggccggagaggagtt

SEQ ID NO: 5454393 - DNA, 17 bp, Homo sapiens
tgaggccggccctgccc

SEQ ID NO: 5454394 - DNA, 17 bp, Homo sapiens
tgaggccgttgctgact

SEQ ID NO: 5454395 - DNA, 19 bp, Homo sapiens
tgaggccgttgctgactta

SEQ ID NO: 5454396 - DNA, 18 bp, Homo sapiens
tgaggcctcatccctcgg

SEQ ID NO: 5454397 - DNA, 14 bp, Homo sapiens
tgaggcctcccttg

SEQ ID NO: 5454398 - DNA, 14 bp, Homo sapiens
tgaggcctcttgga

SEQ ID NO: 5454399 - DNA, 19 bp, Homo sapiens
tgaggcctgagacccagga

SEQ ID NO: 5454400 - DNA, 12 bp, Homo sapiens
tgaggcctgagg

SEQ ID NO: 5454401 - DNA, 15 bp, Homo sapiens
tgaggcctgaggcct

SEQ ID NO: 5454402 - DNA, 16 bp, Homo sapiens
tgaggcctgccccctg

SEQ ID NO: 5454403 - DNA, 21 bp, Homo sapiens
tgaggcctgccccctgggctg

SEQ ID NO: 5454404 - DNA, 19 bp, Homo sapiens
tgaggcctgccctcaggga

SEQ ID NO: 5454405 - DNA, 14 bp, Homo sapiens
tgaggcctggactt

SEQ ID NO: 5454406 - DNA, 23 bp, Homo sapiens
tgaggcctggactttcctgcaac

SEQ ID NO: 5454407 - DNA, 19 bp, Homo sapiens
tgaggcctgtctgtgacct

SEQ ID NO: 5454408 - DNA, 13 bp, Homo sapiens
tgaggcctgtgct

SEQ ID NO: 5454409 - DNA, 21 bp, Homo sapiens
tgaggccttctcttgaggcct

SEQ ID NO: 5454410 - DNA, 13 bp, Homo sapiens
tgaggccttgctc

SEQ ID NO: 5454411 - DNA, 15 bp, Homo sapiens
tgaggccttgtgtgt

SEQ ID NO: 5454412 - DNA, 18 bp, Homo sapiens
tgaggcctttccccagtg

SEQ ID NO: 5454413 - DNA, 23 bp, Homo sapiens
tgaggcctttccccagtgtggcc

SEQ ID NO: 5454414 - DNA, 20 bp, Homo sapiens
tgaggcgctcgctcccatgc

SEQ ID NO: 5454415 - DNA, 20 bp, Homo sapiens
tgaggcgggaaccctctggg

SEQ ID NO: 5454416 - DNA, 16 bp, Homo sapiens
tgaggctaaaacaaat

SEQ ID NO: 5454417 - DNA, 22 bp, Homo sapiens
tgaggctacaaggggtgtgtaa

SEQ ID NO: 5454418 - DNA, 15 bp, Homo sapiens
tgaggctcaagaggc

SEQ ID NO: 5454419 - DNA, 18 bp, Homo sapiens
tgaggctcaagaggccca

SEQ ID NO: 5454420 - DNA, 17 bp, Homo sapiens
tgagtttttcctcccag

SEQ ID NO: 5454421 - DNA, 20 bp, Homo sapiens
tgagtttttcctcccagtga

SEQ ID NO: 5454422 - DNA, 13 bp, Homo sapiens
tgagtttttgata

SEQ ID NO: 5454423 - DNA, 19 bp, Homo sapiens
tgagtttttgatagcttta

SEQ ID NO: 5454424 - DNA, 13 bp, Homo sapiens
tgagttttttcct

SEQ ID NO: 5454425 - DNA, 17 bp, Homo sapiens
tgagttttttctcttgg

SEQ ID NO: 5454426 - DNA, 19 bp, Homo sapiens
tgagttttttctcttgggc

SEQ ID NO: 5454427 - DNA, 20 bp, Homo sapiens
tgataaaaaattttgtaatt

SEQ ID NO: 5454428 - DNA, 16 bp, Homo sapiens
tgataaaaagaaatgt

SEQ ID NO: 5454429 - DNA, 15 bp, Homo sapiens
tgataaaaatgatat

SEQ ID NO: 5454430 - DNA, 16 bp, Homo sapiens
tgataaaaatgatatt

SEQ ID NO: 5454431 - DNA, 17 bp, Homo sapiens
tgataaaagatacattt

SEQ ID NO: 5454432 - DNA, 12 bp, Homo sapiens
tgataaaaggaa

SEQ ID NO: 5454433 - DNA, 13 bp, Homo sapiens
tgataaaaggaag

SEQ ID NO: 5454434 - DNA, 14 bp, Homo sapiens
tgataaaaggaagt

SEQ ID NO: 5454435 - DNA, 18 bp, Homo sapiens
tgataaaaggagaataag

SEQ ID NO: 5454436 - DNA, 18 bp, Homo sapiens
tgataaaagggcaaatct

SEQ ID NO: 5454437 - DNA, 15 bp, Homo sapiens
tgataaaagttttga

SEQ ID NO: 5454438 - DNA, 16 bp, Homo sapiens
tgataaaataaataat

SEQ ID NO: 5454439 - DNA, 17 bp, Homo sapiens
tgataaaataaataatt

SEQ ID NO: 5454440 - DNA, 19 bp, Homo sapiens
tgataaaataagtaacata

SEQ ID NO: 5454441 - DNA, 23 bp, Homo sapiens
tgataaaataagtaacatataaa

SEQ ID NO: 5454442 - DNA, 12 bp, Homo sapiens
tgataaaatcat

SEQ ID NO: 5454443 - DNA, 22 bp, Homo sapiens
tgataaaatcccattgtattta

SEQ ID NO: 5454444 - DNA, 17 bp, Homo sapiens
tgataaaatgttccttt

SEQ ID NO: 5454445 - DNA, 16 bp, Homo sapiens
tgataaacattaaaca

SEQ ID NO: 5454446 - DNA, 17 bp, Homo sapiens
tgataaacattcctgtt

SEQ ID NO: 5454447 - DNA, 18 bp, Homo sapiens
tgataaaccaaaaacatt

SEQ ID NO: 5454448 - DNA, 19 bp, Homo sapiens
tgataaaccaaaaacattt

SEQ ID NO: 5454449 - DNA, 13 bp, Homo sapiens
tgataaacctaat

SEQ ID NO: 5454450 - DNA, 16 bp, Homo sapiens
tgataaactaaaagca

SEQ ID NO: 5454451 - DNA, 17 bp, Homo sapiens
tgataaagaaaagaatc

SEQ ID NO: 5454452 - DNA, 13 bp, Homo sapiens
tgataaagacttt

SEQ ID NO: 5454453 - DNA, 19 bp, Homo sapiens
tgataaagatggggaaact

SEQ ID NO: 5454454 - DNA, 18 bp, Homo sapiens
tgataaagattttttaat

SEQ ID NO: 5454455 - DNA, 20 bp, Homo sapiens
tgataaagattttttaataa

SEQ ID NO: 5454456 - DNA, 12 bp, Homo sapiens
tgataaaggaaa

SEQ ID NO: 5454457 - DNA, 17 bp, Homo sapiens
tgataaaggaaatagga

SEQ ID NO: 5454458 - DNA, 22 bp, Homo sapiens
tgataaaggagaggttaaagca

SEQ ID NO: 5454459 - DNA, 19 bp, Homo sapiens
tgataaagtaaaaaagtta

SEQ ID NO: 5454460 - DNA, 18 bp, Homo sapiens
tgataaagtaataatgtg

SEQ ID NO: 5454461 - DNA, 21 bp, Homo sapiens
tgataaagtaataatgtgcaa

SEQ ID NO: 5454462 - DNA, 18 bp, Homo sapiens
tgataaagtaattcatac

SEQ ID NO: 5454463 - DNA, 16 bp, Homo sapiens
tgataaagtcccctta

SEQ ID NO: 5454464 - DNA, 12 bp, Homo sapiens
tgataaagttgt

SEQ ID NO: 5454465 - DNA, 16 bp, Homo sapiens
tgataaagttgtaaat

SEQ ID NO: 5454466 - DNA, 22 bp, Homo sapiens
tgataaagtttctcagatcctt

SEQ ID NO: 5454467 - DNA, 14 bp, Homo sapiens
tgataaatagtgtt

SEQ ID NO: 5454468 - DNA, 15 bp, Homo sapiens
tgataaatatatatg

SEQ ID NO: 5454469 - DNA, 14 bp, Homo sapiens
tgataaatatatgg

SEQ ID NO: 5454470 - DNA, 17 bp, Homo sapiens
tgataaatcagtcaagc

SEQ ID NO: 5454471 - DNA, 19 bp, Homo sapiens
tgataaatcgggaaattta

SEQ ID NO: 5454472 - DNA, 17 bp, Homo sapiens
tgataaatctagaaaat

SEQ ID NO: 5454473 - DNA, 17 bp, Homo sapiens
tgataacaaaaaataaa

SEQ ID NO: 5454474 - DNA, 20 bp, Homo sapiens
tgataacaaccttttacatt

SEQ ID NO: 5454475 - DNA, 17 bp, Homo sapiens
tgataacaagcaaggat

SEQ ID NO: 5454476 - DNA, 17 bp, Homo sapiens
tgataacaatgttttaa

SEQ ID NO: 5454477 - DNA, 13 bp, Homo sapiens
tgataacaccttg

SEQ ID NO: 5454478 - DNA, 12 bp, Homo sapiens
tgataacagcta

SEQ ID NO: 5454479 - DNA, 16 bp, Homo sapiens
tgataaccaagaatgt

SEQ ID NO: 5454480 - DNA, 15 bp, Homo sapiens
tgataactatttaca

SEQ ID NO: 5454481 - DNA, 21 bp, Homo sapiens
tgataactcaccatcttgaag

SEQ ID NO: 5454482 - DNA, 21 bp, Homo sapiens
tgataactgtttatatgtgtt

SEQ ID NO: 5454483 - DNA, 17 bp, Homo sapiens
tgataacttggggaggc

SEQ ID NO: 5454484 - DNA, 17 bp, Homo sapiens
tgataactttgcttgca

SEQ ID NO: 5454485 - DNA, 12 bp, Homo sapiens
tgataagaaaac

SEQ ID NO: 5454486 - DNA, 20 bp, Homo sapiens
tgataagaacagagtgcctg

SEQ ID NO: 5454487 - DNA, 15 bp, Homo sapiens
tgataagagcagtgg

SEQ ID NO: 5454488 - DNA, 19 bp, Homo sapiens
tgataagagggcacacact

SEQ ID NO: 5454489 - DNA, 12 bp, Homo sapiens
tgataagatctt

SEQ ID NO: 5454490 - DNA, 15 bp, Homo sapiens
tgataagatctttta

SEQ ID NO: 5454491 - DNA, 20 bp, Homo sapiens
tgataagatgaggaaataat

SEQ ID NO: 5454492 - DNA, 16 bp, Homo sapiens
tgataagattgaaatt

SEQ ID NO: 5454493 - DNA, 19 bp, Homo sapiens
tgataagattgaaattcca

SEQ ID NO: 5454494 - DNA, 21 bp, Homo sapiens
tgataagattgaaattccagt

SEQ ID NO: 5454495 - DNA, 13 bp, Homo sapiens
tgataagcacatt

SEQ ID NO: 5454496 - DNA, 24 bp, Homo sapiens
tgataagcagtcatcctcagatca

SEQ ID NO: 5454497 - DNA, 15 bp, Homo sapiens
tgataagcattgact

SEQ ID NO: 5454498 - DNA, 15 bp, Homo sapiens
tgataaggaacattt

SEQ ID NO: 5454499 - DNA, 19 bp, Homo sapiens
tgataaggacatgatgctt

SEQ ID NO: 5454500 - DNA, 20 bp, Homo sapiens
tgataaggatcagaacagca

SEQ ID NO: 5454501 - DNA, 20 bp, Homo sapiens
tgataagggaaaagataaag

SEQ ID NO: 5454502 - DNA, 16 bp, Homo sapiens
tgataagtaaatgcta

SEQ ID NO: 5454503 - DNA, 12 bp, Homo sapiens
tgataagtaatg

SEQ ID NO: 5454504 - DNA, 15 bp, Homo sapiens
tgataagtaatgaaa

SEQ ID NO: 5454505 - DNA, 13 bp, Homo sapiens
tgataagttcata

SEQ ID NO: 5454506 - DNA, 19 bp, Homo sapiens
tgataagttcctttccttt

SEQ ID NO: 5454507 - DNA, 16 bp, Homo sapiens
tgataataaaattcat

SEQ ID NO: 5454508 - DNA, 21 bp, Homo sapiens
tgataataaaattcattccat

SEQ ID NO: 5454509 - DNA, 19 bp, Homo sapiens
tgataataaaggaactgca

SEQ ID NO: 5454510 - DNA, 13 bp, Homo sapiens
tgataataaattg

SEQ ID NO: 5454511 - DNA, 14 bp, Homo sapiens
tgataataaattga

SEQ ID NO: 5454512 - DNA, 22 bp, Homo sapiens
tgataataatgcctaccttgtg

SEQ ID NO: 5454513 - DNA, 14 bp, Homo sapiens
tgataatacccaca

SEQ ID NO: 5454514 - DNA, 14 bp, Homo sapiens
tgataatagattct

SEQ ID NO: 5454515 - DNA, 18 bp, Homo sapiens
tgataatagctcacagca

SEQ ID NO: 5454516 - DNA, 21 bp, Homo sapiens
tgataatatatacaaaccttt

SEQ ID NO: 5454517 - DNA, 17 bp, Homo sapiens
tgataatatattttcaa

SEQ ID NO: 5454518 - DNA, 18 bp, Homo sapiens
tgataatcaactgggctg

SEQ ID NO: 5454519 - DNA, 22 bp, Homo sapiens
tgataatcaattattacattta

SEQ ID NO: 5454520 - DNA, 18 bp, Homo sapiens
tgataatcagtttccact

SEQ ID NO: 5454521 - DNA, 13 bp, Homo sapiens
tgataatcatttt

SEQ ID NO: 5454522 - DNA, 11 bp, Homo sapiens
tgataatcttc

SEQ ID NO: 5454523 - DNA, 23 bp, Homo sapiens
tgataatcttcaggtgaacactt

SEQ ID NO: 5454524 - DNA, 20 bp, Homo sapiens
tgataatgaacagaacatag

SEQ ID NO: 5454525 - DNA, 21 bp, Homo sapiens
tgataatgacactgtttcctg

SEQ ID NO: 5454526 - DNA, 22 bp, Homo sapiens
tgataatgacactgtttcctga

SEQ ID NO: 5454527 - DNA, 23 bp, Homo sapiens
tgataatgatttgctctttgaca

SEQ ID NO: 5454528 - DNA, 14 bp, Homo sapiens
tgataatgttaaat

SEQ ID NO: 5454529 - DNA, 16 bp, Homo sapiens
tgataatgttaaattt

SEQ ID NO: 5454530 - DNA, 22 bp, Homo sapiens
tgataatgttaaatttgtaagt

SEQ ID NO: 5454531 - DNA, 14 bp, Homo sapiens
tgataattatttac

SEQ ID NO: 5454532 - DNA, 15 bp, Homo sapiens
tgataattccagtgg

SEQ ID NO: 5454533 - DNA, 18 bp, Homo sapiens
tgataattcgagcaaaca

SEQ ID NO: 5454534 - DNA, 22 bp, Homo sapiens
tgataattcgagcaaacaactt

SEQ ID NO: 5454535 - DNA, 22 bp, Homo sapiens
tgataattgtttgaggggagga

SEQ ID NO: 5454536 - DNA, 20 bp, Homo sapiens
tgataatttattgtctttat

SEQ ID NO: 5454537 - DNA, 14 bp, Homo sapiens
tgataatttcaggg

SEQ ID NO: 5454538 - DNA, 22 bp, Homo sapiens
tgataatttcagggaaattaat

SEQ ID NO: 5454539 - DNA, 13 bp, Homo sapiens
tgataattttaaa

SEQ ID NO: 5454540 - DNA, 14 bp, Homo sapiens
tgataattttacaa

SEQ ID NO: 5454541 - DNA, 23 bp, Homo sapiens
tgataattttatttataaactag

SEQ ID NO: 5454542 - DNA, 22 bp, Homo sapiens
tgataattttgaaatgattcat

SEQ ID NO: 5454543 - DNA, 11 bp, Homo sapiens
tgatacaaacc

SEQ ID NO: 5454544 - DNA, 16 bp, Homo sapiens
tgatacaaaccactgt

SEQ ID NO: 5454545 - DNA, 18 bp, Homo sapiens
tgatacaaaccactgtga

SEQ ID NO: 5454546 - DNA, 20 bp, Homo sapiens
tgatacaacaggattttcaa

SEQ ID NO: 5454547 - DNA, 16 bp, Homo sapiens
tgatacaagattagaa

SEQ ID NO: 5454548 - DNA, 16 bp, Homo sapiens
tgatacaatgaacact

SEQ ID NO: 5454549 - DNA, 14 bp, Homo sapiens
tgatacaatgctgt

SEQ ID NO: 5454550 - DNA, 15 bp, Homo sapiens
tgatacaatgctgtg

SEQ ID NO: 5454551 - DNA, 21 bp, Homo sapiens
tgatacaatgctgtgccctaa

SEQ ID NO: 5454552 - DNA, 18 bp, Homo sapiens
tgatacacagtaattgtg

SEQ ID NO: 5454553 - DNA, 23 bp, Homo sapiens
tgatacactgaaaggaaaaatgt

SEQ ID NO: 5454554 - DNA, 16 bp, Homo sapiens
tgatacactgtatcta

SEQ ID NO: 5454555 - DNA, 12 bp, Homo sapiens
tgatacagaaaa

SEQ ID NO: 5454556 - DNA, 21 bp, Homo sapiens
tgatacagaaaagttgaattt

SEQ ID NO: 5454557 - DNA, 14 bp, Homo sapiens
tgatacagaactct

SEQ ID NO: 5454558 - DNA, 12 bp, Homo sapiens
tgatacagcctt

SEQ ID NO: 5454559 - DNA, 16 bp, Homo sapiens
tgatacagtattgaaa

SEQ ID NO: 5454560 - DNA, 21 bp, Homo sapiens
tgatacagtgttttttaggaa

SEQ ID NO: 5454561 - DNA, 22 bp, Homo sapiens
tgatacagtgttttttaggaaa

SEQ ID NO: 5454562 - DNA, 17 bp, Homo sapiens
tgatacataactaaatt

SEQ ID NO: 5454563 - DNA, 13 bp, Homo sapiens
tgatacataataa

SEQ ID NO: 5454564 - DNA, 22 bp, Homo sapiens
tgatacatccaaagcagacagc

SEQ ID NO: 5454565 - DNA, 21 bp, Homo sapiens
tgatacatgagccagtgatta

SEQ ID NO: 5454566 - DNA, 21 bp, Homo sapiens
tgatacatttatcttctgttt

SEQ ID NO: 5454567 - DNA, 22 bp, Homo sapiens
tgatacatttatcttctgtttt

SEQ ID NO: 5454568 - DNA, 22 bp, Homo sapiens
tgataccacctttactgtgctt

SEQ ID NO: 5454569 - DNA, 19 bp, Homo sapiens
tgataccagttcagacact

SEQ ID NO: 5454570 - DNA, 22 bp, Homo sapiens
tgataccattctattctccaga

SEQ ID NO: 5454571 - DNA, 16 bp, Homo sapiens
tgatacccaacagttt

SEQ ID NO: 5454572 - DNA, 13 bp, Homo sapiens
tgatacccagagc

SEQ ID NO: 5454573 - DNA, 18 bp, Homo sapiens
tgatacccccctctgtct

SEQ ID NO: 5454574 - DNA, 21 bp, Homo sapiens
tgataccccgtctctactaaa

SEQ ID NO: 5454575 - DNA, 16 bp, Homo sapiens
tgatacccctggggaa

SEQ ID NO: 5454576 - DNA, 24 bp, Homo sapiens
tgataccctgcttggtcaaatccc

SEQ ID NO: 5454577 - DNA, 12 bp, Homo sapiens
tgataccttagg

SEQ ID NO: 5454578 - DNA, 20 bp, Homo sapiens
tgatacgatagttacataat

SEQ ID NO: 5454579 - DNA, 15 bp, Homo sapiens
tgatacgatgcttca

SEQ ID NO: 5454580 - DNA, 19 bp, Homo sapiens
tgatacgcaacataattaa

SEQ ID NO: 5454581 - DNA, 17 bp, Homo sapiens
tgatactaaaagttctt

SEQ ID NO: 5454582 - DNA, 16 bp, Homo sapiens
tgatactaagcattga

SEQ ID NO: 5454583 - DNA, 22 bp, Homo sapiens
tgatactaataaactaataatt

SEQ ID NO: 5454584 - DNA, 16 bp, Homo sapiens
tgatactacaactttt

SEQ ID NO: 5454585 - DNA, 13 bp, Homo sapiens
tgatactaccagg

SEQ ID NO: 5454586 - DNA, 21 bp, Homo sapiens
tgatactatcatactactgaa

SEQ ID NO: 5454587 - DNA, 15 bp, Homo sapiens
tgatactattcaatg

SEQ ID NO: 5454588 - DNA, 19 bp, Homo sapiens
tgatactattcagaggagc

SEQ ID NO: 5454589 - DNA, 19 bp, Homo sapiens
tgatactccaccagtgaaa

SEQ ID NO: 5454590 - DNA, 21 bp, Homo sapiens
tgatactccaccagtgaaaat

SEQ ID NO: 5454591 - DNA, 20 bp, Homo sapiens
tgatactcgttattcataca

SEQ ID NO: 5454592 - DNA, 21 bp, Homo sapiens
tgatactcgttattcatacaa

SEQ ID NO: 5454593 - DNA, 20 bp, Homo sapiens
tgatactctttctaatgctg

SEQ ID NO: 5454594 - DNA, 21 bp, Homo sapiens
tgatactgaattgttatgtaa

SEQ ID NO: 5454595 - DNA, 19 bp, Homo sapiens
tgatactgatgccatgtaa

SEQ ID NO: 5454596 - DNA, 16 bp, Homo sapiens
tgatactgattatgaa

SEQ ID NO: 5454597 - DNA, 16 bp, Homo sapiens
tgatactgcaataaat

SEQ ID NO: 5454598 - DNA, 20 bp, Homo sapiens
tgatccccacgccacagccc

SEQ ID NO: 5454599 - DNA, 17 bp, Homo sapiens
tgatccccatgcctagc

SEQ ID NO: 5454600 - DNA, 15 bp, Homo sapiens
tgatcccccaggttc

SEQ ID NO: 5454601 - DNA, 21 bp, Homo sapiens
tgatccccgtctctgccctgg

SEQ ID NO: 5454602 - DNA, 22 bp, Homo sapiens
tgatccccgtctctgccctggg

SEQ ID NO: 5454603 - DNA, 17 bp, Homo sapiens
tgatcccctctctgtgg

SEQ ID NO: 5454604 - DNA, 22 bp, Homo sapiens
tgatcccctctctgtggctcca

SEQ ID NO: 5454605 - DNA, 22 bp, Homo sapiens
tgatcccggccggccctggctt

SEQ ID NO: 5454606 - DNA, 20 bp, Homo sapiens
tgatcccgttttccccatga

SEQ ID NO: 5454607 - DNA, 22 bp, Homo sapiens
tgatccctgaacccctggccag

SEQ ID NO: 5454608 - DNA, 17 bp, Homo sapiens
tgatccctgctctctga

SEQ ID NO: 5454609 - DNA, 15 bp, Homo sapiens
tgatccctggccact

SEQ ID NO: 5454610 - DNA, 16 bp, Homo sapiens
tgatccctggccactg

SEQ ID NO: 5454611 - DNA, 14 bp, Homo sapiens
tgatcccttccccc

SEQ ID NO: 5454612 - DNA, 14 bp, Homo sapiens
tgatccctttccca

SEQ ID NO: 5454613 - DNA, 20 bp, Homo sapiens
tgatccgcccacctcagcct

SEQ ID NO: 5454614 - DNA, 22 bp, Homo sapiens
tgatccgcccacctcagcctcc

SEQ ID NO: 5454615 - DNA, 20 bp, Homo sapiens
tgatccgcccgcctctgcct

SEQ ID NO: 5454616 - DNA, 21 bp, Homo sapiens
tgatccgcctgcctctgcctc

SEQ ID NO: 5454617 - DNA, 23 bp, Homo sapiens
tgatccggctgctcctccagccc

SEQ ID NO: 5454618 - DNA, 16 bp, Homo sapiens
tgatcctaaccctggg

SEQ ID NO: 5454619 - DNA, 22 bp, Homo sapiens
tgatcctaatgaatgcataaaa

SEQ ID NO: 5454620 - DNA, 18 bp, Homo sapiens
tgatcctcaaacacacaa

SEQ ID NO: 5454621 - DNA, 17 bp, Homo sapiens
tgatcctcacgccttgg

SEQ ID NO: 5454622 - DNA, 13 bp, Homo sapiens
tgatcctccaaca

SEQ ID NO: 5454623 - DNA, 13 bp, Homo sapiens
tgatcctctattt

SEQ ID NO: 5454624 - DNA, 15 bp, Homo sapiens
tgatcctctattttg

SEQ ID NO: 5454625 - DNA, 17 bp, Homo sapiens
tgatcctctattttgtg

SEQ ID NO: 5454626 - DNA, 14 bp, Homo sapiens
tgatcctctcacct

SEQ ID NO: 5454627 - DNA, 15 bp, Homo sapiens
tgatcctgccaatct

SEQ ID NO: 5454628 - DNA, 21 bp, Homo sapiens
tgatcctgcggagaacaccct

SEQ ID NO: 5454629 - DNA, 18 bp, Homo sapiens
tgatcctgctccagcagc

SEQ ID NO: 5454630 - DNA, 11 bp, Homo sapiens
tgatcctgctg

SEQ ID NO: 5454631 - DNA, 15 bp, Homo sapiens
tgatcctggaggccc

SEQ ID NO: 5454632 - DNA, 16 bp, Homo sapiens
tgatcctggaggccca

SEQ ID NO: 5454633 - DNA, 20 bp, Homo sapiens
tgatcctggaggcccagttc

SEQ ID NO: 5454634 - DNA, 20 bp, Homo sapiens
tgatcctgtattcagacaga

SEQ ID NO: 5454635 - DNA, 21 bp, Homo sapiens
tgatcctgtattcagacagat

SEQ ID NO: 5454636 - DNA, 18 bp, Homo sapiens
tgatccttatgatgtcca

SEQ ID NO: 5454637 - DNA, 19 bp, Homo sapiens
tgatccttcaactctgtga

SEQ ID NO: 5454638 - DNA, 20 bp, Homo sapiens
tgatccttcaactctgtgag

SEQ ID NO: 5454639 - DNA, 21 bp, Homo sapiens
tgatccttcaactctgtgagg

SEQ ID NO: 5454640 - DNA, 16 bp, Homo sapiens
tgatccttcccctctt

SEQ ID NO: 5454641 - DNA, 18 bp, Homo sapiens
tgatccttcctactttgc

SEQ ID NO: 5454642 - DNA, 14 bp, Homo sapiens
tgatccttggaaac

SEQ ID NO: 5454643 - DNA, 15 bp, Homo sapiens
tgatccttggtgctg

SEQ ID NO: 5454644 - DNA, 16 bp, Homo sapiens
tgatccttggtgctgt

SEQ ID NO: 5454645 - DNA, 13 bp, Homo sapiens
tgatccttgtttt

SEQ ID NO: 5454646 - DNA, 15 bp, Homo sapiens
tgatccttgttttaa

SEQ ID NO: 5454647 - DNA, 20 bp, Homo sapiens
tgatccttttatgttattta

SEQ ID NO: 5454648 - DNA, 18 bp, Homo sapiens
tgatccttttttgtcatt

SEQ ID NO: 5454649 - DNA, 17 bp, Homo sapiens
tgatcgatgttaaacgt

SEQ ID NO: 5454650 - DNA, 20 bp, Homo sapiens
tgatcgcctctttgacattt

SEQ ID NO: 5454651 - DNA, 13 bp, Homo sapiens
tgatcgccttccc

SEQ ID NO: 5454652 - DNA, 17 bp, Homo sapiens
tgatcgcctttcccagg

SEQ ID NO: 5454653 - DNA, 13 bp, Homo sapiens
tgatcgctgtatt

SEQ ID NO: 5454654 - DNA, 18 bp, Homo sapiens
tgatcggagcctcctctc

SEQ ID NO: 5454655 - DNA, 21 bp, Homo sapiens
tgatcggccagttttcggaaa

SEQ ID NO: 5454656 - DNA, 20 bp, Homo sapiens
tgatcgggataacaaaatca

SEQ ID NO: 5454657 - DNA, 20 bp, Homo sapiens
tgatcgtgacgctgaataaa

SEQ ID NO: 5454658 - DNA, 18 bp, Homo sapiens
tgatcgtttcttccagtt

SEQ ID NO: 5454659 - DNA, 15 bp, Homo sapiens
tgatctaacaaaata

SEQ ID NO: 5454660 - DNA, 18 bp, Homo sapiens
tgatctaagcagttgcaa

SEQ ID NO: 5454661 - DNA, 15 bp, Homo sapiens
tgatctaatatccca

SEQ ID NO: 5454662 - DNA, 21 bp, Homo sapiens
tgatctacccgtgcctgggcc

SEQ ID NO: 5454663 - DNA, 18 bp, Homo sapiens
tgatctacttctgtaatt

SEQ ID NO: 5454664 - DNA, 21 bp, Homo sapiens
tgatctacttctgtaattgtg

SEQ ID NO: 5454665 - DNA, 13 bp, Homo sapiens
tgatctaggaaga

SEQ ID NO: 5454666 - DNA, 19 bp, Homo sapiens
tgatctaggaagactttgg

SEQ ID NO: 5454667 - DNA, 16 bp, Homo sapiens
tgatctaggtttaact

SEQ ID NO: 5454668 - DNA, 18 bp, Homo sapiens
tgatctaggtttaactca

SEQ ID NO: 5454669 - DNA, 21 bp, Homo sapiens
tgatctaggtttaactcagat

SEQ ID NO: 5454670 - DNA, 18 bp, Homo sapiens
tgatctagtccttgtctt

SEQ ID NO: 5454671 - DNA, 18 bp, Homo sapiens
tgatctagttcagaagga

SEQ ID NO: 5454672 - DNA, 18 bp, Homo sapiens
tgatctatctacaaagaa

SEQ ID NO: 5454673 - DNA, 19 bp, Homo sapiens
tgatctatctacaaagaaa

SEQ ID NO: 5454674 - DNA, 21 bp, Homo sapiens
tgatctattgcagatatttga

SEQ ID NO: 5454675 - DNA, 15 bp, Homo sapiens
tgatctatttgtaga

SEQ ID NO: 5454676 - DNA, 14 bp, Homo sapiens
tgatctcaaatcca

SEQ ID NO: 5454677 - DNA, 14 bp, Homo sapiens
tgatctcagggaag

SEQ ID NO: 5454678 - DNA, 21 bp, Homo sapiens
tgatctcagggaagcccagct

SEQ ID NO: 5454679 - DNA, 22 bp, Homo sapiens
tgatctcattcagaagatgctt

SEQ ID NO: 5454680 - DNA, 14 bp, Homo sapiens
tgatctccctgccg

SEQ ID NO: 5454681 - DNA, 11 bp, Homo sapiens
tgatctcctga

SEQ ID NO: 5454682 - DNA, 16 bp, Homo sapiens
tgatctcctgacctca

SEQ ID NO: 5454683 - DNA, 12 bp, Homo sapiens
tgatctcctggt

SEQ ID NO: 5454684 - DNA, 18 bp, Homo sapiens
tgatctcggatgaccaaa

SEQ ID NO: 5454685 - DNA, 23 bp, Homo sapiens
tgatctcggatgaccaaaccagc

SEQ ID NO: 5454686 - DNA, 19 bp, Homo sapiens
tgatctcggctcactgcaa

SEQ ID NO: 5454687 - DNA, 21 bp, Homo sapiens
tgatctcggctcactgcaacc

SEQ ID NO: 5454688 - DNA, 17 bp, Homo sapiens
tgatctctaatgagcta

SEQ ID NO: 5454689 - DNA, 20 bp, Homo sapiens
tgatctctactaccacaagg

SEQ ID NO: 5454690 - DNA, 15 bp, Homo sapiens
tgatctctctagctt

SEQ ID NO: 5454691 - DNA, 15 bp, Homo sapiens
tgatctctcttgtcc

SEQ ID NO: 5454692 - DNA, 17 bp, Homo sapiens
tgatctctcttgtcctc

SEQ ID NO: 5454693 - DNA, 24 bp, Homo sapiens
tgatctctcttgtcctcttctgct

SEQ ID NO: 5454694 - DNA, 13 bp, Homo sapiens
tgatctctgctgg

SEQ ID NO: 5454695 - DNA, 14 bp, Homo sapiens
tgatctctgctggg

SEQ ID NO: 5454696 - DNA, 17 bp, Homo sapiens
tgatctcttagaagcca

SEQ ID NO: 5454697 - DNA, 22 bp, Homo sapiens
tgatctcttctggtgttgactg

SEQ ID NO: 5454698 - DNA, 16 bp, Homo sapiens
tgatctgaacatctgg

SEQ ID NO: 5454699 - DNA, 19 bp, Homo sapiens
tgatctgactttaattgtg

SEQ ID NO: 5454700 - DNA, 20 bp, Homo sapiens
tgatctgatagggtttgtga

SEQ ID NO: 5454701 - DNA, 22 bp, Homo sapiens
tgatctgatagggtttgtgaca

SEQ ID NO: 5454702 - DNA, 21 bp, Homo sapiens
tgatctgatgcaagcaagaaa

SEQ ID NO: 5454703 - DNA, 13 bp, Homo sapiens
tgatctgattttt

SEQ ID NO: 5454704 - DNA, 17 bp, Homo sapiens
tgatctgcaggggtctg

SEQ ID NO: 5454705 - DNA, 18 bp, Homo sapiens
tgatctgcaggggtctgg

SEQ ID NO: 5454706 - DNA, 12 bp, Homo sapiens
tgatctgcatat

SEQ ID NO: 5454707 - DNA, 16 bp, Homo sapiens
tgatctgcatatttct

SEQ ID NO: 5454708 - DNA, 20 bp, Homo sapiens
tgatctgcatatttctgtat

SEQ ID NO: 5454709 - DNA, 21 bp, Homo sapiens
tgatctgcatatttctgtata

SEQ ID NO: 5454710 - DNA, 23 bp, Homo sapiens
tgatctgcccacctcggcctccc

SEQ ID NO: 5454711 - DNA, 21 bp, Homo sapiens
tgatctgctcagccctggagg

SEQ ID NO: 5454712 - DNA, 13 bp, Homo sapiens
tgatctgctctgt

SEQ ID NO: 5454713 - DNA, 15 bp, Homo sapiens
tgatctggaacccag

SEQ ID NO: 5454714 - DNA, 18 bp, Homo sapiens
tgatctggaacccagact

SEQ ID NO: 5454715 - DNA, 19 bp, Homo sapiens
tgatctggcccaagctggg

SEQ ID NO: 5454716 - DNA, 11 bp, Homo sapiens
tgatctgggaa

SEQ ID NO: 5454717 - DNA, 16 bp, Homo sapiens
tgatctgggaactccc

SEQ ID NO: 5454718 - DNA, 19 bp, Homo sapiens
tgatctgggcattttcctc

SEQ ID NO: 5454719 - DNA, 17 bp, Homo sapiens
tgatctggtttgactcc

SEQ ID NO: 5454720 - DNA, 15 bp, Homo sapiens
tgatctgtactttgt

SEQ ID NO: 5454721 - DNA, 20 bp, Homo sapiens
tgatctgtactttgtgttta

SEQ ID NO: 5454722 - DNA, 19 bp, Homo sapiens
tgatctgtatatacaataa

SEQ ID NO: 5454723 - DNA, 12 bp, Homo sapiens
tgatctgtatta

SEQ ID NO: 5454724 - DNA, 15 bp, Homo sapiens
tgatctgtatttaat

SEQ ID NO: 5454725 - DNA, 12 bp, Homo sapiens
tgatctgtcaaa

SEQ ID NO: 5454726 - DNA, 15 bp, Homo sapiens
tgatctgtcccctct

SEQ ID NO: 5454727 - DNA, 15 bp, Homo sapiens
tgatctgtcttgtaa

SEQ ID NO: 5454728 - DNA, 16 bp, Homo sapiens
tgatctgtcttgtaat

SEQ ID NO: 5454729 - DNA, 20 bp, Homo sapiens
tgatctgtgatagttcaccc

SEQ ID NO: 5454730 - DNA, 17 bp, Homo sapiens
tgatctgtgatttcttc

SEQ ID NO: 5454731 - DNA, 13 bp, Homo sapiens
tgatctgtgcagg

SEQ ID NO: 5454732 - DNA, 21 bp, Homo sapiens
tgatctgtgcagggtattaac

SEQ ID NO: 5454733 - DNA, 14 bp, Homo sapiens
tgatctgtgccttt

SEQ ID NO: 5454734 - DNA, 19 bp, Homo sapiens
tgatctgtgctttccagct

SEQ ID NO: 5454735 - DNA, 20 bp, Homo sapiens
tgatctgtgctttccagctc

SEQ ID NO: 5454736 - DNA, 12 bp, Homo sapiens
tgatctgtgtac

SEQ ID NO: 5454737 - DNA, 21 bp, Homo sapiens
tgatctgttgtaatatcagtt

SEQ ID NO: 5454738 - DNA, 15 bp, Homo sapiens
tgatctgttttggat

SEQ ID NO: 5454739 - DNA, 23 bp, Homo sapiens
tgatctgttttggatgttgctat

SEQ ID NO: 5454740 - DNA, 13 bp, Homo sapiens
tgatcttaaaata

SEQ ID NO: 5454741 - DNA, 21 bp, Homo sapiens
tgatcttaaaataattcatat

SEQ ID NO: 5454742 - DNA, 13 bp, Homo sapiens
tgatcttaaagat

SEQ ID NO: 5454743 - DNA, 18 bp, Homo sapiens
tgatcttaaagatcgtgt

SEQ ID NO: 5454744 - DNA, 16 bp, Homo sapiens
tgatcttaagaggctg

SEQ ID NO: 5454745 - DNA, 14 bp, Homo sapiens
tgatcttacagaaa

SEQ ID NO: 5454746 - DNA, 21 bp, Homo sapiens
tgatcttagggaactttgata

SEQ ID NO: 5454747 - DNA, 23 bp, Homo sapiens
tgatcttaggtttgttttttcat

SEQ ID NO: 5454748 - DNA, 21 bp, Homo sapiens
tgatcttcctcaaacttcaga

SEQ ID NO: 5454749 - DNA, 18 bp, Homo sapiens
tgatcttcctctgctaaa

SEQ ID NO: 5454750 - DNA, 20 bp, Homo sapiens
tgatcttcctctgctaaatt

SEQ ID NO: 5454751 - DNA, 14 bp, Homo sapiens
tgatcttgaactcc

SEQ ID NO: 5454752 - DNA, 18 bp, Homo sapiens
tgatcttgagaacctttt

SEQ ID NO: 5454753 - DNA, 15 bp, Homo sapiens
tgatcttgcattcat

SEQ ID NO: 5454754 - DNA, 18 bp, Homo sapiens
tgatcttgcattcatttt

SEQ ID NO: 5454755 - DNA, 18 bp, Homo sapiens
tgatcttgctctatctca

SEQ ID NO: 5454756 - DNA, 13 bp, Homo sapiens
tgatcttggctca

SEQ ID NO: 5454757 - DNA, 10 bp, Homo sapiens
tgatcttgtg

SEQ ID NO: 5454758 - DNA, 15 bp, Homo sapiens
tgatcttgtgctcag

SEQ ID NO: 5454759 - DNA, 19 bp, Homo sapiens
tgatcttgttaatgcattt

SEQ ID NO: 5454760 - DNA, 18 bp, Homo sapiens
tgatcttgttactgtgat

SEQ ID NO: 5454761 - DNA, 22 bp, Homo sapiens
tgatctttaactggaaggctgc

SEQ ID NO: 5454762 - DNA, 15 bp, Homo sapiens
tgatctttgagccca

SEQ ID NO: 5454763 - DNA, 19 bp, Homo sapiens
tgatctttgcagacaggca

SEQ ID NO: 5454764 - DNA, 20 bp, Homo sapiens
tgatctttgcagacaggcaa

SEQ ID NO: 5454765 - DNA, 19 bp, Homo sapiens
tgatctttgggcatcagaa

SEQ ID NO: 5454766 - DNA, 21 bp, Homo sapiens
tgatctttgggcatcagaaaa

SEQ ID NO: 5454767 - DNA, 23 bp, Homo sapiens
tgatctttgggcatcagaaaaca

SEQ ID NO: 5454768 - DNA, 13 bp, Homo sapiens
tgatcttttaaaa

SEQ ID NO: 5454769 - DNA, 19 bp, Homo sapiens
tgatcttttaaaatcatga

SEQ ID NO: 5454770 - DNA, 17 bp, Homo sapiens
tgatcttttaaagtgtt

SEQ ID NO: 5454771 - DNA, 21 bp, Homo sapiens
tgatcttttaaagtgttactt

SEQ ID NO: 5454772 - DNA, 16 bp, Homo sapiens
tgatcttttcagtgtt

SEQ ID NO: 5454773 - DNA, 19 bp, Homo sapiens
tgatctttttatacacaat

SEQ ID NO: 5454774 - DNA, 14 bp, Homo sapiens
tgatgaaaagcttt

SEQ ID NO: 5454775 - DNA, 17 bp, Homo sapiens
tgattaactcagtcctg

SEQ ID NO: 5454776 - DNA, 20 bp, Homo sapiens
tgattaacttatactgtagg

SEQ ID NO: 5454777 - DNA, 21 bp, Homo sapiens
tgattaacttggatgagtttt

SEQ ID NO: 5454778 - DNA, 20 bp, Homo sapiens
tgattaagaaaacattgctt

SEQ ID NO: 5454779 - DNA, 15 bp, Homo sapiens
tgattaagaaaggaa

SEQ ID NO: 5454780 - DNA, 17 bp, Homo sapiens
tgattaagaaaggaagt

SEQ ID NO: 5454781 - DNA, 11 bp, Homo sapiens
tgattaaggac

SEQ ID NO: 5454782 - DNA, 13 bp, Homo sapiens
tgattaaggacta

SEQ ID NO: 5454783 - DNA, 21 bp, Homo sapiens
tgattaaggactacagaattg

SEQ ID NO: 5454784 - DNA, 12 bp, Homo sapiens
tgattaaggcag

SEQ ID NO: 5454785 - DNA, 19 bp, Homo sapiens
tgattaagggacatttcta

SEQ ID NO: 5454786 - DNA, 22 bp, Homo sapiens
tgattaagggacatttctataa

SEQ ID NO: 5454787 - DNA, 16 bp, Homo sapiens
tgattaaggtcctgct

SEQ ID NO: 5454788 - DNA, 18 bp, Homo sapiens
tgattaagtaatgataac

SEQ ID NO: 5454789 - DNA, 13 bp, Homo sapiens
tgattaagtatat

SEQ ID NO: 5454790 - DNA, 13 bp, Homo sapiens
tgattaatcaaag

SEQ ID NO: 5454791 - DNA, 14 bp, Homo sapiens
tgattaatcaaagg

SEQ ID NO: 5454792 - DNA, 13 bp, Homo sapiens
tgattaatccaga

SEQ ID NO: 5454793 - DNA, 12 bp, Homo sapiens
tgattaatgcat

SEQ ID NO: 5454794 - DNA, 17 bp, Homo sapiens
tgattaatggaaatgtt

SEQ ID NO: 5454795 - DNA, 15 bp, Homo sapiens
tgattaatgtttctt

SEQ ID NO: 5454796 - DNA, 18 bp, Homo sapiens
tgattaatgttttcatta

SEQ ID NO: 5454797 - DNA, 19 bp, Homo sapiens
tgattaatgttttcattat

SEQ ID NO: 5454798 - DNA, 20 bp, Homo sapiens
tgattaatgttttcattatg

SEQ ID NO: 5454799 - DNA, 21 bp, Homo sapiens
tgattaatttctgccatttca

SEQ ID NO: 5454800 - DNA, 15 bp, Homo sapiens
tgattaatttgagaa

SEQ ID NO: 5454801 - DNA, 14 bp, Homo sapiens
tgattacacaaaac

SEQ ID NO: 5454802 - DNA, 18 bp, Homo sapiens
tgattacaccagcctcgt

SEQ ID NO: 5454803 - DNA, 16 bp, Homo sapiens
tgattacagtgcagtg

SEQ ID NO: 5454804 - DNA, 18 bp, Homo sapiens
tgattacataatcaaagc

SEQ ID NO: 5454805 - DNA, 20 bp, Homo sapiens
tgattacatagatcagccat

SEQ ID NO: 5454806 - DNA, 22 bp, Homo sapiens
tgattacatagatcagccatta

SEQ ID NO: 5454807 - DNA, 14 bp, Homo sapiens
tgattaccagggac

SEQ ID NO: 5454808 - DNA, 14 bp, Homo sapiens
tgattacctgaaag

SEQ ID NO: 5454809 - DNA, 15 bp, Homo sapiens
tgattacctgccaat

SEQ ID NO: 5454810 - DNA, 16 bp, Homo sapiens
tgattacctgctgcat

SEQ ID NO: 5454811 - DNA, 19 bp, Homo sapiens
tgattacgtgtatgtttct

SEQ ID NO: 5454812 - DNA, 14 bp, Homo sapiens
tgattactcctcca

SEQ ID NO: 5454813 - DNA, 14 bp, Homo sapiens
tgattactctttga

SEQ ID NO: 5454814 - DNA, 14 bp, Homo sapiens
tgattactgcaatc

SEQ ID NO: 5454815 - DNA, 17 bp, Homo sapiens
tgattactgcaatcact

SEQ ID NO: 5454816 - DNA, 23 bp, Homo sapiens
tgattactggcctttttcattta

SEQ ID NO: 5454817 - DNA, 13 bp, Homo sapiens
tgattactgtcaa

SEQ ID NO: 5454818 - DNA, 24 bp, Homo sapiens
tgattactgtcaaggctgcttaga

SEQ ID NO: 5454819 - DNA, 23 bp, Homo sapiens
tgattactgtcaataaacagctt

SEQ ID NO: 5454820 - DNA, 16 bp, Homo sapiens
tgattactttaaaata

SEQ ID NO: 5454821 - DNA, 19 bp, Homo sapiens
tgattagaaaggaaatgaa

SEQ ID NO: 5454822 - DNA, 23 bp, Homo sapiens
tgattagaaattacctgtggata

SEQ ID NO: 5454823 - DNA, 13 bp, Homo sapiens
tgattagaagcca

SEQ ID NO: 5454824 - DNA, 16 bp, Homo sapiens
tgattagacaatgtgg

SEQ ID NO: 5454825 - DNA, 14 bp, Homo sapiens
tgattagataaaga

SEQ ID NO: 5454826 - DNA, 13 bp, Homo sapiens
tgattagcaagtt

SEQ ID NO: 5454827 - DNA, 18 bp, Homo sapiens
tgattagcaagttacagt

SEQ ID NO: 5454828 - DNA, 22 bp, Homo sapiens
tgattagctcaccttgagataa

SEQ ID NO: 5454829 - DNA, 19 bp, Homo sapiens
tgattagctttgtcactgt

SEQ ID NO: 5454830 - DNA, 14 bp, Homo sapiens
tgattagctttgtg

SEQ ID NO: 5454831 - DNA, 15 bp, Homo sapiens
tgattagctttgtgt

SEQ ID NO: 5454832 - DNA, 15 bp, Homo sapiens
tgattaggtatgttt

SEQ ID NO: 5454833 - DNA, 16 bp, Homo sapiens
tgattaggtatgtttg

SEQ ID NO: 5454834 - DNA, 16 bp, Homo sapiens
tgattagtaaagaaat

SEQ ID NO: 5454835 - DNA, 17 bp, Homo sapiens
tgattagtataatattt

SEQ ID NO: 5454836 - DNA, 17 bp, Homo sapiens
tgattagtgcaataaaa

SEQ ID NO: 5454837 - DNA, 23 bp, Homo sapiens
tgattataagccctgcataatgt

SEQ ID NO: 5454838 - DNA, 22 bp, Homo sapiens
tgattataccatgtgtgctaat

SEQ ID NO: 5454839 - DNA, 21 bp, Homo sapiens
tgattatagcaactaatgttt

SEQ ID NO: 5454840 - DNA, 19 bp, Homo sapiens
tgattatagcaatgtgatt

SEQ ID NO: 5454841 - DNA, 20 bp, Homo sapiens
tgattatagcaatgtgattt

SEQ ID NO: 5454842 - DNA, 22 bp, Homo sapiens
tgattatagcaatgtgattttg

SEQ ID NO: 5454843 - DNA, 20 bp, Homo sapiens
tgattatagttaagcaaatt

SEQ ID NO: 5454844 - DNA, 22 bp, Homo sapiens
tgattatataagcaaaatgaaa

SEQ ID NO: 5454845 - DNA, 13 bp, Homo sapiens
tgattatatgtca

SEQ ID NO: 5454846 - DNA, 14 bp, Homo sapiens
tgattatattcaca

SEQ ID NO: 5454847 - DNA, 13 bp, Homo sapiens
tgattatcattta

SEQ ID NO: 5454848 - DNA, 13 bp, Homo sapiens
tgattatcttcag

SEQ ID NO: 5454849 - DNA, 12 bp, Homo sapiens
tgattatcttga

SEQ ID NO: 5454850 - DNA, 15 bp, Homo sapiens
tgattatcttgaaaa

SEQ ID NO: 5454851 - DNA, 19 bp, Homo sapiens
tgattatcttgatttccca

SEQ ID NO: 5454852 - DNA, 17 bp, Homo sapiens
tgattatgaaatgccag

SEQ ID NO: 5454853 - DNA, 22 bp, Homo sapiens
tgattatgaattacatttgtat

SEQ ID NO: 5454854 - DNA, 18 bp, Homo sapiens
tgattatggagccttaga

SEQ ID NO: 5454855 - DNA, 16 bp, Homo sapiens
tgattattactggcaa

SEQ ID NO: 5454856 - DNA, 15 bp, Homo sapiens
tgattattacttctg

SEQ ID NO: 5454857 - DNA, 13 bp, Homo sapiens
tgattattatgtt

SEQ ID NO: 5454858 - DNA, 14 bp, Homo sapiens
tgattattatgttt

SEQ ID NO: 5454859 - DNA, 16 bp, Homo sapiens
tgattattcaacacat

SEQ ID NO: 5454860 - DNA, 17 bp, Homo sapiens
tgattattcaacacatt

SEQ ID NO: 5454861 - DNA, 20 bp, Homo sapiens
tgattattcttcttacatta

SEQ ID NO: 5454862 - DNA, 17 bp, Homo sapiens
tgattattgaatgttat

SEQ ID NO: 5454863 - DNA, 22 bp, Homo sapiens
tgattattgaatgttatatcat

SEQ ID NO: 5454864 - DNA, 19 bp, Homo sapiens
tgattattgagttctgaag

SEQ ID NO: 5454865 - DNA, 18 bp, Homo sapiens
tgattattgtatttattc

SEQ ID NO: 5454866 - DNA, 10 bp, Homo sapiens
tgattattta

SEQ ID NO: 5454867 - DNA, 22 bp, Homo sapiens
tgattatttaagactaaaagtt

SEQ ID NO: 5454868 - DNA, 17 bp, Homo sapiens
tgattatttatcacata

SEQ ID NO: 5454869 - DNA, 18 bp, Homo sapiens
tgattatttgcagctgcg

SEQ ID NO: 5454870 - DNA, 19 bp, Homo sapiens
tgattatttgcatgttatg

SEQ ID NO: 5454871 - DNA, 14 bp, Homo sapiens
tgattattttcaag

SEQ ID NO: 5454872 - DNA, 20 bp, Homo sapiens
tgattattttcagaagctga

SEQ ID NO: 5454873 - DNA, 21 bp, Homo sapiens
tgattattttcattacaatgg

SEQ ID NO: 5454874 - DNA, 14 bp, Homo sapiens
tgattcaaaagtga

SEQ ID NO: 5454875 - DNA, 19 bp, Homo sapiens
tgattcaaaatatttaaaa

SEQ ID NO: 5454876 - DNA, 23 bp, Homo sapiens
tgattcaaagtagttttatttta

SEQ ID NO: 5454877 - DNA, 22 bp, Homo sapiens
tgattcaaagtgttgtgttcct

SEQ ID NO: 5454878 - DNA, 23 bp, Homo sapiens
tgattcaaagtgttgtgttcctg

SEQ ID NO: 5454879 - DNA, 13 bp, Homo sapiens
tgattcaaataac

SEQ ID NO: 5454880 - DNA, 19 bp, Homo sapiens
tgattcaaataaccctgaa

SEQ ID NO: 5454881 - DNA, 22 bp, Homo sapiens
tgattcaaataaccctgaatca

SEQ ID NO: 5454882 - DNA, 22 bp, Homo sapiens
tgattcaaatatcaaaaggaag

SEQ ID NO: 5454883 - DNA, 12 bp, Homo sapiens
tgattcaaatgt

SEQ ID NO: 5454884 - DNA, 18 bp, Homo sapiens
tgattcaaattgctgctt

SEQ ID NO: 5454885 - DNA, 20 bp, Homo sapiens
tgattcaacaggttttcctg

SEQ ID NO: 5454886 - DNA, 21 bp, Homo sapiens
tgattcaaggctcagaaggaa

SEQ ID NO: 5454887 - DNA, 23 bp, Homo sapiens
tgattcaagtaagtagatgcctg

SEQ ID NO: 5454888 - DNA, 20 bp, Homo sapiens
tgattcaataaaatgcactg

SEQ ID NO: 5454889 - DNA, 21 bp, Homo sapiens
tgattcaataaaatgcactga

SEQ ID NO: 5454890 - DNA, 22 bp, Homo sapiens
tgattcaatctgtaaactgtgt

SEQ ID NO: 5454891 - DNA, 11 bp, Homo sapiens
tgattcaatgt

SEQ ID NO: 5454892 - DNA, 12 bp, Homo sapiens
tgattcaatgtg

SEQ ID NO: 5454893 - DNA, 15 bp, Homo sapiens
tgattcaatgtgaat

SEQ ID NO: 5454894 - DNA, 22 bp, Homo sapiens
tgattcacatgctaaagccagg

SEQ ID NO: 5454895 - DNA, 20 bp, Homo sapiens
tgattcacatgttttcaaat

SEQ ID NO: 5454896 - DNA, 13 bp, Homo sapiens
tgattcacctctt

SEQ ID NO: 5454897 - DNA, 16 bp, Homo sapiens
tgattcacctcttcct

SEQ ID NO: 5454898 - DNA, 18 bp, Homo sapiens
tgattcacctcttcctct

SEQ ID NO: 5454899 - DNA, 19 bp, Homo sapiens
tgattcacctcttcctctg

SEQ ID NO: 5454900 - DNA, 16 bp, Homo sapiens
tgattcactatttaaa

SEQ ID NO: 5454901 - DNA, 13 bp, Homo sapiens
tgattcagacagc

SEQ ID NO: 5454902 - DNA, 18 bp, Homo sapiens
tgattcagacagctgcct

SEQ ID NO: 5454903 - DNA, 19 bp, Homo sapiens
tgattcagacagctgcctg

SEQ ID NO: 5454904 - DNA, 20 bp, Homo sapiens
tgattcagacagctgcctgg

SEQ ID NO: 5454905 - DNA, 15 bp, Homo sapiens
tgattcagcatcact

SEQ ID NO: 5454906 - DNA, 15 bp, Homo sapiens
tgattcagcattttt

SEQ ID NO: 5454907 - DNA, 18 bp, Homo sapiens
tgattcagctaagcaaag

SEQ ID NO: 5454908 - DNA, 22 bp, Homo sapiens
tgattcagctcattatgaaaaa

SEQ ID NO: 5454909 - DNA, 13 bp, Homo sapiens
tgattcagctctg

SEQ ID NO: 5454910 - DNA, 18 bp, Homo sapiens
tgattcagggttatttga

SEQ ID NO: 5454911 - DNA, 13 bp, Homo sapiens
tgattcagtcaca

SEQ ID NO: 5454912 - DNA, 15 bp, Homo sapiens
tgattcagtcacatg

SEQ ID NO: 5454913 - DNA, 18 bp, Homo sapiens
tgattcagtgcattttca

SEQ ID NO: 5454914 - DNA, 15 bp, Homo sapiens
tgattcataacaatg

SEQ ID NO: 5454915 - DNA, 17 bp, Homo sapiens
tgattcataacaatgta

SEQ ID NO: 5454916 - DNA, 23 bp, Homo sapiens
tgattcataacaatgtatgtgaa

SEQ ID NO: 5454917 - DNA, 12 bp, Homo sapiens
tgattcatattt

SEQ ID NO: 5454918 - DNA, 15 bp, Homo sapiens
tgattcatatttaat

SEQ ID NO: 5454919 - DNA, 23 bp, Homo sapiens
tgattcatcctgggatgtaaacc

SEQ ID NO: 5454920 - DNA, 15 bp, Homo sapiens
tgattcatctctggt

SEQ ID NO: 5454921 - DNA, 15 bp, Homo sapiens
tgattcatctttcag

SEQ ID NO: 5454922 - DNA, 15 bp, Homo sapiens
tgattcatgagctgg

SEQ ID NO: 5454923 - DNA, 20 bp, Homo sapiens
tgattcatgtgcttgtgcct

SEQ ID NO: 5454924 - DNA, 21 bp, Homo sapiens
tgattcatgtgcttgtgccta

SEQ ID NO: 5454925 - DNA, 17 bp, Homo sapiens
tgattcattcttaacaa

SEQ ID NO: 5454926 - DNA, 20 bp, Homo sapiens
tgattcattttaacatctga

SEQ ID NO: 5454927 - DNA, 22 bp, Homo sapiens
tgattcattttaacatctgaga

SEQ ID NO: 5454928 - DNA, 16 bp, Homo sapiens
tgattcattttcctgt

SEQ ID NO: 5454929 - DNA, 23 bp, Homo sapiens
tgattcattttcctgttcagtga

SEQ ID NO: 5454930 - DNA, 14 bp, Homo sapiens
tgattccaaataaa

SEQ ID NO: 5454931 - DNA, 20 bp, Homo sapiens
tgattccactacacctggct

SEQ ID NO: 5454932 - DNA, 15 bp, Homo sapiens
tgattccacttttat

SEQ ID NO: 5454933 - DNA, 15 bp, Homo sapiens
tgattccagaacaaa

SEQ ID NO: 5454934 - DNA, 19 bp, Homo sapiens
tgattccagccatcacctt

SEQ ID NO: 5454935 - DNA, 15 bp, Homo sapiens
tgattccatcaaaga

SEQ ID NO: 5454936 - DNA, 16 bp, Homo sapiens
tgattccatcctgtgt

SEQ ID NO: 5454937 - DNA, 16 bp, Homo sapiens
tgattccatctccttg

SEQ ID NO: 5454938 - DNA, 23 bp, Homo sapiens
tgattccattccatggaaataaa

SEQ ID NO: 5454939 - DNA, 15 bp, Homo sapiens
tgattcccaactcct

SEQ ID NO: 5454940 - DNA, 21 bp, Homo sapiens
tgattcccaagctctgctcct

SEQ ID NO: 5454941 - DNA, 23 bp, Homo sapiens
tgattcccaagctctgctcctct

SEQ ID NO: 5454942 - DNA, 12 bp, Homo sapiens
tgattcccaccc

SEQ ID NO: 5454943 - DNA, 16 bp, Homo sapiens
tgattcccagagcaga

SEQ ID NO: 5454944 - DNA, 17 bp, Homo sapiens
tgattccccggagctgg

SEQ ID NO: 5454945 - DNA, 18 bp, Homo sapiens
tgattccccggagctggg

SEQ ID NO: 5454946 - DNA, 17 bp, Homo sapiens
tgattcccgcatggttt

SEQ ID NO: 5454947 - DNA, 19 bp, Homo sapiens
tgattcccgcatggttttt

SEQ ID NO: 5454948 - DNA, 14 bp, Homo sapiens
tgattcccgggctt

SEQ ID NO: 5454949 - DNA, 18 bp, Homo sapiens
tgattccgcaccctgcct

SEQ ID NO: 5454950 - DNA, 23 bp, Homo sapiens
tgattcctaagccacttgaaatg

SEQ ID NO: 5454951 - DNA, 19 bp, Homo sapiens
tgattcctaaggcccagct

SEQ ID NO: 5454952 - DNA, 16 bp, Homo sapiens
tgattcctacccctct

SEQ ID NO: 5454953 - DNA, 18 bp, Homo sapiens
tgcaaattccatagctca

SEQ ID NO: 5454954 - DNA, 14 bp, Homo sapiens
tgcaaattgattgt

SEQ ID NO: 5454955 - DNA, 12 bp, Homo sapiens
tgcaaattgtat

SEQ ID NO: 5454956 - DNA, 16 bp, Homo sapiens
tgcaaattgtatctta

SEQ ID NO: 5454957 - DNA, 18 bp, Homo sapiens
tgcaaatttagtttgtta

SEQ ID NO: 5454958 - DNA, 20 bp, Homo sapiens
tgcaaatttagtttgttaaa

SEQ ID NO: 5454959 - DNA, 16 bp, Homo sapiens
tgcaacaaaatgtaga

SEQ ID NO: 5454960 - DNA, 17 bp, Homo sapiens
tgcaacaaaatgtagaa

SEQ ID NO: 5454961 - DNA, 20 bp, Homo sapiens
tgcaacaaaatgtagaatat

SEQ ID NO: 5454962 - DNA, 19 bp, Homo sapiens
tgcaacaacctttccagct

SEQ ID NO: 5454963 - DNA, 23 bp, Homo sapiens
tgcaacaacctttccagctactt

SEQ ID NO: 5454964 - DNA, 20 bp, Homo sapiens
tgcaacaagccctgcttttg

SEQ ID NO: 5454965 - DNA, 18 bp, Homo sapiens
tgcaacaataataaatgt

SEQ ID NO: 5454966 - DNA, 16 bp, Homo sapiens
tgcaacacaacatttg

SEQ ID NO: 5454967 - DNA, 19 bp, Homo sapiens
tgcaacacaacatttgtgt

SEQ ID NO: 5454968 - DNA, 19 bp, Homo sapiens
tgcaacactgccaaacatc

SEQ ID NO: 5454969 - DNA, 20 bp, Homo sapiens
tgcaacactgccaaacatca

SEQ ID NO: 5454970 - DNA, 12 bp, Homo sapiens
tgcaacactggt

SEQ ID NO: 5454971 - DNA, 13 bp, Homo sapiens
tgcaacagacaag

SEQ ID NO: 5454972 - DNA, 14 bp, Homo sapiens
tgcaacagactgcc

SEQ ID NO: 5454973 - DNA, 19 bp, Homo sapiens
tgcaacagactgttgagtt

SEQ ID NO: 5454974 - DNA, 15 bp, Homo sapiens
tgcaacagcaaatta

SEQ ID NO: 5454975 - DNA, 20 bp, Homo sapiens
tgcaacagcaaattaatgtg

SEQ ID NO: 5454976 - DNA, 23 bp, Homo sapiens
tgcaacagcaaattaatgtgtaa

SEQ ID NO: 5454977 - DNA, 15 bp, Homo sapiens
tgcaacagcagtgtt

SEQ ID NO: 5454978 - DNA, 16 bp, Homo sapiens
tgcaacaggctgggct

SEQ ID NO: 5454979 - DNA, 18 bp, Homo sapiens
tgcaacaggggaggaaaa

SEQ ID NO: 5454980 - DNA, 21 bp, Homo sapiens
tgcaacaggggaggaaaaaag

SEQ ID NO: 5454981 - DNA, 19 bp, Homo sapiens
tgcaacagggggcaaagat

SEQ ID NO: 5454982 - DNA, 15 bp, Homo sapiens
tgcaacagtaatcag

SEQ ID NO: 5454983 - DNA, 17 bp, Homo sapiens
tgcaacagtaatcagag

SEQ ID NO: 5454984 - DNA, 14 bp, Homo sapiens
tgcaacagtagcat

SEQ ID NO: 5454985 - DNA, 15 bp, Homo sapiens
tgcaacatgatgagg

SEQ ID NO: 5454986 - DNA, 22 bp, Homo sapiens
tgcaacatggattccaaagcat

SEQ ID NO: 5454987 - DNA, 16 bp, Homo sapiens
tgcaacatttctgtat

SEQ ID NO: 5454988 - DNA, 21 bp, Homo sapiens
tgcaacattttaaggcaatgg

SEQ ID NO: 5454989 - DNA, 20 bp, Homo sapiens
tgcaaccaaaagggaaaaaa

SEQ ID NO: 5454990 - DNA, 16 bp, Homo sapiens
tgcaaccaagtcacac

SEQ ID NO: 5454991 - DNA, 16 bp, Homo sapiens
tgcaaccaattgaaaa

SEQ ID NO: 5454992 - DNA, 22 bp, Homo sapiens
tgcaaccaattgaaaagtgttc

SEQ ID NO: 5454993 - DNA, 16 bp, Homo sapiens
tgcaaccactctgtgg

SEQ ID NO: 5454994 - DNA, 19 bp, Homo sapiens
tgcaaccactctgtggcca

SEQ ID NO: 5454995 - DNA, 20 bp, Homo sapiens
tgcaaccactctgtggccag

SEQ ID NO: 5454996 - DNA, 22 bp, Homo sapiens
tgcaaccactctgtggccagcc

SEQ ID NO: 5454997 - DNA, 24 bp, Homo sapiens
tgcaaccactctgtggccagcctg

SEQ ID NO: 5454998 - DNA, 11 bp, Homo sapiens
tgcaaccactg

SEQ ID NO: 5454999 - DNA, 13 bp, Homo sapiens
tgcaaccactgca

SEQ ID NO: 5455000 - DNA, 15 bp, Homo sapiens
tgcaaccactgcaat

SEQ ID NO: 5455001 - DNA, 18 bp, Homo sapiens
tgcaaccagaattgtcct

SEQ ID NO: 5455002 - DNA, 17 bp, Homo sapiens
tgcaaccaggaacagca

SEQ ID NO: 5455003 - DNA, 20 bp, Homo sapiens
tgcaaccagggagctgcagg

SEQ ID NO: 5455004 - DNA, 14 bp, Homo sapiens
tgcaacccatgagc

SEQ ID NO: 5455005 - DNA, 13 bp, Homo sapiens
tgcaaccccccag

SEQ ID NO: 5455006 - DNA, 14 bp, Homo sapiens
tgcaaccccccagc

SEQ ID NO: 5455007 - DNA, 16 bp, Homo sapiens
tgcaaccgggccctct

SEQ ID NO: 5455008 - DNA, 20 bp, Homo sapiens
tgcaacctcacctcccgggt

SEQ ID NO: 5455009 - DNA, 19 bp, Homo sapiens
tgcaacctcaccttcctgt

SEQ ID NO: 5455010 - DNA, 21 bp, Homo sapiens
tgcaacctcaccttcctgtgg

SEQ ID NO: 5455011 - DNA, 23 bp, Homo sapiens
tgcaacctcaccttcctgtgggt

SEQ ID NO: 5455012 - DNA, 20 bp, Homo sapiens
tgcaacctccacctcccggg

SEQ ID NO: 5455013 - DNA, 19 bp, Homo sapiens
tgcaacctccacctccggg

SEQ ID NO: 5455014 - DNA, 20 bp, Homo sapiens
tgcaacctccacctccgggt

SEQ ID NO: 5455015 - DNA, 18 bp, Homo sapiens
tgcaacctccacctcctg

SEQ ID NO: 5455016 - DNA, 20 bp, Homo sapiens
tgcaacctccacctcctgag

SEQ ID NO: 5455017 - DNA, 19 bp, Homo sapiens
tgcaacctccacctcctgg

SEQ ID NO: 5455018 - DNA, 20 bp, Homo sapiens
tgcaacctccacctcctggg

SEQ ID NO: 5455019 - DNA, 20 bp, Homo sapiens
tgcaacctccgcctcccggg

SEQ ID NO: 5455020 - DNA, 20 bp, Homo sapiens
tgcaacctccgcctcctggg

SEQ ID NO: 5455021 - DNA, 20 bp, Homo sapiens
tgcaacctccgcctcttggg

SEQ ID NO: 5455022 - DNA, 21 bp, Homo sapiens
tgcaacctccgcctcttgggt

SEQ ID NO: 5455023 - DNA, 19 bp, Homo sapiens
tgcaacctcgctggactct

SEQ ID NO: 5455024 - DNA, 22 bp, Homo sapiens
tgcaacctcgctggactctcag

SEQ ID NO: 5455025 - DNA, 13 bp, Homo sapiens
tgcaacctctgcc

SEQ ID NO: 5455026 - DNA, 21 bp, Homo sapiens
tgcaacctctgcctcccaggt

SEQ ID NO: 5455027 - DNA, 20 bp, Homo sapiens
tgcaacctctgcctcccggg

SEQ ID NO: 5455028 - DNA, 23 bp, Homo sapiens
tgcaacctctgcctcccgggttc

SEQ ID NO: 5455029 - DNA, 18 bp, Homo sapiens
tgcaacctctgcctcctg

SEQ ID NO: 5455030 - DNA, 21 bp, Homo sapiens
tgcaacctctgcctcctgggt

SEQ ID NO: 5455031 - DNA, 22 bp, Homo sapiens
tgcaacctgattgtgtctcttg

SEQ ID NO: 5455032 - DNA, 18 bp, Homo sapiens
tgcaacctgtgcaaaata

SEQ ID NO: 5455033 - DNA, 19 bp, Homo sapiens
tgcaacctgtgcaaaataa

SEQ ID NO: 5455034 - DNA, 15 bp, Homo sapiens
tgcaacctgtggctc

SEQ ID NO: 5455035 - DNA, 15 bp, Homo sapiens
tgcaaccttttatgt

SEQ ID NO: 5455036 - DNA, 22 bp, Homo sapiens
tgcaacgcaggaggagaaaaga

SEQ ID NO: 5455037 - DNA, 16 bp, Homo sapiens
tgcaacggaagccagg

SEQ ID NO: 5455038 - DNA, 13 bp, Homo sapiens
tgcaacgtgtaac

SEQ ID NO: 5455039 - DNA, 20 bp, Homo sapiens
tgcaactaactgactctgtt

SEQ ID NO: 5455040 - DNA, 24 bp, Homo sapiens
tgcaactaactgactctgttattg

SEQ ID NO: 5455041 - DNA, 16 bp, Homo sapiens
tgcaactaaggacaaa

SEQ ID NO: 5455042 - DNA, 20 bp, Homo sapiens
tgcaactaaggacaaattag

SEQ ID NO: 5455043 - DNA, 16 bp, Homo sapiens
tgcaactagccaaggc

SEQ ID NO: 5455044 - DNA, 18 bp, Homo sapiens
tgcaactaggtatttcta

SEQ ID NO: 5455045 - DNA, 13 bp, Homo sapiens
tgcaactcactga

SEQ ID NO: 5455046 - DNA, 18 bp, Homo sapiens
tgcaactccagcgtcctc

SEQ ID NO: 5455047 - DNA, 19 bp, Homo sapiens
tgcaactccagcgtcctca

SEQ ID NO: 5455048 - DNA, 15 bp, Homo sapiens
tgcaactccatcctc

SEQ ID NO: 5455049 - DNA, 21 bp, Homo sapiens
tgcaactcttttaagtgcctt

SEQ ID NO: 5455050 - DNA, 19 bp, Homo sapiens
tgcaactggagttccttat

SEQ ID NO: 5455051 - DNA, 17 bp, Homo sapiens
tgcaactggccagccaa

SEQ ID NO: 5455052 - DNA, 16 bp, Homo sapiens
tgcaactggtatatat

SEQ ID NO: 5455053 - DNA, 17 bp, Homo sapiens
tgcaactggtatatatt

SEQ ID NO: 5455054 - DNA, 20 bp, Homo sapiens
tgcaactggtatatatttag

SEQ ID NO: 5455055 - DNA, 20 bp, Homo sapiens
tgcaacttcccagcaacaat

SEQ ID NO: 5455056 - DNA, 21 bp, Homo sapiens
tgcaacttccgctgaggggtc

SEQ ID NO: 5455057 - DNA, 14 bp, Homo sapiens
tgcaacttctatcc

SEQ ID NO: 5455058 - DNA, 15 bp, Homo sapiens
tgcaacttctatcct

SEQ ID NO: 5455059 - DNA, 13 bp, Homo sapiens
tgcaacttctgcc

SEQ ID NO: 5455060 - DNA, 14 bp, Homo sapiens
tgcaacttctgtcc

SEQ ID NO: 5455061 - DNA, 13 bp, Homo sapiens
tgcaacttgtgaa

SEQ ID NO: 5455062 - DNA, 18 bp, Homo sapiens
tgcaacttgtgaactcca

SEQ ID NO: 5455063 - DNA, 23 bp, Homo sapiens
tgcaactttaagcagctcttgct

SEQ ID NO: 5455064 - DNA, 14 bp, Homo sapiens
tgcaactttagaaa

SEQ ID NO: 5455065 - DNA, 16 bp, Homo sapiens
tgcaactttagaaaga

SEQ ID NO: 5455066 - DNA, 21 bp, Homo sapiens
tgcaactttagaaagaaattg

SEQ ID NO: 5455067 - DNA, 20 bp, Homo sapiens
tgcaagaaaatgatgtgtac

SEQ ID NO: 5455068 - DNA, 18 bp, Homo sapiens
tgcaagaactcatcactg

SEQ ID NO: 5455069 - DNA, 23 bp, Homo sapiens
tgcaagaactcatcactgtggct

SEQ ID NO: 5455070 - DNA, 17 bp, Homo sapiens
tgcaagaactgttttta

SEQ ID NO: 5455071 - DNA, 21 bp, Homo sapiens
tgcaagaactgtttttaccca

SEQ ID NO: 5455072 - DNA, 15 bp, Homo sapiens
tgcaagaagcgccga

SEQ ID NO: 5455073 - DNA, 17 bp, Homo sapiens
tgcaagaagtctggcca

SEQ ID NO: 5455074 - DNA, 18 bp, Homo sapiens
tgcaagaagtctggccat

SEQ ID NO: 5455075 - DNA, 15 bp, Homo sapiens
tgcaagaatgaaatg

SEQ ID NO: 5455076 - DNA, 12 bp, Homo sapiens
tgcaagaatgga

SEQ ID NO: 5455077 - DNA, 18 bp, Homo sapiens
tgcaagaatggagatatg

SEQ ID NO: 5455078 - DNA, 22 bp, Homo sapiens
tgcaagacacaggctcagcatg

SEQ ID NO: 5455079 - DNA, 15 bp, Homo sapiens
tgcaagacacccagt

SEQ ID NO: 5455080 - DNA, 17 bp, Homo sapiens
tgcaagaccctcccatg

SEQ ID NO: 5455081 - DNA, 21 bp, Homo sapiens
tgcaagacctagtcccctttc

SEQ ID NO: 5455082 - DNA, 19 bp, Homo sapiens
tgcaagacttcactgcagc

SEQ ID NO: 5455083 - DNA, 21 bp, Homo sapiens
tgcaagacttcactgcagcct

SEQ ID NO: 5455084 - DNA, 16 bp, Homo sapiens
tgcaagagaacatttt

SEQ ID NO: 5455085 - DNA, 17 bp, Homo sapiens
tgcaagagaacatttta

SEQ ID NO: 5455086 - DNA, 19 bp, Homo sapiens
tgcaagagaacattttact

SEQ ID NO: 5455087 - DNA, 16 bp, Homo sapiens
tgcaagagaatctgat

SEQ ID NO: 5455088 - DNA, 16 bp, Homo sapiens
tgcaagagacagagcc

SEQ ID NO: 5455089 - DNA, 19 bp, Homo sapiens
tgcaagagacagagccccc

SEQ ID NO: 5455090 - DNA, 13 bp, Homo sapiens
tgcaagagacttt

SEQ ID NO: 5455091 - DNA, 15 bp, Homo sapiens
tgcaagagactttgt

SEQ ID NO: 5455092 - DNA, 20 bp, Homo sapiens
tgcaagagatggaaaaaaag

SEQ ID NO: 5455093 - DNA, 20 bp, Homo sapiens
tgcaagagcctgagactgga

SEQ ID NO: 5455094 - DNA, 23 bp, Homo sapiens
tgcaagagggagcacgtgactgt

SEQ ID NO: 5455095 - DNA, 17 bp, Homo sapiens
tgcaagaggtgaagttt

SEQ ID NO: 5455096 - DNA, 19 bp, Homo sapiens
tgcaagagtatactttgta

SEQ ID NO: 5455097 - DNA, 14 bp, Homo sapiens
tgcaagagtgatgg

SEQ ID NO: 5455098 - DNA, 15 bp, Homo sapiens
tgcaagagtgattgc

SEQ ID NO: 5455099 - DNA, 20 bp, Homo sapiens
tgcaagagtgattgcagctt

SEQ ID NO: 5455100 - DNA, 21 bp, Homo sapiens
tgcaagatggacacgagccac

SEQ ID NO: 5455101 - DNA, 16 bp, Homo sapiens
tgcaagatgtgaatta

SEQ ID NO: 5455102 - DNA, 14 bp, Homo sapiens
tgcaagattctgtg

SEQ ID NO: 5455103 - DNA, 17 bp, Homo sapiens
tgcaagatttaacacta

SEQ ID NO: 5455104 - DNA, 23 bp, Homo sapiens
tgcaagattttaaaagttttgtt

SEQ ID NO: 5455105 - DNA, 15 bp, Homo sapiens
tgcaagcaaagcaga

SEQ ID NO: 5455106 - DNA, 23 bp, Homo sapiens
tgcaagcacaaatttcatctcct

SEQ ID NO: 5455107 - DNA, 16 bp, Homo sapiens
tgcaagcacagccctt

SEQ ID NO: 5455108 - DNA, 23 bp, Homo sapiens
tgcaagcactcggggtccctgga

SEQ ID NO: 5455109 - DNA, 16 bp, Homo sapiens
tgcaagcagaggacca

SEQ ID NO: 5455110 - DNA, 17 bp, Homo sapiens
tgcaagcagtttcaata

SEQ ID NO: 5455111 - DNA, 14 bp, Homo sapiens
tgcaagccactatg

SEQ ID NO: 5455112 - DNA, 12 bp, Homo sapiens
tgcaagccagct

SEQ ID NO: 5455113 - DNA, 20 bp, Homo sapiens
tgcaagccagcttcctgtgc

SEQ ID NO: 5455114 - DNA, 21 bp, Homo sapiens
tgcaagccagcttcctgtgca

SEQ ID NO: 5455115 - DNA, 12 bp, Homo sapiens
tgcaagccataa

SEQ ID NO: 5455116 - DNA, 14 bp, Homo sapiens
tgcaagccccaggg

SEQ ID NO: 5455117 - DNA, 17 bp, Homo sapiens
tgcaagccccagggcct

SEQ ID NO: 5455118 - DNA, 18 bp, Homo sapiens
tgcaagccccagggcctg

SEQ ID NO: 5455119 - DNA, 21 bp, Homo sapiens
tgcaagccccagggcctgggg

SEQ ID NO: 5455120 - DNA, 18 bp, Homo sapiens
tgcaagcctgtctgagac

SEQ ID NO: 5455121 - DNA, 18 bp, Homo sapiens
tgcaagccttctaaatga

SEQ ID NO: 5455122 - DNA, 14 bp, Homo sapiens
tgcaagctccagta

SEQ ID NO: 5455123 - DNA, 14 bp, Homo sapiens
tgcaagctccgcct

SEQ ID NO: 5455124 - DNA, 12 bp, Homo sapiens
tgcaagctctgc

SEQ ID NO: 5455125 - DNA, 15 bp, Homo sapiens
tgcaagctctgcctc

SEQ ID NO: 5455126 - DNA, 17 bp, Homo sapiens
tgcaagctctgcctccc

SEQ ID NO: 5455127 - DNA, 14 bp, Homo sapiens
tgcaagctgcaggg

SEQ ID NO: 5455128 - DNA, 20 bp, Homo sapiens
tgcaaggaagccacagctgg

SEQ ID NO: 5455129 - DNA, 18 bp, Homo sapiens
tgcaccctccaccctgtc

SEQ ID NO: 5455130 - DNA, 24 bp, Homo sapiens
tgcaccctctgctatgtctgtgat

SEQ ID NO: 5455131 - DNA, 22 bp, Homo sapiens
tgcaccctcttctcctctggct

SEQ ID NO: 5455132 - DNA, 17 bp, Homo sapiens
tgcaccctgcgcctcca

SEQ ID NO: 5455133 - DNA, 19 bp, Homo sapiens
tgcaccctgcgcctccaga

SEQ ID NO: 5455134 - DNA, 22 bp, Homo sapiens
tgcaccctggggcctggacctg

SEQ ID NO: 5455135 - DNA, 18 bp, Homo sapiens
tgcaccctgtatggagct

SEQ ID NO: 5455136 - DNA, 16 bp, Homo sapiens
tgcacccttcttttct

SEQ ID NO: 5455137 - DNA, 17 bp, Homo sapiens
tgcacccttcttttctc

SEQ ID NO: 5455138 - DNA, 19 bp, Homo sapiens
tgcaccgacccgaggccca

SEQ ID NO: 5455139 - DNA, 20 bp, Homo sapiens
tgcaccgacccgaggcccag

SEQ ID NO: 5455140 - DNA, 23 bp, Homo sapiens
tgcaccgagtgatttccatctct

SEQ ID NO: 5455141 - DNA, 19 bp, Homo sapiens
tgcaccgccgcagaagcag

SEQ ID NO: 5455142 - DNA, 20 bp, Homo sapiens
tgcaccgccgcagaagcagc

SEQ ID NO: 5455143 - DNA, 21 bp, Homo sapiens
tgcaccgccgcagaagcagcc

SEQ ID NO: 5455144 - DNA, 20 bp, Homo sapiens
tgcaccgccggccagctggg

SEQ ID NO: 5455145 - DNA, 13 bp, Homo sapiens
tgcaccgcctgcc

SEQ ID NO: 5455146 - DNA, 16 bp, Homo sapiens
tgcaccgcctgccctc

SEQ ID NO: 5455147 - DNA, 20 bp, Homo sapiens
tgcaccggctggcctggccc

SEQ ID NO: 5455148 - DNA, 23 bp, Homo sapiens
tgcaccggctggcctggcccctc

SEQ ID NO: 5455149 - DNA, 14 bp, Homo sapiens
tgcaccgggccaca

SEQ ID NO: 5455150 - DNA, 17 bp, Homo sapiens
tgcaccgggccacagag

SEQ ID NO: 5455151 - DNA, 12 bp, Homo sapiens
tgcaccggggcc

SEQ ID NO: 5455152 - DNA, 22 bp, Homo sapiens
tgcaccggggcctgggcaggag

SEQ ID NO: 5455153 - DNA, 16 bp, Homo sapiens
tgcaccgtcctcagca

SEQ ID NO: 5455154 - DNA, 20 bp, Homo sapiens
tgcaccgtctcactgtgtgt

SEQ ID NO: 5455155 - DNA, 15 bp, Homo sapiens
tgcacctaaaactta

SEQ ID NO: 5455156 - DNA, 16 bp, Homo sapiens
tgcacctaaagaaaaa

SEQ ID NO: 5455157 - DNA, 19 bp, Homo sapiens
tgcacctaaagaaaaacaa

SEQ ID NO: 5455158 - DNA, 21 bp, Homo sapiens
tgcacctagaacctccctcct

SEQ ID NO: 5455159 - DNA, 20 bp, Homo sapiens
tgcacctagctgtgcaagac

SEQ ID NO: 5455160 - DNA, 16 bp, Homo sapiens
tgcacctatggcccag

SEQ ID NO: 5455161 - DNA, 18 bp, Homo sapiens
tgcacctatggcccagcc

SEQ ID NO: 5455162 - DNA, 14 bp, Homo sapiens
tgcacctattctgt

SEQ ID NO: 5455163 - DNA, 13 bp, Homo sapiens
tgcacctcagggc

SEQ ID NO: 5455164 - DNA, 14 bp, Homo sapiens
tgcacctcattcca

SEQ ID NO: 5455165 - DNA, 17 bp, Homo sapiens
tgcacctcattccagtc

SEQ ID NO: 5455166 - DNA, 14 bp, Homo sapiens
tgcacctcccccca

SEQ ID NO: 5455167 - DNA, 18 bp, Homo sapiens
tgcacctccccccactgc

SEQ ID NO: 5455168 - DNA, 19 bp, Homo sapiens
tgcacctccccccactgca

SEQ ID NO: 5455169 - DNA, 21 bp, Homo sapiens
tgcacctcccttccctccctg

SEQ ID NO: 5455170 - DNA, 16 bp, Homo sapiens
tgcacctccgcttgcc

SEQ ID NO: 5455171 - DNA, 17 bp, Homo sapiens
tgcacctccgcttgcca

SEQ ID NO: 5455172 - DNA, 19 bp, Homo sapiens
tgcacctcctaccctccca

SEQ ID NO: 5455173 - DNA, 12 bp, Homo sapiens
tgcacctctcca

SEQ ID NO: 5455174 - DNA, 22 bp, Homo sapiens
tgcacctctggctagagccgag

SEQ ID NO: 5455175 - DNA, 23 bp, Homo sapiens
tgcacctctggctagagccgagg

SEQ ID NO: 5455176 - DNA, 18 bp, Homo sapiens
tgcacctctgttcatttc

SEQ ID NO: 5455177 - DNA, 19 bp, Homo sapiens
tgcacctctgttcatttca

SEQ ID NO: 5455178 - DNA, 16 bp, Homo sapiens
tgcacctgacctgctg

SEQ ID NO: 5455179 - DNA, 17 bp, Homo sapiens
tgcacctgacctgctga

SEQ ID NO: 5455180 - DNA, 21 bp, Homo sapiens
tgcacctgagaccctactgaa

SEQ ID NO: 5455181 - DNA, 19 bp, Homo sapiens
tgcacctgattagttgaaa

SEQ ID NO: 5455182 - DNA, 12 bp, Homo sapiens
tgcacctgcagg

SEQ ID NO: 5455183 - DNA, 13 bp, Homo sapiens
tgcacctgcaggg

SEQ ID NO: 5455184 - DNA, 15 bp, Homo sapiens
tgcacctgcagggag

SEQ ID NO: 5455185 - DNA, 21 bp, Homo sapiens
tgcacctgcagggagcagcac

SEQ ID NO: 5455186 - DNA, 18 bp, Homo sapiens
tgcacctgcatccgtagt

SEQ ID NO: 5455187 - DNA, 20 bp, Homo sapiens
tgcacctgccagcctggctt

SEQ ID NO: 5455188 - DNA, 22 bp, Homo sapiens
tgcacctgccagcctggcttct

SEQ ID NO: 5455189 - DNA, 14 bp, Homo sapiens
tgcacctgcccagc

SEQ ID NO: 5455190 - DNA, 17 bp, Homo sapiens
tgcacctgccccaggct

SEQ ID NO: 5455191 - DNA, 14 bp, Homo sapiens
tgcacctgccccgt

SEQ ID NO: 5455192 - DNA, 18 bp, Homo sapiens
tgcacctgcctccaccag

SEQ ID NO: 5455193 - DNA, 15 bp, Homo sapiens
tgcacctgcctccag

SEQ ID NO: 5455194 - DNA, 18 bp, Homo sapiens
tgcacctgcgcctggctc

SEQ ID NO: 5455195 - DNA, 15 bp, Homo sapiens
tgcacctgctgcgtc

SEQ ID NO: 5455196 - DNA, 20 bp, Homo sapiens
tgcacctgctgcgtccccac

SEQ ID NO: 5455197 - DNA, 13 bp, Homo sapiens
tgcacctgcttct

SEQ ID NO: 5455198 - DNA, 16 bp, Homo sapiens
tgcacctggcctgggc

SEQ ID NO: 5455199 - DNA, 17 bp, Homo sapiens
tgcacctgggcagctcc

SEQ ID NO: 5455200 - DNA, 20 bp, Homo sapiens
tgcacctgtggcctctcagt

SEQ ID NO: 5455201 - DNA, 15 bp, Homo sapiens
tgcaccttaaaagac

SEQ ID NO: 5455202 - DNA, 13 bp, Homo sapiens
tgcaccttaccaa

SEQ ID NO: 5455203 - DNA, 20 bp, Homo sapiens
tgcaccttaccaactttctg

SEQ ID NO: 5455204 - DNA, 20 bp, Homo sapiens
tgcaccttatatttctgtgt

SEQ ID NO: 5455205 - DNA, 22 bp, Homo sapiens
tgcaccttatatttctgtgtac

SEQ ID NO: 5455206 - DNA, 14 bp, Homo sapiens
tgcaccttatctta

SEQ ID NO: 5455207 - DNA, 16 bp, Homo sapiens
tgcaccttccagcccg

SEQ ID NO: 5455208 - DNA, 19 bp, Homo sapiens
tgcaccttccccaaaggaa

SEQ ID NO: 5455209 - DNA, 19 bp, Homo sapiens
tgcaccttgtgaaggaaaa

SEQ ID NO: 5455210 - DNA, 14 bp, Homo sapiens
tgcacctttctagt

SEQ ID NO: 5455211 - DNA, 18 bp, Homo sapiens
tgcacctttgtctggatg

SEQ ID NO: 5455212 - DNA, 16 bp, Homo sapiens
tgcaccttttcatgta

SEQ ID NO: 5455213 - DNA, 23 bp, Homo sapiens
tgcacgaattttaaaacatggca

SEQ ID NO: 5455214 - DNA, 17 bp, Homo sapiens
tgcacgcacactgtctg

SEQ ID NO: 5455215 - DNA, 23 bp, Homo sapiens
tgcacgcaccccgcccctgcatg

SEQ ID NO: 5455216 - DNA, 16 bp, Homo sapiens
tgcacgccaccacacc

SEQ ID NO: 5455217 - DNA, 19 bp, Homo sapiens
tgcacgccaccacacctgg

SEQ ID NO: 5455218 - DNA, 17 bp, Homo sapiens
tgcacgcccatgtgtga

SEQ ID NO: 5455219 - DNA, 19 bp, Homo sapiens
tgcacgcgccctttctacc

SEQ ID NO: 5455220 - DNA, 18 bp, Homo sapiens
tgcacgctcaatgcccag

SEQ ID NO: 5455221 - DNA, 14 bp, Homo sapiens
tgcacgctcccctc

SEQ ID NO: 5455222 - DNA, 15 bp, Homo sapiens
tgcacgctcccctcc

SEQ ID NO: 5455223 - DNA, 15 bp, Homo sapiens
tgcacgctgcccagg

SEQ ID NO: 5455224 - DNA, 17 bp, Homo sapiens
tgcacggcggcagggtg

SEQ ID NO: 5455225 - DNA, 13 bp, Homo sapiens
tgcacggctgctg

SEQ ID NO: 5455226 - DNA, 20 bp, Homo sapiens
tgcacgggcatgcacacggc

SEQ ID NO: 5455227 - DNA, 19 bp, Homo sapiens
tgcacggtgaatggctttg

SEQ ID NO: 5455228 - DNA, 23 bp, Homo sapiens
tgcacggtgaatggctttgtata

SEQ ID NO: 5455229 - DNA, 21 bp, Homo sapiens
tgcacggtgggccttgctggg

SEQ ID NO: 5455230 - DNA, 16 bp, Homo sapiens
tgcacgtacacacaca

SEQ ID NO: 5455231 - DNA, 17 bp, Homo sapiens
tgcacgtcaccctcctg

SEQ ID NO: 5455232 - DNA, 15 bp, Homo sapiens
tgcacgtcatgggag

SEQ ID NO: 5455233 - DNA, 15 bp, Homo sapiens
tgcacgtgcctgtgg

SEQ ID NO: 5455234 - DNA, 12 bp, Homo sapiens
tgcacgtggaga

SEQ ID NO: 5455235 - DNA, 17 bp, Homo sapiens
tgcacgtggagagctgg

SEQ ID NO: 5455236 - DNA, 11 bp, Homo sapiens
tgcacgtgtgt

SEQ ID NO: 5455237 - DNA, 18 bp, Homo sapiens
tgcacgtgtgtttttcta

SEQ ID NO: 5455238 - DNA, 23 bp, Homo sapiens
tgcacgttaaaaattaaaagaag

SEQ ID NO: 5455239 - DNA, 16 bp, Homo sapiens
tgcacgttaacagcgt

SEQ ID NO: 5455240 - DNA, 21 bp, Homo sapiens
tgcacgttaacagcgtgtcaa

SEQ ID NO: 5455241 - DNA, 18 bp, Homo sapiens
tgcactaaaagtgatgtg

SEQ ID NO: 5455242 - DNA, 22 bp, Homo sapiens
tgcactaaaagtgatgtgattt

SEQ ID NO: 5455243 - DNA, 21 bp, Homo sapiens
tgcactaaaatgaggatccag

SEQ ID NO: 5455244 - DNA, 22 bp, Homo sapiens
tgcactaaaatgaggatccagg

SEQ ID NO: 5455245 - DNA, 23 bp, Homo sapiens
tgcactaaaatgaggatccaggg

SEQ ID NO: 5455246 - DNA, 20 bp, Homo sapiens
tgcactaaagccagcctgac

SEQ ID NO: 5455247 - DNA, 19 bp, Homo sapiens
tgcactaaataaactactt

SEQ ID NO: 5455248 - DNA, 13 bp, Homo sapiens
tgcactaaatatg

SEQ ID NO: 5455249 - DNA, 18 bp, Homo sapiens
tgcactaaatcagagaca

SEQ ID NO: 5455250 - DNA, 14 bp, Homo sapiens
tgcactaactgctg

SEQ ID NO: 5455251 - DNA, 16 bp, Homo sapiens
tgcactaactgctggt

SEQ ID NO: 5455252 - DNA, 23 bp, Homo sapiens
tgcactaagtctcttttttacaa

SEQ ID NO: 5455253 - DNA, 14 bp, Homo sapiens
tgcactacactttt

SEQ ID NO: 5455254 - DNA, 16 bp, Homo sapiens
tgcactacataatctc

SEQ ID NO: 5455255 - DNA, 17 bp, Homo sapiens
tgcactacataatctct

SEQ ID NO: 5455256 - DNA, 22 bp, Homo sapiens
tgcactaccatagctacatcag

SEQ ID NO: 5455257 - DNA, 18 bp, Homo sapiens
tgcactactcctctgcag

SEQ ID NO: 5455258 - DNA, 16 bp, Homo sapiens
tgcactactgaaattt

SEQ ID NO: 5455259 - DNA, 16 bp, Homo sapiens
tgcactagaccatata

SEQ ID NO: 5455260 - DNA, 15 bp, Homo sapiens
tgcactagagaaaat

SEQ ID NO: 5455261 - DNA, 13 bp, Homo sapiens
tgcactagcattt

SEQ ID NO: 5455262 - DNA, 19 bp, Homo sapiens
tgcactagcattttcttga

SEQ ID NO: 5455263 - DNA, 14 bp, Homo sapiens
tgcactagcctgtg

SEQ ID NO: 5455264 - DNA, 17 bp, Homo sapiens
tgcactagcctgtgatt

SEQ ID NO: 5455265 - DNA, 18 bp, Homo sapiens
tgcactagcctgtgatta

SEQ ID NO: 5455266 - DNA, 20 bp, Homo sapiens
tgcactaggaattctttgca

SEQ ID NO: 5455267 - DNA, 18 bp, Homo sapiens
tgcactaggttgcagaga

SEQ ID NO: 5455268 - DNA, 12 bp, Homo sapiens
tgcactatatgc

SEQ ID NO: 5455269 - DNA, 15 bp, Homo sapiens
tgcactatatgcaaa

SEQ ID NO: 5455270 - DNA, 15 bp, Homo sapiens
tgcactatctttcag

SEQ ID NO: 5455271 - DNA, 16 bp, Homo sapiens
tgcactatgaaaatca

SEQ ID NO: 5455272 - DNA, 18 bp, Homo sapiens
tgcactatgaaaatcagt

SEQ ID NO: 5455273 - DNA, 14 bp, Homo sapiens
tgcactcaaatctt

SEQ ID NO: 5455274 - DNA, 20 bp, Homo sapiens
tgcactcaaatcttaagaaa

SEQ ID NO: 5455275 - DNA, 14 bp, Homo sapiens
tgcactcaagaccc

SEQ ID NO: 5455276 - DNA, 17 bp, Homo sapiens
tgcactcaagttgttta

SEQ ID NO: 5455277 - DNA, 15 bp, Homo sapiens
tgcactcagactgta

SEQ ID NO: 5455278 - DNA, 12 bp, Homo sapiens
tgcactcagtgt

SEQ ID NO: 5455279 - DNA, 17 bp, Homo sapiens
tgcactcatcatatttt

SEQ ID NO: 5455280 - DNA, 21 bp, Homo sapiens
tgcactccacacatctttctt

SEQ ID NO: 5455281 - DNA, 13 bp, Homo sapiens
tgcactccagaat

SEQ ID NO: 5455282 - DNA, 13 bp, Homo sapiens
tgcactccagact

SEQ ID NO: 5455283 - DNA, 12 bp, Homo sapiens
tgcactccagcc

SEQ ID NO: 5455284 - DNA, 18 bp, Homo sapiens
tgcactccagcctgggca

SEQ ID NO: 5455285 - DNA, 20 bp, Homo sapiens
tgcactccagcctgggtgac

SEQ ID NO: 5455286 - DNA, 15 bp, Homo sapiens
tgcactccagcttgg

SEQ ID NO: 5455287 - DNA, 18 bp, Homo sapiens
tgcactccatggccaccc

SEQ ID NO: 5455288 - DNA, 15 bp, Homo sapiens
tgcactcccacctga

SEQ ID NO: 5455289 - DNA, 13 bp, Homo sapiens
tgcactcccctgc

SEQ ID NO: 5455290 - DNA, 19 bp, Homo sapiens
tgcactccctaagaaaccc

SEQ ID NO: 5455291 - DNA, 12 bp, Homo sapiens
tgcactcctgga

SEQ ID NO: 5455292 - DNA, 17 bp, Homo sapiens
tgcactcctgtctcttg

SEQ ID NO: 5455293 - DNA, 21 bp, Homo sapiens
tgcactcctgtctcttgggaa

SEQ ID NO: 5455294 - DNA, 21 bp, Homo sapiens
tgcactcctttatctgtaatt

SEQ ID NO: 5455295 - DNA, 18 bp, Homo sapiens
tgcactcgcactgcaaat

SEQ ID NO: 5455296 - DNA, 18 bp, Homo sapiens
tgcactctaaaaggttca

SEQ ID NO: 5455297 - DNA, 16 bp, Homo sapiens
tgcactctaaactgca

SEQ ID NO: 5455298 - DNA, 17 bp, Homo sapiens
tgcactctactctgcga

SEQ ID NO: 5455299 - DNA, 15 bp, Homo sapiens
tgcactctagcctgg

SEQ ID NO: 5455300 - DNA, 17 bp, Homo sapiens
tgcactctagcctggca

SEQ ID NO: 5455301 - DNA, 16 bp, Homo sapiens
tgcactctcttggctg

SEQ ID NO: 5455302 - DNA, 21 bp, Homo sapiens
tgcactctgtagcaaatttgt

SEQ ID NO: 5455303 - DNA, 16 bp, Homo sapiens
tgcactctgtgcccat

SEQ ID NO: 5455304 - DNA, 18 bp, Homo sapiens
tgcactcttgaactgggc

SEQ ID NO: 5455305 - DNA, 13 bp, Homo sapiens
tgcactcttgtac

SEQ ID NO: 5455306 - DNA, 18 bp, Homo sapiens
tgcactcttttgagcagt

SEQ ID NO: 5455307 - DNA, 15 bp, Homo sapiens
tgcagggtcctcttc

SEQ ID NO: 5455308 - DNA, 17 bp, Homo sapiens
tgcagggtgacctgctt

SEQ ID NO: 5455309 - DNA, 18 bp, Homo sapiens
tgcagggtgacgcctgag

SEQ ID NO: 5455310 - DNA, 20 bp, Homo sapiens
tgcagggtggaaggtaagag

SEQ ID NO: 5455311 - DNA, 22 bp, Homo sapiens
tgcagggtgggtgagctctcag

SEQ ID NO: 5455312 - DNA, 22 bp, Homo sapiens
tgcaggtaattttttgtctgct

SEQ ID NO: 5455313 - DNA, 24 bp, Homo sapiens
tgcaggtacttcctcctgatggcc

SEQ ID NO: 5455314 - DNA, 15 bp, Homo sapiens
tgcaggtagacctgt

SEQ ID NO: 5455315 - DNA, 12 bp, Homo sapiens
tgcaggtatttt

SEQ ID NO: 5455316 - DNA, 20 bp, Homo sapiens
tgcaggtattttaactgtgt

SEQ ID NO: 5455317 - DNA, 12 bp, Homo sapiens
tgcaggtcagcc

SEQ ID NO: 5455318 - DNA, 17 bp, Homo sapiens
tgcaggtcagcccatgg

SEQ ID NO: 5455319 - DNA, 23 bp, Homo sapiens
tgcaggtcagcccatggaggcag

SEQ ID NO: 5455320 - DNA, 19 bp, Homo sapiens
tgcaggtcagttgtaataa

SEQ ID NO: 5455321 - DNA, 14 bp, Homo sapiens
tgcaggtccctaat

SEQ ID NO: 5455322 - DNA, 17 bp, Homo sapiens
tgcaggtccctaataaa

SEQ ID NO: 5455323 - DNA, 19 bp, Homo sapiens
tgcaggtccggggaggagg

SEQ ID NO: 5455324 - DNA, 17 bp, Homo sapiens
tgcaggtcctggtgggt

SEQ ID NO: 5455325 - DNA, 15 bp, Homo sapiens
tgcaggtctcaaccc

SEQ ID NO: 5455326 - DNA, 18 bp, Homo sapiens
tgcaggtctccacctgca

SEQ ID NO: 5455327 - DNA, 20 bp, Homo sapiens
tgcaggtctccacctgcaca

SEQ ID NO: 5455328 - DNA, 19 bp, Homo sapiens
tgcaggtctccatgaagaa

SEQ ID NO: 5455329 - DNA, 20 bp, Homo sapiens
tgcaggtctccatgaagaag

SEQ ID NO: 5455330 - DNA, 22 bp, Homo sapiens
tgcaggtctttaaatcatttta

SEQ ID NO: 5455331 - DNA, 16 bp, Homo sapiens
tgcaggtgaaacccag

SEQ ID NO: 5455332 - DNA, 14 bp, Homo sapiens
tgcaggtgctgcct

SEQ ID NO: 5455333 - DNA, 14 bp, Homo sapiens
tgcaggtgctgctg

SEQ ID NO: 5455334 - DNA, 17 bp, Homo sapiens
tgcaggtggcagagtga

SEQ ID NO: 5455335 - DNA, 15 bp, Homo sapiens
tgcaggtgggctggg

SEQ ID NO: 5455336 - DNA, 16 bp, Homo sapiens
tgcaggtgggctgggc

SEQ ID NO: 5455337 - DNA, 18 bp, Homo sapiens
tgcaggtgggctgggccc

SEQ ID NO: 5455338 - DNA, 23 bp, Homo sapiens
tgcaggtggggtgatggccagag

SEQ ID NO: 5455339 - DNA, 21 bp, Homo sapiens
tgcaggtggggttcgagggga

SEQ ID NO: 5455340 - DNA, 14 bp, Homo sapiens
tgcaggtggggttt

SEQ ID NO: 5455341 - DNA, 21 bp, Homo sapiens
tgcaggtggtgtcgggccctt

SEQ ID NO: 5455342 - DNA, 19 bp, Homo sapiens
tgcaggtgttctgctgata

SEQ ID NO: 5455343 - DNA, 15 bp, Homo sapiens
tgcaggtttctcctt

SEQ ID NO: 5455344 - DNA, 20 bp, Homo sapiens
tgcaggtttgaccaggaaag

SEQ ID NO: 5455345 - DNA, 12 bp, Homo sapiens
tgcaggttttct

SEQ ID NO: 5455346 - DNA, 14 bp, Homo sapiens
tgcaggttttctaa

SEQ ID NO: 5455347 - DNA, 14 bp, Homo sapiens
tgcaggttttctgt

SEQ ID NO: 5455348 - DNA, 11 bp, Homo sapiens
tgcagtaactg

SEQ ID NO: 5455349 - DNA, 18 bp, Homo sapiens
tgcagtaactgtttttta

SEQ ID NO: 5455350 - DNA, 17 bp, Homo sapiens
tgcagtaacttgggagt

SEQ ID NO: 5455351 - DNA, 16 bp, Homo sapiens
tgcagtaatctccagg

SEQ ID NO: 5455352 - DNA, 17 bp, Homo sapiens
tgcagtaatctccaggg

SEQ ID NO: 5455353 - DNA, 18 bp, Homo sapiens
tgcagtaatctccagggc

SEQ ID NO: 5455354 - DNA, 15 bp, Homo sapiens
tgcagtaattcaact

SEQ ID NO: 5455355 - DNA, 18 bp, Homo sapiens
tgcagtacaggacatata

SEQ ID NO: 5455356 - DNA, 13 bp, Homo sapiens
tgcagtacatcaa

SEQ ID NO: 5455357 - DNA, 20 bp, Homo sapiens
tgcagtactaaaattaatgc

SEQ ID NO: 5455358 - DNA, 18 bp, Homo sapiens
tgcagtactttacctcct

SEQ ID NO: 5455359 - DNA, 22 bp, Homo sapiens
tgcagtacttttgttgtatggg

SEQ ID NO: 5455360 - DNA, 15 bp, Homo sapiens
tgcagtagagagcct

SEQ ID NO: 5455361 - DNA, 18 bp, Homo sapiens
tgcagtagagagcctttc

SEQ ID NO: 5455362 - DNA, 19 bp, Homo sapiens
tgcagtagagtcatctcca

SEQ ID NO: 5455363 - DNA, 22 bp, Homo sapiens
tgcagtagagtcatctccatca

SEQ ID NO: 5455364 - DNA, 20 bp, Homo sapiens
tgcagtagattttctttaaa

SEQ ID NO: 5455365 - DNA, 17 bp, Homo sapiens
tgcagtagccagcacgt

SEQ ID NO: 5455366 - DNA, 18 bp, Homo sapiens
tgcagtagtctctgtgct

SEQ ID NO: 5455367 - DNA, 21 bp, Homo sapiens
tgcagtagtctctgtgctttg

SEQ ID NO: 5455368 - DNA, 13 bp, Homo sapiens
tgcagtagtgcca

SEQ ID NO: 5455369 - DNA, 16 bp, Homo sapiens
tgcagtagtgtcactt

SEQ ID NO: 5455370 - DNA, 16 bp, Homo sapiens
tgcagtatctgtgaac

SEQ ID NO: 5455371 - DNA, 15 bp, Homo sapiens
tgcagtatgaaaata

SEQ ID NO: 5455372 - DNA, 16 bp, Homo sapiens
tgcagtatggtacatt

SEQ ID NO: 5455373 - DNA, 17 bp, Homo sapiens
tgcagtatggtacattt

SEQ ID NO: 5455374 - DNA, 22 bp, Homo sapiens
tgcagtatggtacatttttcaa

SEQ ID NO: 5455375 - DNA, 17 bp, Homo sapiens
tgcagtatggtgtggtg

SEQ ID NO: 5455376 - DNA, 14 bp, Homo sapiens
tgcagtattctgta

SEQ ID NO: 5455377 - DNA, 17 bp, Homo sapiens
tgcagtattgagcactg

SEQ ID NO: 5455378 - DNA, 20 bp, Homo sapiens
tgcagtattttattaaagca

SEQ ID NO: 5455379 - DNA, 21 bp, Homo sapiens
tgcagtcaacagttcaaagaa

SEQ ID NO: 5455380 - DNA, 19 bp, Homo sapiens
tgcagtcacatcacaatat

SEQ ID NO: 5455381 - DNA, 18 bp, Homo sapiens
tgcagtcacccctgtctg

SEQ ID NO: 5455382 - DNA, 19 bp, Homo sapiens
tgcagtcacccctgtctgc

SEQ ID NO: 5455383 - DNA, 20 bp, Homo sapiens
tgcagtcacccctgtctgcg

SEQ ID NO: 5455384 - DNA, 18 bp, Homo sapiens
tgcagtcaccctgtggca

SEQ ID NO: 5455385 - DNA, 14 bp, Homo sapiens
tgcagtcactggag

SEQ ID NO: 5455386 - DNA, 13 bp, Homo sapiens
tgcagtcactgtg

SEQ ID NO: 5455387 - DNA, 17 bp, Homo sapiens
tgcagtcagtgtttctt

SEQ ID NO: 5455388 - DNA, 22 bp, Homo sapiens
tgcagtcatggagaaccaccta

SEQ ID NO: 5455389 - DNA, 12 bp, Homo sapiens
tgcagtccagaa

SEQ ID NO: 5455390 - DNA, 14 bp, Homo sapiens
tgcagtccagacag

SEQ ID NO: 5455391 - DNA, 17 bp, Homo sapiens
tgcagtccatttcctaa

SEQ ID NO: 5455392 - DNA, 11 bp, Homo sapiens
tgcagtcccaa

SEQ ID NO: 5455393 - DNA, 13 bp, Homo sapiens
tgcagtcccaagc

SEQ ID NO: 5455394 - DNA, 21 bp, Homo sapiens
tgcagtcccaagcggtgtctc

SEQ ID NO: 5455395 - DNA, 12 bp, Homo sapiens
tgcagtccccag

SEQ ID NO: 5455396 - DNA, 14 bp, Homo sapiens
tgcagtccccagtc

SEQ ID NO: 5455397 - DNA, 20 bp, Homo sapiens
tgcagtccgcagtctggcct

SEQ ID NO: 5455398 - DNA, 21 bp, Homo sapiens
tgcagtccgcagtctggcctg

SEQ ID NO: 5455399 - DNA, 17 bp, Homo sapiens
tgcagtcctactcaagc

SEQ ID NO: 5455400 - DNA, 14 bp, Homo sapiens
tgcagtcctccggg

SEQ ID NO: 5455401 - DNA, 14 bp, Homo sapiens
tgcagtcctgggat

SEQ ID NO: 5455402 - DNA, 13 bp, Homo sapiens
tgcagtcctgggt

SEQ ID NO: 5455403 - DNA, 15 bp, Homo sapiens
tgcagtcctgggtcc

SEQ ID NO: 5455404 - DNA, 15 bp, Homo sapiens
tgcagtcggcatgcc

SEQ ID NO: 5455405 - DNA, 16 bp, Homo sapiens
tgcagtcggcatgcca

SEQ ID NO: 5455406 - DNA, 19 bp, Homo sapiens
tgcagtcggcatgccagga

SEQ ID NO: 5455407 - DNA, 15 bp, Homo sapiens
tgcagtcgtgtaatt

SEQ ID NO: 5455408 - DNA, 22 bp, Homo sapiens
tgcagtcgtgtaattggcccaa

SEQ ID NO: 5455409 - DNA, 13 bp, Homo sapiens
tgcagtctaaccc

SEQ ID NO: 5455410 - DNA, 20 bp, Homo sapiens
tgcagtctccgcctcctgag

SEQ ID NO: 5455411 - DNA, 15 bp, Homo sapiens
tgcagtctcctcttt

SEQ ID NO: 5455412 - DNA, 23 bp, Homo sapiens
tgcagtctcctctttaaaacaaa

SEQ ID NO: 5455413 - DNA, 16 bp, Homo sapiens
tgcagtctctatacca

SEQ ID NO: 5455414 - DNA, 19 bp, Homo sapiens
tgcagtctctataccaata

SEQ ID NO: 5455415 - DNA, 20 bp, Homo sapiens
tgcagtctctataccaataa

SEQ ID NO: 5455416 - DNA, 18 bp, Homo sapiens
tgcagtctctctctgcca

SEQ ID NO: 5455417 - DNA, 16 bp, Homo sapiens
tgcagtctctttattt

SEQ ID NO: 5455418 - DNA, 23 bp, Homo sapiens
tgcagtctctttattttactaga

SEQ ID NO: 5455419 - DNA, 15 bp, Homo sapiens
tgcagtctgcttctg

SEQ ID NO: 5455420 - DNA, 14 bp, Homo sapiens
tgcagtctggctga

SEQ ID NO: 5455421 - DNA, 14 bp, Homo sapiens
tgcagtctgtggag

SEQ ID NO: 5455422 - DNA, 21 bp, Homo sapiens
tgcagtcttatttccaagtaa

SEQ ID NO: 5455423 - DNA, 22 bp, Homo sapiens
tgcagtcttctctctggctcag

SEQ ID NO: 5455424 - DNA, 14 bp, Homo sapiens
tgcagtcttctggg

SEQ ID NO: 5455425 - DNA, 16 bp, Homo sapiens
tgcagtctttccccca

SEQ ID NO: 5455426 - DNA, 13 bp, Homo sapiens
tgcagtcttttgc

SEQ ID NO: 5455427 - DNA, 15 bp, Homo sapiens
tgcagtcttttgctg

SEQ ID NO: 5455428 - DNA, 13 bp, Homo sapiens
tgcagtgaactat

SEQ ID NO: 5455429 - DNA, 15 bp, Homo sapiens
tgcagtgaagatgtg

SEQ ID NO: 5455430 - DNA, 17 bp, Homo sapiens
tgcagtgaagatgtgta

SEQ ID NO: 5455431 - DNA, 15 bp, Homo sapiens
tgcagtgaagtgttc

SEQ ID NO: 5455432 - DNA, 22 bp, Homo sapiens
tgcagtgacgtgcacctgtact

SEQ ID NO: 5455433 - DNA, 16 bp, Homo sapiens
tgcagtgagcagggtg

SEQ ID NO: 5455434 - DNA, 14 bp, Homo sapiens
tgcagtgagccgag

SEQ ID NO: 5455435 - DNA, 14 bp, Homo sapiens
tgcagtgagctgag

SEQ ID NO: 5455436 - DNA, 15 bp, Homo sapiens
tgcagtgagctgaga

SEQ ID NO: 5455437 - DNA, 19 bp, Homo sapiens
tgcagtgagctgagatcac

SEQ ID NO: 5455438 - DNA, 15 bp, Homo sapiens
tgcagtgaggggccc

SEQ ID NO: 5455439 - DNA, 17 bp, Homo sapiens
tgcagtgatatggcaga

SEQ ID NO: 5455440 - DNA, 20 bp, Homo sapiens
tgcagtgatatggcagaaga

SEQ ID NO: 5455441 - DNA, 21 bp, Homo sapiens
tgcagtgatgcaatcttggct

SEQ ID NO: 5455442 - DNA, 22 bp, Homo sapiens
tgcagtgattaaggtctctctt

SEQ ID NO: 5455443 - DNA, 18 bp, Homo sapiens
tgcagtgattcagcaggc

SEQ ID NO: 5455444 - DNA, 10 bp, Homo sapiens
tgcagtgcag

SEQ ID NO: 5455445 - DNA, 19 bp, Homo sapiens
tgcagtgccagctccctcg

SEQ ID NO: 5455446 - DNA, 17 bp, Homo sapiens
tgcagtgcccctagctt

SEQ ID NO: 5455447 - DNA, 23 bp, Homo sapiens
tgcagtgccttggggaatttcct

SEQ ID NO: 5455448 - DNA, 16 bp, Homo sapiens
tgcagtgctcattcat

SEQ ID NO: 5455449 - DNA, 20 bp, Homo sapiens
tgcagtgctcgctgttgctg

SEQ ID NO: 5455450 - DNA, 21 bp, Homo sapiens
tgcagtgctcgctgttgctga

SEQ ID NO: 5455451 - DNA, 22 bp, Homo sapiens
tgcagtgctgtaatcggctccc

SEQ ID NO: 5455452 - DNA, 16 bp, Homo sapiens
tgcagtggagggggca

SEQ ID NO: 5455453 - DNA, 18 bp, Homo sapiens
tgcagtggagggggcaag

SEQ ID NO: 5455454 - DNA, 21 bp, Homo sapiens
tgcagtggagggggcaagctt

SEQ ID NO: 5455455 - DNA, 18 bp, Homo sapiens
tgcagtggcgcattctag

SEQ ID NO: 5455456 - DNA, 21 bp, Homo sapiens
tgcagtggcgcattctaggct

SEQ ID NO: 5455457 - DNA, 18 bp, Homo sapiens
tgcagtggcgtgatcttg

SEQ ID NO: 5455458 - DNA, 17 bp, Homo sapiens
tgcagtggctcacgcct

SEQ ID NO: 5455459 - DNA, 18 bp, Homo sapiens
tgcagtggctcccctgcc

SEQ ID NO: 5455460 - DNA, 23 bp, Homo sapiens
tgcagtggggtttcgcagcctga

SEQ ID NO: 5455461 - DNA, 18 bp, Homo sapiens
tgcagtgggtggggctgt

SEQ ID NO: 5455462 - DNA, 18 bp, Homo sapiens
tgcagtggtgcaatcaca

SEQ ID NO: 5455463 - DNA, 15 bp, Homo sapiens
tgcagtgtagatttt

SEQ ID NO: 5455464 - DNA, 20 bp, Homo sapiens
tgcagtgtatttaatgtttg

SEQ ID NO: 5455465 - DNA, 21 bp, Homo sapiens
tgcagtgtatttaatgtttgt

SEQ ID NO: 5455466 - DNA, 21 bp, Homo sapiens
tgcagtgtcaaatcgatggcc

SEQ ID NO: 5455467 - DNA, 17 bp, Homo sapiens
tgcagtgtccagaagcg

SEQ ID NO: 5455468 - DNA, 18 bp, Homo sapiens
tgcagtgtgaatgctggg

SEQ ID NO: 5455469 - DNA, 13 bp, Homo sapiens
tgcagtgtgcctg

SEQ ID NO: 5455470 - DNA, 20 bp, Homo sapiens
tgcagtgtggagttcacctt

SEQ ID NO: 5455471 - DNA, 15 bp, Homo sapiens
tgcagtgtgtgaaaa

SEQ ID NO: 5455472 - DNA, 12 bp, Homo sapiens
tgcagtgttaag

SEQ ID NO: 5455473 - DNA, 15 bp, Homo sapiens
tgcagtgttaagata

SEQ ID NO: 5455474 - DNA, 15 bp, Homo sapiens
tgcagtgtttttcct

SEQ ID NO: 5455475 - DNA, 16 bp, Homo sapiens
tgcagttaccacagca

SEQ ID NO: 5455476 - DNA, 17 bp, Homo sapiens
tgcagttagcacagagg

SEQ ID NO: 5455477 - DNA, 22 bp, Homo sapiens
tgcagttagccccagaaaatga

SEQ ID NO: 5455478 - DNA, 19 bp, Homo sapiens
tgcagttattagaacttag

SEQ ID NO: 5455479 - DNA, 22 bp, Homo sapiens
tgcagttattagaacttagttt

SEQ ID NO: 5455480 - DNA, 21 bp, Homo sapiens
tgcagttatttaccagaagtt

SEQ ID NO: 5455481 - DNA, 14 bp, Homo sapiens
tgcagttatttgct

SEQ ID NO: 5455482 - DNA, 20 bp, Homo sapiens
tgcagttcaaatcctcacca

SEQ ID NO: 5455483 - DNA, 15 bp, Homo sapiens
tgcagttcagcacca

SEQ ID NO: 5455484 - DNA, 18 bp, Homo sapiens
tgcagttcagcaccaccc

SEQ ID NO: 5455485 - DNA, 24 bp, Homo sapiens
tgcatttaaatacagtcttccatt

SEQ ID NO: 5455486 - DNA, 14 bp, Homo sapiens
tgcatttaaggaga

SEQ ID NO: 5455487 - DNA, 14 bp, Homo sapiens
tgcatttaagttgt

SEQ ID NO: 5455488 - DNA, 15 bp, Homo sapiens
tgcatttaataaaga

SEQ ID NO: 5455489 - DNA, 20 bp, Homo sapiens
tgcatttaataaagatgagt

SEQ ID NO: 5455490 - DNA, 15 bp, Homo sapiens
tgcatttaccactgt

SEQ ID NO: 5455491 - DNA, 17 bp, Homo sapiens
tgcatttaccactgtat

SEQ ID NO: 5455492 - DNA, 18 bp, Homo sapiens
tgcatttaccggcagtgc

SEQ ID NO: 5455493 - DNA, 21 bp, Homo sapiens
tgcatttacgcctgtaaatgt

SEQ ID NO: 5455494 - DNA, 22 bp, Homo sapiens
tgcatttagcacaaaaaaaatt

SEQ ID NO: 5455495 - DNA, 12 bp, Homo sapiens
tgcatttagcat

SEQ ID NO: 5455496 - DNA, 16 bp, Homo sapiens
tgcatttagcatgagt

SEQ ID NO: 5455497 - DNA, 20 bp, Homo sapiens
tgcatttagcatgagttctg

SEQ ID NO: 5455498 - DNA, 22 bp, Homo sapiens
tgcatttagcttctttccctta

SEQ ID NO: 5455499 - DNA, 15 bp, Homo sapiens
tgcatttataaatgt

SEQ ID NO: 5455500 - DNA, 16 bp, Homo sapiens
tgcatttataaatgtg

SEQ ID NO: 5455501 - DNA, 20 bp, Homo sapiens
tgcatttatagatcatttct

SEQ ID NO: 5455502 - DNA, 20 bp, Homo sapiens
tgcatttatgagctcttcat

SEQ ID NO: 5455503 - DNA, 15 bp, Homo sapiens
tgcatttatgcatga

SEQ ID NO: 5455504 - DNA, 22 bp, Homo sapiens
tgcatttatttatacagtgcct

SEQ ID NO: 5455505 - DNA, 23 bp, Homo sapiens
tgcatttatttatacagtgcctt

SEQ ID NO: 5455506 - DNA, 15 bp, Homo sapiens
tgcatttcaaatgtt

SEQ ID NO: 5455507 - DNA, 18 bp, Homo sapiens
tgcatttcaatttcaatg

SEQ ID NO: 5455508 - DNA, 15 bp, Homo sapiens
tgcatttcacctgtg

SEQ ID NO: 5455509 - DNA, 12 bp, Homo sapiens
tgcatttcagaa

SEQ ID NO: 5455510 - DNA, 12 bp, Homo sapiens
tgcatttcatgc

SEQ ID NO: 5455511 - DNA, 15 bp, Homo sapiens
tgcatttcctgtgtt

SEQ ID NO: 5455512 - DNA, 18 bp, Homo sapiens
tgcatttcctgtgtttgt

SEQ ID NO: 5455513 - DNA, 23 bp, Homo sapiens
tgcatttctatgccatttttagt

SEQ ID NO: 5455514 - DNA, 14 bp, Homo sapiens
tgcatttctcttct

SEQ ID NO: 5455515 - DNA, 22 bp, Homo sapiens
tgcatttctcttctcagctctt

SEQ ID NO: 5455516 - DNA, 13 bp, Homo sapiens
tgcatttctgggc

SEQ ID NO: 5455517 - DNA, 14 bp, Homo sapiens
tgcatttctgggcc

SEQ ID NO: 5455518 - DNA, 12 bp, Homo sapiens
tgcatttctgta

SEQ ID NO: 5455519 - DNA, 21 bp, Homo sapiens
tgcatttctgtattttttgtt

SEQ ID NO: 5455520 - DNA, 15 bp, Homo sapiens
tgcatttctgtctct

SEQ ID NO: 5455521 - DNA, 23 bp, Homo sapiens
tgcatttcttgacttcacagcag

SEQ ID NO: 5455522 - DNA, 23 bp, Homo sapiens
tgcatttgaaaattttgatgttt

SEQ ID NO: 5455523 - DNA, 22 bp, Homo sapiens
tgcatttgaggggccaggggca

SEQ ID NO: 5455524 - DNA, 16 bp, Homo sapiens
tgcatttgatacattt

SEQ ID NO: 5455525 - DNA, 14 bp, Homo sapiens
tgcatttgcctgct

SEQ ID NO: 5455526 - DNA, 17 bp, Homo sapiens
tgcatttgcctgcttct

SEQ ID NO: 5455527 - DNA, 13 bp, Homo sapiens
tgcatttggaaca

SEQ ID NO: 5455528 - DNA, 20 bp, Homo sapiens
tgcatttggagggagtgagt

SEQ ID NO: 5455529 - DNA, 16 bp, Homo sapiens
tgcatttggctggagc

SEQ ID NO: 5455530 - DNA, 17 bp, Homo sapiens
tgcatttgggtccagga

SEQ ID NO: 5455531 - DNA, 18 bp, Homo sapiens
tgcatttgggtccaggag

SEQ ID NO: 5455532 - DNA, 20 bp, Homo sapiens
tgcatttgggtccaggagga

SEQ ID NO: 5455533 - DNA, 21 bp, Homo sapiens
tgcatttggtggtttcagaaa

SEQ ID NO: 5455534 - DNA, 17 bp, Homo sapiens
tgcatttgtaaaaatga

SEQ ID NO: 5455535 - DNA, 17 bp, Homo sapiens
tgcatttgtaccttatt

SEQ ID NO: 5455536 - DNA, 14 bp, Homo sapiens
tgcatttgttacag

SEQ ID NO: 5455537 - DNA, 13 bp, Homo sapiens
tgcatttgttcag

SEQ ID NO: 5455538 - DNA, 18 bp, Homo sapiens
tgcatttgttcagctccc

SEQ ID NO: 5455539 - DNA, 20 bp, Homo sapiens
tgcatttgtttatgtaattt

SEQ ID NO: 5455540 - DNA, 14 bp, Homo sapiens
tgcattttaagcat

SEQ ID NO: 5455541 - DNA, 13 bp, Homo sapiens
tgcattttacaca

SEQ ID NO: 5455542 - DNA, 20 bp, Homo sapiens
tgcattttacacattgacaa

SEQ ID NO: 5455543 - DNA, 13 bp, Homo sapiens
tgcattttacagt

SEQ ID NO: 5455544 - DNA, 19 bp, Homo sapiens
tgcattttatgtgaccttg

SEQ ID NO: 5455545 - DNA, 15 bp, Homo sapiens
tgcattttcacaaca

SEQ ID NO: 5455546 - DNA, 17 bp, Homo sapiens
tgcattttcaccccacc

SEQ ID NO: 5455547 - DNA, 16 bp, Homo sapiens
tgcattttcctcttgt

SEQ ID NO: 5455548 - DNA, 20 bp, Homo sapiens
tgcattttcctcttgtcctg

SEQ ID NO: 5455549 - DNA, 14 bp, Homo sapiens
tgcattttctcagg

SEQ ID NO: 5455550 - DNA, 18 bp, Homo sapiens
tgcattttctcaggcagt

SEQ ID NO: 5455551 - DNA, 11 bp, Homo sapiens
tgcattttctg

SEQ ID NO: 5455552 - DNA, 19 bp, Homo sapiens
tgcattttctgaaactaat

SEQ ID NO: 5455553 - DNA, 16 bp, Homo sapiens
tgcattttctgggttc

SEQ ID NO: 5455554 - DNA, 23 bp, Homo sapiens
tgcattttctgggttctgggtgg

SEQ ID NO: 5455555 - DNA, 15 bp, Homo sapiens
tgcattttcttcaca

SEQ ID NO: 5455556 - DNA, 18 bp, Homo sapiens
tgcattttcttcagaatt

SEQ ID NO: 5455557 - DNA, 19 bp, Homo sapiens
tgcattttcttcagaatta

SEQ ID NO: 5455558 - DNA, 17 bp, Homo sapiens
tgcattttgcactagaa

SEQ ID NO: 5455559 - DNA, 18 bp, Homo sapiens
tgcattttgcactagaac

SEQ ID NO: 5455560 - DNA, 16 bp, Homo sapiens
tgcattttgctattgt

SEQ ID NO: 5455561 - DNA, 19 bp, Homo sapiens
tgcattttgctattgtaaa

SEQ ID NO: 5455562 - DNA, 17 bp, Homo sapiens
tgcattttggaaggctg

SEQ ID NO: 5455563 - DNA, 17 bp, Homo sapiens
tgcattttgtgtacagt

SEQ ID NO: 5455564 - DNA, 20 bp, Homo sapiens
tgcattttgtttctgtatat

SEQ ID NO: 5455565 - DNA, 22 bp, Homo sapiens
tgcattttgtttggtattgtat

SEQ ID NO: 5455566 - DNA, 13 bp, Homo sapiens
tgcatttttaaaa

SEQ ID NO: 5455567 - DNA, 16 bp, Homo sapiens
tgcatttttaaaacta

SEQ ID NO: 5455568 - DNA, 17 bp, Homo sapiens
tgcatttttaaacttga

SEQ ID NO: 5455569 - DNA, 19 bp, Homo sapiens
tgcatttttaaacttgaaa

SEQ ID NO: 5455570 - DNA, 21 bp, Homo sapiens
tgcatttttaaacttgaaata

SEQ ID NO: 5455571 - DNA, 19 bp, Homo sapiens
tgcatttttaatcagtgga

SEQ ID NO: 5455572 - DNA, 15 bp, Homo sapiens
tgcatttttaccttt

SEQ ID NO: 5455573 - DNA, 22 bp, Homo sapiens
tgcatttttatctgtgagttct

SEQ ID NO: 5455574 - DNA, 13 bp, Homo sapiens
tgcatttttctgc

SEQ ID NO: 5455575 - DNA, 20 bp, Homo sapiens
tgcatttttggatcattttt

SEQ ID NO: 5455576 - DNA, 22 bp, Homo sapiens
tgcatttttgtaaatgtgtaca

SEQ ID NO: 5455577 - DNA, 16 bp, Homo sapiens
tgcatttttgtgaaat

SEQ ID NO: 5455578 - DNA, 20 bp, Homo sapiens
tgcatttttgttttgaaagt

SEQ ID NO: 5455579 - DNA, 15 bp, Homo sapiens
tgcattttttaaaac

SEQ ID NO: 5455580 - DNA, 17 bp, Homo sapiens
tgcattttttaaaacaa

SEQ ID NO: 5455581 - DNA, 16 bp, Homo sapiens
tgcattttttaaattt

SEQ ID NO: 5455582 - DNA, 16 bp, Homo sapiens
tgccaaaaaaaaatac

SEQ ID NO: 5455583 - DNA, 15 bp, Homo sapiens
tgccaaaaacaaaat

SEQ ID NO: 5455584 - DNA, 16 bp, Homo sapiens
tgccaaaaagtgaaat

SEQ ID NO: 5455585 - DNA, 18 bp, Homo sapiens
tgccaaaaagtgaaataa

SEQ ID NO: 5455586 - DNA, 15 bp, Homo sapiens
tgccaaaaattcatg

SEQ ID NO: 5455587 - DNA, 19 bp, Homo sapiens
tgccaaaacatttatgaca

SEQ ID NO: 5455588 - DNA, 16 bp, Homo sapiens
tgccaaaaccaaattg

SEQ ID NO: 5455589 - DNA, 16 bp, Homo sapiens
tgccaaaaccacatgg

SEQ ID NO: 5455590 - DNA, 17 bp, Homo sapiens
tgccaaaaccaggcctc

SEQ ID NO: 5455591 - DNA, 20 bp, Homo sapiens
tgccaaaaccaggcctctgc

SEQ ID NO: 5455592 - DNA, 22 bp, Homo sapiens
tgccaaaaccaggcctctgctg

SEQ ID NO: 5455593 - DNA, 19 bp, Homo sapiens
tgccaaaacccagctgcac

SEQ ID NO: 5455594 - DNA, 21 bp, Homo sapiens
tgccaaaagctggaggaacca

SEQ ID NO: 5455595 - DNA, 16 bp, Homo sapiens
tgccaaaaggcccctt

SEQ ID NO: 5455596 - DNA, 17 bp, Homo sapiens
tgccaaaataatgtctt

SEQ ID NO: 5455597 - DNA, 18 bp, Homo sapiens
tgccaaaataatgtcttg

SEQ ID NO: 5455598 - DNA, 16 bp, Homo sapiens
tgccaaaatgacttta

SEQ ID NO: 5455599 - DNA, 17 bp, Homo sapiens
tgccaaaatgctctagt

SEQ ID NO: 5455600 - DNA, 23 bp, Homo sapiens
tgccaaaatgttggctgcgtact

SEQ ID NO: 5455601 - DNA, 17 bp, Homo sapiens
tgccaaaattcatttct

SEQ ID NO: 5455602 - DNA, 12 bp, Homo sapiens
tgccaaacatta

SEQ ID NO: 5455603 - DNA, 19 bp, Homo sapiens
tgccaaacattaatgttga

SEQ ID NO: 5455604 - DNA, 17 bp, Homo sapiens
tgccaaaccacaagact

SEQ ID NO: 5455605 - DNA, 20 bp, Homo sapiens
tgccaaacccagcccctgcg

SEQ ID NO: 5455606 - DNA, 22 bp, Homo sapiens
tgccaaacccagcccctgcggc

SEQ ID NO: 5455607 - DNA, 19 bp, Homo sapiens
tgccaaacctttaaatttt

SEQ ID NO: 5455608 - DNA, 17 bp, Homo sapiens
tgccaaagaagcagacc

SEQ ID NO: 5455609 - DNA, 21 bp, Homo sapiens
tgccaaagatcacttgttgtt

SEQ ID NO: 5455610 - DNA, 19 bp, Homo sapiens
tgccaaagatgtttgaaaa

SEQ ID NO: 5455611 - DNA, 14 bp, Homo sapiens
tgccaaagcagaca

SEQ ID NO: 5455612 - DNA, 21 bp, Homo sapiens
tgccaaagcagattttcctaa

SEQ ID NO: 5455613 - DNA, 16 bp, Homo sapiens
tgccaaagccattctc

SEQ ID NO: 5455614 - DNA, 22 bp, Homo sapiens
tgccaaagctagggtggccctt

SEQ ID NO: 5455615 - DNA, 15 bp, Homo sapiens
tgccaaagctgcttt

SEQ ID NO: 5455616 - DNA, 15 bp, Homo sapiens
tgccaaagcttgtgg

SEQ ID NO: 5455617 - DNA, 17 bp, Homo sapiens
tgccaaaggatgtgata

SEQ ID NO: 5455618 - DNA, 18 bp, Homo sapiens
tgccaaagtagtcctggc

SEQ ID NO: 5455619 - DNA, 18 bp, Homo sapiens
tgccaaataaaaaacaga

SEQ ID NO: 5455620 - DNA, 14 bp, Homo sapiens
tgccaaataaacag

SEQ ID NO: 5455621 - DNA, 15 bp, Homo sapiens
tgccaaataaacagc

SEQ ID NO: 5455622 - DNA, 16 bp, Homo sapiens
tgccaaataaacagct

SEQ ID NO: 5455623 - DNA, 19 bp, Homo sapiens
tgccaaataaacagctatt

SEQ ID NO: 5455624 - DNA, 20 bp, Homo sapiens
tgccaaatagccccagactg

SEQ ID NO: 5455625 - DNA, 16 bp, Homo sapiens
tgccaaatatgtcctg

SEQ ID NO: 5455626 - DNA, 17 bp, Homo sapiens
tgccaaatatgtcctgg

SEQ ID NO: 5455627 - DNA, 14 bp, Homo sapiens
tgccaaatcagttt

SEQ ID NO: 5455628 - DNA, 16 bp, Homo sapiens
tgccaaatcctgggca

SEQ ID NO: 5455629 - DNA, 23 bp, Homo sapiens
tgccaaatcctgggcatccccag

SEQ ID NO: 5455630 - DNA, 14 bp, Homo sapiens
tgccaaatgctggg

SEQ ID NO: 5455631 - DNA, 24 bp, Homo sapiens
tgccaaattgagataatgatactt

SEQ ID NO: 5455632 - DNA, 22 bp, Homo sapiens
tgccaaattgctgcatatttgt

SEQ ID NO: 5455633 - DNA, 15 bp, Homo sapiens
tgccaacaagaatgc

SEQ ID NO: 5455634 - DNA, 16 bp, Homo sapiens
tgccaacaagaatgca

SEQ ID NO: 5455635 - DNA, 15 bp, Homo sapiens
tgccaacaatcctag

SEQ ID NO: 5455636 - DNA, 23 bp, Homo sapiens
tgccaacaccttcttggcttctg

SEQ ID NO: 5455637 - DNA, 20 bp, Homo sapiens
tgccaacactcaagaagcag

SEQ ID NO: 5455638 - DNA, 18 bp, Homo sapiens
tgccaacacttaatcatt

SEQ ID NO: 5455639 - DNA, 19 bp, Homo sapiens
tgccaacagacactacatt

SEQ ID NO: 5455640 - DNA, 22 bp, Homo sapiens
tgccaacatacccttctttaaa

SEQ ID NO: 5455641 - DNA, 23 bp, Homo sapiens
tgccaacatgaggacagaaggac

SEQ ID NO: 5455642 - DNA, 12 bp, Homo sapiens
tgccaacattgc

SEQ ID NO: 5455643 - DNA, 16 bp, Homo sapiens
tgccaaccacctctgg

SEQ ID NO: 5455644 - DNA, 16 bp, Homo sapiens
tgccaaccctcccggg

SEQ ID NO: 5455645 - DNA, 18 bp, Homo sapiens
tgccaacctaaaactctt

SEQ ID NO: 5455646 - DNA, 23 bp, Homo sapiens
tgccaacctgatgccccttcccc

SEQ ID NO: 5455647 - DNA, 19 bp, Homo sapiens
tgccaacctgtaataaata

SEQ ID NO: 5455648 - DNA, 23 bp, Homo sapiens
tgccaacctgtaataaatatgag

SEQ ID NO: 5455649 - DNA, 14 bp, Homo sapiens
tgccaactccatct

SEQ ID NO: 5455650 - DNA, 18 bp, Homo sapiens
tgccaactccatgaccag

SEQ ID NO: 5455651 - DNA, 19 bp, Homo sapiens
tgccaactccatgaccagg

SEQ ID NO: 5455652 - DNA, 21 bp, Homo sapiens
tgccaactccatgaccaggcc

SEQ ID NO: 5455653 - DNA, 23 bp, Homo sapiens
tgccaactccatgaccaggccac

SEQ ID NO: 5455654 - DNA, 13 bp, Homo sapiens
tgccaactcctca

SEQ ID NO: 5455655 - DNA, 21 bp, Homo sapiens
tgccaactgaagccttcttct

SEQ ID NO: 5455656 - DNA, 23 bp, Homo sapiens
tgccaactgaagccttcttctgc

SEQ ID NO: 5455657 - DNA, 24 bp, Homo sapiens
tgccaactgaagccttcttctgcc

SEQ ID NO: 5455658 - DNA, 16 bp, Homo sapiens
tgccaactggtcactg

SEQ ID NO: 5455659 - DNA, 16 bp, Homo sapiens
tgccaactgtggctgg

SEQ ID NO: 5455660 - DNA, 22 bp, Homo sapiens
tgccaactgttcagctgtcctc

SEQ ID NO: 5455661 - DNA, 18 bp, Homo sapiens
tgccatcaaactgtaaaa

SEQ ID NO: 5455662 - DNA, 23 bp, Homo sapiens
tgccatcaccacggctcactgca

SEQ ID NO: 5455663 - DNA, 19 bp, Homo sapiens
tgccatcaccgctgggtgg

SEQ ID NO: 5455664 - DNA, 15 bp, Homo sapiens
tgccatcacgcttgt

SEQ ID NO: 5455665 - DNA, 13 bp, Homo sapiens
tgccatcactggt

SEQ ID NO: 5455666 - DNA, 21 bp, Homo sapiens
tgccatcactggtccaggtct

SEQ ID NO: 5455667 - DNA, 18 bp, Homo sapiens
tgccatcagaaattttct

SEQ ID NO: 5455668 - DNA, 15 bp, Homo sapiens
tgccatcagcccctg

SEQ ID NO: 5455669 - DNA, 16 bp, Homo sapiens
tgccatcagcccctgg

SEQ ID NO: 5455670 - DNA, 19 bp, Homo sapiens
tgccatcagcccctgggaa

SEQ ID NO: 5455671 - DNA, 22 bp, Homo sapiens
tgccatcatttttgatgactac

SEQ ID NO: 5455672 - DNA, 21 bp, Homo sapiens
tgccatccacattttaacagt

SEQ ID NO: 5455673 - DNA, 21 bp, Homo sapiens
tgccatccagatgtgtgcaat

SEQ ID NO: 5455674 - DNA, 12 bp, Homo sapiens
tgccatccaggt

SEQ ID NO: 5455675 - DNA, 20 bp, Homo sapiens
tgccatccaggttcagcttg

SEQ ID NO: 5455676 - DNA, 21 bp, Homo sapiens
tgccatccaggttcagcttgt

SEQ ID NO: 5455677 - DNA, 15 bp, Homo sapiens
tgccatccagttttg

SEQ ID NO: 5455678 - DNA, 21 bp, Homo sapiens
tgccatccccctctcacgcca

SEQ ID NO: 5455679 - DNA, 13 bp, Homo sapiens
tgccatccctgag

SEQ ID NO: 5455680 - DNA, 23 bp, Homo sapiens
tgccatcctcaaacactgcaggc

SEQ ID NO: 5455681 - DNA, 13 bp, Homo sapiens
tgccatcctggcc

SEQ ID NO: 5455682 - DNA, 15 bp, Homo sapiens
tgccatcctggccca

SEQ ID NO: 5455683 - DNA, 16 bp, Homo sapiens
tgccatcctggcccag

SEQ ID NO: 5455684 - DNA, 21 bp, Homo sapiens
tgccatcctggcccagggcat

SEQ ID NO: 5455685 - DNA, 17 bp, Homo sapiens
tgccatctagccagccc

SEQ ID NO: 5455686 - DNA, 18 bp, Homo sapiens
tgccatctagccagcccc

SEQ ID NO: 5455687 - DNA, 21 bp, Homo sapiens
tgccatctcacctcctgctgg

SEQ ID NO: 5455688 - DNA, 21 bp, Homo sapiens
tgccatctccaccctgagcct

SEQ ID NO: 5455689 - DNA, 23 bp, Homo sapiens
tgccatctgtacatattactgtt

SEQ ID NO: 5455690 - DNA, 12 bp, Homo sapiens
tgccatctgtag

SEQ ID NO: 5455691 - DNA, 15 bp, Homo sapiens
tgccatctgttcatt

SEQ ID NO: 5455692 - DNA, 18 bp, Homo sapiens
tgccatctgttcatttct

SEQ ID NO: 5455693 - DNA, 22 bp, Homo sapiens
tgccatctgttcatttctaaat

SEQ ID NO: 5455694 - DNA, 14 bp, Homo sapiens
tgccatcttccata

SEQ ID NO: 5455695 - DNA, 15 bp, Homo sapiens
tgccatcttcccagc

SEQ ID NO: 5455696 - DNA, 12 bp, Homo sapiens
tgccatgaacaa

SEQ ID NO: 5455697 - DNA, 13 bp, Homo sapiens
tgccatgaacaaa

SEQ ID NO: 5455698 - DNA, 17 bp, Homo sapiens
tgccatgaacaaattct

SEQ ID NO: 5455699 - DNA, 18 bp, Homo sapiens
tgccatgaacaaattctt

SEQ ID NO: 5455700 - DNA, 19 bp, Homo sapiens
tgccatgaactggaggcca

SEQ ID NO: 5455701 - DNA, 13 bp, Homo sapiens
tgccatgaagaca

SEQ ID NO: 5455702 - DNA, 18 bp, Homo sapiens
tgccatgaaggcacctgc

SEQ ID NO: 5455703 - DNA, 20 bp, Homo sapiens
tgccatgaaggcacctgccc

SEQ ID NO: 5455704 - DNA, 15 bp, Homo sapiens
tgccatgacatttca

SEQ ID NO: 5455705 - DNA, 16 bp, Homo sapiens
tgccatgacatttcat

SEQ ID NO: 5455706 - DNA, 18 bp, Homo sapiens
tgccatgacatttcatct

SEQ ID NO: 5455707 - DNA, 18 bp, Homo sapiens
tgccatgactgctcaggc

SEQ ID NO: 5455708 - DNA, 22 bp, Homo sapiens
tgccatgactgctcaggcctca

SEQ ID NO: 5455709 - DNA, 18 bp, Homo sapiens
tgccatgagccgcccaag

SEQ ID NO: 5455710 - DNA, 20 bp, Homo sapiens
tgccatgagccgcccaaggc

SEQ ID NO: 5455711 - DNA, 23 bp, Homo sapiens
tgccatgagtccatgtcctatgc

SEQ ID NO: 5455712 - DNA, 15 bp, Homo sapiens
tgccatgatagctgg

SEQ ID NO: 5455713 - DNA, 19 bp, Homo sapiens
tgccatgatgcctctgtct

SEQ ID NO: 5455714 - DNA, 21 bp, Homo sapiens
tgccatgatgcctctgtcttc

SEQ ID NO: 5455715 - DNA, 15 bp, Homo sapiens
tgccatgatgtatat

SEQ ID NO: 5455716 - DNA, 22 bp, Homo sapiens
tgccatgatttttggtatttat

SEQ ID NO: 5455717 - DNA, 15 bp, Homo sapiens
tgccatgcaggaaga

SEQ ID NO: 5455718 - DNA, 21 bp, Homo sapiens
tgccatgcaggaagaggccca

SEQ ID NO: 5455719 - DNA, 13 bp, Homo sapiens
tgccatgccactg

SEQ ID NO: 5455720 - DNA, 19 bp, Homo sapiens
tgccatgccactgccaggc

SEQ ID NO: 5455721 - DNA, 21 bp, Homo sapiens
tgccatgccactgccaggcac

SEQ ID NO: 5455722 - DNA, 14 bp, Homo sapiens
tgccatgcccacca

SEQ ID NO: 5455723 - DNA, 20 bp, Homo sapiens
tgccatgcccttacacgtgc

SEQ ID NO: 5455724 - DNA, 17 bp, Homo sapiens
tgccatgcctgctccct

SEQ ID NO: 5455725 - DNA, 20 bp, Homo sapiens
tgccatgctatgtgcacagc

SEQ ID NO: 5455726 - DNA, 18 bp, Homo sapiens
tgccatgctgctatgaag

SEQ ID NO: 5455727 - DNA, 13 bp, Homo sapiens
tgccatgctggcc

SEQ ID NO: 5455728 - DNA, 13 bp, Homo sapiens
tgccatgctgggc

SEQ ID NO: 5455729 - DNA, 19 bp, Homo sapiens
tgccatgctgggccactgg

SEQ ID NO: 5455730 - DNA, 20 bp, Homo sapiens
tgccatgcttcagtgaacat

SEQ ID NO: 5455731 - DNA, 19 bp, Homo sapiens
tgccatgctttttggtgag

SEQ ID NO: 5455732 - DNA, 14 bp, Homo sapiens
tgccatggaagagg

SEQ ID NO: 5455733 - DNA, 16 bp, Homo sapiens
tgccatggaagaggct

SEQ ID NO: 5455734 - DNA, 23 bp, Homo sapiens
tgccatggaagaggctacagggc

SEQ ID NO: 5455735 - DNA, 17 bp, Homo sapiens
tgccatggaatgactga

SEQ ID NO: 5455736 - DNA, 18 bp, Homo sapiens
tgccatggacagaagaag

SEQ ID NO: 5455737 - DNA, 20 bp, Homo sapiens
tgccatggacagaagaaggc

SEQ ID NO: 5455738 - DNA, 22 bp, Homo sapiens
tgccatggagatctgaaggggc

SEQ ID NO: 5455739 - DNA, 16 bp, Homo sapiens
tgccatggaggcacac

SEQ ID NO: 5455740 - DNA, 16 bp, Homo sapiens
tgccatggaggcgcct

SEQ ID NO: 5455741 - DNA, 19 bp, Homo sapiens
tgccatggaggcgccttcc

SEQ ID NO: 5455742 - DNA, 22 bp, Homo sapiens
tgccatggaggcgccttcctgg

SEQ ID NO: 5455743 - DNA, 21 bp, Homo sapiens
tgccatggatctgatctgtac

SEQ ID NO: 5455744 - DNA, 13 bp, Homo sapiens
tgccatggctggg

SEQ ID NO: 5455745 - DNA, 12 bp, Homo sapiens
tgccatggctgt

SEQ ID NO: 5455746 - DNA, 17 bp, Homo sapiens
tgccatgggagagtcca

SEQ ID NO: 5455747 - DNA, 18 bp, Homo sapiens
tgccatgggagagtccag

SEQ ID NO: 5455748 - DNA, 14 bp, Homo sapiens
tgccatgggccagc

SEQ ID NO: 5455749 - DNA, 17 bp, Homo sapiens
tgccatgggcctgctgc

SEQ ID NO: 5455750 - DNA, 20 bp, Homo sapiens
tgccatgggcttcactgtat

SEQ ID NO: 5455751 - DNA, 22 bp, Homo sapiens
tgccatgggcttcactgtataa

SEQ ID NO: 5455752 - DNA, 18 bp, Homo sapiens
tgccatgggtgcagaccc

SEQ ID NO: 5455753 - DNA, 16 bp, Homo sapiens
tgccatggtctttgct

SEQ ID NO: 5455754 - DNA, 23 bp, Homo sapiens
tgccatgtaaaggcctttaataa

SEQ ID NO: 5455755 - DNA, 14 bp, Homo sapiens
tgccatgtaaggtt

SEQ ID NO: 5455756 - DNA, 23 bp, Homo sapiens
tgccatgtaaggttgtgcagggt

SEQ ID NO: 5455757 - DNA, 22 bp, Homo sapiens
tgccatgtacctcccctgcctt

SEQ ID NO: 5455758 - DNA, 22 bp, Homo sapiens
tgccatgtagaccccttgaaga

SEQ ID NO: 5455759 - DNA, 20 bp, Homo sapiens
tgccatgtagggttccctta

SEQ ID NO: 5455760 - DNA, 13 bp, Homo sapiens
tgccatgtagttg

SEQ ID NO: 5455761 - DNA, 19 bp, Homo sapiens
tgccatgtatgttgcatga

SEQ ID NO: 5455762 - DNA, 18 bp, Homo sapiens
tgccatgtcaaacaaata

SEQ ID NO: 5455763 - DNA, 14 bp, Homo sapiens
tgccatgtcacagc

SEQ ID NO: 5455764 - DNA, 22 bp, Homo sapiens
tgccatgtcttgttcagaagac

SEQ ID NO: 5455765 - DNA, 22 bp, Homo sapiens
tgccatgtggaaggcaagccag

SEQ ID NO: 5455766 - DNA, 17 bp, Homo sapiens
tgccatgtgtgagtcac

SEQ ID NO: 5455767 - DNA, 17 bp, Homo sapiens
tgccatgttggccaggc

SEQ ID NO: 5455768 - DNA, 19 bp, Homo sapiens
tgccatgttggccaggctg

SEQ ID NO: 5455769 - DNA, 21 bp, Homo sapiens
tgccatgttggccaggctggt

SEQ ID NO: 5455770 - DNA, 21 bp, Homo sapiens
tgccatgttttgccaccccct

SEQ ID NO: 5455771 - DNA, 18 bp, Homo sapiens
tgccattaaaaaacagct

SEQ ID NO: 5455772 - DNA, 13 bp, Homo sapiens
tgccattaaatag

SEQ ID NO: 5455773 - DNA, 21 bp, Homo sapiens
tgccattaaatagggaaaaaa

SEQ ID NO: 5455774 - DNA, 19 bp, Homo sapiens
tgccattacactccagcct

SEQ ID NO: 5455775 - DNA, 14 bp, Homo sapiens
tgccattactactg

SEQ ID NO: 5455776 - DNA, 19 bp, Homo sapiens
tgccattagactgaattta

SEQ ID NO: 5455777 - DNA, 16 bp, Homo sapiens
tgccattatccctgaa

SEQ ID NO: 5455778 - DNA, 23 bp, Homo sapiens
tgccattatccctgaatccccct

SEQ ID NO: 5455779 - DNA, 13 bp, Homo sapiens
tgccattattcta

SEQ ID NO: 5455780 - DNA, 19 bp, Homo sapiens
tgccattattttctgtcag

SEQ ID NO: 5455781 - DNA, 20 bp, Homo sapiens
tgccattatttttgtagtta

SEQ ID NO: 5455782 - DNA, 16 bp, Homo sapiens
tgccattcatagagag

SEQ ID NO: 5455783 - DNA, 18 bp, Homo sapiens
tgccattcatagagagcc

SEQ ID NO: 5455784 - DNA, 19 bp, Homo sapiens
tgccattccactccactca

SEQ ID NO: 5455785 - DNA, 11 bp, Homo sapiens
tgccattccca

SEQ ID NO: 5455786 - DNA, 21 bp, Homo sapiens
tgccattctgcatgagctgat

SEQ ID NO: 5455787 - DNA, 14 bp, Homo sapiens
tgccattctgcctc

SEQ ID NO: 5455788 - DNA, 13 bp, Homo sapiens
tgccattcttctg

SEQ ID NO: 5455789 - DNA, 18 bp, Homo sapiens
tgccattcttctggtgct

SEQ ID NO: 5455790 - DNA, 21 bp, Homo sapiens
tgccattcttctggtgctact

SEQ ID NO: 5455791 - DNA, 19 bp, Homo sapiens
tgccattgaaggcttaatt

SEQ ID NO: 5455792 - DNA, 20 bp, Homo sapiens
tgccattgaaggcttaattg

SEQ ID NO: 5455793 - DNA, 21 bp, Homo sapiens
tgccattgaaggcttaattga

SEQ ID NO: 5455794 - DNA, 15 bp, Homo sapiens
tgccattgcactcca

SEQ ID NO: 5455795 - DNA, 16 bp, Homo sapiens
tgccattgccaggaga

SEQ ID NO: 5455796 - DNA, 20 bp, Homo sapiens
tgccattgccaggagatggc

SEQ ID NO: 5455797 - DNA, 13 bp, Homo sapiens
tgccattggcctc

SEQ ID NO: 5455798 - DNA, 16 bp, Homo sapiens
tgccattggcctcttg

SEQ ID NO: 5455799 - DNA, 19 bp, Homo sapiens
tgccattgggaccctccag

SEQ ID NO: 5455800 - DNA, 19 bp, Homo sapiens
tgccattggggtagttgtg

SEQ ID NO: 5455801 - DNA, 19 bp, Homo sapiens
tgccattgtactccagcct

SEQ ID NO: 5455802 - DNA, 11 bp, Homo sapiens
tgccattgtag

SEQ ID NO: 5455803 - DNA, 13 bp, Homo sapiens
tgccattgtcttt

SEQ ID NO: 5455804 - DNA, 14 bp, Homo sapiens
tgccattgtcttta

SEQ ID NO: 5455805 - DNA, 18 bp, Homo sapiens
tgccattgtctttatatg

SEQ ID NO: 5455806 - DNA, 17 bp, Homo sapiens
tgccattgtctttcctc

SEQ ID NO: 5455807 - DNA, 18 bp, Homo sapiens
tgccattgtctttcctcc

SEQ ID NO: 5455808 - DNA, 16 bp, Homo sapiens
tgccatttagaatcta

SEQ ID NO: 5455809 - DNA, 19 bp, Homo sapiens
tgccatttagaatctagaa

SEQ ID NO: 5455810 - DNA, 16 bp, Homo sapiens
tgccatttatttcctc

SEQ ID NO: 5455811 - DNA, 15 bp, Homo sapiens
tgccatttcatgtcc

SEQ ID NO: 5455812 - DNA, 19 bp, Homo sapiens
tgccatttccctgaacaga

SEQ ID NO: 5455813 - DNA, 13 bp, Homo sapiens
tgccatttccctt

SEQ ID NO: 5455814 - DNA, 17 bp, Homo sapiens
tgccatttcctcctggg

SEQ ID NO: 5455815 - DNA, 17 bp, Homo sapiens
tgccatttcctgtctgg

SEQ ID NO: 5455816 - DNA, 14 bp, Homo sapiens
tgccatttctctgc

SEQ ID NO: 5455817 - DNA, 21 bp, Homo sapiens
tgccatttctgaactgttaca

SEQ ID NO: 5455818 - DNA, 16 bp, Homo sapiens
tgccatttcttctctc

SEQ ID NO: 5455819 - DNA, 22 bp, Homo sapiens
tgccatttcttctctctgttcc

SEQ ID NO: 5455820 - DNA, 14 bp, Homo sapiens
tgccatttcttctt

SEQ ID NO: 5455821 - DNA, 15 bp, Homo sapiens
tgccatttctttata

SEQ ID NO: 5455822 - DNA, 17 bp, Homo sapiens
tgccatttgatacccct

SEQ ID NO: 5455823 - DNA, 17 bp, Homo sapiens
tgccatttgcaccctcc

SEQ ID NO: 5455824 - DNA, 23 bp, Homo sapiens
tgccatttgtactgaccccatca

SEQ ID NO: 5455825 - DNA, 13 bp, Homo sapiens
tgccatttgtctt

SEQ ID NO: 5455826 - DNA, 18 bp, Homo sapiens
tgccattttaaattttat

SEQ ID NO: 5455827 - DNA, 23 bp, Homo sapiens
tgccattttaaattttattttta

SEQ ID NO: 5455828 - DNA, 16 bp, Homo sapiens
tgccattttaaggaaa

SEQ ID NO: 5455829 - DNA, 20 bp, Homo sapiens
tgccattttaaggaaaacta

SEQ ID NO: 5455830 - DNA, 14 bp, Homo sapiens
tgccattttaataa

SEQ ID NO: 5455831 - DNA, 17 bp, Homo sapiens
tgccattttaataaaat

SEQ ID NO: 5455832 - DNA, 18 bp, Homo sapiens
tgccattttaataaaatg

SEQ ID NO: 5455833 - DNA, 22 bp, Homo sapiens
tgccattttattaaacattttc

SEQ ID NO: 5455834 - DNA, 21 bp, Homo sapiens
tgccatttttagtttaaaatc

SEQ ID NO: 5455835 - DNA, 18 bp, Homo sapiens
tgccatttttctataaat

SEQ ID NO: 5455836 - DNA, 23 bp, Homo sapiens
tgccattttttgtctgtgataac

SEQ ID NO: 5455837 - DNA, 21 bp, Homo sapiens
tgccccgtcaccatctcaggc

SEQ ID NO: 5455838 - DNA, 22 bp, Homo sapiens
tgccccgtccacggctctaggt

SEQ ID NO: 5455839 - DNA, 22 bp, Homo sapiens
tgccccgtccccctagagactc

SEQ ID NO: 5455840 - DNA, 21 bp, Homo sapiens
tgccccgtcccctgggccacc

SEQ ID NO: 5455841 - DNA, 23 bp, Homo sapiens
tgccccgtcccctgggccaccct

SEQ ID NO: 5455842 - DNA, 23 bp, Homo sapiens
tgccccgtcggactgcccccaga

SEQ ID NO: 5455843 - DNA, 14 bp, Homo sapiens
tgccccgtctctgt

SEQ ID NO: 5455844 - DNA, 16 bp, Homo sapiens
tgccccgtgcagactg

SEQ ID NO: 5455845 - DNA, 17 bp, Homo sapiens
tgccccgtgtgaatgta

SEQ ID NO: 5455846 - DNA, 18 bp, Homo sapiens
tgccccgtgtgaatgtag

SEQ ID NO: 5455847 - DNA, 20 bp, Homo sapiens
tgccccgtgtgtgtggccgg

SEQ ID NO: 5455848 - DNA, 19 bp, Homo sapiens
tgccccgttccctgtcaga

SEQ ID NO: 5455849 - DNA, 17 bp, Homo sapiens
tgccccgttgcttcccg

SEQ ID NO: 5455850 - DNA, 23 bp, Homo sapiens
tgcccctaaagagcatcctgata

SEQ ID NO: 5455851 - DNA, 23 bp, Homo sapiens
tgcccctaagctggctgtacctg

SEQ ID NO: 5455852 - DNA, 19 bp, Homo sapiens
tgcccctcaactctcctcc

SEQ ID NO: 5455853 - DNA, 23 bp, Homo sapiens
tgcccctcaactctcctccagag

SEQ ID NO: 5455854 - DNA, 15 bp, Homo sapiens
tgcccctccaagtca

SEQ ID NO: 5455855 - DNA, 15 bp, Homo sapiens
tgcccctcccaaccc

SEQ ID NO: 5455856 - DNA, 21 bp, Homo sapiens
tgcccctcccagaacacactc

SEQ ID NO: 5455857 - DNA, 17 bp, Homo sapiens
tgcccctcccatggccc

SEQ ID NO: 5455858 - DNA, 17 bp, Homo sapiens
tgcccctcccccaaccc

SEQ ID NO: 5455859 - DNA, 22 bp, Homo sapiens
tgcccctcccccaacccccacc

SEQ ID NO: 5455860 - DNA, 16 bp, Homo sapiens
tgcccctcccccactt

SEQ ID NO: 5455861 - DNA, 14 bp, Homo sapiens
tgcccctcccccag

SEQ ID NO: 5455862 - DNA, 15 bp, Homo sapiens
tgcccctccccgtcc

SEQ ID NO: 5455863 - DNA, 12 bp, Homo sapiens
tgcccctcccta

SEQ ID NO: 5455864 - DNA, 19 bp, Homo sapiens
tgcccctccctagatccag

SEQ ID NO: 5455865 - DNA, 22 bp, Homo sapiens
tgcccctccctgcctccaccca

SEQ ID NO: 5455866 - DNA, 17 bp, Homo sapiens
tgcccctccctgcttca

SEQ ID NO: 5455867 - DNA, 15 bp, Homo sapiens
tgcccctcccttcaa

SEQ ID NO: 5455868 - DNA, 16 bp, Homo sapiens
tgcccctcccttcaac

SEQ ID NO: 5455869 - DNA, 19 bp, Homo sapiens
tgcccctccgatgctgagg

SEQ ID NO: 5455870 - DNA, 18 bp, Homo sapiens
tgcccctccgtccccagg

SEQ ID NO: 5455871 - DNA, 17 bp, Homo sapiens
tgcccctcctctctgcc

SEQ ID NO: 5455872 - DNA, 19 bp, Homo sapiens
tgcccctcctctctgccct

SEQ ID NO: 5455873 - DNA, 17 bp, Homo sapiens
tgcccctcgcacacagg

SEQ ID NO: 5455874 - DNA, 14 bp, Homo sapiens
tgcccctctcacca

SEQ ID NO: 5455875 - DNA, 13 bp, Homo sapiens
tgcccctctgcct

SEQ ID NO: 5455876 - DNA, 15 bp, Homo sapiens
tgcccctctgccttg

SEQ ID NO: 5455877 - DNA, 16 bp, Homo sapiens
tgcccctctgccttgc

SEQ ID NO: 5455878 - DNA, 20 bp, Homo sapiens
tgcccctctgccttgccctc

SEQ ID NO: 5455879 - DNA, 12 bp, Homo sapiens
tgcccctctgtt

SEQ ID NO: 5455880 - DNA, 15 bp, Homo sapiens
tgcccctctgttctc

SEQ ID NO: 5455881 - DNA, 14 bp, Homo sapiens
tgcccctcttagaa

SEQ ID NO: 5455882 - DNA, 14 bp, Homo sapiens
tgcccctcttccaa

SEQ ID NO: 5455883 - DNA, 20 bp, Homo sapiens
tgcccctcttccaaaggcag

SEQ ID NO: 5455884 - DNA, 21 bp, Homo sapiens
tgcccctcttccaaaggcagc

SEQ ID NO: 5455885 - DNA, 13 bp, Homo sapiens
tgcccctctttct

SEQ ID NO: 5455886 - DNA, 14 bp, Homo sapiens
tgcccctctttctc

SEQ ID NO: 5455887 - DNA, 17 bp, Homo sapiens
tgcccctctttctcttt

SEQ ID NO: 5455888 - DNA, 23 bp, Homo sapiens
tgcccctgagcaatgtctgtgct

SEQ ID NO: 5455889 - DNA, 22 bp, Homo sapiens
tgcccctgagttctgacactgt

SEQ ID NO: 5455890 - DNA, 21 bp, Homo sapiens
tgcccctgatcactcccagca

SEQ ID NO: 5455891 - DNA, 24 bp, Homo sapiens
tgcccctgatcactcccagcactc

SEQ ID NO: 5455892 - DNA, 14 bp, Homo sapiens
tgcccctgatgcag

SEQ ID NO: 5455893 - DNA, 15 bp, Homo sapiens
tgcccctgcaaagac

SEQ ID NO: 5455894 - DNA, 13 bp, Homo sapiens
tgcccctgcacct

SEQ ID NO: 5455895 - DNA, 19 bp, Homo sapiens
tgcccctgcacctgcttct

SEQ ID NO: 5455896 - DNA, 15 bp, Homo sapiens
tgcccctgcagctgg

SEQ ID NO: 5455897 - DNA, 13 bp, Homo sapiens
tgcccctgcaggg

SEQ ID NO: 5455898 - DNA, 23 bp, Homo sapiens
tgcccctgcagttggcagaaagg

SEQ ID NO: 5455899 - DNA, 20 bp, Homo sapiens
tgcccctgcagtttggccct

SEQ ID NO: 5455900 - DNA, 21 bp, Homo sapiens
tgcccctgccccaacccccac

SEQ ID NO: 5455901 - DNA, 15 bp, Homo sapiens
tgcccctgccgcctg

SEQ ID NO: 5455902 - DNA, 15 bp, Homo sapiens
tgcccctgcctccca

SEQ ID NO: 5455903 - DNA, 19 bp, Homo sapiens
tgcccctgcgtggcctgag

SEQ ID NO: 5455904 - DNA, 20 bp, Homo sapiens
tgcccctgcgtggcctgagt

SEQ ID NO: 5455905 - DNA, 16 bp, Homo sapiens
tgcccctgctctgtag

SEQ ID NO: 5455906 - DNA, 11 bp, Homo sapiens
tgcccctgctg

SEQ ID NO: 5455907 - DNA, 12 bp, Homo sapiens
tgcccctgctgc

SEQ ID NO: 5455908 - DNA, 18 bp, Homo sapiens
tgcccctgctgtgctgct

SEQ ID NO: 5455909 - DNA, 20 bp, Homo sapiens
tgcccctgctgtgctgctca

SEQ ID NO: 5455910 - DNA, 21 bp, Homo sapiens
tgcccctgctgtgctgctcaa

SEQ ID NO: 5455911 - DNA, 19 bp, Homo sapiens
tgcccctggacctgggaac

SEQ ID NO: 5455912 - DNA, 15 bp, Homo sapiens
tgcccctggcaaatg

SEQ ID NO: 5455913 - DNA, 18 bp, Homo sapiens
tgcccctggcagcccctg

SEQ ID NO: 5455914 - DNA, 13 bp, Homo sapiens
tgcccctggccca

SEQ ID NO: 5455915 - DNA, 21 bp, Homo sapiens
tgcccctggcccatctcagcc

SEQ ID NO: 5455916 - DNA, 16 bp, Homo sapiens
tgcccctggccctgcc

SEQ ID NO: 5455917 - DNA, 17 bp, Homo sapiens
tgcccctggccctgcct

SEQ ID NO: 5455918 - DNA, 19 bp, Homo sapiens
tgcccctggccctgcctca

SEQ ID NO: 5455919 - DNA, 15 bp, Homo sapiens
tgcccctggccttgg

SEQ ID NO: 5455920 - DNA, 14 bp, Homo sapiens
tgcccctggctctg

SEQ ID NO: 5455921 - DNA, 15 bp, Homo sapiens
tgcccctggctttgc

SEQ ID NO: 5455922 - DNA, 18 bp, Homo sapiens
tgcccctggctttgcctc

SEQ ID NO: 5455923 - DNA, 19 bp, Homo sapiens
tgcccctggctttgcctct

SEQ ID NO: 5455924 - DNA, 20 bp, Homo sapiens
tgcccctggctttgcctctt

SEQ ID NO: 5455925 - DNA, 13 bp, Homo sapiens
tgcccctgggaac

SEQ ID NO: 5455926 - DNA, 12 bp, Homo sapiens
tgcccctgggat

SEQ ID NO: 5455927 - DNA, 13 bp, Homo sapiens
tgcccctgggatc

SEQ ID NO: 5455928 - DNA, 18 bp, Homo sapiens
tgcccctgggatccgagg

SEQ ID NO: 5455929 - DNA, 12 bp, Homo sapiens
tgcccctgtaaa

SEQ ID NO: 5455930 - DNA, 21 bp, Homo sapiens
tgcccctgtaggttgcttaaa

SEQ ID NO: 5455931 - DNA, 15 bp, Homo sapiens
tgcccctgtccggac

SEQ ID NO: 5455932 - DNA, 17 bp, Homo sapiens
tgcccctgtctggaaga

SEQ ID NO: 5455933 - DNA, 20 bp, Homo sapiens
tgcccctgtgctgcggggcc

SEQ ID NO: 5455934 - DNA, 23 bp, Homo sapiens
tgcccctgtgggactcatccttg

SEQ ID NO: 5455935 - DNA, 22 bp, Homo sapiens
tgccccttaaacacaggctgtc

SEQ ID NO: 5455936 - DNA, 17 bp, Homo sapiens
tgccccttaaccccaag

SEQ ID NO: 5455937 - DNA, 12 bp, Homo sapiens
tgccccttccac

SEQ ID NO: 5455938 - DNA, 19 bp, Homo sapiens
tgccccttcccatctcttc

SEQ ID NO: 5455939 - DNA, 22 bp, Homo sapiens
tgccccttccccatctccattt

SEQ ID NO: 5455940 - DNA, 18 bp, Homo sapiens
tgccccttccctgggttt

SEQ ID NO: 5455941 - DNA, 14 bp, Homo sapiens
tgccccttccgcca

SEQ ID NO: 5455942 - DNA, 17 bp, Homo sapiens
tgccccttccgccactg

SEQ ID NO: 5455943 - DNA, 14 bp, Homo sapiens
tgccccttctacac

SEQ ID NO: 5455944 - DNA, 22 bp, Homo sapiens
tgccccttctacactctcctgg

SEQ ID NO: 5455945 - DNA, 17 bp, Homo sapiens
tgccccttctccccttc

SEQ ID NO: 5455946 - DNA, 12 bp, Homo sapiens
tgccccttctta

SEQ ID NO: 5455947 - DNA, 16 bp, Homo sapiens
tgccccttcttgggcc

SEQ ID NO: 5455948 - DNA, 20 bp, Homo sapiens
tgccccttgacaactggcag

SEQ ID NO: 5455949 - DNA, 18 bp, Homo sapiens
tgccccttgcaagccata

SEQ ID NO: 5455950 - DNA, 19 bp, Homo sapiens
tgccccttgcaagccataa

SEQ ID NO: 5455951 - DNA, 22 bp, Homo sapiens
tgccccttgcaagccataacgt

SEQ ID NO: 5455952 - DNA, 12 bp, Homo sapiens
tgccccttgctt

SEQ ID NO: 5455953 - DNA, 13 bp, Homo sapiens
tgccccttgcttc

SEQ ID NO: 5455954 - DNA, 22 bp, Homo sapiens
tgccccttggctggatcaggga

SEQ ID NO: 5455955 - DNA, 13 bp, Homo sapiens
tgccccttgggca

SEQ ID NO: 5455956 - DNA, 21 bp, Homo sapiens
tgccccttgggcatccaccca

SEQ ID NO: 5455957 - DNA, 15 bp, Homo sapiens
tgccccttgggcctc

SEQ ID NO: 5455958 - DNA, 19 bp, Homo sapiens
tgccccttggtcctggcag

SEQ ID NO: 5455959 - DNA, 14 bp, Homo sapiens
tgccccttgtcctc

SEQ ID NO: 5455960 - DNA, 20 bp, Homo sapiens
tgcccctttccttcactgcc

SEQ ID NO: 5455961 - DNA, 17 bp, Homo sapiens
tgcccctttcttcccca

SEQ ID NO: 5455962 - DNA, 18 bp, Homo sapiens
tgcccctttcttccccac

SEQ ID NO: 5455963 - DNA, 19 bp, Homo sapiens
tgcccctttcttccccacc

SEQ ID NO: 5455964 - DNA, 23 bp, Homo sapiens
tgcccgaaactaagccaggcctg

SEQ ID NO: 5455965 - DNA, 15 bp, Homo sapiens
tgcccgactgactgg

SEQ ID NO: 5455966 - DNA, 18 bp, Homo sapiens
tgcccgagagagacccca

SEQ ID NO: 5455967 - DNA, 16 bp, Homo sapiens
tgcccgagagagctct

SEQ ID NO: 5455968 - DNA, 15 bp, Homo sapiens
tgcccgagagctctt

SEQ ID NO: 5455969 - DNA, 22 bp, Homo sapiens
tgcccgagagctcttagttttt

SEQ ID NO: 5455970 - DNA, 17 bp, Homo sapiens
tgcccgaggcgccagct

SEQ ID NO: 5455971 - DNA, 15 bp, Homo sapiens
tgcccgagggcagcc

SEQ ID NO: 5455972 - DNA, 17 bp, Homo sapiens
tgcccgagtccgcccat

SEQ ID NO: 5455973 - DNA, 19 bp, Homo sapiens
tgcccgagtccgcccatcc

SEQ ID NO: 5455974 - DNA, 21 bp, Homo sapiens
tgcccgagtccgcccatccct

SEQ ID NO: 5455975 - DNA, 22 bp, Homo sapiens
tgcccgagtccgcccatccctg

SEQ ID NO: 5455976 - DNA, 16 bp, Homo sapiens
tgcccgcacaccctca

SEQ ID NO: 5455977 - DNA, 13 bp, Homo sapiens
tgcccgcacagca

SEQ ID NO: 5455978 - DNA, 19 bp, Homo sapiens
tgcccgcacccctccctgc

SEQ ID NO: 5455979 - DNA, 21 bp, Homo sapiens
tgcccgcaccctggcctggtc

SEQ ID NO: 5455980 - DNA, 18 bp, Homo sapiens
tgcccgcagacctctgga

SEQ ID NO: 5455981 - DNA, 16 bp, Homo sapiens
tgcccgcatgtgtgcc

SEQ ID NO: 5455982 - DNA, 14 bp, Homo sapiens
tgcccgccagccag

SEQ ID NO: 5455983 - DNA, 17 bp, Homo sapiens
tgcccgccagccagtgg

SEQ ID NO: 5455984 - DNA, 16 bp, Homo sapiens
tgcccgccagcctcag

SEQ ID NO: 5455985 - DNA, 22 bp, Homo sapiens
tgcccgccagcctcagtgccac

SEQ ID NO: 5455986 - DNA, 23 bp, Homo sapiens
tgcccgccagcctcagtgccact

SEQ ID NO: 5455987 - DNA, 12 bp, Homo sapiens
tgcccgccagtg

SEQ ID NO: 5455988 - DNA, 19 bp, Homo sapiens
tgcccgcccacctctgctg

SEQ ID NO: 5455989 - DNA, 13 bp, Homo sapiens
tgcccgccctcca

SEQ ID NO: 5455990 - DNA, 16 bp, Homo sapiens
tgcccgccctccaccc

SEQ ID NO: 5455991 - DNA, 13 bp, Homo sapiens
tgcccgccctccc

SEQ ID NO: 5455992 - DNA, 16 bp, Homo sapiens
tgcccgccctccctcc

SEQ ID NO: 5455993 - DNA, 18 bp, Homo sapiens
tgcccgccctgcccctgc

SEQ ID NO: 5455994 - DNA, 12 bp, Homo sapiens
tgcccgcctagg

SEQ ID NO: 5455995 - DNA, 19 bp, Homo sapiens
tgcccgcctgcccacctgc

SEQ ID NO: 5455996 - DNA, 21 bp, Homo sapiens
tgcccgcgggtggctggagcc

SEQ ID NO: 5455997 - DNA, 24 bp, Homo sapiens
tgcccgcgggtggctggagcccca

SEQ ID NO: 5455998 - DNA, 15 bp, Homo sapiens
tgcccgctcagccca

SEQ ID NO: 5455999 - DNA, 16 bp, Homo sapiens
tgcccgctcccacagc

SEQ ID NO: 5456000 - DNA, 19 bp, Homo sapiens
tgcccgctcccacagcttc

SEQ ID NO: 5456001 - DNA, 23 bp, Homo sapiens
tgcccggagattggacggcctga

SEQ ID NO: 5456002 - DNA, 22 bp, Homo sapiens
tgcccggcacagatgctccagg

SEQ ID NO: 5456003 - DNA, 17 bp, Homo sapiens
tgcccggcctccctccc

SEQ ID NO: 5456004 - DNA, 21 bp, Homo sapiens
tgcccggcgccctctgtcctg

SEQ ID NO: 5456005 - DNA, 22 bp, Homo sapiens
tgcccggcgccctctgtcctga

SEQ ID NO: 5456006 - DNA, 17 bp, Homo sapiens
tgcccggcgccgggcac

SEQ ID NO: 5456007 - DNA, 20 bp, Homo sapiens
tgcccggctaatttttgtaa

SEQ ID NO: 5456008 - DNA, 22 bp, Homo sapiens
tgcccggctgtgattgctgcca

SEQ ID NO: 5456009 - DNA, 21 bp, Homo sapiens
tgcccgggcaggggccgcttc

SEQ ID NO: 5456010 - DNA, 22 bp, Homo sapiens
tgcccgggcgcggccagccccg

SEQ ID NO: 5456011 - DNA, 13 bp, Homo sapiens
tgcccgggctccc

SEQ ID NO: 5456012 - DNA, 18 bp, Homo sapiens
tgcccggggaaaggcaag

SEQ ID NO: 5456013 - DNA, 21 bp, Homo sapiens
tgcccggggaaaggcaaggtc

SEQ ID NO: 5456014 - DNA, 23 bp, Homo sapiens
tgcctagaaacaacactgtagta

SEQ ID NO: 5456015 - DNA, 19 bp, Homo sapiens
tgcctagactgttactttg

SEQ ID NO: 5456016 - DNA, 16 bp, Homo sapiens
tgcctagacttcccaa

SEQ ID NO: 5456017 - DNA, 21 bp, Homo sapiens
tgcctagacttcccaacagcc

SEQ ID NO: 5456018 - DNA, 24 bp, Homo sapiens
tgcctagagatatttcaagctcat

SEQ ID NO: 5456019 - DNA, 15 bp, Homo sapiens
tgcctagaggcccca

SEQ ID NO: 5456020 - DNA, 22 bp, Homo sapiens
tgcctagattaggtagactttg

SEQ ID NO: 5456021 - DNA, 23 bp, Homo sapiens
tgcctagattaggtagactttgc

SEQ ID NO: 5456022 - DNA, 18 bp, Homo sapiens
tgcctagcaagctggcct

SEQ ID NO: 5456023 - DNA, 14 bp, Homo sapiens
tgcctagcagagtg

SEQ ID NO: 5456024 - DNA, 21 bp, Homo sapiens
tgcctagcagagtgctggcac

SEQ ID NO: 5456025 - DNA, 23 bp, Homo sapiens
tgcctagcagagtgctggcactt

SEQ ID NO: 5456026 - DNA, 22 bp, Homo sapiens
tgcctagcatggggtcagcccc

SEQ ID NO: 5456027 - DNA, 16 bp, Homo sapiens
tgcctagctcttgggc

SEQ ID NO: 5456028 - DNA, 22 bp, Homo sapiens
tgcctagctcttgggcctgacc

SEQ ID NO: 5456029 - DNA, 23 bp, Homo sapiens
tgcctaggagatgttgggaacag

SEQ ID NO: 5456030 - DNA, 14 bp, Homo sapiens
tgcctaggagctgg

SEQ ID NO: 5456031 - DNA, 15 bp, Homo sapiens
tgcctaggagctggc

SEQ ID NO: 5456032 - DNA, 17 bp, Homo sapiens
tgcctaggagctgggga

SEQ ID NO: 5456033 - DNA, 21 bp, Homo sapiens
tgcctaggaggctggccaagg

SEQ ID NO: 5456034 - DNA, 23 bp, Homo sapiens
tgcctaggattcacaccccacct

SEQ ID NO: 5456035 - DNA, 18 bp, Homo sapiens
tgcctaggctgaccttga

SEQ ID NO: 5456036 - DNA, 19 bp, Homo sapiens
tgcctagggttgcttgggc

SEQ ID NO: 5456037 - DNA, 15 bp, Homo sapiens
tgcctagtattgaca

SEQ ID NO: 5456038 - DNA, 16 bp, Homo sapiens
tgcctagtattgacaa

SEQ ID NO: 5456039 - DNA, 18 bp, Homo sapiens
tgcctagtattgacaaaa

SEQ ID NO: 5456040 - DNA, 19 bp, Homo sapiens
tgcctagtcgggacttgta

SEQ ID NO: 5456041 - DNA, 22 bp, Homo sapiens
tgcctagtcgggacttgtaaca

SEQ ID NO: 5456042 - DNA, 22 bp, Homo sapiens
tgcctatatctgagagacctgt

SEQ ID NO: 5456043 - DNA, 16 bp, Homo sapiens
tgcctatatttataaa

SEQ ID NO: 5456044 - DNA, 15 bp, Homo sapiens
tgcctatattttcct

SEQ ID NO: 5456045 - DNA, 16 bp, Homo sapiens
tgcctatccatcctgc

SEQ ID NO: 5456046 - DNA, 14 bp, Homo sapiens
tgcctatctgactt

SEQ ID NO: 5456047 - DNA, 15 bp, Homo sapiens
tgcctatctgcctgg

SEQ ID NO: 5456048 - DNA, 16 bp, Homo sapiens
tgcctatctgcctgga

SEQ ID NO: 5456049 - DNA, 15 bp, Homo sapiens
tgcctatgggccaga

SEQ ID NO: 5456050 - DNA, 14 bp, Homo sapiens
tgcctattcacgcc

SEQ ID NO: 5456051 - DNA, 22 bp, Homo sapiens
tgcctattcacgccgtaattct

SEQ ID NO: 5456052 - DNA, 20 bp, Homo sapiens
tgcctattgctagagctcct

SEQ ID NO: 5456053 - DNA, 15 bp, Homo sapiens
tgcctattgtaatat

SEQ ID NO: 5456054 - DNA, 17 bp, Homo sapiens
tgcctatttattcattc

SEQ ID NO: 5456055 - DNA, 18 bp, Homo sapiens
tgcctatttattcattca

SEQ ID NO: 5456056 - DNA, 15 bp, Homo sapiens
tgcctatttattggg

SEQ ID NO: 5456057 - DNA, 14 bp, Homo sapiens
tgcctatttgtgtg

SEQ ID NO: 5456058 - DNA, 17 bp, Homo sapiens
tgcctcaaaattgtgtc

SEQ ID NO: 5456059 - DNA, 21 bp, Homo sapiens
tgcctcaaataaaaagtgctt

SEQ ID NO: 5456060 - DNA, 19 bp, Homo sapiens
tgcctcaacagcaggaggc

SEQ ID NO: 5456061 - DNA, 24 bp, Homo sapiens
tgcctcaacagcaggaggcacagc

SEQ ID NO: 5456062 - DNA, 21 bp, Homo sapiens
tgcctcaactccaccctctgc

SEQ ID NO: 5456063 - DNA, 15 bp, Homo sapiens
tgcctcaagagaagg

SEQ ID NO: 5456064 - DNA, 18 bp, Homo sapiens
tgcctcaatgtgaccagg

SEQ ID NO: 5456065 - DNA, 17 bp, Homo sapiens
tgcctcacaaatgctgt

SEQ ID NO: 5456066 - DNA, 14 bp, Homo sapiens
tgcctcacagctgg

SEQ ID NO: 5456067 - DNA, 19 bp, Homo sapiens
tgcctcacatttttttcta

SEQ ID NO: 5456068 - DNA, 22 bp, Homo sapiens
tgcctcaccacacccaggtctc

SEQ ID NO: 5456069 - DNA, 12 bp, Homo sapiens
tgcctcacccac

SEQ ID NO: 5456070 - DNA, 15 bp, Homo sapiens
tgcctcacccacacc

SEQ ID NO: 5456071 - DNA, 16 bp, Homo sapiens
tgcctcaccctcccaa

SEQ ID NO: 5456072 - DNA, 17 bp, Homo sapiens
tgcctcaccctcccaag

SEQ ID NO: 5456073 - DNA, 22 bp, Homo sapiens
tgcctcacctggtcgccaatcc

SEQ ID NO: 5456074 - DNA, 12 bp, Homo sapiens
tgcctcaccttc

SEQ ID NO: 5456075 - DNA, 22 bp, Homo sapiens
tgcctcactaatttttgtatta

SEQ ID NO: 5456076 - DNA, 14 bp, Homo sapiens
tgcctcactggggg

SEQ ID NO: 5456077 - DNA, 12 bp, Homo sapiens
tgcctcactgtg

SEQ ID NO: 5456078 - DNA, 14 bp, Homo sapiens
tgcctcacttcagg

SEQ ID NO: 5456079 - DNA, 16 bp, Homo sapiens
tgcctcactttcttct

SEQ ID NO: 5456080 - DNA, 21 bp, Homo sapiens
tgcctcagacgttgcctgaga

SEQ ID NO: 5456081 - DNA, 20 bp, Homo sapiens
tgcctcagactccgccctcc

SEQ ID NO: 5456082 - DNA, 21 bp, Homo sapiens
tgcctcagactccgccctcct

SEQ ID NO: 5456083 - DNA, 18 bp, Homo sapiens
tgcctcagagaccagggc

SEQ ID NO: 5456084 - DNA, 18 bp, Homo sapiens
tgcctcagccagccctgg

SEQ ID NO: 5456085 - DNA, 19 bp, Homo sapiens
tgcctcagccagccctgga

SEQ ID NO: 5456086 - DNA, 22 bp, Homo sapiens
tgcctcagccagtggcacagga

SEQ ID NO: 5456087 - DNA, 12 bp, Homo sapiens
tgcctcagcccg

SEQ ID NO: 5456088 - DNA, 16 bp, Homo sapiens
tgcctcagccctgacc

SEQ ID NO: 5456089 - DNA, 16 bp, Homo sapiens
tgcctcagcctcccat

SEQ ID NO: 5456090 - DNA, 23 bp, Homo sapiens
tgcctcagcctcccgagtagctg

SEQ ID NO: 5456091 - DNA, 18 bp, Homo sapiens
tgcctcagcctcctgagt

SEQ ID NO: 5456092 - DNA, 15 bp, Homo sapiens
tgcctcagcgctgcc

SEQ ID NO: 5456093 - DNA, 21 bp, Homo sapiens
tgcctcagcgctgcccacacc

SEQ ID NO: 5456094 - DNA, 17 bp, Homo sapiens
tgcctcagctcagcttc

SEQ ID NO: 5456095 - DNA, 21 bp, Homo sapiens
tgcctcagctgcatctgataa

SEQ ID NO: 5456096 - DNA, 10 bp, Homo sapiens
tgcctcagga

SEQ ID NO: 5456097 - DNA, 12 bp, Homo sapiens
tgcctcaggacc

SEQ ID NO: 5456098 - DNA, 22 bp, Homo sapiens
tgcctcaggaggtcacctgccg

SEQ ID NO: 5456099 - DNA, 16 bp, Homo sapiens
tgcctcaggcctctgt

SEQ ID NO: 5456100 - DNA, 18 bp, Homo sapiens
tgcctcaggcctctgtgc

SEQ ID NO: 5456101 - DNA, 16 bp, Homo sapiens
tgcctcaggttcctat

SEQ ID NO: 5456102 - DNA, 21 bp, Homo sapiens
tgcctcagtgcttatgtcata

SEQ ID NO: 5456103 - DNA, 12 bp, Homo sapiens
tgcctcagtggc

SEQ ID NO: 5456104 - DNA, 12 bp, Homo sapiens
tgcctcagtttt

SEQ ID NO: 5456105 - DNA, 15 bp, Homo sapiens
tgcctcataaattaa

SEQ ID NO: 5456106 - DNA, 19 bp, Homo sapiens
tgcctcatcttccttctca

SEQ ID NO: 5456107 - DNA, 21 bp, Homo sapiens
tgcctcatcttccttctcagc

SEQ ID NO: 5456108 - DNA, 14 bp, Homo sapiens
tgcctcatgccaca

SEQ ID NO: 5456109 - DNA, 17 bp, Homo sapiens
tgcctcatgccacacct

SEQ ID NO: 5456110 - DNA, 13 bp, Homo sapiens
tgcctcatgctct

SEQ ID NO: 5456111 - DNA, 18 bp, Homo sapiens
tgcctcatgctgacttgc

SEQ ID NO: 5456112 - DNA, 19 bp, Homo sapiens
tgcctcatggccagcgccc

SEQ ID NO: 5456113 - DNA, 20 bp, Homo sapiens
tgcctcatttcttcctctgc

SEQ ID NO: 5456114 - DNA, 15 bp, Homo sapiens
tgcctccaagatttc

SEQ ID NO: 5456115 - DNA, 20 bp, Homo sapiens
tgcctccaagtcatgggaga

SEQ ID NO: 5456116 - DNA, 16 bp, Homo sapiens
tgcctccaccaccact

SEQ ID NO: 5456117 - DNA, 22 bp, Homo sapiens
tgcctccaccaccactggccac

SEQ ID NO: 5456118 - DNA, 14 bp, Homo sapiens
tgcctccaccagca

SEQ ID NO: 5456119 - DNA, 21 bp, Homo sapiens
tgcctccacccacagtggaga

SEQ ID NO: 5456120 - DNA, 23 bp, Homo sapiens
tgcctccacccgtcctccctcag

SEQ ID NO: 5456121 - DNA, 12 bp, Homo sapiens
tgcctccaccct

SEQ ID NO: 5456122 - DNA, 13 bp, Homo sapiens
tgcctccaccctc

SEQ ID NO: 5456123 - DNA, 16 bp, Homo sapiens
tgcctccaccctcctc

SEQ ID NO: 5456124 - DNA, 18 bp, Homo sapiens
tgcctccaccgagccagc

SEQ ID NO: 5456125 - DNA, 17 bp, Homo sapiens
tgcctccactcccactt

SEQ ID NO: 5456126 - DNA, 13 bp, Homo sapiens
tgcctccagaacc

SEQ ID NO: 5456127 - DNA, 14 bp, Homo sapiens
tgcctccagaacct

SEQ ID NO: 5456128 - DNA, 17 bp, Homo sapiens
tgcctccagaagcactg

SEQ ID NO: 5456129 - DNA, 23 bp, Homo sapiens
tgcctccagccgccggctgtgca

SEQ ID NO: 5456130 - DNA, 21 bp, Homo sapiens
tgcctccagctgtcagcctgg

SEQ ID NO: 5456131 - DNA, 19 bp, Homo sapiens
tgcctccaggaaccacacc

SEQ ID NO: 5456132 - DNA, 14 bp, Homo sapiens
tgcctccagggctg

SEQ ID NO: 5456133 - DNA, 16 bp, Homo sapiens
tgcctccaggtgcaga

SEQ ID NO: 5456134 - DNA, 21 bp, Homo sapiens
tgcctccaggtgcagaggtac

SEQ ID NO: 5456135 - DNA, 12 bp, Homo sapiens
tgcctccaggtt

SEQ ID NO: 5456136 - DNA, 15 bp, Homo sapiens
tgcctccataatttg

SEQ ID NO: 5456137 - DNA, 15 bp, Homo sapiens
tgcctccatcctagt

SEQ ID NO: 5456138 - DNA, 22 bp, Homo sapiens
tgcctccatggcagcagccagg

SEQ ID NO: 5456139 - DNA, 14 bp, Homo sapiens
tgcctccatggtgc

SEQ ID NO: 5456140 - DNA, 16 bp, Homo sapiens
tgcctccatggtgcct

SEQ ID NO: 5456141 - DNA, 21 bp, Homo sapiens
tgcctccattatccattccca

SEQ ID NO: 5456142 - DNA, 15 bp, Homo sapiens
tgcctcccaagcagc

SEQ ID NO: 5456143 - DNA, 16 bp, Homo sapiens
tgcctcccaagcagct

SEQ ID NO: 5456144 - DNA, 18 bp, Homo sapiens
tgcctcccaagctcagag

SEQ ID NO: 5456145 - DNA, 19 bp, Homo sapiens
tgcctcccaagctcagagc

SEQ ID NO: 5456146 - DNA, 19 bp, Homo sapiens
tgcctcccaaggtcctctc

SEQ ID NO: 5456147 - DNA, 22 bp, Homo sapiens
tgcctcccaaggtcctctcagt

SEQ ID NO: 5456148 - DNA, 23 bp, Homo sapiens
tgcctcccacacttgctggggct

SEQ ID NO: 5456149 - DNA, 22 bp, Homo sapiens
tgcctcccagccctgccaggag

SEQ ID NO: 5456150 - DNA, 21 bp, Homo sapiens
tgcctcccaggcaagcagctg

SEQ ID NO: 5456151 - DNA, 13 bp, Homo sapiens
tgcctcccaggcc

SEQ ID NO: 5456152 - DNA, 21 bp, Homo sapiens
tgcctcccagtggcctggctt

SEQ ID NO: 5456153 - DNA, 22 bp, Homo sapiens
tgcctcccagtggcctggcttg

SEQ ID NO: 5456154 - DNA, 14 bp, Homo sapiens
tgcctcccatcacc

SEQ ID NO: 5456155 - DNA, 15 bp, Homo sapiens
tgcctcccatgcctg

SEQ ID NO: 5456156 - DNA, 17 bp, Homo sapiens
tgcctcccatgcctggt

SEQ ID NO: 5456157 - DNA, 18 bp, Homo sapiens
tgcctccccaaccctgcc

SEQ ID NO: 5456158 - DNA, 20 bp, Homo sapiens
tgcctccccatttcccatct

SEQ ID NO: 5456159 - DNA, 21 bp, Homo sapiens
tgcctccccatttcccatctg

SEQ ID NO: 5456160 - DNA, 23 bp, Homo sapiens
tgcctccccatttcccatctgca

SEQ ID NO: 5456161 - DNA, 14 bp, Homo sapiens
tgcctccccccaga

SEQ ID NO: 5456162 - DNA, 16 bp, Homo sapiens
tgcctccccccagacc

SEQ ID NO: 5456163 - DNA, 21 bp, Homo sapiens
tgcctccccccagaccccgcc

SEQ ID NO: 5456164 - DNA, 22 bp, Homo sapiens
tgcctccccccagaccccgccc

SEQ ID NO: 5456165 - DNA, 21 bp, Homo sapiens
tgcctcccccgcctccagtca

SEQ ID NO: 5456166 - DNA, 13 bp, Homo sapiens
tgcctcccctcct

SEQ ID NO: 5456167 - DNA, 18 bp, Homo sapiens
tgcctcccctcctctgct

SEQ ID NO: 5456168 - DNA, 19 bp, Homo sapiens
tgcctcccctcctctgctt

SEQ ID NO: 5456169 - DNA, 22 bp, Homo sapiens
tgcctcccctcctctgcttgcc

SEQ ID NO: 5456170 - DNA, 23 bp, Homo sapiens
tgcctcccctcctctgcttgcca

SEQ ID NO: 5456171 - DNA, 22 bp, Homo sapiens
tgcctccctcaccctgagcccc

SEQ ID NO: 5456172 - DNA, 22 bp, Homo sapiens
tgcctccctctcgtaagatttc

SEQ ID NO: 5456173 - DNA, 23 bp, Homo sapiens
tgcctccctctcgtaagatttcc

SEQ ID NO: 5456174 - DNA, 20 bp, Homo sapiens
tgcctccctctcttccggga

SEQ ID NO: 5456175 - DNA, 19 bp, Homo sapiens
tgcctccctgaccctgcag

SEQ ID NO: 5456176 - DNA, 20 bp, Homo sapiens
tgcctccctgaccctgcaga

SEQ ID NO: 5456177 - DNA, 13 bp, Homo sapiens
tgcctccctgagc

SEQ ID NO: 5456178 - DNA, 22 bp, Homo sapiens
tgcctccctgcacttcatcccg

SEQ ID NO: 5456179 - DNA, 22 bp, Homo sapiens
tgcctccctgggccacctccta

SEQ ID NO: 5456180 - DNA, 22 bp, Homo sapiens
tgcctccctggggaccaggagc

SEQ ID NO: 5456181 - DNA, 23 bp, Homo sapiens
tgcctccctggggaccaggagct

SEQ ID NO: 5456182 - DNA, 13 bp, Homo sapiens
tgcctccctggtg

SEQ ID NO: 5456183 - DNA, 15 bp, Homo sapiens
tgcctccctgtccac

SEQ ID NO: 5456184 - DNA, 16 bp, Homo sapiens
tgcctccctgtccacc

SEQ ID NO: 5456185 - DNA, 15 bp, Homo sapiens
tgcctcccttcccag

SEQ ID NO: 5456186 - DNA, 14 bp, Homo sapiens
tgcctcccttcctc

SEQ ID NO: 5456187 - DNA, 15 bp, Homo sapiens
tgcctcccttcctcc

SEQ ID NO: 5456188 - DNA, 19 bp, Homo sapiens
tgcctcccttgtggcagca

SEQ ID NO: 5456189 - DNA, 22 bp, Homo sapiens
tgcctccgaggcctacctgctc

SEQ ID NO: 5456190 - DNA, 15 bp, Homo sapiens
tgcctgtagagccag

SEQ ID NO: 5456191 - DNA, 18 bp, Homo sapiens
tgcctgtagagccagcct

SEQ ID NO: 5456192 - DNA, 20 bp, Homo sapiens
tgcctgtagagccagccttg

SEQ ID NO: 5456193 - DNA, 23 bp, Homo sapiens
tgcctgtagcccactctgctcgc

SEQ ID NO: 5456194 - DNA, 12 bp, Homo sapiens
tgcctgtagcct

SEQ ID NO: 5456195 - DNA, 16 bp, Homo sapiens
tgcctgtagctttcct

SEQ ID NO: 5456196 - DNA, 23 bp, Homo sapiens
tgcctgtagctttcctggtccct

SEQ ID NO: 5456197 - DNA, 20 bp, Homo sapiens
tgcctgtagtcccagctact

SEQ ID NO: 5456198 - DNA, 13 bp, Homo sapiens
tgcctgtagttag

SEQ ID NO: 5456199 - DNA, 15 bp, Homo sapiens
tgcctgtagttagga

SEQ ID NO: 5456200 - DNA, 16 bp, Homo sapiens
tgcctgtagttaggaa

SEQ ID NO: 5456201 - DNA, 17 bp, Homo sapiens
tgcctgtagttaggaaa

SEQ ID NO: 5456202 - DNA, 19 bp, Homo sapiens
tgcctgtagttaggaaata

SEQ ID NO: 5456203 - DNA, 17 bp, Homo sapiens
tgcctgtatcttttatt

SEQ ID NO: 5456204 - DNA, 12 bp, Homo sapiens
tgcctgtcaagt

SEQ ID NO: 5456205 - DNA, 18 bp, Homo sapiens
tgcctgtcaagttgtaca

SEQ ID NO: 5456206 - DNA, 14 bp, Homo sapiens
tgcctgtcacccca

SEQ ID NO: 5456207 - DNA, 18 bp, Homo sapiens
tgcctgtcacctgggagg

SEQ ID NO: 5456208 - DNA, 19 bp, Homo sapiens
tgcctgtcacctgggaggg

SEQ ID NO: 5456209 - DNA, 15 bp, Homo sapiens
tgcctgtccagcctg

SEQ ID NO: 5456210 - DNA, 16 bp, Homo sapiens
tgcctgtccagcctgg

SEQ ID NO: 5456211 - DNA, 18 bp, Homo sapiens
tgcctgtccagcctgggc

SEQ ID NO: 5456212 - DNA, 19 bp, Homo sapiens
tgcctgtccagcctgggca

SEQ ID NO: 5456213 - DNA, 22 bp, Homo sapiens
tgcctgtccccaaacaggacag

SEQ ID NO: 5456214 - DNA, 13 bp, Homo sapiens
tgcctgtcctgaa

SEQ ID NO: 5456215 - DNA, 21 bp, Homo sapiens
tgcctgtccttgaaaaacaaa

SEQ ID NO: 5456216 - DNA, 22 bp, Homo sapiens
tgcctgtccttgaaaaacaaag

SEQ ID NO: 5456217 - DNA, 15 bp, Homo sapiens
tgcctgtctaaagcc

SEQ ID NO: 5456218 - DNA, 12 bp, Homo sapiens
tgcctgtctctg

SEQ ID NO: 5456219 - DNA, 14 bp, Homo sapiens
tgcctgtctctgtt

SEQ ID NO: 5456220 - DNA, 15 bp, Homo sapiens
tgcctgtctgcccca

SEQ ID NO: 5456221 - DNA, 16 bp, Homo sapiens
tgcctgtctgccccag

SEQ ID NO: 5456222 - DNA, 15 bp, Homo sapiens
tgcctgtctggagct

SEQ ID NO: 5456223 - DNA, 15 bp, Homo sapiens
tgcctgtctggctca

SEQ ID NO: 5456224 - DNA, 14 bp, Homo sapiens
tgcctgtctgtcca

SEQ ID NO: 5456225 - DNA, 20 bp, Homo sapiens
tgcctgtctgtccaacccct

SEQ ID NO: 5456226 - DNA, 21 bp, Homo sapiens
tgcctgtctgtccaacccctc

SEQ ID NO: 5456227 - DNA, 23 bp, Homo sapiens
tgcctgtctgtccaacccctccc

SEQ ID NO: 5456228 - DNA, 21 bp, Homo sapiens
tgcctgtgagcatggggccag

SEQ ID NO: 5456229 - DNA, 19 bp, Homo sapiens
tgcctgtgatttcctaatt

SEQ ID NO: 5456230 - DNA, 20 bp, Homo sapiens
tgcctgtgcacggccagctg

SEQ ID NO: 5456231 - DNA, 15 bp, Homo sapiens
tgcctgtgcatgacc

SEQ ID NO: 5456232 - DNA, 12 bp, Homo sapiens
tgcctgtgccaa

SEQ ID NO: 5456233 - DNA, 16 bp, Homo sapiens
tgcctgtgccacccac

SEQ ID NO: 5456234 - DNA, 12 bp, Homo sapiens
tgcctgtgcccg

SEQ ID NO: 5456235 - DNA, 14 bp, Homo sapiens
tgcctgtgcccgct

SEQ ID NO: 5456236 - DNA, 12 bp, Homo sapiens
tgcctgtgcctg

SEQ ID NO: 5456237 - DNA, 21 bp, Homo sapiens
tgcctgtggccttgcccgcca

SEQ ID NO: 5456238 - DNA, 23 bp, Homo sapiens
tgcctgtggcgccgtctccaggg

SEQ ID NO: 5456239 - DNA, 13 bp, Homo sapiens
tgcctgtggctgc

SEQ ID NO: 5456240 - DNA, 14 bp, Homo sapiens
tgcctgtggctgcg

SEQ ID NO: 5456241 - DNA, 24 bp, Homo sapiens
tgcctgtggtgaagtgtggctggt

SEQ ID NO: 5456242 - DNA, 15 bp, Homo sapiens
tgcctgtgtccatgc

SEQ ID NO: 5456243 - DNA, 21 bp, Homo sapiens
tgcctgtgtccatgcgctcag

SEQ ID NO: 5456244 - DNA, 22 bp, Homo sapiens
tgcctgtgtccatgcgctcagg

SEQ ID NO: 5456245 - DNA, 21 bp, Homo sapiens
tgcctgtgtttcatgttctgt

SEQ ID NO: 5456246 - DNA, 15 bp, Homo sapiens
tgcctgttaaatata

SEQ ID NO: 5456247 - DNA, 17 bp, Homo sapiens
tgcctgttaatttataa

SEQ ID NO: 5456248 - DNA, 23 bp, Homo sapiens
tgcctgttaatttataatgtatt

SEQ ID NO: 5456249 - DNA, 19 bp, Homo sapiens
tgcctgttataactctgca

SEQ ID NO: 5456250 - DNA, 20 bp, Homo sapiens
tgcctgttataactctgcac

SEQ ID NO: 5456251 - DNA, 11 bp, Homo sapiens
tgcctgttcag

SEQ ID NO: 5456252 - DNA, 15 bp, Homo sapiens
tgcctgttctccaga

SEQ ID NO: 5456253 - DNA, 22 bp, Homo sapiens
tgcctgttgatctatgggaaat

SEQ ID NO: 5456254 - DNA, 16 bp, Homo sapiens
tgcctgttgcaggcaa

SEQ ID NO: 5456255 - DNA, 20 bp, Homo sapiens
tgcctgttgctttcttcctg

SEQ ID NO: 5456256 - DNA, 18 bp, Homo sapiens
tgcctgttggcaggccca

SEQ ID NO: 5456257 - DNA, 14 bp, Homo sapiens
tgcctgttggctgc

SEQ ID NO: 5456258 - DNA, 17 bp, Homo sapiens
tgcctgttggctgctgc

SEQ ID NO: 5456259 - DNA, 16 bp, Homo sapiens
tgcctgttgggccagg

SEQ ID NO: 5456260 - DNA, 19 bp, Homo sapiens
tgcctgttgggccaggagc

SEQ ID NO: 5456261 - DNA, 11 bp, Homo sapiens
tgcctgtttcc

SEQ ID NO: 5456262 - DNA, 16 bp, Homo sapiens
tgcctgtttcccaggc

SEQ ID NO: 5456263 - DNA, 19 bp, Homo sapiens
tgcctgtttcccaggccca

SEQ ID NO: 5456264 - DNA, 13 bp, Homo sapiens
tgcctgtttcccg

SEQ ID NO: 5456265 - DNA, 22 bp, Homo sapiens
tgcctgttttgagaccagaagg

SEQ ID NO: 5456266 - DNA, 14 bp, Homo sapiens
tgccttaaacctga

SEQ ID NO: 5456267 - DNA, 13 bp, Homo sapiens
tgccttaaagaaa

SEQ ID NO: 5456268 - DNA, 24 bp, Homo sapiens
tgccttaaagacaagacagcattt

SEQ ID NO: 5456269 - DNA, 17 bp, Homo sapiens
tgccttaacctagaggg

SEQ ID NO: 5456270 - DNA, 23 bp, Homo sapiens
tgccttaacctgggaccaacctg

SEQ ID NO: 5456271 - DNA, 12 bp, Homo sapiens
tgccttaagcag

SEQ ID NO: 5456272 - DNA, 22 bp, Homo sapiens
tgccttaaggccacactggcat

SEQ ID NO: 5456273 - DNA, 21 bp, Homo sapiens
tgccttaagtgaggaaatcaa

SEQ ID NO: 5456274 - DNA, 17 bp, Homo sapiens
tgccttaataaatatgt

SEQ ID NO: 5456275 - DNA, 21 bp, Homo sapiens
tgccttaataaatatgtaata

SEQ ID NO: 5456276 - DNA, 23 bp, Homo sapiens
tgccttaataagaatggttgcct

SEQ ID NO: 5456277 - DNA, 20 bp, Homo sapiens
tgccttaatgagaacattta

SEQ ID NO: 5456278 - DNA, 15 bp, Homo sapiens
tgccttaattaaaga

SEQ ID NO: 5456279 - DNA, 14 bp, Homo sapiens
tgccttaattctta

SEQ ID NO: 5456280 - DNA, 16 bp, Homo sapiens
tgccttaatttagaaa

SEQ ID NO: 5456281 - DNA, 16 bp, Homo sapiens
tgccttaatttttgaa

SEQ ID NO: 5456282 - DNA, 21 bp, Homo sapiens
tgccttaccgagagccaaaca

SEQ ID NO: 5456283 - DNA, 16 bp, Homo sapiens
tgccttacctcctgcc

SEQ ID NO: 5456284 - DNA, 17 bp, Homo sapiens
tgccttacctcctgccc

SEQ ID NO: 5456285 - DNA, 20 bp, Homo sapiens
tgccttacctcctgcccagg

SEQ ID NO: 5456286 - DNA, 21 bp, Homo sapiens
tgccttacctcctgcccagga

SEQ ID NO: 5456287 - DNA, 16 bp, Homo sapiens
tgccttactaaatatg

SEQ ID NO: 5456288 - DNA, 15 bp, Homo sapiens
tgccttactcttctt

SEQ ID NO: 5456289 - DNA, 19 bp, Homo sapiens
tgccttactcttcttgaaa

SEQ ID NO: 5456290 - DNA, 14 bp, Homo sapiens
tgccttagaacctt

SEQ ID NO: 5456291 - DNA, 21 bp, Homo sapiens
tgccttagaacctttcttaca

SEQ ID NO: 5456292 - DNA, 14 bp, Homo sapiens
tgccttagcatgtg

SEQ ID NO: 5456293 - DNA, 19 bp, Homo sapiens
tgccttagcctcttggaaa

SEQ ID NO: 5456294 - DNA, 13 bp, Homo sapiens
tgccttagcttca

SEQ ID NO: 5456295 - DNA, 13 bp, Homo sapiens
tgccttaggaagt

SEQ ID NO: 5456296 - DNA, 21 bp, Homo sapiens
tgccttaggaagtgacttgaa

SEQ ID NO: 5456297 - DNA, 21 bp, Homo sapiens
tgccttaggaatactgtttta

SEQ ID NO: 5456298 - DNA, 16 bp, Homo sapiens
tgccttaggcctacct

SEQ ID NO: 5456299 - DNA, 16 bp, Homo sapiens
tgccttaggctgctgg

SEQ ID NO: 5456300 - DNA, 20 bp, Homo sapiens
tgccttaggctgctgggaga

SEQ ID NO: 5456301 - DNA, 15 bp, Homo sapiens
tgccttagtctcagt

SEQ ID NO: 5456302 - DNA, 16 bp, Homo sapiens
tgccttagtctcagtt

SEQ ID NO: 5456303 - DNA, 20 bp, Homo sapiens
tgccttagtctcagtttgtg

SEQ ID NO: 5456304 - DNA, 20 bp, Homo sapiens
tgccttatattattttctgt

SEQ ID NO: 5456305 - DNA, 14 bp, Homo sapiens
tgccttatcaaata

SEQ ID NO: 5456306 - DNA, 18 bp, Homo sapiens
tgccttatctcatttctc

SEQ ID NO: 5456307 - DNA, 17 bp, Homo sapiens
tgccttatctcttctca

SEQ ID NO: 5456308 - DNA, 15 bp, Homo sapiens
tgccttatggaacac

SEQ ID NO: 5456309 - DNA, 22 bp, Homo sapiens
tgccttatggaacactctgaga

SEQ ID NO: 5456310 - DNA, 20 bp, Homo sapiens
tgccttatgggctgaagtgt

SEQ ID NO: 5456311 - DNA, 17 bp, Homo sapiens
tgccttattcagggaag

SEQ ID NO: 5456312 - DNA, 22 bp, Homo sapiens
tgccttatttctcattgcctct

SEQ ID NO: 5456313 - DNA, 14 bp, Homo sapiens
tgccttatttgtct

SEQ ID NO: 5456314 - DNA, 15 bp, Homo sapiens
tgccttatttgtctg

SEQ ID NO: 5456315 - DNA, 20 bp, Homo sapiens
tgccttatttgtctgtaaaa

SEQ ID NO: 5456316 - DNA, 15 bp, Homo sapiens
tgccttatttttgaa

SEQ ID NO: 5456317 - DNA, 16 bp, Homo sapiens
tgccttatttttgaat

SEQ ID NO: 5456318 - DNA, 18 bp, Homo sapiens
tgccttcaaatagtatag

SEQ ID NO: 5456319 - DNA, 20 bp, Homo sapiens
tgccttcaaatagtatagaa

SEQ ID NO: 5456320 - DNA, 21 bp, Homo sapiens
tgccttcaaatagtatagaaa

SEQ ID NO: 5456321 - DNA, 22 bp, Homo sapiens
tgccttcaaatagtatagaaaa

SEQ ID NO: 5456322 - DNA, 23 bp, Homo sapiens
tgccttcaaatagtatagaaaat

SEQ ID NO: 5456323 - DNA, 20 bp, Homo sapiens
tgccttcaactaaaaacaaa

SEQ ID NO: 5456324 - DNA, 14 bp, Homo sapiens
tgccttcaataaat

SEQ ID NO: 5456325 - DNA, 15 bp, Homo sapiens
tgccttcacaaatgt

SEQ ID NO: 5456326 - DNA, 13 bp, Homo sapiens
tgccttcaccctg

SEQ ID NO: 5456327 - DNA, 15 bp, Homo sapiens
tgccttcaccctgaa

SEQ ID NO: 5456328 - DNA, 17 bp, Homo sapiens
tgccttcactgggccag

SEQ ID NO: 5456329 - DNA, 20 bp, Homo sapiens
tgccttcactgggccagtca

SEQ ID NO: 5456330 - DNA, 13 bp, Homo sapiens
tgccttcagccct

SEQ ID NO: 5456331 - DNA, 18 bp, Homo sapiens
tgccttcagctctacagc

SEQ ID NO: 5456332 - DNA, 18 bp, Homo sapiens
tgccttcagctgttgcag

SEQ ID NO: 5456333 - DNA, 14 bp, Homo sapiens
tgccttcagggaga

SEQ ID NO: 5456334 - DNA, 21 bp, Homo sapiens
tgccttcagtatcaaggctgc

SEQ ID NO: 5456335 - DNA, 12 bp, Homo sapiens
tgccttcatttg

SEQ ID NO: 5456336 - DNA, 19 bp, Homo sapiens
tgccttccacgctgtctcc

SEQ ID NO: 5456337 - DNA, 15 bp, Homo sapiens
tgccttccagaaaac

SEQ ID NO: 5456338 - DNA, 18 bp, Homo sapiens
tgccttccagaaaacaaa

SEQ ID NO: 5456339 - DNA, 17 bp, Homo sapiens
tgccttccagatcctct

SEQ ID NO: 5456340 - DNA, 20 bp, Homo sapiens
tgccttccagatcctctctg

SEQ ID NO: 5456341 - DNA, 18 bp, Homo sapiens
tgccttccagcaccctgc

SEQ ID NO: 5456342 - DNA, 17 bp, Homo sapiens
tgccttccagcccagac

SEQ ID NO: 5456343 - DNA, 13 bp, Homo sapiens
tgccttccaggcg

SEQ ID NO: 5456344 - DNA, 20 bp, Homo sapiens
tgccttccatgtcggcctct

SEQ ID NO: 5456345 - DNA, 21 bp, Homo sapiens
tgccttccatgtcggcctcta

SEQ ID NO: 5456346 - DNA, 20 bp, Homo sapiens
tgccttccccttgaacctca

SEQ ID NO: 5456347 - DNA, 16 bp, Homo sapiens
tgccttccctagcttt

SEQ ID NO: 5456348 - DNA, 15 bp, Homo sapiens
tgccttcccttctct

SEQ ID NO: 5456349 - DNA, 16 bp, Homo sapiens
tgccttccgacaccac

SEQ ID NO: 5456350 - DNA, 22 bp, Homo sapiens
tgccttccgtgggtcatcccag

SEQ ID NO: 5456351 - DNA, 23 bp, Homo sapiens
tgccttcctaagcctgtggctgt

SEQ ID NO: 5456352 - DNA, 13 bp, Homo sapiens
tgccttcctcatc

SEQ ID NO: 5456353 - DNA, 16 bp, Homo sapiens
tgccttcctcatcccc

SEQ ID NO: 5456354 - DNA, 14 bp, Homo sapiens
tgccttcctcctta

SEQ ID NO: 5456355 - DNA, 17 bp, Homo sapiens
tgccttcctcgtgcaga

SEQ ID NO: 5456356 - DNA, 19 bp, Homo sapiens
tgccttcctcgtgcagagc

SEQ ID NO: 5456357 - DNA, 15 bp, Homo sapiens
tgccttcctctctct

SEQ ID NO: 5456358 - DNA, 13 bp, Homo sapiens
tgccttcctctga

SEQ ID NO: 5456359 - DNA, 21 bp, Homo sapiens
tgccttcctgtttaaaaaaag

SEQ ID NO: 5456360 - DNA, 15 bp, Homo sapiens
tgccttcctgttttt

SEQ ID NO: 5456361 - DNA, 12 bp, Homo sapiens
tgccttccttgc

SEQ ID NO: 5456362 - DNA, 16 bp, Homo sapiens
tgccttcctttctcca

SEQ ID NO: 5456363 - DNA, 20 bp, Homo sapiens
tgccttcctttctccaggac

SEQ ID NO: 5456364 - DNA, 21 bp, Homo sapiens
tgccttcctttctccaggacc

SEQ ID NO: 5456365 - DNA, 19 bp, Homo sapiens
tgccttcgctccatgtttt

SEQ ID NO: 5456366 - DNA, 23 bp, Homo sapiens
tgccttcgcttcttgcctctgtg

SEQ ID NO: 5456367 - DNA, 19 bp, Homo sapiens
tgccttcgggaaaattcaa

SEQ ID NO: 5456368 - DNA, 20 bp, Homo sapiens
tgctaattgaacatgcaatt

SEQ ID NO: 5456369 - DNA, 23 bp, Homo sapiens
tgctaattggcagcacccactca

SEQ ID NO: 5456370 - DNA, 12 bp, Homo sapiens
tgctaattgtgt

SEQ ID NO: 5456371 - DNA, 20 bp, Homo sapiens
tgctaatttatgaagatagt

SEQ ID NO: 5456372 - DNA, 16 bp, Homo sapiens
tgctaatttctgtcca

SEQ ID NO: 5456373 - DNA, 21 bp, Homo sapiens
tgctaattttattatagtaat

SEQ ID NO: 5456374 - DNA, 15 bp, Homo sapiens
tgctaattttctcaa

SEQ ID NO: 5456375 - DNA, 20 bp, Homo sapiens
tgctaattttgaaaaactgc

SEQ ID NO: 5456376 - DNA, 14 bp, Homo sapiens
tgctacaaaaacac

SEQ ID NO: 5456377 - DNA, 18 bp, Homo sapiens
tgctacaaaaacacagca

SEQ ID NO: 5456378 - DNA, 20 bp, Homo sapiens
tgctacaaaaacacagcaag

SEQ ID NO: 5456379 - DNA, 16 bp, Homo sapiens
tgctacaaagaagaca

SEQ ID NO: 5456380 - DNA, 21 bp, Homo sapiens
tgctacaaatttatgcatttc

SEQ ID NO: 5456381 - DNA, 19 bp, Homo sapiens
tgctacaacttcagcagta

SEQ ID NO: 5456382 - DNA, 20 bp, Homo sapiens
tgctacaagaatgcaaaaaa

SEQ ID NO: 5456383 - DNA, 14 bp, Homo sapiens
tgctacaataaatg

SEQ ID NO: 5456384 - DNA, 15 bp, Homo sapiens
tgctacaataaatgc

SEQ ID NO: 5456385 - DNA, 16 bp, Homo sapiens
tgctacaataaatgct

SEQ ID NO: 5456386 - DNA, 18 bp, Homo sapiens
tgctacaataaatgctga

SEQ ID NO: 5456387 - DNA, 16 bp, Homo sapiens
tgctacaatggaaacc

SEQ ID NO: 5456388 - DNA, 17 bp, Homo sapiens
tgctacacagaatgcaa

SEQ ID NO: 5456389 - DNA, 19 bp, Homo sapiens
tgctacacagacattaaga

SEQ ID NO: 5456390 - DNA, 13 bp, Homo sapiens
tgctacacaggca

SEQ ID NO: 5456391 - DNA, 14 bp, Homo sapiens
tgctacacagtata

SEQ ID NO: 5456392 - DNA, 19 bp, Homo sapiens
tgctacacatatgtgcttc

SEQ ID NO: 5456393 - DNA, 20 bp, Homo sapiens
tgctacactcgtccccctcc

SEQ ID NO: 5456394 - DNA, 17 bp, Homo sapiens
tgctacacttacaagta

SEQ ID NO: 5456395 - DNA, 13 bp, Homo sapiens
tgctacacttctg

SEQ ID NO: 5456396 - DNA, 18 bp, Homo sapiens
tgctacagaaaagaaact

SEQ ID NO: 5456397 - DNA, 14 bp, Homo sapiens
tgctacagaaaata

SEQ ID NO: 5456398 - DNA, 14 bp, Homo sapiens
tgctacagaaagca

SEQ ID NO: 5456399 - DNA, 18 bp, Homo sapiens
tgctacagagaaaatcaa

SEQ ID NO: 5456400 - DNA, 13 bp, Homo sapiens
tgctacaggaggg

SEQ ID NO: 5456401 - DNA, 15 bp, Homo sapiens
tgctacaggggccag

SEQ ID NO: 5456402 - DNA, 17 bp, Homo sapiens
tgctacatcagactcta

SEQ ID NO: 5456403 - DNA, 16 bp, Homo sapiens
tgctacatgtgctgga

SEQ ID NO: 5456404 - DNA, 14 bp, Homo sapiens
tgctaccaccagct

SEQ ID NO: 5456405 - DNA, 15 bp, Homo sapiens
tgctaccaccagctg

SEQ ID NO: 5456406 - DNA, 16 bp, Homo sapiens
tgctaccaccagctgt

SEQ ID NO: 5456407 - DNA, 18 bp, Homo sapiens
tgctaccaccagctgtgt

SEQ ID NO: 5456408 - DNA, 21 bp, Homo sapiens
tgctaccaccagctgtgtcca

SEQ ID NO: 5456409 - DNA, 22 bp, Homo sapiens
tgctaccaccagctgtgtccaa

SEQ ID NO: 5456410 - DNA, 21 bp, Homo sapiens
tgctaccacggcctcctttcc

SEQ ID NO: 5456411 - DNA, 18 bp, Homo sapiens
tgctaccagtatttagaa

SEQ ID NO: 5456412 - DNA, 19 bp, Homo sapiens
tgctacccatttacaaata

SEQ ID NO: 5456413 - DNA, 14 bp, Homo sapiens
tgctaccctccctg

SEQ ID NO: 5456414 - DNA, 15 bp, Homo sapiens
tgctaccctccctgc

SEQ ID NO: 5456415 - DNA, 15 bp, Homo sapiens
tgctaccgagaaggt

SEQ ID NO: 5456416 - DNA, 21 bp, Homo sapiens
tgctaccgccctgggctggac

SEQ ID NO: 5456417 - DNA, 22 bp, Homo sapiens
tgctaccgccctgggctggact

SEQ ID NO: 5456418 - DNA, 18 bp, Homo sapiens
tgctaccgttgacttcca

SEQ ID NO: 5456419 - DNA, 14 bp, Homo sapiens
tgctacctcactgg

SEQ ID NO: 5456420 - DNA, 16 bp, Homo sapiens
tgctacctcactgggg

SEQ ID NO: 5456421 - DNA, 17 bp, Homo sapiens
tgctacctcagtgctcc

SEQ ID NO: 5456422 - DNA, 13 bp, Homo sapiens
tgctacctctaac

SEQ ID NO: 5456423 - DNA, 15 bp, Homo sapiens
tgctacctctgagaa

SEQ ID NO: 5456424 - DNA, 17 bp, Homo sapiens
tgctacctctgagaaga

SEQ ID NO: 5456425 - DNA, 22 bp, Homo sapiens
tgctacctgggtccttttcaga

SEQ ID NO: 5456426 - DNA, 15 bp, Homo sapiens
tgctaccttgcccca

SEQ ID NO: 5456427 - DNA, 18 bp, Homo sapiens
tgctacctttcaaagctt

SEQ ID NO: 5456428 - DNA, 12 bp, Homo sapiens
tgctacgaagaa

SEQ ID NO: 5456429 - DNA, 14 bp, Homo sapiens
tgctacgtgtgaaa

SEQ ID NO: 5456430 - DNA, 22 bp, Homo sapiens
tgctacgtgtgaaatctgtctt

SEQ ID NO: 5456431 - DNA, 15 bp, Homo sapiens
tgctacgtgtgattt

SEQ ID NO: 5456432 - DNA, 19 bp, Homo sapiens
tgctacgtgtgatttttct

SEQ ID NO: 5456433 - DNA, 13 bp, Homo sapiens
tgctactaacaga

SEQ ID NO: 5456434 - DNA, 14 bp, Homo sapiens
tgctactaacagat

SEQ ID NO: 5456435 - DNA, 15 bp, Homo sapiens
tgctactaacagatt

SEQ ID NO: 5456436 - DNA, 22 bp, Homo sapiens
tgctactactgcagtctttatt

SEQ ID NO: 5456437 - DNA, 19 bp, Homo sapiens
tgctactagaaataaataa

SEQ ID NO: 5456438 - DNA, 18 bp, Homo sapiens
tgctactagctctttgag

SEQ ID NO: 5456439 - DNA, 18 bp, Homo sapiens
tgctactataatcaaatg

SEQ ID NO: 5456440 - DNA, 12 bp, Homo sapiens
tgctactcagta

SEQ ID NO: 5456441 - DNA, 18 bp, Homo sapiens
tgctactccatgcagggg

SEQ ID NO: 5456442 - DNA, 15 bp, Homo sapiens
tgctactcctgtgct

SEQ ID NO: 5456443 - DNA, 16 bp, Homo sapiens
tgctactcctgtgctc

SEQ ID NO: 5456444 - DNA, 18 bp, Homo sapiens
tgctactgaaaaaaatgg

SEQ ID NO: 5456445 - DNA, 19 bp, Homo sapiens
tgctactgaaaaaaatgga

SEQ ID NO: 5456446 - DNA, 21 bp, Homo sapiens
tgctactgcactccagcctgg

SEQ ID NO: 5456447 - DNA, 16 bp, Homo sapiens
tgctactgccaacctc

SEQ ID NO: 5456448 - DNA, 18 bp, Homo sapiens
tgctactgcccctctccg

SEQ ID NO: 5456449 - DNA, 19 bp, Homo sapiens
tgctactgcccctctccga

SEQ ID NO: 5456450 - DNA, 18 bp, Homo sapiens
tgctactggacttgaatg

SEQ ID NO: 5456451 - DNA, 21 bp, Homo sapiens
tgctactggacttgaatggtt

SEQ ID NO: 5456452 - DNA, 13 bp, Homo sapiens
tgctactggggaa

SEQ ID NO: 5456453 - DNA, 19 bp, Homo sapiens
tgctactggggaaactggc

SEQ ID NO: 5456454 - DNA, 13 bp, Homo sapiens
tgctactgtacat

SEQ ID NO: 5456455 - DNA, 13 bp, Homo sapiens
tgctactgtcagt

SEQ ID NO: 5456456 - DNA, 19 bp, Homo sapiens
tgctactgtcagtgtcctc

SEQ ID NO: 5456457 - DNA, 22 bp, Homo sapiens
tgctactgtcagtgtcctcagg

SEQ ID NO: 5456458 - DNA, 22 bp, Homo sapiens
tgctactgtcctacccaccctc

SEQ ID NO: 5456459 - DNA, 20 bp, Homo sapiens
tgctactgttgtaagaattc

SEQ ID NO: 5456460 - DNA, 23 bp, Homo sapiens
tgctactgttgtaagaattctga

SEQ ID NO: 5456461 - DNA, 19 bp, Homo sapiens
tgctacttcactgtcatct

SEQ ID NO: 5456462 - DNA, 23 bp, Homo sapiens
tgctacttcactgtcatcttcaa

SEQ ID NO: 5456463 - DNA, 19 bp, Homo sapiens
tgctacttcccactgtatg

SEQ ID NO: 5456464 - DNA, 22 bp, Homo sapiens
tgctacttccccagctctcagt

SEQ ID NO: 5456465 - DNA, 21 bp, Homo sapiens
tgctacttgaaggtacacccc

SEQ ID NO: 5456466 - DNA, 14 bp, Homo sapiens
tgctacttgagagt

SEQ ID NO: 5456467 - DNA, 23 bp, Homo sapiens
tgctacttggggacataatttca

SEQ ID NO: 5456468 - DNA, 15 bp, Homo sapiens
tgctactttatttgc

SEQ ID NO: 5456469 - DNA, 11 bp, Homo sapiens
tgctactttgc

SEQ ID NO: 5456470 - DNA, 13 bp, Homo sapiens
tgctactttgcct

SEQ ID NO: 5456471 - DNA, 18 bp, Homo sapiens
tgctactttgccttttgc

SEQ ID NO: 5456472 - DNA, 17 bp, Homo sapiens
tgctacttttacttgtt

SEQ ID NO: 5456473 - DNA, 19 bp, Homo sapiens
tgctacttttacttgttca

SEQ ID NO: 5456474 - DNA, 14 bp, Homo sapiens
tgctagaaaatcga

SEQ ID NO: 5456475 - DNA, 16 bp, Homo sapiens
tgctagaaaatttagc

SEQ ID NO: 5456476 - DNA, 15 bp, Homo sapiens
tgctagaaattttca

SEQ ID NO: 5456477 - DNA, 15 bp, Homo sapiens
tgctagaacaatggg

SEQ ID NO: 5456478 - DNA, 10 bp, Homo sapiens
tgctagaact

SEQ ID NO: 5456479 - DNA, 15 bp, Homo sapiens
tgctagaactccctt

SEQ ID NO: 5456480 - DNA, 17 bp, Homo sapiens
tgctagaactccctttc

SEQ ID NO: 5456481 - DNA, 19 bp, Homo sapiens
tgctagaactccctttcaa

SEQ ID NO: 5456482 - DNA, 12 bp, Homo sapiens
tgctagaacttt

SEQ ID NO: 5456483 - DNA, 16 bp, Homo sapiens
tgctagaactttttta

SEQ ID NO: 5456484 - DNA, 17 bp, Homo sapiens
tgctagaacttttttaa

SEQ ID NO: 5456485 - DNA, 13 bp, Homo sapiens
tgctagaagccta

SEQ ID NO: 5456486 - DNA, 15 bp, Homo sapiens
tgctagaagctgtaa

SEQ ID NO: 5456487 - DNA, 16 bp, Homo sapiens
tgctagaatacttttt

SEQ ID NO: 5456488 - DNA, 20 bp, Homo sapiens
tgctagaatagaagaaagag

SEQ ID NO: 5456489 - DNA, 18 bp, Homo sapiens
tgctagaattgatttttt

SEQ ID NO: 5456490 - DNA, 21 bp, Homo sapiens
tgctagacaaggttgctgttg

SEQ ID NO: 5456491 - DNA, 17 bp, Homo sapiens
tgctagacacattttta

SEQ ID NO: 5456492 - DNA, 22 bp, Homo sapiens
tgctagacagaaaccaagccat

SEQ ID NO: 5456493 - DNA, 15 bp, Homo sapiens
tgctagactcctcag

SEQ ID NO: 5456494 - DNA, 17 bp, Homo sapiens
tgctagactcctcagga

SEQ ID NO: 5456495 - DNA, 15 bp, Homo sapiens
tgctagagcagacag

SEQ ID NO: 5456496 - DNA, 13 bp, Homo sapiens
tgctagagcctct

SEQ ID NO: 5456497 - DNA, 16 bp, Homo sapiens
tgctagaggtggcatg

SEQ ID NO: 5456498 - DNA, 17 bp, Homo sapiens
tgctagaggttgcagca

SEQ ID NO: 5456499 - DNA, 16 bp, Homo sapiens
tgctagatccagccca

SEQ ID NO: 5456500 - DNA, 22 bp, Homo sapiens
tgctagatccagcccaaacctg

SEQ ID NO: 5456501 - DNA, 23 bp, Homo sapiens
tgctagatgagaattcagctgcc

SEQ ID NO: 5456502 - DNA, 13 bp, Homo sapiens
tgctagatttcta

SEQ ID NO: 5456503 - DNA, 20 bp, Homo sapiens
tgctagcaaacaaatggctt

SEQ ID NO: 5456504 - DNA, 20 bp, Homo sapiens
tgctagcaaatggcagaacc

SEQ ID NO: 5456505 - DNA, 18 bp, Homo sapiens
tgctagcaacaacttact

SEQ ID NO: 5456506 - DNA, 14 bp, Homo sapiens
tgctagcacagagg

SEQ ID NO: 5456507 - DNA, 12 bp, Homo sapiens
tgctagcacatg

SEQ ID NO: 5456508 - DNA, 16 bp, Homo sapiens
tgctagcacatgccct

SEQ ID NO: 5456509 - DNA, 20 bp, Homo sapiens
tgctagcacctccccagaca

SEQ ID NO: 5456510 - DNA, 20 bp, Homo sapiens
tgctagcacttggagccaag

SEQ ID NO: 5456511 - DNA, 14 bp, Homo sapiens
tgctagcaggctgt

SEQ ID NO: 5456512 - DNA, 18 bp, Homo sapiens
tgctagcagtaaaagatg

SEQ ID NO: 5456513 - DNA, 22 bp, Homo sapiens
tgctagcattaccacttccctg

SEQ ID NO: 5456514 - DNA, 15 bp, Homo sapiens
tgctagccccagaga

SEQ ID NO: 5456515 - DNA, 19 bp, Homo sapiens
tgctagccccctagtcggt

SEQ ID NO: 5456516 - DNA, 21 bp, Homo sapiens
tgctagcctcacgaaactgga

SEQ ID NO: 5456517 - DNA, 21 bp, Homo sapiens
tgctagcctgttcttttacca

SEQ ID NO: 5456518 - DNA, 18 bp, Homo sapiens
tgctagcgcgttgcctgt

SEQ ID NO: 5456519 - DNA, 19 bp, Homo sapiens
tgctagcgcgttgcctgtc

SEQ ID NO: 5456520 - DNA, 18 bp, Homo sapiens
tgctagctatatatttag

SEQ ID NO: 5456521 - DNA, 12 bp, Homo sapiens
tgctagctctta

SEQ ID NO: 5456522 - DNA, 22 bp, Homo sapiens
tgctagctttcctttacagctg

SEQ ID NO: 5456523 - DNA, 19 bp, Homo sapiens
tgctaggaacactccttca

SEQ ID NO: 5456524 - DNA, 20 bp, Homo sapiens
tgctaggaacactccttcac

SEQ ID NO: 5456525 - DNA, 21 bp, Homo sapiens
tgctaggacgcaataaattta

SEQ ID NO: 5456526 - DNA, 19 bp, Homo sapiens
tgctaggagccccagcttc

SEQ ID NO: 5456527 - DNA, 20 bp, Homo sapiens
tgctaggatgcggaaatccc

SEQ ID NO: 5456528 - DNA, 23 bp, Homo sapiens
tgctaggccagagccatgccagg

SEQ ID NO: 5456529 - DNA, 17 bp, Homo sapiens
tgctaggccagagccca

SEQ ID NO: 5456530 - DNA, 14 bp, Homo sapiens
tgctaggcccctgt

SEQ ID NO: 5456531 - DNA, 16 bp, Homo sapiens
tgctaggcccctgtgt

SEQ ID NO: 5456532 - DNA, 18 bp, Homo sapiens
tgctaggcccctgtgtag

SEQ ID NO: 5456533 - DNA, 20 bp, Homo sapiens
tgctaggcccctgtgtagta

SEQ ID NO: 5456534 - DNA, 18 bp, Homo sapiens
tgctaggcgagtgccagg

SEQ ID NO: 5456535 - DNA, 22 bp, Homo sapiens
tgctaggcgagtgccaggactc

SEQ ID NO: 5456536 - DNA, 17 bp, Homo sapiens
tgctagggaaacttccc

SEQ ID NO: 5456537 - DNA, 14 bp, Homo sapiens
tgctagggagaggg

SEQ ID NO: 5456538 - DNA, 21 bp, Homo sapiens
tgctaggggttttaggtctct

SEQ ID NO: 5456539 - DNA, 15 bp, Homo sapiens
tgctagggtgcctgc

SEQ ID NO: 5456540 - DNA, 22 bp, Homo sapiens
tgctaggtagaggcatttgtct

SEQ ID NO: 5456541 - DNA, 23 bp, Homo sapiens
tgctaggtagaggcatttgtctt

SEQ ID NO: 5456542 - DNA, 20 bp, Homo sapiens
tgctaggtataaaaaataag

SEQ ID NO: 5456543 - DNA, 21 bp, Homo sapiens
tgctaggtataaaaaataagt

SEQ ID NO: 5456544 - DNA, 22 bp, Homo sapiens
tgctaggtataaaaaataagta

SEQ ID NO: 5456545 - DNA, 16 bp, Homo sapiens
tgctcctctccaggca

SEQ ID NO: 5456546 - DNA, 14 bp, Homo sapiens
tgctcctctcccca

SEQ ID NO: 5456547 - DNA, 13 bp, Homo sapiens
tgctcctctcttt

SEQ ID NO: 5456548 - DNA, 17 bp, Homo sapiens
tgctcctctctttgtgg

SEQ ID NO: 5456549 - DNA, 12 bp, Homo sapiens
tgctcctctgcc

SEQ ID NO: 5456550 - DNA, 13 bp, Homo sapiens
tgctcctctgcct

SEQ ID NO: 5456551 - DNA, 15 bp, Homo sapiens
tgctcctctgcctgt

SEQ ID NO: 5456552 - DNA, 19 bp, Homo sapiens
tgctcctctgcctgtgccc

SEQ ID NO: 5456553 - DNA, 20 bp, Homo sapiens
tgctcctctgcctgtgcccg

SEQ ID NO: 5456554 - DNA, 22 bp, Homo sapiens
tgctcctctgcctgtgcccgct

SEQ ID NO: 5456555 - DNA, 19 bp, Homo sapiens
tgctcctcttccccagacg

SEQ ID NO: 5456556 - DNA, 20 bp, Homo sapiens
tgctcctcttgattcctggt

SEQ ID NO: 5456557 - DNA, 18 bp, Homo sapiens
tgctcctgaaccagtcct

SEQ ID NO: 5456558 - DNA, 14 bp, Homo sapiens
tgctcctgagcccc

SEQ ID NO: 5456559 - DNA, 16 bp, Homo sapiens
tgctcctgccaaccac

SEQ ID NO: 5456560 - DNA, 12 bp, Homo sapiens
tgctcctgccca

SEQ ID NO: 5456561 - DNA, 21 bp, Homo sapiens
tgctcctgcccacgtgcagca

SEQ ID NO: 5456562 - DNA, 14 bp, Homo sapiens
tgctcctgcccagc

SEQ ID NO: 5456563 - DNA, 21 bp, Homo sapiens
tgctcctgcccagccacccct

SEQ ID NO: 5456564 - DNA, 11 bp, Homo sapiens
tgctcctgctt

SEQ ID NO: 5456565 - DNA, 19 bp, Homo sapiens
tgctcctgcttttctgtcc

SEQ ID NO: 5456566 - DNA, 20 bp, Homo sapiens
tgctcctgcttttctgtcct

SEQ ID NO: 5456567 - DNA, 14 bp, Homo sapiens
tgctcctggaacct

SEQ ID NO: 5456568 - DNA, 12 bp, Homo sapiens
tgctcctgggca

SEQ ID NO: 5456569 - DNA, 20 bp, Homo sapiens
tgctcctgggctacaaggac

SEQ ID NO: 5456570 - DNA, 12 bp, Homo sapiens
tgctcctgggga

SEQ ID NO: 5456571 - DNA, 14 bp, Homo sapiens
tgctcctggggaga

SEQ ID NO: 5456572 - DNA, 21 bp, Homo sapiens
tgctcctgtacttgtcctcag

SEQ ID NO: 5456573 - DNA, 15 bp, Homo sapiens
tgctcctgtggcagg

SEQ ID NO: 5456574 - DNA, 21 bp, Homo sapiens
tgctcctgtggcggtgcagtg

SEQ ID NO: 5456575 - DNA, 21 bp, Homo sapiens
tgctcctgttcacaccagaga

SEQ ID NO: 5456576 - DNA, 23 bp, Homo sapiens
tgctccttcactgttccctctgg

SEQ ID NO: 5456577 - DNA, 21 bp, Homo sapiens
tgctccttccaacaggagctg

SEQ ID NO: 5456578 - DNA, 15 bp, Homo sapiens
tgctccttcctgtgg

SEQ ID NO: 5456579 - DNA, 19 bp, Homo sapiens
tgctccttggcacccccat

SEQ ID NO: 5456580 - DNA, 22 bp, Homo sapiens
tgctccttggcttacctgacct

SEQ ID NO: 5456581 - DNA, 14 bp, Homo sapiens
tgctccttgggccc

SEQ ID NO: 5456582 - DNA, 18 bp, Homo sapiens
tgctccttgtggcctttt

SEQ ID NO: 5456583 - DNA, 15 bp, Homo sapiens
tgctccttgttccta

SEQ ID NO: 5456584 - DNA, 17 bp, Homo sapiens
tgctccttgttcctaga

SEQ ID NO: 5456585 - DNA, 14 bp, Homo sapiens
tgctcctttaccct

SEQ ID NO: 5456586 - DNA, 18 bp, Homo sapiens
tgctcctttaccctcttg

SEQ ID NO: 5456587 - DNA, 20 bp, Homo sapiens
tgctcctttctccacacccc

SEQ ID NO: 5456588 - DNA, 12 bp, Homo sapiens
tgctcctttggg

SEQ ID NO: 5456589 - DNA, 16 bp, Homo sapiens
tgctcgcagcctggcg

SEQ ID NO: 5456590 - DNA, 23 bp, Homo sapiens
tgctcgcagcctggcggggcagg

SEQ ID NO: 5456591 - DNA, 16 bp, Homo sapiens
tgctcgcccagacacc

SEQ ID NO: 5456592 - DNA, 18 bp, Homo sapiens
tgctcgcccagacaccat

SEQ ID NO: 5456593 - DNA, 23 bp, Homo sapiens
tgctcgccctcctttctgtgccc

SEQ ID NO: 5456594 - DNA, 18 bp, Homo sapiens
tgctcgccctgtgccctc

SEQ ID NO: 5456595 - DNA, 22 bp, Homo sapiens
tgctcgccctgtgccctctcac

SEQ ID NO: 5456596 - DNA, 22 bp, Homo sapiens
tgctcgcgaaggtcccacagcc

SEQ ID NO: 5456597 - DNA, 18 bp, Homo sapiens
tgctcgcttctcctccag

SEQ ID NO: 5456598 - DNA, 22 bp, Homo sapiens
tgctcgcttgctggaacacagg

SEQ ID NO: 5456599 - DNA, 23 bp, Homo sapiens
tgctcgcttgctggaacacaggg

SEQ ID NO: 5456600 - DNA, 14 bp, Homo sapiens
tgctcggacacagt

SEQ ID NO: 5456601 - DNA, 19 bp, Homo sapiens
tgctcggagaagagcgcag

SEQ ID NO: 5456602 - DNA, 15 bp, Homo sapiens
tgctcggctactggt

SEQ ID NO: 5456603 - DNA, 23 bp, Homo sapiens
tgctcggctactggttacctgga

SEQ ID NO: 5456604 - DNA, 18 bp, Homo sapiens
tgctcggcttcttggacc

SEQ ID NO: 5456605 - DNA, 17 bp, Homo sapiens
tgctcgggaagggaggg

SEQ ID NO: 5456606 - DNA, 19 bp, Homo sapiens
tgctcgggaagggagggga

SEQ ID NO: 5456607 - DNA, 15 bp, Homo sapiens
tgctcggggtgcaca

SEQ ID NO: 5456608 - DNA, 21 bp, Homo sapiens
tgctcggggtgcacaggaggg

SEQ ID NO: 5456609 - DNA, 22 bp, Homo sapiens
tgctcggggtgcacaggagggg

SEQ ID NO: 5456610 - DNA, 15 bp, Homo sapiens
tgctcgggtgctgcc

SEQ ID NO: 5456611 - DNA, 17 bp, Homo sapiens
tgctcgggtgctgccag

SEQ ID NO: 5456612 - DNA, 23 bp, Homo sapiens
tgctcgggtgctgccagctgctc

SEQ ID NO: 5456613 - DNA, 16 bp, Homo sapiens
tgctcgtgtgatttcc

SEQ ID NO: 5456614 - DNA, 19 bp, Homo sapiens
tgctctaaaatatttatga

SEQ ID NO: 5456615 - DNA, 20 bp, Homo sapiens
tgctctaaaatatttatgaa

SEQ ID NO: 5456616 - DNA, 16 bp, Homo sapiens
tgctctaactggacat

SEQ ID NO: 5456617 - DNA, 14 bp, Homo sapiens
tgctctaagaagct

SEQ ID NO: 5456618 - DNA, 22 bp, Homo sapiens
tgctctaagaagctcgtttctt

SEQ ID NO: 5456619 - DNA, 15 bp, Homo sapiens
tgctctaagaagctg

SEQ ID NO: 5456620 - DNA, 20 bp, Homo sapiens
tgctctaagaagctgcaata

SEQ ID NO: 5456621 - DNA, 15 bp, Homo sapiens
tgctctaagcccagg

SEQ ID NO: 5456622 - DNA, 19 bp, Homo sapiens
tgctctaagcccaggatct

SEQ ID NO: 5456623 - DNA, 14 bp, Homo sapiens
tgctctaattcttt

SEQ ID NO: 5456624 - DNA, 18 bp, Homo sapiens
tgctctaccaaatagtga

SEQ ID NO: 5456625 - DNA, 13 bp, Homo sapiens
tgctctactttga

SEQ ID NO: 5456626 - DNA, 16 bp, Homo sapiens
tgctctagatgagctg

SEQ ID NO: 5456627 - DNA, 18 bp, Homo sapiens
tgctctagatgagctggg

SEQ ID NO: 5456628 - DNA, 19 bp, Homo sapiens
tgctctagatgagctgggc

SEQ ID NO: 5456629 - DNA, 21 bp, Homo sapiens
tgctctagatgagctgggccg

SEQ ID NO: 5456630 - DNA, 19 bp, Homo sapiens
tgctctagccaggagtctg

SEQ ID NO: 5456631 - DNA, 12 bp, Homo sapiens
tgctctagctgg

SEQ ID NO: 5456632 - DNA, 15 bp, Homo sapiens
tgctctagctggcag

SEQ ID NO: 5456633 - DNA, 18 bp, Homo sapiens
tgctctagctggcaggac

SEQ ID NO: 5456634 - DNA, 14 bp, Homo sapiens
tgctctagggaatc

SEQ ID NO: 5456635 - DNA, 15 bp, Homo sapiens
tgctctagggaatct

SEQ ID NO: 5456636 - DNA, 22 bp, Homo sapiens
tgctctagggccctttcttgca

SEQ ID NO: 5456637 - DNA, 18 bp, Homo sapiens
tgctctagtgggacagcc

SEQ ID NO: 5456638 - DNA, 14 bp, Homo sapiens
tgctctataaatag

SEQ ID NO: 5456639 - DNA, 20 bp, Homo sapiens
tgctctataaatagtattcc

SEQ ID NO: 5456640 - DNA, 15 bp, Homo sapiens
tgctctatactgtgg

SEQ ID NO: 5456641 - DNA, 20 bp, Homo sapiens
tgctctatctcacagcacac

SEQ ID NO: 5456642 - DNA, 23 bp, Homo sapiens
tgctctatctcacagcacactca

SEQ ID NO: 5456643 - DNA, 14 bp, Homo sapiens
tgctctatcttgct

SEQ ID NO: 5456644 - DNA, 17 bp, Homo sapiens
tgctctatgccaggctg

SEQ ID NO: 5456645 - DNA, 18 bp, Homo sapiens
tgctctatgcctcagttt

SEQ ID NO: 5456646 - DNA, 12 bp, Homo sapiens
tgctctatgctt

SEQ ID NO: 5456647 - DNA, 17 bp, Homo sapiens
tgctctatgtctgcctt

SEQ ID NO: 5456648 - DNA, 22 bp, Homo sapiens
tgctctatgtttgtatttggaa

SEQ ID NO: 5456649 - DNA, 18 bp, Homo sapiens
tgctctcaaggcttggag

SEQ ID NO: 5456650 - DNA, 22 bp, Homo sapiens
tgctctcaccttggttcctggg

SEQ ID NO: 5456651 - DNA, 13 bp, Homo sapiens
tgctctcagcctc

SEQ ID NO: 5456652 - DNA, 14 bp, Homo sapiens
tgctctcagctggc

SEQ ID NO: 5456653 - DNA, 14 bp, Homo sapiens
tgctctcagcttgt

SEQ ID NO: 5456654 - DNA, 16 bp, Homo sapiens
tgctctcagcttgtgc

SEQ ID NO: 5456655 - DNA, 19 bp, Homo sapiens
tgctctcagcttgtgcctt

SEQ ID NO: 5456656 - DNA, 20 bp, Homo sapiens
tgctctcaggctgagggagg

SEQ ID NO: 5456657 - DNA, 14 bp, Homo sapiens
tgctctcatcagaa

SEQ ID NO: 5456658 - DNA, 17 bp, Homo sapiens
tgctctccaagcccagt

SEQ ID NO: 5456659 - DNA, 19 bp, Homo sapiens
tgctctccaagtctcagtg

SEQ ID NO: 5456660 - DNA, 20 bp, Homo sapiens
tgctctccaagtctcagtgg

SEQ ID NO: 5456661 - DNA, 19 bp, Homo sapiens
tgctctccattctgctcct

SEQ ID NO: 5456662 - DNA, 21 bp, Homo sapiens
tgctctccccggcaggcctga

SEQ ID NO: 5456663 - DNA, 13 bp, Homo sapiens
tgctctcccctgc

SEQ ID NO: 5456664 - DNA, 16 bp, Homo sapiens
tgctctcccctgccct

SEQ ID NO: 5456665 - DNA, 20 bp, Homo sapiens
tgctctcccctgccctgctg

SEQ ID NO: 5456666 - DNA, 20 bp, Homo sapiens
tgctctcccggttcttccag

SEQ ID NO: 5456667 - DNA, 21 bp, Homo sapiens
tgctctccctcttctcaagtg

SEQ ID NO: 5456668 - DNA, 22 bp, Homo sapiens
tgctctccctcttctcaagtgc

SEQ ID NO: 5456669 - DNA, 22 bp, Homo sapiens
tgctctcctaccccacctcatg

SEQ ID NO: 5456670 - DNA, 16 bp, Homo sapiens
tgctctcctcatctcc

SEQ ID NO: 5456671 - DNA, 19 bp, Homo sapiens
tgctctcctcgggccctgt

SEQ ID NO: 5456672 - DNA, 13 bp, Homo sapiens
tgctctcctcttc

SEQ ID NO: 5456673 - DNA, 14 bp, Homo sapiens
tgctctcctggagc

SEQ ID NO: 5456674 - DNA, 15 bp, Homo sapiens
tgctctcctggagca

SEQ ID NO: 5456675 - DNA, 14 bp, Homo sapiens
tgctctccttcact

SEQ ID NO: 5456676 - DNA, 15 bp, Homo sapiens
tgctctccttcactc

SEQ ID NO: 5456677 - DNA, 20 bp, Homo sapiens
tgctctccttcactctgaca

SEQ ID NO: 5456678 - DNA, 17 bp, Homo sapiens
tgctctccttcctggag

SEQ ID NO: 5456679 - DNA, 23 bp, Homo sapiens
tgctctccttcctggagcccaga

SEQ ID NO: 5456680 - DNA, 15 bp, Homo sapiens
tgctctccttgccct

SEQ ID NO: 5456681 - DNA, 19 bp, Homo sapiens
tgctctccttgccctgggc

SEQ ID NO: 5456682 - DNA, 20 bp, Homo sapiens
tgctctcgaccggccctgca

SEQ ID NO: 5456683 - DNA, 13 bp, Homo sapiens
tgctctctaagaa

SEQ ID NO: 5456684 - DNA, 17 bp, Homo sapiens
tgctctctaagaattca

SEQ ID NO: 5456685 - DNA, 22 bp, Homo sapiens
tgctctctacccagcccatctt

SEQ ID NO: 5456686 - DNA, 16 bp, Homo sapiens
tgctctctatccaaaa

SEQ ID NO: 5456687 - DNA, 13 bp, Homo sapiens
tgctctctcacct

SEQ ID NO: 5456688 - DNA, 20 bp, Homo sapiens
tgctctctcattcccaggca

SEQ ID NO: 5456689 - DNA, 14 bp, Homo sapiens
tgctctctccacta

SEQ ID NO: 5456690 - DNA, 11 bp, Homo sapiens
tgctctctctc

SEQ ID NO: 5456691 - DNA, 19 bp, Homo sapiens
tgctctctctccctgcctt

SEQ ID NO: 5456692 - DNA, 12 bp, Homo sapiens
tgctctctgagg

SEQ ID NO: 5456693 - DNA, 16 bp, Homo sapiens
tgctctctgaggcaag

SEQ ID NO: 5456694 - DNA, 19 bp, Homo sapiens
tgctctctgaggcaaggcc

SEQ ID NO: 5456695 - DNA, 13 bp, Homo sapiens
tgctctctgcagc

SEQ ID NO: 5456696 - DNA, 12 bp, Homo sapiens
tgctctctgcca

SEQ ID NO: 5456697 - DNA, 13 bp, Homo sapiens
tgctctctgccac

SEQ ID NO: 5456698 - DNA, 12 bp, Homo sapiens
tgctctctgctc

SEQ ID NO: 5456699 - DNA, 16 bp, Homo sapiens
tgctctctgctcatgg

SEQ ID NO: 5456700 - DNA, 17 bp, Homo sapiens
tgctctctgctcatggg

SEQ ID NO: 5456701 - DNA, 14 bp, Homo sapiens
tgctctctgggctt

SEQ ID NO: 5456702 - DNA, 21 bp, Homo sapiens
tgctctctgttctcttgcttt

SEQ ID NO: 5456703 - DNA, 12 bp, Homo sapiens
tgctctcttcaa

SEQ ID NO: 5456704 - DNA, 13 bp, Homo sapiens
tgctctcttcagg

SEQ ID NO: 5456705 - DNA, 21 bp, Homo sapiens
tgctctgaatctgtacatgtt

SEQ ID NO: 5456706 - DNA, 23 bp, Homo sapiens
tgctctgaatctgtacatgttct

SEQ ID NO: 5456707 - DNA, 17 bp, Homo sapiens
tgctctgaatttcttct

SEQ ID NO: 5456708 - DNA, 20 bp, Homo sapiens
tgctctgaccttccagagcc

SEQ ID NO: 5456709 - DNA, 16 bp, Homo sapiens
tgctctgagaaattga

SEQ ID NO: 5456710 - DNA, 23 bp, Homo sapiens
tgctctgagaagaggagccctca

SEQ ID NO: 5456711 - DNA, 22 bp, Homo sapiens
tgctctgagacggatggaagga

SEQ ID NO: 5456712 - DNA, 17 bp, Homo sapiens
tgctctgaggcttccag

SEQ ID NO: 5456713 - DNA, 18 bp, Homo sapiens
tgctctgaggcttccaga

SEQ ID NO: 5456714 - DNA, 12 bp, Homo sapiens
tgctctgaggta

SEQ ID NO: 5456715 - DNA, 21 bp, Homo sapiens
tgctctgaggtcaataaagca

SEQ ID NO: 5456716 - DNA, 21 bp, Homo sapiens
tgctctgagtagctttacact

SEQ ID NO: 5456717 - DNA, 22 bp, Homo sapiens
tgctctgagtagctttacactg

SEQ ID NO: 5456718 - DNA, 22 bp, Homo sapiens
tgctctgatcatccactgtgcc

SEQ ID NO: 5456719 - DNA, 14 bp, Homo sapiens
tgctctgatccctc

SEQ ID NO: 5456720 - DNA, 19 bp, Homo sapiens
tgctctgatccctctacag

SEQ ID NO: 5456721 - DNA, 14 bp, Homo sapiens
tgctctgatgcagt

SEQ ID NO: 5456722 - DNA, 18 bp, Homo sapiens
tgctctgatgcagtgccc

SEQ ID NO: 5456723 - DNA, 13 bp, Homo sapiens
tgctgcgctgctt

SEQ ID NO: 5456724 - DNA, 20 bp, Homo sapiens
tgctgcggagcaagaggagg

SEQ ID NO: 5456725 - DNA, 19 bp, Homo sapiens
tgctgcggaggagctgcct

SEQ ID NO: 5456726 - DNA, 20 bp, Homo sapiens
tgctgcgtcagaccagtact

SEQ ID NO: 5456727 - DNA, 15 bp, Homo sapiens
tgctgcgtctcccat

SEQ ID NO: 5456728 - DNA, 22 bp, Homo sapiens
tgctgctaatcttcagggcact

SEQ ID NO: 5456729 - DNA, 14 bp, Homo sapiens
tgctgctaattctt

SEQ ID NO: 5456730 - DNA, 17 bp, Homo sapiens
tgctgctaccctccctg

SEQ ID NO: 5456731 - DNA, 21 bp, Homo sapiens
tgctgctaccctccctgctgt

SEQ ID NO: 5456732 - DNA, 16 bp, Homo sapiens
tgctgctaccgccctg

SEQ ID NO: 5456733 - DNA, 20 bp, Homo sapiens
tgctgctaccgccctgggct

SEQ ID NO: 5456734 - DNA, 15 bp, Homo sapiens
tgctgctactgcccc

SEQ ID NO: 5456735 - DNA, 14 bp, Homo sapiens
tgctgctagaactt

SEQ ID NO: 5456736 - DNA, 15 bp, Homo sapiens
tgctgctagaacttt

SEQ ID NO: 5456737 - DNA, 16 bp, Homo sapiens
tgctgctagaactttt

SEQ ID NO: 5456738 - DNA, 17 bp, Homo sapiens
tgctgctagaacttttt

SEQ ID NO: 5456739 - DNA, 13 bp, Homo sapiens
tgctgctatgaaa

SEQ ID NO: 5456740 - DNA, 18 bp, Homo sapiens
tgctgctattttactgtc

SEQ ID NO: 5456741 - DNA, 21 bp, Homo sapiens
tgctgctattttactgtctta

SEQ ID NO: 5456742 - DNA, 22 bp, Homo sapiens
tgctgctattttactgtcttaa

SEQ ID NO: 5456743 - DNA, 11 bp, Homo sapiens
tgctgctcact

SEQ ID NO: 5456744 - DNA, 23 bp, Homo sapiens
tgctgctcactcccgctgagccc

SEQ ID NO: 5456745 - DNA, 23 bp, Homo sapiens
tgctgctcagtaagaagattctc

SEQ ID NO: 5456746 - DNA, 15 bp, Homo sapiens
tgctgctcatccagg

SEQ ID NO: 5456747 - DNA, 15 bp, Homo sapiens
tgctgctccaccctc

SEQ ID NO: 5456748 - DNA, 16 bp, Homo sapiens
tgctgctccaccctcc

SEQ ID NO: 5456749 - DNA, 17 bp, Homo sapiens
tgctgctcccatctgca

SEQ ID NO: 5456750 - DNA, 14 bp, Homo sapiens
tgctgctccctcag

SEQ ID NO: 5456751 - DNA, 15 bp, Homo sapiens
tgctgctccctcaga

SEQ ID NO: 5456752 - DNA, 11 bp, Homo sapiens
tgctgctccta

SEQ ID NO: 5456753 - DNA, 15 bp, Homo sapiens
tgctgctcctccctc

SEQ ID NO: 5456754 - DNA, 18 bp, Homo sapiens
tgctgctcctccctctga

SEQ ID NO: 5456755 - DNA, 13 bp, Homo sapiens
tgctgctcctctt

SEQ ID NO: 5456756 - DNA, 16 bp, Homo sapiens
tgctgctctcccaagg

SEQ ID NO: 5456757 - DNA, 18 bp, Homo sapiens
tgctgctctcccaagggt

SEQ ID NO: 5456758 - DNA, 19 bp, Homo sapiens
tgctgctctcccctcccag

SEQ ID NO: 5456759 - DNA, 20 bp, Homo sapiens
tgctgctctctaagaattca

SEQ ID NO: 5456760 - DNA, 12 bp, Homo sapiens
tgctgctcttca

SEQ ID NO: 5456761 - DNA, 18 bp, Homo sapiens
tgctgctcttggctggac

SEQ ID NO: 5456762 - DNA, 14 bp, Homo sapiens
tgctgctgaagaga

SEQ ID NO: 5456763 - DNA, 21 bp, Homo sapiens
tgctgctgaatttataaaaat

SEQ ID NO: 5456764 - DNA, 17 bp, Homo sapiens
tgctgctgacccctgtg

SEQ ID NO: 5456765 - DNA, 22 bp, Homo sapiens
tgctgctgacctgatcacctct

SEQ ID NO: 5456766 - DNA, 13 bp, Homo sapiens
tgctgctgagaac

SEQ ID NO: 5456767 - DNA, 15 bp, Homo sapiens
tgctgctgagaacct

SEQ ID NO: 5456768 - DNA, 18 bp, Homo sapiens
tgctgctgagaacctggc

SEQ ID NO: 5456769 - DNA, 20 bp, Homo sapiens
tgctgctgagaacctggcct

SEQ ID NO: 5456770 - DNA, 21 bp, Homo sapiens
tgctgctgagaacctggcctt

SEQ ID NO: 5456771 - DNA, 22 bp, Homo sapiens
tgctgctgatactgggtctgcg

SEQ ID NO: 5456772 - DNA, 22 bp, Homo sapiens
tgctgctgcacccaactactga

SEQ ID NO: 5456773 - DNA, 13 bp, Homo sapiens
tgctgctgcccct

SEQ ID NO: 5456774 - DNA, 13 bp, Homo sapiens
tgctgctgcctct

SEQ ID NO: 5456775 - DNA, 19 bp, Homo sapiens
tgctgctgcctggccactg

SEQ ID NO: 5456776 - DNA, 10 bp, Homo sapiens
tgctgctgct

SEQ ID NO: 5456777 - DNA, 22 bp, Homo sapiens
tgctgctgctattgctgtctgg

SEQ ID NO: 5456778 - DNA, 16 bp, Homo sapiens
tgctgctgctcctccc

SEQ ID NO: 5456779 - DNA, 15 bp, Homo sapiens
tgctgctgctgctca

SEQ ID NO: 5456780 - DNA, 15 bp, Homo sapiens
tgctgctgctgctgc

SEQ ID NO: 5456781 - DNA, 13 bp, Homo sapiens
tgctgctgggctc

SEQ ID NO: 5456782 - DNA, 14 bp, Homo sapiens
tgctgctggggaag

SEQ ID NO: 5456783 - DNA, 21 bp, Homo sapiens
tgctgctggggaagacagtgg

SEQ ID NO: 5456784 - DNA, 16 bp, Homo sapiens
tgctgctgtaaataca

SEQ ID NO: 5456785 - DNA, 18 bp, Homo sapiens
tgctgctgtaactgctga

SEQ ID NO: 5456786 - DNA, 19 bp, Homo sapiens
tgctgctgtaactgctgag

SEQ ID NO: 5456787 - DNA, 22 bp, Homo sapiens
tgctgctgtaactgctgagcca

SEQ ID NO: 5456788 - DNA, 20 bp, Homo sapiens
tgctgctgtacaacttctgg

SEQ ID NO: 5456789 - DNA, 13 bp, Homo sapiens
tgctgctgtcacc

SEQ ID NO: 5456790 - DNA, 19 bp, Homo sapiens
tgctgctgtccagtgccta

SEQ ID NO: 5456791 - DNA, 14 bp, Homo sapiens
tgctgctgtgaatt

SEQ ID NO: 5456792 - DNA, 13 bp, Homo sapiens
tgctgctgtgcct

SEQ ID NO: 5456793 - DNA, 13 bp, Homo sapiens
tgctgctgtgctt

SEQ ID NO: 5456794 - DNA, 14 bp, Homo sapiens
tgctgctgtgtttt

SEQ ID NO: 5456795 - DNA, 10 bp, Homo sapiens
tgctgctgtt

SEQ ID NO: 5456796 - DNA, 20 bp, Homo sapiens
tgctgcttagacataacaaa

SEQ ID NO: 5456797 - DNA, 13 bp, Homo sapiens
tgctgcttcaatt

SEQ ID NO: 5456798 - DNA, 14 bp, Homo sapiens
tgctgcttcaattt

SEQ ID NO: 5456799 - DNA, 15 bp, Homo sapiens
tgctgcttcatgttt

SEQ ID NO: 5456800 - DNA, 13 bp, Homo sapiens
tgctgcttcctaa

SEQ ID NO: 5456801 - DNA, 15 bp, Homo sapiens
tgctgcttctcccag

SEQ ID NO: 5456802 - DNA, 17 bp, Homo sapiens
tgctgcttctccctggg

SEQ ID NO: 5456803 - DNA, 12 bp, Homo sapiens
tgctgcttctgc

SEQ ID NO: 5456804 - DNA, 13 bp, Homo sapiens
tgctgcttctgct

SEQ ID NO: 5456805 - DNA, 17 bp, Homo sapiens
tgctgcttctgctccag

SEQ ID NO: 5456806 - DNA, 21 bp, Homo sapiens
tgctgcttctgctccagcccc

SEQ ID NO: 5456807 - DNA, 16 bp, Homo sapiens
tgctgcttctgggcct

SEQ ID NO: 5456808 - DNA, 24 bp, Homo sapiens
tgctgcttctgggcctgatggaga

SEQ ID NO: 5456809 - DNA, 12 bp, Homo sapiens
tgctgcttgagg

SEQ ID NO: 5456810 - DNA, 20 bp, Homo sapiens
tgctgcttggagtgccccaa

SEQ ID NO: 5456811 - DNA, 14 bp, Homo sapiens
tgctgcttggattt

SEQ ID NO: 5456812 - DNA, 20 bp, Homo sapiens
tgctgcttgggacgtgtaca

SEQ ID NO: 5456813 - DNA, 15 bp, Homo sapiens
tgctgcttgtgacct

SEQ ID NO: 5456814 - DNA, 17 bp, Homo sapiens
tgctgcttgtgcctccc

SEQ ID NO: 5456815 - DNA, 23 bp, Homo sapiens
tgctgcttgtgcctcccttccca

SEQ ID NO: 5456816 - DNA, 13 bp, Homo sapiens
tgctgctttaaca

SEQ ID NO: 5456817 - DNA, 18 bp, Homo sapiens
tgctgctttaacagtgga

SEQ ID NO: 5456818 - DNA, 19 bp, Homo sapiens
tgctgctttaattgtgaat

SEQ ID NO: 5456819 - DNA, 17 bp, Homo sapiens
tgctgctttcccctgtg

SEQ ID NO: 5456820 - DNA, 19 bp, Homo sapiens
tgctgctttcccctgtggg

SEQ ID NO: 5456821 - DNA, 12 bp, Homo sapiens
tgctgctttggg

SEQ ID NO: 5456822 - DNA, 16 bp, Homo sapiens
tgctgctttgggctgg

SEQ ID NO: 5456823 - DNA, 18 bp, Homo sapiens
tgctgctttgggctggga

SEQ ID NO: 5456824 - DNA, 19 bp, Homo sapiens
tgctgctttgggctgggat

SEQ ID NO: 5456825 - DNA, 14 bp, Homo sapiens
tgctgctttgtcca

SEQ ID NO: 5456826 - DNA, 15 bp, Homo sapiens
tgctgctttgtccag

SEQ ID NO: 5456827 - DNA, 16 bp, Homo sapiens
tgctgctttgtccagg

SEQ ID NO: 5456828 - DNA, 19 bp, Homo sapiens
tgctgctttgttgttctgc

SEQ ID NO: 5456829 - DNA, 19 bp, Homo sapiens
tgctgcttttatatctgta

SEQ ID NO: 5456830 - DNA, 18 bp, Homo sapiens
tgctgctttttggcacag

SEQ ID NO: 5456831 - DNA, 18 bp, Homo sapiens
tgctggaaaactgccaca

SEQ ID NO: 5456832 - DNA, 13 bp, Homo sapiens
tgctggaaaatca

SEQ ID NO: 5456833 - DNA, 18 bp, Homo sapiens
tgctggaaacacagtcac

SEQ ID NO: 5456834 - DNA, 12 bp, Homo sapiens
tgctggaaataa

SEQ ID NO: 5456835 - DNA, 18 bp, Homo sapiens
tgctggaacacaggggcc

SEQ ID NO: 5456836 - DNA, 17 bp, Homo sapiens
tgctggaacctgcaaaa

SEQ ID NO: 5456837 - DNA, 21 bp, Homo sapiens
tgctggaagaattctagcatg

SEQ ID NO: 5456838 - DNA, 13 bp, Homo sapiens
tgctggaagacag

SEQ ID NO: 5456839 - DNA, 22 bp, Homo sapiens
tgctggaagacgcaagggcctg

SEQ ID NO: 5456840 - DNA, 14 bp, Homo sapiens
tgctggaagctgtc

SEQ ID NO: 5456841 - DNA, 11 bp, Homo sapiens
tgctggaagtc

SEQ ID NO: 5456842 - DNA, 17 bp, Homo sapiens
tgctggaataagttcaa

SEQ ID NO: 5456843 - DNA, 21 bp, Homo sapiens
tgctggaattccacagggacc

SEQ ID NO: 5456844 - DNA, 17 bp, Homo sapiens
tgctggaattctaacaa

SEQ ID NO: 5456845 - DNA, 16 bp, Homo sapiens
tgctggacagtatcac

SEQ ID NO: 5456846 - DNA, 21 bp, Homo sapiens
tgctggaccaaggtgcggacc

SEQ ID NO: 5456847 - DNA, 19 bp, Homo sapiens
tgctggaccagctggcctg

SEQ ID NO: 5456848 - DNA, 20 bp, Homo sapiens
tgctggacggcattcctgct

SEQ ID NO: 5456849 - DNA, 17 bp, Homo sapiens
tgctggactgaggacca

SEQ ID NO: 5456850 - DNA, 11 bp, Homo sapiens
tgctggactgt

SEQ ID NO: 5456851 - DNA, 16 bp, Homo sapiens
tgctggactgtggagg

SEQ ID NO: 5456852 - DNA, 22 bp, Homo sapiens
tgctggactttaaaaaaacaat

SEQ ID NO: 5456853 - DNA, 20 bp, Homo sapiens
tgctggagaaagccacgccc

SEQ ID NO: 5456854 - DNA, 22 bp, Homo sapiens
tgctggagaagagaggagagga

SEQ ID NO: 5456855 - DNA, 21 bp, Homo sapiens
tgctggagaattgactgaagc

SEQ ID NO: 5456856 - DNA, 22 bp, Homo sapiens
tgctggagaggccccagccgct

SEQ ID NO: 5456857 - DNA, 18 bp, Homo sapiens
tgctggagcactgggctc

SEQ ID NO: 5456858 - DNA, 23 bp, Homo sapiens
tgctggagcccgcactgtcccag

SEQ ID NO: 5456859 - DNA, 14 bp, Homo sapiens
tgctggagccctgt

SEQ ID NO: 5456860 - DNA, 12 bp, Homo sapiens
tgctggagcctg

SEQ ID NO: 5456861 - DNA, 14 bp, Homo sapiens
tgctggagctctgc

SEQ ID NO: 5456862 - DNA, 16 bp, Homo sapiens
tgctggagctggcttt

SEQ ID NO: 5456863 - DNA, 17 bp, Homo sapiens
tgctggaggcagactcg

SEQ ID NO: 5456864 - DNA, 13 bp, Homo sapiens
tgctggaggccct

SEQ ID NO: 5456865 - DNA, 11 bp, Homo sapiens
tgctggagggg

SEQ ID NO: 5456866 - DNA, 19 bp, Homo sapiens
tgctggaggggctgtcctc

SEQ ID NO: 5456867 - DNA, 18 bp, Homo sapiens
tgctggaggggtggccca

SEQ ID NO: 5456868 - DNA, 19 bp, Homo sapiens
tgctggaggggtggcccag

SEQ ID NO: 5456869 - DNA, 20 bp, Homo sapiens
tgctggaggggtggcccaga

SEQ ID NO: 5456870 - DNA, 24 bp, Homo sapiens
tgctggaggggtggcccagagcca

SEQ ID NO: 5456871 - DNA, 14 bp, Homo sapiens
tgctggaggtggga

SEQ ID NO: 5456872 - DNA, 15 bp, Homo sapiens
tgctggaggtgggag

SEQ ID NO: 5456873 - DNA, 18 bp, Homo sapiens
tgctggaggtgggagcag

SEQ ID NO: 5456874 - DNA, 22 bp, Homo sapiens
tgctggaggtgggagcaggaga

SEQ ID NO: 5456875 - DNA, 16 bp, Homo sapiens
tgctggagtccagtgc

SEQ ID NO: 5456876 - DNA, 18 bp, Homo sapiens
tgctggagtccagtgctt

SEQ ID NO: 5456877 - DNA, 17 bp, Homo sapiens
tgctggagtcctgttct

SEQ ID NO: 5456878 - DNA, 16 bp, Homo sapiens
tgctggagtgctggct

SEQ ID NO: 5456879 - DNA, 16 bp, Homo sapiens
tgctggatactggaca

SEQ ID NO: 5456880 - DNA, 18 bp, Homo sapiens
tgctggatactggacaca

SEQ ID NO: 5456881 - DNA, 16 bp, Homo sapiens
tgctggatattttcaa

SEQ ID NO: 5456882 - DNA, 17 bp, Homo sapiens
tgctggatggagcccag

SEQ ID NO: 5456883 - DNA, 13 bp, Homo sapiens
tgctggatgggac

SEQ ID NO: 5456884 - DNA, 22 bp, Homo sapiens
tgctggatggtattaatcttgt

SEQ ID NO: 5456885 - DNA, 18 bp, Homo sapiens
tgctggatgtcaccaaga

SEQ ID NO: 5456886 - DNA, 22 bp, Homo sapiens
tgctggatgtctgccaattttt

SEQ ID NO: 5456887 - DNA, 15 bp, Homo sapiens
tgctggattaatgtt

SEQ ID NO: 5456888 - DNA, 19 bp, Homo sapiens
tgctggattctaaattatg

SEQ ID NO: 5456889 - DNA, 13 bp, Homo sapiens
tgctggatttgat

SEQ ID NO: 5456890 - DNA, 18 bp, Homo sapiens
tgctggcaaatccaggct

SEQ ID NO: 5456891 - DNA, 20 bp, Homo sapiens
tgctggcacatttccccaga

SEQ ID NO: 5456892 - DNA, 16 bp, Homo sapiens
tgctggcagcctcagg

SEQ ID NO: 5456893 - DNA, 15 bp, Homo sapiens
tgctggcagggccag

SEQ ID NO: 5456894 - DNA, 18 bp, Homo sapiens
tgctggcagggccagggc

SEQ ID NO: 5456895 - DNA, 18 bp, Homo sapiens
tgctggcatcaagaggtg

SEQ ID NO: 5456896 - DNA, 18 bp, Homo sapiens
tgctggcatgtctgggtc

SEQ ID NO: 5456897 - DNA, 20 bp, Homo sapiens
tgctggcatgtctgggtcgt

SEQ ID NO: 5456898 - DNA, 18 bp, Homo sapiens
tgctggccaaatagcaaa

SEQ ID NO: 5456899 - DNA, 23 bp, Homo sapiens
tgctggccacaaggaaaaggagg

SEQ ID NO: 5456900 - DNA, 17 bp, Homo sapiens
tgctggccacagaaagg

SEQ ID NO: 5456901 - DNA, 17 bp, Homo sapiens
tgctggccagcaccctc

SEQ ID NO: 5456902 - DNA, 19 bp, Homo sapiens
tgcttagtgaaaatactag

SEQ ID NO: 5456903 - DNA, 12 bp, Homo sapiens
tgcttagtttta

SEQ ID NO: 5456904 - DNA, 15 bp, Homo sapiens
tgcttataaacattt

SEQ ID NO: 5456905 - DNA, 13 bp, Homo sapiens
tgcttataacatt

SEQ ID NO: 5456906 - DNA, 23 bp, Homo sapiens
tgcttataacctagttaaagaaa

SEQ ID NO: 5456907 - DNA, 21 bp, Homo sapiens
tgcttataagagagagttaaa

SEQ ID NO: 5456908 - DNA, 16 bp, Homo sapiens
tgcttatattgttcac

SEQ ID NO: 5456909 - DNA, 17 bp, Homo sapiens
tgcttatattgttttca

SEQ ID NO: 5456910 - DNA, 16 bp, Homo sapiens
tgcttatcagtgtgca

SEQ ID NO: 5456911 - DNA, 19 bp, Homo sapiens
tgcttatcagtgtgcaata

SEQ ID NO: 5456912 - DNA, 20 bp, Homo sapiens
tgcttatgaatatttataac

SEQ ID NO: 5456913 - DNA, 22 bp, Homo sapiens
tgcttatgatgggctccccagg

SEQ ID NO: 5456914 - DNA, 23 bp, Homo sapiens
tgcttatgatgggctccccagga

SEQ ID NO: 5456915 - DNA, 20 bp, Homo sapiens
tgcttatgtatgcctattca

SEQ ID NO: 5456916 - DNA, 12 bp, Homo sapiens
tgcttatgtgta

SEQ ID NO: 5456917 - DNA, 15 bp, Homo sapiens
tgcttatgtgtaggt

SEQ ID NO: 5456918 - DNA, 16 bp, Homo sapiens
tgcttatgtgttgcat

SEQ ID NO: 5456919 - DNA, 15 bp, Homo sapiens
tgcttattaagacca

SEQ ID NO: 5456920 - DNA, 19 bp, Homo sapiens
tgcttattacatttaaatc

SEQ ID NO: 5456921 - DNA, 22 bp, Homo sapiens
tgcttattacatttaaatcctt

SEQ ID NO: 5456922 - DNA, 21 bp, Homo sapiens
tgcttattccatgactgcttg

SEQ ID NO: 5456923 - DNA, 22 bp, Homo sapiens
tgcttattccatgactgcttgc

SEQ ID NO: 5456924 - DNA, 21 bp, Homo sapiens
tgcttattgatgaggtttatt

SEQ ID NO: 5456925 - DNA, 13 bp, Homo sapiens
tgcttatttatat

SEQ ID NO: 5456926 - DNA, 19 bp, Homo sapiens
tgcttatttattgtattct

SEQ ID NO: 5456927 - DNA, 23 bp, Homo sapiens
tgcttatttgacaacgtttcagc

SEQ ID NO: 5456928 - DNA, 16 bp, Homo sapiens
tgcttattttgtttca

SEQ ID NO: 5456929 - DNA, 15 bp, Homo sapiens
tgcttatttttataa

SEQ ID NO: 5456930 - DNA, 22 bp, Homo sapiens
tgcttatttttataattaaaga

SEQ ID NO: 5456931 - DNA, 13 bp, Homo sapiens
tgcttcaaaaaca

SEQ ID NO: 5456932 - DNA, 18 bp, Homo sapiens
tgcttcaaaccctcaaga

SEQ ID NO: 5456933 - DNA, 18 bp, Homo sapiens
tgcttcaaactaacacat

SEQ ID NO: 5456934 - DNA, 19 bp, Homo sapiens
tgcttcaaactaacacatt

SEQ ID NO: 5456935 - DNA, 21 bp, Homo sapiens
tgcttcaaactgagacagatg

SEQ ID NO: 5456936 - DNA, 17 bp, Homo sapiens
tgcttcaaatccatcca

SEQ ID NO: 5456937 - DNA, 20 bp, Homo sapiens
tgcttcaaattcaaggcctt

SEQ ID NO: 5456938 - DNA, 23 bp, Homo sapiens
tgcttcaagagaaaatgcggtta

SEQ ID NO: 5456939 - DNA, 16 bp, Homo sapiens
tgcttcaaggatcctg

SEQ ID NO: 5456940 - DNA, 16 bp, Homo sapiens
tgcttcaagtgttgct

SEQ ID NO: 5456941 - DNA, 21 bp, Homo sapiens
tgcttcaagtgttttggtgtt

SEQ ID NO: 5456942 - DNA, 13 bp, Homo sapiens
tgcttcaatagtt

SEQ ID NO: 5456943 - DNA, 15 bp, Homo sapiens
tgcttcaattaataa

SEQ ID NO: 5456944 - DNA, 16 bp, Homo sapiens
tgcttcaattaataaa

SEQ ID NO: 5456945 - DNA, 14 bp, Homo sapiens
tgcttcaatttcaa

SEQ ID NO: 5456946 - DNA, 17 bp, Homo sapiens
tgcttcaatttcaaact

SEQ ID NO: 5456947 - DNA, 12 bp, Homo sapiens
tgcttcacacaa

SEQ ID NO: 5456948 - DNA, 14 bp, Homo sapiens
tgcttcacacaaag

SEQ ID NO: 5456949 - DNA, 14 bp, Homo sapiens
tgcttcacacccct

SEQ ID NO: 5456950 - DNA, 15 bp, Homo sapiens
tgcttcacacccctc

SEQ ID NO: 5456951 - DNA, 16 bp, Homo sapiens
tgcttcacacccctca

SEQ ID NO: 5456952 - DNA, 21 bp, Homo sapiens
tgcttcacaggttttatgtgt

SEQ ID NO: 5456953 - DNA, 16 bp, Homo sapiens
tgcttcacagtagagc

SEQ ID NO: 5456954 - DNA, 21 bp, Homo sapiens
tgcttcacagtagagccagct

SEQ ID NO: 5456955 - DNA, 17 bp, Homo sapiens
tgcttcaccagactttt

SEQ ID NO: 5456956 - DNA, 16 bp, Homo sapiens
tgcttcactgccccct

SEQ ID NO: 5456957 - DNA, 16 bp, Homo sapiens
tgcttcacttctccca

SEQ ID NO: 5456958 - DNA, 22 bp, Homo sapiens
tgcttcactttgccttctggtt

SEQ ID NO: 5456959 - DNA, 13 bp, Homo sapiens
tgcttcagagttt

SEQ ID NO: 5456960 - DNA, 18 bp, Homo sapiens
tgcttcagagtttgtgtg

SEQ ID NO: 5456961 - DNA, 21 bp, Homo sapiens
tgcttcagatgtggagccagg

SEQ ID NO: 5456962 - DNA, 22 bp, Homo sapiens
tgcttcagatgtggagccaggc

SEQ ID NO: 5456963 - DNA, 22 bp, Homo sapiens
tgcttcagccctggcccctgtg

SEQ ID NO: 5456964 - DNA, 23 bp, Homo sapiens
tgcttcagcctgaggctgagact

SEQ ID NO: 5456965 - DNA, 22 bp, Homo sapiens
tgcttcaggagtttcatgttgg

SEQ ID NO: 5456966 - DNA, 14 bp, Homo sapiens
tgcttcatacaggg

SEQ ID NO: 5456967 - DNA, 20 bp, Homo sapiens
tgcttcatagtattggagca

SEQ ID NO: 5456968 - DNA, 12 bp, Homo sapiens
tgcttcatatct

SEQ ID NO: 5456969 - DNA, 16 bp, Homo sapiens
tgcttcatatctctcc

SEQ ID NO: 5456970 - DNA, 17 bp, Homo sapiens
tgcttcatatctctccc

SEQ ID NO: 5456971 - DNA, 20 bp, Homo sapiens
tgcttcatatctctcccttc

SEQ ID NO: 5456972 - DNA, 18 bp, Homo sapiens
tgcttcatccaatgtgaa

SEQ ID NO: 5456973 - DNA, 15 bp, Homo sapiens
tgcttcatctggagt

SEQ ID NO: 5456974 - DNA, 20 bp, Homo sapiens
tgcttcatgaaaatcctacc

SEQ ID NO: 5456975 - DNA, 21 bp, Homo sapiens
tgcttcatgaaaatcctacca

SEQ ID NO: 5456976 - DNA, 19 bp, Homo sapiens
tgcttcatgtgtcccagaa

SEQ ID NO: 5456977 - DNA, 18 bp, Homo sapiens
tgcttcatgtttgccttc

SEQ ID NO: 5456978 - DNA, 23 bp, Homo sapiens
tgcttcattaaaacaagagacca

SEQ ID NO: 5456979 - DNA, 13 bp, Homo sapiens
tgcttcattgtta

SEQ ID NO: 5456980 - DNA, 17 bp, Homo sapiens
tgcttcattttggagct

SEQ ID NO: 5456981 - DNA, 15 bp, Homo sapiens
tgcttcatttttgta

SEQ ID NO: 5456982 - DNA, 16 bp, Homo sapiens
tgcttcatttttgtaa

SEQ ID NO: 5456983 - DNA, 23 bp, Homo sapiens
tgcttccaaaagtgatagtgtgt

SEQ ID NO: 5456984 - DNA, 19 bp, Homo sapiens
tgcttccaagaccatttgt

SEQ ID NO: 5456985 - DNA, 19 bp, Homo sapiens
tgcttccaagcccttccct

SEQ ID NO: 5456986 - DNA, 22 bp, Homo sapiens
tgcttccaagcccttccctctg

SEQ ID NO: 5456987 - DNA, 14 bp, Homo sapiens
tgcttccacctcac

SEQ ID NO: 5456988 - DNA, 18 bp, Homo sapiens
tgcttccacctcacccca

SEQ ID NO: 5456989 - DNA, 19 bp, Homo sapiens
tgcttccacctcaccccac

SEQ ID NO: 5456990 - DNA, 23 bp, Homo sapiens
tgcttccactaccaaaagacatt

SEQ ID NO: 5456991 - DNA, 13 bp, Homo sapiens
tgcttccagaaac

SEQ ID NO: 5456992 - DNA, 16 bp, Homo sapiens
tgcttccaggaaactc

SEQ ID NO: 5456993 - DNA, 21 bp, Homo sapiens
tgcttccaggtaaaaacagat

SEQ ID NO: 5456994 - DNA, 16 bp, Homo sapiens
tgcttccaggtggcag

SEQ ID NO: 5456995 - DNA, 22 bp, Homo sapiens
tgcttccatggccgtgtagaag

SEQ ID NO: 5456996 - DNA, 19 bp, Homo sapiens
tgcttccatggcttcctga

SEQ ID NO: 5456997 - DNA, 20 bp, Homo sapiens
tgcttccatggcttcctgag

SEQ ID NO: 5456998 - DNA, 13 bp, Homo sapiens
tgcttccattatt

SEQ ID NO: 5456999 - DNA, 17 bp, Homo sapiens
tgcttcccacctccctg

SEQ ID NO: 5457000 - DNA, 20 bp, Homo sapiens
tgcttcccacctccctgccc

SEQ ID NO: 5457001 - DNA, 13 bp, Homo sapiens
tgcttcccactgg

SEQ ID NO: 5457002 - DNA, 17 bp, Homo sapiens
tgcttcccactggggcc

SEQ ID NO: 5457003 - DNA, 12 bp, Homo sapiens
tgcttcccagag

SEQ ID NO: 5457004 - DNA, 13 bp, Homo sapiens
tgcttcccagagg

SEQ ID NO: 5457005 - DNA, 19 bp, Homo sapiens
tgcttcccagagggagcag

SEQ ID NO: 5457006 - DNA, 16 bp, Homo sapiens
tgcttcccatcctacc

SEQ ID NO: 5457007 - DNA, 18 bp, Homo sapiens
tgcttcccatcctaccct

SEQ ID NO: 5457008 - DNA, 17 bp, Homo sapiens
tgcttcccattgtggct

SEQ ID NO: 5457009 - DNA, 20 bp, Homo sapiens
tgcttccccaaaggccaaca

SEQ ID NO: 5457010 - DNA, 19 bp, Homo sapiens
tgcttccccaggctgccca

SEQ ID NO: 5457011 - DNA, 19 bp, Homo sapiens
tgcttcccccacccctcca

SEQ ID NO: 5457012 - DNA, 22 bp, Homo sapiens
tgcttccccctccccctcctgc

SEQ ID NO: 5457013 - DNA, 15 bp, Homo sapiens
tgcttcccctcccta

SEQ ID NO: 5457014 - DNA, 19 bp, Homo sapiens
tgcttccccttcctaagtc

SEQ ID NO: 5457015 - DNA, 13 bp, Homo sapiens
tgcttccctgcag

SEQ ID NO: 5457016 - DNA, 15 bp, Homo sapiens
tgcttccctgcagct

SEQ ID NO: 5457017 - DNA, 18 bp, Homo sapiens
tgcttccctgcagctgac

SEQ ID NO: 5457018 - DNA, 14 bp, Homo sapiens
tgcttccctggggc

SEQ ID NO: 5457019 - DNA, 23 bp, Homo sapiens
tgcttcccttttttcctttccac

SEQ ID NO: 5457020 - DNA, 15 bp, Homo sapiens
tgcttccgccactca

SEQ ID NO: 5457021 - DNA, 14 bp, Homo sapiens
tgcttcctaactta

SEQ ID NO: 5457022 - DNA, 12 bp, Homo sapiens
tgcttcctagaa

SEQ ID NO: 5457023 - DNA, 22 bp, Homo sapiens
tgcttcctagaagttactgaat

SEQ ID NO: 5457024 - DNA, 12 bp, Homo sapiens
tgcttcctagta

SEQ ID NO: 5457025 - DNA, 23 bp, Homo sapiens
tgcttcctcagggcccagcaggc

SEQ ID NO: 5457026 - DNA, 13 bp, Homo sapiens
tgcttcctcctgg

SEQ ID NO: 5457027 - DNA, 18 bp, Homo sapiens
tgcttcctcgtgccaatt

SEQ ID NO: 5457028 - DNA, 15 bp, Homo sapiens
tgcttcctgaaagct

SEQ ID NO: 5457029 - DNA, 12 bp, Homo sapiens
tgcttcctgagc

SEQ ID NO: 5457030 - DNA, 11 bp, Homo sapiens
tgcttcctgat

SEQ ID NO: 5457031 - DNA, 23 bp, Homo sapiens
tgcttcctgattaccagtctgat

SEQ ID NO: 5457032 - DNA, 14 bp, Homo sapiens
tgcttcctgctgta

SEQ ID NO: 5457033 - DNA, 14 bp, Homo sapiens
tgcttcctggaccg

SEQ ID NO: 5457034 - DNA, 19 bp, Homo sapiens
tgcttcctgtgtaacatct

SEQ ID NO: 5457035 - DNA, 23 bp, Homo sapiens
tgcttcctgtgtaacatctgcca

SEQ ID NO: 5457036 - DNA, 13 bp, Homo sapiens
tgcttccttcagt

SEQ ID NO: 5457037 - DNA, 19 bp, Homo sapiens
tgcttccttctgcacccag

SEQ ID NO: 5457038 - DNA, 17 bp, Homo sapiens
tgcttccttgcttttat

SEQ ID NO: 5457039 - DNA, 21 bp, Homo sapiens
tgcttcctttctctcctggct

SEQ ID NO: 5457040 - DNA, 16 bp, Homo sapiens
tgcttcgaagtattca

SEQ ID NO: 5457041 - DNA, 21 bp, Homo sapiens
tgcttcgactactgctcctgt

SEQ ID NO: 5457042 - DNA, 23 bp, Homo sapiens
tgcttctaaatgcccagttcact

SEQ ID NO: 5457043 - DNA, 17 bp, Homo sapiens
tgcttctaagtaaatac

SEQ ID NO: 5457044 - DNA, 14 bp, Homo sapiens
tgcttctacatgat

SEQ ID NO: 5457045 - DNA, 18 bp, Homo sapiens
tgcttctaccaactggaa

SEQ ID NO: 5457046 - DNA, 21 bp, Homo sapiens
tgcttctaccaactggaagca

SEQ ID NO: 5457047 - DNA, 23 bp, Homo sapiens
tgcttctaccaactggaagcaca

SEQ ID NO: 5457048 - DNA, 14 bp, Homo sapiens
tgcttctactgtga

SEQ ID NO: 5457049 - DNA, 23 bp, Homo sapiens
tgcttctactttcatcttaaact

SEQ ID NO: 5457050 - DNA, 22 bp, Homo sapiens
tgcttctagaaactctggctca

SEQ ID NO: 5457051 - DNA, 19 bp, Homo sapiens
tgcttctataattttgcct

SEQ ID NO: 5457052 - DNA, 18 bp, Homo sapiens
tgcttctatttatagaat

SEQ ID NO: 5457053 - DNA, 21 bp, Homo sapiens
tgcttctcaactaaagaatag

SEQ ID NO: 5457054 - DNA, 14 bp, Homo sapiens
tgcttctcagcccc

SEQ ID NO: 5457055 - DNA, 15 bp, Homo sapiens
tgcttctcaggctat

SEQ ID NO: 5457056 - DNA, 18 bp, Homo sapiens
tgcttctcatcttgtgaa

SEQ ID NO: 5457057 - DNA, 19 bp, Homo sapiens
tgcttctcatcttgtgaaa

SEQ ID NO: 5457058 - DNA, 21 bp, Homo sapiens
tgcttctccaaaaatctgcct

SEQ ID NO: 5457059 - DNA, 13 bp, Homo sapiens
tgcttctccacct

SEQ ID NO: 5457060 - DNA, 21 bp, Homo sapiens
tgcttctccagtttttgagga

SEQ ID NO: 5457061 - DNA, 11 bp, Homo sapiens
tgcttctcccc

SEQ ID NO: 5457062 - DNA, 16 bp, Homo sapiens
tgcttctccccagaat

SEQ ID NO: 5457063 - DNA, 20 bp, Homo sapiens
tgcttctccccccatcccag

SEQ ID NO: 5457064 - DNA, 23 bp, Homo sapiens
tgcttctccccccatcccagggt

SEQ ID NO: 5457065 - DNA, 21 bp, Homo sapiens
tgcttctcccgccattggcct

SEQ ID NO: 5457066 - DNA, 22 bp, Homo sapiens
tgcttctcccgccattggcctt

SEQ ID NO: 5457067 - DNA, 16 bp, Homo sapiens
tgcttctcccggggac

SEQ ID NO: 5457068 - DNA, 13 bp, Homo sapiens
tgcttctccctca

SEQ ID NO: 5457069 - DNA, 23 bp, Homo sapiens
tgcttctcctcccagcgtgtgta

SEQ ID NO: 5457070 - DNA, 16 bp, Homo sapiens
tgcttctcctgatcct

SEQ ID NO: 5457071 - DNA, 21 bp, Homo sapiens
tgcttctcggaggccaggccc

SEQ ID NO: 5457072 - DNA, 22 bp, Homo sapiens
tgcttctcggaggccaggccct

SEQ ID NO: 5457073 - DNA, 16 bp, Homo sapiens
tgcttctcggccagcc

SEQ ID NO: 5457074 - DNA, 19 bp, Homo sapiens
tgcttctcggggtccagtg

SEQ ID NO: 5457075 - DNA, 10 bp, Homo sapiens
tgcttctcta

SEQ ID NO: 5457076 - DNA, 16 bp, Homo sapiens
tgcttctctacagact

SEQ ID NO: 5457077 - DNA, 17 bp, Homo sapiens
tgcttctctcatagtgt

SEQ ID NO: 5457078 - DNA, 12 bp, Homo sapiens
tggaaaatatac

SEQ ID NO: 5457079 - DNA, 13 bp, Homo sapiens
tggaaaatataca

SEQ ID NO: 5457080 - DNA, 16 bp, Homo sapiens
tggaaaatatacaagt

SEQ ID NO: 5457081 - DNA, 14 bp, Homo sapiens
tggaaaatcatatt

SEQ ID NO: 5457082 - DNA, 21 bp, Homo sapiens
tggaaaatcatattgagaata

SEQ ID NO: 5457083 - DNA, 18 bp, Homo sapiens
tggaaaatgtatattttg

SEQ ID NO: 5457084 - DNA, 17 bp, Homo sapiens
tggaaaatgtcctgtgg

SEQ ID NO: 5457085 - DNA, 15 bp, Homo sapiens
tggaaaatgtgtctc

SEQ ID NO: 5457086 - DNA, 21 bp, Homo sapiens
tggaaaatgttctgacagcat

SEQ ID NO: 5457087 - DNA, 17 bp, Homo sapiens
tggaaaattaattctaa

SEQ ID NO: 5457088 - DNA, 16 bp, Homo sapiens
tggaaacaaaacagaa

SEQ ID NO: 5457089 - DNA, 14 bp, Homo sapiens
tggaaacaaagtgg

SEQ ID NO: 5457090 - DNA, 13 bp, Homo sapiens
tggaaacaagatg

SEQ ID NO: 5457091 - DNA, 20 bp, Homo sapiens
tggaaacaaggaaggacatt

SEQ ID NO: 5457092 - DNA, 22 bp, Homo sapiens
tggaaacaaggaaggacatttc

SEQ ID NO: 5457093 - DNA, 17 bp, Homo sapiens
tggaaacaatgtggagt

SEQ ID NO: 5457094 - DNA, 13 bp, Homo sapiens
tggaaacactaaa

SEQ ID NO: 5457095 - DNA, 16 bp, Homo sapiens
tggaaacactaaatgt

SEQ ID NO: 5457096 - DNA, 17 bp, Homo sapiens
tggaaacactaaatgtt

SEQ ID NO: 5457097 - DNA, 18 bp, Homo sapiens
tggaaacactaaatgtta

SEQ ID NO: 5457098 - DNA, 12 bp, Homo sapiens
tggaaacagagg

SEQ ID NO: 5457099 - DNA, 18 bp, Homo sapiens
tggaaacagaggaccagc

SEQ ID NO: 5457100 - DNA, 20 bp, Homo sapiens
tggaaacagaggaccagcac

SEQ ID NO: 5457101 - DNA, 20 bp, Homo sapiens
tggaaacagaggtaaaaaaa

SEQ ID NO: 5457102 - DNA, 12 bp, Homo sapiens
tggaaacagcat

SEQ ID NO: 5457103 - DNA, 14 bp, Homo sapiens
tggaaacagcatga

SEQ ID NO: 5457104 - DNA, 18 bp, Homo sapiens
tggaaacagcatgaataa

SEQ ID NO: 5457105 - DNA, 12 bp, Homo sapiens
tggaaacagctg

SEQ ID NO: 5457106 - DNA, 14 bp, Homo sapiens
tggaaacaggacca

SEQ ID NO: 5457107 - DNA, 17 bp, Homo sapiens
tggaaacagggcagtga

SEQ ID NO: 5457108 - DNA, 15 bp, Homo sapiens
tggaaacatctgatt

SEQ ID NO: 5457109 - DNA, 17 bp, Homo sapiens
tggaaacatctgatttc

SEQ ID NO: 5457110 - DNA, 13 bp, Homo sapiens
tggaaacatttta

SEQ ID NO: 5457111 - DNA, 21 bp, Homo sapiens
tggaaacatttttgagatatt

SEQ ID NO: 5457112 - DNA, 18 bp, Homo sapiens
tggaaacattttttaaaa

SEQ ID NO: 5457113 - DNA, 19 bp, Homo sapiens
tggaaaccaaataggcttt

SEQ ID NO: 5457114 - DNA, 15 bp, Homo sapiens
tggaaaccacacttc

SEQ ID NO: 5457115 - DNA, 12 bp, Homo sapiens
tggaaaccagaa

SEQ ID NO: 5457116 - DNA, 16 bp, Homo sapiens
tggaaaccatgcacta

SEQ ID NO: 5457117 - DNA, 21 bp, Homo sapiens
tggaaacccataggcccacac

SEQ ID NO: 5457118 - DNA, 18 bp, Homo sapiens
tggaaacccgagggttga

SEQ ID NO: 5457119 - DNA, 15 bp, Homo sapiens
tggaaacctgccctg

SEQ ID NO: 5457120 - DNA, 20 bp, Homo sapiens
tggaaacctgccctgcctga

SEQ ID NO: 5457121 - DNA, 17 bp, Homo sapiens
tggaaacctgtcattgt

SEQ ID NO: 5457122 - DNA, 19 bp, Homo sapiens
tggaaacctgtctgaggtt

SEQ ID NO: 5457123 - DNA, 16 bp, Homo sapiens
tggaaaccttccaccc

SEQ ID NO: 5457124 - DNA, 22 bp, Homo sapiens
tggaaacggtatcctccctgcc

SEQ ID NO: 5457125 - DNA, 15 bp, Homo sapiens
tggaaactaaaactt

SEQ ID NO: 5457126 - DNA, 19 bp, Homo sapiens
tggaaactaataaaatatt

SEQ ID NO: 5457127 - DNA, 21 bp, Homo sapiens
tggaaactatgtgtttttctc

SEQ ID NO: 5457128 - DNA, 12 bp, Homo sapiens
tggaaactgaat

SEQ ID NO: 5457129 - DNA, 17 bp, Homo sapiens
tggaaactgttgccaga

SEQ ID NO: 5457130 - DNA, 21 bp, Homo sapiens
tggaaactgttggttgagata

SEQ ID NO: 5457131 - DNA, 14 bp, Homo sapiens
tggaaacttagagt

SEQ ID NO: 5457132 - DNA, 17 bp, Homo sapiens
tggaaacttctgtaagg

SEQ ID NO: 5457133 - DNA, 21 bp, Homo sapiens
tggaaacttctgtaaggggca

SEQ ID NO: 5457134 - DNA, 15 bp, Homo sapiens
tggaaacttttgtta

SEQ ID NO: 5457135 - DNA, 21 bp, Homo sapiens
tggaaagaaaagaatgtacat

SEQ ID NO: 5457136 - DNA, 15 bp, Homo sapiens
tggaaagaacattta

SEQ ID NO: 5457137 - DNA, 20 bp, Homo sapiens
tggaaagaaggaaaaaagga

SEQ ID NO: 5457138 - DNA, 24 bp, Homo sapiens
tggaaagaaggaaaaaaggaggat

SEQ ID NO: 5457139 - DNA, 16 bp, Homo sapiens
tggaaagaatctaata

SEQ ID NO: 5457140 - DNA, 21 bp, Homo sapiens
tggaaagacaactgttttaat

SEQ ID NO: 5457141 - DNA, 16 bp, Homo sapiens
tggaaagacaggaaga

SEQ ID NO: 5457142 - DNA, 22 bp, Homo sapiens
tggaaagacgtttttgtgctgt

SEQ ID NO: 5457143 - DNA, 14 bp, Homo sapiens
tggaaagacttctc

SEQ ID NO: 5457144 - DNA, 21 bp, Homo sapiens
tggaaagacttttccaaccct

SEQ ID NO: 5457145 - DNA, 10 bp, Homo sapiens
tggaaagaga

SEQ ID NO: 5457146 - DNA, 13 bp, Homo sapiens
tggaaagaggaga

SEQ ID NO: 5457147 - DNA, 14 bp, Homo sapiens
tggaaagaggagaa

SEQ ID NO: 5457148 - DNA, 23 bp, Homo sapiens
tggaaagagtgccagtcagcagt

SEQ ID NO: 5457149 - DNA, 18 bp, Homo sapiens
tggaaagataactaggaa

SEQ ID NO: 5457150 - DNA, 23 bp, Homo sapiens
tggaaagataactaggaaatcca

SEQ ID NO: 5457151 - DNA, 20 bp, Homo sapiens
tggaaagatgttaagcattt

SEQ ID NO: 5457152 - DNA, 22 bp, Homo sapiens
tggaaagatgttaagcatttat

SEQ ID NO: 5457153 - DNA, 17 bp, Homo sapiens
tggaaagattgtgtctg

SEQ ID NO: 5457154 - DNA, 23 bp, Homo sapiens
tggaaagcacaagactggcccag

SEQ ID NO: 5457155 - DNA, 21 bp, Homo sapiens
tggaaagcactttttggctga

SEQ ID NO: 5457156 - DNA, 19 bp, Homo sapiens
tggaaagcagagcctcctg

SEQ ID NO: 5457157 - DNA, 12 bp, Homo sapiens
tggaaagcaggt

SEQ ID NO: 5457158 - DNA, 13 bp, Homo sapiens
tggaaagccaggt

SEQ ID NO: 5457159 - DNA, 14 bp, Homo sapiens
tggaaagccaggtt

SEQ ID NO: 5457160 - DNA, 20 bp, Homo sapiens
tggaaagcgattcactgtat

SEQ ID NO: 5457161 - DNA, 14 bp, Homo sapiens
tggaaagcgcccct

SEQ ID NO: 5457162 - DNA, 21 bp, Homo sapiens
tggaaaggaatgcaaagatga

SEQ ID NO: 5457163 - DNA, 22 bp, Homo sapiens
tggaaaggaatgcaaagatgaa

SEQ ID NO: 5457164 - DNA, 19 bp, Homo sapiens
tggaaaggagaggaaagaa

SEQ ID NO: 5457165 - DNA, 16 bp, Homo sapiens
tggaaaggatcacaga

SEQ ID NO: 5457166 - DNA, 20 bp, Homo sapiens
tggaaaggattctaaacaga

SEQ ID NO: 5457167 - DNA, 13 bp, Homo sapiens
tggaaaggccagc

SEQ ID NO: 5457168 - DNA, 22 bp, Homo sapiens
tggaaaggccagcagccttcca

SEQ ID NO: 5457169 - DNA, 23 bp, Homo sapiens
tggaaaggccagcagccttccag

SEQ ID NO: 5457170 - DNA, 20 bp, Homo sapiens
tggaaaggctcagtctcagg

SEQ ID NO: 5457171 - DNA, 14 bp, Homo sapiens
tggaaagggagaca

SEQ ID NO: 5457172 - DNA, 17 bp, Homo sapiens
tggaaaggggagagcct

SEQ ID NO: 5457173 - DNA, 22 bp, Homo sapiens
tggaaaggggagagcctgctgg

SEQ ID NO: 5457174 - DNA, 18 bp, Homo sapiens
tggaaagggtgtggcttg

SEQ ID NO: 5457175 - DNA, 20 bp, Homo sapiens
tggaaaggtcattgtggcta

SEQ ID NO: 5457176 - DNA, 14 bp, Homo sapiens
tggaaaggtcctgc

SEQ ID NO: 5457177 - DNA, 16 bp, Homo sapiens
tggaaaggtttcaaga

SEQ ID NO: 5457178 - DNA, 19 bp, Homo sapiens
tggaaagtacactctgctg

SEQ ID NO: 5457179 - DNA, 15 bp, Homo sapiens
tggaaagtcaggcta

SEQ ID NO: 5457180 - DNA, 15 bp, Homo sapiens
tggaaagtgaatttg

SEQ ID NO: 5457181 - DNA, 22 bp, Homo sapiens
tggaaagtgccagcattccaga

SEQ ID NO: 5457182 - DNA, 14 bp, Homo sapiens
tggaaagtgtaaag

SEQ ID NO: 5457183 - DNA, 15 bp, Homo sapiens
tggaaagtgtaaagc

SEQ ID NO: 5457184 - DNA, 18 bp, Homo sapiens
tggaaagtgtaaagcatt

SEQ ID NO: 5457185 - DNA, 21 bp, Homo sapiens
tggaaagtgtaaagcattcca

SEQ ID NO: 5457186 - DNA, 17 bp, Homo sapiens
tggaaagttactgtaaa

SEQ ID NO: 5457187 - DNA, 12 bp, Homo sapiens
tggaaataaaaa

SEQ ID NO: 5457188 - DNA, 16 bp, Homo sapiens
tggaaataaaacagct

SEQ ID NO: 5457189 - DNA, 16 bp, Homo sapiens
tggaaataaaagataa

SEQ ID NO: 5457190 - DNA, 13 bp, Homo sapiens
tggaaataaatgt

SEQ ID NO: 5457191 - DNA, 15 bp, Homo sapiens
tggaaataaatgtat

SEQ ID NO: 5457192 - DNA, 23 bp, Homo sapiens
tggaaataaatgtatcatagaaa

SEQ ID NO: 5457193 - DNA, 19 bp, Homo sapiens
tggaaataacgggtggcat

SEQ ID NO: 5457194 - DNA, 20 bp, Homo sapiens
tggaaataataaattaacat

SEQ ID NO: 5457195 - DNA, 20 bp, Homo sapiens
tggaaataatatcatttata

SEQ ID NO: 5457196 - DNA, 15 bp, Homo sapiens
tggaaatacacagtg

SEQ ID NO: 5457197 - DNA, 12 bp, Homo sapiens
tggaaatacatt

SEQ ID NO: 5457198 - DNA, 15 bp, Homo sapiens
tggaaataccaggac

SEQ ID NO: 5457199 - DNA, 19 bp, Homo sapiens
tggaaataccaggaccagt

SEQ ID NO: 5457200 - DNA, 23 bp, Homo sapiens
tggaaataccaggaccagtttat

SEQ ID NO: 5457201 - DNA, 19 bp, Homo sapiens
tggaaatagaaagaagcca

SEQ ID NO: 5457202 - DNA, 15 bp, Homo sapiens
tggaaatatgttcta

SEQ ID NO: 5457203 - DNA, 15 bp, Homo sapiens
tggaaatattaagaa

SEQ ID NO: 5457204 - DNA, 21 bp, Homo sapiens
tggaaatattaagaacatttt

SEQ ID NO: 5457205 - DNA, 17 bp, Homo sapiens
tggaaatattttgataa

SEQ ID NO: 5457206 - DNA, 17 bp, Homo sapiens
tggaaatcaaatgtaaa

SEQ ID NO: 5457207 - DNA, 16 bp, Homo sapiens
tggaaatcaatcagaa

SEQ ID NO: 5457208 - DNA, 20 bp, Homo sapiens
tggaaatcagccaagtttta

SEQ ID NO: 5457209 - DNA, 16 bp, Homo sapiens
tggaaatccagctggt

SEQ ID NO: 5457210 - DNA, 17 bp, Homo sapiens
tggaaatcgcttatatg

SEQ ID NO: 5457211 - DNA, 15 bp, Homo sapiens
tggaaatctggattt

SEQ ID NO: 5457212 - DNA, 16 bp, Homo sapiens
tggaaatgacccaaac

SEQ ID NO: 5457213 - DNA, 16 bp, Homo sapiens
tggaaatgctgggctg

SEQ ID NO: 5457214 - DNA, 22 bp, Homo sapiens
tggaaatggccattgagctgtt

SEQ ID NO: 5457215 - DNA, 17 bp, Homo sapiens
tggaaatgggcagagca

SEQ ID NO: 5457216 - DNA, 17 bp, Homo sapiens
tggaaatggggagctgg

SEQ ID NO: 5457217 - DNA, 16 bp, Homo sapiens
tggaaatgtacttttg

SEQ ID NO: 5457218 - DNA, 16 bp, Homo sapiens
tggaaatgtagcactt

SEQ ID NO: 5457219 - DNA, 17 bp, Homo sapiens
tggaaatgtagcactta

SEQ ID NO: 5457220 - DNA, 15 bp, Homo sapiens
tggaaatgtctgctg

SEQ ID NO: 5457221 - DNA, 16 bp, Homo sapiens
tggaaatgtctgctgg

SEQ ID NO: 5457222 - DNA, 17 bp, Homo sapiens
tggaaatgtctgctggt

SEQ ID NO: 5457223 - DNA, 14 bp, Homo sapiens
tggaaatgtgagaa

SEQ ID NO: 5457224 - DNA, 15 bp, Homo sapiens
tggaaatgtgagaaa

SEQ ID NO: 5457225 - DNA, 16 bp, Homo sapiens
tggaaatgtgagaaat

SEQ ID NO: 5457226 - DNA, 23 bp, Homo sapiens
tggaaatgtgagaaatgtctaat

SEQ ID NO: 5457227 - DNA, 22 bp, Homo sapiens
tggaaattaggatgtaaatctg

SEQ ID NO: 5457228 - DNA, 21 bp, Homo sapiens
tggaaattcccgtgttgcttc

SEQ ID NO: 5457229 - DNA, 13 bp, Homo sapiens
tggaaattcctgt

SEQ ID NO: 5457230 - DNA, 19 bp, Homo sapiens
tggaaattcctgtactgtg

SEQ ID NO: 5457231 - DNA, 13 bp, Homo sapiens
tggaaattccttg

SEQ ID NO: 5457232 - DNA, 18 bp, Homo sapiens
tggaaattcttccctggg

SEQ ID NO: 5457233 - DNA, 18 bp, Homo sapiens
tggaaattgagtctgaag

SEQ ID NO: 5457234 - DNA, 17 bp, Homo sapiens
tggaaattggaagagca

SEQ ID NO: 5457235 - DNA, 12 bp, Homo sapiens
tggaaatttaaa

SEQ ID NO: 5457236 - DNA, 15 bp, Homo sapiens
tggaaatttagcatt

SEQ ID NO: 5457237 - DNA, 17 bp, Homo sapiens
tggaaatttagcattgt

SEQ ID NO: 5457238 - DNA, 15 bp, Homo sapiens
tggaaatttgtgtgc

SEQ ID NO: 5457239 - DNA, 16 bp, Homo sapiens
tggaaatttgtgtgct

SEQ ID NO: 5457240 - DNA, 23 bp, Homo sapiens
tggaaatttgttataatgaatga

SEQ ID NO: 5457241 - DNA, 18 bp, Homo sapiens
tggaaattttagttatag

SEQ ID NO: 5457242 - DNA, 23 bp, Homo sapiens
tggaaattttatatgtaaatgtg

SEQ ID NO: 5457243 - DNA, 13 bp, Homo sapiens
tggaaattttgtc

SEQ ID NO: 5457244 - DNA, 15 bp, Homo sapiens
tggaaatttttggtt

SEQ ID NO: 5457245 - DNA, 14 bp, Homo sapiens
tggaacaaagcatg

SEQ ID NO: 5457246 - DNA, 21 bp, Homo sapiens
tggaacaaatcgtttctcaga

SEQ ID NO: 5457247 - DNA, 20 bp, Homo sapiens
tggaacaacttgtagcagct

SEQ ID NO: 5457248 - DNA, 16 bp, Homo sapiens
tggaacaagacagcct

SEQ ID NO: 5457249 - DNA, 21 bp, Homo sapiens
tggaacaagacagccttcact

SEQ ID NO: 5457250 - DNA, 22 bp, Homo sapiens
tggaacaagacagccttcactt

SEQ ID NO: 5457251 - DNA, 19 bp, Homo sapiens
tggaacaatcacagggaat

SEQ ID NO: 5457252 - DNA, 21 bp, Homo sapiens
tggaacaatctaaaagtttaa

SEQ ID NO: 5457253 - DNA, 23 bp, Homo sapiens
tggaacacaaatgaaaatgaata

SEQ ID NO: 5457254 - DNA, 12 bp, Homo sapiens
tggaacacacac

SEQ ID NO: 5457255 - DNA, 16 bp, Homo sapiens
tggaacacaggggcct

SEQ ID NO: 5457256 - DNA, 22 bp, Homo sapiens
tggacaccgctcagtattactt

SEQ ID NO: 5457257 - DNA, 21 bp, Homo sapiens
tggacacctcccaggggactg

SEQ ID NO: 5457258 - DNA, 13 bp, Homo sapiens
tggacacctgccc

SEQ ID NO: 5457259 - DNA, 14 bp, Homo sapiens
tggacacgagccac

SEQ ID NO: 5457260 - DNA, 15 bp, Homo sapiens
tggacacgagccaca

SEQ ID NO: 5457261 - DNA, 17 bp, Homo sapiens
tggacacgagccacaag

SEQ ID NO: 5457262 - DNA, 21 bp, Homo sapiens
tggacacgagccacaagctgc

SEQ ID NO: 5457263 - DNA, 18 bp, Homo sapiens
tggacactaatgcagcca

SEQ ID NO: 5457264 - DNA, 16 bp, Homo sapiens
tggacactacacccag

SEQ ID NO: 5457265 - DNA, 19 bp, Homo sapiens
tggacactacacccagcaa

SEQ ID NO: 5457266 - DNA, 18 bp, Homo sapiens
tggacactccagggacac

SEQ ID NO: 5457267 - DNA, 24 bp, Homo sapiens
tggacactccagggacacacagcc

SEQ ID NO: 5457268 - DNA, 16 bp, Homo sapiens
tggacactgccaagag

SEQ ID NO: 5457269 - DNA, 13 bp, Homo sapiens
tggacactgcctt

SEQ ID NO: 5457270 - DNA, 14 bp, Homo sapiens
tggacagaaaatgc

SEQ ID NO: 5457271 - DNA, 16 bp, Homo sapiens
tggacagaagcagctc

SEQ ID NO: 5457272 - DNA, 18 bp, Homo sapiens
tggacagaagcagctctt

SEQ ID NO: 5457273 - DNA, 16 bp, Homo sapiens
tggacagaatgatgga

SEQ ID NO: 5457274 - DNA, 14 bp, Homo sapiens
tggacagacacaga

SEQ ID NO: 5457275 - DNA, 19 bp, Homo sapiens
tggacagacacctccccct

SEQ ID NO: 5457276 - DNA, 14 bp, Homo sapiens
tggacagacactgt

SEQ ID NO: 5457277 - DNA, 17 bp, Homo sapiens
tggacagacactgttgc

SEQ ID NO: 5457278 - DNA, 22 bp, Homo sapiens
tggacagacagacaccacagcc

SEQ ID NO: 5457279 - DNA, 24 bp, Homo sapiens
tggacagacagatgttgggaggat

SEQ ID NO: 5457280 - DNA, 21 bp, Homo sapiens
tggacagagggagaagggaga

SEQ ID NO: 5457281 - DNA, 19 bp, Homo sapiens
tggacagaggggactctgg

SEQ ID NO: 5457282 - DNA, 13 bp, Homo sapiens
tggacagatggac

SEQ ID NO: 5457283 - DNA, 14 bp, Homo sapiens
tggacagatggacc

SEQ ID NO: 5457284 - DNA, 19 bp, Homo sapiens
tggacagatggacgcaggc

SEQ ID NO: 5457285 - DNA, 20 bp, Homo sapiens
tggacagatggacgcaggcc

SEQ ID NO: 5457286 - DNA, 15 bp, Homo sapiens
tggacagatggccca

SEQ ID NO: 5457287 - DNA, 19 bp, Homo sapiens
tggacagatggcccaaggg

SEQ ID NO: 5457288 - DNA, 23 bp, Homo sapiens
tggacagatgggtgtcccctggt

SEQ ID NO: 5457289 - DNA, 15 bp, Homo sapiens
tggacagcaaaacca

SEQ ID NO: 5457290 - DNA, 18 bp, Homo sapiens
tggacagcaaaaccattg

SEQ ID NO: 5457291 - DNA, 22 bp, Homo sapiens
tggacagcaaaaccattgcttc

SEQ ID NO: 5457292 - DNA, 12 bp, Homo sapiens
tggacagcatca

SEQ ID NO: 5457293 - DNA, 18 bp, Homo sapiens
tggacagcatcagaaatc

SEQ ID NO: 5457294 - DNA, 15 bp, Homo sapiens
tggacagccagggca

SEQ ID NO: 5457295 - DNA, 16 bp, Homo sapiens
tggacagccagggcag

SEQ ID NO: 5457296 - DNA, 18 bp, Homo sapiens
tggacagccagtgacctt

SEQ ID NO: 5457297 - DNA, 12 bp, Homo sapiens
tggacagcccca

SEQ ID NO: 5457298 - DNA, 12 bp, Homo sapiens
tggacagccccc

SEQ ID NO: 5457299 - DNA, 14 bp, Homo sapiens
tggacagccccctt

SEQ ID NO: 5457300 - DNA, 12 bp, Homo sapiens
tggacagccgga

SEQ ID NO: 5457301 - DNA, 21 bp, Homo sapiens
tggacagcggttgtaaataca

SEQ ID NO: 5457302 - DNA, 12 bp, Homo sapiens
tggacagctgat

SEQ ID NO: 5457303 - DNA, 15 bp, Homo sapiens
tggacagctgataaa

SEQ ID NO: 5457304 - DNA, 15 bp, Homo sapiens
tggacagctgcttgt

SEQ ID NO: 5457305 - DNA, 18 bp, Homo sapiens
tggacagctgtgcctcgc

SEQ ID NO: 5457306 - DNA, 18 bp, Homo sapiens
tggacagctttattttaa

SEQ ID NO: 5457307 - DNA, 22 bp, Homo sapiens
tggacagctttattttaaatgt

SEQ ID NO: 5457308 - DNA, 19 bp, Homo sapiens
tggacaggagatcagcagc

SEQ ID NO: 5457309 - DNA, 14 bp, Homo sapiens
tggacaggagtcag

SEQ ID NO: 5457310 - DNA, 20 bp, Homo sapiens
tggacaggagtcagtgtctg

SEQ ID NO: 5457311 - DNA, 17 bp, Homo sapiens
tggacaggcatgttctc

SEQ ID NO: 5457312 - DNA, 18 bp, Homo sapiens
tggacaggcatgttctct

SEQ ID NO: 5457313 - DNA, 22 bp, Homo sapiens
tggacaggcatgttctctgagg

SEQ ID NO: 5457314 - DNA, 23 bp, Homo sapiens
tggacaggcatgttctctgagga

SEQ ID NO: 5457315 - DNA, 22 bp, Homo sapiens
tggacaggcccagcgcggccag

SEQ ID NO: 5457316 - DNA, 18 bp, Homo sapiens
tggacaggcgggctcgga

SEQ ID NO: 5457317 - DNA, 14 bp, Homo sapiens
tggacaggctctgc

SEQ ID NO: 5457318 - DNA, 12 bp, Homo sapiens
tggacagggcca

SEQ ID NO: 5457319 - DNA, 13 bp, Homo sapiens
tggacagggccag

SEQ ID NO: 5457320 - DNA, 14 bp, Homo sapiens
tggacagggccagg

SEQ ID NO: 5457321 - DNA, 16 bp, Homo sapiens
tggacagggccagggt

SEQ ID NO: 5457322 - DNA, 18 bp, Homo sapiens
tggacagtacctgattgt

SEQ ID NO: 5457323 - DNA, 19 bp, Homo sapiens
tggacagtacctgattgta

SEQ ID NO: 5457324 - DNA, 21 bp, Homo sapiens
tggacagtatcactgtctttc

SEQ ID NO: 5457325 - DNA, 13 bp, Homo sapiens
tggacagtcctgg

SEQ ID NO: 5457326 - DNA, 14 bp, Homo sapiens
tggacagtcctggg

SEQ ID NO: 5457327 - DNA, 17 bp, Homo sapiens
tggacagtcctgggaga

SEQ ID NO: 5457328 - DNA, 15 bp, Homo sapiens
tggacagtctccctg

SEQ ID NO: 5457329 - DNA, 17 bp, Homo sapiens
tggacagtctccctgat

SEQ ID NO: 5457330 - DNA, 20 bp, Homo sapiens
tggacagtctccctgatgga

SEQ ID NO: 5457331 - DNA, 23 bp, Homo sapiens
tggacagtctccctgatggaccc

SEQ ID NO: 5457332 - DNA, 14 bp, Homo sapiens
tggacagtctgagc

SEQ ID NO: 5457333 - DNA, 17 bp, Homo sapiens
tggacagtctgctctag

SEQ ID NO: 5457334 - DNA, 21 bp, Homo sapiens
tggacagttcacaccctgcaa

SEQ ID NO: 5457335 - DNA, 17 bp, Homo sapiens
tggacagtttgtttcct

SEQ ID NO: 5457336 - DNA, 18 bp, Homo sapiens
tggacagtttgtttcctg

SEQ ID NO: 5457337 - DNA, 16 bp, Homo sapiens
tggacatactgctgga

SEQ ID NO: 5457338 - DNA, 23 bp, Homo sapiens
tggacatagagagggagaagaag

SEQ ID NO: 5457339 - DNA, 19 bp, Homo sapiens
tggacatagatattttcac

SEQ ID NO: 5457340 - DNA, 23 bp, Homo sapiens
tggacatagcccaagaacagaaa

SEQ ID NO: 5457341 - DNA, 20 bp, Homo sapiens
tggacatatgggtttgaact

SEQ ID NO: 5457342 - DNA, 19 bp, Homo sapiens
tggacatcacagcagaatg

SEQ ID NO: 5457343 - DNA, 17 bp, Homo sapiens
tggacatcaccagtcct

SEQ ID NO: 5457344 - DNA, 20 bp, Homo sapiens
tggacatcaccagtcctagc

SEQ ID NO: 5457345 - DNA, 23 bp, Homo sapiens
tggacatcctcctcccacccggc

SEQ ID NO: 5457346 - DNA, 19 bp, Homo sapiens
tggacatcctcttctgctt

SEQ ID NO: 5457347 - DNA, 18 bp, Homo sapiens
tggacatcgatatgaaaa

SEQ ID NO: 5457348 - DNA, 19 bp, Homo sapiens
tggacatcgatatgaaaaa

SEQ ID NO: 5457349 - DNA, 14 bp, Homo sapiens
tggacatctctctg

SEQ ID NO: 5457350 - DNA, 22 bp, Homo sapiens
tggacatgaagattctttccca

SEQ ID NO: 5457351 - DNA, 14 bp, Homo sapiens
tggacatgaaggaa

SEQ ID NO: 5457352 - DNA, 21 bp, Homo sapiens
tggacatgatttagggaagca

SEQ ID NO: 5457353 - DNA, 19 bp, Homo sapiens
tggacatgcacagctaaca

SEQ ID NO: 5457354 - DNA, 15 bp, Homo sapiens
tggacatgcacccgc

SEQ ID NO: 5457355 - DNA, 20 bp, Homo sapiens
tggacatgcaggttggcaaa

SEQ ID NO: 5457356 - DNA, 14 bp, Homo sapiens
tggacatgcataaa

SEQ ID NO: 5457357 - DNA, 22 bp, Homo sapiens
tggacatgcctgtcctgaaagc

SEQ ID NO: 5457358 - DNA, 14 bp, Homo sapiens
tggacatgggcagc

SEQ ID NO: 5457359 - DNA, 15 bp, Homo sapiens
tggacatgtgggtgg

SEQ ID NO: 5457360 - DNA, 18 bp, Homo sapiens
tggacatgtgggtggaga

SEQ ID NO: 5457361 - DNA, 22 bp, Homo sapiens
tggacatgtgggtggagaaggg

SEQ ID NO: 5457362 - DNA, 19 bp, Homo sapiens
tggacatgtgtcccagcca

SEQ ID NO: 5457363 - DNA, 20 bp, Homo sapiens
tggacattaagcatcacaaa

SEQ ID NO: 5457364 - DNA, 14 bp, Homo sapiens
tggacattctcttt

SEQ ID NO: 5457365 - DNA, 18 bp, Homo sapiens
tggacattctctttgata

SEQ ID NO: 5457366 - DNA, 19 bp, Homo sapiens
tggacatttagaagaaaga

SEQ ID NO: 5457367 - DNA, 18 bp, Homo sapiens
tggacatttctaattcct

SEQ ID NO: 5457368 - DNA, 17 bp, Homo sapiens
tggacatttgccttgct

SEQ ID NO: 5457369 - DNA, 21 bp, Homo sapiens
tggacatttgtggcagtgctg

SEQ ID NO: 5457370 - DNA, 16 bp, Homo sapiens
tggacattttaaacac

SEQ ID NO: 5457371 - DNA, 13 bp, Homo sapiens
tggacattttatg

SEQ ID NO: 5457372 - DNA, 13 bp, Homo sapiens
tggacattttctt

SEQ ID NO: 5457373 - DNA, 16 bp, Homo sapiens
tggacattttctttta

SEQ ID NO: 5457374 - DNA, 21 bp, Homo sapiens
tggacattttcttttattatc

SEQ ID NO: 5457375 - DNA, 15 bp, Homo sapiens
tggaccaaaaaccag

SEQ ID NO: 5457376 - DNA, 13 bp, Homo sapiens
tggaccaaagcca

SEQ ID NO: 5457377 - DNA, 14 bp, Homo sapiens
tggaccaaagccac

SEQ ID NO: 5457378 - DNA, 19 bp, Homo sapiens
tggaccaaagccacctgct

SEQ ID NO: 5457379 - DNA, 20 bp, Homo sapiens
tggaccaaagccacctgctg

SEQ ID NO: 5457380 - DNA, 17 bp, Homo sapiens
tggaccaaatgtaaaat

SEQ ID NO: 5457381 - DNA, 21 bp, Homo sapiens
tggaccaaccctgtttcctga

SEQ ID NO: 5457382 - DNA, 22 bp, Homo sapiens
tggaccaacctgctctgtcccc

SEQ ID NO: 5457383 - DNA, 21 bp, Homo sapiens
tggaccaatagggctgagctc

SEQ ID NO: 5457384 - DNA, 21 bp, Homo sapiens
tggaccaattattgatatata

SEQ ID NO: 5457385 - DNA, 23 bp, Homo sapiens
tggaccaccgttcagtcattttg

SEQ ID NO: 5457386 - DNA, 18 bp, Homo sapiens
tggaccacgccgccctcc

SEQ ID NO: 5457387 - DNA, 18 bp, Homo sapiens
tggaccactcctgtccct

SEQ ID NO: 5457388 - DNA, 14 bp, Homo sapiens
tggaccactgtttc

SEQ ID NO: 5457389 - DNA, 15 bp, Homo sapiens
tggaccactgtttct

SEQ ID NO: 5457390 - DNA, 19 bp, Homo sapiens
tggaccactgtttcttgct

SEQ ID NO: 5457391 - DNA, 21 bp, Homo sapiens
tggaccactgtttcttgcttg

SEQ ID NO: 5457392 - DNA, 22 bp, Homo sapiens
tggaccactgtttcttgcttgt

SEQ ID NO: 5457393 - DNA, 13 bp, Homo sapiens
tggaccagatgct

SEQ ID NO: 5457394 - DNA, 22 bp, Homo sapiens
tggaccagcctctccactcatg

SEQ ID NO: 5457395 - DNA, 13 bp, Homo sapiens
tggaccagctggc

SEQ ID NO: 5457396 - DNA, 14 bp, Homo sapiens
tggaccaggcccat

SEQ ID NO: 5457397 - DNA, 20 bp, Homo sapiens
tggaccaggcctggagggca

SEQ ID NO: 5457398 - DNA, 22 bp, Homo sapiens
tggaccaggcctggagggcact

SEQ ID NO: 5457399 - DNA, 22 bp, Homo sapiens
tggaccaggtcctgctccgctg

SEQ ID NO: 5457400 - DNA, 16 bp, Homo sapiens
tggaccagtagacaac

SEQ ID NO: 5457401 - DNA, 15 bp, Homo sapiens
tggaccagtttgcag

SEQ ID NO: 5457402 - DNA, 13 bp, Homo sapiens
tggaccatctctg

SEQ ID NO: 5457403 - DNA, 22 bp, Homo sapiens
tggaccatgctgtctggcacag

SEQ ID NO: 5457404 - DNA, 22 bp, Homo sapiens
tggaccatttgattgttttatt

SEQ ID NO: 5457405 - DNA, 14 bp, Homo sapiens
tggacccaaggaaa

SEQ ID NO: 5457406 - DNA, 15 bp, Homo sapiens
tggacccaaggaaaa

SEQ ID NO: 5457407 - DNA, 20 bp, Homo sapiens
tggacccaaggaaaactgca

SEQ ID NO: 5457408 - DNA, 9 bp, Homo sapiens
tggacccac

SEQ ID NO: 5457409 - DNA, 22 bp, Homo sapiens
tggacccacgaacgctcttagc

SEQ ID NO: 5457410 - DNA, 20 bp, Homo sapiens
tggacccactacccttctcc

SEQ ID NO: 5457411 - DNA, 22 bp, Homo sapiens
tggacccactacccttctcctt

SEQ ID NO: 5457412 - DNA, 16 bp, Homo sapiens
tggacccagcaggggc

SEQ ID NO: 5457413 - DNA, 20 bp, Homo sapiens
tggacccagcaggggcagaa

SEQ ID NO: 5457414 - DNA, 23 bp, Homo sapiens
tggacccagcaggggcagaagga

SEQ ID NO: 5457415 - DNA, 18 bp, Homo sapiens
tggacccagccaggccca

SEQ ID NO: 5457416 - DNA, 20 bp, Homo sapiens
tggacccagggatgacatgt

SEQ ID NO: 5457417 - DNA, 16 bp, Homo sapiens
tggacccagggcctga

SEQ ID NO: 5457418 - DNA, 24 bp, Homo sapiens
tggacccagggcctgacttgagcc

SEQ ID NO: 5457419 - DNA, 22 bp, Homo sapiens
tggacccatggtcatctctgtt

SEQ ID NO: 5457420 - DNA, 19 bp, Homo sapiens
tggacccatttgccaggat

SEQ ID NO: 5457421 - DNA, 13 bp, Homo sapiens
tggaccccactgg

SEQ ID NO: 5457422 - DNA, 13 bp, Homo sapiens
tggaccccagcat

SEQ ID NO: 5457423 - DNA, 22 bp, Homo sapiens
tggaccccagccttggtggggg

SEQ ID NO: 5457424 - DNA, 16 bp, Homo sapiens
tggaccccagctggga

SEQ ID NO: 5457425 - DNA, 18 bp, Homo sapiens
tggaccccagctgggagg

SEQ ID NO: 5457426 - DNA, 19 bp, Homo sapiens
tggaccccagctgggaggc

SEQ ID NO: 5457427 - DNA, 13 bp, Homo sapiens
tggaccccaggcc

SEQ ID NO: 5457428 - DNA, 16 bp, Homo sapiens
tggaccccaggctctt

SEQ ID NO: 5457429 - DNA, 21 bp, Homo sapiens
tggacccccagcccccagggc

SEQ ID NO: 5457430 - DNA, 14 bp, Homo sapiens
tggacccccagctt

SEQ ID NO: 5457431 - DNA, 15 bp, Homo sapiens
tggacccccctttca

SEQ ID NO: 5457432 - DNA, 15 bp, Homo sapiens
tggaccccctgcccg

SEQ ID NO: 5457433 - DNA, 18 bp, Homo sapiens
tggagaccctgcgcccct

SEQ ID NO: 5457434 - DNA, 23 bp, Homo sapiens
tggagaccctgcgcccctgccca

SEQ ID NO: 5457435 - DNA, 19 bp, Homo sapiens
tggagaccgcttcacccct

SEQ ID NO: 5457436 - DNA, 20 bp, Homo sapiens
tggagaccgcttcacccctg

SEQ ID NO: 5457437 - DNA, 20 bp, Homo sapiens
tggagaccggaattgagagg

SEQ ID NO: 5457438 - DNA, 16 bp, Homo sapiens
tggagacctcatgcca

SEQ ID NO: 5457439 - DNA, 12 bp, Homo sapiens
tggagacgtgga

SEQ ID NO: 5457440 - DNA, 23 bp, Homo sapiens
tggagacgtggaacctctgtctc

SEQ ID NO: 5457441 - DNA, 16 bp, Homo sapiens
tggagactatttaagt

SEQ ID NO: 5457442 - DNA, 22 bp, Homo sapiens
tggagactcctaggcaggacat

SEQ ID NO: 5457443 - DNA, 17 bp, Homo sapiens
tggagactcctggtctg

SEQ ID NO: 5457444 - DNA, 19 bp, Homo sapiens
tggagactcctggtctgtg

SEQ ID NO: 5457445 - DNA, 12 bp, Homo sapiens
tggagactgctt

SEQ ID NO: 5457446 - DNA, 17 bp, Homo sapiens
tggagactgcttcccat

SEQ ID NO: 5457447 - DNA, 20 bp, Homo sapiens
tggagactgcttcccatcct

SEQ ID NO: 5457448 - DNA, 14 bp, Homo sapiens
tggagactggggtg

SEQ ID NO: 5457449 - DNA, 17 bp, Homo sapiens
tggagactggggtggcc

SEQ ID NO: 5457450 - DNA, 19 bp, Homo sapiens
tggagactggtcctgtgtg

SEQ ID NO: 5457451 - DNA, 14 bp, Homo sapiens
tggagactgtctca

SEQ ID NO: 5457452 - DNA, 17 bp, Homo sapiens
tggagactgtctcaaga

SEQ ID NO: 5457453 - DNA, 16 bp, Homo sapiens
tggagacttagggcac

SEQ ID NO: 5457454 - DNA, 15 bp, Homo sapiens
tggagagaaaaaatt

SEQ ID NO: 5457455 - DNA, 16 bp, Homo sapiens
tggagagaaaaaatta

SEQ ID NO: 5457456 - DNA, 15 bp, Homo sapiens
tggagagaaggcctc

SEQ ID NO: 5457457 - DNA, 11 bp, Homo sapiens
tggagagaagt

SEQ ID NO: 5457458 - DNA, 16 bp, Homo sapiens
tggagagaagtgagca

SEQ ID NO: 5457459 - DNA, 24 bp, Homo sapiens
tggagagaagttgccctccaggcc

SEQ ID NO: 5457460 - DNA, 23 bp, Homo sapiens
tggagagaagtttctggccctgg

SEQ ID NO: 5457461 - DNA, 11 bp, Homo sapiens
tggagagaata

SEQ ID NO: 5457462 - DNA, 17 bp, Homo sapiens
tggagagaatgtgtgtg

SEQ ID NO: 5457463 - DNA, 23 bp, Homo sapiens
tggagagaccagcctttcttcct

SEQ ID NO: 5457464 - DNA, 20 bp, Homo sapiens
tggagagagaggctgcctca

SEQ ID NO: 5457465 - DNA, 21 bp, Homo sapiens
tggagagagattctgttgcat

SEQ ID NO: 5457466 - DNA, 19 bp, Homo sapiens
tggagagagtattaaatat

SEQ ID NO: 5457467 - DNA, 15 bp, Homo sapiens
tggagagatgtttgg

SEQ ID NO: 5457468 - DNA, 22 bp, Homo sapiens
tggagagcaaaggcccatgccc

SEQ ID NO: 5457469 - DNA, 17 bp, Homo sapiens
tggagagcagccagcac

SEQ ID NO: 5457470 - DNA, 12 bp, Homo sapiens
tggagagcagct

SEQ ID NO: 5457471 - DNA, 18 bp, Homo sapiens
tggagagccagaacctgg

SEQ ID NO: 5457472 - DNA, 20 bp, Homo sapiens
tggagagccagaacctggag

SEQ ID NO: 5457473 - DNA, 11 bp, Homo sapiens
tggagagccct

SEQ ID NO: 5457474 - DNA, 14 bp, Homo sapiens
tggagagccctgga

SEQ ID NO: 5457475 - DNA, 15 bp, Homo sapiens
tggagagccctggga

SEQ ID NO: 5457476 - DNA, 17 bp, Homo sapiens
tggagagcgaggaggcg

SEQ ID NO: 5457477 - DNA, 18 bp, Homo sapiens
tggagagctagaacctgg

SEQ ID NO: 5457478 - DNA, 21 bp, Homo sapiens
tggagagctagaacctggagg

SEQ ID NO: 5457479 - DNA, 17 bp, Homo sapiens
tggagagctaggagcaa

SEQ ID NO: 5457480 - DNA, 22 bp, Homo sapiens
tggagagctaggagcaaagcct

SEQ ID NO: 5457481 - DNA, 23 bp, Homo sapiens
tggagagctcagtacagggcagg

SEQ ID NO: 5457482 - DNA, 11 bp, Homo sapiens
tggagagctgg

SEQ ID NO: 5457483 - DNA, 17 bp, Homo sapiens
tggagagctggagcctg

SEQ ID NO: 5457484 - DNA, 20 bp, Homo sapiens
tggagagctggagcctggtg

SEQ ID NO: 5457485 - DNA, 13 bp, Homo sapiens
tggagagctgtct

SEQ ID NO: 5457486 - DNA, 16 bp, Homo sapiens
tggagaggaaaagcca

SEQ ID NO: 5457487 - DNA, 20 bp, Homo sapiens
tggagaggaagccagtggag

SEQ ID NO: 5457488 - DNA, 21 bp, Homo sapiens
tggagaggaagccagtggagc

SEQ ID NO: 5457489 - DNA, 13 bp, Homo sapiens
tggagaggacaga

SEQ ID NO: 5457490 - DNA, 18 bp, Homo sapiens
tggagaggacagagcagg

SEQ ID NO: 5457491 - DNA, 20 bp, Homo sapiens
tggagaggacggccctgcct

SEQ ID NO: 5457492 - DNA, 11 bp, Homo sapiens
tggagaggaga

SEQ ID NO: 5457493 - DNA, 12 bp, Homo sapiens
tggagaggagag

SEQ ID NO: 5457494 - DNA, 21 bp, Homo sapiens
tggagaggagagtggcaggtg

SEQ ID NO: 5457495 - DNA, 15 bp, Homo sapiens
tggagaggagccctg

SEQ ID NO: 5457496 - DNA, 16 bp, Homo sapiens
tggagaggagccctgc

SEQ ID NO: 5457497 - DNA, 23 bp, Homo sapiens
tggagaggaggtgtggagtggag

SEQ ID NO: 5457498 - DNA, 13 bp, Homo sapiens
tggagaggcatgg

SEQ ID NO: 5457499 - DNA, 21 bp, Homo sapiens
tggagaggcatgggggcccaa

SEQ ID NO: 5457500 - DNA, 16 bp, Homo sapiens
tggagaggccctctgg

SEQ ID NO: 5457501 - DNA, 16 bp, Homo sapiens
tggagaggctaacctc

SEQ ID NO: 5457502 - DNA, 22 bp, Homo sapiens
tggagaggcttccctacacagg

SEQ ID NO: 5457503 - DNA, 13 bp, Homo sapiens
tggagagggatga

SEQ ID NO: 5457504 - DNA, 21 bp, Homo sapiens
tggagagggatgaggtgctgg

SEQ ID NO: 5457505 - DNA, 17 bp, Homo sapiens
tggagaggggacttgga

SEQ ID NO: 5457506 - DNA, 13 bp, Homo sapiens
tggagaggggcct

SEQ ID NO: 5457507 - DNA, 18 bp, Homo sapiens
tggagaggggcctgggaa

SEQ ID NO: 5457508 - DNA, 19 bp, Homo sapiens
tggagaggtttgtcaacac

SEQ ID NO: 5457509 - DNA, 14 bp, Homo sapiens
tggagagtgagaat

SEQ ID NO: 5457510 - DNA, 23 bp, Homo sapiens
tggagagtgagaataattgtgta

SEQ ID NO: 5457511 - DNA, 20 bp, Homo sapiens
tggagagtgggctgacatca

SEQ ID NO: 5457512 - DNA, 17 bp, Homo sapiens
tggagagtgggttttgt

SEQ ID NO: 5457513 - DNA, 21 bp, Homo sapiens
tggagagttcaatggctgctg

SEQ ID NO: 5457514 - DNA, 23 bp, Homo sapiens
tggagagttcaatggctgctgaa

SEQ ID NO: 5457515 - DNA, 17 bp, Homo sapiens
tggagagttgggggcca

SEQ ID NO: 5457516 - DNA, 14 bp, Homo sapiens
tggagataaaagca

SEQ ID NO: 5457517 - DNA, 16 bp, Homo sapiens
tggagatagctggggc

SEQ ID NO: 5457518 - DNA, 17 bp, Homo sapiens
tggagatagctggggct

SEQ ID NO: 5457519 - DNA, 16 bp, Homo sapiens
tggagatagggaaaga

SEQ ID NO: 5457520 - DNA, 21 bp, Homo sapiens
tggagatagtgccaggtggct

SEQ ID NO: 5457521 - DNA, 23 bp, Homo sapiens
tggagatcaccagtgtgtggctt

SEQ ID NO: 5457522 - DNA, 18 bp, Homo sapiens
tggagatcctcctgcaga

SEQ ID NO: 5457523 - DNA, 14 bp, Homo sapiens
tggagatctgaagg

SEQ ID NO: 5457524 - DNA, 17 bp, Homo sapiens
tggagatgacagaaata

SEQ ID NO: 5457525 - DNA, 15 bp, Homo sapiens
tggagatgaggccag

SEQ ID NO: 5457526 - DNA, 17 bp, Homo sapiens
tggagatgaggccagac

SEQ ID NO: 5457527 - DNA, 13 bp, Homo sapiens
tggagatgatgat

SEQ ID NO: 5457528 - DNA, 14 bp, Homo sapiens
tggagatgatgatg

SEQ ID NO: 5457529 - DNA, 15 bp, Homo sapiens
tggagatgatgatga

SEQ ID NO: 5457530 - DNA, 16 bp, Homo sapiens
tggagatgatgatgat

SEQ ID NO: 5457531 - DNA, 16 bp, Homo sapiens
tggagatgcagccttc

SEQ ID NO: 5457532 - DNA, 21 bp, Homo sapiens
tggagatgcatcgggaaagaa

SEQ ID NO: 5457533 - DNA, 23 bp, Homo sapiens
tggagatgcccgcacagtaatgt

SEQ ID NO: 5457534 - DNA, 18 bp, Homo sapiens
tggagatgctgagggtgt

SEQ ID NO: 5457535 - DNA, 14 bp, Homo sapiens
tggagatggactca

SEQ ID NO: 5457536 - DNA, 15 bp, Homo sapiens
tggagatggactcag

SEQ ID NO: 5457537 - DNA, 15 bp, Homo sapiens
tggagatggctgctg

SEQ ID NO: 5457538 - DNA, 19 bp, Homo sapiens
tggagatggctgctgctca

SEQ ID NO: 5457539 - DNA, 18 bp, Homo sapiens
tggagatgggatgcttgc

SEQ ID NO: 5457540 - DNA, 14 bp, Homo sapiens
tggagatgtaaaat

SEQ ID NO: 5457541 - DNA, 15 bp, Homo sapiens
tggagatgtaaaatg

SEQ ID NO: 5457542 - DNA, 20 bp, Homo sapiens
tggagatgtcagtctgtcca

SEQ ID NO: 5457543 - DNA, 23 bp, Homo sapiens
tggagatgtcttcgtacagttct

SEQ ID NO: 5457544 - DNA, 22 bp, Homo sapiens
tggagattactaactgtggaca

SEQ ID NO: 5457545 - DNA, 20 bp, Homo sapiens
tggagattagcccttccttg

SEQ ID NO: 5457546 - DNA, 19 bp, Homo sapiens
tggagattataataaatat

SEQ ID NO: 5457547 - DNA, 15 bp, Homo sapiens
tggagattgacctgg

SEQ ID NO: 5457548 - DNA, 16 bp, Homo sapiens
tggagattgacctgga

SEQ ID NO: 5457549 - DNA, 15 bp, Homo sapiens
tggagcaaaaggcag

SEQ ID NO: 5457550 - DNA, 16 bp, Homo sapiens
tggagcaaaaggcagc

SEQ ID NO: 5457551 - DNA, 17 bp, Homo sapiens
tggagcaaaaggcagct

SEQ ID NO: 5457552 - DNA, 19 bp, Homo sapiens
tggagcaaaaggcagctca

SEQ ID NO: 5457553 - DNA, 18 bp, Homo sapiens
tggagcaaagaaggagct

SEQ ID NO: 5457554 - DNA, 17 bp, Homo sapiens
tggagcaaagtggtagg

SEQ ID NO: 5457555 - DNA, 19 bp, Homo sapiens
tggagcaacctactgtcta

SEQ ID NO: 5457556 - DNA, 16 bp, Homo sapiens
tggagcacaaaattca

SEQ ID NO: 5457557 - DNA, 20 bp, Homo sapiens
tggagcacaataaatggctg

SEQ ID NO: 5457558 - DNA, 17 bp, Homo sapiens
tggagcaccaggcacga

SEQ ID NO: 5457559 - DNA, 21 bp, Homo sapiens
tggagcaccgaggccagcgaa

SEQ ID NO: 5457560 - DNA, 22 bp, Homo sapiens
tggagcacgtggagatagtgcc

SEQ ID NO: 5457561 - DNA, 20 bp, Homo sapiens
tggagcactagtttgattat

SEQ ID NO: 5457562 - DNA, 21 bp, Homo sapiens
tggagcactctgagtttacca

SEQ ID NO: 5457563 - DNA, 22 bp, Homo sapiens
tggagcactctgagtttaccat

SEQ ID NO: 5457564 - DNA, 21 bp, Homo sapiens
tggagcactgggctcccgggc

SEQ ID NO: 5457565 - DNA, 20 bp, Homo sapiens
tggagcactgttctgggact

SEQ ID NO: 5457566 - DNA, 21 bp, Homo sapiens
tggagcactgttctgggactc

SEQ ID NO: 5457567 - DNA, 18 bp, Homo sapiens
tggagcagaaagtgcctt

SEQ ID NO: 5457568 - DNA, 13 bp, Homo sapiens
tggagcagagctc

SEQ ID NO: 5457569 - DNA, 23 bp, Homo sapiens
tggagcagcagccactgcacagg

SEQ ID NO: 5457570 - DNA, 13 bp, Homo sapiens
tggagcagcaggc

SEQ ID NO: 5457571 - DNA, 22 bp, Homo sapiens
tggagcagcaggcctctgggac

SEQ ID NO: 5457572 - DNA, 13 bp, Homo sapiens
tggagcagccaag

SEQ ID NO: 5457573 - DNA, 15 bp, Homo sapiens
tggagcagccagagc

SEQ ID NO: 5457574 - DNA, 15 bp, Homo sapiens
tggagcagcccccaa

SEQ ID NO: 5457575 - DNA, 13 bp, Homo sapiens
tggagcagccgga

SEQ ID NO: 5457576 - DNA, 20 bp, Homo sapiens
tggagcagcggattgctctg

SEQ ID NO: 5457577 - DNA, 20 bp, Homo sapiens
tggagcaggactcccaccta

SEQ ID NO: 5457578 - DNA, 11 bp, Homo sapiens
tggagcaggga

SEQ ID NO: 5457579 - DNA, 18 bp, Homo sapiens
tggagcagtttggggcag

SEQ ID NO: 5457580 - DNA, 14 bp, Homo sapiens
tggagcatcccagg

SEQ ID NO: 5457581 - DNA, 17 bp, Homo sapiens
tggagcattggctgaga

SEQ ID NO: 5457582 - DNA, 17 bp, Homo sapiens
tggagcatttctcatca

SEQ ID NO: 5457583 - DNA, 19 bp, Homo sapiens
tggagcatttggaaggaaa

SEQ ID NO: 5457584 - DNA, 21 bp, Homo sapiens
tggagcatttggaaggaaagg

SEQ ID NO: 5457585 - DNA, 18 bp, Homo sapiens
tggagcatttttcagagt

SEQ ID NO: 5457586 - DNA, 17 bp, Homo sapiens
tggagccaaggcagagg

SEQ ID NO: 5457587 - DNA, 17 bp, Homo sapiens
tggagccaagggttcag

SEQ ID NO: 5457588 - DNA, 16 bp, Homo sapiens
tggagccaagtccaga

SEQ ID NO: 5457589 - DNA, 22 bp, Homo sapiens
tggagccaatggtgagggctga

SEQ ID NO: 5457590 - DNA, 17 bp, Homo sapiens
tggagccacaggcagac

SEQ ID NO: 5457591 - DNA, 17 bp, Homo sapiens
tggagccacaggcaggg

SEQ ID NO: 5457592 - DNA, 22 bp, Homo sapiens
tggagccacaggcaggggtgag

SEQ ID NO: 5457593 - DNA, 16 bp, Homo sapiens
tggagccactcctgtc

SEQ ID NO: 5457594 - DNA, 13 bp, Homo sapiens
tggagccactggg

SEQ ID NO: 5457595 - DNA, 14 bp, Homo sapiens
tggagccactggga

SEQ ID NO: 5457596 - DNA, 14 bp, Homo sapiens
tggagccagagaga

SEQ ID NO: 5457597 - DNA, 21 bp, Homo sapiens
tggagccagccgagcaggagg

SEQ ID NO: 5457598 - DNA, 14 bp, Homo sapiens
tggagccagggcag

SEQ ID NO: 5457599 - DNA, 16 bp, Homo sapiens
tggagccagggcagag

SEQ ID NO: 5457600 - DNA, 14 bp, Homo sapiens
tggagccagggcct

SEQ ID NO: 5457601 - DNA, 11 bp, Homo sapiens
tggagccaggt

SEQ ID NO: 5457602 - DNA, 21 bp, Homo sapiens
tggagcccacagcgagcctgt

SEQ ID NO: 5457603 - DNA, 23 bp, Homo sapiens
tggagcccactgtacttgctctt

SEQ ID NO: 5457604 - DNA, 20 bp, Homo sapiens
tggagcccagaggagggcag

SEQ ID NO: 5457605 - DNA, 23 bp, Homo sapiens
tggagcccagaggagggcagcag

SEQ ID NO: 5457606 - DNA, 19 bp, Homo sapiens
tggagcccagcgtcagaag

SEQ ID NO: 5457607 - DNA, 13 bp, Homo sapiens
tggagcccaggcg

SEQ ID NO: 5457608 - DNA, 20 bp, Homo sapiens
tggagcccagggagcggaaa

SEQ ID NO: 5457609 - DNA, 13 bp, Homo sapiens
tggagcccagggt

SEQ ID NO: 5457610 - DNA, 14 bp, Homo sapiens
tggatactacatct

SEQ ID NO: 5457611 - DNA, 16 bp, Homo sapiens
tggatactggggggca

SEQ ID NO: 5457612 - DNA, 18 bp, Homo sapiens
tggatactggggggcagg

SEQ ID NO: 5457613 - DNA, 19 bp, Homo sapiens
tggatactggggggcaggc

SEQ ID NO: 5457614 - DNA, 21 bp, Homo sapiens
tggatactggggggcaggcct

SEQ ID NO: 5457615 - DNA, 13 bp, Homo sapiens
tggatactgtaga

SEQ ID NO: 5457616 - DNA, 14 bp, Homo sapiens
tggatacttcctgg

SEQ ID NO: 5457617 - DNA, 14 bp, Homo sapiens
tggatacttggatt

SEQ ID NO: 5457618 - DNA, 22 bp, Homo sapiens
tggatacttggatttagtttca

SEQ ID NO: 5457619 - DNA, 22 bp, Homo sapiens
tggatagaaaattatgcagctt

SEQ ID NO: 5457620 - DNA, 14 bp, Homo sapiens
tggatagatgccct

SEQ ID NO: 5457621 - DNA, 17 bp, Homo sapiens
tggatagatgccctgct

SEQ ID NO: 5457622 - DNA, 16 bp, Homo sapiens
tggatagattgtttta

SEQ ID NO: 5457623 - DNA, 21 bp, Homo sapiens
tggatagcattgttttctttt

SEQ ID NO: 5457624 - DNA, 20 bp, Homo sapiens
tggatagccttgaaaacaaa

SEQ ID NO: 5457625 - DNA, 13 bp, Homo sapiens
tggatagctaata

SEQ ID NO: 5457626 - DNA, 17 bp, Homo sapiens
tggatagctaataatga

SEQ ID NO: 5457627 - DNA, 15 bp, Homo sapiens
tggatagctcagagg

SEQ ID NO: 5457628 - DNA, 17 bp, Homo sapiens
tggatagttaagggctt

SEQ ID NO: 5457629 - DNA, 12 bp, Homo sapiens
tggatataaata

SEQ ID NO: 5457630 - DNA, 17 bp, Homo sapiens
tggatataaatatatat

SEQ ID NO: 5457631 - DNA, 14 bp, Homo sapiens
tggatataaatctt

SEQ ID NO: 5457632 - DNA, 19 bp, Homo sapiens
tggatataaattaattgtg

SEQ ID NO: 5457633 - DNA, 15 bp, Homo sapiens
tggatataatgtatt

SEQ ID NO: 5457634 - DNA, 17 bp, Homo sapiens
tggatatagaaaatctt

SEQ ID NO: 5457635 - DNA, 19 bp, Homo sapiens
tggatatataggctatttt

SEQ ID NO: 5457636 - DNA, 15 bp, Homo sapiens
tggatatatttaaaa

SEQ ID NO: 5457637 - DNA, 15 bp, Homo sapiens
tggatatatttgaaa

SEQ ID NO: 5457638 - DNA, 22 bp, Homo sapiens
tggatatatttgaaatagtata

SEQ ID NO: 5457639 - DNA, 21 bp, Homo sapiens
tggatatcaaggtggaaatgg

SEQ ID NO: 5457640 - DNA, 21 bp, Homo sapiens
tggatatcagggtataaatta

SEQ ID NO: 5457641 - DNA, 16 bp, Homo sapiens
tggatatctacattat

SEQ ID NO: 5457642 - DNA, 14 bp, Homo sapiens
tggatatctgttag

SEQ ID NO: 5457643 - DNA, 16 bp, Homo sapiens
tggatatctgttagat

SEQ ID NO: 5457644 - DNA, 16 bp, Homo sapiens
tggatatgaaagagaa

SEQ ID NO: 5457645 - DNA, 17 bp, Homo sapiens
tggatatgaaagagaaa

SEQ ID NO: 5457646 - DNA, 20 bp, Homo sapiens
tggatatgaaagagaaaatg

SEQ ID NO: 5457647 - DNA, 21 bp, Homo sapiens
tggatatggtgcaaaaatgag

SEQ ID NO: 5457648 - DNA, 16 bp, Homo sapiens
tggatatgtaaaacat

SEQ ID NO: 5457649 - DNA, 17 bp, Homo sapiens
tggatatgtaaaacatt

SEQ ID NO: 5457650 - DNA, 23 bp, Homo sapiens
tggatatgtccagtcatcctgcc

SEQ ID NO: 5457651 - DNA, 18 bp, Homo sapiens
tggatatgtgtaaatgtt

SEQ ID NO: 5457652 - DNA, 21 bp, Homo sapiens
tggatatgttgtattaactgg

SEQ ID NO: 5457653 - DNA, 23 bp, Homo sapiens
tggatatgttgtattaactgggt

SEQ ID NO: 5457654 - DNA, 13 bp, Homo sapiens
tggatatttcaat

SEQ ID NO: 5457655 - DNA, 19 bp, Homo sapiens
tggatatttgatatttggt

SEQ ID NO: 5457656 - DNA, 15 bp, Homo sapiens
tggatatttgcactt

SEQ ID NO: 5457657 - DNA, 15 bp, Homo sapiens
tggatatttgtcaac

SEQ ID NO: 5457658 - DNA, 22 bp, Homo sapiens
tggatattttcaaattgtatct

SEQ ID NO: 5457659 - DNA, 23 bp, Homo sapiens
tggatattttcaaattgtatcta

SEQ ID NO: 5457660 - DNA, 15 bp, Homo sapiens
tggatattttcttaa

SEQ ID NO: 5457661 - DNA, 13 bp, Homo sapiens
tggatcaaccaag

SEQ ID NO: 5457662 - DNA, 20 bp, Homo sapiens
tggatcaagcttgtgtactt

SEQ ID NO: 5457663 - DNA, 16 bp, Homo sapiens
tggatcacacacatgg

SEQ ID NO: 5457664 - DNA, 23 bp, Homo sapiens
tggatcacacctcagtgggaaga

SEQ ID NO: 5457665 - DNA, 16 bp, Homo sapiens
tggatcacagctgctt

SEQ ID NO: 5457666 - DNA, 20 bp, Homo sapiens
tggatcacgacgctgcagag

SEQ ID NO: 5457667 - DNA, 17 bp, Homo sapiens
tggatcactcaccattc

SEQ ID NO: 5457668 - DNA, 17 bp, Homo sapiens
tggatcagcgtggcctt

SEQ ID NO: 5457669 - DNA, 22 bp, Homo sapiens
tggatcaggaacccttacagta

SEQ ID NO: 5457670 - DNA, 19 bp, Homo sapiens
tggatcagtcctttgatca

SEQ ID NO: 5457671 - DNA, 18 bp, Homo sapiens
tggatcataaactggaaa

SEQ ID NO: 5457672 - DNA, 16 bp, Homo sapiens
tggatcatgaaaagtg

SEQ ID NO: 5457673 - DNA, 20 bp, Homo sapiens
tggatcatgaggtcaggaga

SEQ ID NO: 5457674 - DNA, 18 bp, Homo sapiens
tggatccaatgttagaga

SEQ ID NO: 5457675 - DNA, 14 bp, Homo sapiens
tggatccagcactg

SEQ ID NO: 5457676 - DNA, 24 bp, Homo sapiens
tggatccatcctgctagcacctcc

SEQ ID NO: 5457677 - DNA, 14 bp, Homo sapiens
tggatcccaaagca

SEQ ID NO: 5457678 - DNA, 20 bp, Homo sapiens
tggatcccaattcatttcat

SEQ ID NO: 5457679 - DNA, 17 bp, Homo sapiens
tggatcccatcaaagaa

SEQ ID NO: 5457680 - DNA, 17 bp, Homo sapiens
tggatccccagtgaaaa

SEQ ID NO: 5457681 - DNA, 22 bp, Homo sapiens
tggatcccgttcagaaaaccac

SEQ ID NO: 5457682 - DNA, 18 bp, Homo sapiens
tggatcctcagttctcaa

SEQ ID NO: 5457683 - DNA, 14 bp, Homo sapiens
tggatcctgctgct

SEQ ID NO: 5457684 - DNA, 18 bp, Homo sapiens
tggatcctgggctgggtg

SEQ ID NO: 5457685 - DNA, 17 bp, Homo sapiens
tggatcctgtgtggaga

SEQ ID NO: 5457686 - DNA, 16 bp, Homo sapiens
tggatccttcccaagg

SEQ ID NO: 5457687 - DNA, 19 bp, Homo sapiens
tggatcgagtgtagctgtg

SEQ ID NO: 5457688 - DNA, 19 bp, Homo sapiens
tggatcgctaagctggctc

SEQ ID NO: 5457689 - DNA, 14 bp, Homo sapiens
tggatcgttatcta

SEQ ID NO: 5457690 - DNA, 14 bp, Homo sapiens
tggatctaaatgga

SEQ ID NO: 5457691 - DNA, 20 bp, Homo sapiens
tggatctatcacctgtcatc

SEQ ID NO: 5457692 - DNA, 19 bp, Homo sapiens
tggatctatctgtattttc

SEQ ID NO: 5457693 - DNA, 20 bp, Homo sapiens
tggatctattgatttgaaaa

SEQ ID NO: 5457694 - DNA, 11 bp, Homo sapiens
tggatctattt

SEQ ID NO: 5457695 - DNA, 20 bp, Homo sapiens
tggatctatttcatgttttt

SEQ ID NO: 5457696 - DNA, 14 bp, Homo sapiens
tggatctcagtttt

SEQ ID NO: 5457697 - DNA, 19 bp, Homo sapiens
tggatctcagtttttaaga

SEQ ID NO: 5457698 - DNA, 18 bp, Homo sapiens
tggatctcattggaccct

SEQ ID NO: 5457699 - DNA, 18 bp, Homo sapiens
tggatctccaaggaccag

SEQ ID NO: 5457700 - DNA, 15 bp, Homo sapiens
tggatctccccctca

SEQ ID NO: 5457701 - DNA, 22 bp, Homo sapiens
tggatctccctgagatgggctt

SEQ ID NO: 5457702 - DNA, 17 bp, Homo sapiens
tggatctcctgctgcct

SEQ ID NO: 5457703 - DNA, 20 bp, Homo sapiens
tggatctccttcccttctct

SEQ ID NO: 5457704 - DNA, 16 bp, Homo sapiens
tggatctgaccctccc

SEQ ID NO: 5457705 - DNA, 18 bp, Homo sapiens
tggatctgaccctcccag

SEQ ID NO: 5457706 - DNA, 19 bp, Homo sapiens
tggatctgaccctcccagt

SEQ ID NO: 5457707 - DNA, 17 bp, Homo sapiens
tggatctgctccatgca

SEQ ID NO: 5457708 - DNA, 18 bp, Homo sapiens
tggatctgctccatgcag

SEQ ID NO: 5457709 - DNA, 18 bp, Homo sapiens
tggatctggagtctgaag

SEQ ID NO: 5457710 - DNA, 17 bp, Homo sapiens
tggatctggatctgtta

SEQ ID NO: 5457711 - DNA, 23 bp, Homo sapiens
tggatctgggaccctttccttcc

SEQ ID NO: 5457712 - DNA, 14 bp, Homo sapiens
tggatctgggcaca

SEQ ID NO: 5457713 - DNA, 15 bp, Homo sapiens
tggatctgggcacaa

SEQ ID NO: 5457714 - DNA, 15 bp, Homo sapiens
tggatctggggactg

SEQ ID NO: 5457715 - DNA, 15 bp, Homo sapiens
tggatcttcagaact

SEQ ID NO: 5457716 - DNA, 17 bp, Homo sapiens
tggatcttcagaaggct

SEQ ID NO: 5457717 - DNA, 16 bp, Homo sapiens
tggatcttctatcatt

SEQ ID NO: 5457718 - DNA, 21 bp, Homo sapiens
tggatcttctatcattccaat

SEQ ID NO: 5457719 - DNA, 14 bp, Homo sapiens
tggatcttgaatgt

SEQ ID NO: 5457720 - DNA, 15 bp, Homo sapiens
tggatcttgaatgtg

SEQ ID NO: 5457721 - DNA, 16 bp, Homo sapiens
tggatcttgaatgtgg

SEQ ID NO: 5457722 - DNA, 19 bp, Homo sapiens
tggatcttgccacatttct

SEQ ID NO: 5457723 - DNA, 14 bp, Homo sapiens
tggatctttgctac

SEQ ID NO: 5457724 - DNA, 12 bp, Homo sapiens
tggatcttttct

SEQ ID NO: 5457725 - DNA, 15 bp, Homo sapiens
tggatgaaaatgttc

SEQ ID NO: 5457726 - DNA, 15 bp, Homo sapiens
tggatgaaattttct

SEQ ID NO: 5457727 - DNA, 18 bp, Homo sapiens
tggatgaaattttctaga

SEQ ID NO: 5457728 - DNA, 22 bp, Homo sapiens
tggatgaagattctcctgtgct

SEQ ID NO: 5457729 - DNA, 23 bp, Homo sapiens
tggatgaagattctcctgtgcta

SEQ ID NO: 5457730 - DNA, 13 bp, Homo sapiens
tggatgaaggcaa

SEQ ID NO: 5457731 - DNA, 17 bp, Homo sapiens
tggatgaatgcagtata

SEQ ID NO: 5457732 - DNA, 19 bp, Homo sapiens
tggatgaattttccagacc

SEQ ID NO: 5457733 - DNA, 20 bp, Homo sapiens
tggatgaattttccagacct

SEQ ID NO: 5457734 - DNA, 20 bp, Homo sapiens
tggatgacagggcagagcag

SEQ ID NO: 5457735 - DNA, 20 bp, Homo sapiens
tggatgactcggtctgagaa

SEQ ID NO: 5457736 - DNA, 17 bp, Homo sapiens
tggatgactgttgatga

SEQ ID NO: 5457737 - DNA, 17 bp, Homo sapiens
tggatgacttgctcaag

SEQ ID NO: 5457738 - DNA, 17 bp, Homo sapiens
tggatgacttgttcatt

SEQ ID NO: 5457739 - DNA, 17 bp, Homo sapiens
tggatgagccctcagaa

SEQ ID NO: 5457740 - DNA, 18 bp, Homo sapiens
tggatgaggcacttctgt

SEQ ID NO: 5457741 - DNA, 22 bp, Homo sapiens
tggatgaggcacttctgtcaat

SEQ ID NO: 5457742 - DNA, 14 bp, Homo sapiens
tggatgaggcttct

SEQ ID NO: 5457743 - DNA, 18 bp, Homo sapiens
tggatgaggcttcttcct

SEQ ID NO: 5457744 - DNA, 19 bp, Homo sapiens
tggatgagggccaccagga

SEQ ID NO: 5457745 - DNA, 23 bp, Homo sapiens
tggatgagtaaactgtttctcag

SEQ ID NO: 5457746 - DNA, 21 bp, Homo sapiens
tggatgattttttaagcagac

SEQ ID NO: 5457747 - DNA, 16 bp, Homo sapiens
tggatgcaattaaaac

SEQ ID NO: 5457748 - DNA, 21 bp, Homo sapiens
tggatgcagcctcacagtcct

SEQ ID NO: 5457749 - DNA, 20 bp, Homo sapiens
tggatgcatgttttccagct

SEQ ID NO: 5457750 - DNA, 22 bp, Homo sapiens
tggatgcatgttttccagctcc

SEQ ID NO: 5457751 - DNA, 14 bp, Homo sapiens
tggatgcatttcaa

SEQ ID NO: 5457752 - DNA, 17 bp, Homo sapiens
tggatgcatttcaaatg

SEQ ID NO: 5457753 - DNA, 22 bp, Homo sapiens
tggatgcatttcaaatgttaga

SEQ ID NO: 5457754 - DNA, 21 bp, Homo sapiens
tggatgccaatattaaatctg

SEQ ID NO: 5457755 - DNA, 15 bp, Homo sapiens
tggatgcccagagga

SEQ ID NO: 5457756 - DNA, 13 bp, Homo sapiens
tggatgcccagga

SEQ ID NO: 5457757 - DNA, 14 bp, Homo sapiens
tggatgcccaggaa

SEQ ID NO: 5457758 - DNA, 14 bp, Homo sapiens
tggatgcctcagaa

SEQ ID NO: 5457759 - DNA, 16 bp, Homo sapiens
tggatgcctcagccca

SEQ ID NO: 5457760 - DNA, 18 bp, Homo sapiens
tggatgcctggtggcagc

SEQ ID NO: 5457761 - DNA, 15 bp, Homo sapiens
tggatgcgaggacca

SEQ ID NO: 5457762 - DNA, 16 bp, Homo sapiens
tggatgcgaggaccac

SEQ ID NO: 5457763 - DNA, 17 bp, Homo sapiens
tggatgcgcagtgcctt

SEQ ID NO: 5457764 - DNA, 16 bp, Homo sapiens
tggatgctagtgctgt

SEQ ID NO: 5457765 - DNA, 17 bp, Homo sapiens
tggatgctccagggcag

SEQ ID NO: 5457766 - DNA, 12 bp, Homo sapiens
tggatgctctca

SEQ ID NO: 5457767 - DNA, 18 bp, Homo sapiens
tggatgctctcaggctga

SEQ ID NO: 5457768 - DNA, 15 bp, Homo sapiens
tggatgctctttcaa

SEQ ID NO: 5457769 - DNA, 16 bp, Homo sapiens
tggatgctctttcaat

SEQ ID NO: 5457770 - DNA, 14 bp, Homo sapiens
tggatgctgagctg

SEQ ID NO: 5457771 - DNA, 14 bp, Homo sapiens
tggatgctgggttc

SEQ ID NO: 5457772 - DNA, 18 bp, Homo sapiens
tggatgctgggttctggg

SEQ ID NO: 5457773 - DNA, 20 bp, Homo sapiens
tggatgctgggttctggggc

SEQ ID NO: 5457774 - DNA, 21 bp, Homo sapiens
tggatgctgggttctggggct

SEQ ID NO: 5457775 - DNA, 14 bp, Homo sapiens
tggatgctgtgcta

SEQ ID NO: 5457776 - DNA, 16 bp, Homo sapiens
tggatgcttagaggga

SEQ ID NO: 5457777 - DNA, 18 bp, Homo sapiens
tggatggacagacacctc

SEQ ID NO: 5457778 - DNA, 13 bp, Homo sapiens
tggatggacagat

SEQ ID NO: 5457779 - DNA, 17 bp, Homo sapiens
tggatggacagatggac

SEQ ID NO: 5457780 - DNA, 15 bp, Homo sapiens
tggatggagcccagg

SEQ ID NO: 5457781 - DNA, 22 bp, Homo sapiens
tggatggagcccagttggaaaa

SEQ ID NO: 5457782 - DNA, 18 bp, Homo sapiens
tggatggaggagaaataa

SEQ ID NO: 5457783 - DNA, 12 bp, Homo sapiens
tggatggcaccc

SEQ ID NO: 5457784 - DNA, 13 bp, Homo sapiens
tggatggcaccct

SEQ ID NO: 5457785 - DNA, 14 bp, Homo sapiens
tggatggcaccctg

SEQ ID NO: 5457786 - DNA, 20 bp, Homo sapiens
tggatggcacctcaggctga

SEQ ID NO: 5457787 - DNA, 18 bp, Homo sapiens
tggatggcccagcaggca

SEQ ID NO: 5457788 - DNA, 19 bp, Homo sapiens
tggcagctgggcccacagc

SEQ ID NO: 5457789 - DNA, 23 bp, Homo sapiens
tggcagctgggcccacagccccc

SEQ ID NO: 5457790 - DNA, 17 bp, Homo sapiens
tggcagctggggagcag

SEQ ID NO: 5457791 - DNA, 20 bp, Homo sapiens
tggcagctggggagcagctg

SEQ ID NO: 5457792 - DNA, 18 bp, Homo sapiens
tggcagctggggctgtgg

SEQ ID NO: 5457793 - DNA, 13 bp, Homo sapiens
tggcagctgtccc

SEQ ID NO: 5457794 - DNA, 14 bp, Homo sapiens
tggcagctgtcccc

SEQ ID NO: 5457795 - DNA, 20 bp, Homo sapiens
tggcagctgtttctcatgaa

SEQ ID NO: 5457796 - DNA, 19 bp, Homo sapiens
tggcagcttcaaaacagaa

SEQ ID NO: 5457797 - DNA, 15 bp, Homo sapiens
tggcagcttgctggg

SEQ ID NO: 5457798 - DNA, 11 bp, Homo sapiens
tggcagctttt

SEQ ID NO: 5457799 - DNA, 18 bp, Homo sapiens
tggcagcttttaaaagat

SEQ ID NO: 5457800 - DNA, 12 bp, Homo sapiens
tggcaggaaggc

SEQ ID NO: 5457801 - DNA, 17 bp, Homo sapiens
tggcaggaaggcttgtt

SEQ ID NO: 5457802 - DNA, 20 bp, Homo sapiens
tggcaggaagtctctcccga

SEQ ID NO: 5457803 - DNA, 12 bp, Homo sapiens
tggcaggacaca

SEQ ID NO: 5457804 - DNA, 21 bp, Homo sapiens
tggcaggacacacatggtgag

SEQ ID NO: 5457805 - DNA, 19 bp, Homo sapiens
tggcaggacacatcccggc

SEQ ID NO: 5457806 - DNA, 13 bp, Homo sapiens
tggcaggacagga

SEQ ID NO: 5457807 - DNA, 17 bp, Homo sapiens
tggcaggacctgcctag

SEQ ID NO: 5457808 - DNA, 20 bp, Homo sapiens
tggcaggacgtgggctgggc

SEQ ID NO: 5457809 - DNA, 15 bp, Homo sapiens
tggcaggactcctgg

SEQ ID NO: 5457810 - DNA, 19 bp, Homo sapiens
tggcaggagaatttctact

SEQ ID NO: 5457811 - DNA, 19 bp, Homo sapiens
tggcaggagagagccttgg

SEQ ID NO: 5457812 - DNA, 22 bp, Homo sapiens
tggcaggagagagccttggcct

SEQ ID NO: 5457813 - DNA, 14 bp, Homo sapiens
tggcaggagagctt

SEQ ID NO: 5457814 - DNA, 23 bp, Homo sapiens
tggcaggaggttgggaattcttg

SEQ ID NO: 5457815 - DNA, 15 bp, Homo sapiens
tggcaggagtggggt

SEQ ID NO: 5457816 - DNA, 19 bp, Homo sapiens
tggcaggagttggaagtgt

SEQ ID NO: 5457817 - DNA, 19 bp, Homo sapiens
tggcaggatccaaggggct

SEQ ID NO: 5457818 - DNA, 14 bp, Homo sapiens
tggcaggatgctga

SEQ ID NO: 5457819 - DNA, 18 bp, Homo sapiens
tggcaggatggcctggcc

SEQ ID NO: 5457820 - DNA, 20 bp, Homo sapiens
tggcaggattcttcccgctc

SEQ ID NO: 5457821 - DNA, 21 bp, Homo sapiens
tggcaggcacacagcagcccc

SEQ ID NO: 5457822 - DNA, 23 bp, Homo sapiens
tggcaggcacacagcagcccccc

SEQ ID NO: 5457823 - DNA, 14 bp, Homo sapiens
tggcaggcacctgt

SEQ ID NO: 5457824 - DNA, 21 bp, Homo sapiens
tggcaggcagaggcccaggct

SEQ ID NO: 5457825 - DNA, 23 bp, Homo sapiens
tggcaggcagaggcccaggctgc

SEQ ID NO: 5457826 - DNA, 21 bp, Homo sapiens
tggcaggcaggggccctgcag

SEQ ID NO: 5457827 - DNA, 14 bp, Homo sapiens
tggcaggccagtgt

SEQ ID NO: 5457828 - DNA, 16 bp, Homo sapiens
tggcaggccagtgtct

SEQ ID NO: 5457829 - DNA, 16 bp, Homo sapiens
tggcaggcccactccc

SEQ ID NO: 5457830 - DNA, 18 bp, Homo sapiens
tggcaggcccactcccca

SEQ ID NO: 5457831 - DNA, 19 bp, Homo sapiens
tggcaggcccactccccag

SEQ ID NO: 5457832 - DNA, 17 bp, Homo sapiens
tggcaggccctgcccag

SEQ ID NO: 5457833 - DNA, 20 bp, Homo sapiens
tggcaggccctgcccagcca

SEQ ID NO: 5457834 - DNA, 21 bp, Homo sapiens
tggcaggccctgcccagccag

SEQ ID NO: 5457835 - DNA, 21 bp, Homo sapiens
tggcaggccgaggcaggtgga

SEQ ID NO: 5457836 - DNA, 21 bp, Homo sapiens
tggcaggcctaggacctcagg

SEQ ID NO: 5457837 - DNA, 16 bp, Homo sapiens
tggcaggcctgaccca

SEQ ID NO: 5457838 - DNA, 22 bp, Homo sapiens
tggcaggcctgacccacggggc

SEQ ID NO: 5457839 - DNA, 22 bp, Homo sapiens
tggcaggctgaggcatgagaat

SEQ ID NO: 5457840 - DNA, 14 bp, Homo sapiens
tggcaggctggcca

SEQ ID NO: 5457841 - DNA, 18 bp, Homo sapiens
tggcaggctggccagtcc

SEQ ID NO: 5457842 - DNA, 14 bp, Homo sapiens
tggcaggctgggtg

SEQ ID NO: 5457843 - DNA, 16 bp, Homo sapiens
tggcaggcttccccct

SEQ ID NO: 5457844 - DNA, 13 bp, Homo sapiens
tggcagggaagct

SEQ ID NO: 5457845 - DNA, 21 bp, Homo sapiens
tggcagggaagggtgcctggc

SEQ ID NO: 5457846 - DNA, 22 bp, Homo sapiens
tggcagggaagggtgcctggct

SEQ ID NO: 5457847 - DNA, 14 bp, Homo sapiens
tggcagggaccggc

SEQ ID NO: 5457848 - DNA, 16 bp, Homo sapiens
tggcagggacctgaga

SEQ ID NO: 5457849 - DNA, 20 bp, Homo sapiens
tggcagggaggtcaggccct

SEQ ID NO: 5457850 - DNA, 22 bp, Homo sapiens
tggcagggaggtcaggccctgg

SEQ ID NO: 5457851 - DNA, 20 bp, Homo sapiens
tggcagggcacagggcctgg

SEQ ID NO: 5457852 - DNA, 12 bp, Homo sapiens
tggcagggcagc

SEQ ID NO: 5457853 - DNA, 20 bp, Homo sapiens
tggcagggcaggcagagctc

SEQ ID NO: 5457854 - DNA, 11 bp, Homo sapiens
tggcagggcca

SEQ ID NO: 5457855 - DNA, 13 bp, Homo sapiens
tggcagggccagg

SEQ ID NO: 5457856 - DNA, 14 bp, Homo sapiens
tggcagggccaggg

SEQ ID NO: 5457857 - DNA, 18 bp, Homo sapiens
tggcagggccagggcaat

SEQ ID NO: 5457858 - DNA, 20 bp, Homo sapiens
tggcagggcgtgaggaactc

SEQ ID NO: 5457859 - DNA, 11 bp, Homo sapiens
tggcagggctc

SEQ ID NO: 5457860 - DNA, 17 bp, Homo sapiens
tggcagggctcaggatt

SEQ ID NO: 5457861 - DNA, 12 bp, Homo sapiens
tggcagggctgt

SEQ ID NO: 5457862 - DNA, 21 bp, Homo sapiens
tggcagggctgttccctccag

SEQ ID NO: 5457863 - DNA, 17 bp, Homo sapiens
tggcaggggaagccttg

SEQ ID NO: 5457864 - DNA, 13 bp, Homo sapiens
tggcaggggagca

SEQ ID NO: 5457865 - DNA, 20 bp, Homo sapiens
tggcaggggatccagctcaa

SEQ ID NO: 5457866 - DNA, 20 bp, Homo sapiens
tggcaggggcagtggcctgg

SEQ ID NO: 5457867 - DNA, 21 bp, Homo sapiens
tggcagggggccccgccaggg

SEQ ID NO: 5457868 - DNA, 16 bp, Homo sapiens
tggcagggggctgctg

SEQ ID NO: 5457869 - DNA, 17 bp, Homo sapiens
tggcagggggctgctgc

SEQ ID NO: 5457870 - DNA, 20 bp, Homo sapiens
tggcagggggtgaaggcagg

SEQ ID NO: 5457871 - DNA, 24 bp, Homo sapiens
tggcaggggtggaggagagcctgg

SEQ ID NO: 5457872 - DNA, 23 bp, Homo sapiens
tggcaggggtggctgcctcattt

SEQ ID NO: 5457873 - DNA, 17 bp, Homo sapiens
tggcagggtgggatgga

SEQ ID NO: 5457874 - DNA, 20 bp, Homo sapiens
tggcaggtaggaatattata

SEQ ID NO: 5457875 - DNA, 23 bp, Homo sapiens
tggcaggtaggaatattatattt

SEQ ID NO: 5457876 - DNA, 14 bp, Homo sapiens
tggcaggtcactgt

SEQ ID NO: 5457877 - DNA, 17 bp, Homo sapiens
tggcaggtcactgtcac

SEQ ID NO: 5457878 - DNA, 18 bp, Homo sapiens
tggcaggtcactgtcact

SEQ ID NO: 5457879 - DNA, 19 bp, Homo sapiens
tggcaggtcatggagcagc

SEQ ID NO: 5457880 - DNA, 19 bp, Homo sapiens
tggcaggtcccctgccctg

SEQ ID NO: 5457881 - DNA, 14 bp, Homo sapiens
tggcaggtgggctg

SEQ ID NO: 5457882 - DNA, 18 bp, Homo sapiens
tggcaggtgggctgcctg

SEQ ID NO: 5457883 - DNA, 15 bp, Homo sapiens
tggcaggtgtcatat

SEQ ID NO: 5457884 - DNA, 23 bp, Homo sapiens
tggcaggtgtcatatgactgatt

SEQ ID NO: 5457885 - DNA, 22 bp, Homo sapiens
tggcaggtgtgggatctgggga

SEQ ID NO: 5457886 - DNA, 20 bp, Homo sapiens
tggcaggtgttgggacctgc

SEQ ID NO: 5457887 - DNA, 19 bp, Homo sapiens
tggcaggttgggtaaccct

SEQ ID NO: 5457888 - DNA, 12 bp, Homo sapiens
tggcagtacaga

SEQ ID NO: 5457889 - DNA, 16 bp, Homo sapiens
tggcagtacagagtgc

SEQ ID NO: 5457890 - DNA, 21 bp, Homo sapiens
tggcagtattccatgggatgt

SEQ ID NO: 5457891 - DNA, 22 bp, Homo sapiens
tggcagtatttcatttcttgtc

SEQ ID NO: 5457892 - DNA, 19 bp, Homo sapiens
tggcagtccagccagctcc

SEQ ID NO: 5457893 - DNA, 18 bp, Homo sapiens
tggcagtccgtgggacgg

SEQ ID NO: 5457894 - DNA, 15 bp, Homo sapiens
tggcagtcctggagg

SEQ ID NO: 5457895 - DNA, 18 bp, Homo sapiens
tggcagtcctggaggcag

SEQ ID NO: 5457896 - DNA, 19 bp, Homo sapiens
tggcagtctatatgtttgt

SEQ ID NO: 5457897 - DNA, 16 bp, Homo sapiens
tggcagtctgaatttt

SEQ ID NO: 5457898 - DNA, 14 bp, Homo sapiens
tggcagtgatgaat

SEQ ID NO: 5457899 - DNA, 15 bp, Homo sapiens
tggcagtgcaatgct

SEQ ID NO: 5457900 - DNA, 18 bp, Homo sapiens
tggcagtgctgaaggggg

SEQ ID NO: 5457901 - DNA, 22 bp, Homo sapiens
tggcagtggaaaaatcagaagc

SEQ ID NO: 5457902 - DNA, 16 bp, Homo sapiens
tggcagtggccaggca

SEQ ID NO: 5457903 - DNA, 17 bp, Homo sapiens
tggcagtggccaggcag

SEQ ID NO: 5457904 - DNA, 18 bp, Homo sapiens
tggcagtggccaggcagg

SEQ ID NO: 5457905 - DNA, 15 bp, Homo sapiens
tggcagtggctgtga

SEQ ID NO: 5457906 - DNA, 22 bp, Homo sapiens
tggcagtgggaaaaatgtagga

SEQ ID NO: 5457907 - DNA, 22 bp, Homo sapiens
tggcagtgggaatgttctttct

SEQ ID NO: 5457908 - DNA, 13 bp, Homo sapiens
tggcagtgggaga

SEQ ID NO: 5457909 - DNA, 14 bp, Homo sapiens
tggcagtgggagac

SEQ ID NO: 5457910 - DNA, 19 bp, Homo sapiens
tggcagtgtcccagggccc

SEQ ID NO: 5457911 - DNA, 20 bp, Homo sapiens
tggcagtgtggggagggcag

SEQ ID NO: 5457912 - DNA, 16 bp, Homo sapiens
tggcagtttatattta

SEQ ID NO: 5457913 - DNA, 20 bp, Homo sapiens
tggcagtttatatttaactc

SEQ ID NO: 5457914 - DNA, 16 bp, Homo sapiens
tggcagtttggtattt

SEQ ID NO: 5457915 - DNA, 15 bp, Homo sapiens
tggcataaattgcat

SEQ ID NO: 5457916 - DNA, 21 bp, Homo sapiens
tggcataacataaatctgtga

SEQ ID NO: 5457917 - DNA, 14 bp, Homo sapiens
tggcataattttta

SEQ ID NO: 5457918 - DNA, 13 bp, Homo sapiens
tggcatacaaaat

SEQ ID NO: 5457919 - DNA, 14 bp, Homo sapiens
tggcatacaaaata

SEQ ID NO: 5457920 - DNA, 21 bp, Homo sapiens
tggcatacaaaatatttaagt

SEQ ID NO: 5457921 - DNA, 17 bp, Homo sapiens
tggcatactttttaaaa

SEQ ID NO: 5457922 - DNA, 15 bp, Homo sapiens
tggcatagccccggc

SEQ ID NO: 5457923 - DNA, 21 bp, Homo sapiens
tggcatataattttcacttct

SEQ ID NO: 5457924 - DNA, 15 bp, Homo sapiens
tggcatatccattgt

SEQ ID NO: 5457925 - DNA, 15 bp, Homo sapiens
tggcatatggtccta

SEQ ID NO: 5457926 - DNA, 15 bp, Homo sapiens
tggcatatttatatt

SEQ ID NO: 5457927 - DNA, 21 bp, Homo sapiens
tggcatatttatattgtatat

SEQ ID NO: 5457928 - DNA, 23 bp, Homo sapiens
tggcatattttaatcattatttg

SEQ ID NO: 5457929 - DNA, 23 bp, Homo sapiens
tggcatcaagaggtgggagggcc

SEQ ID NO: 5457930 - DNA, 13 bp, Homo sapiens
tggcatcaaggga

SEQ ID NO: 5457931 - DNA, 22 bp, Homo sapiens
tggcatcaagggagacaccagt

SEQ ID NO: 5457932 - DNA, 16 bp, Homo sapiens
tggcatcacagacccc

SEQ ID NO: 5457933 - DNA, 23 bp, Homo sapiens
tggcatcaccttaggcagggaag

SEQ ID NO: 5457934 - DNA, 19 bp, Homo sapiens
tggcatcaggagctgctca

SEQ ID NO: 5457935 - DNA, 20 bp, Homo sapiens
tggcatcaggagctgctcag

SEQ ID NO: 5457936 - DNA, 21 bp, Homo sapiens
tggcatcaggagctgctcagg

SEQ ID NO: 5457937 - DNA, 20 bp, Homo sapiens
tggcatcagtttaggccttg

SEQ ID NO: 5457938 - DNA, 22 bp, Homo sapiens
tggcatccagagtccctgcctg

SEQ ID NO: 5457939 - DNA, 15 bp, Homo sapiens
tggcatcccagtggc

SEQ ID NO: 5457940 - DNA, 17 bp, Homo sapiens
tggcatcctggctggct

SEQ ID NO: 5457941 - DNA, 18 bp, Homo sapiens
tggcatcctggctggctg

SEQ ID NO: 5457942 - DNA, 22 bp, Homo sapiens
tggcatcgaccacaccagcctc

SEQ ID NO: 5457943 - DNA, 23 bp, Homo sapiens
tggcatcgcaccattctgactcg

SEQ ID NO: 5457944 - DNA, 22 bp, Homo sapiens
tggcatcgcagtctcttagaat

SEQ ID NO: 5457945 - DNA, 19 bp, Homo sapiens
tggcatcgtgtattccata

SEQ ID NO: 5457946 - DNA, 18 bp, Homo sapiens
tggcatctaattcttatt

SEQ ID NO: 5457947 - DNA, 22 bp, Homo sapiens
tggcatctaattcttattttta

SEQ ID NO: 5457948 - DNA, 19 bp, Homo sapiens
tggcatctagccagaggct

SEQ ID NO: 5457949 - DNA, 19 bp, Homo sapiens
tggcatctcccccaccctg

SEQ ID NO: 5457950 - DNA, 18 bp, Homo sapiens
tggcatctccctgacctt

SEQ ID NO: 5457951 - DNA, 17 bp, Homo sapiens
tggcatctgaaaacaat

SEQ ID NO: 5457952 - DNA, 20 bp, Homo sapiens
tggcatctgaatgaaaataa

SEQ ID NO: 5457953 - DNA, 17 bp, Homo sapiens
tggcatctgctctagat

SEQ ID NO: 5457954 - DNA, 15 bp, Homo sapiens
tggcatctggggctc

SEQ ID NO: 5457955 - DNA, 14 bp, Homo sapiens
tggcatctgtgtgc

SEQ ID NO: 5457956 - DNA, 16 bp, Homo sapiens
tggcatcttacatctg

SEQ ID NO: 5457957 - DNA, 22 bp, Homo sapiens
tggcatcttcgtcttcactctt

SEQ ID NO: 5457958 - DNA, 17 bp, Homo sapiens
tggcatcttctggagaa

SEQ ID NO: 5457959 - DNA, 16 bp, Homo sapiens
tggcatcttgctgcta

SEQ ID NO: 5457960 - DNA, 18 bp, Homo sapiens
tggcatgagaaatacaaa

SEQ ID NO: 5457961 - DNA, 14 bp, Homo sapiens
tggcatgaggaggt

SEQ ID NO: 5457962 - DNA, 22 bp, Homo sapiens
tggcatgattagattgcaaagc

SEQ ID NO: 5457963 - DNA, 18 bp, Homo sapiens
tggcatgatttatatatg

SEQ ID NO: 5457964 - DNA, 21 bp, Homo sapiens
tggcccacccctcttccccct

SEQ ID NO: 5457965 - DNA, 22 bp, Homo sapiens
tggcccacccctcttccccctt

SEQ ID NO: 5457966 - DNA, 22 bp, Homo sapiens
tggcccacgccctccctctccc

SEQ ID NO: 5457967 - DNA, 20 bp, Homo sapiens
tggcccacgggccggccagc

SEQ ID NO: 5457968 - DNA, 14 bp, Homo sapiens
tggcccactgcatc

SEQ ID NO: 5457969 - DNA, 13 bp, Homo sapiens
tggcccagaaaca

SEQ ID NO: 5457970 - DNA, 13 bp, Homo sapiens
tggcccagaaagc

SEQ ID NO: 5457971 - DNA, 18 bp, Homo sapiens
tggcccagaaagctgcgg

SEQ ID NO: 5457972 - DNA, 13 bp, Homo sapiens
tggcccagaattg

SEQ ID NO: 5457973 - DNA, 11 bp, Homo sapiens
tggcccagaga

SEQ ID NO: 5457974 - DNA, 14 bp, Homo sapiens
tggcccagagccat

SEQ ID NO: 5457975 - DNA, 13 bp, Homo sapiens
tggcccagagcct

SEQ ID NO: 5457976 - DNA, 19 bp, Homo sapiens
tggcccagataaggcttta

SEQ ID NO: 5457977 - DNA, 19 bp, Homo sapiens
tggcccagcacgagcctgg

SEQ ID NO: 5457978 - DNA, 19 bp, Homo sapiens
tggcccagcagcggcccag

SEQ ID NO: 5457979 - DNA, 15 bp, Homo sapiens
tggcccagcagcttg

SEQ ID NO: 5457980 - DNA, 16 bp, Homo sapiens
tggcccagcaggcagg

SEQ ID NO: 5457981 - DNA, 15 bp, Homo sapiens
tggcccagccactgc

SEQ ID NO: 5457982 - DNA, 18 bp, Homo sapiens
tggcccagccactgcagc

SEQ ID NO: 5457983 - DNA, 19 bp, Homo sapiens
tggcccagccactgcagca

SEQ ID NO: 5457984 - DNA, 16 bp, Homo sapiens
tggcccagccatggct

SEQ ID NO: 5457985 - DNA, 13 bp, Homo sapiens
tggcccagccctg

SEQ ID NO: 5457986 - DNA, 14 bp, Homo sapiens
tggcccagccctgc

SEQ ID NO: 5457987 - DNA, 22 bp, Homo sapiens
tggcccagccggcctctctggc

SEQ ID NO: 5457988 - DNA, 12 bp, Homo sapiens
tggcccagcctg

SEQ ID NO: 5457989 - DNA, 19 bp, Homo sapiens
tggcccagcggcccctccc

SEQ ID NO: 5457990 - DNA, 14 bp, Homo sapiens
tggcccagctcccc

SEQ ID NO: 5457991 - DNA, 22 bp, Homo sapiens
tggcccaggaaaaacctgtggg

SEQ ID NO: 5457992 - DNA, 17 bp, Homo sapiens
tggcccaggaccatcat

SEQ ID NO: 5457993 - DNA, 17 bp, Homo sapiens
tggcccaggagctctgc

SEQ ID NO: 5457994 - DNA, 18 bp, Homo sapiens
tggcccaggagctctgcg

SEQ ID NO: 5457995 - DNA, 13 bp, Homo sapiens
tggcccaggagga

SEQ ID NO: 5457996 - DNA, 13 bp, Homo sapiens
tggcccaggctgg

SEQ ID NO: 5457997 - DNA, 18 bp, Homo sapiens
tggcccagggcccagagc

SEQ ID NO: 5457998 - DNA, 17 bp, Homo sapiens
tggcccagggggcctgg

SEQ ID NO: 5457999 - DNA, 12 bp, Homo sapiens
tggcccagggtg

SEQ ID NO: 5458000 - DNA, 17 bp, Homo sapiens
tggcccagggtggccac

SEQ ID NO: 5458001 - DNA, 12 bp, Homo sapiens
tggcccaggtgg

SEQ ID NO: 5458002 - DNA, 16 bp, Homo sapiens
tggcccaggtggctat

SEQ ID NO: 5458003 - DNA, 19 bp, Homo sapiens
tggcccagtcctctcccaa

SEQ ID NO: 5458004 - DNA, 23 bp, Homo sapiens
tggcccagtcgtccgctcagcca

SEQ ID NO: 5458005 - DNA, 17 bp, Homo sapiens
tggcccagtgagagtga

SEQ ID NO: 5458006 - DNA, 21 bp, Homo sapiens
tggcccagtgagagtgaggcc

SEQ ID NO: 5458007 - DNA, 23 bp, Homo sapiens
tggcccatagaaacatgacactg

SEQ ID NO: 5458008 - DNA, 22 bp, Homo sapiens
tggcccatcagtgtacccccgc

SEQ ID NO: 5458009 - DNA, 15 bp, Homo sapiens
tggcccatcccccct

SEQ ID NO: 5458010 - DNA, 15 bp, Homo sapiens
tggcccatctcagcc

SEQ ID NO: 5458011 - DNA, 16 bp, Homo sapiens
tggcccattctacttg

SEQ ID NO: 5458012 - DNA, 17 bp, Homo sapiens
tggcccattctacttgc

SEQ ID NO: 5458013 - DNA, 23 bp, Homo sapiens
tggcccattctacttgctctgga

SEQ ID NO: 5458014 - DNA, 23 bp, Homo sapiens
tggcccattggagcacctgggcc

SEQ ID NO: 5458015 - DNA, 21 bp, Homo sapiens
tggccccaagaggggcgggct

SEQ ID NO: 5458016 - DNA, 18 bp, Homo sapiens
tggccccacaccagcccc

SEQ ID NO: 5458017 - DNA, 13 bp, Homo sapiens
tggccccaccctg

SEQ ID NO: 5458018 - DNA, 18 bp, Homo sapiens
tggccccaccctgggccc

SEQ ID NO: 5458019 - DNA, 19 bp, Homo sapiens
tggccccaccgagctggag

SEQ ID NO: 5458020 - DNA, 16 bp, Homo sapiens
tggccccacctggccc

SEQ ID NO: 5458021 - DNA, 14 bp, Homo sapiens
tggccccagaggac

SEQ ID NO: 5458022 - DNA, 12 bp, Homo sapiens
tggccccagcac

SEQ ID NO: 5458023 - DNA, 19 bp, Homo sapiens
tggccccagccctgctggg

SEQ ID NO: 5458024 - DNA, 17 bp, Homo sapiens
tggccccagcctgggcc

SEQ ID NO: 5458025 - DNA, 12 bp, Homo sapiens
tggccccagctg

SEQ ID NO: 5458026 - DNA, 16 bp, Homo sapiens
tggccccagctggctg

SEQ ID NO: 5458027 - DNA, 21 bp, Homo sapiens
tggccccaggccccagacagg

SEQ ID NO: 5458028 - DNA, 12 bp, Homo sapiens
tggccccaggcg

SEQ ID NO: 5458029 - DNA, 13 bp, Homo sapiens
tggccccagggtt

SEQ ID NO: 5458030 - DNA, 15 bp, Homo sapiens
tggccccagggttga

SEQ ID NO: 5458031 - DNA, 18 bp, Homo sapiens
tggccccatccaaccact

SEQ ID NO: 5458032 - DNA, 15 bp, Homo sapiens
tggccccatcccagt

SEQ ID NO: 5458033 - DNA, 23 bp, Homo sapiens
tggccccatgtctctcagaattc

SEQ ID NO: 5458034 - DNA, 14 bp, Homo sapiens
tggcccccaataaa

SEQ ID NO: 5458035 - DNA, 19 bp, Homo sapiens
tggcccccaataaaggcag

SEQ ID NO: 5458036 - DNA, 21 bp, Homo sapiens
tggcccccaataaaggcagct

SEQ ID NO: 5458037 - DNA, 22 bp, Homo sapiens
tggcccccaataaaggcagctg

SEQ ID NO: 5458038 - DNA, 14 bp, Homo sapiens
tggcccccacccac

SEQ ID NO: 5458039 - DNA, 18 bp, Homo sapiens
tggcccccacccaccttc

SEQ ID NO: 5458040 - DNA, 21 bp, Homo sapiens
tggcccccaccctcagcccgc

SEQ ID NO: 5458041 - DNA, 14 bp, Homo sapiens
tggcccccagccct

SEQ ID NO: 5458042 - DNA, 12 bp, Homo sapiens
tggcccccaggg

SEQ ID NO: 5458043 - DNA, 21 bp, Homo sapiens
tggcccccaggggcaggactg

SEQ ID NO: 5458044 - DNA, 15 bp, Homo sapiens
tggcccccatacttg

SEQ ID NO: 5458045 - DNA, 18 bp, Homo sapiens
tggcccccatcagccctg

SEQ ID NO: 5458046 - DNA, 21 bp, Homo sapiens
tggccccccaaagtgctggga

SEQ ID NO: 5458047 - DNA, 15 bp, Homo sapiens
tggccccccactccc

SEQ ID NO: 5458048 - DNA, 23 bp, Homo sapiens
tggccccccactcccccttccct

SEQ ID NO: 5458049 - DNA, 20 bp, Homo sapiens
tggcccccccagccccacac

SEQ ID NO: 5458050 - DNA, 21 bp, Homo sapiens
tggcccccccagccccacacc

SEQ ID NO: 5458051 - DNA, 22 bp, Homo sapiens
tggccccccgaggctaaccctg

SEQ ID NO: 5458052 - DNA, 14 bp, Homo sapiens
tggcccccctccag

SEQ ID NO: 5458053 - DNA, 17 bp, Homo sapiens
tggcccccctccaggca

SEQ ID NO: 5458054 - DNA, 15 bp, Homo sapiens
tggcccccctggtcc

SEQ ID NO: 5458055 - DNA, 15 bp, Homo sapiens
tggcccccgacccag

SEQ ID NO: 5458056 - DNA, 14 bp, Homo sapiens
tggcccccgagctg

SEQ ID NO: 5458057 - DNA, 15 bp, Homo sapiens
tggcccccgagctgg

SEQ ID NO: 5458058 - DNA, 19 bp, Homo sapiens
tggcccccgagctgggggc

SEQ ID NO: 5458059 - DNA, 18 bp, Homo sapiens
tggcccccgggcctgcac

SEQ ID NO: 5458060 - DNA, 19 bp, Homo sapiens
tggcccccgggcctgcaca

SEQ ID NO: 5458061 - DNA, 17 bp, Homo sapiens
tggccccctcagctctg

SEQ ID NO: 5458062 - DNA, 20 bp, Homo sapiens
tggccccctcagctctgtcc

SEQ ID NO: 5458063 - DNA, 20 bp, Homo sapiens
tggccccctcattcagagac

SEQ ID NO: 5458064 - DNA, 11 bp, Homo sapiens
tggccccctcc

SEQ ID NO: 5458065 - DNA, 15 bp, Homo sapiens
tggccccctccgtga

SEQ ID NO: 5458066 - DNA, 14 bp, Homo sapiens
tggccccctcgcgc

SEQ ID NO: 5458067 - DNA, 21 bp, Homo sapiens
tggccccctcgcgcccctgtc

SEQ ID NO: 5458068 - DNA, 23 bp, Homo sapiens
tggccccctcgcgcccctgtcca

SEQ ID NO: 5458069 - DNA, 15 bp, Homo sapiens
tggccccctgtgcca

SEQ ID NO: 5458070 - DNA, 20 bp, Homo sapiens
tggccccctgtgccagctca

SEQ ID NO: 5458071 - DNA, 15 bp, Homo sapiens
tggcccccttcagga

SEQ ID NO: 5458072 - DNA, 22 bp, Homo sapiens
tggcccccttcaggagcctggc

SEQ ID NO: 5458073 - DNA, 19 bp, Homo sapiens
tggccccgaggctgggaca

SEQ ID NO: 5458074 - DNA, 20 bp, Homo sapiens
tggccccgcaaggcctccag

SEQ ID NO: 5458075 - DNA, 15 bp, Homo sapiens
tggccccgcagtgcc

SEQ ID NO: 5458076 - DNA, 22 bp, Homo sapiens
tggccccgcagtgccctgcccc

SEQ ID NO: 5458077 - DNA, 19 bp, Homo sapiens
tggccccgcccctgccccc

SEQ ID NO: 5458078 - DNA, 18 bp, Homo sapiens
tggccccgcccgagcccc

SEQ ID NO: 5458079 - DNA, 19 bp, Homo sapiens
tggccccgcccgagcccct

SEQ ID NO: 5458080 - DNA, 23 bp, Homo sapiens
tggccccgcccgagcccctgccc

SEQ ID NO: 5458081 - DNA, 13 bp, Homo sapiens
tggccccgccgcc

SEQ ID NO: 5458082 - DNA, 15 bp, Homo sapiens
tggccccgccgcctg

SEQ ID NO: 5458083 - DNA, 20 bp, Homo sapiens
tggccccgccgcctggtact

SEQ ID NO: 5458084 - DNA, 15 bp, Homo sapiens
tggccccgcctgcct

SEQ ID NO: 5458085 - DNA, 16 bp, Homo sapiens
tggccccgcctgcctg

SEQ ID NO: 5458086 - DNA, 18 bp, Homo sapiens
tggccccgggctctggcc

SEQ ID NO: 5458087 - DNA, 22 bp, Homo sapiens
tggccccgggctctggccaccc

SEQ ID NO: 5458088 - DNA, 15 bp, Homo sapiens
tggccccgtttctgg

SEQ ID NO: 5458089 - DNA, 15 bp, Homo sapiens
tggcccctactttgt

SEQ ID NO: 5458090 - DNA, 21 bp, Homo sapiens
tggcccctcaaatcgtccagc

SEQ ID NO: 5458091 - DNA, 19 bp, Homo sapiens
tggcccctcacccaccatg

SEQ ID NO: 5458092 - DNA, 23 bp, Homo sapiens
tggcccctcatggcgggactgga

SEQ ID NO: 5458093 - DNA, 19 bp, Homo sapiens
tggcccctccaatcctccc

SEQ ID NO: 5458094 - DNA, 12 bp, Homo sapiens
tggcccctccag

SEQ ID NO: 5458095 - DNA, 14 bp, Homo sapiens
tggcccctccagca

SEQ ID NO: 5458096 - DNA, 13 bp, Homo sapiens
tggcccctccagg

SEQ ID NO: 5458097 - DNA, 16 bp, Homo sapiens
tggcccctcccctgca

SEQ ID NO: 5458098 - DNA, 19 bp, Homo sapiens
tggcccctccttgcaacca

SEQ ID NO: 5458099 - DNA, 21 bp, Homo sapiens
tggcccctctcaggctgtgct

SEQ ID NO: 5458100 - DNA, 12 bp, Homo sapiens
tggcccctctga

SEQ ID NO: 5458101 - DNA, 22 bp, Homo sapiens
tggcccctgctgtctctctggg

SEQ ID NO: 5458102 - DNA, 15 bp, Homo sapiens
tggcccctggaacct

SEQ ID NO: 5458103 - DNA, 19 bp, Homo sapiens
tggcccctggaacctttcc

SEQ ID NO: 5458104 - DNA, 14 bp, Homo sapiens
tggcccctgtgtga

SEQ ID NO: 5458105 - DNA, 11 bp, Homo sapiens
tggccccttca

SEQ ID NO: 5458106 - DNA, 16 bp, Homo sapiens
tggccccttcacttct

SEQ ID NO: 5458107 - DNA, 22 bp, Homo sapiens
tggccccttctatgcccagctg

SEQ ID NO: 5458108 - DNA, 16 bp, Homo sapiens
tggccccttctccagc

SEQ ID NO: 5458109 - DNA, 19 bp, Homo sapiens
tggcccctttgggccctgc

SEQ ID NO: 5458110 - DNA, 20 bp, Homo sapiens
tggcccctttgggccctgca

SEQ ID NO: 5458111 - DNA, 21 bp, Homo sapiens
tggcccctttgggccctgcat

SEQ ID NO: 5458112 - DNA, 23 bp, Homo sapiens
tggcccctttgggccctgcatgt

SEQ ID NO: 5458113 - DNA, 21 bp, Homo sapiens
tggcccgaagcgtgcggggcc

SEQ ID NO: 5458114 - DNA, 14 bp, Homo sapiens
tggcccgacagcct

SEQ ID NO: 5458115 - DNA, 16 bp, Homo sapiens
tggcccgacagcctgg

SEQ ID NO: 5458116 - DNA, 17 bp, Homo sapiens
tggcccgacagcctggc

SEQ ID NO: 5458117 - DNA, 17 bp, Homo sapiens
tggcccgaggaagctgg

SEQ ID NO: 5458118 - DNA, 20 bp, Homo sapiens
tggcccgcaagagggacaga

SEQ ID NO: 5458119 - DNA, 15 bp, Homo sapiens
tggcccgcagtggct

SEQ ID NO: 5458120 - DNA, 14 bp, Homo sapiens
tggcccgcggcctg

SEQ ID NO: 5458121 - DNA, 17 bp, Homo sapiens
tggcccggcccctcctg

SEQ ID NO: 5458122 - DNA, 18 bp, Homo sapiens
tggcccggcccctcctga

SEQ ID NO: 5458123 - DNA, 21 bp, Homo sapiens
tggcccggccggcctggcacc

SEQ ID NO: 5458124 - DNA, 16 bp, Homo sapiens
tggcccggtcccagtc

SEQ ID NO: 5458125 - DNA, 23 bp, Homo sapiens
tggcccgtgacagactcctgagg

SEQ ID NO: 5458126 - DNA, 18 bp, Homo sapiens
tggcccgtggcctggcat

SEQ ID NO: 5458127 - DNA, 19 bp, Homo sapiens
tggccctaaatagcagaaa

SEQ ID NO: 5458128 - DNA, 14 bp, Homo sapiens
tggccctacagccc

SEQ ID NO: 5458129 - DNA, 21 bp, Homo sapiens
tggccctacttccaggatgga

SEQ ID NO: 5458130 - DNA, 14 bp, Homo sapiens
tggccctaggcact

SEQ ID NO: 5458131 - DNA, 16 bp, Homo sapiens
tggccctcacccctgc

SEQ ID NO: 5458132 - DNA, 20 bp, Homo sapiens
tggccctcacccctgccctg

SEQ ID NO: 5458133 - DNA, 14 bp, Homo sapiens
tggccctcagctcc

SEQ ID NO: 5458134 - DNA, 23 bp, Homo sapiens
tggccctcattccaagcacttta

SEQ ID NO: 5458135 - DNA, 15 bp, Homo sapiens
tggccctccactcct

SEQ ID NO: 5458136 - DNA, 23 bp, Homo sapiens
tggccctccctcagcggaggggt

SEQ ID NO: 5458137 - DNA, 15 bp, Homo sapiens
tggccctccctccct

SEQ ID NO: 5458138 - DNA, 20 bp, Homo sapiens
tggccctccctccctagccc

SEQ ID NO: 5458139 - DNA, 15 bp, Homo sapiens
tggccctcctctggt

SEQ ID NO: 5458140 - DNA, 22 bp, Homo sapiens
tggccctcggaggtccagctgg

SEQ ID NO: 5458141 - DNA, 18 bp, Homo sapiens
tggccctctcccctgccc

SEQ ID NO: 5458142 - DNA, 16 bp, Homo sapiens
tggcggggcaggaggc

SEQ ID NO: 5458143 - DNA, 18 bp, Homo sapiens
tggcggggggcccattgg

SEQ ID NO: 5458144 - DNA, 18 bp, Homo sapiens
tggcggggtcccccctcc

SEQ ID NO: 5458145 - DNA, 13 bp, Homo sapiens
tggcggggtgggg

SEQ ID NO: 5458146 - DNA, 23 bp, Homo sapiens
tggcgggtccacttgccagggct

SEQ ID NO: 5458147 - DNA, 15 bp, Homo sapiens
tggcgggtggctgca

SEQ ID NO: 5458148 - DNA, 12 bp, Homo sapiens
tggcgggtgggg

SEQ ID NO: 5458149 - DNA, 15 bp, Homo sapiens
tggcggtgcagtggc

SEQ ID NO: 5458150 - DNA, 17 bp, Homo sapiens
tggcggtggaccaaagg

SEQ ID NO: 5458151 - DNA, 15 bp, Homo sapiens
tggcggtggccacag

SEQ ID NO: 5458152 - DNA, 21 bp, Homo sapiens
tggcgtaagtacagagaagcc

SEQ ID NO: 5458153 - DNA, 22 bp, Homo sapiens
tggcgtaagtacagagaagcca

SEQ ID NO: 5458154 - DNA, 15 bp, Homo sapiens
tggcgtaatgggcct

SEQ ID NO: 5458155 - DNA, 20 bp, Homo sapiens
tggcgtaatgggcctgccca

SEQ ID NO: 5458156 - DNA, 20 bp, Homo sapiens
tggcgtagaagtttttgtac

SEQ ID NO: 5458157 - DNA, 22 bp, Homo sapiens
tggcgtagcagagttaaatctc

SEQ ID NO: 5458158 - DNA, 16 bp, Homo sapiens
tggcgtaggctacaga

SEQ ID NO: 5458159 - DNA, 19 bp, Homo sapiens
tggcgtaggctacagagaa

SEQ ID NO: 5458160 - DNA, 19 bp, Homo sapiens
tggcgtcctctccctcctg

SEQ ID NO: 5458161 - DNA, 14 bp, Homo sapiens
tggcgtctccctcg

SEQ ID NO: 5458162 - DNA, 19 bp, Homo sapiens
tggcgtctgcatacgagag

SEQ ID NO: 5458163 - DNA, 18 bp, Homo sapiens
tggcgtctgctctggtgg

SEQ ID NO: 5458164 - DNA, 18 bp, Homo sapiens
tggcgtctggactgttct

SEQ ID NO: 5458165 - DNA, 20 bp, Homo sapiens
tggcgtctgtcttcaagggc

SEQ ID NO: 5458166 - DNA, 12 bp, Homo sapiens
tggcgtgacccg

SEQ ID NO: 5458167 - DNA, 21 bp, Homo sapiens
tggcgtgacccgacctggccg

SEQ ID NO: 5458168 - DNA, 17 bp, Homo sapiens
tggcgtgccctggaggc

SEQ ID NO: 5458169 - DNA, 19 bp, Homo sapiens
tggcgtgccctggaggctg

SEQ ID NO: 5458170 - DNA, 18 bp, Homo sapiens
tggcgtggattaaactta

SEQ ID NO: 5458171 - DNA, 11 bp, Homo sapiens
tggcgtggccc

SEQ ID NO: 5458172 - DNA, 13 bp, Homo sapiens
tggcgtggcctcc

SEQ ID NO: 5458173 - DNA, 18 bp, Homo sapiens
tggcgtgggagccagcct

SEQ ID NO: 5458174 - DNA, 21 bp, Homo sapiens
tggcgtgtgtccctgtggtac

SEQ ID NO: 5458175 - DNA, 14 bp, Homo sapiens
tggcgttatggcag

SEQ ID NO: 5458176 - DNA, 19 bp, Homo sapiens
tggcgttatggcagcccgg

SEQ ID NO: 5458177 - DNA, 13 bp, Homo sapiens
tggcgttcctgcc

SEQ ID NO: 5458178 - DNA, 19 bp, Homo sapiens
tggcgttctgctgcccctg

SEQ ID NO: 5458179 - DNA, 22 bp, Homo sapiens
tggcgtttttctcgtccccctc

SEQ ID NO: 5458180 - DNA, 18 bp, Homo sapiens
tggctaaagataattgct

SEQ ID NO: 5458181 - DNA, 14 bp, Homo sapiens
tggctaaagctcga

SEQ ID NO: 5458182 - DNA, 23 bp, Homo sapiens
tggctaacatggtgaaacatggt

SEQ ID NO: 5458183 - DNA, 16 bp, Homo sapiens
tggctaacttgggtta

SEQ ID NO: 5458184 - DNA, 19 bp, Homo sapiens
tggctaacttttcattttt

SEQ ID NO: 5458185 - DNA, 15 bp, Homo sapiens
tggctaagagtgtcc

SEQ ID NO: 5458186 - DNA, 14 bp, Homo sapiens
tggctaaggcacca

SEQ ID NO: 5458187 - DNA, 22 bp, Homo sapiens
tggctaataaactgtattaaat

SEQ ID NO: 5458188 - DNA, 16 bp, Homo sapiens
tggctaataaggcttt

SEQ ID NO: 5458189 - DNA, 16 bp, Homo sapiens
tggctaattcaattta

SEQ ID NO: 5458190 - DNA, 17 bp, Homo sapiens
tggctaattcaatttat

SEQ ID NO: 5458191 - DNA, 15 bp, Homo sapiens
tggctaattcccaga

SEQ ID NO: 5458192 - DNA, 16 bp, Homo sapiens
tggctaatttaacacc

SEQ ID NO: 5458193 - DNA, 14 bp, Homo sapiens
tggctacaattact

SEQ ID NO: 5458194 - DNA, 18 bp, Homo sapiens
tggctacatcccagcctg

SEQ ID NO: 5458195 - DNA, 20 bp, Homo sapiens
tggctacatcccagcctgtg

SEQ ID NO: 5458196 - DNA, 17 bp, Homo sapiens
tggctacatctccaaat

SEQ ID NO: 5458197 - DNA, 18 bp, Homo sapiens
tggctaccttgtgggaat

SEQ ID NO: 5458198 - DNA, 19 bp, Homo sapiens
tggctaccttgtgggaata

SEQ ID NO: 5458199 - DNA, 13 bp, Homo sapiens
tggctacgttttg

SEQ ID NO: 5458200 - DNA, 15 bp, Homo sapiens
tggctactctgtgcc

SEQ ID NO: 5458201 - DNA, 16 bp, Homo sapiens
tggctactctgtgcca

SEQ ID NO: 5458202 - DNA, 17 bp, Homo sapiens
tggctactctgtgccag

SEQ ID NO: 5458203 - DNA, 15 bp, Homo sapiens
tggctacttcccttc

SEQ ID NO: 5458204 - DNA, 23 bp, Homo sapiens
tggctactttggtttctgtctgt

SEQ ID NO: 5458205 - DNA, 20 bp, Homo sapiens
tggctacttttgaaaatcaa

SEQ ID NO: 5458206 - DNA, 21 bp, Homo sapiens
tggctacttttgaaaatcaag

SEQ ID NO: 5458207 - DNA, 19 bp, Homo sapiens
tggctagagccgaggggag

SEQ ID NO: 5458208 - DNA, 19 bp, Homo sapiens
tggctagaggccagcccca

SEQ ID NO: 5458209 - DNA, 21 bp, Homo sapiens
tggctagaggccagccccacc

SEQ ID NO: 5458210 - DNA, 15 bp, Homo sapiens
tggctagagggccca

SEQ ID NO: 5458211 - DNA, 22 bp, Homo sapiens
tggctagaggttcaaagatatt

SEQ ID NO: 5458212 - DNA, 16 bp, Homo sapiens
tggctagagtcctcac

SEQ ID NO: 5458213 - DNA, 14 bp, Homo sapiens
tggctagcattcct

SEQ ID NO: 5458214 - DNA, 23 bp, Homo sapiens
tggctagcattcctcaggaagga

SEQ ID NO: 5458215 - DNA, 20 bp, Homo sapiens
tggctaggaaagggaagcct

SEQ ID NO: 5458216 - DNA, 21 bp, Homo sapiens
tggctaggactgtggagggga

SEQ ID NO: 5458217 - DNA, 16 bp, Homo sapiens
tggctaggcctttcct

SEQ ID NO: 5458218 - DNA, 17 bp, Homo sapiens
tggctaggcctttcctg

SEQ ID NO: 5458219 - DNA, 17 bp, Homo sapiens
tggctaggggccgagtc

SEQ ID NO: 5458220 - DNA, 23 bp, Homo sapiens
tggctaggggccgagtccaggag

SEQ ID NO: 5458221 - DNA, 21 bp, Homo sapiens
tggctagggttccactggaga

SEQ ID NO: 5458222 - DNA, 14 bp, Homo sapiens
tggctagtactgta

SEQ ID NO: 5458223 - DNA, 17 bp, Homo sapiens
tggctagtcaagctcct

SEQ ID NO: 5458224 - DNA, 20 bp, Homo sapiens
tggctagtcaagctcctcct

SEQ ID NO: 5458225 - DNA, 22 bp, Homo sapiens
tggctagtcaagctcctcctcc

SEQ ID NO: 5458226 - DNA, 22 bp, Homo sapiens
tggctagtcctttctgtgaagc

SEQ ID NO: 5458227 - DNA, 15 bp, Homo sapiens
tggctagtctgtgcc

SEQ ID NO: 5458228 - DNA, 16 bp, Homo sapiens
tggctagtctgtgcct

SEQ ID NO: 5458229 - DNA, 19 bp, Homo sapiens
tggctagtggggtgaacag

SEQ ID NO: 5458230 - DNA, 17 bp, Homo sapiens
tggctagtgtctatcag

SEQ ID NO: 5458231 - DNA, 19 bp, Homo sapiens
tggctataaatatataaaa

SEQ ID NO: 5458232 - DNA, 17 bp, Homo sapiens
tggctataagtgctcaa

SEQ ID NO: 5458233 - DNA, 18 bp, Homo sapiens
tggctatacctggggact

SEQ ID NO: 5458234 - DNA, 13 bp, Homo sapiens
tggctatagatgg

SEQ ID NO: 5458235 - DNA, 18 bp, Homo sapiens
tggctatagatgtctttt

SEQ ID NO: 5458236 - DNA, 22 bp, Homo sapiens
tggctatagatgtcttttccca

SEQ ID NO: 5458237 - DNA, 14 bp, Homo sapiens
tggctatataaaat

SEQ ID NO: 5458238 - DNA, 21 bp, Homo sapiens
tggctatatggcaagaaagct

SEQ ID NO: 5458239 - DNA, 18 bp, Homo sapiens
tggctatattaggcatgt

SEQ ID NO: 5458240 - DNA, 24 bp, Homo sapiens
tggctatcaaaagaaatagaaaag

SEQ ID NO: 5458241 - DNA, 17 bp, Homo sapiens
tggctatcctagagagg

SEQ ID NO: 5458242 - DNA, 14 bp, Homo sapiens
tggctatcctgatt

SEQ ID NO: 5458243 - DNA, 19 bp, Homo sapiens
tggctatgaaaatgagccc

SEQ ID NO: 5458244 - DNA, 14 bp, Homo sapiens
tggctatgcatttg

SEQ ID NO: 5458245 - DNA, 15 bp, Homo sapiens
tggctatgcatttga

SEQ ID NO: 5458246 - DNA, 17 bp, Homo sapiens
tggctatgccttcacta

SEQ ID NO: 5458247 - DNA, 14 bp, Homo sapiens
tggctatggccacc

SEQ ID NO: 5458248 - DNA, 19 bp, Homo sapiens
tggctatgggaatcagctg

SEQ ID NO: 5458249 - DNA, 18 bp, Homo sapiens
tggctattgtccttgtgt

SEQ ID NO: 5458250 - DNA, 19 bp, Homo sapiens
tggctattgtccttgtgta

SEQ ID NO: 5458251 - DNA, 22 bp, Homo sapiens
tggctattgtccttgtgtatcc

SEQ ID NO: 5458252 - DNA, 15 bp, Homo sapiens
tggctatttctgtgt

SEQ ID NO: 5458253 - DNA, 17 bp, Homo sapiens
tggctatttctgtgtcc

SEQ ID NO: 5458254 - DNA, 18 bp, Homo sapiens
tggctatttctgtgtcca

SEQ ID NO: 5458255 - DNA, 12 bp, Homo sapiens
tggctattttat

SEQ ID NO: 5458256 - DNA, 17 bp, Homo sapiens
tggctattttgagaact

SEQ ID NO: 5458257 - DNA, 23 bp, Homo sapiens
tggctattttgagaactccagct

SEQ ID NO: 5458258 - DNA, 16 bp, Homo sapiens
tggctcaaagcagcag

SEQ ID NO: 5458259 - DNA, 17 bp, Homo sapiens
tggctcaaagcagcagg

SEQ ID NO: 5458260 - DNA, 19 bp, Homo sapiens
tggctcaagacaaggctgg

SEQ ID NO: 5458261 - DNA, 14 bp, Homo sapiens
tggctcaagtagaa

SEQ ID NO: 5458262 - DNA, 18 bp, Homo sapiens
tggctcaagtcctctttt

SEQ ID NO: 5458263 - DNA, 17 bp, Homo sapiens
tggctcaagtctggccc

SEQ ID NO: 5458264 - DNA, 17 bp, Homo sapiens
tggctcacaaggcccag

SEQ ID NO: 5458265 - DNA, 19 bp, Homo sapiens
tggctcacaaggcccagga

SEQ ID NO: 5458266 - DNA, 20 bp, Homo sapiens
tggctcacaaggcccaggag

SEQ ID NO: 5458267 - DNA, 22 bp, Homo sapiens
tggctcacaaggcccaggagac

SEQ ID NO: 5458268 - DNA, 13 bp, Homo sapiens
tggctcacacctg

SEQ ID NO: 5458269 - DNA, 22 bp, Homo sapiens
tggctcacacctgtaatcccag

SEQ ID NO: 5458270 - DNA, 17 bp, Homo sapiens
tggctcacactcgacat

SEQ ID NO: 5458271 - DNA, 12 bp, Homo sapiens
tggctcacactg

SEQ ID NO: 5458272 - DNA, 17 bp, Homo sapiens
tggctcacagactggag

SEQ ID NO: 5458273 - DNA, 18 bp, Homo sapiens
tggctcacagactggaga

SEQ ID NO: 5458274 - DNA, 24 bp, Homo sapiens
tggctcacagtacagcatgtgcct

SEQ ID NO: 5458275 - DNA, 20 bp, Homo sapiens
tggctcacagtggggccagc

SEQ ID NO: 5458276 - DNA, 22 bp, Homo sapiens
tggctcacgccccgctgtgtcc

SEQ ID NO: 5458277 - DNA, 21 bp, Homo sapiens
tggctcacgcctgtaatccca

SEQ ID NO: 5458278 - DNA, 22 bp, Homo sapiens
tggctcacgtctgtaatcccag

SEQ ID NO: 5458279 - DNA, 13 bp, Homo sapiens
tggctcactactg

SEQ ID NO: 5458280 - DNA, 17 bp, Homo sapiens
tggctcactcagcactt

SEQ ID NO: 5458281 - DNA, 18 bp, Homo sapiens
tggctcactcagcacttg

SEQ ID NO: 5458282 - DNA, 15 bp, Homo sapiens
tggctcactgcagcc

SEQ ID NO: 5458283 - DNA, 19 bp, Homo sapiens
tggctcactgcagcctccg

SEQ ID NO: 5458284 - DNA, 18 bp, Homo sapiens
tggctcactgcagcctcg

SEQ ID NO: 5458285 - DNA, 13 bp, Homo sapiens
tggctcactggct

SEQ ID NO: 5458286 - DNA, 12 bp, Homo sapiens
tggctcagaaaa

SEQ ID NO: 5458287 - DNA, 13 bp, Homo sapiens
tggctcagaaaat

SEQ ID NO: 5458288 - DNA, 22 bp, Homo sapiens
tggctcagaaaataccttagct

SEQ ID NO: 5458289 - DNA, 18 bp, Homo sapiens
tggctcagagcttgaaga

SEQ ID NO: 5458290 - DNA, 20 bp, Homo sapiens
tggctcagagcttgaagatt

SEQ ID NO: 5458291 - DNA, 13 bp, Homo sapiens
tggctcagagggg

SEQ ID NO: 5458292 - DNA, 15 bp, Homo sapiens
tggctcagcatcctc

SEQ ID NO: 5458293 - DNA, 12 bp, Homo sapiens
tggctcagccag

SEQ ID NO: 5458294 - DNA, 13 bp, Homo sapiens
tggctcagccagc

SEQ ID NO: 5458295 - DNA, 20 bp, Homo sapiens
tggctcagcccgggatcctg

SEQ ID NO: 5458296 - DNA, 24 bp, Homo sapiens
tggctcagcctgtctcgggctgac

SEQ ID NO: 5458297 - DNA, 24 bp, Homo sapiens
tggctcagctcggggagccttagc

SEQ ID NO: 5458298 - DNA, 23 bp, Homo sapiens
tggctcagctgtggtcccaccca

SEQ ID NO: 5458299 - DNA, 14 bp, Homo sapiens
tggctcaggcaagc

SEQ ID NO: 5458300 - DNA, 12 bp, Homo sapiens
tggctcaggccc

SEQ ID NO: 5458301 - DNA, 18 bp, Homo sapiens
tggctcagggatcttctc

SEQ ID NO: 5458302 - DNA, 20 bp, Homo sapiens
tggctcagggtcaaagacag

SEQ ID NO: 5458303 - DNA, 22 bp, Homo sapiens
tggctcaggtggggtcactctg

SEQ ID NO: 5458304 - DNA, 14 bp, Homo sapiens
tggctcagtgccac

SEQ ID NO: 5458305 - DNA, 20 bp, Homo sapiens
tggctcagtgccacctatgc

SEQ ID NO: 5458306 - DNA, 21 bp, Homo sapiens
tggctcatattcctgcagcct

SEQ ID NO: 5458307 - DNA, 16 bp, Homo sapiens
tggctcattcagggaa

SEQ ID NO: 5458308 - DNA, 17 bp, Homo sapiens
tggctcattctgcacct

SEQ ID NO: 5458309 - DNA, 18 bp, Homo sapiens
tggctccaaggtgctctg

SEQ ID NO: 5458310 - DNA, 18 bp, Homo sapiens
tggctccacacacacaaa

SEQ ID NO: 5458311 - DNA, 18 bp, Homo sapiens
tggctccacacctccacc

SEQ ID NO: 5458312 - DNA, 19 bp, Homo sapiens
tggctccagaatgtgctgc

SEQ ID NO: 5458313 - DNA, 20 bp, Homo sapiens
tggctccagaatgtgctgcc

SEQ ID NO: 5458314 - DNA, 20 bp, Homo sapiens
tggctccagatgcagggcag

SEQ ID NO: 5458315 - DNA, 21 bp, Homo sapiens
tggctccagcaccatccgcca

SEQ ID NO: 5458316 - DNA, 13 bp, Homo sapiens
tggctccagcctg

SEQ ID NO: 5458317 - DNA, 15 bp, Homo sapiens
tggctccaggagcag

SEQ ID NO: 5458318 - DNA, 11 bp, Homo sapiens
tggctccaggc

SEQ ID NO: 5458319 - DNA, 20 bp, Homo sapiens
tggcttggccacagccaggg

SEQ ID NO: 5458320 - DNA, 13 bp, Homo sapiens
tggcttggccctg

SEQ ID NO: 5458321 - DNA, 16 bp, Homo sapiens
tggcttggccctggca

SEQ ID NO: 5458322 - DNA, 23 bp, Homo sapiens
tggcttgggactaaatgccctgc

SEQ ID NO: 5458323 - DNA, 20 bp, Homo sapiens
tggcttggggattgtacacg

SEQ ID NO: 5458324 - DNA, 22 bp, Homo sapiens
tggcttggggattgtacacggg

SEQ ID NO: 5458325 - DNA, 20 bp, Homo sapiens
tggcttggggggctccaggg

SEQ ID NO: 5458326 - DNA, 20 bp, Homo sapiens
tggcttgggttgaaaagtgt

SEQ ID NO: 5458327 - DNA, 13 bp, Homo sapiens
tggcttgtacatt

SEQ ID NO: 5458328 - DNA, 12 bp, Homo sapiens
tggcttgtagaa

SEQ ID NO: 5458329 - DNA, 17 bp, Homo sapiens
tggcttgtagaattgtt

SEQ ID NO: 5458330 - DNA, 18 bp, Homo sapiens
tggcttgtagaattgtta

SEQ ID NO: 5458331 - DNA, 16 bp, Homo sapiens
tggcttgtagggtgag

SEQ ID NO: 5458332 - DNA, 22 bp, Homo sapiens
tggcttgtagggtgaggcgtgg

SEQ ID NO: 5458333 - DNA, 14 bp, Homo sapiens
tggcttgtcctcac

SEQ ID NO: 5458334 - DNA, 17 bp, Homo sapiens
tggcttgtcggagcaag

SEQ ID NO: 5458335 - DNA, 13 bp, Homo sapiens
tggcttgtctata

SEQ ID NO: 5458336 - DNA, 16 bp, Homo sapiens
tggcttgtgtgtttca

SEQ ID NO: 5458337 - DNA, 18 bp, Homo sapiens
tggcttgtgtgtttcact

SEQ ID NO: 5458338 - DNA, 22 bp, Homo sapiens
tggcttgttattgcctctactt

SEQ ID NO: 5458339 - DNA, 18 bp, Homo sapiens
tggcttgttgtaaagcaa

SEQ ID NO: 5458340 - DNA, 16 bp, Homo sapiens
tggcttgtttgatttc

SEQ ID NO: 5458341 - DNA, 15 bp, Homo sapiens
tggctttaagccttc

SEQ ID NO: 5458342 - DNA, 17 bp, Homo sapiens
tggctttaattgtataa

SEQ ID NO: 5458343 - DNA, 23 bp, Homo sapiens
tggctttaattgtataagtcaag

SEQ ID NO: 5458344 - DNA, 17 bp, Homo sapiens
tggctttacattttatt

SEQ ID NO: 5458345 - DNA, 17 bp, Homo sapiens
tggctttaggagcagtg

SEQ ID NO: 5458346 - DNA, 12 bp, Homo sapiens
tggctttcacat

SEQ ID NO: 5458347 - DNA, 15 bp, Homo sapiens
tggctttcagaaaac

SEQ ID NO: 5458348 - DNA, 14 bp, Homo sapiens
tggctttcagagcc

SEQ ID NO: 5458349 - DNA, 17 bp, Homo sapiens
tggctttcagagcctcc

SEQ ID NO: 5458350 - DNA, 15 bp, Homo sapiens
tggctttcagcctct

SEQ ID NO: 5458351 - DNA, 22 bp, Homo sapiens
tggctttcataaatcatgttgt

SEQ ID NO: 5458352 - DNA, 17 bp, Homo sapiens
tggctttcatcctgtgt

SEQ ID NO: 5458353 - DNA, 19 bp, Homo sapiens
tggctttcatcctgtgtcc

SEQ ID NO: 5458354 - DNA, 17 bp, Homo sapiens
tggctttcattattagt

SEQ ID NO: 5458355 - DNA, 13 bp, Homo sapiens
tggctttcatttc

SEQ ID NO: 5458356 - DNA, 22 bp, Homo sapiens
tggctttccaggcaccctcagg

SEQ ID NO: 5458357 - DNA, 13 bp, Homo sapiens
tggctttcccagg

SEQ ID NO: 5458358 - DNA, 12 bp, Homo sapiens
tggctttcccgg

SEQ ID NO: 5458359 - DNA, 19 bp, Homo sapiens
tggctttcctctcgttggt

SEQ ID NO: 5458360 - DNA, 20 bp, Homo sapiens
tggctttccttgtggcagag

SEQ ID NO: 5458361 - DNA, 14 bp, Homo sapiens
tggctttctccctg

SEQ ID NO: 5458362 - DNA, 22 bp, Homo sapiens
tggctttctctctggcttctct

SEQ ID NO: 5458363 - DNA, 19 bp, Homo sapiens
tggctttgaaacctcaggg

SEQ ID NO: 5458364 - DNA, 14 bp, Homo sapiens
tggctttgcacttg

SEQ ID NO: 5458365 - DNA, 17 bp, Homo sapiens
tggctttgcccaacctc

SEQ ID NO: 5458366 - DNA, 23 bp, Homo sapiens
tggctttgcccaacctcagcaac

SEQ ID NO: 5458367 - DNA, 15 bp, Homo sapiens
tggctttgcccaccc

SEQ ID NO: 5458368 - DNA, 12 bp, Homo sapiens
tggctttgcctc

SEQ ID NO: 5458369 - DNA, 20 bp, Homo sapiens
tggctttgcctcttctttgt

SEQ ID NO: 5458370 - DNA, 12 bp, Homo sapiens
tggctttgctgt

SEQ ID NO: 5458371 - DNA, 13 bp, Homo sapiens
tggctttggaagc

SEQ ID NO: 5458372 - DNA, 19 bp, Homo sapiens
tggctttggcactctctgc

SEQ ID NO: 5458373 - DNA, 17 bp, Homo sapiens
tggctttggcgccccat

SEQ ID NO: 5458374 - DNA, 20 bp, Homo sapiens
tggctttgggaaagcccaga

SEQ ID NO: 5458375 - DNA, 21 bp, Homo sapiens
tggctttggtctcttgcttgt

SEQ ID NO: 5458376 - DNA, 22 bp, Homo sapiens
tggctttgtcccacagcttggg

SEQ ID NO: 5458377 - DNA, 13 bp, Homo sapiens
tggctttgtctct

SEQ ID NO: 5458378 - DNA, 15 bp, Homo sapiens
tggctttgtcttgaa

SEQ ID NO: 5458379 - DNA, 17 bp, Homo sapiens
tggctttgtcttgaaaa

SEQ ID NO: 5458380 - DNA, 12 bp, Homo sapiens
tggctttgtgct

SEQ ID NO: 5458381 - DNA, 16 bp, Homo sapiens
tggctttgtgctgctg

SEQ ID NO: 5458382 - DNA, 13 bp, Homo sapiens
tggctttgtgctt

SEQ ID NO: 5458383 - DNA, 17 bp, Homo sapiens
tggctttgttcttgtca

SEQ ID NO: 5458384 - DNA, 11 bp, Homo sapiens
tggctttgttt

SEQ ID NO: 5458385 - DNA, 22 bp, Homo sapiens
tggcttttcactgctggctgcc

SEQ ID NO: 5458386 - DNA, 21 bp, Homo sapiens
tggcttttcatgcgtgtgtgt

SEQ ID NO: 5458387 - DNA, 21 bp, Homo sapiens
tggcttttcgcttgcttctgc

SEQ ID NO: 5458388 - DNA, 17 bp, Homo sapiens
tggcttttctgatccag

SEQ ID NO: 5458389 - DNA, 14 bp, Homo sapiens
tggcttttctgttt

SEQ ID NO: 5458390 - DNA, 18 bp, Homo sapiens
tggcttttctgtttcctg

SEQ ID NO: 5458391 - DNA, 19 bp, Homo sapiens
tggcttttctgtttcctgt

SEQ ID NO: 5458392 - DNA, 22 bp, Homo sapiens
tggcttttcttacccagattgt

SEQ ID NO: 5458393 - DNA, 19 bp, Homo sapiens
tggcttttgcctgtaagaa

SEQ ID NO: 5458394 - DNA, 22 bp, Homo sapiens
tggcttttgctttccctgaagc

SEQ ID NO: 5458395 - DNA, 14 bp, Homo sapiens
tggcttttgtgcat

SEQ ID NO: 5458396 - DNA, 15 bp, Homo sapiens
tggcttttgtgcatt

SEQ ID NO: 5458397 - DNA, 18 bp, Homo sapiens
tggctttttaaattttcc

SEQ ID NO: 5458398 - DNA, 15 bp, Homo sapiens
tggctttttaacatg

SEQ ID NO: 5458399 - DNA, 21 bp, Homo sapiens
tggctttttactattaacatg

SEQ ID NO: 5458400 - DNA, 18 bp, Homo sapiens
tggctttttcagagtcat

SEQ ID NO: 5458401 - DNA, 22 bp, Homo sapiens
tggctttttccaaatgcttcta

SEQ ID NO: 5458402 - DNA, 18 bp, Homo sapiens
tggctttttcctctgagc

SEQ ID NO: 5458403 - DNA, 15 bp, Homo sapiens
tggctttttctgcca

SEQ ID NO: 5458404 - DNA, 16 bp, Homo sapiens
tggctttttctgccac

SEQ ID NO: 5458405 - DNA, 21 bp, Homo sapiens
tggcttttttttttcttttgt

SEQ ID NO: 5458406 - DNA, 15 bp, Homo sapiens
tgggaaaaaaaaaag

SEQ ID NO: 5458407 - DNA, 18 bp, Homo sapiens
tgggaaaaaaaaaagtgt

SEQ ID NO: 5458408 - DNA, 19 bp, Homo sapiens
tgggaaaaaaatgaatgag

SEQ ID NO: 5458409 - DNA, 16 bp, Homo sapiens
tgggaaaaactggctt

SEQ ID NO: 5458410 - DNA, 12 bp, Homo sapiens
tgggaaaaagag

SEQ ID NO: 5458411 - DNA, 16 bp, Homo sapiens
tgggaaaaagagactc

SEQ ID NO: 5458412 - DNA, 15 bp, Homo sapiens
tgggaaaaaggctgg

SEQ ID NO: 5458413 - DNA, 23 bp, Homo sapiens
tgggaaaaatgcccttaaatcat

SEQ ID NO: 5458414 - DNA, 16 bp, Homo sapiens
tgggaaaaatgtagga

SEQ ID NO: 5458415 - DNA, 14 bp, Homo sapiens
tgggaaaaattatt

SEQ ID NO: 5458416 - DNA, 15 bp, Homo sapiens
tgggaaaacagagga

SEQ ID NO: 5458417 - DNA, 17 bp, Homo sapiens
tgggaaaacagtgaatc

SEQ ID NO: 5458418 - DNA, 21 bp, Homo sapiens
tgggaaaacatgttaatgaca

SEQ ID NO: 5458419 - DNA, 22 bp, Homo sapiens
tgggaaaacttcactccaaaga

SEQ ID NO: 5458420 - DNA, 20 bp, Homo sapiens
tgggaaaagtgttattattt

SEQ ID NO: 5458421 - DNA, 18 bp, Homo sapiens
tgggaaaatatcactttg

SEQ ID NO: 5458422 - DNA, 13 bp, Homo sapiens
tgggaaaatgtcc

SEQ ID NO: 5458423 - DNA, 18 bp, Homo sapiens
tgggaaacaaaaggataa

SEQ ID NO: 5458424 - DNA, 20 bp, Homo sapiens
tgggaaacactgaaatgaaa

SEQ ID NO: 5458425 - DNA, 15 bp, Homo sapiens
tgggaaacagaggct

SEQ ID NO: 5458426 - DNA, 18 bp, Homo sapiens
tgggaaaccctctccatc

SEQ ID NO: 5458427 - DNA, 21 bp, Homo sapiens
tgggaaacctcattgttctgt

SEQ ID NO: 5458428 - DNA, 14 bp, Homo sapiens
tgggaaacctgcct

SEQ ID NO: 5458429 - DNA, 21 bp, Homo sapiens
tgggaaacgtgggttcaattt

SEQ ID NO: 5458430 - DNA, 17 bp, Homo sapiens
tgggaaagaacttggac

SEQ ID NO: 5458431 - DNA, 23 bp, Homo sapiens
tgggaaagacatccataaagaag

SEQ ID NO: 5458432 - DNA, 22 bp, Homo sapiens
tgggaaagaccctaggtgctca

SEQ ID NO: 5458433 - DNA, 17 bp, Homo sapiens
tgggaaagagatttaaa

SEQ ID NO: 5458434 - DNA, 14 bp, Homo sapiens
tgggaaagagccta

SEQ ID NO: 5458435 - DNA, 19 bp, Homo sapiens
tgggaaagatggataaact

SEQ ID NO: 5458436 - DNA, 14 bp, Homo sapiens
tgggaaagcattgt

SEQ ID NO: 5458437 - DNA, 16 bp, Homo sapiens
tgggaaagcattgtaa

SEQ ID NO: 5458438 - DNA, 18 bp, Homo sapiens
tgggaaagcattgtaaat

SEQ ID NO: 5458439 - DNA, 22 bp, Homo sapiens
tgggaaagccacctctccctca

SEQ ID NO: 5458440 - DNA, 17 bp, Homo sapiens
tgggaaaggagtagaaa

SEQ ID NO: 5458441 - DNA, 15 bp, Homo sapiens
tgggaaaggcagggc

SEQ ID NO: 5458442 - DNA, 23 bp, Homo sapiens
tgggaaagggacccgaagcccag

SEQ ID NO: 5458443 - DNA, 15 bp, Homo sapiens
tgggaaaggtgctca

SEQ ID NO: 5458444 - DNA, 14 bp, Homo sapiens
tgggaaataaagaa

SEQ ID NO: 5458445 - DNA, 15 bp, Homo sapiens
tgggaaataaagaaa

SEQ ID NO: 5458446 - DNA, 19 bp, Homo sapiens
tgggaaatagcggccctgg

SEQ ID NO: 5458447 - DNA, 20 bp, Homo sapiens
tgggaaatatgccactgacc

SEQ ID NO: 5458448 - DNA, 23 bp, Homo sapiens
tgggaaatgagatcccagagtta

SEQ ID NO: 5458449 - DNA, 14 bp, Homo sapiens
tgggaaatgagcca

SEQ ID NO: 5458450 - DNA, 16 bp, Homo sapiens
tgggaaatgcagaaat

SEQ ID NO: 5458451 - DNA, 15 bp, Homo sapiens
tgggaaatgttttaa

SEQ ID NO: 5458452 - DNA, 19 bp, Homo sapiens
tgggaaattcttgcactgt

SEQ ID NO: 5458453 - DNA, 20 bp, Homo sapiens
tgggaaattgaagtgtcttc

SEQ ID NO: 5458454 - DNA, 14 bp, Homo sapiens
tgggaacaagtgta

SEQ ID NO: 5458455 - DNA, 17 bp, Homo sapiens
tgggaacaagtgtacag

SEQ ID NO: 5458456 - DNA, 22 bp, Homo sapiens
tgggaacaagtgtacagaagaa

SEQ ID NO: 5458457 - DNA, 16 bp, Homo sapiens
tgggaacacagtgccc

SEQ ID NO: 5458458 - DNA, 18 bp, Homo sapiens
tgggaacacgtgtgcaca

SEQ ID NO: 5458459 - DNA, 22 bp, Homo sapiens
tgggaacagtaaagaaagcaga

SEQ ID NO: 5458460 - DNA, 21 bp, Homo sapiens
tgggaacataaaaactactga

SEQ ID NO: 5458461 - DNA, 13 bp, Homo sapiens
tgggaaccactcc

SEQ ID NO: 5458462 - DNA, 23 bp, Homo sapiens
tgggaaccagcatctcagcgcca

SEQ ID NO: 5458463 - DNA, 20 bp, Homo sapiens
tgggaacccaagtccaagca

SEQ ID NO: 5458464 - DNA, 21 bp, Homo sapiens
tgggaacccccctcccaccca

SEQ ID NO: 5458465 - DNA, 14 bp, Homo sapiens
tgggaaccccgcag

SEQ ID NO: 5458466 - DNA, 15 bp, Homo sapiens
tgggaaccctcccca

SEQ ID NO: 5458467 - DNA, 16 bp, Homo sapiens
tgggaaccgccctcct

SEQ ID NO: 5458468 - DNA, 22 bp, Homo sapiens
tgggaacctagctacactgagc

SEQ ID NO: 5458469 - DNA, 23 bp, Homo sapiens
tgggaacctagctacactgagca

SEQ ID NO: 5458470 - DNA, 19 bp, Homo sapiens
tgggaacctcccagaggtc

SEQ ID NO: 5458471 - DNA, 18 bp, Homo sapiens
tgggaacctccttacctg

SEQ ID NO: 5458472 - DNA, 15 bp, Homo sapiens
tgggaacgagagggg

SEQ ID NO: 5458473 - DNA, 20 bp, Homo sapiens
tgggaacgagaggggaagag

SEQ ID NO: 5458474 - DNA, 21 bp, Homo sapiens
tgggaacgcagatgatccatg

SEQ ID NO: 5458475 - DNA, 14 bp, Homo sapiens
tgggaacgcagcct

SEQ ID NO: 5458476 - DNA, 15 bp, Homo sapiens
tgggaacgcagcctc

SEQ ID NO: 5458477 - DNA, 16 bp, Homo sapiens
tgggaacgtgactgcc

SEQ ID NO: 5458478 - DNA, 22 bp, Homo sapiens
tgggaacgtgtgtccaggctct

SEQ ID NO: 5458479 - DNA, 13 bp, Homo sapiens
tgggaactagact

SEQ ID NO: 5458480 - DNA, 19 bp, Homo sapiens
tgggaactccactctcctt

SEQ ID NO: 5458481 - DNA, 17 bp, Homo sapiens
tgggaactcccaagaac

SEQ ID NO: 5458482 - DNA, 17 bp, Homo sapiens
tgggaactgcagacctg

SEQ ID NO: 5458483 - DNA, 19 bp, Homo sapiens
tgggaactgggccagcaga

SEQ ID NO: 5458484 - DNA, 14 bp, Homo sapiens
tgggaactgtgcaa

SEQ ID NO: 5458485 - DNA, 22 bp, Homo sapiens
tgggaacttattaaatggaaac

SEQ ID NO: 5458486 - DNA, 17 bp, Homo sapiens
tgggaacttgcgagtcc

SEQ ID NO: 5458487 - DNA, 12 bp, Homo sapiens
tgggaagaaaca

SEQ ID NO: 5458488 - DNA, 14 bp, Homo sapiens
tgggaagaaacaaa

SEQ ID NO: 5458489 - DNA, 18 bp, Homo sapiens
tgggaagaacagaattgc

SEQ ID NO: 5458490 - DNA, 14 bp, Homo sapiens
tgggaagaagcaag

SEQ ID NO: 5458491 - DNA, 16 bp, Homo sapiens
tgggaagaattggaag

SEQ ID NO: 5458492 - DNA, 16 bp, Homo sapiens
tgggaagaccaaagga

SEQ ID NO: 5458493 - DNA, 21 bp, Homo sapiens
tgggaagaccaaaggaaggaa

SEQ ID NO: 5458494 - DNA, 17 bp, Homo sapiens
tgggaagacgaggccct

SEQ ID NO: 5458495 - DNA, 21 bp, Homo sapiens
tgggaagacgcctgagctcac

SEQ ID NO: 5458496 - DNA, 18 bp, Homo sapiens
tgggaggcagccgaggcc

SEQ ID NO: 5458497 - DNA, 11 bp, Homo sapiens
tgggaggcagg

SEQ ID NO: 5458498 - DNA, 20 bp, Homo sapiens
tgggaggcagggctctcccg

SEQ ID NO: 5458499 - DNA, 12 bp, Homo sapiens
tgggaggcaggt

SEQ ID NO: 5458500 - DNA, 14 bp, Homo sapiens
tgggaggccaaggc

SEQ ID NO: 5458501 - DNA, 15 bp, Homo sapiens
tgggaggccaaggca

SEQ ID NO: 5458502 - DNA, 19 bp, Homo sapiens
tgggaggccaaggtgggag

SEQ ID NO: 5458503 - DNA, 20 bp, Homo sapiens
tgggaggccaggcgagcctg

SEQ ID NO: 5458504 - DNA, 23 bp, Homo sapiens
tgggaggccaggcgagcctgact

SEQ ID NO: 5458505 - DNA, 16 bp, Homo sapiens
tgggaggccccactgg

SEQ ID NO: 5458506 - DNA, 14 bp, Homo sapiens
tgggaggccctggc

SEQ ID NO: 5458507 - DNA, 17 bp, Homo sapiens
tgggaggccgaggcagg

SEQ ID NO: 5458508 - DNA, 20 bp, Homo sapiens
tgggaggcctttccctaagc

SEQ ID NO: 5458509 - DNA, 12 bp, Homo sapiens
tgggaggcgggc

SEQ ID NO: 5458510 - DNA, 17 bp, Homo sapiens
tgggaggcgtgcccccc

SEQ ID NO: 5458511 - DNA, 13 bp, Homo sapiens
tgggaggctcacc

SEQ ID NO: 5458512 - DNA, 14 bp, Homo sapiens
tgggaggctcccag

SEQ ID NO: 5458513 - DNA, 23 bp, Homo sapiens
tgggaggctcccagacccagggc

SEQ ID NO: 5458514 - DNA, 16 bp, Homo sapiens
tgggaggctcctggtg

SEQ ID NO: 5458515 - DNA, 14 bp, Homo sapiens
tgggaggctgaagt

SEQ ID NO: 5458516 - DNA, 15 bp, Homo sapiens
tgggaggctgaggca

SEQ ID NO: 5458517 - DNA, 18 bp, Homo sapiens
tgggaggctgaggcagga

SEQ ID NO: 5458518 - DNA, 16 bp, Homo sapiens
tgggaggctgcagcca

SEQ ID NO: 5458519 - DNA, 18 bp, Homo sapiens
tgggaggctgcagccagg

SEQ ID NO: 5458520 - DNA, 21 bp, Homo sapiens
tgggaggctgcagccaggcct

SEQ ID NO: 5458521 - DNA, 15 bp, Homo sapiens
tgggaggctggagtt

SEQ ID NO: 5458522 - DNA, 18 bp, Homo sapiens
tgggagggaaaagggaag

SEQ ID NO: 5458523 - DNA, 18 bp, Homo sapiens
tgggagggagcagacagg

SEQ ID NO: 5458524 - DNA, 16 bp, Homo sapiens
tgggagggaggagggc

SEQ ID NO: 5458525 - DNA, 18 bp, Homo sapiens
tgggagggaggcatctgc

SEQ ID NO: 5458526 - DNA, 17 bp, Homo sapiens
tgggagggatcagcccc

SEQ ID NO: 5458527 - DNA, 18 bp, Homo sapiens
tgggagggatcagccccg

SEQ ID NO: 5458528 - DNA, 14 bp, Homo sapiens
tgggagggatgaga

SEQ ID NO: 5458529 - DNA, 14 bp, Homo sapiens
tgggagggcagcag

SEQ ID NO: 5458530 - DNA, 18 bp, Homo sapiens
tgggagggcgaggcgggg

SEQ ID NO: 5458531 - DNA, 15 bp, Homo sapiens
tgggagggcgtcagg

SEQ ID NO: 5458532 - DNA, 18 bp, Homo sapiens
tgggagggcgtcaggcag

SEQ ID NO: 5458533 - DNA, 15 bp, Homo sapiens
tgggaggggaagaaa

SEQ ID NO: 5458534 - DNA, 18 bp, Homo sapiens
tgggaggggaagaaaaac

SEQ ID NO: 5458535 - DNA, 24 bp, Homo sapiens
tgggaggggccatgctgtgtgaga

SEQ ID NO: 5458536 - DNA, 18 bp, Homo sapiens
tgggaggggcccacagga

SEQ ID NO: 5458537 - DNA, 18 bp, Homo sapiens
tgggagggggagaaaagg

SEQ ID NO: 5458538 - DNA, 14 bp, Homo sapiens
tgggagggggcagg

SEQ ID NO: 5458539 - DNA, 18 bp, Homo sapiens
tgggagggggcagggggc

SEQ ID NO: 5458540 - DNA, 15 bp, Homo sapiens
tgggagggggccctt

SEQ ID NO: 5458541 - DNA, 19 bp, Homo sapiens
tgggagggggcgttggatt

SEQ ID NO: 5458542 - DNA, 23 bp, Homo sapiens
tgggagggggctatttctctccc

SEQ ID NO: 5458543 - DNA, 23 bp, Homo sapiens
tgggagggggcttgaagccaaag

SEQ ID NO: 5458544 - DNA, 21 bp, Homo sapiens
tgggagggggtgagaggcagg

SEQ ID NO: 5458545 - DNA, 15 bp, Homo sapiens
tgggagggggtgggg

SEQ ID NO: 5458546 - DNA, 18 bp, Homo sapiens
tgggagggtctgcaggga

SEQ ID NO: 5458547 - DNA, 15 bp, Homo sapiens
tgggagggttcccct

SEQ ID NO: 5458548 - DNA, 19 bp, Homo sapiens
tgggagggttggcacctgc

SEQ ID NO: 5458549 - DNA, 19 bp, Homo sapiens
tgggaggtaggctgtgggg

SEQ ID NO: 5458550 - DNA, 19 bp, Homo sapiens
tgggaggtatgggctgggg

SEQ ID NO: 5458551 - DNA, 17 bp, Homo sapiens
tgggaggtcaaggctgc

SEQ ID NO: 5458552 - DNA, 21 bp, Homo sapiens
tgggaggtccaaggtcaaggc

SEQ ID NO: 5458553 - DNA, 16 bp, Homo sapiens
tgggaggtccaggcag

SEQ ID NO: 5458554 - DNA, 20 bp, Homo sapiens
tgggaggtctccactgagga

SEQ ID NO: 5458555 - DNA, 20 bp, Homo sapiens
tgggaggtctcgtcccagcc

SEQ ID NO: 5458556 - DNA, 23 bp, Homo sapiens
tgggaggtcttggccgactcagg

SEQ ID NO: 5458557 - DNA, 19 bp, Homo sapiens
tgggaggtgagctagaccc

SEQ ID NO: 5458558 - DNA, 22 bp, Homo sapiens
tgggaggtgcgtgttcagcaga

SEQ ID NO: 5458559 - DNA, 14 bp, Homo sapiens
tgggaggtggaaaa

SEQ ID NO: 5458560 - DNA, 15 bp, Homo sapiens
tgggaggtggggcct

SEQ ID NO: 5458561 - DNA, 20 bp, Homo sapiens
tgggaggtgttggctgcacg

SEQ ID NO: 5458562 - DNA, 20 bp, Homo sapiens
tgggaggttgggaggctgtg

SEQ ID NO: 5458563 - DNA, 19 bp, Homo sapiens
tgggagtaacagggcagaa

SEQ ID NO: 5458564 - DNA, 23 bp, Homo sapiens
tgggagtaagaaatgggcctcag

SEQ ID NO: 5458565 - DNA, 20 bp, Homo sapiens
tgggagtagttggagcattg

SEQ ID NO: 5458566 - DNA, 18 bp, Homo sapiens
tgggagtatgttgtcata

SEQ ID NO: 5458567 - DNA, 20 bp, Homo sapiens
tgggagtatgttgtcataac

SEQ ID NO: 5458568 - DNA, 13 bp, Homo sapiens
tgggagtcagagc

SEQ ID NO: 5458569 - DNA, 21 bp, Homo sapiens
tgggagtcagagccctggctg

SEQ ID NO: 5458570 - DNA, 19 bp, Homo sapiens
tgggagtcaggacctccgg

SEQ ID NO: 5458571 - DNA, 20 bp, Homo sapiens
tgggagtcaggcctgggcag

SEQ ID NO: 5458572 - DNA, 14 bp, Homo sapiens
tgggagtcagggag

SEQ ID NO: 5458573 - DNA, 21 bp, Homo sapiens
tgggagtcagggagccctggg

SEQ ID NO: 5458574 - DNA, 16 bp, Homo sapiens
tgggagtccaaggtgg

SEQ ID NO: 5458575 - DNA, 12 bp, Homo sapiens
tgggagtccagg

SEQ ID NO: 5458576 - DNA, 17 bp, Homo sapiens
tgggagtccaggcacag

SEQ ID NO: 5458577 - DNA, 19 bp, Homo sapiens
tgggagtccaggcacagga

SEQ ID NO: 5458578 - DNA, 15 bp, Homo sapiens
tgggagtccctacct

SEQ ID NO: 5458579 - DNA, 19 bp, Homo sapiens
tgggagtccttacctcggg

SEQ ID NO: 5458580 - DNA, 13 bp, Homo sapiens
tgggagtctcttg

SEQ ID NO: 5458581 - DNA, 15 bp, Homo sapiens
tgggagtctgaaatg

SEQ ID NO: 5458582 - DNA, 17 bp, Homo sapiens
tgggagtgaacatttct

SEQ ID NO: 5458583 - DNA, 15 bp, Homo sapiens
tgggagtgagctggt

SEQ ID NO: 5458584 - DNA, 21 bp, Homo sapiens
tgggagtgaggatgtctgggc

SEQ ID NO: 5458585 - DNA, 15 bp, Homo sapiens
tgggagtgggagagg

SEQ ID NO: 5458586 - DNA, 16 bp, Homo sapiens
tgggagtgggagagga

SEQ ID NO: 5458587 - DNA, 13 bp, Homo sapiens
tgggagtgggcac

SEQ ID NO: 5458588 - DNA, 14 bp, Homo sapiens
tgggagtggggcct

SEQ ID NO: 5458589 - DNA, 22 bp, Homo sapiens
tgggagtggggcctttgccagc

SEQ ID NO: 5458590 - DNA, 17 bp, Homo sapiens
tgggagtgtgggctgcc

SEQ ID NO: 5458591 - DNA, 19 bp, Homo sapiens
tgggagtgtgggctgccct

SEQ ID NO: 5458592 - DNA, 18 bp, Homo sapiens
tgggagtgtggtttcttt

SEQ ID NO: 5458593 - DNA, 11 bp, Homo sapiens
tgggagtgtgt

SEQ ID NO: 5458594 - DNA, 19 bp, Homo sapiens
tgggagtgtgtctgctgag

SEQ ID NO: 5458595 - DNA, 21 bp, Homo sapiens
tgggagtgttcccgtgcctgg

SEQ ID NO: 5458596 - DNA, 22 bp, Homo sapiens
tgggagtgttcccgtgcctggg

SEQ ID NO: 5458597 - DNA, 18 bp, Homo sapiens
tgggagtgttgagcatct

SEQ ID NO: 5458598 - DNA, 17 bp, Homo sapiens
tgggagttgctgttaat

SEQ ID NO: 5458599 - DNA, 23 bp, Homo sapiens
tgggagttgctgttaatctgatg

SEQ ID NO: 5458600 - DNA, 15 bp, Homo sapiens
tgggataaagcaagg

SEQ ID NO: 5458601 - DNA, 22 bp, Homo sapiens
tgggataaagcaaggggacctt

SEQ ID NO: 5458602 - DNA, 12 bp, Homo sapiens
tgggataaatag

SEQ ID NO: 5458603 - DNA, 12 bp, Homo sapiens
tgggataaatgc

SEQ ID NO: 5458604 - DNA, 21 bp, Homo sapiens
tgggataacagaggcaggagt

SEQ ID NO: 5458605 - DNA, 19 bp, Homo sapiens
tgggataactgatttctat

SEQ ID NO: 5458606 - DNA, 16 bp, Homo sapiens
tgggataattccttgg

SEQ ID NO: 5458607 - DNA, 12 bp, Homo sapiens
tgggatacaacc

SEQ ID NO: 5458608 - DNA, 16 bp, Homo sapiens
tgggatactgcagggc

SEQ ID NO: 5458609 - DNA, 22 bp, Homo sapiens
tgggatacttagtggtatgtct

SEQ ID NO: 5458610 - DNA, 21 bp, Homo sapiens
tgggatagatttgtttcttaa

SEQ ID NO: 5458611 - DNA, 14 bp, Homo sapiens
tgggataggagcag

SEQ ID NO: 5458612 - DNA, 21 bp, Homo sapiens
tgggataggagggtgcccctg

SEQ ID NO: 5458613 - DNA, 23 bp, Homo sapiens
tgggataggagggtgcccctggg

SEQ ID NO: 5458614 - DNA, 21 bp, Homo sapiens
tgggatagtgttctgctcctg

SEQ ID NO: 5458615 - DNA, 18 bp, Homo sapiens
tgggatatggctgcccag

SEQ ID NO: 5458616 - DNA, 19 bp, Homo sapiens
tgggatatggctgcccagg

SEQ ID NO: 5458617 - DNA, 15 bp, Homo sapiens
tgggatatgtggtgt

SEQ ID NO: 5458618 - DNA, 18 bp, Homo sapiens
tgggatattgaatgttaa

SEQ ID NO: 5458619 - DNA, 18 bp, Homo sapiens
tgggatattttgaaatga

SEQ ID NO: 5458620 - DNA, 22 bp, Homo sapiens
tgggatattttgaaatgaactt

SEQ ID NO: 5458621 - DNA, 23 bp, Homo sapiens
tgggatattttgaaatgaacttt

SEQ ID NO: 5458622 - DNA, 14 bp, Homo sapiens
tgggatcaaagcta

SEQ ID NO: 5458623 - DNA, 19 bp, Homo sapiens
tgggatcacatgtggactt

SEQ ID NO: 5458624 - DNA, 14 bp, Homo sapiens
tgggatcagagcag

SEQ ID NO: 5458625 - DNA, 21 bp, Homo sapiens
tgggatcagggcattgcctgt

SEQ ID NO: 5458626 - DNA, 23 bp, Homo sapiens
tgggatcagggcattgcctgtga

SEQ ID NO: 5458627 - DNA, 20 bp, Homo sapiens
tgggatcaggggtaggaatg

SEQ ID NO: 5458628 - DNA, 14 bp, Homo sapiens
tgggatcagtgggg

SEQ ID NO: 5458629 - DNA, 14 bp, Homo sapiens
tgggatcatgaaag

SEQ ID NO: 5458630 - DNA, 16 bp, Homo sapiens
tgggatcattgcattt

SEQ ID NO: 5458631 - DNA, 19 bp, Homo sapiens
tgggatcatttttccagga

SEQ ID NO: 5458632 - DNA, 23 bp, Homo sapiens
tgggatcatttttccaggactct

SEQ ID NO: 5458633 - DNA, 17 bp, Homo sapiens
tgggatccaaggggcag

SEQ ID NO: 5458634 - DNA, 18 bp, Homo sapiens
tgggatccacgctgggcc

SEQ ID NO: 5458635 - DNA, 15 bp, Homo sapiens
tgggatccaggcccc

SEQ ID NO: 5458636 - DNA, 15 bp, Homo sapiens
tgggatcccacagcc

SEQ ID NO: 5458637 - DNA, 16 bp, Homo sapiens
tgggatcccacagccc

SEQ ID NO: 5458638 - DNA, 19 bp, Homo sapiens
tgggatccctgtctttcct

SEQ ID NO: 5458639 - DNA, 18 bp, Homo sapiens
tgggatccgagggcccct

SEQ ID NO: 5458640 - DNA, 21 bp, Homo sapiens
tgggatccgcatccagccgtg

SEQ ID NO: 5458641 - DNA, 13 bp, Homo sapiens
tgggatcctccag

SEQ ID NO: 5458642 - DNA, 15 bp, Homo sapiens
tgggatcctccaggt

SEQ ID NO: 5458643 - DNA, 23 bp, Homo sapiens
tgggatcggacctcagtttctgt

SEQ ID NO: 5458644 - DNA, 14 bp, Homo sapiens
tgggatctaggaga

SEQ ID NO: 5458645 - DNA, 19 bp, Homo sapiens
tgggatctatttttgcact

SEQ ID NO: 5458646 - DNA, 14 bp, Homo sapiens
tgggatctgcaaga

SEQ ID NO: 5458647 - DNA, 13 bp, Homo sapiens
tgggatctgccaa

SEQ ID NO: 5458648 - DNA, 18 bp, Homo sapiens
tgggatctgcccctccct

SEQ ID NO: 5458649 - DNA, 19 bp, Homo sapiens
tgggatctgcccctccctg

SEQ ID NO: 5458650 - DNA, 23 bp, Homo sapiens
tgggatctgcccctccctgcttc

SEQ ID NO: 5458651 - DNA, 12 bp, Homo sapiens
tgggatctgggg

SEQ ID NO: 5458652 - DNA, 23 bp, Homo sapiens
tgggatctgtaaggaactggaac

SEQ ID NO: 5458653 - DNA, 13 bp, Homo sapiens
tgggatcttgaag

SEQ ID NO: 5458654 - DNA, 18 bp, Homo sapiens
tgggatctttctgggagc

SEQ ID NO: 5458655 - DNA, 16 bp, Homo sapiens
tgggatgaaactaaag

SEQ ID NO: 5458656 - DNA, 16 bp, Homo sapiens
tgggatgacaggtgtg

SEQ ID NO: 5458657 - DNA, 21 bp, Homo sapiens
tgggatgagaatgaaagctta

SEQ ID NO: 5458658 - DNA, 15 bp, Homo sapiens
tgggatgagcctctc

SEQ ID NO: 5458659 - DNA, 22 bp, Homo sapiens
tgggatgagggagacagaccac

SEQ ID NO: 5458660 - DNA, 18 bp, Homo sapiens
tgggatgcagtgatgtga

SEQ ID NO: 5458661 - DNA, 21 bp, Homo sapiens
tgggatgcggggcagagccac

SEQ ID NO: 5458662 - DNA, 12 bp, Homo sapiens
tgggatgctcct

SEQ ID NO: 5458663 - DNA, 16 bp, Homo sapiens
tgggatgctgacccag

SEQ ID NO: 5458664 - DNA, 19 bp, Homo sapiens
tgggatgctgacccaggaa

SEQ ID NO: 5458665 - DNA, 20 bp, Homo sapiens
tgggatgctgacccaggaat

SEQ ID NO: 5458666 - DNA, 21 bp, Homo sapiens
tgggatgctgacccaggaata

SEQ ID NO: 5458667 - DNA, 14 bp, Homo sapiens
tgggatgcttgcct

SEQ ID NO: 5458668 - DNA, 13 bp, Homo sapiens
tgggatggaggag

SEQ ID NO: 5458669 - DNA, 15 bp, Homo sapiens
tgggatggcgatggg

SEQ ID NO: 5458670 - DNA, 23 bp, Homo sapiens
tgggatggcgatggggactctgc

SEQ ID NO: 5458671 - DNA, 16 bp, Homo sapiens
tgggatgggaggccgg

SEQ ID NO: 5458672 - DNA, 18 bp, Homo sapiens
tgggatgggcacaggctg

SEQ ID NO: 5458673 - DNA, 12 bp, Homo sapiens
tgggccttcagg

SEQ ID NO: 5458674 - DNA, 15 bp, Homo sapiens
tgggccttctcagct

SEQ ID NO: 5458675 - DNA, 17 bp, Homo sapiens
tgggccttctcagctct

SEQ ID NO: 5458676 - DNA, 16 bp, Homo sapiens
tgggccttgctgctgc

SEQ ID NO: 5458677 - DNA, 20 bp, Homo sapiens
tgggccttgctgctgctgca

SEQ ID NO: 5458678 - DNA, 16 bp, Homo sapiens
tgggccttgctttggg

SEQ ID NO: 5458679 - DNA, 15 bp, Homo sapiens
tgggccttggcctgg

SEQ ID NO: 5458680 - DNA, 15 bp, Homo sapiens
tgggccttggctggg

SEQ ID NO: 5458681 - DNA, 23 bp, Homo sapiens
tgggccttggggctcagccacag

SEQ ID NO: 5458682 - DNA, 23 bp, Homo sapiens
tgggcctttccagagaactgcag

SEQ ID NO: 5458683 - DNA, 14 bp, Homo sapiens
tgggcctttcctgt

SEQ ID NO: 5458684 - DNA, 21 bp, Homo sapiens
tgggcgagcatgggggctgcc

SEQ ID NO: 5458685 - DNA, 19 bp, Homo sapiens
tgggcgaggcctgacacag

SEQ ID NO: 5458686 - DNA, 16 bp, Homo sapiens
tgggcgatgtcactca

SEQ ID NO: 5458687 - DNA, 20 bp, Homo sapiens
tgggcgcagctgaagcctgg

SEQ ID NO: 5458688 - DNA, 21 bp, Homo sapiens
tgggcgcagctgaagcctgga

SEQ ID NO: 5458689 - DNA, 13 bp, Homo sapiens
tgggcgcaggccc

SEQ ID NO: 5458690 - DNA, 14 bp, Homo sapiens
tgggcgcagtggct

SEQ ID NO: 5458691 - DNA, 17 bp, Homo sapiens
tgggcgcagtggctcac

SEQ ID NO: 5458692 - DNA, 15 bp, Homo sapiens
tgggcgcccaccctg

SEQ ID NO: 5458693 - DNA, 16 bp, Homo sapiens
tgggcgcccaccctgg

SEQ ID NO: 5458694 - DNA, 20 bp, Homo sapiens
tgggcgcccaccctgggctc

SEQ ID NO: 5458695 - DNA, 17 bp, Homo sapiens
tgggcgccctggaagcc

SEQ ID NO: 5458696 - DNA, 18 bp, Homo sapiens
tgggcgccgtgctgggca

SEQ ID NO: 5458697 - DNA, 19 bp, Homo sapiens
tgggcgcctctgtcctggc

SEQ ID NO: 5458698 - DNA, 13 bp, Homo sapiens
tgggcgctctgcc

SEQ ID NO: 5458699 - DNA, 17 bp, Homo sapiens
tgggcgctgcttccagg

SEQ ID NO: 5458700 - DNA, 14 bp, Homo sapiens
tgggcgctggtcct

SEQ ID NO: 5458701 - DNA, 17 bp, Homo sapiens
tgggcgcttcccacctg

SEQ ID NO: 5458702 - DNA, 23 bp, Homo sapiens
tgggcggaagtacttccctcagg

SEQ ID NO: 5458703 - DNA, 22 bp, Homo sapiens
tgggcggacaaaagggccaggt

SEQ ID NO: 5458704 - DNA, 15 bp, Homo sapiens
tgggcggcagagagg

SEQ ID NO: 5458705 - DNA, 16 bp, Homo sapiens
tgggcggcggccacgc

SEQ ID NO: 5458706 - DNA, 15 bp, Homo sapiens
tgggcggctcctggt

SEQ ID NO: 5458707 - DNA, 16 bp, Homo sapiens
tgggcggctctgaagc

SEQ ID NO: 5458708 - DNA, 18 bp, Homo sapiens
tgggcggctgagagcccc

SEQ ID NO: 5458709 - DNA, 14 bp, Homo sapiens
tgggcggctgtgct

SEQ ID NO: 5458710 - DNA, 17 bp, Homo sapiens
tgggcgggcaggggagg

SEQ ID NO: 5458711 - DNA, 13 bp, Homo sapiens
tgggcggggcttc

SEQ ID NO: 5458712 - DNA, 14 bp, Homo sapiens
tgggcggggcttct

SEQ ID NO: 5458713 - DNA, 13 bp, Homo sapiens
tgggcggtccaga

SEQ ID NO: 5458714 - DNA, 21 bp, Homo sapiens
tgggcgtacgctggtgctgag

SEQ ID NO: 5458715 - DNA, 18 bp, Homo sapiens
tgggcgtccagctcagcc

SEQ ID NO: 5458716 - DNA, 15 bp, Homo sapiens
tgggcgtctccccca

SEQ ID NO: 5458717 - DNA, 17 bp, Homo sapiens
tgggcgtctcccccaga

SEQ ID NO: 5458718 - DNA, 18 bp, Homo sapiens
tgggcgtctcccccagag

SEQ ID NO: 5458719 - DNA, 16 bp, Homo sapiens
tgggcgtctgactccc

SEQ ID NO: 5458720 - DNA, 17 bp, Homo sapiens
tgggcgtctgagctggg

SEQ ID NO: 5458721 - DNA, 13 bp, Homo sapiens
tgggcgtctgttc

SEQ ID NO: 5458722 - DNA, 13 bp, Homo sapiens
tgggcgtgacttc

SEQ ID NO: 5458723 - DNA, 20 bp, Homo sapiens
tgggcgtgagacctgcccct

SEQ ID NO: 5458724 - DNA, 14 bp, Homo sapiens
tgggcgtggcctgc

SEQ ID NO: 5458725 - DNA, 20 bp, Homo sapiens
tgggcgtggtcactgctgtc

SEQ ID NO: 5458726 - DNA, 14 bp, Homo sapiens
tgggcgtgtgtgac

SEQ ID NO: 5458727 - DNA, 20 bp, Homo sapiens
tgggcgttaggggcaggcag

SEQ ID NO: 5458728 - DNA, 21 bp, Homo sapiens
tgggctaacatttaggagaag

SEQ ID NO: 5458729 - DNA, 22 bp, Homo sapiens
tgggctaagtgatcctcccacc

SEQ ID NO: 5458730 - DNA, 15 bp, Homo sapiens
tgggctaccatctgc

SEQ ID NO: 5458731 - DNA, 14 bp, Homo sapiens
tgggctagagggtg

SEQ ID NO: 5458732 - DNA, 23 bp, Homo sapiens
tgggctaggtagaaaaagggtca

SEQ ID NO: 5458733 - DNA, 21 bp, Homo sapiens
tgggctagtgtgagtggcagc

SEQ ID NO: 5458734 - DNA, 16 bp, Homo sapiens
tgggctagttgggctt

SEQ ID NO: 5458735 - DNA, 17 bp, Homo sapiens
tgggctatagcacacag

SEQ ID NO: 5458736 - DNA, 22 bp, Homo sapiens
tgggctatattcctgacaaaag

SEQ ID NO: 5458737 - DNA, 19 bp, Homo sapiens
tgggctatggacacagggt

SEQ ID NO: 5458738 - DNA, 20 bp, Homo sapiens
tgggctattgaagatacaca

SEQ ID NO: 5458739 - DNA, 21 bp, Homo sapiens
tgggctattgaagatacacaa

SEQ ID NO: 5458740 - DNA, 18 bp, Homo sapiens
tgggctattgctgctgcc

SEQ ID NO: 5458741 - DNA, 19 bp, Homo sapiens
tgggctatttggactcagg

SEQ ID NO: 5458742 - DNA, 14 bp, Homo sapiens
tgggctcaaatgat

SEQ ID NO: 5458743 - DNA, 22 bp, Homo sapiens
tgggctcaagcagtcctcccac

SEQ ID NO: 5458744 - DNA, 14 bp, Homo sapiens
tgggctcaagcttt

SEQ ID NO: 5458745 - DNA, 11 bp, Homo sapiens
tgggctcacac

SEQ ID NO: 5458746 - DNA, 18 bp, Homo sapiens
tgggctcacaccagccct

SEQ ID NO: 5458747 - DNA, 15 bp, Homo sapiens
tgggctcacaggcct

SEQ ID NO: 5458748 - DNA, 17 bp, Homo sapiens
tgggctcacaggcctct

SEQ ID NO: 5458749 - DNA, 18 bp, Homo sapiens
tgggctcacaggcctctc

SEQ ID NO: 5458750 - DNA, 23 bp, Homo sapiens
tgggctcactacatgggccagcc

SEQ ID NO: 5458751 - DNA, 15 bp, Homo sapiens
tgggctcactgcagg

SEQ ID NO: 5458752 - DNA, 19 bp, Homo sapiens
tgggctcactgcaggcatg

SEQ ID NO: 5458753 - DNA, 16 bp, Homo sapiens
tgggctcactgtgctg

SEQ ID NO: 5458754 - DNA, 12 bp, Homo sapiens
tgggctcagaga

SEQ ID NO: 5458755 - DNA, 23 bp, Homo sapiens
tgggctcagagagtacactgtgt

SEQ ID NO: 5458756 - DNA, 20 bp, Homo sapiens
tgggctcagatcctgggcat

SEQ ID NO: 5458757 - DNA, 10 bp, Homo sapiens
tgggctcagc

SEQ ID NO: 5458758 - DNA, 16 bp, Homo sapiens
tgggctcagcagggct

SEQ ID NO: 5458759 - DNA, 14 bp, Homo sapiens
tgggctcagggcca

SEQ ID NO: 5458760 - DNA, 15 bp, Homo sapiens
tgggctcagggctgg

SEQ ID NO: 5458761 - DNA, 15 bp, Homo sapiens
tgggctcagggttgg

SEQ ID NO: 5458762 - DNA, 16 bp, Homo sapiens
tgggctcagggttggc

SEQ ID NO: 5458763 - DNA, 21 bp, Homo sapiens
tgggctccacacagcagtgtc

SEQ ID NO: 5458764 - DNA, 22 bp, Homo sapiens
tgggctccacacagcagtgtcc

SEQ ID NO: 5458765 - DNA, 11 bp, Homo sapiens
tgggctccaga

SEQ ID NO: 5458766 - DNA, 12 bp, Homo sapiens
tgggctccagag

SEQ ID NO: 5458767 - DNA, 16 bp, Homo sapiens
tgggctccagagggca

SEQ ID NO: 5458768 - DNA, 14 bp, Homo sapiens
tgggctcccaccct

SEQ ID NO: 5458769 - DNA, 14 bp, Homo sapiens
tgggctcccctctt

SEQ ID NO: 5458770 - DNA, 16 bp, Homo sapiens
tgggctcccgtgtttt

SEQ ID NO: 5458771 - DNA, 11 bp, Homo sapiens
tgggctccctg

SEQ ID NO: 5458772 - DNA, 17 bp, Homo sapiens
tgggctccctggcccag

SEQ ID NO: 5458773 - DNA, 21 bp, Homo sapiens
tgggctccctggcccagccag

SEQ ID NO: 5458774 - DNA, 14 bp, Homo sapiens
tgggctcccttccc

SEQ ID NO: 5458775 - DNA, 18 bp, Homo sapiens
tgggctcccttcccacct

SEQ ID NO: 5458776 - DNA, 20 bp, Homo sapiens
tgggctcccttcccacctct

SEQ ID NO: 5458777 - DNA, 21 bp, Homo sapiens
tgggctccctttaagccaaga

SEQ ID NO: 5458778 - DNA, 15 bp, Homo sapiens
tgggctcctccaggg

SEQ ID NO: 5458779 - DNA, 23 bp, Homo sapiens
tgggctcctccagggtgtgtgct

SEQ ID NO: 5458780 - DNA, 15 bp, Homo sapiens
tgggctcctctgcat

SEQ ID NO: 5458781 - DNA, 15 bp, Homo sapiens
tgggctcctcttagc

SEQ ID NO: 5458782 - DNA, 10 bp, Homo sapiens
tgggctcctg

SEQ ID NO: 5458783 - DNA, 13 bp, Homo sapiens
tgggctcctggac

SEQ ID NO: 5458784 - DNA, 17 bp, Homo sapiens
tgggctcctggctgcca

SEQ ID NO: 5458785 - DNA, 18 bp, Homo sapiens
tgggctcgcactgcccac

SEQ ID NO: 5458786 - DNA, 16 bp, Homo sapiens
tgggctcgtctttgca

SEQ ID NO: 5458787 - DNA, 17 bp, Homo sapiens
tgggctctacctctctt

SEQ ID NO: 5458788 - DNA, 15 bp, Homo sapiens
tgggctctcacccag

SEQ ID NO: 5458789 - DNA, 16 bp, Homo sapiens
tgggctctcacccagt

SEQ ID NO: 5458790 - DNA, 14 bp, Homo sapiens
tgggctctccgggg

SEQ ID NO: 5458791 - DNA, 16 bp, Homo sapiens
tgggctctgaacacac

SEQ ID NO: 5458792 - DNA, 11 bp, Homo sapiens
tgggctctgac

SEQ ID NO: 5458793 - DNA, 15 bp, Homo sapiens
tgggctctgatgaaa

SEQ ID NO: 5458794 - DNA, 13 bp, Homo sapiens
tgggctctgccac

SEQ ID NO: 5458795 - DNA, 19 bp, Homo sapiens
tgggctctgccccagctct

SEQ ID NO: 5458796 - DNA, 23 bp, Homo sapiens
tgggctctgccccagctctggct

SEQ ID NO: 5458797 - DNA, 11 bp, Homo sapiens
tgggctctgga

SEQ ID NO: 5458798 - DNA, 12 bp, Homo sapiens
tgggctctggaa

SEQ ID NO: 5458799 - DNA, 19 bp, Homo sapiens
tgggctctggacctcagga

SEQ ID NO: 5458800 - DNA, 19 bp, Homo sapiens
tgggctctggactccacgg

SEQ ID NO: 5458801 - DNA, 15 bp, Homo sapiens
tgggctctggctccc

SEQ ID NO: 5458802 - DNA, 14 bp, Homo sapiens
tgggctctggctct

SEQ ID NO: 5458803 - DNA, 14 bp, Homo sapiens
tgggctctgggagc

SEQ ID NO: 5458804 - DNA, 14 bp, Homo sapiens
tgggctctggtctg

SEQ ID NO: 5458805 - DNA, 22 bp, Homo sapiens
tgggctctggttttctggtggg

SEQ ID NO: 5458806 - DNA, 15 bp, Homo sapiens
tgggctctgtcttcc

SEQ ID NO: 5458807 - DNA, 21 bp, Homo sapiens
tgggctctgtgggctgcactc

SEQ ID NO: 5458808 - DNA, 20 bp, Homo sapiens
tgggctgaactgagcctagc

SEQ ID NO: 5458809 - DNA, 20 bp, Homo sapiens
tgggctgaagggaagcccag

SEQ ID NO: 5458810 - DNA, 20 bp, Homo sapiens
tgggctgacatcaagtgtaa

SEQ ID NO: 5458811 - DNA, 15 bp, Homo sapiens
tgggctgaccaggct

SEQ ID NO: 5458812 - DNA, 16 bp, Homo sapiens
tgggctgacccagcat

SEQ ID NO: 5458813 - DNA, 18 bp, Homo sapiens
tgggctgacccagcatct

SEQ ID NO: 5458814 - DNA, 20 bp, Homo sapiens
tgggctgacccagcatctcc

SEQ ID NO: 5458815 - DNA, 18 bp, Homo sapiens
tgggctgagcccctaccc

SEQ ID NO: 5458816 - DNA, 14 bp, Homo sapiens
tgggctgagctagc

SEQ ID NO: 5458817 - DNA, 19 bp, Homo sapiens
tgggctgagtgcagccaaa

SEQ ID NO: 5458818 - DNA, 21 bp, Homo sapiens
tgggctgatggaagatggtcc

SEQ ID NO: 5458819 - DNA, 15 bp, Homo sapiens
tgggctgatttacat

SEQ ID NO: 5458820 - DNA, 19 bp, Homo sapiens
tgggctgatttacatgtat

SEQ ID NO: 5458821 - DNA, 18 bp, Homo sapiens
tgggctgcaaaatgaaga

SEQ ID NO: 5458822 - DNA, 17 bp, Homo sapiens
tgggctgcactctgtgc

SEQ ID NO: 5458823 - DNA, 18 bp, Homo sapiens
tgggctgcactctgtgcc

SEQ ID NO: 5458824 - DNA, 21 bp, Homo sapiens
tgggctgcactctgtgcccat

SEQ ID NO: 5458825 - DNA, 14 bp, Homo sapiens
tgggctgcagaaga

SEQ ID NO: 5458826 - DNA, 11 bp, Homo sapiens
tgggctgcagc

SEQ ID NO: 5458827 - DNA, 16 bp, Homo sapiens
tgggctgcagcagccg

SEQ ID NO: 5458828 - DNA, 16 bp, Homo sapiens
tgggctgccaccagcc

SEQ ID NO: 5458829 - DNA, 16 bp, Homo sapiens
tgggctgccctggtgc

SEQ ID NO: 5458830 - DNA, 21 bp, Homo sapiens
tgggctgccctggtgctgcca

SEQ ID NO: 5458831 - DNA, 16 bp, Homo sapiens
tgggctgcctgctgtg

SEQ ID NO: 5458832 - DNA, 13 bp, Homo sapiens
tgggctgcctggg

SEQ ID NO: 5458833 - DNA, 18 bp, Homo sapiens
tgggctgccttgaaatca

SEQ ID NO: 5458834 - DNA, 17 bp, Homo sapiens
tgggctgcgggaggccc

SEQ ID NO: 5458835 - DNA, 20 bp, Homo sapiens
tgggctgcgggaggccctgg

SEQ ID NO: 5458836 - DNA, 21 bp, Homo sapiens
tgggctgcgggaggccctggc

SEQ ID NO: 5458837 - DNA, 15 bp, Homo sapiens
tgggctgctcctcat

SEQ ID NO: 5458838 - DNA, 15 bp, Homo sapiens
tgggctgctcctgaa

SEQ ID NO: 5458839 - DNA, 18 bp, Homo sapiens
tgggctgctcctgaatga

SEQ ID NO: 5458840 - DNA, 14 bp, Homo sapiens
tgggctgctggggc

SEQ ID NO: 5458841 - DNA, 19 bp, Homo sapiens
tgggctgctggggcagggc

SEQ ID NO: 5458842 - DNA, 22 bp, Homo sapiens
tgggctgctggggcagggccca

SEQ ID NO: 5458843 - DNA, 23 bp, Homo sapiens
tgggctgctggggcagggcccag

SEQ ID NO: 5458844 - DNA, 21 bp, Homo sapiens
tgggctgcttcacatccaccc

SEQ ID NO: 5458845 - DNA, 20 bp, Homo sapiens
tgggctggaacgtgaactca

SEQ ID NO: 5458846 - DNA, 14 bp, Homo sapiens
tgggctggactgga

SEQ ID NO: 5458847 - DNA, 15 bp, Homo sapiens
tgggctggactggcc

SEQ ID NO: 5458848 - DNA, 12 bp, Homo sapiens
tgggctggactt

SEQ ID NO: 5458849 - DNA, 14 bp, Homo sapiens
tgggctggagagtt

SEQ ID NO: 5458850 - DNA, 19 bp, Homo sapiens
tgggctggagtcctctcca

SEQ ID NO: 5458851 - DNA, 16 bp, Homo sapiens
tgggctggataaatat

SEQ ID NO: 5458852 - DNA, 19 bp, Homo sapiens
tgggctggcacagcccctg

SEQ ID NO: 5458853 - DNA, 19 bp, Homo sapiens
tggggctgcgaccgccaga

SEQ ID NO: 5458854 - DNA, 17 bp, Homo sapiens
tggggctgcgcagggct

SEQ ID NO: 5458855 - DNA, 16 bp, Homo sapiens
tggggctgctccccta

SEQ ID NO: 5458856 - DNA, 14 bp, Homo sapiens
tggggctgctcctc

SEQ ID NO: 5458857 - DNA, 17 bp, Homo sapiens
tggggctgctcctccag

SEQ ID NO: 5458858 - DNA, 14 bp, Homo sapiens
tggggctgctgtga

SEQ ID NO: 5458859 - DNA, 17 bp, Homo sapiens
tggggctggaagcagaa

SEQ ID NO: 5458860 - DNA, 15 bp, Homo sapiens
tggggctggcaccag

SEQ ID NO: 5458861 - DNA, 17 bp, Homo sapiens
tggggctggcaccagca

SEQ ID NO: 5458862 - DNA, 18 bp, Homo sapiens
tggggctggcaccagcag

SEQ ID NO: 5458863 - DNA, 13 bp, Homo sapiens
tggggctggcatc

SEQ ID NO: 5458864 - DNA, 13 bp, Homo sapiens
tggggctgggcac

SEQ ID NO: 5458865 - DNA, 15 bp, Homo sapiens
tggggctgggcaccg

SEQ ID NO: 5458866 - DNA, 16 bp, Homo sapiens
tggggctgggcagcta

SEQ ID NO: 5458867 - DNA, 13 bp, Homo sapiens
tggggctgggccc

SEQ ID NO: 5458868 - DNA, 12 bp, Homo sapiens
tggggctggggg

SEQ ID NO: 5458869 - DNA, 18 bp, Homo sapiens
tggggctgggggatgggc

SEQ ID NO: 5458870 - DNA, 13 bp, Homo sapiens
tggggctgggggc

SEQ ID NO: 5458871 - DNA, 14 bp, Homo sapiens
tggggctgggggcc

SEQ ID NO: 5458872 - DNA, 16 bp, Homo sapiens
tggggctggggtcctc

SEQ ID NO: 5458873 - DNA, 19 bp, Homo sapiens
tggggctggtagctcaggt

SEQ ID NO: 5458874 - DNA, 16 bp, Homo sapiens
tggggctggtcctggg

SEQ ID NO: 5458875 - DNA, 15 bp, Homo sapiens
tggggctggtgaggc

SEQ ID NO: 5458876 - DNA, 13 bp, Homo sapiens
tggggctggtgga

SEQ ID NO: 5458877 - DNA, 22 bp, Homo sapiens
tggggctggtgggataggaggg

SEQ ID NO: 5458878 - DNA, 16 bp, Homo sapiens
tggggctggttctgta

SEQ ID NO: 5458879 - DNA, 22 bp, Homo sapiens
tggggctgtatttatctctgag

SEQ ID NO: 5458880 - DNA, 23 bp, Homo sapiens
tggggctgtatttatctctgagg

SEQ ID NO: 5458881 - DNA, 17 bp, Homo sapiens
tggggctgtcctgctgc

SEQ ID NO: 5458882 - DNA, 22 bp, Homo sapiens
tggggctgtcgggggctgtgga

SEQ ID NO: 5458883 - DNA, 16 bp, Homo sapiens
tggggcttatgggtgg

SEQ ID NO: 5458884 - DNA, 15 bp, Homo sapiens
tggggcttcaccagt

SEQ ID NO: 5458885 - DNA, 15 bp, Homo sapiens
tggggcttcctgggc

SEQ ID NO: 5458886 - DNA, 18 bp, Homo sapiens
tggggcttctcctgaaat

SEQ ID NO: 5458887 - DNA, 16 bp, Homo sapiens
tggggcttctctggga

SEQ ID NO: 5458888 - DNA, 21 bp, Homo sapiens
tggggcttctctgggaccagg

SEQ ID NO: 5458889 - DNA, 13 bp, Homo sapiens
tggggcttctgtg

SEQ ID NO: 5458890 - DNA, 20 bp, Homo sapiens
tggggcttgcaagaggaggt

SEQ ID NO: 5458891 - DNA, 13 bp, Homo sapiens
tggggcttgccct

SEQ ID NO: 5458892 - DNA, 18 bp, Homo sapiens
tggggcttgccctgggtc

SEQ ID NO: 5458893 - DNA, 19 bp, Homo sapiens
tggggctttcccaggagaa

SEQ ID NO: 5458894 - DNA, 22 bp, Homo sapiens
tggggctttcgtccacagcttc

SEQ ID NO: 5458895 - DNA, 16 bp, Homo sapiens
tggggctttgccttgc

SEQ ID NO: 5458896 - DNA, 15 bp, Homo sapiens
tgggggaaaaaaagt

SEQ ID NO: 5458897 - DNA, 12 bp, Homo sapiens
tgggggaaaaag

SEQ ID NO: 5458898 - DNA, 22 bp, Homo sapiens
tgggggaaacgggctccttccc

SEQ ID NO: 5458899 - DNA, 20 bp, Homo sapiens
tgggggaaagcaaagcacag

SEQ ID NO: 5458900 - DNA, 21 bp, Homo sapiens
tgggggaaagcaaagcacaga

SEQ ID NO: 5458901 - DNA, 19 bp, Homo sapiens
tgggggaacactgagaaag

SEQ ID NO: 5458902 - DNA, 22 bp, Homo sapiens
tgggggaacactgagaaagagg

SEQ ID NO: 5458903 - DNA, 14 bp, Homo sapiens
tgggggaaccagca

SEQ ID NO: 5458904 - DNA, 20 bp, Homo sapiens
tgggggaactcagatccagg

SEQ ID NO: 5458905 - DNA, 14 bp, Homo sapiens
tgggggaacttgta

SEQ ID NO: 5458906 - DNA, 23 bp, Homo sapiens
tgggggaagactttaaaccacct

SEQ ID NO: 5458907 - DNA, 18 bp, Homo sapiens
tgggggaagagcacagcc

SEQ ID NO: 5458908 - DNA, 15 bp, Homo sapiens
tgggggaagaggaga

SEQ ID NO: 5458909 - DNA, 16 bp, Homo sapiens
tgggggaaggcaggag

SEQ ID NO: 5458910 - DNA, 18 bp, Homo sapiens
tgggggaaggcaggagcc

SEQ ID NO: 5458911 - DNA, 23 bp, Homo sapiens
tgggggaaggcgctgggtgcctg

SEQ ID NO: 5458912 - DNA, 20 bp, Homo sapiens
tgggggaagggcttgaattg

SEQ ID NO: 5458913 - DNA, 20 bp, Homo sapiens
tgggggaaggggaggagggg

SEQ ID NO: 5458914 - DNA, 19 bp, Homo sapiens
tgggggacactgtggcagc

SEQ ID NO: 5458915 - DNA, 21 bp, Homo sapiens
tgggggacactgtggcagcag

SEQ ID NO: 5458916 - DNA, 20 bp, Homo sapiens
tgggggacagaaagagactc

SEQ ID NO: 5458917 - DNA, 14 bp, Homo sapiens
tgggggacagagaa

SEQ ID NO: 5458918 - DNA, 22 bp, Homo sapiens
tgggggacagggctggcccagc

SEQ ID NO: 5458919 - DNA, 20 bp, Homo sapiens
tgggggacccaggtgggact

SEQ ID NO: 5458920 - DNA, 18 bp, Homo sapiens
tgggggaccccttcccac

SEQ ID NO: 5458921 - DNA, 19 bp, Homo sapiens
tgggggacgatcaggagga

SEQ ID NO: 5458922 - DNA, 18 bp, Homo sapiens
tgggggacgcccagcccc

SEQ ID NO: 5458923 - DNA, 17 bp, Homo sapiens
tgggggacgtttctcat

SEQ ID NO: 5458924 - DNA, 23 bp, Homo sapiens
tgggggactgctttcagtgcctg

SEQ ID NO: 5458925 - DNA, 15 bp, Homo sapiens
tgggggactgggagt

SEQ ID NO: 5458926 - DNA, 19 bp, Homo sapiens
tgggggactggggggccat

SEQ ID NO: 5458927 - DNA, 19 bp, Homo sapiens
tgggggagaaaaaatcact

SEQ ID NO: 5458928 - DNA, 22 bp, Homo sapiens
tgggggagaaaaaatcactgtt

SEQ ID NO: 5458929 - DNA, 11 bp, Homo sapiens
tgggggagaga

SEQ ID NO: 5458930 - DNA, 14 bp, Homo sapiens
tgggggagagcagg

SEQ ID NO: 5458931 - DNA, 17 bp, Homo sapiens
tgggggagagcaggctg

SEQ ID NO: 5458932 - DNA, 20 bp, Homo sapiens
tgggggagattctgggtttg

SEQ ID NO: 5458933 - DNA, 16 bp, Homo sapiens
tgggggagcctctgga

SEQ ID NO: 5458934 - DNA, 16 bp, Homo sapiens
tgggggagcctggagc

SEQ ID NO: 5458935 - DNA, 19 bp, Homo sapiens
tgggggagcctggagcccc

SEQ ID NO: 5458936 - DNA, 19 bp, Homo sapiens
tgggggaggagcctctggc

SEQ ID NO: 5458937 - DNA, 14 bp, Homo sapiens
tgggggaggcaggg

SEQ ID NO: 5458938 - DNA, 15 bp, Homo sapiens
tgggggaggcagggc

SEQ ID NO: 5458939 - DNA, 13 bp, Homo sapiens
tgggggaggccca

SEQ ID NO: 5458940 - DNA, 16 bp, Homo sapiens
tgggggagggaagacc

SEQ ID NO: 5458941 - DNA, 21 bp, Homo sapiens
tgggggagggaagaccagaat

SEQ ID NO: 5458942 - DNA, 19 bp, Homo sapiens
tgggggagggactgctgac

SEQ ID NO: 5458943 - DNA, 17 bp, Homo sapiens
tgggggagggaggttcc

SEQ ID NO: 5458944 - DNA, 17 bp, Homo sapiens
tgggggagttttcctct

SEQ ID NO: 5458945 - DNA, 20 bp, Homo sapiens
tgggggatcacagcctctga

SEQ ID NO: 5458946 - DNA, 20 bp, Homo sapiens
tgggggatgactagaggcag

SEQ ID NO: 5458947 - DNA, 16 bp, Homo sapiens
tgggggattcaaatgc

SEQ ID NO: 5458948 - DNA, 18 bp, Homo sapiens
tgggggattcaaatgcat

SEQ ID NO: 5458949 - DNA, 19 bp, Homo sapiens
tgggggcaaaatcagaatg

SEQ ID NO: 5458950 - DNA, 18 bp, Homo sapiens
tgggggcacagctgtctg

SEQ ID NO: 5458951 - DNA, 16 bp, Homo sapiens
tgggggcaccatctgg

SEQ ID NO: 5458952 - DNA, 17 bp, Homo sapiens
tgggggcagagggcaga

SEQ ID NO: 5458953 - DNA, 18 bp, Homo sapiens
tgggggcagcacaggagg

SEQ ID NO: 5458954 - DNA, 17 bp, Homo sapiens
tgggggcagcctgcgtg

SEQ ID NO: 5458955 - DNA, 17 bp, Homo sapiens
tgggggcagtctcccct

SEQ ID NO: 5458956 - DNA, 20 bp, Homo sapiens
tgggggcagtctccccttcc

SEQ ID NO: 5458957 - DNA, 18 bp, Homo sapiens
tgggggcagtgactggca

SEQ ID NO: 5458958 - DNA, 21 bp, Homo sapiens
tgggggcatctcttccccaga

SEQ ID NO: 5458959 - DNA, 19 bp, Homo sapiens
tgggggccaaacctgggac

SEQ ID NO: 5458960 - DNA, 13 bp, Homo sapiens
tgggggccagcac

SEQ ID NO: 5458961 - DNA, 14 bp, Homo sapiens
tgggggccaggcct

SEQ ID NO: 5458962 - DNA, 23 bp, Homo sapiens
tgggggccagggctggatggaca

SEQ ID NO: 5458963 - DNA, 18 bp, Homo sapiens
tgggggccccgtctcagg

SEQ ID NO: 5458964 - DNA, 23 bp, Homo sapiens
tgggggccccgtctcaggtctga

SEQ ID NO: 5458965 - DNA, 15 bp, Homo sapiens
tgggggcccctcagg

SEQ ID NO: 5458966 - DNA, 14 bp, Homo sapiens
tgggggcccctcgg

SEQ ID NO: 5458967 - DNA, 20 bp, Homo sapiens
tgggggcccgacaggtgggc

SEQ ID NO: 5458968 - DNA, 12 bp, Homo sapiens
tgggggccctgg

SEQ ID NO: 5458969 - DNA, 18 bp, Homo sapiens
tgggggccgctggcccag

SEQ ID NO: 5458970 - DNA, 20 bp, Homo sapiens
tgggggccgctggcccaggg

SEQ ID NO: 5458971 - DNA, 21 bp, Homo sapiens
tgggggcctcactccaggaag

SEQ ID NO: 5458972 - DNA, 16 bp, Homo sapiens
tgggggcctcagtgcc

SEQ ID NO: 5458973 - DNA, 13 bp, Homo sapiens
tgggggcctcctc

SEQ ID NO: 5458974 - DNA, 11 bp, Homo sapiens
tgggggcctgg

SEQ ID NO: 5458975 - DNA, 14 bp, Homo sapiens
tgggggcctggatt

SEQ ID NO: 5458976 - DNA, 13 bp, Homo sapiens
tgggggcggccag

SEQ ID NO: 5458977 - DNA, 19 bp, Homo sapiens
tgggggcgggggagccaac

SEQ ID NO: 5458978 - DNA, 21 bp, Homo sapiens
tgggggcggggtgggaaagat

SEQ ID NO: 5458979 - DNA, 15 bp, Homo sapiens
tgggggctaggggag

SEQ ID NO: 5458980 - DNA, 18 bp, Homo sapiens
tgggggctcagcaaggcc

SEQ ID NO: 5458981 - DNA, 22 bp, Homo sapiens
tgggggctccccttgcccttcc

SEQ ID NO: 5458982 - DNA, 19 bp, Homo sapiens
tgggggctcggggaggcag

SEQ ID NO: 5458983 - DNA, 19 bp, Homo sapiens
tgggggctctggccaaggg

SEQ ID NO: 5458984 - DNA, 20 bp, Homo sapiens
tgggggctctggccaagggc

SEQ ID NO: 5458985 - DNA, 23 bp, Homo sapiens
tgggggctctggccaagggccag

SEQ ID NO: 5458986 - DNA, 14 bp, Homo sapiens
tgggggctgcagca

SEQ ID NO: 5458987 - DNA, 16 bp, Homo sapiens
tgggggctgcagggct

SEQ ID NO: 5458988 - DNA, 17 bp, Homo sapiens
tgggggctggaggtgct

SEQ ID NO: 5458989 - DNA, 18 bp, Homo sapiens
tgggggctggaggtgctg

SEQ ID NO: 5458990 - DNA, 17 bp, Homo sapiens
tgggggctggctcccag

SEQ ID NO: 5458991 - DNA, 17 bp, Homo sapiens
tgggggctgggcagagg

SEQ ID NO: 5458992 - DNA, 18 bp, Homo sapiens
tgggggctgggcagagga

SEQ ID NO: 5458993 - DNA, 13 bp, Homo sapiens
tgggggctggtgc

SEQ ID NO: 5458994 - DNA, 15 bp, Homo sapiens
tgggggctggtgcca

SEQ ID NO: 5458995 - DNA, 14 bp, Homo sapiens
tgggggctgtcctg

SEQ ID NO: 5458996 - DNA, 16 bp, Homo sapiens
tgggggctgtcctgct

SEQ ID NO: 5458997 - DNA, 18 bp, Homo sapiens
tgggggctgtcctgctca

SEQ ID NO: 5458998 - DNA, 21 bp, Homo sapiens
tgggggctgtctttgcagggc

SEQ ID NO: 5458999 - DNA, 22 bp, Homo sapiens
tgggggctgtctttgcagggca

SEQ ID NO: 5459000 - DNA, 13 bp, Homo sapiens
tgggggctgtggc

SEQ ID NO: 5459001 - DNA, 16 bp, Homo sapiens
tgggggctgtggccct

SEQ ID NO: 5459002 - DNA, 18 bp, Homo sapiens
tgggggctgtggccctgc

SEQ ID NO: 5459003 - DNA, 19 bp, Homo sapiens
tgggggctgtggccctgcc

SEQ ID NO: 5459004 - DNA, 20 bp, Homo sapiens
tgggggctgtggccctgccc

SEQ ID NO: 5459005 - DNA, 22 bp, Homo sapiens
tgggggctgttagctcagagga

SEQ ID NO: 5459006 - DNA, 23 bp, Homo sapiens
tgggggcttcatctctttagaga

SEQ ID NO: 5459007 - DNA, 23 bp, Homo sapiens
tgggggcttctctgctgagaagg

SEQ ID NO: 5459008 - DNA, 15 bp, Homo sapiens
tgggggcttcttcct

SEQ ID NO: 5459009 - DNA, 19 bp, Homo sapiens
tgggggctttccttttatt

SEQ ID NO: 5459010 - DNA, 20 bp, Homo sapiens
tgggggctttccttttattt

SEQ ID NO: 5459011 - DNA, 12 bp, Homo sapiens
tggggggaaaga

SEQ ID NO: 5459012 - DNA, 20 bp, Homo sapiens
tggggggaaataccttgagc

SEQ ID NO: 5459013 - DNA, 19 bp, Homo sapiens
tggggggaacgcccacttc

SEQ ID NO: 5459014 - DNA, 20 bp, Homo sapiens
tggggggaacgcccacttcc

SEQ ID NO: 5459015 - DNA, 15 bp, Homo sapiens
tggggggacagagac

SEQ ID NO: 5459016 - DNA, 23 bp, Homo sapiens
tggggggacagagactcagatga

SEQ ID NO: 5459017 - DNA, 16 bp, Homo sapiens
tggggggaccaaatag

SEQ ID NO: 5459018 - DNA, 13 bp, Homo sapiens
tggggggagaaac

SEQ ID NO: 5459019 - DNA, 20 bp, Homo sapiens
tggggggagcaccctgaggg

SEQ ID NO: 5459020 - DNA, 21 bp, Homo sapiens
tggggggaggaagcagaggtc

SEQ ID NO: 5459021 - DNA, 11 bp, Homo sapiens
tggggggaggc

SEQ ID NO: 5459022 - DNA, 14 bp, Homo sapiens
tggggggagggcac

SEQ ID NO: 5459023 - DNA, 20 bp, Homo sapiens
tggggggatggtaagagaaa

SEQ ID NO: 5459024 - DNA, 20 bp, Homo sapiens
tggggggcaaggtgggggag

SEQ ID NO: 5459025 - DNA, 18 bp, Homo sapiens
tggggggcacagccagaa

SEQ ID NO: 5459026 - DNA, 20 bp, Homo sapiens
tggggggcactagaagatga

SEQ ID NO: 5459027 - DNA, 16 bp, Homo sapiens
tggggggcaggcctcc

SEQ ID NO: 5459028 - DNA, 13 bp, Homo sapiens
tggggggcagggc

SEQ ID NO: 5459029 - DNA, 11 bp, Homo sapiens
tggggggccaa

SEQ ID NO: 5459030 - DNA, 15 bp, Homo sapiens
tggggggccaacacc

SEQ ID NO: 5459031 - DNA, 15 bp, Homo sapiens
tgggttctggggctg

SEQ ID NO: 5459032 - DNA, 22 bp, Homo sapiens
tgggttctggggctgagagtgg

SEQ ID NO: 5459033 - DNA, 14 bp, Homo sapiens
tgggttcttagctt

SEQ ID NO: 5459034 - DNA, 20 bp, Homo sapiens
tgggttcttcccagctctct

SEQ ID NO: 5459035 - DNA, 18 bp, Homo sapiens
tgggttctttctgggggg

SEQ ID NO: 5459036 - DNA, 17 bp, Homo sapiens
tgggttctttggaagga

SEQ ID NO: 5459037 - DNA, 23 bp, Homo sapiens
tgggttctttggaaggagtgaga

SEQ ID NO: 5459038 - DNA, 21 bp, Homo sapiens
tgggttctttttcttgtcatt

SEQ ID NO: 5459039 - DNA, 22 bp, Homo sapiens
tgggttgaatatagcctgcctc

SEQ ID NO: 5459040 - DNA, 14 bp, Homo sapiens
tgggttgactttca

SEQ ID NO: 5459041 - DNA, 21 bp, Homo sapiens
tgggttgcagacaggaatctt

SEQ ID NO: 5459042 - DNA, 15 bp, Homo sapiens
tgggttgctaactga

SEQ ID NO: 5459043 - DNA, 17 bp, Homo sapiens
tgggttgctaactgaac

SEQ ID NO: 5459044 - DNA, 13 bp, Homo sapiens
tgggttggaggga

SEQ ID NO: 5459045 - DNA, 22 bp, Homo sapiens
tgggttggagggaaccaccagc

SEQ ID NO: 5459046 - DNA, 19 bp, Homo sapiens
tgggttggccaggaggttc

SEQ ID NO: 5459047 - DNA, 23 bp, Homo sapiens
tgggttgggcacggcttatacca

SEQ ID NO: 5459048 - DNA, 18 bp, Homo sapiens
tgggttgggggcactcag

SEQ ID NO: 5459049 - DNA, 21 bp, Homo sapiens
tgggttgggggcactcagcca

SEQ ID NO: 5459050 - DNA, 22 bp, Homo sapiens
tgggttgggggcactcagccac

SEQ ID NO: 5459051 - DNA, 14 bp, Homo sapiens
tgggttgttctgga

SEQ ID NO: 5459052 - DNA, 12 bp, Homo sapiens
tgggttgtttaa

SEQ ID NO: 5459053 - DNA, 16 bp, Homo sapiens
tgggttgtttccagga

SEQ ID NO: 5459054 - DNA, 19 bp, Homo sapiens
tgggttgtttccaggagaa

SEQ ID NO: 5459055 - DNA, 21 bp, Homo sapiens
tgggttgtttccaggagaaag

SEQ ID NO: 5459056 - DNA, 22 bp, Homo sapiens
tgggtttacaacaaacactgtg

SEQ ID NO: 5459057 - DNA, 15 bp, Homo sapiens
tgggtttactctgtg

SEQ ID NO: 5459058 - DNA, 16 bp, Homo sapiens
tgggtttcatatttct

SEQ ID NO: 5459059 - DNA, 18 bp, Homo sapiens
tgggtttccaacaattca

SEQ ID NO: 5459060 - DNA, 15 bp, Homo sapiens
tgggtttcctgcagg

SEQ ID NO: 5459061 - DNA, 18 bp, Homo sapiens
tgggtttctaaagctgcc

SEQ ID NO: 5459062 - DNA, 16 bp, Homo sapiens
tgggtttctagcccat

SEQ ID NO: 5459063 - DNA, 21 bp, Homo sapiens
tgggtttctctgtgctctgaa

SEQ ID NO: 5459064 - DNA, 11 bp, Homo sapiens
tgggtttcttt

SEQ ID NO: 5459065 - DNA, 18 bp, Homo sapiens
tgggtttgaagctgctgt

SEQ ID NO: 5459066 - DNA, 15 bp, Homo sapiens
tgggtttgagacaga

SEQ ID NO: 5459067 - DNA, 15 bp, Homo sapiens
tgggtttgcaagaat

SEQ ID NO: 5459068 - DNA, 19 bp, Homo sapiens
tgggtttgcccagtcctgg

SEQ ID NO: 5459069 - DNA, 20 bp, Homo sapiens
tgggtttgcccagtcctggg

SEQ ID NO: 5459070 - DNA, 14 bp, Homo sapiens
tgggtttggacccc

SEQ ID NO: 5459071 - DNA, 19 bp, Homo sapiens
tgggtttggaccccagctg

SEQ ID NO: 5459072 - DNA, 20 bp, Homo sapiens
tgggtttggaccccagctgg

SEQ ID NO: 5459073 - DNA, 21 bp, Homo sapiens
tgggtttggaccccagctggg

SEQ ID NO: 5459074 - DNA, 15 bp, Homo sapiens
tgggtttggccaggg

SEQ ID NO: 5459075 - DNA, 16 bp, Homo sapiens
tgggtttggccaggga

SEQ ID NO: 5459076 - DNA, 17 bp, Homo sapiens
tgggtttggccagggag

SEQ ID NO: 5459077 - DNA, 15 bp, Homo sapiens
tgggtttggcccctg

SEQ ID NO: 5459078 - DNA, 18 bp, Homo sapiens
tgggtttggggccatggt

SEQ ID NO: 5459079 - DNA, 19 bp, Homo sapiens
tgggtttggggctggcccc

SEQ ID NO: 5459080 - DNA, 17 bp, Homo sapiens
tgggtttgtattttaaa

SEQ ID NO: 5459081 - DNA, 18 bp, Homo sapiens
tgggttttagaaattcta

SEQ ID NO: 5459082 - DNA, 21 bp, Homo sapiens
tgggttttagaaattctataa

SEQ ID NO: 5459083 - DNA, 14 bp, Homo sapiens
tgggttttcttccc

SEQ ID NO: 5459084 - DNA, 24 bp, Homo sapiens
tgggttttcttcccatcactggag

SEQ ID NO: 5459085 - DNA, 21 bp, Homo sapiens
tgggttttgtattctctgagc

SEQ ID NO: 5459086 - DNA, 17 bp, Homo sapiens
tgggttttgtctctgca

SEQ ID NO: 5459087 - DNA, 14 bp, Homo sapiens
tgggtttttaactc

SEQ ID NO: 5459088 - DNA, 19 bp, Homo sapiens
tgggtttttaactcatctt

SEQ ID NO: 5459089 - DNA, 16 bp, Homo sapiens
tgggtttttgctgttt

SEQ ID NO: 5459090 - DNA, 17 bp, Homo sapiens
tgggttttttctgtttt

SEQ ID NO: 5459091 - DNA, 17 bp, Homo sapiens
tgggtttttttccttta

SEQ ID NO: 5459092 - DNA, 14 bp, Homo sapiens
tggtaaaaaagaaa

SEQ ID NO: 5459093 - DNA, 16 bp, Homo sapiens
tggtaaaaaagaaatg

SEQ ID NO: 5459094 - DNA, 20 bp, Homo sapiens
tggtaaaaaagaaatgaaat

SEQ ID NO: 5459095 - DNA, 18 bp, Homo sapiens
tggtaaaaactgcagtgt

SEQ ID NO: 5459096 - DNA, 12 bp, Homo sapiens
tggtaaaaatgc

SEQ ID NO: 5459097 - DNA, 15 bp, Homo sapiens
tggtaaaactcactg

SEQ ID NO: 5459098 - DNA, 20 bp, Homo sapiens
tggtaaaactcactgtgatc

SEQ ID NO: 5459099 - DNA, 14 bp, Homo sapiens
tggtaaaattgcat

SEQ ID NO: 5459100 - DNA, 21 bp, Homo sapiens
tggtaaacattcctccagcct

SEQ ID NO: 5459101 - DNA, 19 bp, Homo sapiens
tggtaaaccaagcctccca

SEQ ID NO: 5459102 - DNA, 16 bp, Homo sapiens
tggtaaagactggctt

SEQ ID NO: 5459103 - DNA, 14 bp, Homo sapiens
tggtaaagagatgt

SEQ ID NO: 5459104 - DNA, 13 bp, Homo sapiens
tggtaaagatatt

SEQ ID NO: 5459105 - DNA, 16 bp, Homo sapiens
tggtaaagcacatggt

SEQ ID NO: 5459106 - DNA, 16 bp, Homo sapiens
tggtaaagtagttgat

SEQ ID NO: 5459107 - DNA, 17 bp, Homo sapiens
tggtaaagtccttttct

SEQ ID NO: 5459108 - DNA, 17 bp, Homo sapiens
tggtaaagtgttaagga

SEQ ID NO: 5459109 - DNA, 17 bp, Homo sapiens
tggtaaagttacacttt

SEQ ID NO: 5459110 - DNA, 15 bp, Homo sapiens
tggtaaataactgtg

SEQ ID NO: 5459111 - DNA, 17 bp, Homo sapiens
tggtaaatactgtgaaa

SEQ ID NO: 5459112 - DNA, 20 bp, Homo sapiens
tggtaaatactgtgaaatac

SEQ ID NO: 5459113 - DNA, 22 bp, Homo sapiens
tggtaaatatgagactattatg

SEQ ID NO: 5459114 - DNA, 19 bp, Homo sapiens
tggtaaatgccacacacct

SEQ ID NO: 5459115 - DNA, 13 bp, Homo sapiens
tggtaaattcaga

SEQ ID NO: 5459116 - DNA, 15 bp, Homo sapiens
tggtaaattcagaca

SEQ ID NO: 5459117 - DNA, 16 bp, Homo sapiens
tggtaaattcagacaa

SEQ ID NO: 5459118 - DNA, 19 bp, Homo sapiens
tggtaaattcagacaacat

SEQ ID NO: 5459119 - DNA, 20 bp, Homo sapiens
tggtaaattcagacaacatt

SEQ ID NO: 5459120 - DNA, 20 bp, Homo sapiens
tggtaaatttccccaacagt

SEQ ID NO: 5459121 - DNA, 23 bp, Homo sapiens
tggtaaatttttgaaaaatattg

SEQ ID NO: 5459122 - DNA, 18 bp, Homo sapiens
tggtaacaatagttctta

SEQ ID NO: 5459123 - DNA, 17 bp, Homo sapiens
tggtaacagtaatacat

SEQ ID NO: 5459124 - DNA, 21 bp, Homo sapiens
tggtaacagttcatgtttgct

SEQ ID NO: 5459125 - DNA, 13 bp, Homo sapiens
tggtaacataaca

SEQ ID NO: 5459126 - DNA, 21 bp, Homo sapiens
tggtaacattttgacaactga

SEQ ID NO: 5459127 - DNA, 22 bp, Homo sapiens
tggtaaccaaatattaaagatt

SEQ ID NO: 5459128 - DNA, 17 bp, Homo sapiens
tggtaacgaatttaaaa

SEQ ID NO: 5459129 - DNA, 19 bp, Homo sapiens
tggtaacgaatttaaaatg

SEQ ID NO: 5459130 - DNA, 22 bp, Homo sapiens
tggtaacgaatttaaaatgtag

SEQ ID NO: 5459131 - DNA, 22 bp, Homo sapiens
tggtaactgattacctgccaat

SEQ ID NO: 5459132 - DNA, 19 bp, Homo sapiens
tggtaactgcacctgggca

SEQ ID NO: 5459133 - DNA, 16 bp, Homo sapiens
tggtaactgccagcct

SEQ ID NO: 5459134 - DNA, 22 bp, Homo sapiens
tggtaactgctttctgttccaa

SEQ ID NO: 5459135 - DNA, 20 bp, Homo sapiens
tggtaactgctttggtctct

SEQ ID NO: 5459136 - DNA, 20 bp, Homo sapiens
tggtaacttctttgaagtta

SEQ ID NO: 5459137 - DNA, 16 bp, Homo sapiens
tggtaacttgctgtga

SEQ ID NO: 5459138 - DNA, 24 bp, Homo sapiens
tggtaacttttgtagtcttatgaa

SEQ ID NO: 5459139 - DNA, 22 bp, Homo sapiens
tggtaagaaaaagcaaaaggca

SEQ ID NO: 5459140 - DNA, 16 bp, Homo sapiens
tggtaagactgctggt

SEQ ID NO: 5459141 - DNA, 22 bp, Homo sapiens
tggtaagagacagaatgtatct

SEQ ID NO: 5459142 - DNA, 18 bp, Homo sapiens
tggtaagatgactctgag

SEQ ID NO: 5459143 - DNA, 18 bp, Homo sapiens
tggtaagattgttattaa

SEQ ID NO: 5459144 - DNA, 16 bp, Homo sapiens
tggtaagcagaggctt

SEQ ID NO: 5459145 - DNA, 20 bp, Homo sapiens
tggtaagcgatttgaaacac

SEQ ID NO: 5459146 - DNA, 13 bp, Homo sapiens
tggtaagcttcca

SEQ ID NO: 5459147 - DNA, 20 bp, Homo sapiens
tggtaagggaagtttagatg

SEQ ID NO: 5459148 - DNA, 22 bp, Homo sapiens
tggtaagggggtccctgtgctg

SEQ ID NO: 5459149 - DNA, 16 bp, Homo sapiens
tggtaagtggcttttt

SEQ ID NO: 5459150 - DNA, 21 bp, Homo sapiens
tggtaataagggaaaaatcaa

SEQ ID NO: 5459151 - DNA, 13 bp, Homo sapiens
tggtaatatatat

SEQ ID NO: 5459152 - DNA, 14 bp, Homo sapiens
tggtaatatatata

SEQ ID NO: 5459153 - DNA, 14 bp, Homo sapiens
tggtaatattgact

SEQ ID NO: 5459154 - DNA, 18 bp, Homo sapiens
tggtaatcagttttgtat

SEQ ID NO: 5459155 - DNA, 16 bp, Homo sapiens
tggtaatcatatgtgt

SEQ ID NO: 5459156 - DNA, 14 bp, Homo sapiens
tggtaatcatatta

SEQ ID NO: 5459157 - DNA, 21 bp, Homo sapiens
tggtaatctacaccaatgaaa

SEQ ID NO: 5459158 - DNA, 23 bp, Homo sapiens
tggtaatctacaccaatgaaaac

SEQ ID NO: 5459159 - DNA, 23 bp, Homo sapiens
tggtaatctttacctgtatacag

SEQ ID NO: 5459160 - DNA, 15 bp, Homo sapiens
tggtaatgacagatg

SEQ ID NO: 5459161 - DNA, 20 bp, Homo sapiens
tggtaatgacagatgcaagt

SEQ ID NO: 5459162 - DNA, 19 bp, Homo sapiens
tggtaatgatgttgataat

SEQ ID NO: 5459163 - DNA, 21 bp, Homo sapiens
tggtaatgatgttgataattt

SEQ ID NO: 5459164 - DNA, 19 bp, Homo sapiens
tggtaatgtgtcaaagaga

SEQ ID NO: 5459165 - DNA, 17 bp, Homo sapiens
tggtaatgtgttttaga

SEQ ID NO: 5459166 - DNA, 14 bp, Homo sapiens
tggtaatgttagca

SEQ ID NO: 5459167 - DNA, 22 bp, Homo sapiens
tggtaattattttggtactttt

SEQ ID NO: 5459168 - DNA, 15 bp, Homo sapiens
tggtaattcctctcc

SEQ ID NO: 5459169 - DNA, 18 bp, Homo sapiens
tggtaattcctctccagg

SEQ ID NO: 5459170 - DNA, 13 bp, Homo sapiens
tggtaattgtaca

SEQ ID NO: 5459171 - DNA, 13 bp, Homo sapiens
tggtaattgttgc

SEQ ID NO: 5459172 - DNA, 22 bp, Homo sapiens
tggtaatttaagattccagaga

SEQ ID NO: 5459173 - DNA, 23 bp, Homo sapiens
tggtaatttatagtttatacagt

SEQ ID NO: 5459174 - DNA, 19 bp, Homo sapiens
tggtaatttctactttgat

SEQ ID NO: 5459175 - DNA, 21 bp, Homo sapiens
tggtaatttgtatctgaagga

SEQ ID NO: 5459176 - DNA, 13 bp, Homo sapiens
tggtacaaatgtg

SEQ ID NO: 5459177 - DNA, 16 bp, Homo sapiens
tggtacaacggaggcc

SEQ ID NO: 5459178 - DNA, 19 bp, Homo sapiens
tggtacaatcgacatccta

SEQ ID NO: 5459179 - DNA, 16 bp, Homo sapiens
tggtacacaatgtgat

SEQ ID NO: 5459180 - DNA, 17 bp, Homo sapiens
tggtacacacttgacct

SEQ ID NO: 5459181 - DNA, 19 bp, Homo sapiens
tggtacacacttgaccttc

SEQ ID NO: 5459182 - DNA, 20 bp, Homo sapiens
tggtacacatgtgttatcta

SEQ ID NO: 5459183 - DNA, 22 bp, Homo sapiens
tggtacacatgtgttatctacc

SEQ ID NO: 5459184 - DNA, 20 bp, Homo sapiens
tggtacagagaagccagctt

SEQ ID NO: 5459185 - DNA, 21 bp, Homo sapiens
tggtacagagaagccagcttg

SEQ ID NO: 5459186 - DNA, 14 bp, Homo sapiens
tggtacagcagggt

SEQ ID NO: 5459187 - DNA, 20 bp, Homo sapiens
tggtacagcttctggagcag

SEQ ID NO: 5459188 - DNA, 23 bp, Homo sapiens
tggtacagttcataattcaccaa

SEQ ID NO: 5459189 - DNA, 17 bp, Homo sapiens
tggtacagttgcaggag

SEQ ID NO: 5459190 - DNA, 18 bp, Homo sapiens
tggtacagttgcaggagc

SEQ ID NO: 5459191 - DNA, 17 bp, Homo sapiens
tggtacatacacaccag

SEQ ID NO: 5459192 - DNA, 23 bp, Homo sapiens
tggtacataggcttctattacct

SEQ ID NO: 5459193 - DNA, 16 bp, Homo sapiens
tggtacattcacagca

SEQ ID NO: 5459194 - DNA, 13 bp, Homo sapiens
tggtaccagagcc

SEQ ID NO: 5459195 - DNA, 14 bp, Homo sapiens
tggtaccagataaa

SEQ ID NO: 5459196 - DNA, 14 bp, Homo sapiens
tggtaccagataac

SEQ ID NO: 5459197 - DNA, 14 bp, Homo sapiens
tggtaccagccctg

SEQ ID NO: 5459198 - DNA, 15 bp, Homo sapiens
tggtaccagccctgg

SEQ ID NO: 5459199 - DNA, 16 bp, Homo sapiens
tggtaccagccctggg

SEQ ID NO: 5459200 - DNA, 18 bp, Homo sapiens
tggtaccagccctggggc

SEQ ID NO: 5459201 - DNA, 19 bp, Homo sapiens
tggtaccagccctggggct

SEQ ID NO: 5459202 - DNA, 14 bp, Homo sapiens
tggtaccagctcac

SEQ ID NO: 5459203 - DNA, 22 bp, Homo sapiens
tggtacccaggctttagcatta

SEQ ID NO: 5459204 - DNA, 20 bp, Homo sapiens
tggtacccgcccttccgagc

SEQ ID NO: 5459205 - DNA, 16 bp, Homo sapiens
tggtaccctcctggct

SEQ ID NO: 5459206 - DNA, 16 bp, Homo sapiens
tggtacctctgtctat

SEQ ID NO: 5459207 - DNA, 20 bp, Homo sapiens
tggtgacccctgctttgccc

SEQ ID NO: 5459208 - DNA, 22 bp, Homo sapiens
tggtgaccccttttcagcttct

SEQ ID NO: 5459209 - DNA, 22 bp, Homo sapiens
tggtgacctcctgtcactcact

SEQ ID NO: 5459210 - DNA, 16 bp, Homo sapiens
tggtgacctctgcctg

SEQ ID NO: 5459211 - DNA, 15 bp, Homo sapiens
tggtgacctgggtat

SEQ ID NO: 5459212 - DNA, 21 bp, Homo sapiens
tggtgaccttccaagagcctg

SEQ ID NO: 5459213 - DNA, 14 bp, Homo sapiens
tggtgacgccccgg

SEQ ID NO: 5459214 - DNA, 15 bp, Homo sapiens
tggtgactcacttca

SEQ ID NO: 5459215 - DNA, 13 bp, Homo sapiens
tggtgactcctga

SEQ ID NO: 5459216 - DNA, 23 bp, Homo sapiens
tggtgactcgggggctgtctcag

SEQ ID NO: 5459217 - DNA, 14 bp, Homo sapiens
tggtgactgaacga

SEQ ID NO: 5459218 - DNA, 15 bp, Homo sapiens
tggtgactgattctt

SEQ ID NO: 5459219 - DNA, 19 bp, Homo sapiens
tggtgactgattcttcagc

SEQ ID NO: 5459220 - DNA, 17 bp, Homo sapiens
tggtgactgggaaagtt

SEQ ID NO: 5459221 - DNA, 13 bp, Homo sapiens
tggtgactgtccc

SEQ ID NO: 5459222 - DNA, 12 bp, Homo sapiens
tggtgacttcct

SEQ ID NO: 5459223 - DNA, 23 bp, Homo sapiens
tggtgacttcctcgcctctccca

SEQ ID NO: 5459224 - DNA, 13 bp, Homo sapiens
tggtgacttctgc

SEQ ID NO: 5459225 - DNA, 19 bp, Homo sapiens
tggtgactttcctctttgg

SEQ ID NO: 5459226 - DNA, 18 bp, Homo sapiens
tggtgactttggggacag

SEQ ID NO: 5459227 - DNA, 11 bp, Homo sapiens
tggtgagaaaa

SEQ ID NO: 5459228 - DNA, 22 bp, Homo sapiens
tggtgagaaatttctgtgaaac

SEQ ID NO: 5459229 - DNA, 23 bp, Homo sapiens
tggtgagagcccaagttatcttt

SEQ ID NO: 5459230 - DNA, 16 bp, Homo sapiens
tggtgagagtcaaagc

SEQ ID NO: 5459231 - DNA, 17 bp, Homo sapiens
tggtgagagtcaaagct

SEQ ID NO: 5459232 - DNA, 18 bp, Homo sapiens
tggtgagagtcaaagctg

SEQ ID NO: 5459233 - DNA, 19 bp, Homo sapiens
tggtgagagtcaaagctga

SEQ ID NO: 5459234 - DNA, 21 bp, Homo sapiens
tggtgagcaagcaccaacctc

SEQ ID NO: 5459235 - DNA, 23 bp, Homo sapiens
tggtgagcacatctgggaggctg

SEQ ID NO: 5459236 - DNA, 18 bp, Homo sapiens
tggtgagcattacaggca

SEQ ID NO: 5459237 - DNA, 20 bp, Homo sapiens
tggtgagcctagccctggga

SEQ ID NO: 5459238 - DNA, 15 bp, Homo sapiens
tggtgagctgggaag

SEQ ID NO: 5459239 - DNA, 12 bp, Homo sapiens
tggtgaggaagc

SEQ ID NO: 5459240 - DNA, 14 bp, Homo sapiens
tggtgaggaagctc

SEQ ID NO: 5459241 - DNA, 21 bp, Homo sapiens
tggtgaggctgacatgctcac

SEQ ID NO: 5459242 - DNA, 14 bp, Homo sapiens
tggtgagggcaaga

SEQ ID NO: 5459243 - DNA, 18 bp, Homo sapiens
tggtgagggcagttctgc

SEQ ID NO: 5459244 - DNA, 18 bp, Homo sapiens
tggtgaggggccactggg

SEQ ID NO: 5459245 - DNA, 15 bp, Homo sapiens
tggtgaggggctttc

SEQ ID NO: 5459246 - DNA, 19 bp, Homo sapiens
tggtgaggggctttctctt

SEQ ID NO: 5459247 - DNA, 13 bp, Homo sapiens
tggtgaggtggcc

SEQ ID NO: 5459248 - DNA, 16 bp, Homo sapiens
tggtgaggtggcccag

SEQ ID NO: 5459249 - DNA, 21 bp, Homo sapiens
tggtgaggtggcccaggcccc

SEQ ID NO: 5459250 - DNA, 16 bp, Homo sapiens
tggtgagtaacttaga

SEQ ID NO: 5459251 - DNA, 20 bp, Homo sapiens
tggtgagtcttggcggcagc

SEQ ID NO: 5459252 - DNA, 17 bp, Homo sapiens
tggtgagttgtgccttt

SEQ ID NO: 5459253 - DNA, 18 bp, Homo sapiens
tggtgatactgagattgt

SEQ ID NO: 5459254 - DNA, 19 bp, Homo sapiens
tggtgatcgcacaaggaca

SEQ ID NO: 5459255 - DNA, 16 bp, Homo sapiens
tggtgatggaaaaagc

SEQ ID NO: 5459256 - DNA, 14 bp, Homo sapiens
tggtgatgtgcctg

SEQ ID NO: 5459257 - DNA, 17 bp, Homo sapiens
tggtgattctccaggcc

SEQ ID NO: 5459258 - DNA, 16 bp, Homo sapiens
tggtgatttcttgcta

SEQ ID NO: 5459259 - DNA, 20 bp, Homo sapiens
tggtgcaaggccatctgctt

SEQ ID NO: 5459260 - DNA, 16 bp, Homo sapiens
tggtgcaagttgagga

SEQ ID NO: 5459261 - DNA, 22 bp, Homo sapiens
tggtgcaagttgaggacttctt

SEQ ID NO: 5459262 - DNA, 23 bp, Homo sapiens
tggtgcaagttgaggacttcttg

SEQ ID NO: 5459263 - DNA, 17 bp, Homo sapiens
tggtgcaatcacagctc

SEQ ID NO: 5459264 - DNA, 21 bp, Homo sapiens
tggtgcaatgacctttcaata

SEQ ID NO: 5459265 - DNA, 22 bp, Homo sapiens
tggtgcaatgtgtgtatatgga

SEQ ID NO: 5459266 - DNA, 21 bp, Homo sapiens
tggtgcaattacagcaaaaag

SEQ ID NO: 5459267 - DNA, 22 bp, Homo sapiens
tggtgcacaggtttgttttttc

SEQ ID NO: 5459268 - DNA, 18 bp, Homo sapiens
tggtgcagagaagctgga

SEQ ID NO: 5459269 - DNA, 23 bp, Homo sapiens
tggtgcagagaagctggacttct

SEQ ID NO: 5459270 - DNA, 20 bp, Homo sapiens
tggtgcagaggtgagcagag

SEQ ID NO: 5459271 - DNA, 23 bp, Homo sapiens
tggtgcagaggtgagcagaggag

SEQ ID NO: 5459272 - DNA, 17 bp, Homo sapiens
tggtgcagccccaggac

SEQ ID NO: 5459273 - DNA, 18 bp, Homo sapiens
tggtgcaggatggctttg

SEQ ID NO: 5459274 - DNA, 23 bp, Homo sapiens
tggtgcagggagacatctgcacc

SEQ ID NO: 5459275 - DNA, 12 bp, Homo sapiens
tggtgcagtgaa

SEQ ID NO: 5459276 - DNA, 18 bp, Homo sapiens
tggtgcagtgtgtgaaaa

SEQ ID NO: 5459277 - DNA, 15 bp, Homo sapiens
tggtgcatagaactg

SEQ ID NO: 5459278 - DNA, 15 bp, Homo sapiens
tggtgcatgcactgt

SEQ ID NO: 5459279 - DNA, 18 bp, Homo sapiens
tggtgcatgcactgtctc

SEQ ID NO: 5459280 - DNA, 14 bp, Homo sapiens
tggtgcatgggctc

SEQ ID NO: 5459281 - DNA, 14 bp, Homo sapiens
tggtgcattcctga

SEQ ID NO: 5459282 - DNA, 20 bp, Homo sapiens
tggtgcattctgtttcctct

SEQ ID NO: 5459283 - DNA, 22 bp, Homo sapiens
tggtgcattctgtttcctcttg

SEQ ID NO: 5459284 - DNA, 18 bp, Homo sapiens
tggtgcatttaaaatgga

SEQ ID NO: 5459285 - DNA, 20 bp, Homo sapiens
tggtgccaaaaccaggcctc

SEQ ID NO: 5459286 - DNA, 21 bp, Homo sapiens
tggtgccaaaaccaggcctct

SEQ ID NO: 5459287 - DNA, 21 bp, Homo sapiens
tggtgccaaatagccccagac

SEQ ID NO: 5459288 - DNA, 21 bp, Homo sapiens
tggtgccaaatgaagattttt

SEQ ID NO: 5459289 - DNA, 22 bp, Homo sapiens
tggtgccaatggaacctccttt

SEQ ID NO: 5459290 - DNA, 17 bp, Homo sapiens
tggtgccacaaataaaa

SEQ ID NO: 5459291 - DNA, 13 bp, Homo sapiens
tggtgccagcctt

SEQ ID NO: 5459292 - DNA, 14 bp, Homo sapiens
tggtgccagccttc

SEQ ID NO: 5459293 - DNA, 21 bp, Homo sapiens
tggtgccagccttcctctgca

SEQ ID NO: 5459294 - DNA, 14 bp, Homo sapiens
tggtgccatcccca

SEQ ID NO: 5459295 - DNA, 20 bp, Homo sapiens
tggtgccatttctgaactgt

SEQ ID NO: 5459296 - DNA, 21 bp, Homo sapiens
tggtgccatttctgaactgtt

SEQ ID NO: 5459297 - DNA, 22 bp, Homo sapiens
tggtgccatttctgaactgtta

SEQ ID NO: 5459298 - DNA, 21 bp, Homo sapiens
tggtgcccaccagctggctct

SEQ ID NO: 5459299 - DNA, 17 bp, Homo sapiens
tggtgcccacccttcgc

SEQ ID NO: 5459300 - DNA, 13 bp, Homo sapiens
tggtgccccagga

SEQ ID NO: 5459301 - DNA, 17 bp, Homo sapiens
tggtgccccaggaccag

SEQ ID NO: 5459302 - DNA, 20 bp, Homo sapiens
tggtgccccaggaccagctc

SEQ ID NO: 5459303 - DNA, 23 bp, Homo sapiens
tggtgccccaggaccagctcagg

SEQ ID NO: 5459304 - DNA, 12 bp, Homo sapiens
tggtgcccccag

SEQ ID NO: 5459305 - DNA, 16 bp, Homo sapiens
tggtgccccccacccc

SEQ ID NO: 5459306 - DNA, 14 bp, Homo sapiens
tggtgccctgcttt

SEQ ID NO: 5459307 - DNA, 18 bp, Homo sapiens
tggtgccctggaacactc

SEQ ID NO: 5459308 - DNA, 12 bp, Homo sapiens
tggtgccctggc

SEQ ID NO: 5459309 - DNA, 14 bp, Homo sapiens
tggtgccctggccc

SEQ ID NO: 5459310 - DNA, 22 bp, Homo sapiens
tggtgccctggtggcctgcccc

SEQ ID NO: 5459311 - DNA, 23 bp, Homo sapiens
tggtgccctggtggcctgcccca

SEQ ID NO: 5459312 - DNA, 20 bp, Homo sapiens
tggtgcccttccctggaggt

SEQ ID NO: 5459313 - DNA, 15 bp, Homo sapiens
tggtgcctagtattg

SEQ ID NO: 5459314 - DNA, 24 bp, Homo sapiens
tggtgcctagtattgacaaaatgt

SEQ ID NO: 5459315 - DNA, 18 bp, Homo sapiens
tggtgcctatatctgaga

SEQ ID NO: 5459316 - DNA, 19 bp, Homo sapiens
tggtgcctatatctgagag

SEQ ID NO: 5459317 - DNA, 22 bp, Homo sapiens
tggtgcctatctgcctggaggc

SEQ ID NO: 5459318 - DNA, 13 bp, Homo sapiens
tggtgcctccaga

SEQ ID NO: 5459319 - DNA, 13 bp, Homo sapiens
tggtgcctctgtg

SEQ ID NO: 5459320 - DNA, 17 bp, Homo sapiens
tggtgcctgaagacccc

SEQ ID NO: 5459321 - DNA, 15 bp, Homo sapiens
tggtgcctgagaggc

SEQ ID NO: 5459322 - DNA, 20 bp, Homo sapiens
tggtgcctgagaggcaggca

SEQ ID NO: 5459323 - DNA, 14 bp, Homo sapiens
tggtgcctgcaggc

SEQ ID NO: 5459324 - DNA, 18 bp, Homo sapiens
tggtgcctgcctctgcca

SEQ ID NO: 5459325 - DNA, 23 bp, Homo sapiens
tggtgcctgctttgacgggccag

SEQ ID NO: 5459326 - DNA, 14 bp, Homo sapiens
tggtgcctggcctg

SEQ ID NO: 5459327 - DNA, 17 bp, Homo sapiens
tggtgcctggcctggca

SEQ ID NO: 5459328 - DNA, 19 bp, Homo sapiens
tggtgcctggcctggcaca

SEQ ID NO: 5459329 - DNA, 15 bp, Homo sapiens
tggtgcctttcctgt

SEQ ID NO: 5459330 - DNA, 17 bp, Homo sapiens
tggtgcgatctgggttc

SEQ ID NO: 5459331 - DNA, 15 bp, Homo sapiens
tggtgcgctgtgctc

SEQ ID NO: 5459332 - DNA, 13 bp, Homo sapiens
tggtgcgggccag

SEQ ID NO: 5459333 - DNA, 23 bp, Homo sapiens
tggtgcgggccaggtctggcgcc

SEQ ID NO: 5459334 - DNA, 13 bp, Homo sapiens
tggtgcgggcctg

SEQ ID NO: 5459335 - DNA, 20 bp, Homo sapiens
tggtgcgggcctggccctca

SEQ ID NO: 5459336 - DNA, 18 bp, Homo sapiens
tggtgctaaagattgtta

SEQ ID NO: 5459337 - DNA, 18 bp, Homo sapiens
tggtgctaaaggaggcca

SEQ ID NO: 5459338 - DNA, 22 bp, Homo sapiens
tggtgctaactgtatgtgtctt

SEQ ID NO: 5459339 - DNA, 22 bp, Homo sapiens
tggtgctaatattttatttgaa

SEQ ID NO: 5459340 - DNA, 13 bp, Homo sapiens
tggtgctataaca

SEQ ID NO: 5459341 - DNA, 22 bp, Homo sapiens
tggtgctataggctggagaagc

SEQ ID NO: 5459342 - DNA, 14 bp, Homo sapiens
tggtgctatttgaa

SEQ ID NO: 5459343 - DNA, 14 bp, Homo sapiens
tggtgctcagttgt

SEQ ID NO: 5459344 - DNA, 15 bp, Homo sapiens
tggtgctcagttgta

SEQ ID NO: 5459345 - DNA, 21 bp, Homo sapiens
tggtgctcagttgtagaatgt

SEQ ID NO: 5459346 - DNA, 18 bp, Homo sapiens
tggtgctcatttaaatat

SEQ ID NO: 5459347 - DNA, 21 bp, Homo sapiens
tggtgctcgggaagggagggg

SEQ ID NO: 5459348 - DNA, 14 bp, Homo sapiens
tggtgctcttgctt

SEQ ID NO: 5459349 - DNA, 16 bp, Homo sapiens
tggtgctcttttttct

SEQ ID NO: 5459350 - DNA, 23 bp, Homo sapiens
tggtgctgagtagatgcgcagcc

SEQ ID NO: 5459351 - DNA, 16 bp, Homo sapiens
tggtgctgagtgctat

SEQ ID NO: 5459352 - DNA, 13 bp, Homo sapiens
tggtgctgatgga

SEQ ID NO: 5459353 - DNA, 12 bp, Homo sapiens
tggtgctgcacc

SEQ ID NO: 5459354 - DNA, 21 bp, Homo sapiens
tggtgctgcacccctggtgtc

SEQ ID NO: 5459355 - DNA, 15 bp, Homo sapiens
tggtgctgcagattt

SEQ ID NO: 5459356 - DNA, 20 bp, Homo sapiens
tggtgctgcattgagtccag

SEQ ID NO: 5459357 - DNA, 13 bp, Homo sapiens
tggtgctgccaca

SEQ ID NO: 5459358 - DNA, 17 bp, Homo sapiens
tggtgctgccgagggct

SEQ ID NO: 5459359 - DNA, 21 bp, Homo sapiens
tggtgctggatattttcaaat

SEQ ID NO: 5459360 - DNA, 13 bp, Homo sapiens
tggtgctgggaac

SEQ ID NO: 5459361 - DNA, 14 bp, Homo sapiens
tggtgctgggactg

SEQ ID NO: 5459362 - DNA, 15 bp, Homo sapiens
tggtgctgggactga

SEQ ID NO: 5459363 - DNA, 16 bp, Homo sapiens
tggtgctgggactgag

SEQ ID NO: 5459364 - DNA, 13 bp, Homo sapiens
tggtgctgggaga

SEQ ID NO: 5459365 - DNA, 17 bp, Homo sapiens
tggtgctgtggccaggg

SEQ ID NO: 5459366 - DNA, 20 bp, Homo sapiens
tggtgctgtggccagggtga

SEQ ID NO: 5459367 - DNA, 19 bp, Homo sapiens
tggtgcttaagttccagca

SEQ ID NO: 5459368 - DNA, 22 bp, Homo sapiens
tggtgcttacacatctcagacc

SEQ ID NO: 5459369 - DNA, 16 bp, Homo sapiens
tggtgcttattaagac

SEQ ID NO: 5459370 - DNA, 20 bp, Homo sapiens
tggtgcttcagccctggccc

SEQ ID NO: 5459371 - DNA, 13 bp, Homo sapiens
tggtgcttccccc

SEQ ID NO: 5459372 - DNA, 16 bp, Homo sapiens
tggtgcttggcaggaa

SEQ ID NO: 5459373 - DNA, 11 bp, Homo sapiens
tggtgctttcc

SEQ ID NO: 5459374 - DNA, 16 bp, Homo sapiens
tggtgcttttatagtt

SEQ ID NO: 5459375 - DNA, 21 bp, Homo sapiens
tggtggaagaggttctcagca

SEQ ID NO: 5459376 - DNA, 21 bp, Homo sapiens
tggtggagaggcccggcctct

SEQ ID NO: 5459377 - DNA, 17 bp, Homo sapiens
tggtggagcagccagag

SEQ ID NO: 5459378 - DNA, 18 bp, Homo sapiens
tggtggagcagccagagc

SEQ ID NO: 5459379 - DNA, 14 bp, Homo sapiens
tggtggagccaggg

SEQ ID NO: 5459380 - DNA, 22 bp, Homo sapiens
tggtggaggaaacttccaactt

SEQ ID NO: 5459381 - DNA, 21 bp, Homo sapiens
tggtggaggaagggctgggcc

SEQ ID NO: 5459382 - DNA, 22 bp, Homo sapiens
tggtggaggaagggctgggcca

SEQ ID NO: 5459383 - DNA, 23 bp, Homo sapiens
tggtggaggaagggctgggccac

SEQ ID NO: 5459384 - DNA, 21 bp, Homo sapiens
tggtttggtcagttacaaagt

SEQ ID NO: 5459385 - DNA, 20 bp, Homo sapiens
tggtttggtggccaggctgg

SEQ ID NO: 5459386 - DNA, 17 bp, Homo sapiens
tggtttggttcctctct

SEQ ID NO: 5459387 - DNA, 15 bp, Homo sapiens
tggtttggttttgga

SEQ ID NO: 5459388 - DNA, 16 bp, Homo sapiens
tggtttggtttttgtt

SEQ ID NO: 5459389 - DNA, 21 bp, Homo sapiens
tggtttgtaaattaactttta

SEQ ID NO: 5459390 - DNA, 13 bp, Homo sapiens
tggtttgtatgag

SEQ ID NO: 5459391 - DNA, 20 bp, Homo sapiens
tggtttgtatgagatggtta

SEQ ID NO: 5459392 - DNA, 22 bp, Homo sapiens
tggtttgtgagccttgctgcca

SEQ ID NO: 5459393 - DNA, 21 bp, Homo sapiens
tggtttgtggcgtctccctcg

SEQ ID NO: 5459394 - DNA, 13 bp, Homo sapiens
tggtttgttctga

SEQ ID NO: 5459395 - DNA, 18 bp, Homo sapiens
tggttttaacaatttcct

SEQ ID NO: 5459396 - DNA, 22 bp, Homo sapiens
tggttttaagtggaactgccct

SEQ ID NO: 5459397 - DNA, 15 bp, Homo sapiens
tggttttacacagga

SEQ ID NO: 5459398 - DNA, 12 bp, Homo sapiens
tggttttacatt

SEQ ID NO: 5459399 - DNA, 11 bp, Homo sapiens
tggttttacta

SEQ ID NO: 5459400 - DNA, 19 bp, Homo sapiens
tggttttaggatacttaac

SEQ ID NO: 5459401 - DNA, 20 bp, Homo sapiens
tggttttcaacctctagaat

SEQ ID NO: 5459402 - DNA, 21 bp, Homo sapiens
tggttttcccctccctgggtt

SEQ ID NO: 5459403 - DNA, 16 bp, Homo sapiens
tggttttcctaaatgc

SEQ ID NO: 5459404 - DNA, 13 bp, Homo sapiens
tggttttcctgta

SEQ ID NO: 5459405 - DNA, 21 bp, Homo sapiens
tggttttcgtcatcttccctg

SEQ ID NO: 5459406 - DNA, 22 bp, Homo sapiens
tggttttcgtcatcttccctgc

SEQ ID NO: 5459407 - DNA, 17 bp, Homo sapiens
tggttttctactgttat

SEQ ID NO: 5459408 - DNA, 20 bp, Homo sapiens
tggttttctccttcccaagg

SEQ ID NO: 5459409 - DNA, 18 bp, Homo sapiens
tggttttctgccaatgac

SEQ ID NO: 5459410 - DNA, 12 bp, Homo sapiens
tggttttctgtt

SEQ ID NO: 5459411 - DNA, 13 bp, Homo sapiens
tggttttctgttt

SEQ ID NO: 5459412 - DNA, 22 bp, Homo sapiens
tggttttcttgggggaaaatac

SEQ ID NO: 5459413 - DNA, 12 bp, Homo sapiens
tggttttcttgt

SEQ ID NO: 5459414 - DNA, 17 bp, Homo sapiens
tggttttgaatattaag

SEQ ID NO: 5459415 - DNA, 13 bp, Homo sapiens
tggttttgagaaa

SEQ ID NO: 5459416 - DNA, 17 bp, Homo sapiens
tggttttggctctccca

SEQ ID NO: 5459417 - DNA, 19 bp, Homo sapiens
tggttttgtaagatgctgg

SEQ ID NO: 5459418 - DNA, 21 bp, Homo sapiens
tggttttgtacactgctgtac

SEQ ID NO: 5459419 - DNA, 18 bp, Homo sapiens
tggttttgtgccatctgt

SEQ ID NO: 5459420 - DNA, 14 bp, Homo sapiens
tggttttgtgcttt

SEQ ID NO: 5459421 - DNA, 14 bp, Homo sapiens
tggttttgttttgc

SEQ ID NO: 5459422 - DNA, 15 bp, Homo sapiens
tggtttttaaatttt

SEQ ID NO: 5459423 - DNA, 16 bp, Homo sapiens
tggtttttacttaact

SEQ ID NO: 5459424 - DNA, 19 bp, Homo sapiens
tggtttttagtgcacttaa

SEQ ID NO: 5459425 - DNA, 15 bp, Homo sapiens
tggtttttatttcac

SEQ ID NO: 5459426 - DNA, 19 bp, Homo sapiens
tggtttttatttctccttt

SEQ ID NO: 5459427 - DNA, 16 bp, Homo sapiens
tggtttttcagctccc

SEQ ID NO: 5459428 - DNA, 12 bp, Homo sapiens
tggtttttccaa

SEQ ID NO: 5459429 - DNA, 13 bp, Homo sapiens
tggtttttcccac

SEQ ID NO: 5459430 - DNA, 14 bp, Homo sapiens
tggtttttcctcat

SEQ ID NO: 5459431 - DNA, 21 bp, Homo sapiens
tggtttttcctcattgagaat

SEQ ID NO: 5459432 - DNA, 22 bp, Homo sapiens
tggtttttctcatttgaaatgt

SEQ ID NO: 5459433 - DNA, 21 bp, Homo sapiens
tggtttttctgttccctgctg

SEQ ID NO: 5459434 - DNA, 20 bp, Homo sapiens
tggtttttcttttctttatt

SEQ ID NO: 5459435 - DNA, 18 bp, Homo sapiens
tggtttttgctctacttt

SEQ ID NO: 5459436 - DNA, 14 bp, Homo sapiens
tggtttttgctctc

SEQ ID NO: 5459437 - DNA, 18 bp, Homo sapiens
tggtttttggttacatgg

SEQ ID NO: 5459438 - DNA, 17 bp, Homo sapiens
tggtttttgtagccttc

SEQ ID NO: 5459439 - DNA, 14 bp, Homo sapiens
tggttttttataaa

SEQ ID NO: 5459440 - DNA, 15 bp, Homo sapiens
tggtttttttaagta

SEQ ID NO: 5459441 - DNA, 23 bp, Homo sapiens
tggttttttttttttttttggct

SEQ ID NO: 5459442 - DNA, 13 bp, Homo sapiens
tgtaaaaaaaaaa

SEQ ID NO: 5459443 - DNA, 22 bp, Homo sapiens
tgtaaaaaaaaaaaagttatat

SEQ ID NO: 5459444 - DNA, 14 bp, Homo sapiens
tgtaaaaaaaccac

SEQ ID NO: 5459445 - DNA, 20 bp, Homo sapiens
tgtaaaaaaagcaaaaatga

SEQ ID NO: 5459446 - DNA, 14 bp, Homo sapiens
tgtaaaaaacaaaa

SEQ ID NO: 5459447 - DNA, 23 bp, Homo sapiens
tgtaaaaaacaaaaaaaacaaca

SEQ ID NO: 5459448 - DNA, 16 bp, Homo sapiens
tgtaaaaaacaaaaac

SEQ ID NO: 5459449 - DNA, 16 bp, Homo sapiens
tgtaaaaaacaaacat

SEQ ID NO: 5459450 - DNA, 13 bp, Homo sapiens
tgtaaaaaagatt

SEQ ID NO: 5459451 - DNA, 15 bp, Homo sapiens
tgtaaaaaaggaaca

SEQ ID NO: 5459452 - DNA, 14 bp, Homo sapiens
tgtaaaaaagtgtt

SEQ ID NO: 5459453 - DNA, 12 bp, Homo sapiens
tgtaaaaaatgt

SEQ ID NO: 5459454 - DNA, 17 bp, Homo sapiens
tgtaaaaaatgtgtgta

SEQ ID NO: 5459455 - DNA, 13 bp, Homo sapiens
tgtaaaaaattca

SEQ ID NO: 5459456 - DNA, 17 bp, Homo sapiens
tgtaaaaacaaaaagac

SEQ ID NO: 5459457 - DNA, 20 bp, Homo sapiens
tgtaaaaacaaaaagacagt

SEQ ID NO: 5459458 - DNA, 13 bp, Homo sapiens
tgtaaaaactttt

SEQ ID NO: 5459459 - DNA, 14 bp, Homo sapiens
tgtaaaaacttttt

SEQ ID NO: 5459460 - DNA, 17 bp, Homo sapiens
tgtaaaaagaaattgtg

SEQ ID NO: 5459461 - DNA, 22 bp, Homo sapiens
tgtaaaaagagagaaaacttat

SEQ ID NO: 5459462 - DNA, 23 bp, Homo sapiens
tgtaaaaagcctccttgtgcaat

SEQ ID NO: 5459463 - DNA, 18 bp, Homo sapiens
tgtaaaaatacactaatg

SEQ ID NO: 5459464 - DNA, 20 bp, Homo sapiens
tgtaaaaatactgtttcact

SEQ ID NO: 5459465 - DNA, 16 bp, Homo sapiens
tgtaaaaatcttttga

SEQ ID NO: 5459466 - DNA, 14 bp, Homo sapiens
tgtaaaaatgagaa

SEQ ID NO: 5459467 - DNA, 12 bp, Homo sapiens
tgtaaaaatgtt

SEQ ID NO: 5459468 - DNA, 20 bp, Homo sapiens
tgtaaaaattggtcacccta

SEQ ID NO: 5459469 - DNA, 19 bp, Homo sapiens
tgtaaaaattgttataatt

SEQ ID NO: 5459470 - DNA, 15 bp, Homo sapiens
tgtaaaacaaaaaac

SEQ ID NO: 5459471 - DNA, 14 bp, Homo sapiens
tgtaaaacaaaatt

SEQ ID NO: 5459472 - DNA, 22 bp, Homo sapiens
tgtaaaacaaagattgattgat

SEQ ID NO: 5459473 - DNA, 13 bp, Homo sapiens
tgtaaaacaatgc

SEQ ID NO: 5459474 - DNA, 23 bp, Homo sapiens
tgtaaaacaatgccatgaacaaa

SEQ ID NO: 5459475 - DNA, 20 bp, Homo sapiens
tgtaaaacacaagactgtca

SEQ ID NO: 5459476 - DNA, 13 bp, Homo sapiens
tgtaaaacagaat

SEQ ID NO: 5459477 - DNA, 12 bp, Homo sapiens
tgtaaaacagtg

SEQ ID NO: 5459478 - DNA, 19 bp, Homo sapiens
tgtaaaaccatgtagtttt

SEQ ID NO: 5459479 - DNA, 22 bp, Homo sapiens
tgtaaaacgagaatccacccat

SEQ ID NO: 5459480 - DNA, 12 bp, Homo sapiens
tgtaaaacgctg

SEQ ID NO: 5459481 - DNA, 18 bp, Homo sapiens
tgtaaaactcgcttttat

SEQ ID NO: 5459482 - DNA, 15 bp, Homo sapiens
tgtaaaactgaggca

SEQ ID NO: 5459483 - DNA, 12 bp, Homo sapiens
tgtaaaactgtg

SEQ ID NO: 5459484 - DNA, 12 bp, Homo sapiens
tgtaaaacttct

SEQ ID NO: 5459485 - DNA, 13 bp, Homo sapiens
tgtaaaagaaatc

SEQ ID NO: 5459486 - DNA, 13 bp, Homo sapiens
tgtaaaagacatt

SEQ ID NO: 5459487 - DNA, 18 bp, Homo sapiens
tgtaaaagattaaactgc

SEQ ID NO: 5459488 - DNA, 17 bp, Homo sapiens
tgtaaaagcattttgta

SEQ ID NO: 5459489 - DNA, 22 bp, Homo sapiens
tgtaaaaggccaaacctctgtt

SEQ ID NO: 5459490 - DNA, 23 bp, Homo sapiens
tgtaaaaggccaaacctctgttc

SEQ ID NO: 5459491 - DNA, 17 bp, Homo sapiens
tgtaaaagtagtaaatt

SEQ ID NO: 5459492 - DNA, 20 bp, Homo sapiens
tgtaaaagtctagttaccta

SEQ ID NO: 5459493 - DNA, 12 bp, Homo sapiens
tgtaaaataaga

SEQ ID NO: 5459494 - DNA, 12 bp, Homo sapiens
tgtaaaataatt

SEQ ID NO: 5459495 - DNA, 11 bp, Homo sapiens
tgtaaaatata

SEQ ID NO: 5459496 - DNA, 13 bp, Homo sapiens
tgtaaaatatgta

SEQ ID NO: 5459497 - DNA, 14 bp, Homo sapiens
tgtaaaatattgtt

SEQ ID NO: 5459498 - DNA, 21 bp, Homo sapiens
tgtaaaatattttgaatcaat

SEQ ID NO: 5459499 - DNA, 16 bp, Homo sapiens
tgtaaaatccacagct

SEQ ID NO: 5459500 - DNA, 23 bp, Homo sapiens
tgtaaaatccacagctatatcct

SEQ ID NO: 5459501 - DNA, 19 bp, Homo sapiens
tgtaaaatcctacagtgaa

SEQ ID NO: 5459502 - DNA, 20 bp, Homo sapiens
tgtaaaatcctacagtgaaa

SEQ ID NO: 5459503 - DNA, 14 bp, Homo sapiens
tgtaaaatcttcag

SEQ ID NO: 5459504 - DNA, 15 bp, Homo sapiens
tgtaaaatcttcagc

SEQ ID NO: 5459505 - DNA, 19 bp, Homo sapiens
tgtaaaatcttcagctggt

SEQ ID NO: 5459506 - DNA, 15 bp, Homo sapiens
tgtaaaatcttgcag

SEQ ID NO: 5459507 - DNA, 21 bp, Homo sapiens
tgtaaaatcttggcacagaaa

SEQ ID NO: 5459508 - DNA, 22 bp, Homo sapiens
tgtaaaatcttggcacagaaac

SEQ ID NO: 5459509 - DNA, 16 bp, Homo sapiens
tgtaaaatcttgtcat

SEQ ID NO: 5459510 - DNA, 19 bp, Homo sapiens
tgtaaaatcttgtcatgtg

SEQ ID NO: 5459511 - DNA, 14 bp, Homo sapiens
tgtaaaatgaaatt

SEQ ID NO: 5459512 - DNA, 23 bp, Homo sapiens
tgtaaaatgaattgaaaaacaat

SEQ ID NO: 5459513 - DNA, 12 bp, Homo sapiens
tgtaaaatgaca

SEQ ID NO: 5459514 - DNA, 13 bp, Homo sapiens
tgtaaaatgcagt

SEQ ID NO: 5459515 - DNA, 19 bp, Homo sapiens
tgtaaaatgcagtccagaa

SEQ ID NO: 5459516 - DNA, 13 bp, Homo sapiens
tgtaaaatgcttt

SEQ ID NO: 5459517 - DNA, 22 bp, Homo sapiens
tgtaaaatggaaaacttagttt

SEQ ID NO: 5459518 - DNA, 13 bp, Homo sapiens
tgtaaaatgtatt

SEQ ID NO: 5459519 - DNA, 20 bp, Homo sapiens
tgtaaaatgtgaagtgaatg

SEQ ID NO: 5459520 - DNA, 18 bp, Homo sapiens
tgtaaaatgtttaatggt

SEQ ID NO: 5459521 - DNA, 12 bp, Homo sapiens
tgtaaaattaat

SEQ ID NO: 5459522 - DNA, 18 bp, Homo sapiens
tgtaaaattataaacttt

SEQ ID NO: 5459523 - DNA, 21 bp, Homo sapiens
tgtaaaattataaacttttat

SEQ ID NO: 5459524 - DNA, 13 bp, Homo sapiens
tgtaaaattcata

SEQ ID NO: 5459525 - DNA, 17 bp, Homo sapiens
tgtaaaattgttcctga

SEQ ID NO: 5459526 - DNA, 21 bp, Homo sapiens
tgtaaaatttatacacacaaa

SEQ ID NO: 5459527 - DNA, 19 bp, Homo sapiens
tgtaaaatttatttatatt

SEQ ID NO: 5459528 - DNA, 22 bp, Homo sapiens
tgtaaaatttatttatattccg

SEQ ID NO: 5459529 - DNA, 13 bp, Homo sapiens
tgtaaaatttgtg

SEQ ID NO: 5459530 - DNA, 18 bp, Homo sapiens
tgtaaacaaataataaag

SEQ ID NO: 5459531 - DNA, 19 bp, Homo sapiens
tgtaaacaaatattttctt

SEQ ID NO: 5459532 - DNA, 14 bp, Homo sapiens
tgtaaacaaatctt

SEQ ID NO: 5459533 - DNA, 12 bp, Homo sapiens
tgtaaacaacaa

SEQ ID NO: 5459534 - DNA, 19 bp, Homo sapiens
tgtaaacaatgtaaagtaa

SEQ ID NO: 5459535 - DNA, 11 bp, Homo sapiens
tgtaaacacag

SEQ ID NO: 5459536 - DNA, 13 bp, Homo sapiens
tgtaaacagaaat

SEQ ID NO: 5459537 - DNA, 16 bp, Homo sapiens
tgtaaacagaataaaa

SEQ ID NO: 5459538 - DNA, 12 bp, Homo sapiens
tgtaaacagtgc

SEQ ID NO: 5459539 - DNA, 15 bp, Homo sapiens
tgtaaacatcataaa

SEQ ID NO: 5459540 - DNA, 14 bp, Homo sapiens
tgtaaaccaaatac

SEQ ID NO: 5459541 - DNA, 14 bp, Homo sapiens
tgtaaaccaatttt

SEQ ID NO: 5459542 - DNA, 16 bp, Homo sapiens
tgtaaaccacatgaac

SEQ ID NO: 5459543 - DNA, 23 bp, Homo sapiens
tgtaaaccagaaaaaataaatgt

SEQ ID NO: 5459544 - DNA, 15 bp, Homo sapiens
tgtaaaccattgtaa

SEQ ID NO: 5459545 - DNA, 14 bp, Homo sapiens
tgtaaaccgctttg

SEQ ID NO: 5459546 - DNA, 12 bp, Homo sapiens
tgtaaactaaag

SEQ ID NO: 5459547 - DNA, 18 bp, Homo sapiens
tgtaaactaaagtgtgct

SEQ ID NO: 5459548 - DNA, 12 bp, Homo sapiens
tgtaaactataa

SEQ ID NO: 5459549 - DNA, 22 bp, Homo sapiens
tgtaaactataaactactgtaa

SEQ ID NO: 5459550 - DNA, 20 bp, Homo sapiens
tgtaaactcaaaatatttgt

SEQ ID NO: 5459551 - DNA, 23 bp, Homo sapiens
tgtaaactcgggggtgctggggc

SEQ ID NO: 5459552 - DNA, 19 bp, Homo sapiens
tgtaaactgaatataaagc

SEQ ID NO: 5459553 - DNA, 22 bp, Homo sapiens
tgtaaactgaatataaagctta

SEQ ID NO: 5459554 - DNA, 18 bp, Homo sapiens
tgtaaactgcattagaaa

SEQ ID NO: 5459555 - DNA, 13 bp, Homo sapiens
tgtaaactgccat

SEQ ID NO: 5459556 - DNA, 22 bp, Homo sapiens
tgtaaactgccatatataacag

SEQ ID NO: 5459557 - DNA, 21 bp, Homo sapiens
tgtaaactgtactagtctgtg

SEQ ID NO: 5459558 - DNA, 18 bp, Homo sapiens
tgtaaactgtgtattcca

SEQ ID NO: 5459559 - DNA, 23 bp, Homo sapiens
tgtaaactgttgttttgtatgag

SEQ ID NO: 5459560 - DNA, 17 bp, Homo sapiens
tgtaaacttctgaagac

SEQ ID NO: 5459561 - DNA, 17 bp, Homo sapiens
tgtaaactttatcactt

SEQ ID NO: 5459562 - DNA, 15 bp, Homo sapiens
tgtaaactttgaaat

SEQ ID NO: 5459563 - DNA, 20 bp, Homo sapiens
tgtaaactttttcaatggtt

SEQ ID NO: 5459564 - DNA, 19 bp, Homo sapiens
tgtacagaatttccactgt

SEQ ID NO: 5459565 - DNA, 19 bp, Homo sapiens
tgtacagaattttggaaga

SEQ ID NO: 5459566 - DNA, 19 bp, Homo sapiens
tgtacagaatttttaatga

SEQ ID NO: 5459567 - DNA, 17 bp, Homo sapiens
tgtacagacatatttaa

SEQ ID NO: 5459568 - DNA, 19 bp, Homo sapiens
tgtacagacatatttaact

SEQ ID NO: 5459569 - DNA, 18 bp, Homo sapiens
tgtacagaccacctttca

SEQ ID NO: 5459570 - DNA, 21 bp, Homo sapiens
tgtacagaccgagaggccagt

SEQ ID NO: 5459571 - DNA, 18 bp, Homo sapiens
tgtacagacgtatgctta

SEQ ID NO: 5459572 - DNA, 19 bp, Homo sapiens
tgtacagacgtatgcttat

SEQ ID NO: 5459573 - DNA, 12 bp, Homo sapiens
tgtacagactct

SEQ ID NO: 5459574 - DNA, 20 bp, Homo sapiens
tgtacagactgttttactgt

SEQ ID NO: 5459575 - DNA, 22 bp, Homo sapiens
tgtacagagaactaacactatt

SEQ ID NO: 5459576 - DNA, 22 bp, Homo sapiens
tgtacagagaagaagtgcttgg

SEQ ID NO: 5459577 - DNA, 17 bp, Homo sapiens
tgtacagagcccacgcc

SEQ ID NO: 5459578 - DNA, 22 bp, Homo sapiens
tgtacagagccgtaaaaactga

SEQ ID NO: 5459579 - DNA, 14 bp, Homo sapiens
tgtacagagctttc

SEQ ID NO: 5459580 - DNA, 16 bp, Homo sapiens
tgtacagagctttctt

SEQ ID NO: 5459581 - DNA, 21 bp, Homo sapiens
tgtacagagtggaataagaca

SEQ ID NO: 5459582 - DNA, 19 bp, Homo sapiens
tgtacagattctttcagtt

SEQ ID NO: 5459583 - DNA, 14 bp, Homo sapiens
tgtacagattttat

SEQ ID NO: 5459584 - DNA, 14 bp, Homo sapiens
tgtacagcacagaa

SEQ ID NO: 5459585 - DNA, 17 bp, Homo sapiens
tgtacagcacagaatga

SEQ ID NO: 5459586 - DNA, 12 bp, Homo sapiens
tgtacagcccag

SEQ ID NO: 5459587 - DNA, 17 bp, Homo sapiens
tgtacagcgttttaaaa

SEQ ID NO: 5459588 - DNA, 17 bp, Homo sapiens
tgtacagctggctctac

SEQ ID NO: 5459589 - DNA, 16 bp, Homo sapiens
tgtacagctggtgctt

SEQ ID NO: 5459590 - DNA, 19 bp, Homo sapiens
tgtacaggatgctttggtt

SEQ ID NO: 5459591 - DNA, 17 bp, Homo sapiens
tgtacaggctgagacac

SEQ ID NO: 5459592 - DNA, 17 bp, Homo sapiens
tgtacaggggccatgcc

SEQ ID NO: 5459593 - DNA, 18 bp, Homo sapiens
tgtacaggggccatgccc

SEQ ID NO: 5459594 - DNA, 20 bp, Homo sapiens
tgtacaggtcacccatcagg

SEQ ID NO: 5459595 - DNA, 12 bp, Homo sapiens
tgtacaggttgg

SEQ ID NO: 5459596 - DNA, 18 bp, Homo sapiens
tgtacaggttggatgtgg

SEQ ID NO: 5459597 - DNA, 21 bp, Homo sapiens
tgtacagtaatatgtttaatg

SEQ ID NO: 5459598 - DNA, 22 bp, Homo sapiens
tgtacagtaatatgtttaatgt

SEQ ID NO: 5459599 - DNA, 13 bp, Homo sapiens
tgtacagtatgtg

SEQ ID NO: 5459600 - DNA, 14 bp, Homo sapiens
tgtacagtatgtgt

SEQ ID NO: 5459601 - DNA, 17 bp, Homo sapiens
tgtacagtatgtgtcta

SEQ ID NO: 5459602 - DNA, 21 bp, Homo sapiens
tgtacagtatttttcagatat

SEQ ID NO: 5459603 - DNA, 23 bp, Homo sapiens
tgtacagtatttttcagatataa

SEQ ID NO: 5459604 - DNA, 19 bp, Homo sapiens
tgtacagtctgctcctctt

SEQ ID NO: 5459605 - DNA, 18 bp, Homo sapiens
tgtacagtctgtcatgaa

SEQ ID NO: 5459606 - DNA, 15 bp, Homo sapiens
tgtacagtctgtctt

SEQ ID NO: 5459607 - DNA, 12 bp, Homo sapiens
tgtacagtcttg

SEQ ID NO: 5459608 - DNA, 15 bp, Homo sapiens
tgtacagtcttgtat

SEQ ID NO: 5459609 - DNA, 16 bp, Homo sapiens
tgtacagtggagaaat

SEQ ID NO: 5459610 - DNA, 17 bp, Homo sapiens
tgtacagtggagaaata

SEQ ID NO: 5459611 - DNA, 22 bp, Homo sapiens
tgtacagtgtctttttttgtat

SEQ ID NO: 5459612 - DNA, 23 bp, Homo sapiens
tgtacagtgtctttttttgtata

SEQ ID NO: 5459613 - DNA, 17 bp, Homo sapiens
tgtacagtgtgtaaagt

SEQ ID NO: 5459614 - DNA, 11 bp, Homo sapiens
tgtacagtgtt

SEQ ID NO: 5459615 - DNA, 13 bp, Homo sapiens
tgtacagtgttct

SEQ ID NO: 5459616 - DNA, 16 bp, Homo sapiens
tgtacagtgttctgtt

SEQ ID NO: 5459617 - DNA, 20 bp, Homo sapiens
tgtacagtgttctgtttaat

SEQ ID NO: 5459618 - DNA, 23 bp, Homo sapiens
tgtacagttaactctcccaggtg

SEQ ID NO: 5459619 - DNA, 18 bp, Homo sapiens
tgtacagttatctaagtt

SEQ ID NO: 5459620 - DNA, 21 bp, Homo sapiens
tgtacagttatctaagttaat

SEQ ID NO: 5459621 - DNA, 16 bp, Homo sapiens
tgtacagttgagctca

SEQ ID NO: 5459622 - DNA, 19 bp, Homo sapiens
tgtacagttgagctcaggt

SEQ ID NO: 5459623 - DNA, 16 bp, Homo sapiens
tgtacagtttgctgta

SEQ ID NO: 5459624 - DNA, 16 bp, Homo sapiens
tgtacagtttgtttac

SEQ ID NO: 5459625 - DNA, 18 bp, Homo sapiens
tgtacataaaagaatttt

SEQ ID NO: 5459626 - DNA, 19 bp, Homo sapiens
tgtacataaactgtcactc

SEQ ID NO: 5459627 - DNA, 23 bp, Homo sapiens
tgtacataaattgcataaagcat

SEQ ID NO: 5459628 - DNA, 14 bp, Homo sapiens
tgtacataactctg

SEQ ID NO: 5459629 - DNA, 19 bp, Homo sapiens
tgtacataactgaaaatgt

SEQ ID NO: 5459630 - DNA, 20 bp, Homo sapiens
tgtacataatgcgtgcatac

SEQ ID NO: 5459631 - DNA, 18 bp, Homo sapiens
tgtacataattgcatgaa

SEQ ID NO: 5459632 - DNA, 22 bp, Homo sapiens
tgtacataccggggctcctctc

SEQ ID NO: 5459633 - DNA, 18 bp, Homo sapiens
tgtacatacgatttaagg

SEQ ID NO: 5459634 - DNA, 23 bp, Homo sapiens
tgtacatacgatttaaggtattt

SEQ ID NO: 5459635 - DNA, 16 bp, Homo sapiens
tgtacatactggcctc

SEQ ID NO: 5459636 - DNA, 17 bp, Homo sapiens
tgtacatactggcctct

SEQ ID NO: 5459637 - DNA, 18 bp, Homo sapiens
tgtacatactggcctctg

SEQ ID NO: 5459638 - DNA, 20 bp, Homo sapiens
tgtacatactggcctctgtg

SEQ ID NO: 5459639 - DNA, 15 bp, Homo sapiens
tgtacatagagcaat

SEQ ID NO: 5459640 - DNA, 18 bp, Homo sapiens
tgtacatagagcaatgtt

SEQ ID NO: 5459641 - DNA, 16 bp, Homo sapiens
tgtacatagtggtcat

SEQ ID NO: 5459642 - DNA, 18 bp, Homo sapiens
tgtacatagttatttatt

SEQ ID NO: 5459643 - DNA, 14 bp, Homo sapiens
tgtacatataagtg

SEQ ID NO: 5459644 - DNA, 20 bp, Homo sapiens
tgtacatatatgtataatat

SEQ ID NO: 5459645 - DNA, 16 bp, Homo sapiens
tgtacatatcaaatag

SEQ ID NO: 5459646 - DNA, 18 bp, Homo sapiens
tgtacatatcaaatagat

SEQ ID NO: 5459647 - DNA, 22 bp, Homo sapiens
tgtacatatcaaatagatattt

SEQ ID NO: 5459648 - DNA, 15 bp, Homo sapiens
tgtacatatggaaat

SEQ ID NO: 5459649 - DNA, 21 bp, Homo sapiens
tgtacatatggaaatcctgtt

SEQ ID NO: 5459650 - DNA, 19 bp, Homo sapiens
tgtacatatggaaatgtta

SEQ ID NO: 5459651 - DNA, 15 bp, Homo sapiens
tgtacatatgtaaaa

SEQ ID NO: 5459652 - DNA, 17 bp, Homo sapiens
tgtacatatgtgctgga

SEQ ID NO: 5459653 - DNA, 15 bp, Homo sapiens
tgtacatattactgt

SEQ ID NO: 5459654 - DNA, 23 bp, Homo sapiens
tgtacatattactgttgcattta

SEQ ID NO: 5459655 - DNA, 21 bp, Homo sapiens
tgtacatattagcgacaacag

SEQ ID NO: 5459656 - DNA, 12 bp, Homo sapiens
tgtacatattat

SEQ ID NO: 5459657 - DNA, 22 bp, Homo sapiens
tgtacatcccatgtaacagaaa

SEQ ID NO: 5459658 - DNA, 14 bp, Homo sapiens
tgtacatctggctt

SEQ ID NO: 5459659 - DNA, 17 bp, Homo sapiens
tgtacatctggcttatt

SEQ ID NO: 5459660 - DNA, 18 bp, Homo sapiens
tgtacatgaaaacacatt

SEQ ID NO: 5459661 - DNA, 12 bp, Homo sapiens
tgtacatgaaat

SEQ ID NO: 5459662 - DNA, 19 bp, Homo sapiens
tgtacatgaaatttttgta

SEQ ID NO: 5459663 - DNA, 20 bp, Homo sapiens
tgtacatgaaatttttgtaa

SEQ ID NO: 5459664 - DNA, 22 bp, Homo sapiens
tgtacatgaagaagctaaatcc

SEQ ID NO: 5459665 - DNA, 14 bp, Homo sapiens
tgtacatgaagaat

SEQ ID NO: 5459666 - DNA, 17 bp, Homo sapiens
tgtacatgaagaatgta

SEQ ID NO: 5459667 - DNA, 16 bp, Homo sapiens
tgtacatgagaaggaa

SEQ ID NO: 5459668 - DNA, 11 bp, Homo sapiens
tgtacatgata

SEQ ID NO: 5459669 - DNA, 12 bp, Homo sapiens
tgtacatgataa

SEQ ID NO: 5459670 - DNA, 13 bp, Homo sapiens
tgtacatgtacat

SEQ ID NO: 5459671 - DNA, 20 bp, Homo sapiens
tgtacatgtacatagtaaag

SEQ ID NO: 5459672 - DNA, 17 bp, Homo sapiens
tgtacatgtatgaaatt

SEQ ID NO: 5459673 - DNA, 20 bp, Homo sapiens
tgtacatgtattaaattaca

SEQ ID NO: 5459674 - DNA, 21 bp, Homo sapiens
tgtacatgtattaaattacat

SEQ ID NO: 5459675 - DNA, 15 bp, Homo sapiens
tgtacatgtgtagcc

SEQ ID NO: 5459676 - DNA, 21 bp, Homo sapiens
tgtacatgtgtagcctgtgca

SEQ ID NO: 5459677 - DNA, 18 bp, Homo sapiens
tgtacatgtgtgcagagc

SEQ ID NO: 5459678 - DNA, 14 bp, Homo sapiens
tgtacattaattac

SEQ ID NO: 5459679 - DNA, 15 bp, Homo sapiens
tgtacattctgccta

SEQ ID NO: 5459680 - DNA, 14 bp, Homo sapiens
tgtacattcttcca

SEQ ID NO: 5459681 - DNA, 23 bp, Homo sapiens
tgtacattcttccatcatcactg

SEQ ID NO: 5459682 - DNA, 20 bp, Homo sapiens
tgtacatttatgatttaata

SEQ ID NO: 5459683 - DNA, 18 bp, Homo sapiens
tgtacatttatgtgtgaa

SEQ ID NO: 5459684 - DNA, 20 bp, Homo sapiens
tgtacatttatgtgtgaagc

SEQ ID NO: 5459685 - DNA, 14 bp, Homo sapiens
tgtacatttattca

SEQ ID NO: 5459686 - DNA, 21 bp, Homo sapiens
tgtacatttatttattactgt

SEQ ID NO: 5459687 - DNA, 23 bp, Homo sapiens
tgtacatttatttattactgtcc

SEQ ID NO: 5459688 - DNA, 18 bp, Homo sapiens
tgtacatttccaaattca

SEQ ID NO: 5459689 - DNA, 22 bp, Homo sapiens
tgtacatttccaaattcacaag

SEQ ID NO: 5459690 - DNA, 17 bp, Homo sapiens
tgtacatttctataaat

SEQ ID NO: 5459691 - DNA, 18 bp, Homo sapiens
tgtacatttctataaata

SEQ ID NO: 5459692 - DNA, 16 bp, Homo sapiens
tgtacatttctcaggc

SEQ ID NO: 5459693 - DNA, 19 bp, Homo sapiens
tgtacatttctcaggctag

SEQ ID NO: 5459694 - DNA, 14 bp, Homo sapiens
tgtacatttggaac

SEQ ID NO: 5459695 - DNA, 17 bp, Homo sapiens
tgtacatttggaacagt

SEQ ID NO: 5459696 - DNA, 22 bp, Homo sapiens
tgtacatttggaacagtgacaa

SEQ ID NO: 5459697 - DNA, 21 bp, Homo sapiens
tgtacattttgttgtaaaaag

SEQ ID NO: 5459698 - DNA, 22 bp, Homo sapiens
tgtacattttgttgtaaaaaga

SEQ ID NO: 5459699 - DNA, 19 bp, Homo sapiens
tgtacatttttaaattctt

SEQ ID NO: 5459700 - DNA, 17 bp, Homo sapiens
tgtacatttttgggggg

SEQ ID NO: 5459701 - DNA, 13 bp, Homo sapiens
tgtaccaaaattt

SEQ ID NO: 5459702 - DNA, 17 bp, Homo sapiens
tgtaccaaaattttaaa

SEQ ID NO: 5459703 - DNA, 13 bp, Homo sapiens
tgtaccaaagctg

SEQ ID NO: 5459704 - DNA, 18 bp, Homo sapiens
tgtaccaacctcatagag

SEQ ID NO: 5459705 - DNA, 15 bp, Homo sapiens
tgtaccaagaatctt

SEQ ID NO: 5459706 - DNA, 15 bp, Homo sapiens
tgtaccaagtgcttc

SEQ ID NO: 5459707 - DNA, 18 bp, Homo sapiens
tgtaccaagtgcttccta

SEQ ID NO: 5459708 - DNA, 21 bp, Homo sapiens
tgtaccacaccctgcctgctg

SEQ ID NO: 5459709 - DNA, 15 bp, Homo sapiens
tgtaccacagacaca

SEQ ID NO: 5459710 - DNA, 17 bp, Homo sapiens
tgtaccacctaatgttt

SEQ ID NO: 5459711 - DNA, 14 bp, Homo sapiens
tgtaccactactta

SEQ ID NO: 5459712 - DNA, 20 bp, Homo sapiens
tgtaccactgctaataaatg

SEQ ID NO: 5459713 - DNA, 18 bp, Homo sapiens
tgtaccacttctgtgggc

SEQ ID NO: 5459714 - DNA, 17 bp, Homo sapiens
tgtaccacttttgcaaa

SEQ ID NO: 5459715 - DNA, 15 bp, Homo sapiens
tgtaccagggctctg

SEQ ID NO: 5459716 - DNA, 19 bp, Homo sapiens
tgtaccagtgaatttttgc

SEQ ID NO: 5459717 - DNA, 21 bp, Homo sapiens
tgtaccagtgtactgctttca

SEQ ID NO: 5459718 - DNA, 12 bp, Homo sapiens
tgtaccagtgtg

SEQ ID NO: 5459719 - DNA, 22 bp, Homo sapiens
tgtaccagttaatttttccaac

SEQ ID NO: 5459720 - DNA, 19 bp, Homo sapiens
tgtaccatagaaaaatgta

SEQ ID NO: 5459721 - DNA, 18 bp, Homo sapiens
tgtaccatatgatctgtt

SEQ ID NO: 5459722 - DNA, 13 bp, Homo sapiens
tgtaccatatgta

SEQ ID NO: 5459723 - DNA, 18 bp, Homo sapiens
tgtaccatatgtagcatt

SEQ ID NO: 5459724 - DNA, 15 bp, Homo sapiens
tgtaccatcaataaa

SEQ ID NO: 5459725 - DNA, 17 bp, Homo sapiens
tgtaccatggtttgata

SEQ ID NO: 5459726 - DNA, 20 bp, Homo sapiens
tgtaccatggtttgatatgt

SEQ ID NO: 5459727 - DNA, 19 bp, Homo sapiens
tgtaccatgtgctacaggg

SEQ ID NO: 5459728 - DNA, 14 bp, Homo sapiens
tgtaccatgttaaa

SEQ ID NO: 5459729 - DNA, 17 bp, Homo sapiens
tgtaccatgttaaagag

SEQ ID NO: 5459730 - DNA, 17 bp, Homo sapiens
tgtaccatgttgcccag

SEQ ID NO: 5459731 - DNA, 18 bp, Homo sapiens
tgtaccatgttgcccaga

SEQ ID NO: 5459732 - DNA, 17 bp, Homo sapiens
tgtaccattaaaatatg

SEQ ID NO: 5459733 - DNA, 23 bp, Homo sapiens
tgtaccattaaaatatgcactaa

SEQ ID NO: 5459734 - DNA, 18 bp, Homo sapiens
tgtaccattccttcaaat

SEQ ID NO: 5459735 - DNA, 13 bp, Homo sapiens
tgtacccacccca

SEQ ID NO: 5459736 - DNA, 15 bp, Homo sapiens
tgtacccaccccagc

SEQ ID NO: 5459737 - DNA, 19 bp, Homo sapiens
tgtacccaccccagcacag

SEQ ID NO: 5459738 - DNA, 18 bp, Homo sapiens
tgtacccacgctgggtat

SEQ ID NO: 5459739 - DNA, 12 bp, Homo sapiens
tgtacccagcca

SEQ ID NO: 5459740 - DNA, 17 bp, Homo sapiens
tgtacccagccaccttc

SEQ ID NO: 5459741 - DNA, 21 bp, Homo sapiens
tgtagttttaaataaagtttg

SEQ ID NO: 5459742 - DNA, 15 bp, Homo sapiens
tgtagttttacttgg

SEQ ID NO: 5459743 - DNA, 16 bp, Homo sapiens
tgtagttttacttggt

SEQ ID NO: 5459744 - DNA, 17 bp, Homo sapiens
tgtagttttacttggtg

SEQ ID NO: 5459745 - DNA, 20 bp, Homo sapiens
tgtagttttatcacatgtat

SEQ ID NO: 5459746 - DNA, 17 bp, Homo sapiens
tgtagttttattttatg

SEQ ID NO: 5459747 - DNA, 14 bp, Homo sapiens
tgtagttttgtata

SEQ ID NO: 5459748 - DNA, 14 bp, Homo sapiens
tgtagttttgttta

SEQ ID NO: 5459749 - DNA, 17 bp, Homo sapiens
tgtagtttttaattaaa

SEQ ID NO: 5459750 - DNA, 17 bp, Homo sapiens
tgtagtttttgctgaag

SEQ ID NO: 5459751 - DNA, 14 bp, Homo sapiens
tgtataaaaaggaa

SEQ ID NO: 5459752 - DNA, 14 bp, Homo sapiens
tgtataaaaataaa

SEQ ID NO: 5459753 - DNA, 13 bp, Homo sapiens
tgtataaaaatag

SEQ ID NO: 5459754 - DNA, 19 bp, Homo sapiens
tgtataaaaatgtaaatta

SEQ ID NO: 5459755 - DNA, 17 bp, Homo sapiens
tgtataaaaattatcaa

SEQ ID NO: 5459756 - DNA, 23 bp, Homo sapiens
tgtataaaaattatcaaaaagct

SEQ ID NO: 5459757 - DNA, 20 bp, Homo sapiens
tgtataaaacattaattgct

SEQ ID NO: 5459758 - DNA, 22 bp, Homo sapiens
tgtataaaagggactgagaaat

SEQ ID NO: 5459759 - DNA, 21 bp, Homo sapiens
tgtataaaagtgtgaaataaa

SEQ ID NO: 5459760 - DNA, 19 bp, Homo sapiens
tgtataaaagttgtactgc

SEQ ID NO: 5459761 - DNA, 16 bp, Homo sapiens
tgtataaaatacatag

SEQ ID NO: 5459762 - DNA, 13 bp, Homo sapiens
tgtataaaataga

SEQ ID NO: 5459763 - DNA, 15 bp, Homo sapiens
tgtataaaatagaca

SEQ ID NO: 5459764 - DNA, 14 bp, Homo sapiens
tgtataaaatcagc

SEQ ID NO: 5459765 - DNA, 14 bp, Homo sapiens
tgtataaaatctga

SEQ ID NO: 5459766 - DNA, 18 bp, Homo sapiens
tgtataaaatctgaattt

SEQ ID NO: 5459767 - DNA, 21 bp, Homo sapiens
tgtataaaatctgaattttgc

SEQ ID NO: 5459768 - DNA, 20 bp, Homo sapiens
tgtataaaatgtaacactga

SEQ ID NO: 5459769 - DNA, 20 bp, Homo sapiens
tgtataaacataagttgcat

SEQ ID NO: 5459770 - DNA, 23 bp, Homo sapiens
tgtataaacataagttgcattta

SEQ ID NO: 5459771 - DNA, 13 bp, Homo sapiens
tgtataaagaaca

SEQ ID NO: 5459772 - DNA, 14 bp, Homo sapiens
tgtataaagattgt

SEQ ID NO: 5459773 - DNA, 16 bp, Homo sapiens
tgtataaagattgtac

SEQ ID NO: 5459774 - DNA, 12 bp, Homo sapiens
tgtataaagtga

SEQ ID NO: 5459775 - DNA, 20 bp, Homo sapiens
tgtataaataataaagaact

SEQ ID NO: 5459776 - DNA, 13 bp, Homo sapiens
tgtataaataatg

SEQ ID NO: 5459777 - DNA, 13 bp, Homo sapiens
tgtataaatgaca

SEQ ID NO: 5459778 - DNA, 11 bp, Homo sapiens
tgtataaatgt

SEQ ID NO: 5459779 - DNA, 15 bp, Homo sapiens
tgtataaatgtacat

SEQ ID NO: 5459780 - DNA, 20 bp, Homo sapiens
tgtataaatgtatatacaca

SEQ ID NO: 5459781 - DNA, 18 bp, Homo sapiens
tgtataaatgtctattat

SEQ ID NO: 5459782 - DNA, 13 bp, Homo sapiens
tgtataaattaat

SEQ ID NO: 5459783 - DNA, 20 bp, Homo sapiens
tgtataaattaatacagagt

SEQ ID NO: 5459784 - DNA, 13 bp, Homo sapiens
tgtataaattact

SEQ ID NO: 5459785 - DNA, 21 bp, Homo sapiens
tgtataaattatgaaggacct

SEQ ID NO: 5459786 - DNA, 14 bp, Homo sapiens
tgtataaattttta

SEQ ID NO: 5459787 - DNA, 16 bp, Homo sapiens
tgtataacatcactgt

SEQ ID NO: 5459788 - DNA, 18 bp, Homo sapiens
tgtataaccaagtgtgct

SEQ ID NO: 5459789 - DNA, 20 bp, Homo sapiens
tgtataaccaagtgtgctct

SEQ ID NO: 5459790 - DNA, 16 bp, Homo sapiens
tgtataacccatatct

SEQ ID NO: 5459791 - DNA, 18 bp, Homo sapiens
tgtataaccctgttacaa

SEQ ID NO: 5459792 - DNA, 15 bp, Homo sapiens
tgtataactaggagc

SEQ ID NO: 5459793 - DNA, 15 bp, Homo sapiens
tgtataactgttctt

SEQ ID NO: 5459794 - DNA, 18 bp, Homo sapiens
tgtataactttaacttct

SEQ ID NO: 5459795 - DNA, 19 bp, Homo sapiens
tgtataagacactttgcca

SEQ ID NO: 5459796 - DNA, 17 bp, Homo sapiens
tgtataagatcctagat

SEQ ID NO: 5459797 - DNA, 22 bp, Homo sapiens
tgtataagatgctgctgagcac

SEQ ID NO: 5459798 - DNA, 13 bp, Homo sapiens
tgtataagcatgc

SEQ ID NO: 5459799 - DNA, 20 bp, Homo sapiens
tgtataagctgtaatatcat

SEQ ID NO: 5459800 - DNA, 22 bp, Homo sapiens
tgtataaggagattctgtgtat

SEQ ID NO: 5459801 - DNA, 14 bp, Homo sapiens
tgtataagtaagaa

SEQ ID NO: 5459802 - DNA, 13 bp, Homo sapiens
tgtataagtagat

SEQ ID NO: 5459803 - DNA, 20 bp, Homo sapiens
tgtataagtagatctgcttt

SEQ ID NO: 5459804 - DNA, 22 bp, Homo sapiens
tgtataagtagatctgctttct

SEQ ID NO: 5459805 - DNA, 22 bp, Homo sapiens
tgtataagtcaagcacatgtaa

SEQ ID NO: 5459806 - DNA, 16 bp, Homo sapiens
tgtataagtgcacaca

SEQ ID NO: 5459807 - DNA, 21 bp, Homo sapiens
tgtataagtgcacacagaaat

SEQ ID NO: 5459808 - DNA, 16 bp, Homo sapiens
tgtataagtggaggca

SEQ ID NO: 5459809 - DNA, 20 bp, Homo sapiens
tgtataagtggaggcacttt

SEQ ID NO: 5459810 - DNA, 23 bp, Homo sapiens
tgtataagtggaggcactttagg

SEQ ID NO: 5459811 - DNA, 17 bp, Homo sapiens
tgtataagttgaaggaa

SEQ ID NO: 5459812 - DNA, 18 bp, Homo sapiens
tgtataagttgaaggaaa

SEQ ID NO: 5459813 - DNA, 15 bp, Homo sapiens
tgtataagttgtatt

SEQ ID NO: 5459814 - DNA, 21 bp, Homo sapiens
tgtataagttgtattattaga

SEQ ID NO: 5459815 - DNA, 17 bp, Homo sapiens
tgtataatactttgtat

SEQ ID NO: 5459816 - DNA, 22 bp, Homo sapiens
tgtataatactttgtatacaag

SEQ ID NO: 5459817 - DNA, 16 bp, Homo sapiens
tgtataatatatatct

SEQ ID NO: 5459818 - DNA, 17 bp, Homo sapiens
tgtataatatatatcta

SEQ ID NO: 5459819 - DNA, 21 bp, Homo sapiens
tgtataatattgaaaattgaa

SEQ ID NO: 5459820 - DNA, 22 bp, Homo sapiens
tgtataatattgaaaattgaaa

SEQ ID NO: 5459821 - DNA, 21 bp, Homo sapiens
tgtataatgacttttaaaatt

SEQ ID NO: 5459822 - DNA, 19 bp, Homo sapiens
tgtataatgtgctttattt

SEQ ID NO: 5459823 - DNA, 21 bp, Homo sapiens
tgtataatgttggtgtggagt

SEQ ID NO: 5459824 - DNA, 21 bp, Homo sapiens
tgtataattaacttaactgaa

SEQ ID NO: 5459825 - DNA, 22 bp, Homo sapiens
tgtataattaacttaactgaag

SEQ ID NO: 5459826 - DNA, 23 bp, Homo sapiens
tgtataattaacttaactgaaga

SEQ ID NO: 5459827 - DNA, 18 bp, Homo sapiens
tgtataattggatttcct

SEQ ID NO: 5459828 - DNA, 19 bp, Homo sapiens
tgtataattggatttccta

SEQ ID NO: 5459829 - DNA, 13 bp, Homo sapiens
tgtataattgtat

SEQ ID NO: 5459830 - DNA, 17 bp, Homo sapiens
tgtataatttaacagtg

SEQ ID NO: 5459831 - DNA, 14 bp, Homo sapiens
tgtataatttacct

SEQ ID NO: 5459832 - DNA, 12 bp, Homo sapiens
tgtataatttca

SEQ ID NO: 5459833 - DNA, 15 bp, Homo sapiens
tgtatacaaacaggt

SEQ ID NO: 5459834 - DNA, 19 bp, Homo sapiens
tgtatacaaacaggtgcta

SEQ ID NO: 5459835 - DNA, 20 bp, Homo sapiens
tgtatacaaacaggtgctaa

SEQ ID NO: 5459836 - DNA, 22 bp, Homo sapiens
tgtatacaaatatattgttaat

SEQ ID NO: 5459837 - DNA, 12 bp, Homo sapiens
tgtatacaagga

SEQ ID NO: 5459838 - DNA, 18 bp, Homo sapiens
tgtatacaagtactggta

SEQ ID NO: 5459839 - DNA, 17 bp, Homo sapiens
tgtatacacacatatac

SEQ ID NO: 5459840 - DNA, 19 bp, Homo sapiens
tgtatacacacatatacat

SEQ ID NO: 5459841 - DNA, 13 bp, Homo sapiens
tgtatacaccaag

SEQ ID NO: 5459842 - DNA, 14 bp, Homo sapiens
tgtatacacttaaa

SEQ ID NO: 5459843 - DNA, 17 bp, Homo sapiens
tgtatacagattctagc

SEQ ID NO: 5459844 - DNA, 22 bp, Homo sapiens
tgtatacagtgcagagccttct

SEQ ID NO: 5459845 - DNA, 13 bp, Homo sapiens
tgtatacatatgt

SEQ ID NO: 5459846 - DNA, 21 bp, Homo sapiens
tgtatacatatgtatgtgtga

SEQ ID NO: 5459847 - DNA, 21 bp, Homo sapiens
tgtatacatcttatagatgca

SEQ ID NO: 5459848 - DNA, 13 bp, Homo sapiens
tgtatacatgcca

SEQ ID NO: 5459849 - DNA, 15 bp, Homo sapiens
tgtatacatgccagt

SEQ ID NO: 5459850 - DNA, 22 bp, Homo sapiens
tgtatacattttgttatagaat

SEQ ID NO: 5459851 - DNA, 16 bp, Homo sapiens
tgtataccaatgtgtt

SEQ ID NO: 5459852 - DNA, 17 bp, Homo sapiens
tgtataccacctgtaca

SEQ ID NO: 5459853 - DNA, 18 bp, Homo sapiens
tgtataccacctgtacat

SEQ ID NO: 5459854 - DNA, 20 bp, Homo sapiens
tgtataccacctgtacatac

SEQ ID NO: 5459855 - DNA, 17 bp, Homo sapiens
tgtataccgtgtgctcc

SEQ ID NO: 5459856 - DNA, 15 bp, Homo sapiens
tgtatacctgtaact

SEQ ID NO: 5459857 - DNA, 14 bp, Homo sapiens
tgtatactatagta

SEQ ID NO: 5459858 - DNA, 19 bp, Homo sapiens
tgtatactatagtaccagt

SEQ ID NO: 5459859 - DNA, 15 bp, Homo sapiens
tgtatactcctgtca

SEQ ID NO: 5459860 - DNA, 19 bp, Homo sapiens
tgtatactcctgtcaccta

SEQ ID NO: 5459861 - DNA, 16 bp, Homo sapiens
tgtatactgtaaaagt

SEQ ID NO: 5459862 - DNA, 22 bp, Homo sapiens
tgtatactgtaatcgtgctatt

SEQ ID NO: 5459863 - DNA, 19 bp, Homo sapiens
tgtatactttagtatgacg

SEQ ID NO: 5459864 - DNA, 12 bp, Homo sapiens
tgtatagaaaat

SEQ ID NO: 5459865 - DNA, 23 bp, Homo sapiens
tgtatagaaaataaaataaatta

SEQ ID NO: 5459866 - DNA, 20 bp, Homo sapiens
tgtatagaaaattcttgaga

SEQ ID NO: 5459867 - DNA, 14 bp, Homo sapiens
tgtatagaaatcta

SEQ ID NO: 5459868 - DNA, 23 bp, Homo sapiens
tgtatagaacctctttgtctaca

SEQ ID NO: 5459869 - DNA, 21 bp, Homo sapiens
tgtatagacagtttgtaaatg

SEQ ID NO: 5459870 - DNA, 18 bp, Homo sapiens
tgtatagatatttcctct

SEQ ID NO: 5459871 - DNA, 16 bp, Homo sapiens
tgtatagatgagtttt

SEQ ID NO: 5459872 - DNA, 20 bp, Homo sapiens
tgtatagatgagtttttcat

SEQ ID NO: 5459873 - DNA, 21 bp, Homo sapiens
tgtatagattagaattctgta

SEQ ID NO: 5459874 - DNA, 23 bp, Homo sapiens
tgtatagattagattatattgag

SEQ ID NO: 5459875 - DNA, 22 bp, Homo sapiens
tgtatagcaacctatttgactg

SEQ ID NO: 5459876 - DNA, 19 bp, Homo sapiens
tgtatagcatgaaataaaa

SEQ ID NO: 5459877 - DNA, 22 bp, Homo sapiens
tgtatagctgaaattccagttt

SEQ ID NO: 5459878 - DNA, 21 bp, Homo sapiens
tgtatagcttttatctgcggc

SEQ ID NO: 5459879 - DNA, 12 bp, Homo sapiens
tgtataggaatt

SEQ ID NO: 5459880 - DNA, 17 bp, Homo sapiens
tgtataggccatctgta

SEQ ID NO: 5459881 - DNA, 22 bp, Homo sapiens
tgtataggccatctgtaaatat

SEQ ID NO: 5459882 - DNA, 23 bp, Homo sapiens
tgtataggccatctgtaaatatc

SEQ ID NO: 5459883 - DNA, 16 bp, Homo sapiens
tgtataggtagatgtt

SEQ ID NO: 5459884 - DNA, 14 bp, Homo sapiens
tgtatagtaatcat

SEQ ID NO: 5459885 - DNA, 19 bp, Homo sapiens
tgtatagtattggaaaata

SEQ ID NO: 5459886 - DNA, 16 bp, Homo sapiens
tgtatagtatttgaaa

SEQ ID NO: 5459887 - DNA, 20 bp, Homo sapiens
tgtatagtatttgaaaacag

SEQ ID NO: 5459888 - DNA, 20 bp, Homo sapiens
tgtatagtgagtgtggctta

SEQ ID NO: 5459889 - DNA, 24 bp, Homo sapiens
tgtatagtgtaaaataagaatgat

SEQ ID NO: 5459890 - DNA, 11 bp, Homo sapiens
tgtatagtgtt

SEQ ID NO: 5459891 - DNA, 13 bp, Homo sapiens
tgtatagttagaa

SEQ ID NO: 5459892 - DNA, 13 bp, Homo sapiens
tgtatagttatgt

SEQ ID NO: 5459893 - DNA, 14 bp, Homo sapiens
tgtatagttatgta

SEQ ID NO: 5459894 - DNA, 15 bp, Homo sapiens
tgtatagttatgtaa

SEQ ID NO: 5459895 - DNA, 16 bp, Homo sapiens
tgtatagttgcttgcc

SEQ ID NO: 5459896 - DNA, 18 bp, Homo sapiens
tgtatagttgcttgcctg

SEQ ID NO: 5459897 - DNA, 22 bp, Homo sapiens
tgtatagttttataaaactcag

SEQ ID NO: 5459898 - DNA, 15 bp, Homo sapiens
tgtatataaatatat

SEQ ID NO: 5459899 - DNA, 12 bp, Homo sapiens
tgtatataaatg

SEQ ID NO: 5459900 - DNA, 19 bp, Homo sapiens
tgtatataaatgggaacat

SEQ ID NO: 5459901 - DNA, 16 bp, Homo sapiens
tgtatataacttattt

SEQ ID NO: 5459902 - DNA, 21 bp, Homo sapiens
tgtatataagtactgaccact

SEQ ID NO: 5459903 - DNA, 19 bp, Homo sapiens
tgtatataatactaaagtg

SEQ ID NO: 5459904 - DNA, 21 bp, Homo sapiens
tgtatataatcatgctcatgt

SEQ ID NO: 5459905 - DNA, 17 bp, Homo sapiens
tgtatatacaataacat

SEQ ID NO: 5459906 - DNA, 16 bp, Homo sapiens
tgtatatacacatata

SEQ ID NO: 5459907 - DNA, 18 bp, Homo sapiens
tgtatatacacatatacc

SEQ ID NO: 5459908 - DNA, 19 bp, Homo sapiens
tgtatatacacatatacct

SEQ ID NO: 5459909 - DNA, 13 bp, Homo sapiens
tgtatatacagtt

SEQ ID NO: 5459910 - DNA, 14 bp, Homo sapiens
tgtatatacatatt

SEQ ID NO: 5459911 - DNA, 17 bp, Homo sapiens
tgtatatacatattata

SEQ ID NO: 5459912 - DNA, 20 bp, Homo sapiens
tgtatatacatattataaat

SEQ ID NO: 5459913 - DNA, 12 bp, Homo sapiens
tgtatatacatt

SEQ ID NO: 5459914 - DNA, 22 bp, Homo sapiens
tgtatatacatttatgaattaa

SEQ ID NO: 5459915 - DNA, 21 bp, Homo sapiens
tgtatatactatacaacaatg

SEQ ID NO: 5459916 - DNA, 23 bp, Homo sapiens
tgtatatagatgtctgtgtatac

SEQ ID NO: 5459917 - DNA, 18 bp, Homo sapiens
tgtatatagatgtgcaag

SEQ ID NO: 5459918 - DNA, 17 bp, Homo sapiens
tgtattcatatattgca

SEQ ID NO: 5459919 - DNA, 22 bp, Homo sapiens
tgtattcatatattgcatttct

SEQ ID NO: 5459920 - DNA, 15 bp, Homo sapiens
tgtattcatatttgt

SEQ ID NO: 5459921 - DNA, 16 bp, Homo sapiens
tgtattcatgttcatg

SEQ ID NO: 5459922 - DNA, 20 bp, Homo sapiens
tgtattcatgttcatgtgat

SEQ ID NO: 5459923 - DNA, 20 bp, Homo sapiens
tgtattccaagacatgtctg

SEQ ID NO: 5459924 - DNA, 18 bp, Homo sapiens
tgtattccaagcatataa

SEQ ID NO: 5459925 - DNA, 19 bp, Homo sapiens
tgtattccagtttgtttat

SEQ ID NO: 5459926 - DNA, 14 bp, Homo sapiens
tgtattcccagcta

SEQ ID NO: 5459927 - DNA, 17 bp, Homo sapiens
tgtattcccagttactt

SEQ ID NO: 5459928 - DNA, 17 bp, Homo sapiens
tgtattcccatatcaaa

SEQ ID NO: 5459929 - DNA, 15 bp, Homo sapiens
tgtattcccttcctc

SEQ ID NO: 5459930 - DNA, 15 bp, Homo sapiens
tgtattcccttgtat

SEQ ID NO: 5459931 - DNA, 17 bp, Homo sapiens
tgtattcccttgtattt

SEQ ID NO: 5459932 - DNA, 22 bp, Homo sapiens
tgtattcccttgtattttgtta

SEQ ID NO: 5459933 - DNA, 13 bp, Homo sapiens
tgtattcctgaaa

SEQ ID NO: 5459934 - DNA, 14 bp, Homo sapiens
tgtattcctgaaaa

SEQ ID NO: 5459935 - DNA, 17 bp, Homo sapiens
tgtattcgtgcattttt

SEQ ID NO: 5459936 - DNA, 18 bp, Homo sapiens
tgtattctcagacactga

SEQ ID NO: 5459937 - DNA, 22 bp, Homo sapiens
tgtattctctcctgtacctctt

SEQ ID NO: 5459938 - DNA, 15 bp, Homo sapiens
tgtattctctgtcca

SEQ ID NO: 5459939 - DNA, 20 bp, Homo sapiens
tgtattctctgtccagggct

SEQ ID NO: 5459940 - DNA, 13 bp, Homo sapiens
tgtattctggctg

SEQ ID NO: 5459941 - DNA, 21 bp, Homo sapiens
tgtattctgggtattctatta

SEQ ID NO: 5459942 - DNA, 15 bp, Homo sapiens
tgtattctgttggcc

SEQ ID NO: 5459943 - DNA, 22 bp, Homo sapiens
tgtattcttaaaatgcaatatt

SEQ ID NO: 5459944 - DNA, 16 bp, Homo sapiens
tgtattcttaaattca

SEQ ID NO: 5459945 - DNA, 14 bp, Homo sapiens
tgtattcttcatga

SEQ ID NO: 5459946 - DNA, 15 bp, Homo sapiens
tgtattcttcatgaa

SEQ ID NO: 5459947 - DNA, 18 bp, Homo sapiens
tgtattcttcatgaaatg

SEQ ID NO: 5459948 - DNA, 19 bp, Homo sapiens
tgtattcttcatgaaatgt

SEQ ID NO: 5459949 - DNA, 23 bp, Homo sapiens
tgtattcttgctttagaaaacat

SEQ ID NO: 5459950 - DNA, 14 bp, Homo sapiens
tgtattctttaaga

SEQ ID NO: 5459951 - DNA, 20 bp, Homo sapiens
tgtattctttataattgaat

SEQ ID NO: 5459952 - DNA, 18 bp, Homo sapiens
tgtattctttgatgttaa

SEQ ID NO: 5459953 - DNA, 22 bp, Homo sapiens
tgtattctttgatgttaacaca

SEQ ID NO: 5459954 - DNA, 22 bp, Homo sapiens
tgtattcttttatataactaca

SEQ ID NO: 5459955 - DNA, 17 bp, Homo sapiens
tgtattgaaaaaatatt

SEQ ID NO: 5459956 - DNA, 19 bp, Homo sapiens
tgtattgaaaacacttagt

SEQ ID NO: 5459957 - DNA, 21 bp, Homo sapiens
tgtattgaaaacacttagtat

SEQ ID NO: 5459958 - DNA, 17 bp, Homo sapiens
tgtattgaagttaactg

SEQ ID NO: 5459959 - DNA, 20 bp, Homo sapiens
tgtattgaagttaactgttc

SEQ ID NO: 5459960 - DNA, 16 bp, Homo sapiens
tgtattgaatcatgta

SEQ ID NO: 5459961 - DNA, 23 bp, Homo sapiens
tgtattgagatttacccagactg

SEQ ID NO: 5459962 - DNA, 20 bp, Homo sapiens
tgtattgagggccagtgatg

SEQ ID NO: 5459963 - DNA, 23 bp, Homo sapiens
tgtattgagggccagtgatgatg

SEQ ID NO: 5459964 - DNA, 15 bp, Homo sapiens
tgtattgagtcttaa

SEQ ID NO: 5459965 - DNA, 19 bp, Homo sapiens
tgtattgagtcttaactgt

SEQ ID NO: 5459966 - DNA, 18 bp, Homo sapiens
tgtattgattcaacaggg

SEQ ID NO: 5459967 - DNA, 16 bp, Homo sapiens
tgtattgattttcaca

SEQ ID NO: 5459968 - DNA, 15 bp, Homo sapiens
tgtattgcacattgt

SEQ ID NO: 5459969 - DNA, 23 bp, Homo sapiens
tgtattgccatcgggtgccaaat

SEQ ID NO: 5459970 - DNA, 16 bp, Homo sapiens
tgtattgcccccatgg

SEQ ID NO: 5459971 - DNA, 14 bp, Homo sapiens
tgtattgctcctcc

SEQ ID NO: 5459972 - DNA, 14 bp, Homo sapiens
tgtattgctgtcct

SEQ ID NO: 5459973 - DNA, 13 bp, Homo sapiens
tgtattggcagca

SEQ ID NO: 5459974 - DNA, 18 bp, Homo sapiens
tgtattggcagcacagct

SEQ ID NO: 5459975 - DNA, 19 bp, Homo sapiens
tgtattggcagcacagcta

SEQ ID NO: 5459976 - DNA, 23 bp, Homo sapiens
tgtattgggcagcagactgtgtt

SEQ ID NO: 5459977 - DNA, 15 bp, Homo sapiens
tgtattggtgaaaga

SEQ ID NO: 5459978 - DNA, 21 bp, Homo sapiens
tgtattggtgttgcagccgca

SEQ ID NO: 5459979 - DNA, 13 bp, Homo sapiens
tgtattgtaaaaa

SEQ ID NO: 5459980 - DNA, 15 bp, Homo sapiens
tgtattgtaaacatg

SEQ ID NO: 5459981 - DNA, 12 bp, Homo sapiens
tgtattgtaatg

SEQ ID NO: 5459982 - DNA, 19 bp, Homo sapiens
tgtattgtaccttttaaca

SEQ ID NO: 5459983 - DNA, 21 bp, Homo sapiens
tgtattgtaccttttaacacc

SEQ ID NO: 5459984 - DNA, 19 bp, Homo sapiens
tgtattgtcctattagtgt

SEQ ID NO: 5459985 - DNA, 20 bp, Homo sapiens
tgtattgtgagatcctgtga

SEQ ID NO: 5459986 - DNA, 19 bp, Homo sapiens
tgtattgtgcaatgtgtat

SEQ ID NO: 5459987 - DNA, 14 bp, Homo sapiens
tgtattgtggtatt

SEQ ID NO: 5459988 - DNA, 17 bp, Homo sapiens
tgtattgttagatgttt

SEQ ID NO: 5459989 - DNA, 13 bp, Homo sapiens
tgtattgttccca

SEQ ID NO: 5459990 - DNA, 18 bp, Homo sapiens
tgtattgttgaaaaagtt

SEQ ID NO: 5459991 - DNA, 18 bp, Homo sapiens
tgtattgttgtaaaatgt

SEQ ID NO: 5459992 - DNA, 13 bp, Homo sapiens
tgtattgtttcta

SEQ ID NO: 5459993 - DNA, 15 bp, Homo sapiens
tgtattgtttctaca

SEQ ID NO: 5459994 - DNA, 19 bp, Homo sapiens
tgtattgttttctgacagt

SEQ ID NO: 5459995 - DNA, 16 bp, Homo sapiens
tgtatttaaaaacaaa

SEQ ID NO: 5459996 - DNA, 15 bp, Homo sapiens
tgtatttaaaaacat

SEQ ID NO: 5459997 - DNA, 20 bp, Homo sapiens
tgtatttaaaaatagaaaca

SEQ ID NO: 5459998 - DNA, 22 bp, Homo sapiens
tgtatttaaaaccttgatttaa

SEQ ID NO: 5459999 - DNA, 13 bp, Homo sapiens
tgtatttaagaaa

SEQ ID NO: 5460000 - DNA, 14 bp, Homo sapiens
tgtatttaagacat

SEQ ID NO: 5460001 - DNA, 23 bp, Homo sapiens
tgtatttaagatgtacatttaat

SEQ ID NO: 5460002 - DNA, 11 bp, Homo sapiens
tgtatttaatt

SEQ ID NO: 5460003 - DNA, 13 bp, Homo sapiens
tgtatttaattgt

SEQ ID NO: 5460004 - DNA, 17 bp, Homo sapiens
tgtatttaattgtaaac

SEQ ID NO: 5460005 - DNA, 23 bp, Homo sapiens
tgtatttaattgtaaactgtact

SEQ ID NO: 5460006 - DNA, 15 bp, Homo sapiens
tgtatttaattttga

SEQ ID NO: 5460007 - DNA, 13 bp, Homo sapiens
tgtatttaccaaa

SEQ ID NO: 5460008 - DNA, 20 bp, Homo sapiens
tgtatttacgctttgattca

SEQ ID NO: 5460009 - DNA, 21 bp, Homo sapiens
tgtatttacgctttgattcat

SEQ ID NO: 5460010 - DNA, 18 bp, Homo sapiens
tgtatttagctacagctt

SEQ ID NO: 5460011 - DNA, 15 bp, Homo sapiens
tgtatttaggccatt

SEQ ID NO: 5460012 - DNA, 22 bp, Homo sapiens
tgtatttagtaaaaataaatca

SEQ ID NO: 5460013 - DNA, 16 bp, Homo sapiens
tgtatttagtagttat

SEQ ID NO: 5460014 - DNA, 14 bp, Homo sapiens
tgtatttataaata

SEQ ID NO: 5460015 - DNA, 15 bp, Homo sapiens
tgtatttataattta

SEQ ID NO: 5460016 - DNA, 21 bp, Homo sapiens
tgtatttataatttaaatgat

SEQ ID NO: 5460017 - DNA, 21 bp, Homo sapiens
tgtatttatattttgtgctat

SEQ ID NO: 5460018 - DNA, 21 bp, Homo sapiens
tgtatttatggaagaaagagt

SEQ ID NO: 5460019 - DNA, 14 bp, Homo sapiens
tgtatttatggatt

SEQ ID NO: 5460020 - DNA, 21 bp, Homo sapiens
tgtatttatggattaaaaact

SEQ ID NO: 5460021 - DNA, 22 bp, Homo sapiens
tgtatttatgtaatgaagtaaa

SEQ ID NO: 5460022 - DNA, 13 bp, Homo sapiens
tgtatttattaat

SEQ ID NO: 5460023 - DNA, 22 bp, Homo sapiens
tgtatttattaatttgaaacca

SEQ ID NO: 5460024 - DNA, 15 bp, Homo sapiens
tgtatttattatttg

SEQ ID NO: 5460025 - DNA, 23 bp, Homo sapiens
tgtatttattccatattcatgta

SEQ ID NO: 5460026 - DNA, 14 bp, Homo sapiens
tgtatttattcttt

SEQ ID NO: 5460027 - DNA, 22 bp, Homo sapiens
tgtatttattggttttgcagaa

SEQ ID NO: 5460028 - DNA, 17 bp, Homo sapiens
tgtatttattgtcatta

SEQ ID NO: 5460029 - DNA, 21 bp, Homo sapiens
tgtatttatttaaaactctgg

SEQ ID NO: 5460030 - DNA, 18 bp, Homo sapiens
tgtatttattttcctccc

SEQ ID NO: 5460031 - DNA, 22 bp, Homo sapiens
tgtatttcaaaccagtttcaca

SEQ ID NO: 5460032 - DNA, 14 bp, Homo sapiens
tgtatttcagtatt

SEQ ID NO: 5460033 - DNA, 14 bp, Homo sapiens
tgtatttcattatc

SEQ ID NO: 5460034 - DNA, 13 bp, Homo sapiens
tgtatttcattgc

SEQ ID NO: 5460035 - DNA, 15 bp, Homo sapiens
tgtatttccagtgca

SEQ ID NO: 5460036 - DNA, 22 bp, Homo sapiens
tgtatttccttttctaaatcct

SEQ ID NO: 5460037 - DNA, 13 bp, Homo sapiens
tgtatttctccat

SEQ ID NO: 5460038 - DNA, 17 bp, Homo sapiens
tgtatttctctgtgaat

SEQ ID NO: 5460039 - DNA, 22 bp, Homo sapiens
tgtatttctgtagaatgctgta

SEQ ID NO: 5460040 - DNA, 16 bp, Homo sapiens
tgtatttctgtggaaa

SEQ ID NO: 5460041 - DNA, 14 bp, Homo sapiens
tgtatttctttgta

SEQ ID NO: 5460042 - DNA, 13 bp, Homo sapiens
tgtatttctttta

SEQ ID NO: 5460043 - DNA, 15 bp, Homo sapiens
tgtatttcttttata

SEQ ID NO: 5460044 - DNA, 20 bp, Homo sapiens
tgtatttcttttatatataa

SEQ ID NO: 5460045 - DNA, 21 bp, Homo sapiens
tgtatttcttttatatataaa

SEQ ID NO: 5460046 - DNA, 12 bp, Homo sapiens
tgtatttgaaag

SEQ ID NO: 5460047 - DNA, 13 bp, Homo sapiens
tgtatttgaaagt

SEQ ID NO: 5460048 - DNA, 19 bp, Homo sapiens
tgtatttgaagactgattt

SEQ ID NO: 5460049 - DNA, 20 bp, Homo sapiens
tgtatttgaagactgatttt

SEQ ID NO: 5460050 - DNA, 12 bp, Homo sapiens
tgtatttggaaa

SEQ ID NO: 5460051 - DNA, 21 bp, Homo sapiens
tgtatttggaaataaagtcag

SEQ ID NO: 5460052 - DNA, 20 bp, Homo sapiens
tgtatttggaatatttgaat

SEQ ID NO: 5460053 - DNA, 16 bp, Homo sapiens
tgtatttgtagccagt

SEQ ID NO: 5460054 - DNA, 16 bp, Homo sapiens
tgtatttgtattaata

SEQ ID NO: 5460055 - DNA, 21 bp, Homo sapiens
tgtatttgtattaataaagca

SEQ ID NO: 5460056 - DNA, 14 bp, Homo sapiens
tgtatttgtattcc

SEQ ID NO: 5460057 - DNA, 14 bp, Homo sapiens
tgtatttgtgacta

SEQ ID NO: 5460058 - DNA, 15 bp, Homo sapiens
tgtatttgtgactaa

SEQ ID NO: 5460059 - DNA, 16 bp, Homo sapiens
tgtatttgtgactaat

SEQ ID NO: 5460060 - DNA, 14 bp, Homo sapiens
tgtatttgttaatt

SEQ ID NO: 5460061 - DNA, 17 bp, Homo sapiens
tgtatttgttaatttct

SEQ ID NO: 5460062 - DNA, 21 bp, Homo sapiens
tgtatttgttatatataataa

SEQ ID NO: 5460063 - DNA, 14 bp, Homo sapiens
tgtatttgttcatg

SEQ ID NO: 5460064 - DNA, 14 bp, Homo sapiens
tgtatttgtttgca

SEQ ID NO: 5460065 - DNA, 16 bp, Homo sapiens
tgtattttaaaataga

SEQ ID NO: 5460066 - DNA, 13 bp, Homo sapiens
tgtattttacaca

SEQ ID NO: 5460067 - DNA, 16 bp, Homo sapiens
tgtattttagcagaga

SEQ ID NO: 5460068 - DNA, 16 bp, Homo sapiens
tgtattttatgtatgt

SEQ ID NO: 5460069 - DNA, 19 bp, Homo sapiens
tgtattttatgtatgttta

SEQ ID NO: 5460070 - DNA, 17 bp, Homo sapiens
tgtattttatgttatat

SEQ ID NO: 5460071 - DNA, 11 bp, Homo sapiens
tgtattttatt

SEQ ID NO: 5460072 - DNA, 16 bp, Homo sapiens
tgtattttattcagta

SEQ ID NO: 5460073 - DNA, 18 bp, Homo sapiens
tgtattttcaaagactgc

SEQ ID NO: 5460074 - DNA, 14 bp, Homo sapiens
tgtattttcaactt

SEQ ID NO: 5460075 - DNA, 20 bp, Homo sapiens
tgtattttcaataaagaaaa

SEQ ID NO: 5460076 - DNA, 22 bp, Homo sapiens
tgtattttcaataaagaaaaaa

SEQ ID NO: 5460077 - DNA, 14 bp, Homo sapiens
tgtattttcagctc

SEQ ID NO: 5460078 - DNA, 14 bp, Homo sapiens
tgtattttcatagt

SEQ ID NO: 5460079 - DNA, 12 bp, Homo sapiens
tgtattttcatg

SEQ ID NO: 5460080 - DNA, 16 bp, Homo sapiens
tgtattttcatgaaaa

SEQ ID NO: 5460081 - DNA, 10 bp, Homo sapiens
tgtattttcc

SEQ ID NO: 5460082 - DNA, 20 bp, Homo sapiens
tgtattttccaagtgtgcat

SEQ ID NO: 5460083 - DNA, 14 bp, Homo sapiens
tgtattttccacct

SEQ ID NO: 5460084 - DNA, 12 bp, Homo sapiens
tgtattttccat

SEQ ID NO: 5460085 - DNA, 14 bp, Homo sapiens
tgtattttccatac

SEQ ID NO: 5460086 - DNA, 15 bp, Homo sapiens
tgtattttcctaatg

SEQ ID NO: 5460087 - DNA, 16 bp, Homo sapiens
tgtattttctgtcact

SEQ ID NO: 5460088 - DNA, 19 bp, Homo sapiens
tgtattttctgtcactgta

SEQ ID NO: 5460089 - DNA, 15 bp, Homo sapiens
tgtattttcttaata

SEQ ID NO: 5460090 - DNA, 22 bp, Homo sapiens
tgtattttcttcccatttgtaa

SEQ ID NO: 5460091 - DNA, 16 bp, Homo sapiens
tgtattttctttctct

SEQ ID NO: 5460092 - DNA, 23 bp, Homo sapiens
tgtattttcttttatatctgtaa

SEQ ID NO: 5460093 - DNA, 17 bp, Homo sapiens
tgtattttgacaaaaat

SEQ ID NO: 5460094 - DNA, 15 bp, Homo sapiens
tgtattttgatgaga

SEQ ID NO: 5460095 - DNA, 18 bp, Homo sapiens
tgtattttgatgagatat

SEQ ID NO: 5460096 - DNA, 14 bp, Homo sapiens
tgtattttggaaga

SEQ ID NO: 5460097 - DNA, 22 bp, Homo sapiens
tgtgaaatctcagaatttatct

SEQ ID NO: 5460098 - DNA, 17 bp, Homo sapiens
tgtgaaatctgtctttg

SEQ ID NO: 5460099 - DNA, 18 bp, Homo sapiens
tgtgaaatctttcaagtt

SEQ ID NO: 5460100 - DNA, 22 bp, Homo sapiens
tgtgaaatgcttttatattcta

SEQ ID NO: 5460101 - DNA, 17 bp, Homo sapiens
tgtgaaatgtaacatga

SEQ ID NO: 5460102 - DNA, 16 bp, Homo sapiens
tgtgaaattctcagag

SEQ ID NO: 5460103 - DNA, 15 bp, Homo sapiens
tgtgaaattgtgtag

SEQ ID NO: 5460104 - DNA, 22 bp, Homo sapiens
tgtgaaatttcatgaaaacttt

SEQ ID NO: 5460105 - DNA, 21 bp, Homo sapiens
tgtgaaatttgttaatatata

SEQ ID NO: 5460106 - DNA, 20 bp, Homo sapiens
tgtgaacaaaagatgctctt

SEQ ID NO: 5460107 - DNA, 18 bp, Homo sapiens
tgtgaacaactgtttgtc

SEQ ID NO: 5460108 - DNA, 23 bp, Homo sapiens
tgtgaacaagcttcagtaagtta

SEQ ID NO: 5460109 - DNA, 23 bp, Homo sapiens
tgtgaacagagagacccttgtgg

SEQ ID NO: 5460110 - DNA, 17 bp, Homo sapiens
tgtgaacagtacagtat

SEQ ID NO: 5460111 - DNA, 22 bp, Homo sapiens
tgtgaacagttgtgtttgaagc

SEQ ID NO: 5460112 - DNA, 14 bp, Homo sapiens
tgtgaacatgcctt

SEQ ID NO: 5460113 - DNA, 14 bp, Homo sapiens
tgtgaacattccta

SEQ ID NO: 5460114 - DNA, 15 bp, Homo sapiens
tgtgaacattcctat

SEQ ID NO: 5460115 - DNA, 14 bp, Homo sapiens
tgtgaacatttgtg

SEQ ID NO: 5460116 - DNA, 19 bp, Homo sapiens
tgtgaaccaactgccttaa

SEQ ID NO: 5460117 - DNA, 16 bp, Homo sapiens
tgtgaaccaagatcta

SEQ ID NO: 5460118 - DNA, 15 bp, Homo sapiens
tgtgaaccaccacac

SEQ ID NO: 5460119 - DNA, 16 bp, Homo sapiens
tgtgaaccaccacacc

SEQ ID NO: 5460120 - DNA, 20 bp, Homo sapiens
tgtgaaccaccacacccagc

SEQ ID NO: 5460121 - DNA, 17 bp, Homo sapiens
tgtgaaccactgtgccc

SEQ ID NO: 5460122 - DNA, 13 bp, Homo sapiens
tgtgaacccagga

SEQ ID NO: 5460123 - DNA, 20 bp, Homo sapiens
tgtgaaccctggggcctgac

SEQ ID NO: 5460124 - DNA, 17 bp, Homo sapiens
tgtgaaccgaggggctc

SEQ ID NO: 5460125 - DNA, 15 bp, Homo sapiens
tgtgaaccggctccc

SEQ ID NO: 5460126 - DNA, 15 bp, Homo sapiens
tgtgaacctacctgc

SEQ ID NO: 5460127 - DNA, 18 bp, Homo sapiens
tgtgaacctacctgcctt

SEQ ID NO: 5460128 - DNA, 21 bp, Homo sapiens
tgtgaacgatttagaaagaag

SEQ ID NO: 5460129 - DNA, 19 bp, Homo sapiens
tgtgaactaaactttcaca

SEQ ID NO: 5460130 - DNA, 18 bp, Homo sapiens
tgtgaactaagttattgc

SEQ ID NO: 5460131 - DNA, 19 bp, Homo sapiens
tgtgaactaagttattgct

SEQ ID NO: 5460132 - DNA, 20 bp, Homo sapiens
tgtgaactaagttattgctg

SEQ ID NO: 5460133 - DNA, 20 bp, Homo sapiens
tgtgaactagggaagctcag

SEQ ID NO: 5460134 - DNA, 21 bp, Homo sapiens
tgtgaactatcccctgcgctt

SEQ ID NO: 5460135 - DNA, 13 bp, Homo sapiens
tgtgaactatttt

SEQ ID NO: 5460136 - DNA, 21 bp, Homo sapiens
tgtgaactattttgaagaaaa

SEQ ID NO: 5460137 - DNA, 14 bp, Homo sapiens
tgtgaactcaccct

SEQ ID NO: 5460138 - DNA, 16 bp, Homo sapiens
tgtgaactcagccaag

SEQ ID NO: 5460139 - DNA, 16 bp, Homo sapiens
tgtgaactccatcatt

SEQ ID NO: 5460140 - DNA, 14 bp, Homo sapiens
tgtgaactgaactc

SEQ ID NO: 5460141 - DNA, 15 bp, Homo sapiens
tgtgaactgacaggc

SEQ ID NO: 5460142 - DNA, 14 bp, Homo sapiens
tgtgaactgccagg

SEQ ID NO: 5460143 - DNA, 18 bp, Homo sapiens
tgtgaactggaccctgtt

SEQ ID NO: 5460144 - DNA, 17 bp, Homo sapiens
tgtgaactgtcatgata

SEQ ID NO: 5460145 - DNA, 12 bp, Homo sapiens
tgtgaactgtgt

SEQ ID NO: 5460146 - DNA, 13 bp, Homo sapiens
tgtgaactgtgtg

SEQ ID NO: 5460147 - DNA, 14 bp, Homo sapiens
tgtgaactgtgtgt

SEQ ID NO: 5460148 - DNA, 14 bp, Homo sapiens
tgtgaacttgaaat

SEQ ID NO: 5460149 - DNA, 15 bp, Homo sapiens
tgtgaacttgaaatt

SEQ ID NO: 5460150 - DNA, 21 bp, Homo sapiens
tgtgaacttgtagctgtaaaa

SEQ ID NO: 5460151 - DNA, 21 bp, Homo sapiens
tgtgaactttctcagcatata

SEQ ID NO: 5460152 - DNA, 14 bp, Homo sapiens
tgtgaagaaaaaga

SEQ ID NO: 5460153 - DNA, 15 bp, Homo sapiens
tgtgaagaaacattt

SEQ ID NO: 5460154 - DNA, 22 bp, Homo sapiens
tgtgaagaaagcctcagtgaaa

SEQ ID NO: 5460155 - DNA, 15 bp, Homo sapiens
tgtgaagaaataagt

SEQ ID NO: 5460156 - DNA, 18 bp, Homo sapiens
tgtgaagaagccctgttc

SEQ ID NO: 5460157 - DNA, 17 bp, Homo sapiens
tgtgaagaatgtctgta

SEQ ID NO: 5460158 - DNA, 12 bp, Homo sapiens
tgtgaagacact

SEQ ID NO: 5460159 - DNA, 17 bp, Homo sapiens
tgtgaagacactgtgca

SEQ ID NO: 5460160 - DNA, 21 bp, Homo sapiens
tgtgaagacactgtgcaggcc

SEQ ID NO: 5460161 - DNA, 22 bp, Homo sapiens
tgtgaagacactgtgcaggccc

SEQ ID NO: 5460162 - DNA, 14 bp, Homo sapiens
tgtgaagacatttt

SEQ ID NO: 5460163 - DNA, 19 bp, Homo sapiens
tgtgaagacattttttgct

SEQ ID NO: 5460164 - DNA, 21 bp, Homo sapiens
tgtgaagacccaaaacagctt

SEQ ID NO: 5460165 - DNA, 23 bp, Homo sapiens
tgtgaagacccaaaacagctttg

SEQ ID NO: 5460166 - DNA, 13 bp, Homo sapiens
tgtgaagacccag

SEQ ID NO: 5460167 - DNA, 15 bp, Homo sapiens
tgtgaagagactctg

SEQ ID NO: 5460168 - DNA, 16 bp, Homo sapiens
tgtgaagaggaacagt

SEQ ID NO: 5460169 - DNA, 22 bp, Homo sapiens
tgtgaagatgatatactatttt

SEQ ID NO: 5460170 - DNA, 14 bp, Homo sapiens
tgtgaagcaaaatt

SEQ ID NO: 5460171 - DNA, 10 bp, Homo sapiens
tgtgaagcca

SEQ ID NO: 5460172 - DNA, 20 bp, Homo sapiens
tgtgaagccaattcagacag

SEQ ID NO: 5460173 - DNA, 15 bp, Homo sapiens
tgtgaagccagatct

SEQ ID NO: 5460174 - DNA, 23 bp, Homo sapiens
tgtgaagccatgagttccagaaa

SEQ ID NO: 5460175 - DNA, 20 bp, Homo sapiens
tgtgaagcctggagctttcc

SEQ ID NO: 5460176 - DNA, 22 bp, Homo sapiens
tgtgaagcctgtcgtgttctct

SEQ ID NO: 5460177 - DNA, 19 bp, Homo sapiens
tgtgaagctaatgaccaac

SEQ ID NO: 5460178 - DNA, 12 bp, Homo sapiens
tgtgaagctgga

SEQ ID NO: 5460179 - DNA, 22 bp, Homo sapiens
tgtgaagcttaagggtcatatg

SEQ ID NO: 5460180 - DNA, 18 bp, Homo sapiens
tgtgaaggaaaaacatgc

SEQ ID NO: 5460181 - DNA, 13 bp, Homo sapiens
tgtgaaggaccct

SEQ ID NO: 5460182 - DNA, 22 bp, Homo sapiens
tgtgaaggattatggaaaaata

SEQ ID NO: 5460183 - DNA, 23 bp, Homo sapiens
tgtgaaggcagagaaagggacaa

SEQ ID NO: 5460184 - DNA, 13 bp, Homo sapiens
tgtgaaggcccaa

SEQ ID NO: 5460185 - DNA, 21 bp, Homo sapiens
tgtgaaggcccaagagcagag

SEQ ID NO: 5460186 - DNA, 18 bp, Homo sapiens
tgtgaagggaaagaaatt

SEQ ID NO: 5460187 - DNA, 15 bp, Homo sapiens
tgtgaagtattcaca

SEQ ID NO: 5460188 - DNA, 18 bp, Homo sapiens
tgtgaagtgaatgaaaca

SEQ ID NO: 5460189 - DNA, 23 bp, Homo sapiens
tgtgaagtgatgttcagatttct

SEQ ID NO: 5460190 - DNA, 17 bp, Homo sapiens
tgtgaagtgattgacat

SEQ ID NO: 5460191 - DNA, 14 bp, Homo sapiens
tgtgaagttacatg

SEQ ID NO: 5460192 - DNA, 20 bp, Homo sapiens
tgtgaagttacatgcataaa

SEQ ID NO: 5460193 - DNA, 17 bp, Homo sapiens
tgtgaataataaataca

SEQ ID NO: 5460194 - DNA, 16 bp, Homo sapiens
tgtgaataattacagt

SEQ ID NO: 5460195 - DNA, 11 bp, Homo sapiens
tgtgaatacaa

SEQ ID NO: 5460196 - DNA, 12 bp, Homo sapiens
tgtgaatacaat

SEQ ID NO: 5460197 - DNA, 12 bp, Homo sapiens
tgtgaatacatt

SEQ ID NO: 5460198 - DNA, 14 bp, Homo sapiens
tgtgaatacattct

SEQ ID NO: 5460199 - DNA, 21 bp, Homo sapiens
tgtgaatacctgctcacgtca

SEQ ID NO: 5460200 - DNA, 21 bp, Homo sapiens
tgtgaatatccagaaataaaa

SEQ ID NO: 5460201 - DNA, 23 bp, Homo sapiens
tgtgaatatccagaaataaaaca

SEQ ID NO: 5460202 - DNA, 13 bp, Homo sapiens
tgtgaatatgtgt

SEQ ID NO: 5460203 - DNA, 19 bp, Homo sapiens
tgtgaatatgtgtaacttt

SEQ ID NO: 5460204 - DNA, 13 bp, Homo sapiens
tgtgaatattcct

SEQ ID NO: 5460205 - DNA, 23 bp, Homo sapiens
tgtgaatattcctttattttgct

SEQ ID NO: 5460206 - DNA, 17 bp, Homo sapiens
tgtgaatattgtggctc

SEQ ID NO: 5460207 - DNA, 21 bp, Homo sapiens
tgtgaatatttccatatggat

SEQ ID NO: 5460208 - DNA, 18 bp, Homo sapiens
tgtgaatattttcaacta

SEQ ID NO: 5460209 - DNA, 18 bp, Homo sapiens
tgtgaatcagaccctacc

SEQ ID NO: 5460210 - DNA, 16 bp, Homo sapiens
tgtgaatcattttacc

SEQ ID NO: 5460211 - DNA, 22 bp, Homo sapiens
tgtgaatccaggaggcagtgga

SEQ ID NO: 5460212 - DNA, 14 bp, Homo sapiens
tgtgaatcctggca

SEQ ID NO: 5460213 - DNA, 14 bp, Homo sapiens
tgtgaatcgcaagg

SEQ ID NO: 5460214 - DNA, 19 bp, Homo sapiens
tgtgaatcgcaaggcctgt

SEQ ID NO: 5460215 - DNA, 19 bp, Homo sapiens
tgtgaatcgcagctgtggg

SEQ ID NO: 5460216 - DNA, 21 bp, Homo sapiens
tgtgaatctgaactgctctac

SEQ ID NO: 5460217 - DNA, 15 bp, Homo sapiens
tgtgaatcttaacat

SEQ ID NO: 5460218 - DNA, 19 bp, Homo sapiens
tgtgaatcttaacattttg

SEQ ID NO: 5460219 - DNA, 23 bp, Homo sapiens
tgtgaatcttaacattttggtga

SEQ ID NO: 5460220 - DNA, 19 bp, Homo sapiens
tgtgaatgaatacacagga

SEQ ID NO: 5460221 - DNA, 11 bp, Homo sapiens
tgtgaatgcac

SEQ ID NO: 5460222 - DNA, 12 bp, Homo sapiens
tgtgaatgctaa

SEQ ID NO: 5460223 - DNA, 16 bp, Homo sapiens
tgtgaatgctgtacct

SEQ ID NO: 5460224 - DNA, 17 bp, Homo sapiens
tgtgaatgctgtacctt

SEQ ID NO: 5460225 - DNA, 15 bp, Homo sapiens
tgtgaatgcttctca

SEQ ID NO: 5460226 - DNA, 18 bp, Homo sapiens
tgtgaatgcttctgattt

SEQ ID NO: 5460227 - DNA, 14 bp, Homo sapiens
tgtgaatggaagca

SEQ ID NO: 5460228 - DNA, 23 bp, Homo sapiens
tgtgaatggaagcaaagtgctgg

SEQ ID NO: 5460229 - DNA, 22 bp, Homo sapiens
tgtgaatggaggcagagacctc

SEQ ID NO: 5460230 - DNA, 22 bp, Homo sapiens
tgtgaatggcaaataaacagtt

SEQ ID NO: 5460231 - DNA, 14 bp, Homo sapiens
tgtgaatgtgagtg

SEQ ID NO: 5460232 - DNA, 21 bp, Homo sapiens
tgtgaatgttgtgatgtattc

SEQ ID NO: 5460233 - DNA, 19 bp, Homo sapiens
tgtgaattactaacttcta

SEQ ID NO: 5460234 - DNA, 20 bp, Homo sapiens
tgtgaattactaacttctaa

SEQ ID NO: 5460235 - DNA, 20 bp, Homo sapiens
tgtgaattagctcacttggt

SEQ ID NO: 5460236 - DNA, 24 bp, Homo sapiens
tgtgaattaggctgtaactacttt

SEQ ID NO: 5460237 - DNA, 20 bp, Homo sapiens
tgtgaattcaatacaggcta

SEQ ID NO: 5460238 - DNA, 16 bp, Homo sapiens
tgtgaattcccagact

SEQ ID NO: 5460239 - DNA, 15 bp, Homo sapiens
tgtgaattcccaggt

SEQ ID NO: 5460240 - DNA, 18 bp, Homo sapiens
tgtgaattgagctgcaga

SEQ ID NO: 5460241 - DNA, 16 bp, Homo sapiens
tgtgaattgataataa

SEQ ID NO: 5460242 - DNA, 16 bp, Homo sapiens
tgtgaattgcctgcca

SEQ ID NO: 5460243 - DNA, 18 bp, Homo sapiens
tgtgaattgtggctgttc

SEQ ID NO: 5460244 - DNA, 19 bp, Homo sapiens
tgtgaatttgagtttgctg

SEQ ID NO: 5460245 - DNA, 14 bp, Homo sapiens
tgtgaatttgccag

SEQ ID NO: 5460246 - DNA, 15 bp, Homo sapiens
tgtgaatttgccaga

SEQ ID NO: 5460247 - DNA, 19 bp, Homo sapiens
tgtgaatttgtttgtgaca

SEQ ID NO: 5460248 - DNA, 14 bp, Homo sapiens
tgtgaatttttaag

SEQ ID NO: 5460249 - DNA, 17 bp, Homo sapiens
tgtgaatttttaagctg

SEQ ID NO: 5460250 - DNA, 15 bp, Homo sapiens
tgtgaatttttattg

SEQ ID NO: 5460251 - DNA, 17 bp, Homo sapiens
tgtgaatttttattgtt

SEQ ID NO: 5460252 - DNA, 17 bp, Homo sapiens
tgtgaatttttgcctat

SEQ ID NO: 5460253 - DNA, 20 bp, Homo sapiens
tgtgaatttttgcctatctt

SEQ ID NO: 5460254 - DNA, 12 bp, Homo sapiens
tgtgacaaaaaa

SEQ ID NO: 5460255 - DNA, 16 bp, Homo sapiens
tgtgacaaagaagacc

SEQ ID NO: 5460256 - DNA, 19 bp, Homo sapiens
tgtgacaaaggatgaagaa

SEQ ID NO: 5460257 - DNA, 20 bp, Homo sapiens
tgtgacaaaggatgaagaac

SEQ ID NO: 5460258 - DNA, 17 bp, Homo sapiens
tgtgacaacctttgtgt

SEQ ID NO: 5460259 - DNA, 15 bp, Homo sapiens
tgtgacaactaaaca

SEQ ID NO: 5460260 - DNA, 21 bp, Homo sapiens
tgtgacaactgtctaacttta

SEQ ID NO: 5460261 - DNA, 13 bp, Homo sapiens
tgtgacaaggcta

SEQ ID NO: 5460262 - DNA, 20 bp, Homo sapiens
tgtgacaatgactaagccaa

SEQ ID NO: 5460263 - DNA, 22 bp, Homo sapiens
tgtgacaatgactaagccaagc

SEQ ID NO: 5460264 - DNA, 15 bp, Homo sapiens
tgtgacaattctgtt

SEQ ID NO: 5460265 - DNA, 19 bp, Homo sapiens
tgtgacaattttgtacaaa

SEQ ID NO: 5460266 - DNA, 18 bp, Homo sapiens
tgtgacacatcaagcttt

SEQ ID NO: 5460267 - DNA, 19 bp, Homo sapiens
tgtgacaccaccactgtgt

SEQ ID NO: 5460268 - DNA, 19 bp, Homo sapiens
tgtgacaccccccttctga

SEQ ID NO: 5460269 - DNA, 16 bp, Homo sapiens
tgtgacacctaactct

SEQ ID NO: 5460270 - DNA, 22 bp, Homo sapiens
tgtgacacctggtgcgggcctg

SEQ ID NO: 5460271 - DNA, 14 bp, Homo sapiens
tgtgacactgatga

SEQ ID NO: 5460272 - DNA, 18 bp, Homo sapiens
tgtgacagattatacaga

SEQ ID NO: 5460273 - DNA, 16 bp, Homo sapiens
tgtgacagcagctctg

SEQ ID NO: 5460274 - DNA, 14 bp, Homo sapiens
tgtgcattgtggct

SEQ ID NO: 5460275 - DNA, 15 bp, Homo sapiens
tgtgcattgtgtgtc

SEQ ID NO: 5460276 - DNA, 21 bp, Homo sapiens
tgtgcattgtgtgtcacaaag

SEQ ID NO: 5460277 - DNA, 14 bp, Homo sapiens
tgtgcatttgtaaa

SEQ ID NO: 5460278 - DNA, 19 bp, Homo sapiens
tgtgcatttgtgtctgcct

SEQ ID NO: 5460279 - DNA, 22 bp, Homo sapiens
tgtgcatttgtgtctgcctgcc

SEQ ID NO: 5460280 - DNA, 14 bp, Homo sapiens
tgtgcatttgttca

SEQ ID NO: 5460281 - DNA, 18 bp, Homo sapiens
tgtgcatttgttcagctc

SEQ ID NO: 5460282 - DNA, 20 bp, Homo sapiens
tgtgcattttattgactggg

SEQ ID NO: 5460283 - DNA, 19 bp, Homo sapiens
tgtgcattttctaaacaga

SEQ ID NO: 5460284 - DNA, 21 bp, Homo sapiens
tgtgcatttttgtgaaatgaa

SEQ ID NO: 5460285 - DNA, 14 bp, Homo sapiens
tgtgccaaagatag

SEQ ID NO: 5460286 - DNA, 17 bp, Homo sapiens
tgtgccaaagcaggtca

SEQ ID NO: 5460287 - DNA, 13 bp, Homo sapiens
tgtgccaacctga

SEQ ID NO: 5460288 - DNA, 17 bp, Homo sapiens
tgtgccaagacattaat

SEQ ID NO: 5460289 - DNA, 14 bp, Homo sapiens
tgtgccaagagcta

SEQ ID NO: 5460290 - DNA, 14 bp, Homo sapiens
tgtgccaagattta

SEQ ID NO: 5460291 - DNA, 12 bp, Homo sapiens
tgtgccaagcct

SEQ ID NO: 5460292 - DNA, 14 bp, Homo sapiens
tgtgccaagccttc

SEQ ID NO: 5460293 - DNA, 16 bp, Homo sapiens
tgtgccaatatgtatt

SEQ ID NO: 5460294 - DNA, 23 bp, Homo sapiens
tgtgccacacttcgctcttgagg

SEQ ID NO: 5460295 - DNA, 13 bp, Homo sapiens
tgtgccacagagg

SEQ ID NO: 5460296 - DNA, 14 bp, Homo sapiens
tgtgccacagaggc

SEQ ID NO: 5460297 - DNA, 20 bp, Homo sapiens
tgtgccacagaggccccacc

SEQ ID NO: 5460298 - DNA, 22 bp, Homo sapiens
tgtgccacagagtgtagccagg

SEQ ID NO: 5460299 - DNA, 15 bp, Homo sapiens
tgtgccacagatctt

SEQ ID NO: 5460300 - DNA, 12 bp, Homo sapiens
tgtgccacaggc

SEQ ID NO: 5460301 - DNA, 17 bp, Homo sapiens
tgtgccaccacccctcc

SEQ ID NO: 5460302 - DNA, 19 bp, Homo sapiens
tgtgccaccacgcccggct

SEQ ID NO: 5460303 - DNA, 16 bp, Homo sapiens
tgtgccacccaccagg

SEQ ID NO: 5460304 - DNA, 22 bp, Homo sapiens
tgtgccaccctctgcagggcag

SEQ ID NO: 5460305 - DNA, 14 bp, Homo sapiens
tgtgccaccctggg

SEQ ID NO: 5460306 - DNA, 14 bp, Homo sapiens
tgtgccacctgtcc

SEQ ID NO: 5460307 - DNA, 20 bp, Homo sapiens
tgtgccacgctcctctgttt

SEQ ID NO: 5460308 - DNA, 13 bp, Homo sapiens
tgtgccactgact

SEQ ID NO: 5460309 - DNA, 21 bp, Homo sapiens
tgtgccagacaaataggagtg

SEQ ID NO: 5460310 - DNA, 14 bp, Homo sapiens
tgtgccagagcctg

SEQ ID NO: 5460311 - DNA, 20 bp, Homo sapiens
tgtgccagagcctggggctc

SEQ ID NO: 5460312 - DNA, 22 bp, Homo sapiens
tgtgccagagcctggggctcta

SEQ ID NO: 5460313 - DNA, 22 bp, Homo sapiens
tgtgccagaggaatcctggcag

SEQ ID NO: 5460314 - DNA, 17 bp, Homo sapiens
tgtgccagatgccctgt

SEQ ID NO: 5460315 - DNA, 18 bp, Homo sapiens
tgtgccagatttatgcat

SEQ ID NO: 5460316 - DNA, 14 bp, Homo sapiens
tgtgccagcccgga

SEQ ID NO: 5460317 - DNA, 13 bp, Homo sapiens
tgtgccagctgct

SEQ ID NO: 5460318 - DNA, 20 bp, Homo sapiens
tgtgccagctgcttctgccc

SEQ ID NO: 5460319 - DNA, 21 bp, Homo sapiens
tgtgccaggactctctttctt

SEQ ID NO: 5460320 - DNA, 23 bp, Homo sapiens
tgtgccaggaggcggcagctctt

SEQ ID NO: 5460321 - DNA, 22 bp, Homo sapiens
tgtgccaggagtgggtgggaca

SEQ ID NO: 5460322 - DNA, 13 bp, Homo sapiens
tgtgccaggctga

SEQ ID NO: 5460323 - DNA, 19 bp, Homo sapiens
tgtgccaggcttgcctggg

SEQ ID NO: 5460324 - DNA, 13 bp, Homo sapiens
tgtgccagggcag

SEQ ID NO: 5460325 - DNA, 14 bp, Homo sapiens
tgtgccatagaaca

SEQ ID NO: 5460326 - DNA, 21 bp, Homo sapiens
tgtgccatagagtttaacaca

SEQ ID NO: 5460327 - DNA, 10 bp, Homo sapiens
tgtgccatca

SEQ ID NO: 5460328 - DNA, 13 bp, Homo sapiens
tgtgccatcacca

SEQ ID NO: 5460329 - DNA, 15 bp, Homo sapiens
tgtgccatcatgcct

SEQ ID NO: 5460330 - DNA, 23 bp, Homo sapiens
tgtgccatctgtacatattactg

SEQ ID NO: 5460331 - DNA, 14 bp, Homo sapiens
tgtgccatgcccaa

SEQ ID NO: 5460332 - DNA, 14 bp, Homo sapiens
tgtgccatgctggg

SEQ ID NO: 5460333 - DNA, 17 bp, Homo sapiens
tgtgccatggatctgat

SEQ ID NO: 5460334 - DNA, 19 bp, Homo sapiens
tgtgccatggatctgatct

SEQ ID NO: 5460335 - DNA, 23 bp, Homo sapiens
tgtgccatgtataatttttttct

SEQ ID NO: 5460336 - DNA, 16 bp, Homo sapiens
tgtgccatgtgccagg

SEQ ID NO: 5460337 - DNA, 19 bp, Homo sapiens
tgtgccatgttcaaaagaa

SEQ ID NO: 5460338 - DNA, 18 bp, Homo sapiens
tgtgccattatatttgca

SEQ ID NO: 5460339 - DNA, 18 bp, Homo sapiens
tgtgcccaaaagccatgt

SEQ ID NO: 5460340 - DNA, 17 bp, Homo sapiens
tgtgcccaagtgggcag

SEQ ID NO: 5460341 - DNA, 20 bp, Homo sapiens
tgtgcccaagtgggcagtca

SEQ ID NO: 5460342 - DNA, 12 bp, Homo sapiens
tgtgcccaagtt

SEQ ID NO: 5460343 - DNA, 17 bp, Homo sapiens
tgtgcccacatcccagg

SEQ ID NO: 5460344 - DNA, 23 bp, Homo sapiens
tgtgcccacggtctgagctagct

SEQ ID NO: 5460345 - DNA, 15 bp, Homo sapiens
tgtgcccacgtgtgc

SEQ ID NO: 5460346 - DNA, 21 bp, Homo sapiens
tgtgcccacgtgtgcagactg

SEQ ID NO: 5460347 - DNA, 16 bp, Homo sapiens
tgtgcccacttaccct

SEQ ID NO: 5460348 - DNA, 17 bp, Homo sapiens
tgtgcccagaatactga

SEQ ID NO: 5460349 - DNA, 21 bp, Homo sapiens
tgtgcccagaatactgatgga

SEQ ID NO: 5460350 - DNA, 12 bp, Homo sapiens
tgtgcccagagt

SEQ ID NO: 5460351 - DNA, 16 bp, Homo sapiens
tgtgcccagcaggccc

SEQ ID NO: 5460352 - DNA, 19 bp, Homo sapiens
tgtgcccagcaggcccagc

SEQ ID NO: 5460353 - DNA, 21 bp, Homo sapiens
tgtgcccagcagtttcccaga

SEQ ID NO: 5460354 - DNA, 15 bp, Homo sapiens
tgtgcccagggtggc

SEQ ID NO: 5460355 - DNA, 20 bp, Homo sapiens
tgtgcccagtcatgacattt

SEQ ID NO: 5460356 - DNA, 21 bp, Homo sapiens
tgtgcccagttaatcttgctt

SEQ ID NO: 5460357 - DNA, 19 bp, Homo sapiens
tgtgcccatcatctctgcc

SEQ ID NO: 5460358 - DNA, 22 bp, Homo sapiens
tgtgcccatcatctctgccttt

SEQ ID NO: 5460359 - DNA, 18 bp, Homo sapiens
tgtgcccatgggcactgc

SEQ ID NO: 5460360 - DNA, 19 bp, Homo sapiens
tgtgcccatgggcactgct

SEQ ID NO: 5460361 - DNA, 14 bp, Homo sapiens
tgtgcccattccta

SEQ ID NO: 5460362 - DNA, 14 bp, Homo sapiens
tgtgccccactcca

SEQ ID NO: 5460363 - DNA, 17 bp, Homo sapiens
tgtgccccactccagcc

SEQ ID NO: 5460364 - DNA, 14 bp, Homo sapiens
tgtgccccagctgc

SEQ ID NO: 5460365 - DNA, 17 bp, Homo sapiens
tgtgccccagctgccag

SEQ ID NO: 5460366 - DNA, 15 bp, Homo sapiens
tgtgccccatgcctg

SEQ ID NO: 5460367 - DNA, 16 bp, Homo sapiens
tgtgccccatgtccaa

SEQ ID NO: 5460368 - DNA, 23 bp, Homo sapiens
tgtgcccccaaccatttcctcag

SEQ ID NO: 5460369 - DNA, 16 bp, Homo sapiens
tgtgcccccaccccca

SEQ ID NO: 5460370 - DNA, 16 bp, Homo sapiens
tgtgcccccagacgca

SEQ ID NO: 5460371 - DNA, 22 bp, Homo sapiens
tgtgcccccagacgcacgtggg

SEQ ID NO: 5460372 - DNA, 13 bp, Homo sapiens
tgtgcccccagcc

SEQ ID NO: 5460373 - DNA, 14 bp, Homo sapiens
tgtgcccccagcct

SEQ ID NO: 5460374 - DNA, 22 bp, Homo sapiens
tgtgcccccagggtcctgggag

SEQ ID NO: 5460375 - DNA, 18 bp, Homo sapiens
tgtgccccccatcctggc

SEQ ID NO: 5460376 - DNA, 14 bp, Homo sapiens
tgtgccccctctac

SEQ ID NO: 5460377 - DNA, 14 bp, Homo sapiens
tgtgccccctctgg

SEQ ID NO: 5460378 - DNA, 15 bp, Homo sapiens
tgtgcccctccaagt

SEQ ID NO: 5460379 - DNA, 16 bp, Homo sapiens
tgtgcccctccaagtc

SEQ ID NO: 5460380 - DNA, 14 bp, Homo sapiens
tgtgcccctcctgg

SEQ ID NO: 5460381 - DNA, 21 bp, Homo sapiens
tgtgcccctgatgcagcctgt

SEQ ID NO: 5460382 - DNA, 18 bp, Homo sapiens
tgtgcccctgccaaggcc

SEQ ID NO: 5460383 - DNA, 15 bp, Homo sapiens
tgtgcccctggccca

SEQ ID NO: 5460384 - DNA, 13 bp, Homo sapiens
tgtgccccttccc

SEQ ID NO: 5460385 - DNA, 20 bp, Homo sapiens
tgtgccccttccgccactgg

SEQ ID NO: 5460386 - DNA, 22 bp, Homo sapiens
tgtgcccgccctgggctgggcc

SEQ ID NO: 5460387 - DNA, 17 bp, Homo sapiens
tgtgcccgctgcgctgc

SEQ ID NO: 5460388 - DNA, 19 bp, Homo sapiens
tgtgcccgctgcgctgccc

SEQ ID NO: 5460389 - DNA, 22 bp, Homo sapiens
tgtgcccgctgcgctgccctgc

SEQ ID NO: 5460390 - DNA, 14 bp, Homo sapiens
tgtgcccgtgtgtg

SEQ ID NO: 5460391 - DNA, 21 bp, Homo sapiens
tgtgccctaaagtgtattttt

SEQ ID NO: 5460392 - DNA, 19 bp, Homo sapiens
tgtgccctagatgcacgtg

SEQ ID NO: 5460393 - DNA, 19 bp, Homo sapiens
tgtgccctagggctcagag

SEQ ID NO: 5460394 - DNA, 16 bp, Homo sapiens
tgtgccctcaccacca

SEQ ID NO: 5460395 - DNA, 18 bp, Homo sapiens
tgtgccctcaccaccaca

SEQ ID NO: 5460396 - DNA, 15 bp, Homo sapiens
tgtgccctccaaaga

SEQ ID NO: 5460397 - DNA, 17 bp, Homo sapiens
tgtgccctcctgaccca

SEQ ID NO: 5460398 - DNA, 23 bp, Homo sapiens
tgtgccctcctgacccattgctg

SEQ ID NO: 5460399 - DNA, 18 bp, Homo sapiens
tgtgccctcctgggagct

SEQ ID NO: 5460400 - DNA, 13 bp, Homo sapiens
tgtgccctctggg

SEQ ID NO: 5460401 - DNA, 21 bp, Homo sapiens
tgtgccctctgggctctgagt

SEQ ID NO: 5460402 - DNA, 18 bp, Homo sapiens
tgtgccctgccttcagct

SEQ ID NO: 5460403 - DNA, 16 bp, Homo sapiens
tgtgccctgccttgaa

SEQ ID NO: 5460404 - DNA, 11 bp, Homo sapiens
tgtgccctggg

SEQ ID NO: 5460405 - DNA, 12 bp, Homo sapiens
tgtgccctgggc

SEQ ID NO: 5460406 - DNA, 16 bp, Homo sapiens
tgtgccctgggccagg

SEQ ID NO: 5460407 - DNA, 13 bp, Homo sapiens
tgtgccctggtgg

SEQ ID NO: 5460408 - DNA, 20 bp, Homo sapiens
tgtgccctgtagctccttag

SEQ ID NO: 5460409 - DNA, 20 bp, Homo sapiens
tgtgcccttgatttttatct

SEQ ID NO: 5460410 - DNA, 18 bp, Homo sapiens
tgtgcccttgctgggtcc

SEQ ID NO: 5460411 - DNA, 14 bp, Homo sapiens
tgtgccgagccctt

SEQ ID NO: 5460412 - DNA, 21 bp, Homo sapiens
tgtgccgcactagcctccctc

SEQ ID NO: 5460413 - DNA, 18 bp, Homo sapiens
tgtgccgctgccacccgc

SEQ ID NO: 5460414 - DNA, 21 bp, Homo sapiens
tgtgccgggaggcagccacag

SEQ ID NO: 5460415 - DNA, 22 bp, Homo sapiens
tgtgccgggaggcagccacagg

SEQ ID NO: 5460416 - DNA, 13 bp, Homo sapiens
tgtgccgtaatta

SEQ ID NO: 5460417 - DNA, 16 bp, Homo sapiens
tgtgccgtaattatgt

SEQ ID NO: 5460418 - DNA, 21 bp, Homo sapiens
tgtgccgtgaactgcgtgcca

SEQ ID NO: 5460419 - DNA, 13 bp, Homo sapiens
tgtgcctaataaa

SEQ ID NO: 5460420 - DNA, 18 bp, Homo sapiens
tgtgcctaatgtgtttga

SEQ ID NO: 5460421 - DNA, 17 bp, Homo sapiens
tgtgcctatagtcccag

SEQ ID NO: 5460422 - DNA, 14 bp, Homo sapiens
tgtgcctcagagac

SEQ ID NO: 5460423 - DNA, 19 bp, Homo sapiens
tgtgcctcagcctcctaag

SEQ ID NO: 5460424 - DNA, 17 bp, Homo sapiens
tgtgcctccaggaccag

SEQ ID NO: 5460425 - DNA, 19 bp, Homo sapiens
tgtgcctcccaagctcaga

SEQ ID NO: 5460426 - DNA, 14 bp, Homo sapiens
tgtgcctcccccca

SEQ ID NO: 5460427 - DNA, 17 bp, Homo sapiens
tgtgcctccccccagac

SEQ ID NO: 5460428 - DNA, 13 bp, Homo sapiens
tgtgcctccctct

SEQ ID NO: 5460429 - DNA, 16 bp, Homo sapiens
tgtgcctcccttccca

SEQ ID NO: 5460430 - DNA, 17 bp, Homo sapiens
tgtgcctcccttcccag

SEQ ID NO: 5460431 - DNA, 17 bp, Homo sapiens
tgtgcctcccttttctc

SEQ ID NO: 5460432 - DNA, 21 bp, Homo sapiens
tgtgcctcccttttctcctct

SEQ ID NO: 5460433 - DNA, 14 bp, Homo sapiens
tgtgcctcctcacc

SEQ ID NO: 5460434 - DNA, 16 bp, Homo sapiens
tgtgcctcctccctcc

SEQ ID NO: 5460435 - DNA, 16 bp, Homo sapiens
tgtgcctcgcatccta

SEQ ID NO: 5460436 - DNA, 21 bp, Homo sapiens
tgtgcctcgctccccactctg

SEQ ID NO: 5460437 - DNA, 15 bp, Homo sapiens
tgtgcctctagctga

SEQ ID NO: 5460438 - DNA, 21 bp, Homo sapiens
tgtgcctctcagtatcttaaa

SEQ ID NO: 5460439 - DNA, 17 bp, Homo sapiens
tgtgcctctctctccca

SEQ ID NO: 5460440 - DNA, 12 bp, Homo sapiens
tgtgcctctgcc

SEQ ID NO: 5460441 - DNA, 23 bp, Homo sapiens
tgtgcctctgcccaagcagcctg

SEQ ID NO: 5460442 - DNA, 14 bp, Homo sapiens
tgtgcctctgcctg

SEQ ID NO: 5460443 - DNA, 15 bp, Homo sapiens
tgtgcctctgcctgt

SEQ ID NO: 5460444 - DNA, 18 bp, Homo sapiens
tgtgcctctgccttatct

SEQ ID NO: 5460445 - DNA, 14 bp, Homo sapiens
tgtgcctctgtcct

SEQ ID NO: 5460446 - DNA, 20 bp, Homo sapiens
tgtgcctctgtcctagactc

SEQ ID NO: 5460447 - DNA, 20 bp, Homo sapiens
tgtgcctcttatcaagtgtt

SEQ ID NO: 5460448 - DNA, 18 bp, Homo sapiens
tgtgcctgactgcccagc

SEQ ID NO: 5460449 - DNA, 17 bp, Homo sapiens
tgtgcctgcaccaggag

SEQ ID NO: 5460450 - DNA, 18 bp, Homo sapiens
tgtgcctgcaccaggaga

SEQ ID NO: 5460451 - DNA, 19 bp, Homo sapiens
tgtgcctgcaccaggagac

SEQ ID NO: 5460452 - DNA, 14 bp, Homo sapiens
tgtgcctgcactga

SEQ ID NO: 5460453 - DNA, 13 bp, Homo sapiens
tgtggcctgggtc

SEQ ID NO: 5460454 - DNA, 22 bp, Homo sapiens
tgtggcctggttcaaagtaaag

SEQ ID NO: 5460455 - DNA, 16 bp, Homo sapiens
tgtggccttctcagcc

SEQ ID NO: 5460456 - DNA, 21 bp, Homo sapiens
tgtggccttctcagcctacag

SEQ ID NO: 5460457 - DNA, 23 bp, Homo sapiens
tgtggcctttagcaaaactggac

SEQ ID NO: 5460458 - DNA, 16 bp, Homo sapiens
tgtggcctttatgttc

SEQ ID NO: 5460459 - DNA, 19 bp, Homo sapiens
tgtggcgccgcgtggacag

SEQ ID NO: 5460460 - DNA, 18 bp, Homo sapiens
tgtggcgggaagggtggg

SEQ ID NO: 5460461 - DNA, 22 bp, Homo sapiens
tgtggcgggaagggtgggccct

SEQ ID NO: 5460462 - DNA, 23 bp, Homo sapiens
tgtggcgggaagggtgggccctg

SEQ ID NO: 5460463 - DNA, 13 bp, Homo sapiens
tgtggcggtgcct

SEQ ID NO: 5460464 - DNA, 22 bp, Homo sapiens
tgtggcgttctgctgcccctgc

SEQ ID NO: 5460465 - DNA, 23 bp, Homo sapiens
tgtggcgttctgctgcccctgca

SEQ ID NO: 5460466 - DNA, 10 bp, Homo sapiens
tgtggctcac

SEQ ID NO: 5460467 - DNA, 22 bp, Homo sapiens
tgtggctcacgtgagagtgtct

SEQ ID NO: 5460468 - DNA, 17 bp, Homo sapiens
tgtggctcattcttttc

SEQ ID NO: 5460469 - DNA, 14 bp, Homo sapiens
tgtggctccaagct

SEQ ID NO: 5460470 - DNA, 14 bp, Homo sapiens
tgtggctccaggcc

SEQ ID NO: 5460471 - DNA, 14 bp, Homo sapiens
tgtggctcccctct

SEQ ID NO: 5460472 - DNA, 23 bp, Homo sapiens
tgtggctcccctctatttagcat

SEQ ID NO: 5460473 - DNA, 14 bp, Homo sapiens
tgtggctccctctc

SEQ ID NO: 5460474 - DNA, 21 bp, Homo sapiens
tgtggctccctctctcctgga

SEQ ID NO: 5460475 - DNA, 22 bp, Homo sapiens
tgtggctccctctctcctggac

SEQ ID NO: 5460476 - DNA, 17 bp, Homo sapiens
tgtggctcctatctgtg

SEQ ID NO: 5460477 - DNA, 18 bp, Homo sapiens
tgtggctcctatctgtgt

SEQ ID NO: 5460478 - DNA, 17 bp, Homo sapiens
tgtggctcctcccgaaa

SEQ ID NO: 5460479 - DNA, 17 bp, Homo sapiens
tgtggctcctgccttga

SEQ ID NO: 5460480 - DNA, 19 bp, Homo sapiens
tgtggctcctgccttgatg

SEQ ID NO: 5460481 - DNA, 12 bp, Homo sapiens
tgtggctcctgg

SEQ ID NO: 5460482 - DNA, 13 bp, Homo sapiens
tgtggctcctggg

SEQ ID NO: 5460483 - DNA, 15 bp, Homo sapiens
tgtggctccttccca

SEQ ID NO: 5460484 - DNA, 21 bp, Homo sapiens
tgtggctctcccgttgcagag

SEQ ID NO: 5460485 - DNA, 14 bp, Homo sapiens
tgtggctcttgcct

SEQ ID NO: 5460486 - DNA, 12 bp, Homo sapiens
tgtggctgaaaa

SEQ ID NO: 5460487 - DNA, 14 bp, Homo sapiens
tgtggctgcagaga

SEQ ID NO: 5460488 - DNA, 18 bp, Homo sapiens
tgtggctgccatcagaaa

SEQ ID NO: 5460489 - DNA, 22 bp, Homo sapiens
tgtggctgctatttcatctggt

SEQ ID NO: 5460490 - DNA, 21 bp, Homo sapiens
tgtggctggaggagctggcct

SEQ ID NO: 5460491 - DNA, 23 bp, Homo sapiens
tgtggctggaggagctggcctgt

SEQ ID NO: 5460492 - DNA, 15 bp, Homo sapiens
tgtggctggtgtccc

SEQ ID NO: 5460493 - DNA, 16 bp, Homo sapiens
tgtggctggtgtcccc

SEQ ID NO: 5460494 - DNA, 21 bp, Homo sapiens
tgtggctgtcaaatccatgtg

SEQ ID NO: 5460495 - DNA, 15 bp, Homo sapiens
tgtggctgtcagcag

SEQ ID NO: 5460496 - DNA, 12 bp, Homo sapiens
tgtggctgtgca

SEQ ID NO: 5460497 - DNA, 13 bp, Homo sapiens
tgtggctgtgccc

SEQ ID NO: 5460498 - DNA, 12 bp, Homo sapiens
tgtggcttctgg

SEQ ID NO: 5460499 - DNA, 17 bp, Homo sapiens
tgtggctttcagagcct

SEQ ID NO: 5460500 - DNA, 19 bp, Homo sapiens
tgtggctttcagcctctgg

SEQ ID NO: 5460501 - DNA, 13 bp, Homo sapiens
tgtggctttccag

SEQ ID NO: 5460502 - DNA, 21 bp, Homo sapiens
tgtggcttttatttcagtgcc

SEQ ID NO: 5460503 - DNA, 17 bp, Homo sapiens
tgtggctttttgttcag

SEQ ID NO: 5460504 - DNA, 19 bp, Homo sapiens
tgtggctttttgttcagaa

SEQ ID NO: 5460505 - DNA, 15 bp, Homo sapiens
tgtgggaaaaaagaa

SEQ ID NO: 5460506 - DNA, 17 bp, Homo sapiens
tgtgggaaaatggcaga

SEQ ID NO: 5460507 - DNA, 22 bp, Homo sapiens
tgtgggaaaatggcagaaagat

SEQ ID NO: 5460508 - DNA, 21 bp, Homo sapiens
tgtgggaacattatttttaga

SEQ ID NO: 5460509 - DNA, 15 bp, Homo sapiens
tgtgggaagaaacaa

SEQ ID NO: 5460510 - DNA, 19 bp, Homo sapiens
tgtgggaagaaacaaaccc

SEQ ID NO: 5460511 - DNA, 22 bp, Homo sapiens
tgtgggaagaccaaaggaagga

SEQ ID NO: 5460512 - DNA, 23 bp, Homo sapiens
tgtgggaagaccaaaggaaggaa

SEQ ID NO: 5460513 - DNA, 15 bp, Homo sapiens
tgtgggaaggccagc

SEQ ID NO: 5460514 - DNA, 15 bp, Homo sapiens
tgtgggaagggagag

SEQ ID NO: 5460515 - DNA, 17 bp, Homo sapiens
tgtgggaatctcccaga

SEQ ID NO: 5460516 - DNA, 19 bp, Homo sapiens
tgtgggaattagtgagaca

SEQ ID NO: 5460517 - DNA, 16 bp, Homo sapiens
tgtgggaccgcctggc

SEQ ID NO: 5460518 - DNA, 20 bp, Homo sapiens
tgtgggaccgcctggccctc

SEQ ID NO: 5460519 - DNA, 15 bp, Homo sapiens
tgtgggagacagcag

SEQ ID NO: 5460520 - DNA, 14 bp, Homo sapiens
tgtgggagccgcag

SEQ ID NO: 5460521 - DNA, 18 bp, Homo sapiens
tgtgggagccgcagagcc

SEQ ID NO: 5460522 - DNA, 21 bp, Homo sapiens
tgtgggagccgcagagcctga

SEQ ID NO: 5460523 - DNA, 16 bp, Homo sapiens
tgtgggaggctcctgt

SEQ ID NO: 5460524 - DNA, 20 bp, Homo sapiens
tgtgggaggctggggaccca

SEQ ID NO: 5460525 - DNA, 13 bp, Homo sapiens
tgtgggagtccac

SEQ ID NO: 5460526 - DNA, 14 bp, Homo sapiens
tgtgggagtccact

SEQ ID NO: 5460527 - DNA, 14 bp, Homo sapiens
tgtgggagtgtgta

SEQ ID NO: 5460528 - DNA, 17 bp, Homo sapiens
tgtgggatattgaatgt

SEQ ID NO: 5460529 - DNA, 17 bp, Homo sapiens
tgtgggatctgaggagt

SEQ ID NO: 5460530 - DNA, 19 bp, Homo sapiens
tgtgggatgttcagcactg

SEQ ID NO: 5460531 - DNA, 22 bp, Homo sapiens
tgtgggatgttcagcactgtcc

SEQ ID NO: 5460532 - DNA, 17 bp, Homo sapiens
tgtgggcaaaggcaggg

SEQ ID NO: 5460533 - DNA, 19 bp, Homo sapiens
tgtgggcaaaggcagggcc

SEQ ID NO: 5460534 - DNA, 20 bp, Homo sapiens
tgtgggcaaaggcagggcca

SEQ ID NO: 5460535 - DNA, 12 bp, Homo sapiens
tgtgggcaaagt

SEQ ID NO: 5460536 - DNA, 17 bp, Homo sapiens
tgtgggcagcaccctcc

SEQ ID NO: 5460537 - DNA, 19 bp, Homo sapiens
tgtgggcagcatgcccaga

SEQ ID NO: 5460538 - DNA, 16 bp, Homo sapiens
tgtgggcagctggctc

SEQ ID NO: 5460539 - DNA, 17 bp, Homo sapiens
tgtgggcagctggctct

SEQ ID NO: 5460540 - DNA, 11 bp, Homo sapiens
tgtgggcaggg

SEQ ID NO: 5460541 - DNA, 18 bp, Homo sapiens
tgtgggccaagtccactg

SEQ ID NO: 5460542 - DNA, 17 bp, Homo sapiens
tgtgggccaccgtgcct

SEQ ID NO: 5460543 - DNA, 19 bp, Homo sapiens
tgtgggcccctcaacagcc

SEQ ID NO: 5460544 - DNA, 21 bp, Homo sapiens
tgtgggccctaccctcctgct

SEQ ID NO: 5460545 - DNA, 20 bp, Homo sapiens
tgtgggcctgggctcctgga

SEQ ID NO: 5460546 - DNA, 21 bp, Homo sapiens
tgtgggcgcccaccctgggct

SEQ ID NO: 5460547 - DNA, 16 bp, Homo sapiens
tgtgggctccaggcct

SEQ ID NO: 5460548 - DNA, 17 bp, Homo sapiens
tgtgggctcccacgccc

SEQ ID NO: 5460549 - DNA, 13 bp, Homo sapiens
tgtgggctccctt

SEQ ID NO: 5460550 - DNA, 14 bp, Homo sapiens
tgtgggctcccttc

SEQ ID NO: 5460551 - DNA, 16 bp, Homo sapiens
tgtgggctgcactctg

SEQ ID NO: 5460552 - DNA, 22 bp, Homo sapiens
tgtgggctgcactctgtgccca

SEQ ID NO: 5460553 - DNA, 13 bp, Homo sapiens
tgtgggctgcccc

SEQ ID NO: 5460554 - DNA, 22 bp, Homo sapiens
tgtgggctggtgccccacagct

SEQ ID NO: 5460555 - DNA, 15 bp, Homo sapiens
tgtgggctggttgct

SEQ ID NO: 5460556 - DNA, 22 bp, Homo sapiens
tgtgggctggttgctgtagaaa

SEQ ID NO: 5460557 - DNA, 13 bp, Homo sapiens
tgtgggcttcctg

SEQ ID NO: 5460558 - DNA, 15 bp, Homo sapiens
tgtgggcttggcctt

SEQ ID NO: 5460559 - DNA, 21 bp, Homo sapiens
tgtggggaacatggctggcct

SEQ ID NO: 5460560 - DNA, 22 bp, Homo sapiens
tgtggggaacatggctggcctg

SEQ ID NO: 5460561 - DNA, 23 bp, Homo sapiens
tgtggggaacatggctggcctgg

SEQ ID NO: 5460562 - DNA, 17 bp, Homo sapiens
tgtggggaggctgcact

SEQ ID NO: 5460563 - DNA, 19 bp, Homo sapiens
tgtggggagggcaggtcca

SEQ ID NO: 5460564 - DNA, 15 bp, Homo sapiens
tgtggggagggtcat

SEQ ID NO: 5460565 - DNA, 13 bp, Homo sapiens
tgtggggagggtg

SEQ ID NO: 5460566 - DNA, 15 bp, Homo sapiens
tgtggggatggtgat

SEQ ID NO: 5460567 - DNA, 21 bp, Homo sapiens
tgtggggatggtgatggagag

SEQ ID NO: 5460568 - DNA, 14 bp, Homo sapiens
tgtggggcaagcct

SEQ ID NO: 5460569 - DNA, 18 bp, Homo sapiens
tgtggggcacagatgcct

SEQ ID NO: 5460570 - DNA, 13 bp, Homo sapiens
tgtggggccagga

SEQ ID NO: 5460571 - DNA, 13 bp, Homo sapiens
tgtggggcctggg

SEQ ID NO: 5460572 - DNA, 13 bp, Homo sapiens
tgtggggcgtgga

SEQ ID NO: 5460573 - DNA, 12 bp, Homo sapiens
tgtggggctgga

SEQ ID NO: 5460574 - DNA, 20 bp, Homo sapiens
tgtggggctggtagctcagg

SEQ ID NO: 5460575 - DNA, 17 bp, Homo sapiens
tgtgggggaaggccttg

SEQ ID NO: 5460576 - DNA, 15 bp, Homo sapiens
tgtgggggactgtaa

SEQ ID NO: 5460577 - DNA, 19 bp, Homo sapiens
tgtgggggagattctgggt

SEQ ID NO: 5460578 - DNA, 21 bp, Homo sapiens
tgtgggggccaaacctgggac

SEQ ID NO: 5460579 - DNA, 13 bp, Homo sapiens
tgtgggggctgca

SEQ ID NO: 5460580 - DNA, 16 bp, Homo sapiens
tgtgggggtctgtgtg

SEQ ID NO: 5460581 - DNA, 22 bp, Homo sapiens
tgtgggggtgtcacagaggcag

SEQ ID NO: 5460582 - DNA, 15 bp, Homo sapiens
tgtggggtgaaaagt

SEQ ID NO: 5460583 - DNA, 16 bp, Homo sapiens
tgtggggtggacctgg

SEQ ID NO: 5460584 - DNA, 22 bp, Homo sapiens
tgtggggtggagcactggactc

SEQ ID NO: 5460585 - DNA, 20 bp, Homo sapiens
tgtggggtgtgtgcagggct

SEQ ID NO: 5460586 - DNA, 13 bp, Homo sapiens
tgtggggttttta

SEQ ID NO: 5460587 - DNA, 20 bp, Homo sapiens
tgtggggtttttaatctctt

SEQ ID NO: 5460588 - DNA, 16 bp, Homo sapiens
tgtgggtaaatgcttt

SEQ ID NO: 5460589 - DNA, 20 bp, Homo sapiens
tgtgggtaagaggagcagag

SEQ ID NO: 5460590 - DNA, 22 bp, Homo sapiens
tgtgggtaagaggagcagaggg

SEQ ID NO: 5460591 - DNA, 19 bp, Homo sapiens
tgtgggtagtggggaagag

SEQ ID NO: 5460592 - DNA, 16 bp, Homo sapiens
tgtgggtcagtgtgcc

SEQ ID NO: 5460593 - DNA, 21 bp, Homo sapiens
tgtgggtcagtgtgccaccct

SEQ ID NO: 5460594 - DNA, 14 bp, Homo sapiens
tgtgggtcccgcac

SEQ ID NO: 5460595 - DNA, 20 bp, Homo sapiens
tgtgggtcgaggattctgtg

SEQ ID NO: 5460596 - DNA, 13 bp, Homo sapiens
tgtgggtctctga

SEQ ID NO: 5460597 - DNA, 14 bp, Homo sapiens
tgtgggtctgtgtg

SEQ ID NO: 5460598 - DNA, 14 bp, Homo sapiens
tgtgggtctttttc

SEQ ID NO: 5460599 - DNA, 18 bp, Homo sapiens
tgtgggtgaagtgcctgc

SEQ ID NO: 5460600 - DNA, 21 bp, Homo sapiens
tgtgggtgaatgtgtgttcat

SEQ ID NO: 5460601 - DNA, 14 bp, Homo sapiens
tgtgggtggagaag

SEQ ID NO: 5460602 - DNA, 20 bp, Homo sapiens
tgtgggtgggagtgtgtctg

SEQ ID NO: 5460603 - DNA, 15 bp, Homo sapiens
tgtgggtgtcctgcc

SEQ ID NO: 5460604 - DNA, 16 bp, Homo sapiens
tgtgggtgtctccctc

SEQ ID NO: 5460605 - DNA, 18 bp, Homo sapiens
tgtgggtgttctttcctg

SEQ ID NO: 5460606 - DNA, 23 bp, Homo sapiens
tgtgggtgtttattacaagtggc

SEQ ID NO: 5460607 - DNA, 21 bp, Homo sapiens
tgtgggttatcatggaagaaa

SEQ ID NO: 5460608 - DNA, 18 bp, Homo sapiens
tgtgggttggccaggagg

SEQ ID NO: 5460609 - DNA, 18 bp, Homo sapiens
tgtgggttgtgatattga

SEQ ID NO: 5460610 - DNA, 21 bp, Homo sapiens
tgtgggtttctaaagctgcca

SEQ ID NO: 5460611 - DNA, 20 bp, Homo sapiens
tgtgggtttttatttcctat

SEQ ID NO: 5460612 - DNA, 18 bp, Homo sapiens
tgtggtacaaggtggaga

SEQ ID NO: 5460613 - DNA, 17 bp, Homo sapiens
tgtggtacagagaagcc

SEQ ID NO: 5460614 - DNA, 18 bp, Homo sapiens
tgtggtacagagaagcca

SEQ ID NO: 5460615 - DNA, 19 bp, Homo sapiens
tgtggtaccctggcagaga

SEQ ID NO: 5460616 - DNA, 23 bp, Homo sapiens
tgtggtaccctggcagagaagag

SEQ ID NO: 5460617 - DNA, 17 bp, Homo sapiens
tgtggtaccttcagccc

SEQ ID NO: 5460618 - DNA, 18 bp, Homo sapiens
tgtggtaccttcagccct

SEQ ID NO: 5460619 - DNA, 19 bp, Homo sapiens
tgtggtaccttcagccctg

SEQ ID NO: 5460620 - DNA, 21 bp, Homo sapiens
tgtggtactggcaataagata

SEQ ID NO: 5460621 - DNA, 14 bp, Homo sapiens
tgtggtagaaattt

SEQ ID NO: 5460622 - DNA, 16 bp, Homo sapiens
tgtggtagctccagcg

SEQ ID NO: 5460623 - DNA, 20 bp, Homo sapiens
tgtggtagcttatcttagaa

SEQ ID NO: 5460624 - DNA, 17 bp, Homo sapiens
tgtggtaggccttttaa

SEQ ID NO: 5460625 - DNA, 19 bp, Homo sapiens
tgtggtaggccttttaaca

SEQ ID NO: 5460626 - DNA, 21 bp, Homo sapiens
tgtggtaggccttttaacatt

SEQ ID NO: 5460627 - DNA, 24 bp, Homo sapiens
tgtggtaggccttttaacattttg

SEQ ID NO: 5460628 - DNA, 17 bp, Homo sapiens
tgtggtaggtgataaag

SEQ ID NO: 5460629 - DNA, 22 bp, Homo sapiens
tgtggtaggtgataaagaggca

SEQ ID NO: 5460630 - DNA, 14 bp, Homo sapiens
tgtgtgtatttgta

SEQ ID NO: 5460631 - DNA, 14 bp, Homo sapiens
tgtgtgtcaggccc

SEQ ID NO: 5460632 - DNA, 18 bp, Homo sapiens
tgtgtgtcatgccagtga

SEQ ID NO: 5460633 - DNA, 16 bp, Homo sapiens
tgtgtgtcccaggcag

SEQ ID NO: 5460634 - DNA, 19 bp, Homo sapiens
tgtgtgtcccaggcaggga

SEQ ID NO: 5460635 - DNA, 19 bp, Homo sapiens
tgtgtgtctaggtagagat

SEQ ID NO: 5460636 - DNA, 12 bp, Homo sapiens
tgtgtgtctctg

SEQ ID NO: 5460637 - DNA, 12 bp, Homo sapiens
tgtgtgtctgca

SEQ ID NO: 5460638 - DNA, 14 bp, Homo sapiens
tgtgtgtctgcttt

SEQ ID NO: 5460639 - DNA, 20 bp, Homo sapiens
tgtgtgtctttttttactta

SEQ ID NO: 5460640 - DNA, 16 bp, Homo sapiens
tgtgtgtgacaattct

SEQ ID NO: 5460641 - DNA, 12 bp, Homo sapiens
tgtgtgtgagct

SEQ ID NO: 5460642 - DNA, 14 bp, Homo sapiens
tgtgtgtgcaatgt

SEQ ID NO: 5460643 - DNA, 15 bp, Homo sapiens
tgtgtgtgcaatgtt

SEQ ID NO: 5460644 - DNA, 15 bp, Homo sapiens
tgtgtgtgccaagcc

SEQ ID NO: 5460645 - DNA, 14 bp, Homo sapiens
tgtgtgtgccctct

SEQ ID NO: 5460646 - DNA, 13 bp, Homo sapiens
tgtgtgtgccctg

SEQ ID NO: 5460647 - DNA, 20 bp, Homo sapiens
tgtgtgtgcttatgtatgag

SEQ ID NO: 5460648 - DNA, 22 bp, Homo sapiens
tgtgtgtggtcagcggtatgtg

SEQ ID NO: 5460649 - DNA, 20 bp, Homo sapiens
tgtgtgtggttttttttcta

SEQ ID NO: 5460650 - DNA, 12 bp, Homo sapiens
tgtgtgtgtact

SEQ ID NO: 5460651 - DNA, 13 bp, Homo sapiens
tgtgtgtgtctgt

SEQ ID NO: 5460652 - DNA, 14 bp, Homo sapiens
tgtgtgtgtgcaca

SEQ ID NO: 5460653 - DNA, 14 bp, Homo sapiens
tgtgtgtgtgcatg

SEQ ID NO: 5460654 - DNA, 15 bp, Homo sapiens
tgtgtgtgtgggtgt

SEQ ID NO: 5460655 - DNA, 13 bp, Homo sapiens
tgtgtgtgtgtac

SEQ ID NO: 5460656 - DNA, 15 bp, Homo sapiens
tgtgtgtgtgtatga

SEQ ID NO: 5460657 - DNA, 15 bp, Homo sapiens
tgtgtgtgtgtctgt

SEQ ID NO: 5460658 - DNA, 14 bp, Homo sapiens
tgtgtgtgtgtgca

SEQ ID NO: 5460659 - DNA, 14 bp, Homo sapiens
tgtgtgtgtgtgta

SEQ ID NO: 5460660 - DNA, 15 bp, Homo sapiens
tgtgtgtgtgtgtgc

SEQ ID NO: 5460661 - DNA, 16 bp, Homo sapiens
tgtgtgtgtgtgtgca

SEQ ID NO: 5460662 - DNA, 12 bp, Homo sapiens
tgtgtgtgtgtt

SEQ ID NO: 5460663 - DNA, 14 bp, Homo sapiens
tgtgtgtgtgttca

SEQ ID NO: 5460664 - DNA, 12 bp, Homo sapiens
tgtgtgtgttct

SEQ ID NO: 5460665 - DNA, 14 bp, Homo sapiens
tgtgtgtgttctgt

SEQ ID NO: 5460666 - DNA, 12 bp, Homo sapiens
tgtgtgttcacc

SEQ ID NO: 5460667 - DNA, 13 bp, Homo sapiens
tgtgtgttcacct

SEQ ID NO: 5460668 - DNA, 19 bp, Homo sapiens
tgtgtgttccaagtttcca

SEQ ID NO: 5460669 - DNA, 14 bp, Homo sapiens
tgtgtgttcctggc

SEQ ID NO: 5460670 - DNA, 12 bp, Homo sapiens
tgtgtgttctaa

SEQ ID NO: 5460671 - DNA, 23 bp, Homo sapiens
tgtgtgttctgtaatggaactga

SEQ ID NO: 5460672 - DNA, 14 bp, Homo sapiens
tgtgtgttgacact

SEQ ID NO: 5460673 - DNA, 22 bp, Homo sapiens
tgtgtgttgatcccaagacaat

SEQ ID NO: 5460674 - DNA, 15 bp, Homo sapiens
tgtgtgttgcaaatc

SEQ ID NO: 5460675 - DNA, 16 bp, Homo sapiens
tgtgtgttgccacagg

SEQ ID NO: 5460676 - DNA, 20 bp, Homo sapiens
tgtgtgttgccacaggacac

SEQ ID NO: 5460677 - DNA, 16 bp, Homo sapiens
tgtgtgttgcttctct

SEQ ID NO: 5460678 - DNA, 23 bp, Homo sapiens
tgtgtgttggctttgcagctgct

SEQ ID NO: 5460679 - DNA, 15 bp, Homo sapiens
tgtgtgttgtttcca

SEQ ID NO: 5460680 - DNA, 16 bp, Homo sapiens
tgtgtgtttaaataaa

SEQ ID NO: 5460681 - DNA, 19 bp, Homo sapiens
tgtgtgtttaaataaagta

SEQ ID NO: 5460682 - DNA, 16 bp, Homo sapiens
tgtgtgtttcttgctt

SEQ ID NO: 5460683 - DNA, 15 bp, Homo sapiens
tgtgtgtttgtatgt

SEQ ID NO: 5460684 - DNA, 23 bp, Homo sapiens
tgtgttaaaaggaaaaataacaa

SEQ ID NO: 5460685 - DNA, 14 bp, Homo sapiens
tgtgttaaaatact

SEQ ID NO: 5460686 - DNA, 14 bp, Homo sapiens
tgtgttaaaatttt

SEQ ID NO: 5460687 - DNA, 16 bp, Homo sapiens
tgtgttaaacatgcta

SEQ ID NO: 5460688 - DNA, 17 bp, Homo sapiens
tgtgttaaacatgctaa

SEQ ID NO: 5460689 - DNA, 15 bp, Homo sapiens
tgtgttaacttatgt

SEQ ID NO: 5460690 - DNA, 18 bp, Homo sapiens
tgtgttaacttgcctcca

SEQ ID NO: 5460691 - DNA, 12 bp, Homo sapiens
tgtgttaagagt

SEQ ID NO: 5460692 - DNA, 21 bp, Homo sapiens
tgtgttaagctctgctattag

SEQ ID NO: 5460693 - DNA, 22 bp, Homo sapiens
tgtgttaagtatgtgtaaaatg

SEQ ID NO: 5460694 - DNA, 19 bp, Homo sapiens
tgtgttaatcttaatgtat

SEQ ID NO: 5460695 - DNA, 12 bp, Homo sapiens
tgtgttaatgtc

SEQ ID NO: 5460696 - DNA, 14 bp, Homo sapiens
tgtgttaatttaag

SEQ ID NO: 5460697 - DNA, 12 bp, Homo sapiens
tgtgttacaata

SEQ ID NO: 5460698 - DNA, 14 bp, Homo sapiens
tgtgttacattatt

SEQ ID NO: 5460699 - DNA, 23 bp, Homo sapiens
tgtgttacctgaaaacactgtgc

SEQ ID NO: 5460700 - DNA, 13 bp, Homo sapiens
tgtgttacttgaa

SEQ ID NO: 5460701 - DNA, 14 bp, Homo sapiens
tgtgttagttccca

SEQ ID NO: 5460702 - DNA, 19 bp, Homo sapiens
tgtgttataaaataatgta

SEQ ID NO: 5460703 - DNA, 13 bp, Homo sapiens
tgtgttatattcc

SEQ ID NO: 5460704 - DNA, 19 bp, Homo sapiens
tgtgttatattccaaggaa

SEQ ID NO: 5460705 - DNA, 21 bp, Homo sapiens
tgtgttatcggacattctaat

SEQ ID NO: 5460706 - DNA, 21 bp, Homo sapiens
tgtgttcaccttcaaaatgtt

SEQ ID NO: 5460707 - DNA, 19 bp, Homo sapiens
tgtgttcactaaactctga

SEQ ID NO: 5460708 - DNA, 21 bp, Homo sapiens
tgtgttcagaagaatcttcct

SEQ ID NO: 5460709 - DNA, 22 bp, Homo sapiens
tgtgttcagaagaatcttcctg

SEQ ID NO: 5460710 - DNA, 20 bp, Homo sapiens
tgtgttcagctctttccaaa

SEQ ID NO: 5460711 - DNA, 21 bp, Homo sapiens
tgtgttcagctctttccaaat

SEQ ID NO: 5460712 - DNA, 15 bp, Homo sapiens
tgtgttcaggcattc

SEQ ID NO: 5460713 - DNA, 14 bp, Homo sapiens
tgtgttcagttcca

SEQ ID NO: 5460714 - DNA, 22 bp, Homo sapiens
tgtgttcatttggtgttcctgg

SEQ ID NO: 5460715 - DNA, 20 bp, Homo sapiens
tgtgttccaaacatgaggtt

SEQ ID NO: 5460716 - DNA, 19 bp, Homo sapiens
tgtgttccaactgccccca

SEQ ID NO: 5460717 - DNA, 15 bp, Homo sapiens
tgtgttcccagaggc

SEQ ID NO: 5460718 - DNA, 17 bp, Homo sapiens
tgtgttcccatttcagc

SEQ ID NO: 5460719 - DNA, 15 bp, Homo sapiens
tgtgttccccaaagg

SEQ ID NO: 5460720 - DNA, 18 bp, Homo sapiens
tgtgttccctttgtcttt

SEQ ID NO: 5460721 - DNA, 15 bp, Homo sapiens
tgtgttcctatggaa

SEQ ID NO: 5460722 - DNA, 12 bp, Homo sapiens
tgtgttcctcca

SEQ ID NO: 5460723 - DNA, 15 bp, Homo sapiens
tgtgttcctcctgct

SEQ ID NO: 5460724 - DNA, 10 bp, Homo sapiens
tgtgttcctg

SEQ ID NO: 5460725 - DNA, 11 bp, Homo sapiens
tgtgttcctgg

SEQ ID NO: 5460726 - DNA, 16 bp, Homo sapiens
tgtgttcctggcaata

SEQ ID NO: 5460727 - DNA, 21 bp, Homo sapiens
tgtgttccttctgtgaagaag

SEQ ID NO: 5460728 - DNA, 22 bp, Homo sapiens
tgtgttccttctgtgaagaagc

SEQ ID NO: 5460729 - DNA, 12 bp, Homo sapiens
tgtgttcctttt

SEQ ID NO: 5460730 - DNA, 22 bp, Homo sapiens
tgtgttcctttttgcagcaatt

SEQ ID NO: 5460731 - DNA, 20 bp, Homo sapiens
tgtgttcgcgtgtgtgggtg

SEQ ID NO: 5460732 - DNA, 17 bp, Homo sapiens
tgtgttcgttcttgttc

SEQ ID NO: 5460733 - DNA, 20 bp, Homo sapiens
tgtgttcgttgcacagctgt

SEQ ID NO: 5460734 - DNA, 18 bp, Homo sapiens
tgtgttctcggagtgtgt

SEQ ID NO: 5460735 - DNA, 16 bp, Homo sapiens
tgtgttctctaggcct

SEQ ID NO: 5460736 - DNA, 14 bp, Homo sapiens
tgtgttctgggctg

SEQ ID NO: 5460737 - DNA, 22 bp, Homo sapiens
tgtgttctgggctggggccacc

SEQ ID NO: 5460738 - DNA, 18 bp, Homo sapiens
tgtgttctgtttgttaaa

SEQ ID NO: 5460739 - DNA, 13 bp, Homo sapiens
tgtgttcttaaaa

SEQ ID NO: 5460740 - DNA, 13 bp, Homo sapiens
tgtgttcttcgta

SEQ ID NO: 5460741 - DNA, 17 bp, Homo sapiens
tgtgttctttaaataaa

SEQ ID NO: 5460742 - DNA, 14 bp, Homo sapiens
tgtgttcttttgat

SEQ ID NO: 5460743 - DNA, 15 bp, Homo sapiens
tgtgttcttttgata

SEQ ID NO: 5460744 - DNA, 12 bp, Homo sapiens
tgtgttgaaaca

SEQ ID NO: 5460745 - DNA, 13 bp, Homo sapiens
tgtgttgaaactg

SEQ ID NO: 5460746 - DNA, 14 bp, Homo sapiens
tgtgttgaaatata

SEQ ID NO: 5460747 - DNA, 13 bp, Homo sapiens
tgtgttgaagagg

SEQ ID NO: 5460748 - DNA, 15 bp, Homo sapiens
tgtgttgaaggaact

SEQ ID NO: 5460749 - DNA, 12 bp, Homo sapiens
tgtgttgacaca

SEQ ID NO: 5460750 - DNA, 23 bp, Homo sapiens
tgtgttgacacatatgaacacag

SEQ ID NO: 5460751 - DNA, 18 bp, Homo sapiens
tgtgttgaccggctgccg

SEQ ID NO: 5460752 - DNA, 16 bp, Homo sapiens
tgtgttgagatccagt

SEQ ID NO: 5460753 - DNA, 17 bp, Homo sapiens
tgtgttgatactgttgc

SEQ ID NO: 5460754 - DNA, 22 bp, Homo sapiens
tgtgttgatactgttgcacgtg

SEQ ID NO: 5460755 - DNA, 23 bp, Homo sapiens
tgtgttgatgactcactcataaa

SEQ ID NO: 5460756 - DNA, 19 bp, Homo sapiens
tgtgttgattcttgaaaac

SEQ ID NO: 5460757 - DNA, 12 bp, Homo sapiens
tgtgttgcaaag

SEQ ID NO: 5460758 - DNA, 18 bp, Homo sapiens
tgtgttgcaaattattct

SEQ ID NO: 5460759 - DNA, 17 bp, Homo sapiens
tgtgttgcagctgtcac

SEQ ID NO: 5460760 - DNA, 18 bp, Homo sapiens
tgtgttgccactttccaa

SEQ ID NO: 5460761 - DNA, 13 bp, Homo sapiens
tgtgttgcccagg

SEQ ID NO: 5460762 - DNA, 15 bp, Homo sapiens
tgtgttgctaaaaaa

SEQ ID NO: 5460763 - DNA, 15 bp, Homo sapiens
tgtgttgctatcctg

SEQ ID NO: 5460764 - DNA, 13 bp, Homo sapiens
tgtgttgctgttt

SEQ ID NO: 5460765 - DNA, 22 bp, Homo sapiens
tgtgttgcttctctattgcaag

SEQ ID NO: 5460766 - DNA, 14 bp, Homo sapiens
tgtgttgctttctg

SEQ ID NO: 5460767 - DNA, 16 bp, Homo sapiens
tgtgttggccaggctg

SEQ ID NO: 5460768 - DNA, 16 bp, Homo sapiens
tgtgttgggccccagg

SEQ ID NO: 5460769 - DNA, 16 bp, Homo sapiens
tgtgttggtatttact

SEQ ID NO: 5460770 - DNA, 14 bp, Homo sapiens
tgtgttggtgcttt

SEQ ID NO: 5460771 - DNA, 18 bp, Homo sapiens
tgtgttgtctgtgcagct

SEQ ID NO: 5460772 - DNA, 13 bp, Homo sapiens
tgtgttgtgatag

SEQ ID NO: 5460773 - DNA, 20 bp, Homo sapiens
tgtgttgtgtttgtagtctt

SEQ ID NO: 5460774 - DNA, 14 bp, Homo sapiens
tgtgttgtttccat

SEQ ID NO: 5460775 - DNA, 12 bp, Homo sapiens
tgtgttgtttga

SEQ ID NO: 5460776 - DNA, 22 bp, Homo sapiens
tgtgtttaaaaattgaaaaaag

SEQ ID NO: 5460777 - DNA, 18 bp, Homo sapiens
tgtgtttaaataaagtat

SEQ ID NO: 5460778 - DNA, 15 bp, Homo sapiens
tgtgtttaacattca

SEQ ID NO: 5460779 - DNA, 20 bp, Homo sapiens
tgtgtttaactgctgcaggg

SEQ ID NO: 5460780 - DNA, 21 bp, Homo sapiens
tgtgtttaactgctgcagggt

SEQ ID NO: 5460781 - DNA, 16 bp, Homo sapiens
tgtgtttaatttcttc

SEQ ID NO: 5460782 - DNA, 15 bp, Homo sapiens
tgtgtttacagacag

SEQ ID NO: 5460783 - DNA, 21 bp, Homo sapiens
tgtgtttacattttatggtgc

SEQ ID NO: 5460784 - DNA, 20 bp, Homo sapiens
tgtgtttactttatgttact

SEQ ID NO: 5460785 - DNA, 21 bp, Homo sapiens
tgtgtttactttttggctgga

SEQ ID NO: 5460786 - DNA, 22 bp, Homo sapiens
tgtgtttagaattgaaggtttt

SEQ ID NO: 5460787 - DNA, 22 bp, Homo sapiens
tgtgtttaggaactactgagga

SEQ ID NO: 5460788 - DNA, 12 bp, Homo sapiens
tgtgtttatatg

SEQ ID NO: 5460789 - DNA, 15 bp, Homo sapiens
tgtgtttatatggaa

SEQ ID NO: 5460790 - DNA, 13 bp, Homo sapiens
tgtgtttatgaaa

SEQ ID NO: 5460791 - DNA, 23 bp, Homo sapiens
tgtgtttattcaaactgaaaagc

SEQ ID NO: 5460792 - DNA, 15 bp, Homo sapiens
tgtgtttattcttga

SEQ ID NO: 5460793 - DNA, 15 bp, Homo sapiens
tgtgtttatttcact

SEQ ID NO: 5460794 - DNA, 13 bp, Homo sapiens
tgtgtttcaaact

SEQ ID NO: 5460795 - DNA, 19 bp, Homo sapiens
tgtgtttcacagtttgaaa

SEQ ID NO: 5460796 - DNA, 23 bp, Homo sapiens
tgtgtttcacagtttgaaataag

SEQ ID NO: 5460797 - DNA, 18 bp, Homo sapiens
tgtgtttcacttaatgtt

SEQ ID NO: 5460798 - DNA, 11 bp, Homo sapiens
tgtgtttcagg

SEQ ID NO: 5460799 - DNA, 23 bp, Homo sapiens
tgtgtttcaggacagctgcttct

SEQ ID NO: 5460800 - DNA, 24 bp, Homo sapiens
tgtgtttcaggacagctgcttctg

SEQ ID NO: 5460801 - DNA, 22 bp, Homo sapiens
tgtgtttcataacaaaccatct

SEQ ID NO: 5460802 - DNA, 23 bp, Homo sapiens
tgtgtttcatgttctgtgtcacg

SEQ ID NO: 5460803 - DNA, 21 bp, Homo sapiens
tgtgtttcattacttgaatgt

SEQ ID NO: 5460804 - DNA, 22 bp, Homo sapiens
tgtgtttcattacttgaatgta

SEQ ID NO: 5460805 - DNA, 12 bp, Homo sapiens
tgtgtttcccta

SEQ ID NO: 5460806 - DNA, 19 bp, Homo sapiens
tgtgtttccttttcaggag

SEQ ID NO: 5460807 - DNA, 22 bp, Homo sapiens
tgtgtttcgcattaagcacaca

SEQ ID NO: 5460808 - DNA, 13 bp, Homo sapiens
tgtgtttctggag

SEQ ID NO: 5460809 - DNA, 14 bp, Homo sapiens
tgtgtttctgtaac

SEQ ID NO: 5460810 - DNA, 18 bp, Homo sapiens
tgtgtttctgtaacaaat

SEQ ID NO: 5460811 - DNA, 12 bp, Homo sapiens
tgttccctctgg

SEQ ID NO: 5460812 - DNA, 12 bp, Homo sapiens
tgttccctgagg

SEQ ID NO: 5460813 - DNA, 13 bp, Homo sapiens
tgttccctgcacc

SEQ ID NO: 5460814 - DNA, 15 bp, Homo sapiens
tgttccctgcaccct

SEQ ID NO: 5460815 - DNA, 20 bp, Homo sapiens
tgttccctgcaccctggaaa

SEQ ID NO: 5460816 - DNA, 11 bp, Homo sapiens
tgttccctgga

SEQ ID NO: 5460817 - DNA, 13 bp, Homo sapiens
tgttccctggagt

SEQ ID NO: 5460818 - DNA, 18 bp, Homo sapiens
tgttccctgttctggtat

SEQ ID NO: 5460819 - DNA, 21 bp, Homo sapiens
tgttcccttcctctgtgccac

SEQ ID NO: 5460820 - DNA, 21 bp, Homo sapiens
tgttcccttcctcttcctgcc

SEQ ID NO: 5460821 - DNA, 18 bp, Homo sapiens
tgttcccttgaatttcat

SEQ ID NO: 5460822 - DNA, 15 bp, Homo sapiens
tgttcccttgaccat

SEQ ID NO: 5460823 - DNA, 16 bp, Homo sapiens
tgttcccttgtggctt

SEQ ID NO: 5460824 - DNA, 17 bp, Homo sapiens
tgttcccttgtggcttg

SEQ ID NO: 5460825 - DNA, 16 bp, Homo sapiens
tgttccctttgcctta

SEQ ID NO: 5460826 - DNA, 22 bp, Homo sapiens
tgttccgaaaccaaagaagaaa

SEQ ID NO: 5460827 - DNA, 19 bp, Homo sapiens
tgttccggcgtttatttct

SEQ ID NO: 5460828 - DNA, 21 bp, Homo sapiens
tgttccgtgggaccctcagca

SEQ ID NO: 5460829 - DNA, 22 bp, Homo sapiens
tgttccgtgggaccctcagcag

SEQ ID NO: 5460830 - DNA, 19 bp, Homo sapiens
tgttccgttcatctgagga

SEQ ID NO: 5460831 - DNA, 21 bp, Homo sapiens
tgttcctaaaaatctgtggca

SEQ ID NO: 5460832 - DNA, 17 bp, Homo sapiens
tgttcctaacaaaatga

SEQ ID NO: 5460833 - DNA, 19 bp, Homo sapiens
tgttcctactcacacttca

SEQ ID NO: 5460834 - DNA, 16 bp, Homo sapiens
tgttcctagagtagag

SEQ ID NO: 5460835 - DNA, 15 bp, Homo sapiens
tgttcctatggaaac

SEQ ID NO: 5460836 - DNA, 16 bp, Homo sapiens
tgttcctatggaaaca

SEQ ID NO: 5460837 - DNA, 14 bp, Homo sapiens
tgttcctcaaatca

SEQ ID NO: 5460838 - DNA, 17 bp, Homo sapiens
tgttcctcaaggtccat

SEQ ID NO: 5460839 - DNA, 15 bp, Homo sapiens
tgttcctcatgttgc

SEQ ID NO: 5460840 - DNA, 16 bp, Homo sapiens
tgttcctcctgctgta

SEQ ID NO: 5460841 - DNA, 22 bp, Homo sapiens
tgttcctcggtgggccagagct

SEQ ID NO: 5460842 - DNA, 14 bp, Homo sapiens
tgttcctgaagctg

SEQ ID NO: 5460843 - DNA, 16 bp, Homo sapiens
tgttcctgaagctgct

SEQ ID NO: 5460844 - DNA, 20 bp, Homo sapiens
tgttcctgaaggaggccctg

SEQ ID NO: 5460845 - DNA, 19 bp, Homo sapiens
tgttcctgaatacaagcct

SEQ ID NO: 5460846 - DNA, 22 bp, Homo sapiens
tgttcctgaattctatttgctg

SEQ ID NO: 5460847 - DNA, 15 bp, Homo sapiens
tgttcctgactgttc

SEQ ID NO: 5460848 - DNA, 16 bp, Homo sapiens
tgttcctgactgttct

SEQ ID NO: 5460849 - DNA, 15 bp, Homo sapiens
tgttcctgagacaga

SEQ ID NO: 5460850 - DNA, 12 bp, Homo sapiens
tgttcctgcccc

SEQ ID NO: 5460851 - DNA, 17 bp, Homo sapiens
tgttcctgccttctctt

SEQ ID NO: 5460852 - DNA, 20 bp, Homo sapiens
tgttcctgccttctcttcta

SEQ ID NO: 5460853 - DNA, 15 bp, Homo sapiens
tgttcctgctccatg

SEQ ID NO: 5460854 - DNA, 13 bp, Homo sapiens
tgttcctgctttc

SEQ ID NO: 5460855 - DNA, 18 bp, Homo sapiens
tgttcctggagttttgat

SEQ ID NO: 5460856 - DNA, 14 bp, Homo sapiens
tgttcctggcaata

SEQ ID NO: 5460857 - DNA, 15 bp, Homo sapiens
tgttcctggcagttt

SEQ ID NO: 5460858 - DNA, 20 bp, Homo sapiens
tgttcctggcccactctgta

SEQ ID NO: 5460859 - DNA, 22 bp, Homo sapiens
tgttcctggctgatgatccaga

SEQ ID NO: 5460860 - DNA, 13 bp, Homo sapiens
tgttcctgtgtat

SEQ ID NO: 5460861 - DNA, 18 bp, Homo sapiens
tgttcctgtttattttta

SEQ ID NO: 5460862 - DNA, 19 bp, Homo sapiens
tgttcctgtttatttttaa

SEQ ID NO: 5460863 - DNA, 12 bp, Homo sapiens
tgttccttcaca

SEQ ID NO: 5460864 - DNA, 13 bp, Homo sapiens
tgttccttctgtg

SEQ ID NO: 5460865 - DNA, 16 bp, Homo sapiens
tgttccttgctagccc

SEQ ID NO: 5460866 - DNA, 17 bp, Homo sapiens
tgttcctttgaagaatt

SEQ ID NO: 5460867 - DNA, 18 bp, Homo sapiens
tgttcctttgttaaattt

SEQ ID NO: 5460868 - DNA, 17 bp, Homo sapiens
tgttccttttctctcct

SEQ ID NO: 5460869 - DNA, 22 bp, Homo sapiens
tgttccttttctctcctgtgtg

SEQ ID NO: 5460870 - DNA, 13 bp, Homo sapiens
tgttccttttgaa

SEQ ID NO: 5460871 - DNA, 13 bp, Homo sapiens
tgttccttttgta

SEQ ID NO: 5460872 - DNA, 20 bp, Homo sapiens
tgttcgacagtgaatattca

SEQ ID NO: 5460873 - DNA, 23 bp, Homo sapiens
tgttcgcatggtcacacactgat

SEQ ID NO: 5460874 - DNA, 15 bp, Homo sapiens
tgttcgctcctccca

SEQ ID NO: 5460875 - DNA, 22 bp, Homo sapiens
tgttcggagctcttctgtgccc

SEQ ID NO: 5460876 - DNA, 22 bp, Homo sapiens
tgttcgggggagcagagagagc

SEQ ID NO: 5460877 - DNA, 15 bp, Homo sapiens
tgttcgggtgtgggt

SEQ ID NO: 5460878 - DNA, 21 bp, Homo sapiens
tgttcggtttttttcctgttt

SEQ ID NO: 5460879 - DNA, 22 bp, Homo sapiens
tgttcgttgcacagctgtttga

SEQ ID NO: 5460880 - DNA, 17 bp, Homo sapiens
tgttcgtttccatcatg

SEQ ID NO: 5460881 - DNA, 21 bp, Homo sapiens
tgttcgtttccatcatgtctg

SEQ ID NO: 5460882 - DNA, 18 bp, Homo sapiens
tgttctaaaatgaaatat

SEQ ID NO: 5460883 - DNA, 13 bp, Homo sapiens
tgttctaaagctc

SEQ ID NO: 5460884 - DNA, 18 bp, Homo sapiens
tgttctaaagctctgaca

SEQ ID NO: 5460885 - DNA, 14 bp, Homo sapiens
tgttctaaattcta

SEQ ID NO: 5460886 - DNA, 20 bp, Homo sapiens
tgttctaactagtaatcttg

SEQ ID NO: 5460887 - DNA, 16 bp, Homo sapiens
tgttctaactcttaga

SEQ ID NO: 5460888 - DNA, 15 bp, Homo sapiens
tgttctaagaagtga

SEQ ID NO: 5460889 - DNA, 16 bp, Homo sapiens
tgttctaagactctgt

SEQ ID NO: 5460890 - DNA, 18 bp, Homo sapiens
tgttctaagactctgtgt

SEQ ID NO: 5460891 - DNA, 19 bp, Homo sapiens
tgttctaagactctgtgtg

SEQ ID NO: 5460892 - DNA, 22 bp, Homo sapiens
tgttctaagatgtgatattcta

SEQ ID NO: 5460893 - DNA, 19 bp, Homo sapiens
tgttctaagcaatgcaaat

SEQ ID NO: 5460894 - DNA, 16 bp, Homo sapiens
tgttctaaggctctga

SEQ ID NO: 5460895 - DNA, 12 bp, Homo sapiens
tgttctaagttt

SEQ ID NO: 5460896 - DNA, 17 bp, Homo sapiens
tgttctaagtttctaag

SEQ ID NO: 5460897 - DNA, 19 bp, Homo sapiens
tgttctaagtttctaagat

SEQ ID NO: 5460898 - DNA, 23 bp, Homo sapiens
tgttctaagtttctaagattcta

SEQ ID NO: 5460899 - DNA, 21 bp, Homo sapiens
tgttctaatccaagggccagt

SEQ ID NO: 5460900 - DNA, 19 bp, Homo sapiens
tgttctaatgcaacagaaa

SEQ ID NO: 5460901 - DNA, 19 bp, Homo sapiens
tgttctacccgttccaaaa

SEQ ID NO: 5460902 - DNA, 20 bp, Homo sapiens
tgttctacttgatatttcct

SEQ ID NO: 5460903 - DNA, 18 bp, Homo sapiens
tgttctagcatggctgcc

SEQ ID NO: 5460904 - DNA, 23 bp, Homo sapiens
tgttctaggtcagtctaacagtt

SEQ ID NO: 5460905 - DNA, 22 bp, Homo sapiens
tgttctagtaacaatacatgag

SEQ ID NO: 5460906 - DNA, 15 bp, Homo sapiens
tgttctagttttcag

SEQ ID NO: 5460907 - DNA, 14 bp, Homo sapiens
tgttctagtttttt

SEQ ID NO: 5460908 - DNA, 13 bp, Homo sapiens
tgttctatacgag

SEQ ID NO: 5460909 - DNA, 14 bp, Homo sapiens
tgttctatacgagt

SEQ ID NO: 5460910 - DNA, 20 bp, Homo sapiens
tgttctatagcagtcatcat

SEQ ID NO: 5460911 - DNA, 12 bp, Homo sapiens
tgttctatagct

SEQ ID NO: 5460912 - DNA, 14 bp, Homo sapiens
tgttctatatgcat

SEQ ID NO: 5460913 - DNA, 16 bp, Homo sapiens
tgttctatatgcattt

SEQ ID NO: 5460914 - DNA, 19 bp, Homo sapiens
tgttctatggaccaaatgt

SEQ ID NO: 5460915 - DNA, 21 bp, Homo sapiens
tgttctattaatcacctctct

SEQ ID NO: 5460916 - DNA, 22 bp, Homo sapiens
tgttctattaatcacctctctg

SEQ ID NO: 5460917 - DNA, 24 bp, Homo sapiens
tgttctatttaacaactgggtcat

SEQ ID NO: 5460918 - DNA, 16 bp, Homo sapiens
tgttctcaacatactg

SEQ ID NO: 5460919 - DNA, 19 bp, Homo sapiens
tgttctcaacatactgtaa

SEQ ID NO: 5460920 - DNA, 23 bp, Homo sapiens
tgttctcaacatactgtaatcaa

SEQ ID NO: 5460921 - DNA, 21 bp, Homo sapiens
tgttctcaatgcttttctagc

SEQ ID NO: 5460922 - DNA, 22 bp, Homo sapiens
tgttctcacaccaacagtgtga

SEQ ID NO: 5460923 - DNA, 23 bp, Homo sapiens
tgttctcacactggtctgctgtc

SEQ ID NO: 5460924 - DNA, 15 bp, Homo sapiens
tgttctcacagtgtg

SEQ ID NO: 5460925 - DNA, 16 bp, Homo sapiens
tgttctcacagtgtgg

SEQ ID NO: 5460926 - DNA, 22 bp, Homo sapiens
tgttctcagaatcccttaacag

SEQ ID NO: 5460927 - DNA, 16 bp, Homo sapiens
tgttctcagagctcca

SEQ ID NO: 5460928 - DNA, 20 bp, Homo sapiens
tgttctcagagctccacaga

SEQ ID NO: 5460929 - DNA, 17 bp, Homo sapiens
tgttctcagctccccct

SEQ ID NO: 5460930 - DNA, 16 bp, Homo sapiens
tgttctcaggacagca

SEQ ID NO: 5460931 - DNA, 11 bp, Homo sapiens
tgttctcaggg

SEQ ID NO: 5460932 - DNA, 16 bp, Homo sapiens
tgttctcagttttcaa

SEQ ID NO: 5460933 - DNA, 14 bp, Homo sapiens
tgttctcattcctg

SEQ ID NO: 5460934 - DNA, 19 bp, Homo sapiens
tgttctcattcctgttctt

SEQ ID NO: 5460935 - DNA, 21 bp, Homo sapiens
tgttctccataggagggaagg

SEQ ID NO: 5460936 - DNA, 17 bp, Homo sapiens
tgttctccctttctctc

SEQ ID NO: 5460937 - DNA, 22 bp, Homo sapiens
tgttctcctaatgctctgaaag

SEQ ID NO: 5460938 - DNA, 22 bp, Homo sapiens
tgttctcctccattgctgttgt

SEQ ID NO: 5460939 - DNA, 14 bp, Homo sapiens
tgttctcctcccca

SEQ ID NO: 5460940 - DNA, 21 bp, Homo sapiens
tgttctccttttcctctctcc

SEQ ID NO: 5460941 - DNA, 17 bp, Homo sapiens
tgttctcgaactcctga

SEQ ID NO: 5460942 - DNA, 15 bp, Homo sapiens
tgttctcgttgccct

SEQ ID NO: 5460943 - DNA, 19 bp, Homo sapiens
tgttctctagttttccaga

SEQ ID NO: 5460944 - DNA, 18 bp, Homo sapiens
tgttctctatcatttaat

SEQ ID NO: 5460945 - DNA, 16 bp, Homo sapiens
tgttctctcccctcac

SEQ ID NO: 5460946 - DNA, 23 bp, Homo sapiens
tgttctctcccctcacatcctcc

SEQ ID NO: 5460947 - DNA, 13 bp, Homo sapiens
tgttctctccgga

SEQ ID NO: 5460948 - DNA, 18 bp, Homo sapiens
tgttctctctgaatgctg

SEQ ID NO: 5460949 - DNA, 23 bp, Homo sapiens
tgttctctctgaatgctgagctg

SEQ ID NO: 5460950 - DNA, 12 bp, Homo sapiens
tgttctctgccc

SEQ ID NO: 5460951 - DNA, 11 bp, Homo sapiens
tgttctctgct

SEQ ID NO: 5460952 - DNA, 14 bp, Homo sapiens
tgttctctgctgag

SEQ ID NO: 5460953 - DNA, 15 bp, Homo sapiens
tgttctcttcttcat

SEQ ID NO: 5460954 - DNA, 21 bp, Homo sapiens
tgttctcttgctttaaagagt

SEQ ID NO: 5460955 - DNA, 16 bp, Homo sapiens
tgttctcttggctgca

SEQ ID NO: 5460956 - DNA, 22 bp, Homo sapiens
tgttctcttgtatagctgaaat

SEQ ID NO: 5460957 - DNA, 16 bp, Homo sapiens
tgttctctttaatgct

SEQ ID NO: 5460958 - DNA, 18 bp, Homo sapiens
tgttctgaaaggagacat

SEQ ID NO: 5460959 - DNA, 13 bp, Homo sapiens
tgttctgaactgt

SEQ ID NO: 5460960 - DNA, 20 bp, Homo sapiens
tgttctgaaggtgcccagga

SEQ ID NO: 5460961 - DNA, 21 bp, Homo sapiens
tgttctgaagtgggaaaaaat

SEQ ID NO: 5460962 - DNA, 18 bp, Homo sapiens
tgttctgaataatttctt

SEQ ID NO: 5460963 - DNA, 16 bp, Homo sapiens
tgttctgacattaaca

SEQ ID NO: 5460964 - DNA, 20 bp, Homo sapiens
tgttctgacattaacagttt

SEQ ID NO: 5460965 - DNA, 18 bp, Homo sapiens
tgttctgagaactgactt

SEQ ID NO: 5460966 - DNA, 19 bp, Homo sapiens
tgttctgagaactgacttt

SEQ ID NO: 5460967 - DNA, 23 bp, Homo sapiens
tgttctgagcacatttgactcca

SEQ ID NO: 5460968 - DNA, 13 bp, Homo sapiens
tgttctgagcccc

SEQ ID NO: 5460969 - DNA, 21 bp, Homo sapiens
tgttctgaggattcaggggct

SEQ ID NO: 5460970 - DNA, 12 bp, Homo sapiens
tgttctgagtaa

SEQ ID NO: 5460971 - DNA, 17 bp, Homo sapiens
tgttctgagtaagtgtg

SEQ ID NO: 5460972 - DNA, 15 bp, Homo sapiens
tgttctgagtacttg

SEQ ID NO: 5460973 - DNA, 19 bp, Homo sapiens
tgttctgagtacttgattt

SEQ ID NO: 5460974 - DNA, 15 bp, Homo sapiens
tgttctgatattaat

SEQ ID NO: 5460975 - DNA, 18 bp, Homo sapiens
tgttctgatcggccagtt

SEQ ID NO: 5460976 - DNA, 18 bp, Homo sapiens
tgttctgatgaggcattt

SEQ ID NO: 5460977 - DNA, 17 bp, Homo sapiens
tgttctgcacacagcac

SEQ ID NO: 5460978 - DNA, 13 bp, Homo sapiens
tgttctgcactga

SEQ ID NO: 5460979 - DNA, 15 bp, Homo sapiens
tgttctgcatggatt

SEQ ID NO: 5460980 - DNA, 18 bp, Homo sapiens
tgttctgcccccagccca

SEQ ID NO: 5460981 - DNA, 20 bp, Homo sapiens
tgttctgcctctccctgggt

SEQ ID NO: 5460982 - DNA, 11 bp, Homo sapiens
tgttctgcctg

SEQ ID NO: 5460983 - DNA, 12 bp, Homo sapiens
tgttctgctggg

SEQ ID NO: 5460984 - DNA, 21 bp, Homo sapiens
tgttctgcttcgaagtattca

SEQ ID NO: 5460985 - DNA, 13 bp, Homo sapiens
tgttctggacagc

SEQ ID NO: 5460986 - DNA, 23 bp, Homo sapiens
tgttctggactacacccaagcct

SEQ ID NO: 5460987 - DNA, 14 bp, Homo sapiens
tgttctggagctgc

SEQ ID NO: 5460988 - DNA, 17 bp, Homo sapiens
tgttctggagctgctgt

SEQ ID NO: 5460989 - DNA, 20 bp, Homo sapiens
tgtttagtcttgtctcagat

SEQ ID NO: 5460990 - DNA, 23 bp, Homo sapiens
tgtttagtcttgtctcagatttt

SEQ ID NO: 5460991 - DNA, 15 bp, Homo sapiens
tgtttagtctttata

SEQ ID NO: 5460992 - DNA, 17 bp, Homo sapiens
tgtttagtgatattaca

SEQ ID NO: 5460993 - DNA, 13 bp, Homo sapiens
tgtttagtggaaa

SEQ ID NO: 5460994 - DNA, 14 bp, Homo sapiens
tgtttagttgcaga

SEQ ID NO: 5460995 - DNA, 19 bp, Homo sapiens
tgtttataaatcttatgct

SEQ ID NO: 5460996 - DNA, 16 bp, Homo sapiens
tgtttataaatgttct

SEQ ID NO: 5460997 - DNA, 14 bp, Homo sapiens
tgtttataactcta

SEQ ID NO: 5460998 - DNA, 16 bp, Homo sapiens
tgtttataatctgaag

SEQ ID NO: 5460999 - DNA, 21 bp, Homo sapiens
tgtttataatgaagaacactg

SEQ ID NO: 5461000 - DNA, 17 bp, Homo sapiens
tgtttataattgtttat

SEQ ID NO: 5461001 - DNA, 18 bp, Homo sapiens
tgtttatatactgggttc

SEQ ID NO: 5461002 - DNA, 16 bp, Homo sapiens
tgtttatatgaaaaca

SEQ ID NO: 5461003 - DNA, 17 bp, Homo sapiens
tgtttatatggaagaaa

SEQ ID NO: 5461004 - DNA, 23 bp, Homo sapiens
tgtttatatggataatctgagca

SEQ ID NO: 5461005 - DNA, 20 bp, Homo sapiens
tgtttatatggcgttttgtc

SEQ ID NO: 5461006 - DNA, 20 bp, Homo sapiens
tgtttatattgggaagatat

SEQ ID NO: 5461007 - DNA, 15 bp, Homo sapiens
tgtttatcagataca

SEQ ID NO: 5461008 - DNA, 16 bp, Homo sapiens
tgtttatcagatacat

SEQ ID NO: 5461009 - DNA, 17 bp, Homo sapiens
tgtttatcagatacatc

SEQ ID NO: 5461010 - DNA, 22 bp, Homo sapiens
tgtttatcagatacatcactgc

SEQ ID NO: 5461011 - DNA, 23 bp, Homo sapiens
tgtttatcagatacatcactgct

SEQ ID NO: 5461012 - DNA, 16 bp, Homo sapiens
tgtttatcctttcata

SEQ ID NO: 5461013 - DNA, 18 bp, Homo sapiens
tgtttatctagatgtaaa

SEQ ID NO: 5461014 - DNA, 22 bp, Homo sapiens
tgtttatctagatgtaaatttt

SEQ ID NO: 5461015 - DNA, 14 bp, Homo sapiens
tgtttatgaaaata

SEQ ID NO: 5461016 - DNA, 18 bp, Homo sapiens
tgtttatgaaaataaata

SEQ ID NO: 5461017 - DNA, 15 bp, Homo sapiens
tgtttatgagaaact

SEQ ID NO: 5461018 - DNA, 15 bp, Homo sapiens
tgtttatgaggaaac

SEQ ID NO: 5461019 - DNA, 22 bp, Homo sapiens
tgtttatgatatttcttgcttt

SEQ ID NO: 5461020 - DNA, 23 bp, Homo sapiens
tgtttatgatatttcttgctttc

SEQ ID NO: 5461021 - DNA, 19 bp, Homo sapiens
tgtttatgcatttcaattt

SEQ ID NO: 5461022 - DNA, 14 bp, Homo sapiens
tgtttatgcttttg

SEQ ID NO: 5461023 - DNA, 22 bp, Homo sapiens
tgtttatggaaataccaggacc

SEQ ID NO: 5461024 - DNA, 15 bp, Homo sapiens
tgtttatggcctcag

SEQ ID NO: 5461025 - DNA, 19 bp, Homo sapiens
tgtttatgtaacttcctgt

SEQ ID NO: 5461026 - DNA, 21 bp, Homo sapiens
tgtttatgtgaacattcctat

SEQ ID NO: 5461027 - DNA, 22 bp, Homo sapiens
tgtttatgtgctattaatattt

SEQ ID NO: 5461028 - DNA, 16 bp, Homo sapiens
tgtttatgtgtgtgtg

SEQ ID NO: 5461029 - DNA, 19 bp, Homo sapiens
tgtttatgtgttatgaaca

SEQ ID NO: 5461030 - DNA, 21 bp, Homo sapiens
tgtttatgtgttatgaacatc

SEQ ID NO: 5461031 - DNA, 13 bp, Homo sapiens
tgtttatgttctt

SEQ ID NO: 5461032 - DNA, 18 bp, Homo sapiens
tgtttatgttcttataga

SEQ ID NO: 5461033 - DNA, 22 bp, Homo sapiens
tgtttatgttcttatagaataa

SEQ ID NO: 5461034 - DNA, 23 bp, Homo sapiens
tgtttatgttcttatagaataaa

SEQ ID NO: 5461035 - DNA, 18 bp, Homo sapiens
tgtttatgttgtttataa

SEQ ID NO: 5461036 - DNA, 15 bp, Homo sapiens
tgtttatgtttaaaa

SEQ ID NO: 5461037 - DNA, 14 bp, Homo sapiens
tgtttatgttttta

SEQ ID NO: 5461038 - DNA, 13 bp, Homo sapiens
tgtttattaaata

SEQ ID NO: 5461039 - DNA, 16 bp, Homo sapiens
tgtttattaacaaatt

SEQ ID NO: 5461040 - DNA, 22 bp, Homo sapiens
tgtttattaatagaatgataaa

SEQ ID NO: 5461041 - DNA, 17 bp, Homo sapiens
tgtttattaatcttagt

SEQ ID NO: 5461042 - DNA, 14 bp, Homo sapiens
tgtttattacaatt

SEQ ID NO: 5461043 - DNA, 18 bp, Homo sapiens
tgtttattacaattttta

SEQ ID NO: 5461044 - DNA, 13 bp, Homo sapiens
tgtttattagcat

SEQ ID NO: 5461045 - DNA, 19 bp, Homo sapiens
tgtttattagttttgcata

SEQ ID NO: 5461046 - DNA, 20 bp, Homo sapiens
tgtttattatcctgatcaag

SEQ ID NO: 5461047 - DNA, 14 bp, Homo sapiens
tgtttattatgaca

SEQ ID NO: 5461048 - DNA, 15 bp, Homo sapiens
tgtttattatttaca

SEQ ID NO: 5461049 - DNA, 21 bp, Homo sapiens
tgtttattcaaactgaaaagc

SEQ ID NO: 5461050 - DNA, 16 bp, Homo sapiens
tgtttattcatatgca

SEQ ID NO: 5461051 - DNA, 18 bp, Homo sapiens
tgtttattcatatgcata

SEQ ID NO: 5461052 - DNA, 19 bp, Homo sapiens
tgtttattcatccagcagt

SEQ ID NO: 5461053 - DNA, 21 bp, Homo sapiens
tgtttattcatccagcagtgt

SEQ ID NO: 5461054 - DNA, 23 bp, Homo sapiens
tgtttattcatccagcagtgttg

SEQ ID NO: 5461055 - DNA, 18 bp, Homo sapiens
tgtttattcctgataata

SEQ ID NO: 5461056 - DNA, 13 bp, Homo sapiens
tgtttattccttg

SEQ ID NO: 5461057 - DNA, 22 bp, Homo sapiens
tgtttattctagttaaggaaat

SEQ ID NO: 5461058 - DNA, 21 bp, Homo sapiens
tgtttattctctgctgcatct

SEQ ID NO: 5461059 - DNA, 16 bp, Homo sapiens
tgtttattctgtttca

SEQ ID NO: 5461060 - DNA, 17 bp, Homo sapiens
tgtttattcttccagaa

SEQ ID NO: 5461061 - DNA, 17 bp, Homo sapiens
tgtttattcttctagag

SEQ ID NO: 5461062 - DNA, 13 bp, Homo sapiens
tgtttattcttga

SEQ ID NO: 5461063 - DNA, 22 bp, Homo sapiens
tgtttattgagctgtacatgca

SEQ ID NO: 5461064 - DNA, 14 bp, Homo sapiens
tgtttattgagttt

SEQ ID NO: 5461065 - DNA, 14 bp, Homo sapiens
tgtttattgccatt

SEQ ID NO: 5461066 - DNA, 16 bp, Homo sapiens
tgtttattgccattat

SEQ ID NO: 5461067 - DNA, 22 bp, Homo sapiens
tgtttattgccattatagcgcc

SEQ ID NO: 5461068 - DNA, 14 bp, Homo sapiens
tgtttatttaagga

SEQ ID NO: 5461069 - DNA, 15 bp, Homo sapiens
tgtttatttaaggat

SEQ ID NO: 5461070 - DNA, 22 bp, Homo sapiens
tgtttatttataagcagattta

SEQ ID NO: 5461071 - DNA, 23 bp, Homo sapiens
tgtttatttataagcagatttaa

SEQ ID NO: 5461072 - DNA, 15 bp, Homo sapiens
tgtttatttatcagt

SEQ ID NO: 5461073 - DNA, 20 bp, Homo sapiens
tgtttatttattcactgtaa

SEQ ID NO: 5461074 - DNA, 22 bp, Homo sapiens
tgtttatttatttccagtggtc

SEQ ID NO: 5461075 - DNA, 15 bp, Homo sapiens
tgtttatttgcaatt

SEQ ID NO: 5461076 - DNA, 18 bp, Homo sapiens
tgtttatttgcaatttga

SEQ ID NO: 5461077 - DNA, 16 bp, Homo sapiens
tgtttattttatatta

SEQ ID NO: 5461078 - DNA, 18 bp, Homo sapiens
tgtttatttttaaatttt

SEQ ID NO: 5461079 - DNA, 18 bp, Homo sapiens
tgtttatttttcatattg

SEQ ID NO: 5461080 - DNA, 17 bp, Homo sapiens
tgtttatttttctatga

SEQ ID NO: 5461081 - DNA, 23 bp, Homo sapiens
tgtttatttttgtacatttgagc

SEQ ID NO: 5461082 - DNA, 14 bp, Homo sapiens
tgtttcaaaaccat

SEQ ID NO: 5461083 - DNA, 18 bp, Homo sapiens
tgtttcaaacacaaatgc

SEQ ID NO: 5461084 - DNA, 15 bp, Homo sapiens
tgtttcaaactttac

SEQ ID NO: 5461085 - DNA, 20 bp, Homo sapiens
tgtttcaaagggtaaattat

SEQ ID NO: 5461086 - DNA, 22 bp, Homo sapiens
tgtttcaaagggtaaattataa

SEQ ID NO: 5461087 - DNA, 19 bp, Homo sapiens
tgtttcaaatgcagaaacc

SEQ ID NO: 5461088 - DNA, 16 bp, Homo sapiens
tgtttcaaatggactg

SEQ ID NO: 5461089 - DNA, 19 bp, Homo sapiens
tgtttcaagaacctggaaa

SEQ ID NO: 5461090 - DNA, 23 bp, Homo sapiens
tgtttcaattagaaaaggaaata

SEQ ID NO: 5461091 - DNA, 14 bp, Homo sapiens
tgtttcaattctgt

SEQ ID NO: 5461092 - DNA, 21 bp, Homo sapiens
tgtttcaattctgtaattaca

SEQ ID NO: 5461093 - DNA, 13 bp, Homo sapiens
tgtttcacaaggt

SEQ ID NO: 5461094 - DNA, 21 bp, Homo sapiens
tgtttcacagtgtctgtaaat

SEQ ID NO: 5461095 - DNA, 17 bp, Homo sapiens
tgtttcacgtaagactt

SEQ ID NO: 5461096 - DNA, 15 bp, Homo sapiens
tgtttcactcctgct

SEQ ID NO: 5461097 - DNA, 16 bp, Homo sapiens
tgtttcactcctgctt

SEQ ID NO: 5461098 - DNA, 19 bp, Homo sapiens
tgtttcactcctgcttctc

SEQ ID NO: 5461099 - DNA, 14 bp, Homo sapiens
tgtttcactctttc

SEQ ID NO: 5461100 - DNA, 13 bp, Homo sapiens
tgtttcagaatct

SEQ ID NO: 5461101 - DNA, 22 bp, Homo sapiens
tgtttcagaatctctctactca

SEQ ID NO: 5461102 - DNA, 21 bp, Homo sapiens
tgtttcagaggctcagattgt

SEQ ID NO: 5461103 - DNA, 20 bp, Homo sapiens
tgtttcagattttttaaaat

SEQ ID NO: 5461104 - DNA, 17 bp, Homo sapiens
tgtttcagctaagggaa

SEQ ID NO: 5461105 - DNA, 22 bp, Homo sapiens
tgtttcagctgcagttgaagag

SEQ ID NO: 5461106 - DNA, 17 bp, Homo sapiens
tgtttcagcttctctgc

SEQ ID NO: 5461107 - DNA, 23 bp, Homo sapiens
tgtttcaggacagctgcttctgt

SEQ ID NO: 5461108 - DNA, 16 bp, Homo sapiens
tgtttcaggtggaaca

SEQ ID NO: 5461109 - DNA, 22 bp, Homo sapiens
tgtttcaggttcagtattatgt

SEQ ID NO: 5461110 - DNA, 16 bp, Homo sapiens
tgtttcaggtttccat

SEQ ID NO: 5461111 - DNA, 14 bp, Homo sapiens
tgtttcataacaaa

SEQ ID NO: 5461112 - DNA, 16 bp, Homo sapiens
tgtttcatagttttct

SEQ ID NO: 5461113 - DNA, 17 bp, Homo sapiens
tgtttcatagttttcta

SEQ ID NO: 5461114 - DNA, 14 bp, Homo sapiens
tgtttcatatctgg

SEQ ID NO: 5461115 - DNA, 14 bp, Homo sapiens
tgtttcatctcagc

SEQ ID NO: 5461116 - DNA, 15 bp, Homo sapiens
tgtttcatctcagct

SEQ ID NO: 5461117 - DNA, 16 bp, Homo sapiens
tgtttcatctcagctt

SEQ ID NO: 5461118 - DNA, 17 bp, Homo sapiens
tgtttcatctcagcttt

SEQ ID NO: 5461119 - DNA, 13 bp, Homo sapiens
tgtttcatgtttt

SEQ ID NO: 5461120 - DNA, 15 bp, Homo sapiens
tgtttcattcatcct

SEQ ID NO: 5461121 - DNA, 14 bp, Homo sapiens
tgtttccaaagtgc

SEQ ID NO: 5461122 - DNA, 20 bp, Homo sapiens
tgtttccaaagtgcatgtca

SEQ ID NO: 5461123 - DNA, 16 bp, Homo sapiens
tgtttccagaaaatat

SEQ ID NO: 5461124 - DNA, 18 bp, Homo sapiens
tgtttccagaaaatataa

SEQ ID NO: 5461125 - DNA, 19 bp, Homo sapiens
tgtttccagaaaatataaa

SEQ ID NO: 5461126 - DNA, 20 bp, Homo sapiens
tgtttccagaattggtaaaa

SEQ ID NO: 5461127 - DNA, 20 bp, Homo sapiens
tgtttccagcagaagacaaa

SEQ ID NO: 5461128 - DNA, 13 bp, Homo sapiens
tgtttccagcatt

SEQ ID NO: 5461129 - DNA, 14 bp, Homo sapiens
tgtttccagcattc

SEQ ID NO: 5461130 - DNA, 18 bp, Homo sapiens
tgtttccagcattcccag

SEQ ID NO: 5461131 - DNA, 14 bp, Homo sapiens
tgtttccagctgcc

SEQ ID NO: 5461132 - DNA, 15 bp, Homo sapiens
tgtttccagctgcca

SEQ ID NO: 5461133 - DNA, 15 bp, Homo sapiens
tgtttccaggagaaa

SEQ ID NO: 5461134 - DNA, 13 bp, Homo sapiens
tgtttccagggtc

SEQ ID NO: 5461135 - DNA, 17 bp, Homo sapiens
tgtttccaggtcagaaa

SEQ ID NO: 5461136 - DNA, 20 bp, Homo sapiens
tgtttccaggtcagaaacca

SEQ ID NO: 5461137 - DNA, 15 bp, Homo sapiens
tgtttccagtgacac

SEQ ID NO: 5461138 - DNA, 23 bp, Homo sapiens
tgtttccatcctttgcatttctc

SEQ ID NO: 5461139 - DNA, 22 bp, Homo sapiens
tgtttccccacaaaacaaagca

SEQ ID NO: 5461140 - DNA, 17 bp, Homo sapiens
tgtttccccatctctgt

SEQ ID NO: 5461141 - DNA, 15 bp, Homo sapiens
tgtttcccctcagaa

SEQ ID NO: 5461142 - DNA, 13 bp, Homo sapiens
tgtttcccctgca

SEQ ID NO: 5461143 - DNA, 22 bp, Homo sapiens
tgtttcccgggcaatttaacaa

SEQ ID NO: 5461144 - DNA, 17 bp, Homo sapiens
tgtttccctctgtgtta

SEQ ID NO: 5461145 - DNA, 15 bp, Homo sapiens
tgtttccctgctgaa

SEQ ID NO: 5461146 - DNA, 15 bp, Homo sapiens
tgtttccctgctggc

SEQ ID NO: 5461147 - DNA, 18 bp, Homo sapiens
tgtttccctgctggccaa

SEQ ID NO: 5461148 - DNA, 22 bp, Homo sapiens
tgtttccctgctggccaaagtc

SEQ ID NO: 5461149 - DNA, 12 bp, Homo sapiens
tgtttcccttcc

SEQ ID NO: 5461150 - DNA, 20 bp, Homo sapiens
tgtttcctatttaatacagc

SEQ ID NO: 5461151 - DNA, 21 bp, Homo sapiens
tgtttcctcatctatggttct

SEQ ID NO: 5461152 - DNA, 19 bp, Homo sapiens
tgtttcctccaaatctgat

SEQ ID NO: 5461153 - DNA, 14 bp, Homo sapiens
tgtttcctctagtt

SEQ ID NO: 5461154 - DNA, 14 bp, Homo sapiens
tgtttcctctgttc

SEQ ID NO: 5461155 - DNA, 13 bp, Homo sapiens
tgtttcctcttga

SEQ ID NO: 5461156 - DNA, 20 bp, Homo sapiens
tgtttcctgcacctgctgtc

SEQ ID NO: 5461157 - DNA, 12 bp, Homo sapiens
tgtttcctggaa

SEQ ID NO: 5461158 - DNA, 19 bp, Homo sapiens
tgtttcctggaagcagagc

SEQ ID NO: 5461159 - DNA, 23 bp, Homo sapiens
tgtttcctggcactgcttccagt

SEQ ID NO: 5461160 - DNA, 12 bp, Homo sapiens
tgtttcctggcc

SEQ ID NO: 5461161 - DNA, 18 bp, Homo sapiens
tgtttcctggcctcagag

SEQ ID NO: 5461162 - DNA, 14 bp, Homo sapiens
tgtttcctgtctga

SEQ ID NO: 5461163 - DNA, 17 bp, Homo sapiens
tgtttcctgtggaaata

SEQ ID NO: 5461164 - DNA, 14 bp, Homo sapiens
tgtttcctgtgtct

SEQ ID NO: 5461165 - DNA, 15 bp, Homo sapiens
tgtttcctgtgtctc

SEQ ID NO: 5461166 - DNA, 21 bp, Homo sapiens
tgttttttaagatagtgtaac

SEQ ID NO: 5461167 - DNA, 20 bp, Homo sapiens
tgttttttaaggtgagttct

SEQ ID NO: 5461168 - DNA, 14 bp, Homo sapiens
tgttttttcaaaat

SEQ ID NO: 5461169 - DNA, 24 bp, Homo sapiens
tgttttttcaagaaaattttgcag

SEQ ID NO: 5461170 - DNA, 13 bp, Homo sapiens
tgttttttcatgt

SEQ ID NO: 5461171 - DNA, 18 bp, Homo sapiens
tgttttttcctaaggaaa

SEQ ID NO: 5461172 - DNA, 13 bp, Homo sapiens
tgttttttccttt

SEQ ID NO: 5461173 - DNA, 16 bp, Homo sapiens
tgttttttcctttata

SEQ ID NO: 5461174 - DNA, 15 bp, Homo sapiens
tgttttttctttata

SEQ ID NO: 5461175 - DNA, 18 bp, Homo sapiens
tgttttttctttataatg

SEQ ID NO: 5461176 - DNA, 12 bp, Homo sapiens
tgttttttgata

SEQ ID NO: 5461177 - DNA, 17 bp, Homo sapiens
tgttttttggcttgctt

SEQ ID NO: 5461178 - DNA, 14 bp, Homo sapiens
tgttttttgttact

SEQ ID NO: 5461179 - DNA, 15 bp, Homo sapiens
tgttttttgttactg

SEQ ID NO: 5461180 - DNA, 13 bp, Homo sapiens
tgttttttgttct

SEQ ID NO: 5461181 - DNA, 18 bp, Homo sapiens
tgttttttgtttttctgc

SEQ ID NO: 5461182 - DNA, 9 bp, Homo sapiens
tgttttttt

SEQ ID NO: 5461183 - DNA, 20 bp, Homo sapiens
tgtttttttcctcatgtaac

SEQ ID NO: 5461184 - DNA, 15 bp, Homo sapiens
tgtttttttctaaaa

SEQ ID NO: 5461185 - DNA, 16 bp, Homo sapiens
tgtttttttctaaaaa

SEQ ID NO: 5461186 - DNA, 15 bp, Homo sapiens
tgtttttttctaata

SEQ ID NO: 5461187 - DNA, 20 bp, Homo sapiens
tgtttttttctcctgcaaat

SEQ ID NO: 5461188 - DNA, 22 bp, Homo sapiens
tgtttttttctttttttataaa

SEQ ID NO: 5461189 - DNA, 13 bp, Homo sapiens
tgtttttttgaga

SEQ ID NO: 5461190 - DNA, 14 bp, Homo sapiens
tgtttttttgagac

SEQ ID NO: 5461191 - DNA, 13 bp, Homo sapiens
tgtttttttgtag

SEQ ID NO: 5461192 - DNA, 18 bp, Homo sapiens
tgtttttttgttattaaa

SEQ ID NO: 5461193 - DNA, 16 bp, Homo sapiens
tgttttttttcctttg

SEQ ID NO: 5461194 - DNA, 14 bp, Homo sapiens
tgtttttttttaag

SEQ ID NO: 5461195 - DNA, 16 bp, Homo sapiens
tgttttttttttgaaa

SEQ ID NO: 5461196 - DNA, 20 bp, Homo sapiens
tgtttttttttttgagatgg

SEQ ID NO: 5461197 - DNA, 20 bp, Homo sapiens
ttaaaaaaaaagtcagagac

SEQ ID NO: 5461198 - DNA, 16 bp, Homo sapiens
ttaaaaaaaaatcttg

SEQ ID NO: 5461199 - DNA, 21 bp, Homo sapiens
ttaaaaaaaaatcttgtgtta

SEQ ID NO: 5461200 - DNA, 18 bp, Homo sapiens
ttaaaaaaaacaaaaaga

SEQ ID NO: 5461201 - DNA, 19 bp, Homo sapiens
ttaaaaaaaactatttaac

SEQ ID NO: 5461202 - DNA, 12 bp, Homo sapiens
ttaaaaaaaaga

SEQ ID NO: 5461203 - DNA, 13 bp, Homo sapiens
ttaaaaaaaataa

SEQ ID NO: 5461204 - DNA, 18 bp, Homo sapiens
ttaaaaaaaataataaat

SEQ ID NO: 5461205 - DNA, 18 bp, Homo sapiens
ttaaaaaaaatattctgt

SEQ ID NO: 5461206 - DNA, 19 bp, Homo sapiens
ttaaaaaaaatattctgtc

SEQ ID NO: 5461207 - DNA, 21 bp, Homo sapiens
ttaaaaaaaatattctgtcat

SEQ ID NO: 5461208 - DNA, 13 bp, Homo sapiens
ttaaaaaaaatcc

SEQ ID NO: 5461209 - DNA, 20 bp, Homo sapiens
ttaaaaaaacaaataaataa

SEQ ID NO: 5461210 - DNA, 23 bp, Homo sapiens
ttaaaaaaacaaatgttagactt

SEQ ID NO: 5461211 - DNA, 17 bp, Homo sapiens
ttaaaaaaacaaattgg

SEQ ID NO: 5461212 - DNA, 12 bp, Homo sapiens
ttaaaaaaacac

SEQ ID NO: 5461213 - DNA, 12 bp, Homo sapiens
ttaaaaaaactg

SEQ ID NO: 5461214 - DNA, 13 bp, Homo sapiens
ttaaaaaaactga

SEQ ID NO: 5461215 - DNA, 14 bp, Homo sapiens
ttaaaaaaagaaaa

SEQ ID NO: 5461216 - DNA, 21 bp, Homo sapiens
ttaaaaaaataaaacagtatc

SEQ ID NO: 5461217 - DNA, 22 bp, Homo sapiens
ttaaaaaaataaaacagtatct

SEQ ID NO: 5461218 - DNA, 18 bp, Homo sapiens
ttaaaaaaataaaacatt

SEQ ID NO: 5461219 - DNA, 19 bp, Homo sapiens
ttaaaaaaataaaacattt

SEQ ID NO: 5461220 - DNA, 14 bp, Homo sapiens
ttaaaaaaataaca

SEQ ID NO: 5461221 - DNA, 19 bp, Homo sapiens
ttaaaaaaataacatctga

SEQ ID NO: 5461222 - DNA, 22 bp, Homo sapiens
ttaaaaaaataacatctgaaaa

SEQ ID NO: 5461223 - DNA, 20 bp, Homo sapiens
ttaaaaaaataatataaatg

SEQ ID NO: 5461224 - DNA, 12 bp, Homo sapiens
ttaaaaaaatca

SEQ ID NO: 5461225 - DNA, 18 bp, Homo sapiens
ttaaaaaaatcaaaacaa

SEQ ID NO: 5461226 - DNA, 17 bp, Homo sapiens
ttaaaaaaatcacaaaa

SEQ ID NO: 5461227 - DNA, 12 bp, Homo sapiens
ttaaaaaaatgc

SEQ ID NO: 5461228 - DNA, 16 bp, Homo sapiens
ttaaaaaaatggcagt

SEQ ID NO: 5461229 - DNA, 21 bp, Homo sapiens
ttaaaaaaattggttggagaa

SEQ ID NO: 5461230 - DNA, 11 bp, Homo sapiens
ttaaaaaacaa

SEQ ID NO: 5461231 - DNA, 18 bp, Homo sapiens
ttaaaaaacaaaaagtaa

SEQ ID NO: 5461232 - DNA, 15 bp, Homo sapiens
ttaaaaaacagaaaa

SEQ ID NO: 5461233 - DNA, 23 bp, Homo sapiens
ttaaaaaacagaaaaacagacaa

SEQ ID NO: 5461234 - DNA, 14 bp, Homo sapiens
ttaaaaaactcttt

SEQ ID NO: 5461235 - DNA, 20 bp, Homo sapiens
ttaaaaaactgacaggcact

SEQ ID NO: 5461236 - DNA, 16 bp, Homo sapiens
ttaaaaaactgtataa

SEQ ID NO: 5461237 - DNA, 18 bp, Homo sapiens
ttaaaaaagaaacatttg

SEQ ID NO: 5461238 - DNA, 19 bp, Homo sapiens
ttaaaaaagaaacatttgg

SEQ ID NO: 5461239 - DNA, 20 bp, Homo sapiens
ttaaaaaagaaattatcttt

SEQ ID NO: 5461240 - DNA, 20 bp, Homo sapiens
ttaaaaaagactgaacatgt

SEQ ID NO: 5461241 - DNA, 15 bp, Homo sapiens
ttaaaaaagagacat

SEQ ID NO: 5461242 - DNA, 13 bp, Homo sapiens
ttaaaaaagataa

SEQ ID NO: 5461243 - DNA, 15 bp, Homo sapiens
ttaaaaaagatggat

SEQ ID NO: 5461244 - DNA, 21 bp, Homo sapiens
ttaaaaaagcttaaaactttg

SEQ ID NO: 5461245 - DNA, 16 bp, Homo sapiens
ttaaaaaagtgatctt

SEQ ID NO: 5461246 - DNA, 18 bp, Homo sapiens
ttaaaaaagtttaaaatg

SEQ ID NO: 5461247 - DNA, 14 bp, Homo sapiens
ttaaaaaataaaaa

SEQ ID NO: 5461248 - DNA, 22 bp, Homo sapiens
ttaaaaaataaaaaaatacagt

SEQ ID NO: 5461249 - DNA, 14 bp, Homo sapiens
ttaaaaaataaata

SEQ ID NO: 5461250 - DNA, 15 bp, Homo sapiens
ttaaaaaataaatat

SEQ ID NO: 5461251 - DNA, 20 bp, Homo sapiens
ttaaaaaataacatattctt

SEQ ID NO: 5461252 - DNA, 19 bp, Homo sapiens
ttaaaaaataatacaacaa

SEQ ID NO: 5461253 - DNA, 22 bp, Homo sapiens
ttaaaaaatacagtattattta

SEQ ID NO: 5461254 - DNA, 15 bp, Homo sapiens
ttaaaaaataccatt

SEQ ID NO: 5461255 - DNA, 19 bp, Homo sapiens
ttaaaaaataccattgaaa

SEQ ID NO: 5461256 - DNA, 21 bp, Homo sapiens
ttaaaaaatattttaagaaag

SEQ ID NO: 5461257 - DNA, 22 bp, Homo sapiens
ttaaaaaatattttaagaaaga

SEQ ID NO: 5461258 - DNA, 14 bp, Homo sapiens
ttaaaaaatcagaa

SEQ ID NO: 5461259 - DNA, 15 bp, Homo sapiens
ttaaaaaatcttaat

SEQ ID NO: 5461260 - DNA, 16 bp, Homo sapiens
ttaaaaaatcttaatg

SEQ ID NO: 5461261 - DNA, 16 bp, Homo sapiens
ttaaaaaatgaaatcc

SEQ ID NO: 5461262 - DNA, 18 bp, Homo sapiens
ttaaaaaatgaatagtac

SEQ ID NO: 5461263 - DNA, 13 bp, Homo sapiens
ttaaaaaatgtcc

SEQ ID NO: 5461264 - DNA, 18 bp, Homo sapiens
ttaaaaaatgttttctgg

SEQ ID NO: 5461265 - DNA, 15 bp, Homo sapiens
ttaaaaaattaaaaa

SEQ ID NO: 5461266 - DNA, 17 bp, Homo sapiens
ttaaaaacaaaaggcaa

SEQ ID NO: 5461267 - DNA, 23 bp, Homo sapiens
ttaaaaacacctaagtgactacc

SEQ ID NO: 5461268 - DNA, 15 bp, Homo sapiens
ttaaaaacaggaaaa

SEQ ID NO: 5461269 - DNA, 16 bp, Homo sapiens
ttaaaaacatagaaaa

SEQ ID NO: 5461270 - DNA, 17 bp, Homo sapiens
ttaaaaacatgagaaat

SEQ ID NO: 5461271 - DNA, 20 bp, Homo sapiens
ttaaaaacatgagaaatgtg

SEQ ID NO: 5461272 - DNA, 12 bp, Homo sapiens
ttaaaaacattt

SEQ ID NO: 5461273 - DNA, 13 bp, Homo sapiens
ttaaaaacatttt

SEQ ID NO: 5461274 - DNA, 20 bp, Homo sapiens
ttaaaaacctattttgaaag

SEQ ID NO: 5461275 - DNA, 21 bp, Homo sapiens
ttaaaaacgaaaacctgacta

SEQ ID NO: 5461276 - DNA, 18 bp, Homo sapiens
ttaaaaactagtagttct

SEQ ID NO: 5461277 - DNA, 16 bp, Homo sapiens
ttaaaaactatttaac

SEQ ID NO: 5461278 - DNA, 15 bp, Homo sapiens
ttaaaaactcctttt

SEQ ID NO: 5461279 - DNA, 18 bp, Homo sapiens
ttaaaaactgaaaaatct

SEQ ID NO: 5461280 - DNA, 11 bp, Homo sapiens
ttaaaaactgt

SEQ ID NO: 5461281 - DNA, 13 bp, Homo sapiens
ttaaaaactgtgt

SEQ ID NO: 5461282 - DNA, 14 bp, Homo sapiens
ttaaaaactttatt

SEQ ID NO: 5461283 - DNA, 20 bp, Homo sapiens
ttaaaaagaaaagtttataa

SEQ ID NO: 5461284 - DNA, 20 bp, Homo sapiens
ttaaaaagaaacaagatgct

SEQ ID NO: 5461285 - DNA, 12 bp, Homo sapiens
ttaaaaagaaat

SEQ ID NO: 5461286 - DNA, 15 bp, Homo sapiens
ttaaaaagaaattaa

SEQ ID NO: 5461287 - DNA, 15 bp, Homo sapiens
ttaaaaagagtaatt

SEQ ID NO: 5461288 - DNA, 13 bp, Homo sapiens
ttaaaaagattct

SEQ ID NO: 5461289 - DNA, 18 bp, Homo sapiens
ttaaaaagattctttttc

SEQ ID NO: 5461290 - DNA, 11 bp, Homo sapiens
ttaaaaagcaa

SEQ ID NO: 5461291 - DNA, 16 bp, Homo sapiens
ttaaaaagcagtcctc

SEQ ID NO: 5461292 - DNA, 20 bp, Homo sapiens
ttaaaaagcagtttttgaaa

SEQ ID NO: 5461293 - DNA, 20 bp, Homo sapiens
ttaaaaagccaagtgtcctg

SEQ ID NO: 5461294 - DNA, 13 bp, Homo sapiens
ttaaaaagccagt

SEQ ID NO: 5461295 - DNA, 20 bp, Homo sapiens
ttaaaaagctcactgctgat

SEQ ID NO: 5461296 - DNA, 16 bp, Homo sapiens
ttaaaaaggaattttg

SEQ ID NO: 5461297 - DNA, 18 bp, Homo sapiens
ttaaaaaggactatatta

SEQ ID NO: 5461298 - DNA, 20 bp, Homo sapiens
ttaaaaaggcagtttgcaaa

SEQ ID NO: 5461299 - DNA, 12 bp, Homo sapiens
ttaaaaaggcca

SEQ ID NO: 5461300 - DNA, 16 bp, Homo sapiens
ttaaaaaggccaaaga

SEQ ID NO: 5461301 - DNA, 17 bp, Homo sapiens
ttaaaaaggccaaagat

SEQ ID NO: 5461302 - DNA, 17 bp, Homo sapiens
ttaaaaaggcctttggg

SEQ ID NO: 5461303 - DNA, 18 bp, Homo sapiens
ttaaaaagggaagaaact

SEQ ID NO: 5461304 - DNA, 16 bp, Homo sapiens
ttaaaaagtctgcatt

SEQ ID NO: 5461305 - DNA, 16 bp, Homo sapiens
ttaaaaagtcttttaa

SEQ ID NO: 5461306 - DNA, 23 bp, Homo sapiens
ttaaaaagtcttttaaaaagtat

SEQ ID NO: 5461307 - DNA, 13 bp, Homo sapiens
ttaaaaagtgttt

SEQ ID NO: 5461308 - DNA, 18 bp, Homo sapiens
ttaaaaagttgcacatta

SEQ ID NO: 5461309 - DNA, 16 bp, Homo sapiens
ttaaaaagttgttcaa

SEQ ID NO: 5461310 - DNA, 16 bp, Homo sapiens
ttaaaaataaaagcta

SEQ ID NO: 5461311 - DNA, 13 bp, Homo sapiens
ttaaaaataaaat

SEQ ID NO: 5461312 - DNA, 17 bp, Homo sapiens
ttaaaaataaatctaaa

SEQ ID NO: 5461313 - DNA, 23 bp, Homo sapiens
ttaaaaataactgagatattatt

SEQ ID NO: 5461314 - DNA, 15 bp, Homo sapiens
ttaaaaataagtcaa

SEQ ID NO: 5461315 - DNA, 14 bp, Homo sapiens
ttaaaaatacacat

SEQ ID NO: 5461316 - DNA, 16 bp, Homo sapiens
ttaaaaatacacatgg

SEQ ID NO: 5461317 - DNA, 23 bp, Homo sapiens
ttaaaaataccttctatgtatta

SEQ ID NO: 5461318 - DNA, 13 bp, Homo sapiens
ttaaaaatataaa

SEQ ID NO: 5461319 - DNA, 20 bp, Homo sapiens
ttaaaaatatggaacttcta

SEQ ID NO: 5461320 - DNA, 22 bp, Homo sapiens
ttaaaaatatggaacttctaat

SEQ ID NO: 5461321 - DNA, 19 bp, Homo sapiens
ttaaaaatctacgtcttta

SEQ ID NO: 5461322 - DNA, 17 bp, Homo sapiens
ttaaaaatctcaaattt

SEQ ID NO: 5461323 - DNA, 19 bp, Homo sapiens
ttaaaaatctcaaatttct

SEQ ID NO: 5461324 - DNA, 16 bp, Homo sapiens
ttaaaaatctgccacc

SEQ ID NO: 5461325 - DNA, 13 bp, Homo sapiens
ttaaaaatctttc

SEQ ID NO: 5461326 - DNA, 16 bp, Homo sapiens
ttaaaaatgaaaatta

SEQ ID NO: 5461327 - DNA, 14 bp, Homo sapiens
ttaaaaatgaagat

SEQ ID NO: 5461328 - DNA, 19 bp, Homo sapiens
ttaaaaatgagtgtgaagg

SEQ ID NO: 5461329 - DNA, 12 bp, Homo sapiens
ttaaaaatgcat

SEQ ID NO: 5461330 - DNA, 14 bp, Homo sapiens
ttaaaaatgcattt

SEQ ID NO: 5461331 - DNA, 18 bp, Homo sapiens
ttaaaaatgcatttaagt

SEQ ID NO: 5461332 - DNA, 12 bp, Homo sapiens
ttaaaaatggaa

SEQ ID NO: 5461333 - DNA, 12 bp, Homo sapiens
ttaaaaatggta

SEQ ID NO: 5461334 - DNA, 19 bp, Homo sapiens
ttaaaaatggtatcaaaat

SEQ ID NO: 5461335 - DNA, 20 bp, Homo sapiens
ttaaaaatggtatcaaaatt

SEQ ID NO: 5461336 - DNA, 18 bp, Homo sapiens
ttaaaaatggtggcttca

SEQ ID NO: 5461337 - DNA, 20 bp, Homo sapiens
ttaaaaatggtttaaatggt

SEQ ID NO: 5461338 - DNA, 13 bp, Homo sapiens
ttaaaaatgtaaa

SEQ ID NO: 5461339 - DNA, 16 bp, Homo sapiens
ttaaaaatgtaaatat

SEQ ID NO: 5461340 - DNA, 20 bp, Homo sapiens
ttaaaaatgttttttcatgt

SEQ ID NO: 5461341 - DNA, 19 bp, Homo sapiens
ttaaaaattaaatatttat

SEQ ID NO: 5461342 - DNA, 18 bp, Homo sapiens
ttaaaaattaattcttta

SEQ ID NO: 5461343 - DNA, 21 bp, Homo sapiens
ttaaaaattagccttgatatt

SEQ ID NO: 5461344 - DNA, 18 bp, Homo sapiens
ttaaaaattgaaaacttt

SEQ ID NO: 5461345 - DNA, 22 bp, Homo sapiens
ttaaaaattggctagttgaatc

SEQ ID NO: 5461346 - DNA, 22 bp, Homo sapiens
ttaaactgttagcactgttgat

SEQ ID NO: 5461347 - DNA, 16 bp, Homo sapiens
ttaaacttaatctaaa

SEQ ID NO: 5461348 - DNA, 18 bp, Homo sapiens
ttaaacttaatctaaatg

SEQ ID NO: 5461349 - DNA, 23 bp, Homo sapiens
ttaaacttataaatcatattgat

SEQ ID NO: 5461350 - DNA, 13 bp, Homo sapiens
ttaaacttcacct

SEQ ID NO: 5461351 - DNA, 12 bp, Homo sapiens
ttaaacttcagc

SEQ ID NO: 5461352 - DNA, 14 bp, Homo sapiens
ttaaacttcagttt

SEQ ID NO: 5461353 - DNA, 19 bp, Homo sapiens
ttaaacttcagttttactg

SEQ ID NO: 5461354 - DNA, 15 bp, Homo sapiens
ttaaacttctctgaa

SEQ ID NO: 5461355 - DNA, 17 bp, Homo sapiens
ttaaacttctctgaagg

SEQ ID NO: 5461356 - DNA, 20 bp, Homo sapiens
ttaaacttgaaatatataat

SEQ ID NO: 5461357 - DNA, 21 bp, Homo sapiens
ttaaacttgaaatatataata

SEQ ID NO: 5461358 - DNA, 22 bp, Homo sapiens
ttaaacttgaaatatataatat

SEQ ID NO: 5461359 - DNA, 13 bp, Homo sapiens
ttaaacttgaact

SEQ ID NO: 5461360 - DNA, 15 bp, Homo sapiens
ttaaacttgcacatt

SEQ ID NO: 5461361 - DNA, 18 bp, Homo sapiens
ttaaagaaaaaaatgtat

SEQ ID NO: 5461362 - DNA, 23 bp, Homo sapiens
ttaaagaaaaaaatgtcaaaagt

SEQ ID NO: 5461363 - DNA, 20 bp, Homo sapiens
ttaaagaaaaaaattgaaat

SEQ ID NO: 5461364 - DNA, 15 bp, Homo sapiens
ttaaagaaaagatga

SEQ ID NO: 5461365 - DNA, 19 bp, Homo sapiens
ttaaagaaaagttcttaaa

SEQ ID NO: 5461366 - DNA, 21 bp, Homo sapiens
ttaaagaaaagttcttaaaac

SEQ ID NO: 5461367 - DNA, 13 bp, Homo sapiens
ttaaagaaaatgt

SEQ ID NO: 5461368 - DNA, 17 bp, Homo sapiens
ttaaagaaaatgtgtct

SEQ ID NO: 5461369 - DNA, 23 bp, Homo sapiens
ttaaagaaaattaattatgtgta

SEQ ID NO: 5461370 - DNA, 18 bp, Homo sapiens
ttaaagaaaattgcatga

SEQ ID NO: 5461371 - DNA, 18 bp, Homo sapiens
ttaaagaaaattgccaaa

SEQ ID NO: 5461372 - DNA, 22 bp, Homo sapiens
ttaaagaaacactaaattagtt

SEQ ID NO: 5461373 - DNA, 21 bp, Homo sapiens
ttaaagaaacagctttcaagt

SEQ ID NO: 5461374 - DNA, 17 bp, Homo sapiens
ttaaagaaacatggttt

SEQ ID NO: 5461375 - DNA, 14 bp, Homo sapiens
ttaaagaaaggaaa

SEQ ID NO: 5461376 - DNA, 20 bp, Homo sapiens
ttaaagaaatatgtattctg

SEQ ID NO: 5461377 - DNA, 15 bp, Homo sapiens
ttaaagaaatttaat

SEQ ID NO: 5461378 - DNA, 17 bp, Homo sapiens
ttaaagaagctctccag

SEQ ID NO: 5461379 - DNA, 13 bp, Homo sapiens
ttaaagaagcttt

SEQ ID NO: 5461380 - DNA, 15 bp, Homo sapiens
ttaaagaagctttat

SEQ ID NO: 5461381 - DNA, 19 bp, Homo sapiens
ttaaagaagtatgggaaat

SEQ ID NO: 5461382 - DNA, 24 bp, Homo sapiens
ttaaagaagtccatgtgataattg

SEQ ID NO: 5461383 - DNA, 23 bp, Homo sapiens
ttaaagaataaagtccaaagtca

SEQ ID NO: 5461384 - DNA, 18 bp, Homo sapiens
ttaaagaatatgaaacat

SEQ ID NO: 5461385 - DNA, 12 bp, Homo sapiens
ttaaagaatcca

SEQ ID NO: 5461386 - DNA, 20 bp, Homo sapiens
ttaaagaatccttatctata

SEQ ID NO: 5461387 - DNA, 19 bp, Homo sapiens
ttaaagaatgagaaacata

SEQ ID NO: 5461388 - DNA, 13 bp, Homo sapiens
ttaaagaatgtta

SEQ ID NO: 5461389 - DNA, 14 bp, Homo sapiens
ttaaagaattcaaa

SEQ ID NO: 5461390 - DNA, 15 bp, Homo sapiens
ttaaagaattcaaat

SEQ ID NO: 5461391 - DNA, 17 bp, Homo sapiens
ttaaagaattcaaattt

SEQ ID NO: 5461392 - DNA, 20 bp, Homo sapiens
ttaaagaattcaaattttat

SEQ ID NO: 5461393 - DNA, 17 bp, Homo sapiens
ttaaagaatttctttat

SEQ ID NO: 5461394 - DNA, 11 bp, Homo sapiens
ttaaagacaga

SEQ ID NO: 5461395 - DNA, 12 bp, Homo sapiens
ttaaagacagag

SEQ ID NO: 5461396 - DNA, 19 bp, Homo sapiens
ttaaagacccaacttgcca

SEQ ID NO: 5461397 - DNA, 17 bp, Homo sapiens
ttaaagactacaataaa

SEQ ID NO: 5461398 - DNA, 13 bp, Homo sapiens
ttaaagactagga

SEQ ID NO: 5461399 - DNA, 12 bp, Homo sapiens
ttaaagacttga

SEQ ID NO: 5461400 - DNA, 17 bp, Homo sapiens
ttaaagacttgatgaat

SEQ ID NO: 5461401 - DNA, 17 bp, Homo sapiens
ttaaagagatagcttct

SEQ ID NO: 5461402 - DNA, 17 bp, Homo sapiens
ttaaagagatttccctt

SEQ ID NO: 5461403 - DNA, 23 bp, Homo sapiens
ttaaagagatttcccttcattta

SEQ ID NO: 5461404 - DNA, 16 bp, Homo sapiens
ttaaagagcatggaaa

SEQ ID NO: 5461405 - DNA, 23 bp, Homo sapiens
ttaaagaggaatggccctcattc

SEQ ID NO: 5461406 - DNA, 19 bp, Homo sapiens
ttaaagaggagaaggaaaa

SEQ ID NO: 5461407 - DNA, 14 bp, Homo sapiens
ttaaagagtctaga

SEQ ID NO: 5461408 - DNA, 16 bp, Homo sapiens
ttaaagagtctagatt

SEQ ID NO: 5461409 - DNA, 18 bp, Homo sapiens
ttaaagagtctagattca

SEQ ID NO: 5461410 - DNA, 19 bp, Homo sapiens
ttaaagagtctagattcaa

SEQ ID NO: 5461411 - DNA, 17 bp, Homo sapiens
ttaaagagtgtgttata

SEQ ID NO: 5461412 - DNA, 14 bp, Homo sapiens
ttaaagatattgtt

SEQ ID NO: 5461413 - DNA, 20 bp, Homo sapiens
ttaaagatatttctttaaat

SEQ ID NO: 5461414 - DNA, 18 bp, Homo sapiens
ttaaagatcatgacatat

SEQ ID NO: 5461415 - DNA, 19 bp, Homo sapiens
ttaaagatctcaacatgga

SEQ ID NO: 5461416 - DNA, 16 bp, Homo sapiens
ttaaagatctgcaact

SEQ ID NO: 5461417 - DNA, 17 bp, Homo sapiens
ttaaagatgaactctga

SEQ ID NO: 5461418 - DNA, 14 bp, Homo sapiens
ttaaagatgcaggt

SEQ ID NO: 5461419 - DNA, 11 bp, Homo sapiens
ttaaagatgcc

SEQ ID NO: 5461420 - DNA, 17 bp, Homo sapiens
ttaaagatgccatagca

SEQ ID NO: 5461421 - DNA, 23 bp, Homo sapiens
ttaaagatgccatagcataatat

SEQ ID NO: 5461422 - DNA, 19 bp, Homo sapiens
ttaaagatggatttgaaaa

SEQ ID NO: 5461423 - DNA, 22 bp, Homo sapiens
ttaaagattattgtgacttcac

SEQ ID NO: 5461424 - DNA, 19 bp, Homo sapiens
ttaaagattggaatgtgtt

SEQ ID NO: 5461425 - DNA, 14 bp, Homo sapiens
ttaaagatttatca

SEQ ID NO: 5461426 - DNA, 14 bp, Homo sapiens
ttaaagatttctgc

SEQ ID NO: 5461427 - DNA, 13 bp, Homo sapiens
ttaaagatttctt

SEQ ID NO: 5461428 - DNA, 21 bp, Homo sapiens
ttaaagatttgtttgtgttta

SEQ ID NO: 5461429 - DNA, 16 bp, Homo sapiens
ttaaagcaaaaaatga

SEQ ID NO: 5461430 - DNA, 15 bp, Homo sapiens
ttaaagcaaagtcac

SEQ ID NO: 5461431 - DNA, 14 bp, Homo sapiens
ttaaagcaattgca

SEQ ID NO: 5461432 - DNA, 16 bp, Homo sapiens
ttaaagcacatgccag

SEQ ID NO: 5461433 - DNA, 14 bp, Homo sapiens
ttaaagcagacagt

SEQ ID NO: 5461434 - DNA, 18 bp, Homo sapiens
ttaaagcagtgcttctca

SEQ ID NO: 5461435 - DNA, 19 bp, Homo sapiens
ttaaagcatatagagatga

SEQ ID NO: 5461436 - DNA, 18 bp, Homo sapiens
ttaaagcattacagtatt

SEQ ID NO: 5461437 - DNA, 16 bp, Homo sapiens
ttaaagcattgctttt

SEQ ID NO: 5461438 - DNA, 17 bp, Homo sapiens
ttaaagcatttactttg

SEQ ID NO: 5461439 - DNA, 20 bp, Homo sapiens
ttaaagcatttactttgaat

SEQ ID NO: 5461440 - DNA, 16 bp, Homo sapiens
ttaaagccaaatgtaa

SEQ ID NO: 5461441 - DNA, 17 bp, Homo sapiens
ttaaagccaaatgtaaa

SEQ ID NO: 5461442 - DNA, 22 bp, Homo sapiens
ttaaagccacaaccacatacaa

SEQ ID NO: 5461443 - DNA, 16 bp, Homo sapiens
ttaaagccagtcatca

SEQ ID NO: 5461444 - DNA, 21 bp, Homo sapiens
ttaaagccagtcatcatctct

SEQ ID NO: 5461445 - DNA, 12 bp, Homo sapiens
ttaaagccatgt

SEQ ID NO: 5461446 - DNA, 18 bp, Homo sapiens
ttaaagccatgtttatta

SEQ ID NO: 5461447 - DNA, 18 bp, Homo sapiens
ttaaagccattctgatta

SEQ ID NO: 5461448 - DNA, 16 bp, Homo sapiens
ttaaagccctgtgtta

SEQ ID NO: 5461449 - DNA, 21 bp, Homo sapiens
ttaaagccctgtgttaagtgt

SEQ ID NO: 5461450 - DNA, 18 bp, Homo sapiens
ttaaagcctgaaaattcc

SEQ ID NO: 5461451 - DNA, 19 bp, Homo sapiens
ttaaagcctgaaaattcca

SEQ ID NO: 5461452 - DNA, 11 bp, Homo sapiens
ttaaagccttc

SEQ ID NO: 5461453 - DNA, 13 bp, Homo sapiens
ttaaagctaaatt

SEQ ID NO: 5461454 - DNA, 18 bp, Homo sapiens
ttaaagctgcctgtagtt

SEQ ID NO: 5461455 - DNA, 19 bp, Homo sapiens
ttaaagctggaacatttga

SEQ ID NO: 5461456 - DNA, 17 bp, Homo sapiens
ttaaagcttatttttat

SEQ ID NO: 5461457 - DNA, 18 bp, Homo sapiens
ttaaagcttatttttatg

SEQ ID NO: 5461458 - DNA, 22 bp, Homo sapiens
ttaaagcttatttttatgtggt

SEQ ID NO: 5461459 - DNA, 20 bp, Homo sapiens
ttaaagcttatttttctgtg

SEQ ID NO: 5461460 - DNA, 21 bp, Homo sapiens
ttaaagcttatttttctgtga

SEQ ID NO: 5461461 - DNA, 15 bp, Homo sapiens
ttaaagcttccattg

SEQ ID NO: 5461462 - DNA, 20 bp, Homo sapiens
ttaaagcttccattgttgtc

SEQ ID NO: 5461463 - DNA, 18 bp, Homo sapiens
ttaaagctttcaacatgt

SEQ ID NO: 5461464 - DNA, 17 bp, Homo sapiens
ttaaaggaaaaaatgtt

SEQ ID NO: 5461465 - DNA, 16 bp, Homo sapiens
ttaaaggaaaagcaca

SEQ ID NO: 5461466 - DNA, 22 bp, Homo sapiens
ttaaaggaaaagtcaacatctt

SEQ ID NO: 5461467 - DNA, 20 bp, Homo sapiens
ttaaaggaaacgtggcagga

SEQ ID NO: 5461468 - DNA, 15 bp, Homo sapiens
ttaaaggaaggaaaa

SEQ ID NO: 5461469 - DNA, 18 bp, Homo sapiens
ttaaaggaatgtgaaatt

SEQ ID NO: 5461470 - DNA, 16 bp, Homo sapiens
ttaaaggcagcatttg

SEQ ID NO: 5461471 - DNA, 20 bp, Homo sapiens
ttaaaggcagcatttgatga

SEQ ID NO: 5461472 - DNA, 21 bp, Homo sapiens
ttaaaggcagtattttgtgtc

SEQ ID NO: 5461473 - DNA, 15 bp, Homo sapiens
ttaaaggctgtggta

SEQ ID NO: 5461474 - DNA, 17 bp, Homo sapiens
ttaaaggcttctctctc

SEQ ID NO: 5461475 - DNA, 13 bp, Homo sapiens
ttaaagggaagaa

SEQ ID NO: 5461476 - DNA, 16 bp, Homo sapiens
ttaaagggaagaaaac

SEQ ID NO: 5461477 - DNA, 22 bp, Homo sapiens
ttaaagggcagaaggggaagat

SEQ ID NO: 5461478 - DNA, 21 bp, Homo sapiens
ttaaaggggagacctcagaag

SEQ ID NO: 5461479 - DNA, 22 bp, Homo sapiens
ttaaagggggagaattctagaa

SEQ ID NO: 5461480 - DNA, 16 bp, Homo sapiens
ttaaaggtcctgccct

SEQ ID NO: 5461481 - DNA, 17 bp, Homo sapiens
ttaaaggttactgtttt

SEQ ID NO: 5461482 - DNA, 17 bp, Homo sapiens
ttaaaggtttttgaaat

SEQ ID NO: 5461483 - DNA, 19 bp, Homo sapiens
ttaaagtaaacttgtgtat

SEQ ID NO: 5461484 - DNA, 16 bp, Homo sapiens
ttaaagtaaaggcctc

SEQ ID NO: 5461485 - DNA, 17 bp, Homo sapiens
ttaaagtaaaggcctca

SEQ ID NO: 5461486 - DNA, 22 bp, Homo sapiens
ttaaagtaattgttccagagac

SEQ ID NO: 5461487 - DNA, 20 bp, Homo sapiens
ttaaagtaatttacaaacct

SEQ ID NO: 5461488 - DNA, 16 bp, Homo sapiens
ttaaagtaatttctaa

SEQ ID NO: 5461489 - DNA, 15 bp, Homo sapiens
ttaaagtactttctt

SEQ ID NO: 5461490 - DNA, 18 bp, Homo sapiens
ttaaagtatgaatctatg

SEQ ID NO: 5461491 - DNA, 13 bp, Homo sapiens
ttaaagtattctt

SEQ ID NO: 5461492 - DNA, 20 bp, Homo sapiens
ttaaagtattttaattttaa

SEQ ID NO: 5461493 - DNA, 14 bp, Homo sapiens
ttaaagtattttct

SEQ ID NO: 5461494 - DNA, 21 bp, Homo sapiens
ttaaagtcaatattgatttta

SEQ ID NO: 5461495 - DNA, 18 bp, Homo sapiens
ttaaagtcaggtccaatt

SEQ ID NO: 5461496 - DNA, 19 bp, Homo sapiens
ttaaagtcgagcttttcta

SEQ ID NO: 5461497 - DNA, 16 bp, Homo sapiens
ttaaagtctgagaaat

SEQ ID NO: 5461498 - DNA, 16 bp, Homo sapiens
ttaaagtgaacacaca

SEQ ID NO: 5461499 - DNA, 14 bp, Homo sapiens
ttaaagtgaaggaa

SEQ ID NO: 5461500 - DNA, 13 bp, Homo sapiens
ttaaagtgaattg

SEQ ID NO: 5461501 - DNA, 20 bp, Homo sapiens
ttaaagtgactaatggcatg

SEQ ID NO: 5461502 - DNA, 12 bp, Homo sapiens
ttaaagtgactt

SEQ ID NO: 5461503 - DNA, 14 bp, Homo sapiens
ttaaagtgactttc

SEQ ID NO: 5461504 - DNA, 20 bp, Homo sapiens
ttaaagtgaggccactgaag

SEQ ID NO: 5461505 - DNA, 17 bp, Homo sapiens
ttaaagtgcactgtgtc

SEQ ID NO: 5461506 - DNA, 22 bp, Homo sapiens
ttaaagtgcagtcatttgtggt

SEQ ID NO: 5461507 - DNA, 20 bp, Homo sapiens
ttaaagtgccttatcaaata

SEQ ID NO: 5461508 - DNA, 21 bp, Homo sapiens
ttaaagtgctaaggttctaag

SEQ ID NO: 5461509 - DNA, 14 bp, Homo sapiens
ttaaagtgctgttt

SEQ ID NO: 5461510 - DNA, 19 bp, Homo sapiens
ttaaagtgtccattgacat

SEQ ID NO: 5461511 - DNA, 21 bp, Homo sapiens
ttaaagtgtccattgacatgt

SEQ ID NO: 5461512 - DNA, 14 bp, Homo sapiens
ttaaagtgtttcag

SEQ ID NO: 5461513 - DNA, 12 bp, Homo sapiens
ttaaagttaata

SEQ ID NO: 5461514 - DNA, 14 bp, Homo sapiens
ttaaagttcaaact

SEQ ID NO: 5461515 - DNA, 11 bp, Homo sapiens
ttaaagttctg

SEQ ID NO: 5461516 - DNA, 15 bp, Homo sapiens
ttaaagttctgtgta

SEQ ID NO: 5461517 - DNA, 19 bp, Homo sapiens
ttaaagttctgtgtattta

SEQ ID NO: 5461518 - DNA, 16 bp, Homo sapiens
ttaaagttgaatttat

SEQ ID NO: 5461519 - DNA, 20 bp, Homo sapiens
ttaaagttgattttgaactt

SEQ ID NO: 5461520 - DNA, 22 bp, Homo sapiens
ttaaagttgattttgaactttt

SEQ ID NO: 5461521 - DNA, 14 bp, Homo sapiens
ttaaagttggaatt

SEQ ID NO: 5461522 - DNA, 21 bp, Homo sapiens
ttaaagttgtataaaaacatg

SEQ ID NO: 5461523 - DNA, 15 bp, Homo sapiens
ttaaagttgtttgtg

SEQ ID NO: 5461524 - DNA, 19 bp, Homo sapiens
ttaacttgttaccattgta

SEQ ID NO: 5461525 - DNA, 15 bp, Homo sapiens
ttaactttaaaactg

SEQ ID NO: 5461526 - DNA, 16 bp, Homo sapiens
ttaactttaaaactgt

SEQ ID NO: 5461527 - DNA, 16 bp, Homo sapiens
ttaactttaagtttca

SEQ ID NO: 5461528 - DNA, 13 bp, Homo sapiens
ttaactttaccat

SEQ ID NO: 5461529 - DNA, 23 bp, Homo sapiens
ttaactttatcacattatttgca

SEQ ID NO: 5461530 - DNA, 14 bp, Homo sapiens
ttaactttattaca

SEQ ID NO: 5461531 - DNA, 23 bp, Homo sapiens
ttaactttattacaatttgtatt

SEQ ID NO: 5461532 - DNA, 17 bp, Homo sapiens
ttaactttgggcccaga

SEQ ID NO: 5461533 - DNA, 20 bp, Homo sapiens
ttaactttgtggtaacttct

SEQ ID NO: 5461534 - DNA, 22 bp, Homo sapiens
ttaactttgtggtaacttcttt

SEQ ID NO: 5461535 - DNA, 15 bp, Homo sapiens
ttaacttttaaagaa

SEQ ID NO: 5461536 - DNA, 15 bp, Homo sapiens
ttaacttttataaac

SEQ ID NO: 5461537 - DNA, 23 bp, Homo sapiens
ttaacttttataaactttacctt

SEQ ID NO: 5461538 - DNA, 15 bp, Homo sapiens
ttaacttttggaatc

SEQ ID NO: 5461539 - DNA, 18 bp, Homo sapiens
ttaactttttatttctaa

SEQ ID NO: 5461540 - DNA, 21 bp, Homo sapiens
ttaactttttgtaggatactt

SEQ ID NO: 5461541 - DNA, 16 bp, Homo sapiens
ttaagaaaaaaataat

SEQ ID NO: 5461542 - DNA, 16 bp, Homo sapiens
ttaagaaaaacatgtc

SEQ ID NO: 5461543 - DNA, 19 bp, Homo sapiens
ttaagaaaaacatgtcatg

SEQ ID NO: 5461544 - DNA, 21 bp, Homo sapiens
ttaagaaaaatcataactcac

SEQ ID NO: 5461545 - DNA, 22 bp, Homo sapiens
ttaagaaaacaagtatataatt

SEQ ID NO: 5461546 - DNA, 15 bp, Homo sapiens
ttaagaaaactatta

SEQ ID NO: 5461547 - DNA, 14 bp, Homo sapiens
ttaagaaaagcact

SEQ ID NO: 5461548 - DNA, 14 bp, Homo sapiens
ttaagaaaagtatt

SEQ ID NO: 5461549 - DNA, 21 bp, Homo sapiens
ttaagaaaatattctaacatt

SEQ ID NO: 5461550 - DNA, 19 bp, Homo sapiens
ttaagaaaatttacaaaat

SEQ ID NO: 5461551 - DNA, 20 bp, Homo sapiens
ttaagaaagaaatactgtat

SEQ ID NO: 5461552 - DNA, 22 bp, Homo sapiens
ttaagaaagactatctaaatgt

SEQ ID NO: 5461553 - DNA, 13 bp, Homo sapiens
ttaagaaagagaa

SEQ ID NO: 5461554 - DNA, 24 bp, Homo sapiens
ttaagaaagagaatgaactgtgga

SEQ ID NO: 5461555 - DNA, 18 bp, Homo sapiens
ttaagaaagcaaaactca

SEQ ID NO: 5461556 - DNA, 19 bp, Homo sapiens
ttaagaaagcttcttgtga

SEQ ID NO: 5461557 - DNA, 13 bp, Homo sapiens
ttaagaaaggaag

SEQ ID NO: 5461558 - DNA, 20 bp, Homo sapiens
ttaagaaaggatataaaagg

SEQ ID NO: 5461559 - DNA, 21 bp, Homo sapiens
ttaagaaaggatataaaagga

SEQ ID NO: 5461560 - DNA, 20 bp, Homo sapiens
ttaagaaagggaaagctgtg

SEQ ID NO: 5461561 - DNA, 15 bp, Homo sapiens
ttaagaaagtaattt

SEQ ID NO: 5461562 - DNA, 12 bp, Homo sapiens
ttaagaaataaa

SEQ ID NO: 5461563 - DNA, 12 bp, Homo sapiens
ttaagaaatacc

SEQ ID NO: 5461564 - DNA, 15 bp, Homo sapiens
ttaagaaatagaatt

SEQ ID NO: 5461565 - DNA, 22 bp, Homo sapiens
ttaagaaatagacagcatgaga

SEQ ID NO: 5461566 - DNA, 22 bp, Homo sapiens
ttaagaaatctgtttttgttta

SEQ ID NO: 5461567 - DNA, 18 bp, Homo sapiens
ttaagaaattttgccttt

SEQ ID NO: 5461568 - DNA, 23 bp, Homo sapiens
ttaagaaattttgcctttaagtt

SEQ ID NO: 5461569 - DNA, 20 bp, Homo sapiens
ttaagaactaaaatgttcta

SEQ ID NO: 5461570 - DNA, 14 bp, Homo sapiens
ttaagaactatatt

SEQ ID NO: 5461571 - DNA, 13 bp, Homo sapiens
ttaagaactgaat

SEQ ID NO: 5461572 - DNA, 12 bp, Homo sapiens
ttaagaactgct

SEQ ID NO: 5461573 - DNA, 16 bp, Homo sapiens
ttaagaactgtgtctg

SEQ ID NO: 5461574 - DNA, 22 bp, Homo sapiens
ttaagaagccctgcagagcaca

SEQ ID NO: 5461575 - DNA, 11 bp, Homo sapiens
ttaagaagctg

SEQ ID NO: 5461576 - DNA, 13 bp, Homo sapiens
ttaagaagctgtt

SEQ ID NO: 5461577 - DNA, 14 bp, Homo sapiens
ttaagaagctgttg

SEQ ID NO: 5461578 - DNA, 22 bp, Homo sapiens
ttaagaagctgttgtacattta

SEQ ID NO: 5461579 - DNA, 17 bp, Homo sapiens
ttaagaaggcattggca

SEQ ID NO: 5461580 - DNA, 22 bp, Homo sapiens
ttaagaagttgctgcagattcc

SEQ ID NO: 5461581 - DNA, 20 bp, Homo sapiens
ttaagaatagaaaactgggt

SEQ ID NO: 5461582 - DNA, 17 bp, Homo sapiens
ttaagaatcatggattt

SEQ ID NO: 5461583 - DNA, 15 bp, Homo sapiens
ttaagaatgatctga

SEQ ID NO: 5461584 - DNA, 19 bp, Homo sapiens
ttaagaatgatctgattga

SEQ ID NO: 5461585 - DNA, 14 bp, Homo sapiens
ttaagaattgacca

SEQ ID NO: 5461586 - DNA, 15 bp, Homo sapiens
ttaagaatttaccag

SEQ ID NO: 5461587 - DNA, 16 bp, Homo sapiens
ttaagaatttgtttaa

SEQ ID NO: 5461588 - DNA, 18 bp, Homo sapiens
ttaagacaaatgggactg

SEQ ID NO: 5461589 - DNA, 10 bp, Homo sapiens
ttaagacaag

SEQ ID NO: 5461590 - DNA, 19 bp, Homo sapiens
ttaagacaagcctggcaac

SEQ ID NO: 5461591 - DNA, 22 bp, Homo sapiens
ttaagacactagtagagcaaag

SEQ ID NO: 5461592 - DNA, 16 bp, Homo sapiens
ttaagacactgtgaga

SEQ ID NO: 5461593 - DNA, 22 bp, Homo sapiens
ttaagacacttccgtcacatcc

SEQ ID NO: 5461594 - DNA, 15 bp, Homo sapiens
ttaagacagtgtaca

SEQ ID NO: 5461595 - DNA, 16 bp, Homo sapiens
ttaagacagtgtacaa

SEQ ID NO: 5461596 - DNA, 19 bp, Homo sapiens
ttaagacataaacaaagac

SEQ ID NO: 5461597 - DNA, 21 bp, Homo sapiens
ttaagacataaacaaagacat

SEQ ID NO: 5461598 - DNA, 18 bp, Homo sapiens
ttaagaccaaagacttgt

SEQ ID NO: 5461599 - DNA, 19 bp, Homo sapiens
ttaagaccacctcaaattt

SEQ ID NO: 5461600 - DNA, 11 bp, Homo sapiens
ttaagacctgg

SEQ ID NO: 5461601 - DNA, 13 bp, Homo sapiens
ttaagacgtgttt

SEQ ID NO: 5461602 - DNA, 17 bp, Homo sapiens
ttaagacgtgtttgtgt

SEQ ID NO: 5461603 - DNA, 16 bp, Homo sapiens
ttaagactgaatgttt

SEQ ID NO: 5461604 - DNA, 21 bp, Homo sapiens
ttaagactgagcacctgcttc

SEQ ID NO: 5461605 - DNA, 13 bp, Homo sapiens
ttaagactgataa

SEQ ID NO: 5461606 - DNA, 21 bp, Homo sapiens
ttaagactgataacaaccttt

SEQ ID NO: 5461607 - DNA, 21 bp, Homo sapiens
ttaagactgataattttacaa

SEQ ID NO: 5461608 - DNA, 14 bp, Homo sapiens
ttaagactgatttt

SEQ ID NO: 5461609 - DNA, 20 bp, Homo sapiens
ttaagacttaatctttgctg

SEQ ID NO: 5461610 - DNA, 18 bp, Homo sapiens
ttaagacttagttatttc

SEQ ID NO: 5461611 - DNA, 13 bp, Homo sapiens
ttaagagaaactt

SEQ ID NO: 5461612 - DNA, 20 bp, Homo sapiens
ttaagagaaactttatacat

SEQ ID NO: 5461613 - DNA, 13 bp, Homo sapiens
ttaagagaaatgg

SEQ ID NO: 5461614 - DNA, 19 bp, Homo sapiens
ttaagagaacaaagagtga

SEQ ID NO: 5461615 - DNA, 22 bp, Homo sapiens
ttaagagaacaaagagtgaaat

SEQ ID NO: 5461616 - DNA, 20 bp, Homo sapiens
ttaagagaagaaatgttata

SEQ ID NO: 5461617 - DNA, 18 bp, Homo sapiens
ttaagagacagagaatct

SEQ ID NO: 5461618 - DNA, 16 bp, Homo sapiens
ttaagagacagtttcg

SEQ ID NO: 5461619 - DNA, 11 bp, Homo sapiens
ttaagagactc

SEQ ID NO: 5461620 - DNA, 13 bp, Homo sapiens
ttaagagactcac

SEQ ID NO: 5461621 - DNA, 23 bp, Homo sapiens
ttaagagactctttatttttctc

SEQ ID NO: 5461622 - DNA, 13 bp, Homo sapiens
ttaagagataatt

SEQ ID NO: 5461623 - DNA, 21 bp, Homo sapiens
ttaagagataattcttaaaag

SEQ ID NO: 5461624 - DNA, 14 bp, Homo sapiens
ttaagagatacatt

SEQ ID NO: 5461625 - DNA, 15 bp, Homo sapiens
ttaagagatacattc

SEQ ID NO: 5461626 - DNA, 18 bp, Homo sapiens
ttaagagatacattccct

SEQ ID NO: 5461627 - DNA, 22 bp, Homo sapiens
ttaagagatcccttaagaagtt

SEQ ID NO: 5461628 - DNA, 16 bp, Homo sapiens
ttaagagattttatgt

SEQ ID NO: 5461629 - DNA, 24 bp, Homo sapiens
ttaagagcaaatcaattctagtca

SEQ ID NO: 5461630 - DNA, 15 bp, Homo sapiens
ttaagagcagtccat

SEQ ID NO: 5461631 - DNA, 18 bp, Homo sapiens
ttaagagctattttagaa

SEQ ID NO: 5461632 - DNA, 20 bp, Homo sapiens
ttaagagctattttagaaag

SEQ ID NO: 5461633 - DNA, 12 bp, Homo sapiens
ttaagaggcttt

SEQ ID NO: 5461634 - DNA, 21 bp, Homo sapiens
ttaagaggttgattataaagt

SEQ ID NO: 5461635 - DNA, 14 bp, Homo sapiens
ttaagagtccaact

SEQ ID NO: 5461636 - DNA, 19 bp, Homo sapiens
ttaagagtgaaataattaa

SEQ ID NO: 5461637 - DNA, 16 bp, Homo sapiens
ttaagagtgaatgtgt

SEQ ID NO: 5461638 - DNA, 18 bp, Homo sapiens
ttaagagtgctaaatttt

SEQ ID NO: 5461639 - DNA, 19 bp, Homo sapiens
ttaagagtgctaaattttt

SEQ ID NO: 5461640 - DNA, 19 bp, Homo sapiens
ttaagagttactcagatga

SEQ ID NO: 5461641 - DNA, 22 bp, Homo sapiens
ttaagataatatttaaaatagt

SEQ ID NO: 5461642 - DNA, 16 bp, Homo sapiens
ttaagataattataat

SEQ ID NO: 5461643 - DNA, 16 bp, Homo sapiens
ttaagatacaaatggt

SEQ ID NO: 5461644 - DNA, 14 bp, Homo sapiens
ttaagatacaaatt

SEQ ID NO: 5461645 - DNA, 20 bp, Homo sapiens
ttaagatacaaattaatttt

SEQ ID NO: 5461646 - DNA, 15 bp, Homo sapiens
ttaagatacactcct

SEQ ID NO: 5461647 - DNA, 11 bp, Homo sapiens
ttaagatatcc

SEQ ID NO: 5461648 - DNA, 22 bp, Homo sapiens
ttaagatatccatctttttctt

SEQ ID NO: 5461649 - DNA, 18 bp, Homo sapiens
ttaagatcacagtgaact

SEQ ID NO: 5461650 - DNA, 15 bp, Homo sapiens
ttaagatcctaaact

SEQ ID NO: 5461651 - DNA, 18 bp, Homo sapiens
ttaagatcctaaactctc

SEQ ID NO: 5461652 - DNA, 23 bp, Homo sapiens
ttaagatcctaaactctctagct

SEQ ID NO: 5461653 - DNA, 21 bp, Homo sapiens
ttaagatctgaaagttttctc

SEQ ID NO: 5461654 - DNA, 16 bp, Homo sapiens
ttaagatgccttgaat

SEQ ID NO: 5461655 - DNA, 23 bp, Homo sapiens
ttaagatgctaatagaaaactgt

SEQ ID NO: 5461656 - DNA, 18 bp, Homo sapiens
ttaagatggattctcaga

SEQ ID NO: 5461657 - DNA, 22 bp, Homo sapiens
ttaagatggattctcagatatt

SEQ ID NO: 5461658 - DNA, 22 bp, Homo sapiens
ttaagatggtaagacctctgag

SEQ ID NO: 5461659 - DNA, 19 bp, Homo sapiens
ttaagatggtcatattatt

SEQ ID NO: 5461660 - DNA, 17 bp, Homo sapiens
ttaagatgtacatttaa

SEQ ID NO: 5461661 - DNA, 18 bp, Homo sapiens
ttaagatgtacatttaat

SEQ ID NO: 5461662 - DNA, 17 bp, Homo sapiens
ttaagatgtgaaaatta

SEQ ID NO: 5461663 - DNA, 17 bp, Homo sapiens
ttaagatgtgtcttcaa

SEQ ID NO: 5461664 - DNA, 21 bp, Homo sapiens
ttaagatgtgtcttcaatttg

SEQ ID NO: 5461665 - DNA, 13 bp, Homo sapiens
ttaagattaaatt

SEQ ID NO: 5461666 - DNA, 14 bp, Homo sapiens
ttaagattattgtc

SEQ ID NO: 5461667 - DNA, 17 bp, Homo sapiens
ttaagattattgtctga

SEQ ID NO: 5461668 - DNA, 16 bp, Homo sapiens
ttaagattggaaatgt

SEQ ID NO: 5461669 - DNA, 14 bp, Homo sapiens
ttaagattgtaatt

SEQ ID NO: 5461670 - DNA, 11 bp, Homo sapiens
ttaagatttaa

SEQ ID NO: 5461671 - DNA, 16 bp, Homo sapiens
ttaagatttttctcaa

SEQ ID NO: 5461672 - DNA, 19 bp, Homo sapiens
ttaagcaaaggaaaccaaa

SEQ ID NO: 5461673 - DNA, 16 bp, Homo sapiens
ttaagcaaaggggaca

SEQ ID NO: 5461674 - DNA, 14 bp, Homo sapiens
ttaagcaaatactt

SEQ ID NO: 5461675 - DNA, 19 bp, Homo sapiens
ttaagcaaatgttaaaagt

SEQ ID NO: 5461676 - DNA, 15 bp, Homo sapiens
ttaagcaaattttgt

SEQ ID NO: 5461677 - DNA, 21 bp, Homo sapiens
ttaagcaaattttgtattatt

SEQ ID NO: 5461678 - DNA, 16 bp, Homo sapiens
ttaagcaacagataaa

SEQ ID NO: 5461679 - DNA, 19 bp, Homo sapiens
ttaagcaacgttagtagaa

SEQ ID NO: 5461680 - DNA, 17 bp, Homo sapiens
ttaagcacaaaaaattt

SEQ ID NO: 5461681 - DNA, 11 bp, Homo sapiens
ttaagcacaca

SEQ ID NO: 5461682 - DNA, 14 bp, Homo sapiens
ttaagcactacata

SEQ ID NO: 5461683 - DNA, 17 bp, Homo sapiens
ttaagcactacataaac

SEQ ID NO: 5461684 - DNA, 22 bp, Homo sapiens
ttaagcactacataaactgact

SEQ ID NO: 5461685 - DNA, 17 bp, Homo sapiens
ttaagcactttgaaaat

SEQ ID NO: 5461686 - DNA, 20 bp, Homo sapiens
ttaagcactttgaaaatatt

SEQ ID NO: 5461687 - DNA, 16 bp, Homo sapiens
ttaagcagaagcatta

SEQ ID NO: 5461688 - DNA, 15 bp, Homo sapiens
ttaagcagaattgga

SEQ ID NO: 5461689 - DNA, 18 bp, Homo sapiens
ttaagcagaattggaaaa

SEQ ID NO: 5461690 - DNA, 14 bp, Homo sapiens
ttaagcagagataa

SEQ ID NO: 5461691 - DNA, 19 bp, Homo sapiens
ttaagcagcctttctgtgg

SEQ ID NO: 5461692 - DNA, 12 bp, Homo sapiens
ttaagcagctct

SEQ ID NO: 5461693 - DNA, 21 bp, Homo sapiens
ttaagcagtacatcttgtgca

SEQ ID NO: 5461694 - DNA, 13 bp, Homo sapiens
ttaagcatatatt

SEQ ID NO: 5461695 - DNA, 23 bp, Homo sapiens
ttaagcatatatttttatattta

SEQ ID NO: 5461696 - DNA, 15 bp, Homo sapiens
ttaagcatcacatta

SEQ ID NO: 5461697 - DNA, 13 bp, Homo sapiens
ttaagcattacca

SEQ ID NO: 5461698 - DNA, 14 bp, Homo sapiens
ttaagcattactct

SEQ ID NO: 5461699 - DNA, 19 bp, Homo sapiens
ttaagcattactcttgtaa

SEQ ID NO: 5461700 - DNA, 22 bp, Homo sapiens
ttaagcattactcttgtaagat

SEQ ID NO: 5461701 - DNA, 15 bp, Homo sapiens
ttaagcatttgtata

SEQ ID NO: 5461702 - DNA, 15 bp, Homo sapiens
ttaatattagcttgc

SEQ ID NO: 5461703 - DNA, 13 bp, Homo sapiens
ttaatattatata

SEQ ID NO: 5461704 - DNA, 15 bp, Homo sapiens
ttaatattctattaa

SEQ ID NO: 5461705 - DNA, 18 bp, Homo sapiens
ttaatattgatatgctta

SEQ ID NO: 5461706 - DNA, 20 bp, Homo sapiens
ttaatattgatgtcagtatt

SEQ ID NO: 5461707 - DNA, 13 bp, Homo sapiens
ttaatattgattt

SEQ ID NO: 5461708 - DNA, 16 bp, Homo sapiens
ttaatattgtattgct

SEQ ID NO: 5461709 - DNA, 16 bp, Homo sapiens
ttaatatttaaacagc

SEQ ID NO: 5461710 - DNA, 18 bp, Homo sapiens
ttaatatttaaacagcag

SEQ ID NO: 5461711 - DNA, 15 bp, Homo sapiens
ttaatatttaccaaa

SEQ ID NO: 5461712 - DNA, 20 bp, Homo sapiens
ttaatatttatagagttcat

SEQ ID NO: 5461713 - DNA, 22 bp, Homo sapiens
ttaatatttataggtcactttg

SEQ ID NO: 5461714 - DNA, 16 bp, Homo sapiens
ttaatatttatgtgtt

SEQ ID NO: 5461715 - DNA, 14 bp, Homo sapiens
ttaatatttattga

SEQ ID NO: 5461716 - DNA, 13 bp, Homo sapiens
ttaatatttctaa

SEQ ID NO: 5461717 - DNA, 15 bp, Homo sapiens
ttaatatttctaaaa

SEQ ID NO: 5461718 - DNA, 16 bp, Homo sapiens
ttaatatttgctaaat

SEQ ID NO: 5461719 - DNA, 20 bp, Homo sapiens
ttaatatttgctgacagctg

SEQ ID NO: 5461720 - DNA, 19 bp, Homo sapiens
ttaatatttgtgctttgaa

SEQ ID NO: 5461721 - DNA, 20 bp, Homo sapiens
ttaatatttgtgctttgaaa

SEQ ID NO: 5461722 - DNA, 15 bp, Homo sapiens
ttaatattttatgtg

SEQ ID NO: 5461723 - DNA, 15 bp, Homo sapiens
ttaatattttgtaat

SEQ ID NO: 5461724 - DNA, 20 bp, Homo sapiens
ttaatattttgtaatattct

SEQ ID NO: 5461725 - DNA, 16 bp, Homo sapiens
ttaatattttgttctt

SEQ ID NO: 5461726 - DNA, 20 bp, Homo sapiens
ttaatcaagatttttttcct

SEQ ID NO: 5461727 - DNA, 14 bp, Homo sapiens
ttaatcaagttgaa

SEQ ID NO: 5461728 - DNA, 22 bp, Homo sapiens
ttaatcaatcatgccctgcctt

SEQ ID NO: 5461729 - DNA, 20 bp, Homo sapiens
ttaatcaatttaaacccatt

SEQ ID NO: 5461730 - DNA, 18 bp, Homo sapiens
ttaatcacagtcatcttt

SEQ ID NO: 5461731 - DNA, 15 bp, Homo sapiens
ttaatcaccaaagta

SEQ ID NO: 5461732 - DNA, 18 bp, Homo sapiens
ttaatcaccttctttgta

SEQ ID NO: 5461733 - DNA, 19 bp, Homo sapiens
ttaatcaccttctttgtaa

SEQ ID NO: 5461734 - DNA, 21 bp, Homo sapiens
ttaatcagaaaccccacttcc

SEQ ID NO: 5461735 - DNA, 15 bp, Homo sapiens
ttaatcagaagaaaa

SEQ ID NO: 5461736 - DNA, 22 bp, Homo sapiens
ttaatcagaatatcagaatatg

SEQ ID NO: 5461737 - DNA, 16 bp, Homo sapiens
ttaatcagacaaagta

SEQ ID NO: 5461738 - DNA, 17 bp, Homo sapiens
ttaatcagagtatctga

SEQ ID NO: 5461739 - DNA, 20 bp, Homo sapiens
ttaatcagcaatattgcctg

SEQ ID NO: 5461740 - DNA, 17 bp, Homo sapiens
ttaatcagccccagagt

SEQ ID NO: 5461741 - DNA, 16 bp, Homo sapiens
ttaatcagttctgtgt

SEQ ID NO: 5461742 - DNA, 23 bp, Homo sapiens
ttaatcatagttactgtgtaaac

SEQ ID NO: 5461743 - DNA, 18 bp, Homo sapiens
ttaatcatgagcctgttt

SEQ ID NO: 5461744 - DNA, 21 bp, Homo sapiens
ttaatcatgagcctgtttatt

SEQ ID NO: 5461745 - DNA, 22 bp, Homo sapiens
ttaatcatttccagcaaaatat

SEQ ID NO: 5461746 - DNA, 19 bp, Homo sapiens
ttaatcattttcattccta

SEQ ID NO: 5461747 - DNA, 12 bp, Homo sapiens
ttaatcattttt

SEQ ID NO: 5461748 - DNA, 22 bp, Homo sapiens
ttaatccaatcaatttaaatgt

SEQ ID NO: 5461749 - DNA, 14 bp, Homo sapiens
ttaatccagagaac

SEQ ID NO: 5461750 - DNA, 17 bp, Homo sapiens
ttaatccatttcaggac

SEQ ID NO: 5461751 - DNA, 19 bp, Homo sapiens
ttaatccatttcaggactc

SEQ ID NO: 5461752 - DNA, 21 bp, Homo sapiens
ttaatcccagtacgatttgca

SEQ ID NO: 5461753 - DNA, 17 bp, Homo sapiens
ttaatccccagtaaaat

SEQ ID NO: 5461754 - DNA, 18 bp, Homo sapiens
ttaatccccagtaaaatt

SEQ ID NO: 5461755 - DNA, 13 bp, Homo sapiens
ttaatcctgtacc

SEQ ID NO: 5461756 - DNA, 15 bp, Homo sapiens
ttaatctaaaatgat

SEQ ID NO: 5461757 - DNA, 16 bp, Homo sapiens
ttaatctaaaatgatt

SEQ ID NO: 5461758 - DNA, 13 bp, Homo sapiens
ttaatctaagaaa

SEQ ID NO: 5461759 - DNA, 14 bp, Homo sapiens
ttaatctctaaaat

SEQ ID NO: 5461760 - DNA, 15 bp, Homo sapiens
ttaatctctaaaatt

SEQ ID NO: 5461761 - DNA, 19 bp, Homo sapiens
ttaatctctaaaattctag

SEQ ID NO: 5461762 - DNA, 20 bp, Homo sapiens
ttaatctctccaccttccaa

SEQ ID NO: 5461763 - DNA, 22 bp, Homo sapiens
ttaatctctccaccttccaaag

SEQ ID NO: 5461764 - DNA, 14 bp, Homo sapiens
ttaatctcttgtca

SEQ ID NO: 5461765 - DNA, 22 bp, Homo sapiens
ttaatctcttgtcattctcatc

SEQ ID NO: 5461766 - DNA, 17 bp, Homo sapiens
ttaatctgaaattctaa

SEQ ID NO: 5461767 - DNA, 23 bp, Homo sapiens
ttaatctgaaattctaaagagca

SEQ ID NO: 5461768 - DNA, 15 bp, Homo sapiens
ttaatctgatgtata

SEQ ID NO: 5461769 - DNA, 16 bp, Homo sapiens
ttaatctgcatttatt

SEQ ID NO: 5461770 - DNA, 20 bp, Homo sapiens
ttaatctgtttgtttggcac

SEQ ID NO: 5461771 - DNA, 17 bp, Homo sapiens
ttaatcttaatgtatat

SEQ ID NO: 5461772 - DNA, 17 bp, Homo sapiens
ttaatcttagcttttaa

SEQ ID NO: 5461773 - DNA, 14 bp, Homo sapiens
ttaatcttagtgta

SEQ ID NO: 5461774 - DNA, 21 bp, Homo sapiens
ttaatcttagtgtatgattac

SEQ ID NO: 5461775 - DNA, 18 bp, Homo sapiens
ttaatcttcaaagccttc

SEQ ID NO: 5461776 - DNA, 13 bp, Homo sapiens
ttaatcttcatgg

SEQ ID NO: 5461777 - DNA, 17 bp, Homo sapiens
ttaatcttctctcttga

SEQ ID NO: 5461778 - DNA, 15 bp, Homo sapiens
ttaatcttgctttct

SEQ ID NO: 5461779 - DNA, 12 bp, Homo sapiens
ttaatcttggat

SEQ ID NO: 5461780 - DNA, 16 bp, Homo sapiens
ttaatcttggatagct

SEQ ID NO: 5461781 - DNA, 15 bp, Homo sapiens
ttaatcttgtgtagt

SEQ ID NO: 5461782 - DNA, 13 bp, Homo sapiens
ttaatctttaatt

SEQ ID NO: 5461783 - DNA, 22 bp, Homo sapiens
ttaatctttattttattattca

SEQ ID NO: 5461784 - DNA, 20 bp, Homo sapiens
ttaatctttctacctctttt

SEQ ID NO: 5461785 - DNA, 23 bp, Homo sapiens
ttaatctttctatattttttaaa

SEQ ID NO: 5461786 - DNA, 21 bp, Homo sapiens
ttaatctttctttacctgaga

SEQ ID NO: 5461787 - DNA, 18 bp, Homo sapiens
ttaatctttgtgacagga

SEQ ID NO: 5461788 - DNA, 13 bp, Homo sapiens
ttaatcttttaaa

SEQ ID NO: 5461789 - DNA, 17 bp, Homo sapiens
ttaatctttttcatcat

SEQ ID NO: 5461790 - DNA, 23 bp, Homo sapiens
ttaatcttttttttaaaaaaact

SEQ ID NO: 5461791 - DNA, 22 bp, Homo sapiens
ttaatgaaaaaagcataggaat

SEQ ID NO: 5461792 - DNA, 14 bp, Homo sapiens
ttaatgaaaaggaa

SEQ ID NO: 5461793 - DNA, 15 bp, Homo sapiens
ttaatgaaaataaga

SEQ ID NO: 5461794 - DNA, 18 bp, Homo sapiens
ttaatgaaagactgtaca

SEQ ID NO: 5461795 - DNA, 19 bp, Homo sapiens
ttaatgaaagactgtacaa

SEQ ID NO: 5461796 - DNA, 21 bp, Homo sapiens
ttaatgaaataaaatttgaaa

SEQ ID NO: 5461797 - DNA, 15 bp, Homo sapiens
ttaatgaaataccaa

SEQ ID NO: 5461798 - DNA, 16 bp, Homo sapiens
ttaatgaaatcaaatg

SEQ ID NO: 5461799 - DNA, 17 bp, Homo sapiens
ttaatgaaatcaaatgt

SEQ ID NO: 5461800 - DNA, 19 bp, Homo sapiens
ttaatgaaatcaaatgtat

SEQ ID NO: 5461801 - DNA, 20 bp, Homo sapiens
ttaatgaaatgataaagact

SEQ ID NO: 5461802 - DNA, 14 bp, Homo sapiens
ttaatgaagaaata

SEQ ID NO: 5461803 - DNA, 19 bp, Homo sapiens
ttaatgaagaaatacagct

SEQ ID NO: 5461804 - DNA, 19 bp, Homo sapiens
ttaatgaaggtgtgctaca

SEQ ID NO: 5461805 - DNA, 15 bp, Homo sapiens
ttaatgaagtcacta

SEQ ID NO: 5461806 - DNA, 17 bp, Homo sapiens
ttaatgaagtttgaatg

SEQ ID NO: 5461807 - DNA, 23 bp, Homo sapiens
ttaatgaagtttgaatgttaaat

SEQ ID NO: 5461808 - DNA, 22 bp, Homo sapiens
ttaatgaatatcaggctattat

SEQ ID NO: 5461809 - DNA, 21 bp, Homo sapiens
ttaatgaatattgatgttaac

SEQ ID NO: 5461810 - DNA, 14 bp, Homo sapiens
ttaatgaatgacca

SEQ ID NO: 5461811 - DNA, 17 bp, Homo sapiens
ttaatgaatgcttaaag

SEQ ID NO: 5461812 - DNA, 20 bp, Homo sapiens
ttaatgaatgcttaaagaat

SEQ ID NO: 5461813 - DNA, 21 bp, Homo sapiens
ttaatgaatgcttaaagaatt

SEQ ID NO: 5461814 - DNA, 20 bp, Homo sapiens
ttaatgactttatgtattat

SEQ ID NO: 5461815 - DNA, 22 bp, Homo sapiens
ttaatgacttttgaattacaga

SEQ ID NO: 5461816 - DNA, 18 bp, Homo sapiens
ttaatgactttttataat

SEQ ID NO: 5461817 - DNA, 20 bp, Homo sapiens
ttaatgagatatttgtattt

SEQ ID NO: 5461818 - DNA, 19 bp, Homo sapiens
ttaatgagcaatatctgct

SEQ ID NO: 5461819 - DNA, 16 bp, Homo sapiens
ttaatgaggtctttaa

SEQ ID NO: 5461820 - DNA, 17 bp, Homo sapiens
ttaatgaggtctttaaa

SEQ ID NO: 5461821 - DNA, 15 bp, Homo sapiens
ttaatgagtatatgt

SEQ ID NO: 5461822 - DNA, 18 bp, Homo sapiens
ttaatgagtatatgtaac

SEQ ID NO: 5461823 - DNA, 22 bp, Homo sapiens
ttaatgagtatatgtaacagtt

SEQ ID NO: 5461824 - DNA, 18 bp, Homo sapiens
ttaatgataaaatagcca

SEQ ID NO: 5461825 - DNA, 17 bp, Homo sapiens
ttaatgataaaatccca

SEQ ID NO: 5461826 - DNA, 17 bp, Homo sapiens
ttaatgataaactcaga

SEQ ID NO: 5461827 - DNA, 18 bp, Homo sapiens
ttaatgatattggaggaa

SEQ ID NO: 5461828 - DNA, 18 bp, Homo sapiens
ttaatgatgttatcttaa

SEQ ID NO: 5461829 - DNA, 20 bp, Homo sapiens
ttaatgatgttatcttaaca

SEQ ID NO: 5461830 - DNA, 13 bp, Homo sapiens
ttaatgattcttg

SEQ ID NO: 5461831 - DNA, 17 bp, Homo sapiens
ttaatgatttttgtgta

SEQ ID NO: 5461832 - DNA, 21 bp, Homo sapiens
ttaatgcaccaatcttgttta

SEQ ID NO: 5461833 - DNA, 22 bp, Homo sapiens
ttaatgcagttgcttactaaag

SEQ ID NO: 5461834 - DNA, 20 bp, Homo sapiens
ttaatgcatgttaggaaaat

SEQ ID NO: 5461835 - DNA, 22 bp, Homo sapiens
ttaatgcattaaacctgtctcc

SEQ ID NO: 5461836 - DNA, 21 bp, Homo sapiens
ttaatgcattctttcttctct

SEQ ID NO: 5461837 - DNA, 12 bp, Homo sapiens
ttaatgcattgt

SEQ ID NO: 5461838 - DNA, 15 bp, Homo sapiens
ttaatgcattgttgt

SEQ ID NO: 5461839 - DNA, 22 bp, Homo sapiens
ttaatgcattgttgtaaagtat

SEQ ID NO: 5461840 - DNA, 12 bp, Homo sapiens
ttaatgcatttt

SEQ ID NO: 5461841 - DNA, 12 bp, Homo sapiens
ttaatgcctgcc

SEQ ID NO: 5461842 - DNA, 22 bp, Homo sapiens
ttaatgcctgcccattagagaa

SEQ ID NO: 5461843 - DNA, 16 bp, Homo sapiens
ttaatgcctgcttttt

SEQ ID NO: 5461844 - DNA, 21 bp, Homo sapiens
ttaatgcctgctttttggaaa

SEQ ID NO: 5461845 - DNA, 15 bp, Homo sapiens
ttaatgcctttaaag

SEQ ID NO: 5461846 - DNA, 23 bp, Homo sapiens
ttaatgctaatcttgtgaaaata

SEQ ID NO: 5461847 - DNA, 19 bp, Homo sapiens
ttaatgctctatgtttgta

SEQ ID NO: 5461848 - DNA, 20 bp, Homo sapiens
ttaatgctctatgtttgtat

SEQ ID NO: 5461849 - DNA, 17 bp, Homo sapiens
ttaatgctgccttttct

SEQ ID NO: 5461850 - DNA, 15 bp, Homo sapiens
ttaatgctgtctttg

SEQ ID NO: 5461851 - DNA, 16 bp, Homo sapiens
ttaatgctgtttctaa

SEQ ID NO: 5461852 - DNA, 22 bp, Homo sapiens
ttaatgctgtttctaagaaaat

SEQ ID NO: 5461853 - DNA, 16 bp, Homo sapiens
ttaatgcttaaaaatg

SEQ ID NO: 5461854 - DNA, 20 bp, Homo sapiens
ttaatggaagtgtatttatt

SEQ ID NO: 5461855 - DNA, 17 bp, Homo sapiens
ttaatggactgtgaatt

SEQ ID NO: 5461856 - DNA, 18 bp, Homo sapiens
ttaatggacttatttctt

SEQ ID NO: 5461857 - DNA, 18 bp, Homo sapiens
ttaatggatgaaatcata

SEQ ID NO: 5461858 - DNA, 20 bp, Homo sapiens
ttaatggattgttaatttca

SEQ ID NO: 5461859 - DNA, 23 bp, Homo sapiens
ttaatggcataacaaaggcaaga

SEQ ID NO: 5461860 - DNA, 21 bp, Homo sapiens
ttaatggcatttctctttaaa

SEQ ID NO: 5461861 - DNA, 16 bp, Homo sapiens
ttaatggctgataatt

SEQ ID NO: 5461862 - DNA, 17 bp, Homo sapiens
ttaatggcttccctctt

SEQ ID NO: 5461863 - DNA, 23 bp, Homo sapiens
ttaatggcttccctctttcatct

SEQ ID NO: 5461864 - DNA, 19 bp, Homo sapiens
ttaatgggggtagcagctg

SEQ ID NO: 5461865 - DNA, 19 bp, Homo sapiens
ttaatggtagttttacagt

SEQ ID NO: 5461866 - DNA, 20 bp, Homo sapiens
ttaatggtatcctactgagc

SEQ ID NO: 5461867 - DNA, 19 bp, Homo sapiens
ttaatggtgccttcatttg

SEQ ID NO: 5461868 - DNA, 12 bp, Homo sapiens
ttaatggttttt

SEQ ID NO: 5461869 - DNA, 12 bp, Homo sapiens
ttaatgtaaata

SEQ ID NO: 5461870 - DNA, 13 bp, Homo sapiens
ttaatgtaaataa

SEQ ID NO: 5461871 - DNA, 13 bp, Homo sapiens
ttaatgtaataaa

SEQ ID NO: 5461872 - DNA, 14 bp, Homo sapiens
ttaatgtaataaag

SEQ ID NO: 5461873 - DNA, 21 bp, Homo sapiens
ttaatgtacaagttttgtata

SEQ ID NO: 5461874 - DNA, 20 bp, Homo sapiens
ttaatgtactttttattgca

SEQ ID NO: 5461875 - DNA, 15 bp, Homo sapiens
ttaatgtagataaag

SEQ ID NO: 5461876 - DNA, 20 bp, Homo sapiens
ttaatgtagataaagcactg

SEQ ID NO: 5461877 - DNA, 15 bp, Homo sapiens
ttaatgtagccatgg

SEQ ID NO: 5461878 - DNA, 17 bp, Homo sapiens
ttaccaggtttcatttt

SEQ ID NO: 5461879 - DNA, 17 bp, Homo sapiens
ttaccagtcctattttt

SEQ ID NO: 5461880 - DNA, 18 bp, Homo sapiens
ttaccagtcctatttttc

SEQ ID NO: 5461881 - DNA, 14 bp, Homo sapiens
ttaccagtctgatt

SEQ ID NO: 5461882 - DNA, 15 bp, Homo sapiens
ttaccagtctgatta

SEQ ID NO: 5461883 - DNA, 20 bp, Homo sapiens
ttaccagtgttaataaatgg

SEQ ID NO: 5461884 - DNA, 12 bp, Homo sapiens
ttaccataaagc

SEQ ID NO: 5461885 - DNA, 23 bp, Homo sapiens
ttaccataaagcctttaaaacca

SEQ ID NO: 5461886 - DNA, 14 bp, Homo sapiens
ttaccataatctta

SEQ ID NO: 5461887 - DNA, 22 bp, Homo sapiens
ttaccatactgtctctggagtg

SEQ ID NO: 5461888 - DNA, 23 bp, Homo sapiens
ttaccatactgtctctggagtga

SEQ ID NO: 5461889 - DNA, 15 bp, Homo sapiens
ttaccatatgtgctt

SEQ ID NO: 5461890 - DNA, 14 bp, Homo sapiens
ttaccatcatctct

SEQ ID NO: 5461891 - DNA, 19 bp, Homo sapiens
ttaccatgtaaataatctg

SEQ ID NO: 5461892 - DNA, 20 bp, Homo sapiens
ttaccatgtaaataatctgt

SEQ ID NO: 5461893 - DNA, 16 bp, Homo sapiens
ttaccatgtgcctgat

SEQ ID NO: 5461894 - DNA, 21 bp, Homo sapiens
ttaccattatttaatttgtat

SEQ ID NO: 5461895 - DNA, 18 bp, Homo sapiens
ttaccattattttacagt

SEQ ID NO: 5461896 - DNA, 13 bp, Homo sapiens
ttaccattcacaa

SEQ ID NO: 5461897 - DNA, 14 bp, Homo sapiens
ttaccattcacaat

SEQ ID NO: 5461898 - DNA, 15 bp, Homo sapiens
ttaccattcacaata

SEQ ID NO: 5461899 - DNA, 21 bp, Homo sapiens
ttaccattcagttaattcaat

SEQ ID NO: 5461900 - DNA, 13 bp, Homo sapiens
ttaccattggaaa

SEQ ID NO: 5461901 - DNA, 15 bp, Homo sapiens
ttaccattggaaatt

SEQ ID NO: 5461902 - DNA, 16 bp, Homo sapiens
ttaccattggaaattt

SEQ ID NO: 5461903 - DNA, 18 bp, Homo sapiens
ttaccattggaaatttca

SEQ ID NO: 5461904 - DNA, 21 bp, Homo sapiens
ttaccatttgctactgtacat

SEQ ID NO: 5461905 - DNA, 13 bp, Homo sapiens
ttaccatttgtaa

SEQ ID NO: 5461906 - DNA, 23 bp, Homo sapiens
ttaccatttgtaataaagtatat

SEQ ID NO: 5461907 - DNA, 23 bp, Homo sapiens
ttaccattttggggtacccactg

SEQ ID NO: 5461908 - DNA, 14 bp, Homo sapiens
ttaccatttttcat

SEQ ID NO: 5461909 - DNA, 14 bp, Homo sapiens
ttacccaaagcaca

SEQ ID NO: 5461910 - DNA, 17 bp, Homo sapiens
ttacccaagtcttctcc

SEQ ID NO: 5461911 - DNA, 17 bp, Homo sapiens
ttacccaataagataca

SEQ ID NO: 5461912 - DNA, 14 bp, Homo sapiens
ttacccaatttccc

SEQ ID NO: 5461913 - DNA, 23 bp, Homo sapiens
ttacccacactacgcagaagaga

SEQ ID NO: 5461914 - DNA, 21 bp, Homo sapiens
ttacccacccgacctggctgc

SEQ ID NO: 5461915 - DNA, 14 bp, Homo sapiens
ttacccagactggt

SEQ ID NO: 5461916 - DNA, 22 bp, Homo sapiens
ttacccagagaatatatacatt

SEQ ID NO: 5461917 - DNA, 22 bp, Homo sapiens
ttacccagcatgactttcctta

SEQ ID NO: 5461918 - DNA, 20 bp, Homo sapiens
ttacccatatcccctctccc

SEQ ID NO: 5461919 - DNA, 21 bp, Homo sapiens
ttacccatcagttccagcctt

SEQ ID NO: 5461920 - DNA, 15 bp, Homo sapiens
ttacccattgactaa

SEQ ID NO: 5461921 - DNA, 17 bp, Homo sapiens
ttacccatttgttcata

SEQ ID NO: 5461922 - DNA, 17 bp, Homo sapiens
ttaccccaaagagaaag

SEQ ID NO: 5461923 - DNA, 22 bp, Homo sapiens
ttaccccacaacgtgcaactga

SEQ ID NO: 5461924 - DNA, 17 bp, Homo sapiens
ttaccccagctgcggca

SEQ ID NO: 5461925 - DNA, 19 bp, Homo sapiens
ttaccccctcctccagatc

SEQ ID NO: 5461926 - DNA, 14 bp, Homo sapiens
ttacccctctacca

SEQ ID NO: 5461927 - DNA, 22 bp, Homo sapiens
ttacccgaaagcatcactgcct

SEQ ID NO: 5461928 - DNA, 15 bp, Homo sapiens
ttacccgcagatcct

SEQ ID NO: 5461929 - DNA, 18 bp, Homo sapiens
ttaccctaaaacatgtgt

SEQ ID NO: 5461930 - DNA, 21 bp, Homo sapiens
ttaccctaagaatgctttgcc

SEQ ID NO: 5461931 - DNA, 17 bp, Homo sapiens
ttaccctccctgtcccc

SEQ ID NO: 5461932 - DNA, 16 bp, Homo sapiens
ttaccctcctctgctg

SEQ ID NO: 5461933 - DNA, 17 bp, Homo sapiens
ttaccctcctctgctgg

SEQ ID NO: 5461934 - DNA, 15 bp, Homo sapiens
ttaccctctctttca

SEQ ID NO: 5461935 - DNA, 16 bp, Homo sapiens
ttaccctctgcagaac

SEQ ID NO: 5461936 - DNA, 18 bp, Homo sapiens
ttaccctggcccctctcc

SEQ ID NO: 5461937 - DNA, 20 bp, Homo sapiens
ttaccctggcccctctccct

SEQ ID NO: 5461938 - DNA, 12 bp, Homo sapiens
ttaccctgtgtc

SEQ ID NO: 5461939 - DNA, 14 bp, Homo sapiens
ttaccctgtgtcag

SEQ ID NO: 5461940 - DNA, 15 bp, Homo sapiens
ttacccttcaatgtt

SEQ ID NO: 5461941 - DNA, 21 bp, Homo sapiens
ttacccttcacctttggtgca

SEQ ID NO: 5461942 - DNA, 13 bp, Homo sapiens
ttacccttccctg

SEQ ID NO: 5461943 - DNA, 15 bp, Homo sapiens
ttacccttcctcatc

SEQ ID NO: 5461944 - DNA, 23 bp, Homo sapiens
ttacccttctacaaaagaagtgt

SEQ ID NO: 5461945 - DNA, 21 bp, Homo sapiens
ttacccttctgtgcccagctc

SEQ ID NO: 5461946 - DNA, 16 bp, Homo sapiens
ttaccctttcttttga

SEQ ID NO: 5461947 - DNA, 22 bp, Homo sapiens
ttaccctttggccccactttga

SEQ ID NO: 5461948 - DNA, 13 bp, Homo sapiens
ttaccgaaatgaa

SEQ ID NO: 5461949 - DNA, 20 bp, Homo sapiens
ttaccgacaagcacagtcag

SEQ ID NO: 5461950 - DNA, 20 bp, Homo sapiens
ttaccgaggacagcctgcct

SEQ ID NO: 5461951 - DNA, 12 bp, Homo sapiens
ttaccgcccacc

SEQ ID NO: 5461952 - DNA, 22 bp, Homo sapiens
ttaccgcgtaatgcgccaataa

SEQ ID NO: 5461953 - DNA, 13 bp, Homo sapiens
ttaccgttcactt

SEQ ID NO: 5461954 - DNA, 16 bp, Homo sapiens
ttaccgttcacttccc

SEQ ID NO: 5461955 - DNA, 17 bp, Homo sapiens
ttaccgttgcttgaaat

SEQ ID NO: 5461956 - DNA, 16 bp, Homo sapiens
ttaccgtttcttccct

SEQ ID NO: 5461957 - DNA, 20 bp, Homo sapiens
ttacctaaaagctacagaac

SEQ ID NO: 5461958 - DNA, 22 bp, Homo sapiens
ttacctaaaagctacagaacca

SEQ ID NO: 5461959 - DNA, 20 bp, Homo sapiens
ttacctaaacagatataaat

SEQ ID NO: 5461960 - DNA, 21 bp, Homo sapiens
ttacctaagagccacaataag

SEQ ID NO: 5461961 - DNA, 18 bp, Homo sapiens
ttacctaagtgacatttg

SEQ ID NO: 5461962 - DNA, 15 bp, Homo sapiens
ttacctaatctccac

SEQ ID NO: 5461963 - DNA, 14 bp, Homo sapiens
ttacctaattatta

SEQ ID NO: 5461964 - DNA, 15 bp, Homo sapiens
ttacctaatttcatt

SEQ ID NO: 5461965 - DNA, 16 bp, Homo sapiens
ttacctaccacagtgt

SEQ ID NO: 5461966 - DNA, 21 bp, Homo sapiens
ttacctaccacagtgtctgta

SEQ ID NO: 5461967 - DNA, 19 bp, Homo sapiens
ttacctaccgtagcttttt

SEQ ID NO: 5461968 - DNA, 22 bp, Homo sapiens
ttacctaccttactatttaaag

SEQ ID NO: 5461969 - DNA, 15 bp, Homo sapiens
ttacctagctgtgcc

SEQ ID NO: 5461970 - DNA, 15 bp, Homo sapiens
ttacctagtcttgta

SEQ ID NO: 5461971 - DNA, 19 bp, Homo sapiens
ttacctagtgaaacttttc

SEQ ID NO: 5461972 - DNA, 22 bp, Homo sapiens
ttacctagtgaaacttttctag

SEQ ID NO: 5461973 - DNA, 22 bp, Homo sapiens
ttacctagtgcaaaaactgtaa

SEQ ID NO: 5461974 - DNA, 16 bp, Homo sapiens
ttacctatctgtggaa

SEQ ID NO: 5461975 - DNA, 13 bp, Homo sapiens
ttacctattctga

SEQ ID NO: 5461976 - DNA, 21 bp, Homo sapiens
ttacctattctgaaaaagaca

SEQ ID NO: 5461977 - DNA, 14 bp, Homo sapiens
ttacctcaaattaa

SEQ ID NO: 5461978 - DNA, 17 bp, Homo sapiens
ttacctcaacaagaaga

SEQ ID NO: 5461979 - DNA, 17 bp, Homo sapiens
ttacctcactggtgcat

SEQ ID NO: 5461980 - DNA, 19 bp, Homo sapiens
ttacctcactggtgcattt

SEQ ID NO: 5461981 - DNA, 18 bp, Homo sapiens
ttacctcaggtgtgcctg

SEQ ID NO: 5461982 - DNA, 19 bp, Homo sapiens
ttacctcatccatgcactt

SEQ ID NO: 5461983 - DNA, 21 bp, Homo sapiens
ttacctcatgccgctgtgtct

SEQ ID NO: 5461984 - DNA, 15 bp, Homo sapiens
ttacctcatttgcat

SEQ ID NO: 5461985 - DNA, 15 bp, Homo sapiens
ttacctccaacagaa

SEQ ID NO: 5461986 - DNA, 19 bp, Homo sapiens
ttacctccaacagaactaa

SEQ ID NO: 5461987 - DNA, 18 bp, Homo sapiens
ttacctcccctgccaggg

SEQ ID NO: 5461988 - DNA, 21 bp, Homo sapiens
ttacctccctactttcttaga

SEQ ID NO: 5461989 - DNA, 23 bp, Homo sapiens
ttacctcctaatggcatggagac

SEQ ID NO: 5461990 - DNA, 11 bp, Homo sapiens
ttacctcctga

SEQ ID NO: 5461991 - DNA, 19 bp, Homo sapiens
ttacctcctgagaaaaaag

SEQ ID NO: 5461992 - DNA, 12 bp, Homo sapiens
ttacctcctgcc

SEQ ID NO: 5461993 - DNA, 13 bp, Homo sapiens
ttacctcctgccc

SEQ ID NO: 5461994 - DNA, 14 bp, Homo sapiens
ttacctcctgccca

SEQ ID NO: 5461995 - DNA, 21 bp, Homo sapiens
ttacctcggggagagggggag

SEQ ID NO: 5461996 - DNA, 22 bp, Homo sapiens
ttacctctaaatttccatatcc

SEQ ID NO: 5461997 - DNA, 21 bp, Homo sapiens
ttacctctcattagaaaggct

SEQ ID NO: 5461998 - DNA, 17 bp, Homo sapiens
ttacctctctgtcatgt

SEQ ID NO: 5461999 - DNA, 12 bp, Homo sapiens
ttacctctggaa

SEQ ID NO: 5462000 - DNA, 13 bp, Homo sapiens
ttacctctggaac

SEQ ID NO: 5462001 - DNA, 14 bp, Homo sapiens
ttacctcttacctg

SEQ ID NO: 5462002 - DNA, 18 bp, Homo sapiens
ttacctcttgcccttggg

SEQ ID NO: 5462003 - DNA, 15 bp, Homo sapiens
ttacctctttggaaa

SEQ ID NO: 5462004 - DNA, 18 bp, Homo sapiens
ttacctgaacaggaatcc

SEQ ID NO: 5462005 - DNA, 13 bp, Homo sapiens
ttacctgacacaa

SEQ ID NO: 5462006 - DNA, 17 bp, Homo sapiens
ttacctgatcaatgaca

SEQ ID NO: 5462007 - DNA, 23 bp, Homo sapiens
ttacctgatcaatgacagagcct

SEQ ID NO: 5462008 - DNA, 13 bp, Homo sapiens
ttacctgcaggct

SEQ ID NO: 5462009 - DNA, 15 bp, Homo sapiens
ttacctgcaggctcc

SEQ ID NO: 5462010 - DNA, 23 bp, Homo sapiens
ttacctgcaggctccatgcacct

SEQ ID NO: 5462011 - DNA, 14 bp, Homo sapiens
ttacctgcaggctg

SEQ ID NO: 5462012 - DNA, 15 bp, Homo sapiens
ttacctgcatgtgtt

SEQ ID NO: 5462013 - DNA, 13 bp, Homo sapiens
ttacctggagaag

SEQ ID NO: 5462014 - DNA, 20 bp, Homo sapiens
ttacctggatataaattaat

SEQ ID NO: 5462015 - DNA, 23 bp, Homo sapiens
ttacctggcagtggctctcagag

SEQ ID NO: 5462016 - DNA, 15 bp, Homo sapiens
ttacctggtactaaa

SEQ ID NO: 5462017 - DNA, 22 bp, Homo sapiens
ttacctgtacactgacttgaga

SEQ ID NO: 5462018 - DNA, 13 bp, Homo sapiens
ttacctgtacctg

SEQ ID NO: 5462019 - DNA, 13 bp, Homo sapiens
ttacctgtcacat

SEQ ID NO: 5462020 - DNA, 17 bp, Homo sapiens
ttacctgtcacattgca

SEQ ID NO: 5462021 - DNA, 18 bp, Homo sapiens
ttacctgtcacattgcat

SEQ ID NO: 5462022 - DNA, 19 bp, Homo sapiens
ttacctgtcacattgcatt

SEQ ID NO: 5462023 - DNA, 22 bp, Homo sapiens
ttacctgtcacattgcattcta

SEQ ID NO: 5462024 - DNA, 19 bp, Homo sapiens
ttacctgtcatctgggcca

SEQ ID NO: 5462025 - DNA, 17 bp, Homo sapiens
ttacctgtctctctctt

SEQ ID NO: 5462026 - DNA, 20 bp, Homo sapiens
ttacctgtcttgctcctggg

SEQ ID NO: 5462027 - DNA, 21 bp, Homo sapiens
ttacctgtgaccctctttgct

SEQ ID NO: 5462028 - DNA, 17 bp, Homo sapiens
ttacctgtgcaccagtg

SEQ ID NO: 5462029 - DNA, 12 bp, Homo sapiens
ttacctgtggat

SEQ ID NO: 5462030 - DNA, 20 bp, Homo sapiens
ttacctgttatatatctctt

SEQ ID NO: 5462031 - DNA, 19 bp, Homo sapiens
ttaccttagattagctctg

SEQ ID NO: 5462032 - DNA, 22 bp, Homo sapiens
ttaccttagattagctctggac

SEQ ID NO: 5462033 - DNA, 17 bp, Homo sapiens
ttaccttattggatatt

SEQ ID NO: 5462034 - DNA, 21 bp, Homo sapiens
ttaccttgaaaaaaagaaaag

SEQ ID NO: 5462035 - DNA, 19 bp, Homo sapiens
ttaccttgactgttgatgt

SEQ ID NO: 5462036 - DNA, 19 bp, Homo sapiens
ttaccttggccgtgaggac

SEQ ID NO: 5462037 - DNA, 16 bp, Homo sapiens
ttaccttggtatatca

SEQ ID NO: 5462038 - DNA, 20 bp, Homo sapiens
ttaccttgtcattttggtct

SEQ ID NO: 5462039 - DNA, 12 bp, Homo sapiens
ttaccttgtttt

SEQ ID NO: 5462040 - DNA, 18 bp, Homo sapiens
ttaccttgttttgccagt

SEQ ID NO: 5462041 - DNA, 16 bp, Homo sapiens
ttacctttaatgcaat

SEQ ID NO: 5462042 - DNA, 16 bp, Homo sapiens
ttacctttacatatat

SEQ ID NO: 5462043 - DNA, 15 bp, Homo sapiens
ttacctttattaatg

SEQ ID NO: 5462044 - DNA, 15 bp, Homo sapiens
ttacctttcccatgc

SEQ ID NO: 5462045 - DNA, 13 bp, Homo sapiens
ttacctttgacaa

SEQ ID NO: 5462046 - DNA, 20 bp, Homo sapiens
ttacctttgacaaaggtaaa

SEQ ID NO: 5462047 - DNA, 13 bp, Homo sapiens
ttacctttgctgt

SEQ ID NO: 5462048 - DNA, 20 bp, Homo sapiens
ttaccttttaccagctttta

SEQ ID NO: 5462049 - DNA, 18 bp, Homo sapiens
ttaccttttcagggctgg

SEQ ID NO: 5462050 - DNA, 13 bp, Homo sapiens
ttaccttttccta

SEQ ID NO: 5462051 - DNA, 14 bp, Homo sapiens
ttaccttttcctat

SEQ ID NO: 5462052 - DNA, 22 bp, Homo sapiens
ttaccttttcctattctgttgc

SEQ ID NO: 5462053 - DNA, 14 bp, Homo sapiens
ttaccttttctata

SEQ ID NO: 5462054 - DNA, 15 bp, Homo sapiens
ttaccttttgatgtt

SEQ ID NO: 5462055 - DNA, 15 bp, Homo sapiens
ttacctttttatttg

SEQ ID NO: 5462056 - DNA, 13 bp, Homo sapiens
ttagagaactaaa

SEQ ID NO: 5462057 - DNA, 15 bp, Homo sapiens
ttagagaactggagg

SEQ ID NO: 5462058 - DNA, 22 bp, Homo sapiens
ttagagaagctacccctcaaac

SEQ ID NO: 5462059 - DNA, 13 bp, Homo sapiens
ttagagaagctga

SEQ ID NO: 5462060 - DNA, 15 bp, Homo sapiens
ttagagaagctgaaa

SEQ ID NO: 5462061 - DNA, 19 bp, Homo sapiens
ttagagaaggctcagcctt

SEQ ID NO: 5462062 - DNA, 16 bp, Homo sapiens
ttagagaatatatttt

SEQ ID NO: 5462063 - DNA, 19 bp, Homo sapiens
ttagagaatatatttttga

SEQ ID NO: 5462064 - DNA, 12 bp, Homo sapiens
ttagagaatccg

SEQ ID NO: 5462065 - DNA, 15 bp, Homo sapiens
ttagagacagggtct

SEQ ID NO: 5462066 - DNA, 18 bp, Homo sapiens
ttagagagcctgtcacca

SEQ ID NO: 5462067 - DNA, 19 bp, Homo sapiens
ttagagagggaccatgtgt

SEQ ID NO: 5462068 - DNA, 17 bp, Homo sapiens
ttagagagtgttgaaac

SEQ ID NO: 5462069 - DNA, 20 bp, Homo sapiens
ttagagataaatatttatgc

SEQ ID NO: 5462070 - DNA, 23 bp, Homo sapiens
ttagagataaatatttatgcaga

SEQ ID NO: 5462071 - DNA, 14 bp, Homo sapiens
ttagagataattgc

SEQ ID NO: 5462072 - DNA, 21 bp, Homo sapiens
ttagagataccctctgagaca

SEQ ID NO: 5462073 - DNA, 14 bp, Homo sapiens
ttagagatgattca

SEQ ID NO: 5462074 - DNA, 16 bp, Homo sapiens
ttagagatgctactgt

SEQ ID NO: 5462075 - DNA, 18 bp, Homo sapiens
ttagagatgctactgtca

SEQ ID NO: 5462076 - DNA, 15 bp, Homo sapiens
ttagagattttcatt

SEQ ID NO: 5462077 - DNA, 12 bp, Homo sapiens
ttagagattttt

SEQ ID NO: 5462078 - DNA, 17 bp, Homo sapiens
ttagagcattaaaataa

SEQ ID NO: 5462079 - DNA, 15 bp, Homo sapiens
ttagagccaagctgc

SEQ ID NO: 5462080 - DNA, 17 bp, Homo sapiens
ttagagccaagtgtctt

SEQ ID NO: 5462081 - DNA, 21 bp, Homo sapiens
ttagagccaagtgtcttttaa

SEQ ID NO: 5462082 - DNA, 19 bp, Homo sapiens
ttagagccagaagtaactt

SEQ ID NO: 5462083 - DNA, 22 bp, Homo sapiens
ttagagccaggcacacactgtg

SEQ ID NO: 5462084 - DNA, 19 bp, Homo sapiens
ttagagcccattaatcttg

SEQ ID NO: 5462085 - DNA, 20 bp, Homo sapiens
ttagagcccattaatcttga

SEQ ID NO: 5462086 - DNA, 22 bp, Homo sapiens
ttagagcccattaatcttgatc

SEQ ID NO: 5462087 - DNA, 19 bp, Homo sapiens
ttagagcctcgtccctccc

SEQ ID NO: 5462088 - DNA, 19 bp, Homo sapiens
ttagagctaaaaaggccct

SEQ ID NO: 5462089 - DNA, 21 bp, Homo sapiens
ttagagcttccgagaatagct

SEQ ID NO: 5462090 - DNA, 15 bp, Homo sapiens
ttagagcttggacag

SEQ ID NO: 5462091 - DNA, 18 bp, Homo sapiens
ttagaggaaaaaaatgac

SEQ ID NO: 5462092 - DNA, 13 bp, Homo sapiens
ttagaggaaaagg

SEQ ID NO: 5462093 - DNA, 15 bp, Homo sapiens
ttagaggaaaatgag

SEQ ID NO: 5462094 - DNA, 12 bp, Homo sapiens
ttagaggaattt

SEQ ID NO: 5462095 - DNA, 15 bp, Homo sapiens
ttagaggcattgtta

SEQ ID NO: 5462096 - DNA, 18 bp, Homo sapiens
ttagagggaggagaatga

SEQ ID NO: 5462097 - DNA, 17 bp, Homo sapiens
ttagaggggcaaaaata

SEQ ID NO: 5462098 - DNA, 19 bp, Homo sapiens
ttagaggggcaaaaatatt

SEQ ID NO: 5462099 - DNA, 22 bp, Homo sapiens
ttagagggtgatggaacaagag

SEQ ID NO: 5462100 - DNA, 17 bp, Homo sapiens
ttagaggtaaaagtaca

SEQ ID NO: 5462101 - DNA, 15 bp, Homo sapiens
ttagaggttctgcct

SEQ ID NO: 5462102 - DNA, 17 bp, Homo sapiens
ttagaggttctgcctct

SEQ ID NO: 5462103 - DNA, 20 bp, Homo sapiens
ttagagtaaataaactgttt

SEQ ID NO: 5462104 - DNA, 19 bp, Homo sapiens
ttagagtaagaaatttcag

SEQ ID NO: 5462105 - DNA, 24 bp, Homo sapiens
ttagagtaggtattaatcttattg

SEQ ID NO: 5462106 - DNA, 21 bp, Homo sapiens
ttagagtatgcaagaagaata

SEQ ID NO: 5462107 - DNA, 16 bp, Homo sapiens
ttagagtggttattca

SEQ ID NO: 5462108 - DNA, 16 bp, Homo sapiens
ttagagttaacaatga

SEQ ID NO: 5462109 - DNA, 17 bp, Homo sapiens
ttagagttagactgttg

SEQ ID NO: 5462110 - DNA, 20 bp, Homo sapiens
ttagagttattttgtgtcct

SEQ ID NO: 5462111 - DNA, 14 bp, Homo sapiens
ttagagtttacagt

SEQ ID NO: 5462112 - DNA, 16 bp, Homo sapiens
ttagagtttctgtttg

SEQ ID NO: 5462113 - DNA, 18 bp, Homo sapiens
ttagagttttattccttt

SEQ ID NO: 5462114 - DNA, 15 bp, Homo sapiens
ttagataaaaataaa

SEQ ID NO: 5462115 - DNA, 21 bp, Homo sapiens
ttagataaagatttctagtag

SEQ ID NO: 5462116 - DNA, 14 bp, Homo sapiens
ttagataaaggaaa

SEQ ID NO: 5462117 - DNA, 22 bp, Homo sapiens
ttagataaagtaagcctaggtg

SEQ ID NO: 5462118 - DNA, 16 bp, Homo sapiens
ttagataacttcttga

SEQ ID NO: 5462119 - DNA, 21 bp, Homo sapiens
ttagataatacaggtaacatt

SEQ ID NO: 5462120 - DNA, 13 bp, Homo sapiens
ttagataatcttt

SEQ ID NO: 5462121 - DNA, 18 bp, Homo sapiens
ttagataatcttttacat

SEQ ID NO: 5462122 - DNA, 15 bp, Homo sapiens
ttagataatttgaaa

SEQ ID NO: 5462123 - DNA, 16 bp, Homo sapiens
ttagataatttgaaaa

SEQ ID NO: 5462124 - DNA, 16 bp, Homo sapiens
ttagatagccctgtcc

SEQ ID NO: 5462125 - DNA, 18 bp, Homo sapiens
ttagatagccctgtcctg

SEQ ID NO: 5462126 - DNA, 16 bp, Homo sapiens
ttagatatattctcta

SEQ ID NO: 5462127 - DNA, 18 bp, Homo sapiens
ttagatatttacatccag

SEQ ID NO: 5462128 - DNA, 15 bp, Homo sapiens
ttagatatttcatgt

SEQ ID NO: 5462129 - DNA, 16 bp, Homo sapiens
ttagatattttccata

SEQ ID NO: 5462130 - DNA, 24 bp, Homo sapiens
ttagatattttccatatattggca

SEQ ID NO: 5462131 - DNA, 23 bp, Homo sapiens
ttagatcaaatactttaaaggaa

SEQ ID NO: 5462132 - DNA, 19 bp, Homo sapiens
ttagatcaacacttttctc

SEQ ID NO: 5462133 - DNA, 18 bp, Homo sapiens
ttagatcaaggcaaaaat

SEQ ID NO: 5462134 - DNA, 15 bp, Homo sapiens
ttagatcatagtttt

SEQ ID NO: 5462135 - DNA, 18 bp, Homo sapiens
ttagatccaagccaagtt

SEQ ID NO: 5462136 - DNA, 16 bp, Homo sapiens
ttagatctctcctgca

SEQ ID NO: 5462137 - DNA, 14 bp, Homo sapiens
ttagatcttatatt

SEQ ID NO: 5462138 - DNA, 17 bp, Homo sapiens
ttagatcttatattggt

SEQ ID NO: 5462139 - DNA, 17 bp, Homo sapiens
ttagatgagggtgactg

SEQ ID NO: 5462140 - DNA, 21 bp, Homo sapiens
ttagatgcagttctgaagaag

SEQ ID NO: 5462141 - DNA, 23 bp, Homo sapiens
ttagatgcagttctgaagaagat

SEQ ID NO: 5462142 - DNA, 12 bp, Homo sapiens
ttagatgccaaa

SEQ ID NO: 5462143 - DNA, 17 bp, Homo sapiens
ttagatgctactaagaa

SEQ ID NO: 5462144 - DNA, 21 bp, Homo sapiens
ttagatgctattaaagtttca

SEQ ID NO: 5462145 - DNA, 20 bp, Homo sapiens
ttagatgctattaagaaggc

SEQ ID NO: 5462146 - DNA, 21 bp, Homo sapiens
ttagatgctattaagaaggca

SEQ ID NO: 5462147 - DNA, 15 bp, Homo sapiens
ttagatgctctgaga

SEQ ID NO: 5462148 - DNA, 18 bp, Homo sapiens
ttagatgctctgagaaat

SEQ ID NO: 5462149 - DNA, 23 bp, Homo sapiens
ttagatgcttaggtgaaggcaga

SEQ ID NO: 5462150 - DNA, 19 bp, Homo sapiens
ttagatggaaaaatgtgaa

SEQ ID NO: 5462151 - DNA, 16 bp, Homo sapiens
ttagatggattctcca

SEQ ID NO: 5462152 - DNA, 17 bp, Homo sapiens
ttagatggattctccac

SEQ ID NO: 5462153 - DNA, 20 bp, Homo sapiens
ttagatgggaggatgaattg

SEQ ID NO: 5462154 - DNA, 21 bp, Homo sapiens
ttagatggtggcacattcctt

SEQ ID NO: 5462155 - DNA, 17 bp, Homo sapiens
ttagatggttacactgt

SEQ ID NO: 5462156 - DNA, 16 bp, Homo sapiens
ttagatgtagcactga

SEQ ID NO: 5462157 - DNA, 13 bp, Homo sapiens
ttagatgtcatga

SEQ ID NO: 5462158 - DNA, 20 bp, Homo sapiens
ttagatgtgatttaatagtg

SEQ ID NO: 5462159 - DNA, 21 bp, Homo sapiens
ttagatgtgatttaatagtgt

SEQ ID NO: 5462160 - DNA, 17 bp, Homo sapiens
ttagatgtgccaataac

SEQ ID NO: 5462161 - DNA, 19 bp, Homo sapiens
ttagatgtgccaataacca

SEQ ID NO: 5462162 - DNA, 18 bp, Homo sapiens
ttagatgttactacctta

SEQ ID NO: 5462163 - DNA, 21 bp, Homo sapiens
ttagatgttccagtaatctaa

SEQ ID NO: 5462164 - DNA, 17 bp, Homo sapiens
ttagatgtttaccttca

SEQ ID NO: 5462165 - DNA, 21 bp, Homo sapiens
ttagatgtttaccttcagcca

SEQ ID NO: 5462166 - DNA, 15 bp, Homo sapiens
ttagatgtttcacac

SEQ ID NO: 5462167 - DNA, 15 bp, Homo sapiens
ttagatgttttacaa

SEQ ID NO: 5462168 - DNA, 22 bp, Homo sapiens
ttagattagaaagactttctaa

SEQ ID NO: 5462169 - DNA, 16 bp, Homo sapiens
ttagattagctctgga

SEQ ID NO: 5462170 - DNA, 14 bp, Homo sapiens
ttagattattgaaa

SEQ ID NO: 5462171 - DNA, 15 bp, Homo sapiens
ttagattcactttga

SEQ ID NO: 5462172 - DNA, 13 bp, Homo sapiens
ttagattccagga

SEQ ID NO: 5462173 - DNA, 12 bp, Homo sapiens
ttagattctgta

SEQ ID NO: 5462174 - DNA, 13 bp, Homo sapiens
ttagattgagaaa

SEQ ID NO: 5462175 - DNA, 17 bp, Homo sapiens
ttagattgggccatggc

SEQ ID NO: 5462176 - DNA, 17 bp, Homo sapiens
ttagattggttctgttt

SEQ ID NO: 5462177 - DNA, 18 bp, Homo sapiens
ttagattgtattaactat

SEQ ID NO: 5462178 - DNA, 14 bp, Homo sapiens
ttagattgtgttcc

SEQ ID NO: 5462179 - DNA, 14 bp, Homo sapiens
ttagatttcatagt

SEQ ID NO: 5462180 - DNA, 12 bp, Homo sapiens
ttagattttaca

SEQ ID NO: 5462181 - DNA, 19 bp, Homo sapiens
ttagattttacatgaagta

SEQ ID NO: 5462182 - DNA, 20 bp, Homo sapiens
ttagattttacatgaagtat

SEQ ID NO: 5462183 - DNA, 21 bp, Homo sapiens
ttagattttattttactattg

SEQ ID NO: 5462184 - DNA, 23 bp, Homo sapiens
ttagattttgtgtttattcttga

SEQ ID NO: 5462185 - DNA, 15 bp, Homo sapiens
ttagatttttaaatt

SEQ ID NO: 5462186 - DNA, 16 bp, Homo sapiens
ttagatttttaaattg

SEQ ID NO: 5462187 - DNA, 15 bp, Homo sapiens
ttagcaaactgatgc

SEQ ID NO: 5462188 - DNA, 22 bp, Homo sapiens
ttagcaaagatatctcatctct

SEQ ID NO: 5462189 - DNA, 22 bp, Homo sapiens
ttagcaaatcagtatattttct

SEQ ID NO: 5462190 - DNA, 12 bp, Homo sapiens
ttagcaacaaca

SEQ ID NO: 5462191 - DNA, 13 bp, Homo sapiens
ttagcaaggcaga

SEQ ID NO: 5462192 - DNA, 19 bp, Homo sapiens
ttagcaataaataacactt

SEQ ID NO: 5462193 - DNA, 23 bp, Homo sapiens
ttagcaataaataacacttgtca

SEQ ID NO: 5462194 - DNA, 17 bp, Homo sapiens
ttagcaataaatgcttt

SEQ ID NO: 5462195 - DNA, 18 bp, Homo sapiens
ttagcaataaatgctttt

SEQ ID NO: 5462196 - DNA, 14 bp, Homo sapiens
ttagcaatatttat

SEQ ID NO: 5462197 - DNA, 17 bp, Homo sapiens
ttagcacaaaaaaaatt

SEQ ID NO: 5462198 - DNA, 18 bp, Homo sapiens
ttagcacaatttatattt

SEQ ID NO: 5462199 - DNA, 13 bp, Homo sapiens
ttagcacagagag

SEQ ID NO: 5462200 - DNA, 20 bp, Homo sapiens
ttagcacagattttaattgt

SEQ ID NO: 5462201 - DNA, 22 bp, Homo sapiens
ttagcacagattttaattgtca

SEQ ID NO: 5462202 - DNA, 11 bp, Homo sapiens
ttagcacagcg

SEQ ID NO: 5462203 - DNA, 13 bp, Homo sapiens
ttagcacagtatt

SEQ ID NO: 5462204 - DNA, 18 bp, Homo sapiens
ttagcacagtatttaaca

SEQ ID NO: 5462205 - DNA, 14 bp, Homo sapiens
ttagcaccagcttg

SEQ ID NO: 5462206 - DNA, 19 bp, Homo sapiens
ttagcaccagcttgcttct

SEQ ID NO: 5462207 - DNA, 16 bp, Homo sapiens
ttagcaccgtttgtga

SEQ ID NO: 5462208 - DNA, 18 bp, Homo sapiens
ttagcacgtttaaagttc

SEQ ID NO: 5462209 - DNA, 14 bp, Homo sapiens
ttagcactgttgat

SEQ ID NO: 5462210 - DNA, 21 bp, Homo sapiens
ttagcactgttgatgtatctg

SEQ ID NO: 5462211 - DNA, 13 bp, Homo sapiens
ttagcacttcttt

SEQ ID NO: 5462212 - DNA, 21 bp, Homo sapiens
ttagcacttgggtgacggcag

SEQ ID NO: 5462213 - DNA, 19 bp, Homo sapiens
ttagcagaatggagaaagt

SEQ ID NO: 5462214 - DNA, 12 bp, Homo sapiens
ttagcagacagg

SEQ ID NO: 5462215 - DNA, 16 bp, Homo sapiens
ttagcagacccagctt

SEQ ID NO: 5462216 - DNA, 15 bp, Homo sapiens
ttagcagacctaaag

SEQ ID NO: 5462217 - DNA, 17 bp, Homo sapiens
ttagcagagtctgtctc

SEQ ID NO: 5462218 - DNA, 23 bp, Homo sapiens
ttagcaggagaggagagccagag

SEQ ID NO: 5462219 - DNA, 18 bp, Homo sapiens
ttagcagggatgttcctt

SEQ ID NO: 5462220 - DNA, 14 bp, Homo sapiens
ttagcagtaaaata

SEQ ID NO: 5462221 - DNA, 18 bp, Homo sapiens
ttagcagtccatttttga

SEQ ID NO: 5462222 - DNA, 20 bp, Homo sapiens
ttagcagtggctggtgccca

SEQ ID NO: 5462223 - DNA, 23 bp, Homo sapiens
ttagcagtggctggtgcccatga

SEQ ID NO: 5462224 - DNA, 21 bp, Homo sapiens
ttagcagttctgcaaatagaa

SEQ ID NO: 5462225 - DNA, 19 bp, Homo sapiens
ttagcagttgctcacatgt

SEQ ID NO: 5462226 - DNA, 16 bp, Homo sapiens
ttagcataaatttaat

SEQ ID NO: 5462227 - DNA, 19 bp, Homo sapiens
ttagcataaatttaatgta

SEQ ID NO: 5462228 - DNA, 15 bp, Homo sapiens
ttagcataattttgt

SEQ ID NO: 5462229 - DNA, 23 bp, Homo sapiens
ttagcatactagaatcagataca

SEQ ID NO: 5462230 - DNA, 18 bp, Homo sapiens
ttagcatagcttattatt

SEQ ID NO: 5462231 - DNA, 13 bp, Homo sapiens
ttagcatcaagtt

SEQ ID NO: 5462232 - DNA, 17 bp, Homo sapiens
ttagcatcaagttctcc

SEQ ID NO: 5462233 - DNA, 14 bp, Homo sapiens
ttagcatccaggct

SEQ ID NO: 5462234 - DNA, 11 bp, Homo sapiens
ttagtattgca

SEQ ID NO: 5462235 - DNA, 12 bp, Homo sapiens
ttagtattgttg

SEQ ID NO: 5462236 - DNA, 16 bp, Homo sapiens
ttagtattgttgtcct

SEQ ID NO: 5462237 - DNA, 22 bp, Homo sapiens
ttagtattgttgtccttttcat

SEQ ID NO: 5462238 - DNA, 17 bp, Homo sapiens
ttagtatttcagtgttt

SEQ ID NO: 5462239 - DNA, 20 bp, Homo sapiens
ttagtatttcagtgttttca

SEQ ID NO: 5462240 - DNA, 16 bp, Homo sapiens
ttagtatttgcatatt

SEQ ID NO: 5462241 - DNA, 22 bp, Homo sapiens
ttagtattttaatcctgtacca

SEQ ID NO: 5462242 - DNA, 21 bp, Homo sapiens
ttagtattttgagccttatta

SEQ ID NO: 5462243 - DNA, 14 bp, Homo sapiens
ttagtatttttact

SEQ ID NO: 5462244 - DNA, 22 bp, Homo sapiens
ttagtcactttttttttccaaa

SEQ ID NO: 5462245 - DNA, 19 bp, Homo sapiens
ttagtcagaaatgattcag

SEQ ID NO: 5462246 - DNA, 15 bp, Homo sapiens
ttagtcatccaacaa

SEQ ID NO: 5462247 - DNA, 16 bp, Homo sapiens
ttagtccaatgaagat

SEQ ID NO: 5462248 - DNA, 17 bp, Homo sapiens
ttagtccaatgaagata

SEQ ID NO: 5462249 - DNA, 23 bp, Homo sapiens
ttagtccaatgaagataaatgct

SEQ ID NO: 5462250 - DNA, 17 bp, Homo sapiens
ttagtcctcacagccta

SEQ ID NO: 5462251 - DNA, 12 bp, Homo sapiens
ttagtcctggga

SEQ ID NO: 5462252 - DNA, 19 bp, Homo sapiens
ttagtcctgtactgtatgg

SEQ ID NO: 5462253 - DNA, 13 bp, Homo sapiens
ttagtcgtgagct

SEQ ID NO: 5462254 - DNA, 19 bp, Homo sapiens
ttagtctaacacagttgac

SEQ ID NO: 5462255 - DNA, 18 bp, Homo sapiens
ttagtctaagatgattca

SEQ ID NO: 5462256 - DNA, 22 bp, Homo sapiens
ttagtctagacacaatttcatt

SEQ ID NO: 5462257 - DNA, 16 bp, Homo sapiens
ttagtctcaggttcaa

SEQ ID NO: 5462258 - DNA, 23 bp, Homo sapiens
ttagtctcagtttgtgtgtctta

SEQ ID NO: 5462259 - DNA, 18 bp, Homo sapiens
ttagtctctaaagagttt

SEQ ID NO: 5462260 - DNA, 22 bp, Homo sapiens
ttagtctcttgtattaaactct

SEQ ID NO: 5462261 - DNA, 14 bp, Homo sapiens
ttagtctctttatt

SEQ ID NO: 5462262 - DNA, 20 bp, Homo sapiens
ttagtctctttattcctagt

SEQ ID NO: 5462263 - DNA, 15 bp, Homo sapiens
ttagtctgaaactgg

SEQ ID NO: 5462264 - DNA, 18 bp, Homo sapiens
ttagtctgaaactggctt

SEQ ID NO: 5462265 - DNA, 14 bp, Homo sapiens
ttagtcttctcata

SEQ ID NO: 5462266 - DNA, 18 bp, Homo sapiens
ttagtcttctcatagcat

SEQ ID NO: 5462267 - DNA, 20 bp, Homo sapiens
ttagtcttgctgtttcttga

SEQ ID NO: 5462268 - DNA, 18 bp, Homo sapiens
ttagtcttttactccttt

SEQ ID NO: 5462269 - DNA, 14 bp, Homo sapiens
ttagtgaaaatact

SEQ ID NO: 5462270 - DNA, 20 bp, Homo sapiens
ttagtgaaccaaaaatagaa

SEQ ID NO: 5462271 - DNA, 12 bp, Homo sapiens
ttagtgaagatg

SEQ ID NO: 5462272 - DNA, 19 bp, Homo sapiens
ttagtgacctcagctttga

SEQ ID NO: 5462273 - DNA, 23 bp, Homo sapiens
ttagtgactaaaccattgtgcat

SEQ ID NO: 5462274 - DNA, 16 bp, Homo sapiens
ttagtgagacatattt

SEQ ID NO: 5462275 - DNA, 14 bp, Homo sapiens
ttagtgagattaaa

SEQ ID NO: 5462276 - DNA, 13 bp, Homo sapiens
ttagtgagatttg

SEQ ID NO: 5462277 - DNA, 19 bp, Homo sapiens
ttagtgatactggctcaga

SEQ ID NO: 5462278 - DNA, 16 bp, Homo sapiens
ttagtgatatttctct

SEQ ID NO: 5462279 - DNA, 18 bp, Homo sapiens
ttagtgatatttctctag

SEQ ID NO: 5462280 - DNA, 19 bp, Homo sapiens
ttagtgatatttctctagt

SEQ ID NO: 5462281 - DNA, 23 bp, Homo sapiens
ttagtgatatttctctagtagtt

SEQ ID NO: 5462282 - DNA, 16 bp, Homo sapiens
ttagtgattgctttta

SEQ ID NO: 5462283 - DNA, 14 bp, Homo sapiens
ttagtgcatccagt

SEQ ID NO: 5462284 - DNA, 17 bp, Homo sapiens
ttagtgcatgtcacatg

SEQ ID NO: 5462285 - DNA, 13 bp, Homo sapiens
ttagtgccaactt

SEQ ID NO: 5462286 - DNA, 16 bp, Homo sapiens
ttagtgccaatgttgt

SEQ ID NO: 5462287 - DNA, 12 bp, Homo sapiens
ttagtgccctgc

SEQ ID NO: 5462288 - DNA, 20 bp, Homo sapiens
ttagtgccctgccccctggc

SEQ ID NO: 5462289 - DNA, 14 bp, Homo sapiens
ttagtgcctgtgtg

SEQ ID NO: 5462290 - DNA, 19 bp, Homo sapiens
ttagtgctaagtgtgaact

SEQ ID NO: 5462291 - DNA, 21 bp, Homo sapiens
ttagtgctaagtgtgaactgg

SEQ ID NO: 5462292 - DNA, 20 bp, Homo sapiens
ttagtggacttgttttaatt

SEQ ID NO: 5462293 - DNA, 16 bp, Homo sapiens
ttagtggatggaatat

SEQ ID NO: 5462294 - DNA, 12 bp, Homo sapiens
ttagtggctttt

SEQ ID NO: 5462295 - DNA, 16 bp, Homo sapiens
ttagtgggccagggct

SEQ ID NO: 5462296 - DNA, 19 bp, Homo sapiens
ttagtggggtaattctgct

SEQ ID NO: 5462297 - DNA, 16 bp, Homo sapiens
ttagtggtatgtctct

SEQ ID NO: 5462298 - DNA, 15 bp, Homo sapiens
ttagtggttctgtgc

SEQ ID NO: 5462299 - DNA, 19 bp, Homo sapiens
ttagtggttctgtgcctct

SEQ ID NO: 5462300 - DNA, 15 bp, Homo sapiens
ttagtgtaaaaatga

SEQ ID NO: 5462301 - DNA, 13 bp, Homo sapiens
ttagtgtatatgt

SEQ ID NO: 5462302 - DNA, 18 bp, Homo sapiens
ttagtgtatgattactgg

SEQ ID NO: 5462303 - DNA, 13 bp, Homo sapiens
ttagtgtatgtga

SEQ ID NO: 5462304 - DNA, 23 bp, Homo sapiens
ttagtgtcacttacctagattta

SEQ ID NO: 5462305 - DNA, 20 bp, Homo sapiens
ttagtgtctccagtcaagct

SEQ ID NO: 5462306 - DNA, 11 bp, Homo sapiens
ttagtgtctgt

SEQ ID NO: 5462307 - DNA, 14 bp, Homo sapiens
ttagtgtgaatatt

SEQ ID NO: 5462308 - DNA, 19 bp, Homo sapiens
ttagtgtgacagtttccaa

SEQ ID NO: 5462309 - DNA, 14 bp, Homo sapiens
ttagtgtgccttcc

SEQ ID NO: 5462310 - DNA, 18 bp, Homo sapiens
ttagtgtggttttctgtt

SEQ ID NO: 5462311 - DNA, 19 bp, Homo sapiens
ttagtgtggttttctgttt

SEQ ID NO: 5462312 - DNA, 13 bp, Homo sapiens
ttagtgtgtaaaa

SEQ ID NO: 5462313 - DNA, 15 bp, Homo sapiens
ttagtgtgtaaaatt

SEQ ID NO: 5462314 - DNA, 19 bp, Homo sapiens
ttagtgtgtaaaattaatg

SEQ ID NO: 5462315 - DNA, 15 bp, Homo sapiens
ttagtgtgtgtgcat

SEQ ID NO: 5462316 - DNA, 19 bp, Homo sapiens
ttagtgtgtgtgcatgtgt

SEQ ID NO: 5462317 - DNA, 21 bp, Homo sapiens
ttagtgtgtgtgcatgtgtgt

SEQ ID NO: 5462318 - DNA, 15 bp, Homo sapiens
ttagtgttagttata

SEQ ID NO: 5462319 - DNA, 12 bp, Homo sapiens
ttagtgtttctg

SEQ ID NO: 5462320 - DNA, 16 bp, Homo sapiens
ttagtgtttctgtgca

SEQ ID NO: 5462321 - DNA, 16 bp, Homo sapiens
ttagtgtttttttatt

SEQ ID NO: 5462322 - DNA, 14 bp, Homo sapiens
ttagttaactgaat

SEQ ID NO: 5462323 - DNA, 14 bp, Homo sapiens
ttagttaagtttta

SEQ ID NO: 5462324 - DNA, 14 bp, Homo sapiens
ttagttaatggatt

SEQ ID NO: 5462325 - DNA, 19 bp, Homo sapiens
ttagttaccgagacatgaa

SEQ ID NO: 5462326 - DNA, 16 bp, Homo sapiens
ttagttaccttatagt

SEQ ID NO: 5462327 - DNA, 18 bp, Homo sapiens
ttagttaccttatagtta

SEQ ID NO: 5462328 - DNA, 22 bp, Homo sapiens
ttagttaccttatagttactgt

SEQ ID NO: 5462329 - DNA, 20 bp, Homo sapiens
ttagttacgtataatgcttt

SEQ ID NO: 5462330 - DNA, 17 bp, Homo sapiens
ttagttaggtgtgccaa

SEQ ID NO: 5462331 - DNA, 15 bp, Homo sapiens
ttagttatagtttca

SEQ ID NO: 5462332 - DNA, 22 bp, Homo sapiens
ttagttatagtttcagatatat

SEQ ID NO: 5462333 - DNA, 15 bp, Homo sapiens
ttagttatttctgcc

SEQ ID NO: 5462334 - DNA, 17 bp, Homo sapiens
ttagttcaatacagtga

SEQ ID NO: 5462335 - DNA, 20 bp, Homo sapiens
ttagttccaacaaagaaagg

SEQ ID NO: 5462336 - DNA, 15 bp, Homo sapiens
ttagttccagtttct

SEQ ID NO: 5462337 - DNA, 23 bp, Homo sapiens
ttagttccccaaatacaaagtta

SEQ ID NO: 5462338 - DNA, 13 bp, Homo sapiens
ttagttccctgtc

SEQ ID NO: 5462339 - DNA, 18 bp, Homo sapiens
ttagttcctgtgcacagc

SEQ ID NO: 5462340 - DNA, 12 bp, Homo sapiens
ttagttctattt

SEQ ID NO: 5462341 - DNA, 14 bp, Homo sapiens
ttagttctgacttt

SEQ ID NO: 5462342 - DNA, 23 bp, Homo sapiens
ttagttctgactttgaatttata

SEQ ID NO: 5462343 - DNA, 20 bp, Homo sapiens
ttagttctgtatataaatat

SEQ ID NO: 5462344 - DNA, 15 bp, Homo sapiens
ttagttcttgaattg

SEQ ID NO: 5462345 - DNA, 16 bp, Homo sapiens
ttagttcttgaattgt

SEQ ID NO: 5462346 - DNA, 17 bp, Homo sapiens
ttagttcttgaattgtt

SEQ ID NO: 5462347 - DNA, 19 bp, Homo sapiens
ttagttcttgaattgttat

SEQ ID NO: 5462348 - DNA, 22 bp, Homo sapiens
ttagttgacaacctagaatgtc

SEQ ID NO: 5462349 - DNA, 12 bp, Homo sapiens
ttagttgacagt

SEQ ID NO: 5462350 - DNA, 23 bp, Homo sapiens
ttagttgaccaactatattgcga

SEQ ID NO: 5462351 - DNA, 22 bp, Homo sapiens
ttagttgagtcttcacatttag

SEQ ID NO: 5462352 - DNA, 22 bp, Homo sapiens
ttagttgattgctgttgagatg

SEQ ID NO: 5462353 - DNA, 12 bp, Homo sapiens
ttagttgcattg

SEQ ID NO: 5462354 - DNA, 13 bp, Homo sapiens
ttagttgctgtat

SEQ ID NO: 5462355 - DNA, 15 bp, Homo sapiens
ttagttgctgtatgt

SEQ ID NO: 5462356 - DNA, 22 bp, Homo sapiens
ttagttgcttgctaatatttcc

SEQ ID NO: 5462357 - DNA, 12 bp, Homo sapiens
ttagttggaatg

SEQ ID NO: 5462358 - DNA, 13 bp, Homo sapiens
ttagttggctgga

SEQ ID NO: 5462359 - DNA, 22 bp, Homo sapiens
ttagttgggatgccaatttcct

SEQ ID NO: 5462360 - DNA, 13 bp, Homo sapiens
ttagtttaaaatg

SEQ ID NO: 5462361 - DNA, 12 bp, Homo sapiens
ttagtttacaat

SEQ ID NO: 5462362 - DNA, 17 bp, Homo sapiens
ttagtttacaatcagcc

SEQ ID NO: 5462363 - DNA, 16 bp, Homo sapiens
ttagtttagaacaggt

SEQ ID NO: 5462364 - DNA, 22 bp, Homo sapiens
ttagtttatattaatttcggtt

SEQ ID NO: 5462365 - DNA, 15 bp, Homo sapiens
ttagtttcaaaatgt

SEQ ID NO: 5462366 - DNA, 17 bp, Homo sapiens
ttagtttcagctgacca

SEQ ID NO: 5462367 - DNA, 18 bp, Homo sapiens
ttagtttcagctgaccag

SEQ ID NO: 5462368 - DNA, 20 bp, Homo sapiens
ttagtttctgagttttacca

SEQ ID NO: 5462369 - DNA, 19 bp, Homo sapiens
ttagtttctgttctgtgga

SEQ ID NO: 5462370 - DNA, 14 bp, Homo sapiens
ttagtttctttggg

SEQ ID NO: 5462371 - DNA, 14 bp, Homo sapiens
ttagtttgaaacag

SEQ ID NO: 5462372 - DNA, 13 bp, Homo sapiens
ttagtttgttaaa

SEQ ID NO: 5462373 - DNA, 14 bp, Homo sapiens
ttagtttgttcttc

SEQ ID NO: 5462374 - DNA, 15 bp, Homo sapiens
ttagtttgttttaca

SEQ ID NO: 5462375 - DNA, 19 bp, Homo sapiens
ttagttttaaggacttcat

SEQ ID NO: 5462376 - DNA, 15 bp, Homo sapiens
ttagttttagttgca

SEQ ID NO: 5462377 - DNA, 17 bp, Homo sapiens
ttagttttatggcatga

SEQ ID NO: 5462378 - DNA, 18 bp, Homo sapiens
ttagttttctgtatatga

SEQ ID NO: 5462379 - DNA, 14 bp, Homo sapiens
ttagttttctttgt

SEQ ID NO: 5462380 - DNA, 21 bp, Homo sapiens
ttagttttctttgtaaaggtc

SEQ ID NO: 5462381 - DNA, 16 bp, Homo sapiens
ttagttttgatgagtt

SEQ ID NO: 5462382 - DNA, 14 bp, Homo sapiens
ttagttttgctttt

SEQ ID NO: 5462383 - DNA, 20 bp, Homo sapiens
ttagtttttaaaaaggcctt

SEQ ID NO: 5462384 - DNA, 21 bp, Homo sapiens
ttagtttttaaaaaggccttt

SEQ ID NO: 5462385 - DNA, 20 bp, Homo sapiens
ttagtttttaaaatatcttt

SEQ ID NO: 5462386 - DNA, 22 bp, Homo sapiens
ttagtttttaaaatttatttgc

SEQ ID NO: 5462387 - DNA, 17 bp, Homo sapiens
ttagtttttgtaattta

SEQ ID NO: 5462388 - DNA, 19 bp, Homo sapiens
ttagtttttgtaatttatt

SEQ ID NO: 5462389 - DNA, 18 bp, Homo sapiens
ttagtttttgtgaagttt

SEQ ID NO: 5462390 - DNA, 19 bp, Homo sapiens
ttagttttttttttttaca

SEQ ID NO: 5462391 - DNA, 20 bp, Homo sapiens
ttagttttttttttttacaa

SEQ ID NO: 5462392 - DNA, 23 bp, Homo sapiens
ttagttttttttttttacaacta

SEQ ID NO: 5462393 - DNA, 21 bp, Homo sapiens
ttataaaaaaaagttgtttat

SEQ ID NO: 5462394 - DNA, 19 bp, Homo sapiens
ttataaaaaatggtgcctg

SEQ ID NO: 5462395 - DNA, 17 bp, Homo sapiens
ttataaaaaatggttca

SEQ ID NO: 5462396 - DNA, 17 bp, Homo sapiens
ttataaaaaatgtaaca

SEQ ID NO: 5462397 - DNA, 18 bp, Homo sapiens
ttataaaaaatgtaacat

SEQ ID NO: 5462398 - DNA, 11 bp, Homo sapiens
ttataaaaaca

SEQ ID NO: 5462399 - DNA, 14 bp, Homo sapiens
ttataaaaacattg

SEQ ID NO: 5462400 - DNA, 20 bp, Homo sapiens
ttataaaaacattgaaatat

SEQ ID NO: 5462401 - DNA, 21 bp, Homo sapiens
ttataaaaacccctaaaaaca

SEQ ID NO: 5462402 - DNA, 14 bp, Homo sapiens
ttataaaaagataa

SEQ ID NO: 5462403 - DNA, 13 bp, Homo sapiens
ttataaaaagtga

SEQ ID NO: 5462404 - DNA, 15 bp, Homo sapiens
ttataaaaataaaaa

SEQ ID NO: 5462405 - DNA, 22 bp, Homo sapiens
ttataaaaataaaaaacactgg

SEQ ID NO: 5462406 - DNA, 21 bp, Homo sapiens
ttataaaaataaagggaagaa

SEQ ID NO: 5462407 - DNA, 17 bp, Homo sapiens
ttataaaaataaataga

SEQ ID NO: 5462408 - DNA, 21 bp, Homo sapiens
ttataaaaataaatagaaaag

SEQ ID NO: 5462409 - DNA, 19 bp, Homo sapiens
ttataaaaatataaattgt

SEQ ID NO: 5462410 - DNA, 21 bp, Homo sapiens
ttataaaaatattaagacaat

SEQ ID NO: 5462411 - DNA, 15 bp, Homo sapiens
ttataaaaatgaatt

SEQ ID NO: 5462412 - DNA, 20 bp, Homo sapiens
ttataaaaattctagtctgt

SEQ ID NO: 5462413 - DNA, 15 bp, Homo sapiens
ttatatatgaaaact

SEQ ID NO: 5462414 - DNA, 18 bp, Homo sapiens
ttatatatgaaaactata

SEQ ID NO: 5462415 - DNA, 22 bp, Homo sapiens
ttatatatgaatattacatgta

SEQ ID NO: 5462416 - DNA, 14 bp, Homo sapiens
ttatatatggacat

SEQ ID NO: 5462417 - DNA, 17 bp, Homo sapiens
ttatatatggacatggc

SEQ ID NO: 5462418 - DNA, 20 bp, Homo sapiens
ttatatatgtatatctgtgt

SEQ ID NO: 5462419 - DNA, 17 bp, Homo sapiens
ttatatatgtatttata

SEQ ID NO: 5462420 - DNA, 12 bp, Homo sapiens
ttatatatgtga

SEQ ID NO: 5462421 - DNA, 23 bp, Homo sapiens
ttatatattataagttgaccttt

SEQ ID NO: 5462422 - DNA, 16 bp, Homo sapiens
ttatatattatatgga

SEQ ID NO: 5462423 - DNA, 17 bp, Homo sapiens
ttatatattatgtgaag

SEQ ID NO: 5462424 - DNA, 22 bp, Homo sapiens
ttatatattccttactagaaat

SEQ ID NO: 5462425 - DNA, 11 bp, Homo sapiens
ttatatattgt

SEQ ID NO: 5462426 - DNA, 13 bp, Homo sapiens
ttatatattgtat

SEQ ID NO: 5462427 - DNA, 18 bp, Homo sapiens
ttatatattgtattaagg

SEQ ID NO: 5462428 - DNA, 19 bp, Homo sapiens
ttatatatttacagaagaa

SEQ ID NO: 5462429 - DNA, 23 bp, Homo sapiens
ttatatatttataactcatcata

SEQ ID NO: 5462430 - DNA, 19 bp, Homo sapiens
ttatatatttctaactata

SEQ ID NO: 5462431 - DNA, 20 bp, Homo sapiens
ttatatatttttctgagatt

SEQ ID NO: 5462432 - DNA, 13 bp, Homo sapiens
ttatatcagcttt

SEQ ID NO: 5462433 - DNA, 15 bp, Homo sapiens
ttatatcatacagtt

SEQ ID NO: 5462434 - DNA, 18 bp, Homo sapiens
ttatatcatacagttttc

SEQ ID NO: 5462435 - DNA, 23 bp, Homo sapiens
ttatatcatacagttttcattga

SEQ ID NO: 5462436 - DNA, 19 bp, Homo sapiens
ttatatcatatataaaagt

SEQ ID NO: 5462437 - DNA, 12 bp, Homo sapiens
ttatatcatcaa

SEQ ID NO: 5462438 - DNA, 18 bp, Homo sapiens
ttatatcatcaatacttt

SEQ ID NO: 5462439 - DNA, 19 bp, Homo sapiens
ttatatcatccagaaaaga

SEQ ID NO: 5462440 - DNA, 14 bp, Homo sapiens
ttatatcatgcaaa

SEQ ID NO: 5462441 - DNA, 16 bp, Homo sapiens
ttatatcatgcaaaat

SEQ ID NO: 5462442 - DNA, 15 bp, Homo sapiens
ttatatcattttaaa

SEQ ID NO: 5462443 - DNA, 18 bp, Homo sapiens
ttatatccagtaacacat

SEQ ID NO: 5462444 - DNA, 17 bp, Homo sapiens
ttatatcctgacaagat

SEQ ID NO: 5462445 - DNA, 21 bp, Homo sapiens
ttatatcgaaatagttacagg

SEQ ID NO: 5462446 - DNA, 19 bp, Homo sapiens
ttatatctatattttacat

SEQ ID NO: 5462447 - DNA, 23 bp, Homo sapiens
ttatatctcctttgtattctgtc

SEQ ID NO: 5462448 - DNA, 14 bp, Homo sapiens
ttatatctgaggaa

SEQ ID NO: 5462449 - DNA, 23 bp, Homo sapiens
ttatatctgaggaattctgtata

SEQ ID NO: 5462450 - DNA, 21 bp, Homo sapiens
ttatatctgggttaagtgttt

SEQ ID NO: 5462451 - DNA, 11 bp, Homo sapiens
ttatatctgta

SEQ ID NO: 5462452 - DNA, 13 bp, Homo sapiens
ttatatctgtatg

SEQ ID NO: 5462453 - DNA, 16 bp, Homo sapiens
ttatatcttatatata

SEQ ID NO: 5462454 - DNA, 15 bp, Homo sapiens
ttatatcttgtttac

SEQ ID NO: 5462455 - DNA, 12 bp, Homo sapiens
ttatatgaaata

SEQ ID NO: 5462456 - DNA, 19 bp, Homo sapiens
ttatatgaaatgtttcact

SEQ ID NO: 5462457 - DNA, 19 bp, Homo sapiens
ttatatgaagaaaatcact

SEQ ID NO: 5462458 - DNA, 17 bp, Homo sapiens
ttatatgaagcaagctg

SEQ ID NO: 5462459 - DNA, 21 bp, Homo sapiens
ttatatgaagcaagctgtgtt

SEQ ID NO: 5462460 - DNA, 15 bp, Homo sapiens
ttatatgagtagata

SEQ ID NO: 5462461 - DNA, 18 bp, Homo sapiens
ttatatgatatgcatgta

SEQ ID NO: 5462462 - DNA, 18 bp, Homo sapiens
ttatatgccaagctaatt

SEQ ID NO: 5462463 - DNA, 22 bp, Homo sapiens
ttatatggaaatatatattata

SEQ ID NO: 5462464 - DNA, 19 bp, Homo sapiens
ttatatggaacgcattttg

SEQ ID NO: 5462465 - DNA, 20 bp, Homo sapiens
ttatatggatgattcagaaa

SEQ ID NO: 5462466 - DNA, 12 bp, Homo sapiens
ttatatggcagg

SEQ ID NO: 5462467 - DNA, 17 bp, Homo sapiens
ttatatggcccagcctt

SEQ ID NO: 5462468 - DNA, 22 bp, Homo sapiens
ttatatggccctgcacagacct

SEQ ID NO: 5462469 - DNA, 23 bp, Homo sapiens
ttatatggcgttttgtctgtgtt

SEQ ID NO: 5462470 - DNA, 22 bp, Homo sapiens
ttatatggggttgttgtctcat

SEQ ID NO: 5462471 - DNA, 14 bp, Homo sapiens
ttatatgtaaatgt

SEQ ID NO: 5462472 - DNA, 22 bp, Homo sapiens
ttatatgtaccctctgaaatac

SEQ ID NO: 5462473 - DNA, 14 bp, Homo sapiens
ttatatgtactgtt

SEQ ID NO: 5462474 - DNA, 20 bp, Homo sapiens
ttatatgtatccagtacatt

SEQ ID NO: 5462475 - DNA, 15 bp, Homo sapiens
ttatatgtccttggg

SEQ ID NO: 5462476 - DNA, 19 bp, Homo sapiens
ttatatgtgttgaaaacca

SEQ ID NO: 5462477 - DNA, 18 bp, Homo sapiens
ttatatgttgtaagcaac

SEQ ID NO: 5462478 - DNA, 16 bp, Homo sapiens
ttatattaaaatatga

SEQ ID NO: 5462479 - DNA, 20 bp, Homo sapiens
ttatattaaagtaaatggca

SEQ ID NO: 5462480 - DNA, 17 bp, Homo sapiens
ttatattaagaaaaata

SEQ ID NO: 5462481 - DNA, 20 bp, Homo sapiens
ttatattaatagtaatttgt

SEQ ID NO: 5462482 - DNA, 19 bp, Homo sapiens
ttatattactgacatttct

SEQ ID NO: 5462483 - DNA, 23 bp, Homo sapiens
ttatattacttgcctatctgact

SEQ ID NO: 5462484 - DNA, 16 bp, Homo sapiens
ttatattacttttgta

SEQ ID NO: 5462485 - DNA, 19 bp, Homo sapiens
ttatattacttttgtaaat

SEQ ID NO: 5462486 - DNA, 17 bp, Homo sapiens
ttatattagtgaagatg

SEQ ID NO: 5462487 - DNA, 23 bp, Homo sapiens
ttatattagtgaagatggtttca

SEQ ID NO: 5462488 - DNA, 20 bp, Homo sapiens
ttatattagttgctttgtta

SEQ ID NO: 5462489 - DNA, 17 bp, Homo sapiens
ttatattattttctgta

SEQ ID NO: 5462490 - DNA, 23 bp, Homo sapiens
ttatattcaaccatggactttat

SEQ ID NO: 5462491 - DNA, 17 bp, Homo sapiens
ttatattcaatgcattt

SEQ ID NO: 5462492 - DNA, 14 bp, Homo sapiens
ttatattcattcag

SEQ ID NO: 5462493 - DNA, 18 bp, Homo sapiens
ttatattcattcagatat

SEQ ID NO: 5462494 - DNA, 21 bp, Homo sapiens
ttatattccatatattagcat

SEQ ID NO: 5462495 - DNA, 15 bp, Homo sapiens
ttatattctaagtca

SEQ ID NO: 5462496 - DNA, 14 bp, Homo sapiens
ttatattctaatag

SEQ ID NO: 5462497 - DNA, 15 bp, Homo sapiens
ttatattctataact

SEQ ID NO: 5462498 - DNA, 21 bp, Homo sapiens
ttatattctcagcagagtgct

SEQ ID NO: 5462499 - DNA, 14 bp, Homo sapiens
ttatattctgttta

SEQ ID NO: 5462500 - DNA, 20 bp, Homo sapiens
ttatattctgtttattatga

SEQ ID NO: 5462501 - DNA, 14 bp, Homo sapiens
ttatattctttaaa

SEQ ID NO: 5462502 - DNA, 15 bp, Homo sapiens
ttatattctttaaat

SEQ ID NO: 5462503 - DNA, 16 bp, Homo sapiens
ttatattctttaaatt

SEQ ID NO: 5462504 - DNA, 12 bp, Homo sapiens
ttatattgaaaa

SEQ ID NO: 5462505 - DNA, 15 bp, Homo sapiens
ttatattgaagacaa

SEQ ID NO: 5462506 - DNA, 16 bp, Homo sapiens
ttatattgaagacaat

SEQ ID NO: 5462507 - DNA, 22 bp, Homo sapiens
ttatattgaagacaatttgata

SEQ ID NO: 5462508 - DNA, 13 bp, Homo sapiens
ttatattgcaatg

SEQ ID NO: 5462509 - DNA, 19 bp, Homo sapiens
ttatattgcttcctgtgta

SEQ ID NO: 5462510 - DNA, 22 bp, Homo sapiens
ttatattggaattataaatatt

SEQ ID NO: 5462511 - DNA, 23 bp, Homo sapiens
ttatattggtgcgtttttacagt

SEQ ID NO: 5462512 - DNA, 17 bp, Homo sapiens
ttatattgtatattctg

SEQ ID NO: 5462513 - DNA, 15 bp, Homo sapiens
ttatattgttcactt

SEQ ID NO: 5462514 - DNA, 17 bp, Homo sapiens
ttatattgttcacttct

SEQ ID NO: 5462515 - DNA, 19 bp, Homo sapiens
ttatatttaaaaattgttt

SEQ ID NO: 5462516 - DNA, 16 bp, Homo sapiens
ttatatttaattatta

SEQ ID NO: 5462517 - DNA, 16 bp, Homo sapiens
ttatatttacaaatgg

SEQ ID NO: 5462518 - DNA, 19 bp, Homo sapiens
ttatatttagttatagttt

SEQ ID NO: 5462519 - DNA, 19 bp, Homo sapiens
ttatatttatatttcaggt

SEQ ID NO: 5462520 - DNA, 15 bp, Homo sapiens
ttatatttattgact

SEQ ID NO: 5462521 - DNA, 13 bp, Homo sapiens
ttatatttattgt

SEQ ID NO: 5462522 - DNA, 15 bp, Homo sapiens
ttatatttcaataaa

SEQ ID NO: 5462523 - DNA, 19 bp, Homo sapiens
ttatatttcacccatctct

SEQ ID NO: 5462524 - DNA, 11 bp, Homo sapiens
ttatatttcag

SEQ ID NO: 5462525 - DNA, 11 bp, Homo sapiens
ttatatttcat

SEQ ID NO: 5462526 - DNA, 11 bp, Homo sapiens
ttatatttcca

SEQ ID NO: 5462527 - DNA, 22 bp, Homo sapiens
ttatatttccctaaaatacatt

SEQ ID NO: 5462528 - DNA, 23 bp, Homo sapiens
ttatatttcctgtattgctttag

SEQ ID NO: 5462529 - DNA, 16 bp, Homo sapiens
ttatatttcctttatg

SEQ ID NO: 5462530 - DNA, 22 bp, Homo sapiens
ttatatttctattttattatga

SEQ ID NO: 5462531 - DNA, 19 bp, Homo sapiens
ttatatttgaaatattgac

SEQ ID NO: 5462532 - DNA, 18 bp, Homo sapiens
ttatatttgaattagtaa

SEQ ID NO: 5462533 - DNA, 13 bp, Homo sapiens
ttatatttggaaa

SEQ ID NO: 5462534 - DNA, 19 bp, Homo sapiens
ttatatttggaaagagacc

SEQ ID NO: 5462535 - DNA, 15 bp, Homo sapiens
ttatatttggatgca

SEQ ID NO: 5462536 - DNA, 22 bp, Homo sapiens
ttatatttgtccaacaactgtc

SEQ ID NO: 5462537 - DNA, 20 bp, Homo sapiens
ttatattttaaagcttggtg

SEQ ID NO: 5462538 - DNA, 21 bp, Homo sapiens
ttatattttaaattagttttt

SEQ ID NO: 5462539 - DNA, 22 bp, Homo sapiens
ttatattttagaaataataaaa

SEQ ID NO: 5462540 - DNA, 14 bp, Homo sapiens
ttatattttataag

SEQ ID NO: 5462541 - DNA, 15 bp, Homo sapiens
ttatattttatgaac

SEQ ID NO: 5462542 - DNA, 23 bp, Homo sapiens
ttatattttatgaacattgtact

SEQ ID NO: 5462543 - DNA, 18 bp, Homo sapiens
ttatattttcgtatgaaa

SEQ ID NO: 5462544 - DNA, 12 bp, Homo sapiens
ttatattttctt

SEQ ID NO: 5462545 - DNA, 21 bp, Homo sapiens
ttatattttgtgtataatgtg

SEQ ID NO: 5462546 - DNA, 14 bp, Homo sapiens
ttatatttttctta

SEQ ID NO: 5462547 - DNA, 19 bp, Homo sapiens
ttatatttttgtaaatagt

SEQ ID NO: 5462548 - DNA, 16 bp, Homo sapiens
ttatattttttcagtt

SEQ ID NO: 5462549 - DNA, 16 bp, Homo sapiens
ttatattttttctata

SEQ ID NO: 5462550 - DNA, 19 bp, Homo sapiens
ttatatttttttaactgtg

SEQ ID NO: 5462551 - DNA, 22 bp, Homo sapiens
ttatatttttttaactgtgata

SEQ ID NO: 5462552 - DNA, 10 bp, Homo sapiens
ttatcaaaaa

SEQ ID NO: 5462553 - DNA, 15 bp, Homo sapiens
ttatcaaaaaacaga

SEQ ID NO: 5462554 - DNA, 17 bp, Homo sapiens
ttatcaaaaaacagaaa

SEQ ID NO: 5462555 - DNA, 22 bp, Homo sapiens
ttatcaaaaagtattatcattg

SEQ ID NO: 5462556 - DNA, 21 bp, Homo sapiens
ttatcaaaagaagaaaaaact

SEQ ID NO: 5462557 - DNA, 13 bp, Homo sapiens
ttatcaaaagaca

SEQ ID NO: 5462558 - DNA, 22 bp, Homo sapiens
ttatcaaaagtgatcagcaatg

SEQ ID NO: 5462559 - DNA, 12 bp, Homo sapiens
ttatcaaaatct

SEQ ID NO: 5462560 - DNA, 16 bp, Homo sapiens
ttatcaaaatgtagct

SEQ ID NO: 5462561 - DNA, 18 bp, Homo sapiens
ttatcaaaccctagcctt

SEQ ID NO: 5462562 - DNA, 21 bp, Homo sapiens
ttatcaaaccctagccttgct

SEQ ID NO: 5462563 - DNA, 13 bp, Homo sapiens
ttatcaaagcatt

SEQ ID NO: 5462564 - DNA, 18 bp, Homo sapiens
ttatcaaataatattcat

SEQ ID NO: 5462565 - DNA, 13 bp, Homo sapiens
ttatcaaatcagt

SEQ ID NO: 5462566 - DNA, 13 bp, Homo sapiens
ttatcaaatcatt

SEQ ID NO: 5462567 - DNA, 15 bp, Homo sapiens
ttatcaacaatagtg

SEQ ID NO: 5462568 - DNA, 24 bp, Homo sapiens
ttatcaaccacgtggagaaaatca

SEQ ID NO: 5462569 - DNA, 16 bp, Homo sapiens
ttatcaactcaagaat

SEQ ID NO: 5462570 - DNA, 15 bp, Homo sapiens
ttatcaacttcctaa

SEQ ID NO: 5462571 - DNA, 21 bp, Homo sapiens
ttatcaacttcctaaatatta

SEQ ID NO: 5462572 - DNA, 12 bp, Homo sapiens
ttatcaacttta

SEQ ID NO: 5462573 - DNA, 22 bp, Homo sapiens
ttatcaagagttgtgacaactt

SEQ ID NO: 5462574 - DNA, 20 bp, Homo sapiens
ttatcaagctaataaaatat

SEQ ID NO: 5462575 - DNA, 20 bp, Homo sapiens
ttatcaagcttagtgagcag

SEQ ID NO: 5462576 - DNA, 18 bp, Homo sapiens
ttatcaaggaagtcttca

SEQ ID NO: 5462577 - DNA, 20 bp, Homo sapiens
ttatcaaggaagtcttcaaa

SEQ ID NO: 5462578 - DNA, 22 bp, Homo sapiens
ttatcaaggaagtcttcaaatt

SEQ ID NO: 5462579 - DNA, 16 bp, Homo sapiens
ttatcaataaaagcct

SEQ ID NO: 5462580 - DNA, 17 bp, Homo sapiens
ttatcaatagcccagga

SEQ ID NO: 5462581 - DNA, 15 bp, Homo sapiens
ttatcaatatctaat

SEQ ID NO: 5462582 - DNA, 22 bp, Homo sapiens
ttatcaatatctaatatatatg

SEQ ID NO: 5462583 - DNA, 20 bp, Homo sapiens
ttatcaatgtgtctttctaa

SEQ ID NO: 5462584 - DNA, 13 bp, Homo sapiens
ttatcaatttttc

SEQ ID NO: 5462585 - DNA, 20 bp, Homo sapiens
ttatcacaaaaaagaaaatg

SEQ ID NO: 5462586 - DNA, 23 bp, Homo sapiens
ttatcacaccatcgctggcccct

SEQ ID NO: 5462587 - DNA, 22 bp, Homo sapiens
ttatcacagaaataaaatatct

SEQ ID NO: 5462588 - DNA, 22 bp, Homo sapiens
ttatcacatcaagcatgcaata

SEQ ID NO: 5462589 - DNA, 15 bp, Homo sapiens
ttatcacatgtatgt

SEQ ID NO: 5462590 - DNA, 13 bp, Homo sapiens
ttatgttatttat

SEQ ID NO: 5462591 - DNA, 20 bp, Homo sapiens
ttatgttatttatatattgg

SEQ ID NO: 5462592 - DNA, 13 bp, Homo sapiens
ttatgttcagaaa

SEQ ID NO: 5462593 - DNA, 20 bp, Homo sapiens
ttatgttcctcaaggtccat

SEQ ID NO: 5462594 - DNA, 11 bp, Homo sapiens
ttatgttcctt

SEQ ID NO: 5462595 - DNA, 19 bp, Homo sapiens
ttatgttcttatagaataa

SEQ ID NO: 5462596 - DNA, 20 bp, Homo sapiens
ttatgttcttatagaataaa

SEQ ID NO: 5462597 - DNA, 23 bp, Homo sapiens
ttatgttcttatagaataaaagc

SEQ ID NO: 5462598 - DNA, 14 bp, Homo sapiens
ttatgttgacattt

SEQ ID NO: 5462599 - DNA, 17 bp, Homo sapiens
ttatgttgtatagatta

SEQ ID NO: 5462600 - DNA, 15 bp, Homo sapiens
ttatgttgttagaga

SEQ ID NO: 5462601 - DNA, 19 bp, Homo sapiens
ttatgttgtttataataaa

SEQ ID NO: 5462602 - DNA, 15 bp, Homo sapiens
ttatgtttaaaaagt

SEQ ID NO: 5462603 - DNA, 19 bp, Homo sapiens
ttatgtttaaaagaaatat

SEQ ID NO: 5462604 - DNA, 20 bp, Homo sapiens
ttatgtttaaaatggcattt

SEQ ID NO: 5462605 - DNA, 16 bp, Homo sapiens
ttatgtttaagtgctt

SEQ ID NO: 5462606 - DNA, 19 bp, Homo sapiens
ttatgtttatataaatgct

SEQ ID NO: 5462607 - DNA, 19 bp, Homo sapiens
ttatgtttattacaatttt

SEQ ID NO: 5462608 - DNA, 14 bp, Homo sapiens
ttatgtttgaatat

SEQ ID NO: 5462609 - DNA, 15 bp, Homo sapiens
ttatgtttgaatgaa

SEQ ID NO: 5462610 - DNA, 20 bp, Homo sapiens
ttatgtttgccactttgcaa

SEQ ID NO: 5462611 - DNA, 17 bp, Homo sapiens
ttatgttttacatgccc

SEQ ID NO: 5462612 - DNA, 18 bp, Homo sapiens
ttatgttttctttctcac

SEQ ID NO: 5462613 - DNA, 19 bp, Homo sapiens
ttatgttttgtttctgaaa

SEQ ID NO: 5462614 - DNA, 18 bp, Homo sapiens
ttatgtttttcagtttaa

SEQ ID NO: 5462615 - DNA, 17 bp, Homo sapiens
ttatgtttttgtactct

SEQ ID NO: 5462616 - DNA, 21 bp, Homo sapiens
ttatgttttttgtaagataaa

SEQ ID NO: 5462617 - DNA, 16 bp, Homo sapiens
ttattaaaaaaacaca

SEQ ID NO: 5462618 - DNA, 20 bp, Homo sapiens
ttattaaaaaaacacaaaaa

SEQ ID NO: 5462619 - DNA, 15 bp, Homo sapiens
ttattaaaaacatga

SEQ ID NO: 5462620 - DNA, 20 bp, Homo sapiens
ttattaaaaatgttctcaaa

SEQ ID NO: 5462621 - DNA, 20 bp, Homo sapiens
ttattaaaacagaaattaat

SEQ ID NO: 5462622 - DNA, 13 bp, Homo sapiens
ttattaaaatatt

SEQ ID NO: 5462623 - DNA, 14 bp, Homo sapiens
ttattaaaattctg

SEQ ID NO: 5462624 - DNA, 16 bp, Homo sapiens
ttattaaacaaataat

SEQ ID NO: 5462625 - DNA, 22 bp, Homo sapiens
ttattaaacgatttctaaaatc

SEQ ID NO: 5462626 - DNA, 18 bp, Homo sapiens
ttattaaacgtatgcatg

SEQ ID NO: 5462627 - DNA, 22 bp, Homo sapiens
ttattaaacgtatgcatgtgaa

SEQ ID NO: 5462628 - DNA, 14 bp, Homo sapiens
ttattaaagaaaaa

SEQ ID NO: 5462629 - DNA, 17 bp, Homo sapiens
ttattaaagaaaaatgc

SEQ ID NO: 5462630 - DNA, 13 bp, Homo sapiens
ttattaaagtcta

SEQ ID NO: 5462631 - DNA, 16 bp, Homo sapiens
ttattaaagtctaaac

SEQ ID NO: 5462632 - DNA, 17 bp, Homo sapiens
ttattaaagtttcaaaa

SEQ ID NO: 5462633 - DNA, 22 bp, Homo sapiens
ttattaaagttttcaaattatt

SEQ ID NO: 5462634 - DNA, 15 bp, Homo sapiens
ttattaaataaaatc

SEQ ID NO: 5462635 - DNA, 23 bp, Homo sapiens
ttattaaataaatattttacagt

SEQ ID NO: 5462636 - DNA, 15 bp, Homo sapiens
ttattaaatcagaat

SEQ ID NO: 5462637 - DNA, 19 bp, Homo sapiens
ttattaaatcagttttgtg

SEQ ID NO: 5462638 - DNA, 22 bp, Homo sapiens
ttattaaatcgtttaatgttta

SEQ ID NO: 5462639 - DNA, 17 bp, Homo sapiens
ttattaaatgcttcatt

SEQ ID NO: 5462640 - DNA, 18 bp, Homo sapiens
ttattaaatgtagcttca

SEQ ID NO: 5462641 - DNA, 21 bp, Homo sapiens
ttattaaattaattgaatcta

SEQ ID NO: 5462642 - DNA, 17 bp, Homo sapiens
ttattaaatttatttga

SEQ ID NO: 5462643 - DNA, 22 bp, Homo sapiens
ttattaaatttttttgtatgaa

SEQ ID NO: 5462644 - DNA, 15 bp, Homo sapiens
ttattaacaaacagg

SEQ ID NO: 5462645 - DNA, 19 bp, Homo sapiens
ttattaacaaattatgtta

SEQ ID NO: 5462646 - DNA, 17 bp, Homo sapiens
ttattaacaactgtgaa

SEQ ID NO: 5462647 - DNA, 18 bp, Homo sapiens
ttattaacaactgtgaat

SEQ ID NO: 5462648 - DNA, 16 bp, Homo sapiens
ttattaacaattaggc

SEQ ID NO: 5462649 - DNA, 15 bp, Homo sapiens
ttattaaccaaatta

SEQ ID NO: 5462650 - DNA, 15 bp, Homo sapiens
ttattaactttaatg

SEQ ID NO: 5462651 - DNA, 15 bp, Homo sapiens
ttattaagaccaaag

SEQ ID NO: 5462652 - DNA, 18 bp, Homo sapiens
ttattaagaccaaagact

SEQ ID NO: 5462653 - DNA, 23 bp, Homo sapiens
ttattaagaccaaagacttgtta

SEQ ID NO: 5462654 - DNA, 20 bp, Homo sapiens
ttattaagactggctttaga

SEQ ID NO: 5462655 - DNA, 17 bp, Homo sapiens
ttattaagatggattct

SEQ ID NO: 5462656 - DNA, 20 bp, Homo sapiens
ttattaagatggattctcag

SEQ ID NO: 5462657 - DNA, 21 bp, Homo sapiens
ttattaagatggattctcaga

SEQ ID NO: 5462658 - DNA, 23 bp, Homo sapiens
ttattaagatggattctcagata

SEQ ID NO: 5462659 - DNA, 21 bp, Homo sapiens
ttattaagcaaccttaaagca

SEQ ID NO: 5462660 - DNA, 20 bp, Homo sapiens
ttattaagcagactggaaaa

SEQ ID NO: 5462661 - DNA, 15 bp, Homo sapiens
ttattaagctttttg

SEQ ID NO: 5462662 - DNA, 23 bp, Homo sapiens
ttattaagtctgggatgtagaac

SEQ ID NO: 5462663 - DNA, 13 bp, Homo sapiens
ttattaagtgatt

SEQ ID NO: 5462664 - DNA, 12 bp, Homo sapiens
ttattaatactt

SEQ ID NO: 5462665 - DNA, 13 bp, Homo sapiens
ttattaatataat

SEQ ID NO: 5462666 - DNA, 11 bp, Homo sapiens
ttattaatatt

SEQ ID NO: 5462667 - DNA, 22 bp, Homo sapiens
ttattaatcatacaaactctca

SEQ ID NO: 5462668 - DNA, 12 bp, Homo sapiens
ttattaatcatt

SEQ ID NO: 5462669 - DNA, 14 bp, Homo sapiens
ttattaatgaatgc

SEQ ID NO: 5462670 - DNA, 13 bp, Homo sapiens
ttattaatgatca

SEQ ID NO: 5462671 - DNA, 14 bp, Homo sapiens
ttattaatgctaag

SEQ ID NO: 5462672 - DNA, 15 bp, Homo sapiens
ttattaatgtttctt

SEQ ID NO: 5462673 - DNA, 13 bp, Homo sapiens
ttattaatgtttt

SEQ ID NO: 5462674 - DNA, 13 bp, Homo sapiens
ttattaattaaag

SEQ ID NO: 5462675 - DNA, 15 bp, Homo sapiens
ttattaattgctttg

SEQ ID NO: 5462676 - DNA, 13 bp, Homo sapiens
ttattaattgtcc

SEQ ID NO: 5462677 - DNA, 12 bp, Homo sapiens
ttattaatttga

SEQ ID NO: 5462678 - DNA, 14 bp, Homo sapiens
ttattaatttgaaa

SEQ ID NO: 5462679 - DNA, 20 bp, Homo sapiens
ttattaattttagtttttca

SEQ ID NO: 5462680 - DNA, 18 bp, Homo sapiens
ttattaatttttaaggat

SEQ ID NO: 5462681 - DNA, 22 bp, Homo sapiens
ttattacaaatattgtcatctt

SEQ ID NO: 5462682 - DNA, 21 bp, Homo sapiens
ttattacaacaagcaaactga

SEQ ID NO: 5462683 - DNA, 16 bp, Homo sapiens
ttattacaatgtatct

SEQ ID NO: 5462684 - DNA, 17 bp, Homo sapiens
ttattacaatgtatctt

SEQ ID NO: 5462685 - DNA, 16 bp, Homo sapiens
ttattacaatttgtat

SEQ ID NO: 5462686 - DNA, 16 bp, Homo sapiens
ttattacacaaactat

SEQ ID NO: 5462687 - DNA, 21 bp, Homo sapiens
ttattacacaaagaacttgct

SEQ ID NO: 5462688 - DNA, 16 bp, Homo sapiens
ttattacagtataatt

SEQ ID NO: 5462689 - DNA, 15 bp, Homo sapiens
ttattacagtccttc

SEQ ID NO: 5462690 - DNA, 19 bp, Homo sapiens
ttattacagtcttatttaa

SEQ ID NO: 5462691 - DNA, 13 bp, Homo sapiens
ttattacagtgtt

SEQ ID NO: 5462692 - DNA, 21 bp, Homo sapiens
ttattacatccttgtggcaca

SEQ ID NO: 5462693 - DNA, 12 bp, Homo sapiens
ttattacattta

SEQ ID NO: 5462694 - DNA, 13 bp, Homo sapiens
ttattacatttaa

SEQ ID NO: 5462695 - DNA, 15 bp, Homo sapiens
ttattaccagattca

SEQ ID NO: 5462696 - DNA, 18 bp, Homo sapiens
ttattaccagattcactt

SEQ ID NO: 5462697 - DNA, 20 bp, Homo sapiens
ttattaccccctccttcaga

SEQ ID NO: 5462698 - DNA, 15 bp, Homo sapiens
ttattacctctcagg

SEQ ID NO: 5462699 - DNA, 12 bp, Homo sapiens
ttattacctctg

SEQ ID NO: 5462700 - DNA, 20 bp, Homo sapiens
ttattaccttctttctaata

SEQ ID NO: 5462701 - DNA, 21 bp, Homo sapiens
ttattacgtatgtctggttct

SEQ ID NO: 5462702 - DNA, 23 bp, Homo sapiens
ttattacgtatgtctggttctca

SEQ ID NO: 5462703 - DNA, 20 bp, Homo sapiens
ttattactaattctatttct

SEQ ID NO: 5462704 - DNA, 19 bp, Homo sapiens
ttattactctacactgaaa

SEQ ID NO: 5462705 - DNA, 13 bp, Homo sapiens
ttattactctcac

SEQ ID NO: 5462706 - DNA, 15 bp, Homo sapiens
ttattactgaggaaa

SEQ ID NO: 5462707 - DNA, 21 bp, Homo sapiens
ttattactgttgtatctatgt

SEQ ID NO: 5462708 - DNA, 13 bp, Homo sapiens
ttattactgttta

SEQ ID NO: 5462709 - DNA, 14 bp, Homo sapiens
ttattactgtttct

SEQ ID NO: 5462710 - DNA, 15 bp, Homo sapiens
ttattacttccatga

SEQ ID NO: 5462711 - DNA, 15 bp, Homo sapiens
ttattacttgtaaat

SEQ ID NO: 5462712 - DNA, 20 bp, Homo sapiens
ttattacttgtaaatataaa

SEQ ID NO: 5462713 - DNA, 15 bp, Homo sapiens
ttattacttgtgcac

SEQ ID NO: 5462714 - DNA, 16 bp, Homo sapiens
ttattacttgtgcact

SEQ ID NO: 5462715 - DNA, 20 bp, Homo sapiens
ttattacttgttgcaaaggt

SEQ ID NO: 5462716 - DNA, 11 bp, Homo sapiens
ttattagaaag

SEQ ID NO: 5462717 - DNA, 19 bp, Homo sapiens
ttattagaacattcacttt

SEQ ID NO: 5462718 - DNA, 23 bp, Homo sapiens
ttattagaatataaaaaatgtta

SEQ ID NO: 5462719 - DNA, 20 bp, Homo sapiens
ttattagaatcaaacatttt

SEQ ID NO: 5462720 - DNA, 20 bp, Homo sapiens
ttattagagattttctcttc

SEQ ID NO: 5462721 - DNA, 11 bp, Homo sapiens
ttattagatga

SEQ ID NO: 5462722 - DNA, 16 bp, Homo sapiens
ttattagcatttgttt

SEQ ID NO: 5462723 - DNA, 21 bp, Homo sapiens
ttattagcatttgttttagca

SEQ ID NO: 5462724 - DNA, 16 bp, Homo sapiens
ttattagccagtgaaa

SEQ ID NO: 5462725 - DNA, 18 bp, Homo sapiens
ttattaggaaaagatatt

SEQ ID NO: 5462726 - DNA, 18 bp, Homo sapiens
ttattaggcctcagaaag

SEQ ID NO: 5462727 - DNA, 16 bp, Homo sapiens
ttattagggagaaaat

SEQ ID NO: 5462728 - DNA, 18 bp, Homo sapiens
ttattagggagaaaattc

SEQ ID NO: 5462729 - DNA, 19 bp, Homo sapiens
ttattaggttaagtctcaa

SEQ ID NO: 5462730 - DNA, 20 bp, Homo sapiens
ttattagtaaatgcttatca

SEQ ID NO: 5462731 - DNA, 16 bp, Homo sapiens
ttattagtaacatcat

SEQ ID NO: 5462732 - DNA, 24 bp, Homo sapiens
ttattagtaccatagtaccattta

SEQ ID NO: 5462733 - DNA, 19 bp, Homo sapiens
ttattagtattgttgtcct

SEQ ID NO: 5462734 - DNA, 18 bp, Homo sapiens
ttattagtttaaaatgca

SEQ ID NO: 5462735 - DNA, 15 bp, Homo sapiens
ttattagtttacatc

SEQ ID NO: 5462736 - DNA, 13 bp, Homo sapiens
ttattagttttgc

SEQ ID NO: 5462737 - DNA, 23 bp, Homo sapiens
ttattataaactataaacttaag

SEQ ID NO: 5462738 - DNA, 14 bp, Homo sapiens
ttattataaactgt

SEQ ID NO: 5462739 - DNA, 12 bp, Homo sapiens
ttattataaagc

SEQ ID NO: 5462740 - DNA, 21 bp, Homo sapiens
ttattataaatgttagttcta

SEQ ID NO: 5462741 - DNA, 14 bp, Homo sapiens
ttattataaattct

SEQ ID NO: 5462742 - DNA, 21 bp, Homo sapiens
ttattataatcctcaagagaa

SEQ ID NO: 5462743 - DNA, 13 bp, Homo sapiens
ttattataatggt

SEQ ID NO: 5462744 - DNA, 15 bp, Homo sapiens
ttattatatatataa

SEQ ID NO: 5462745 - DNA, 12 bp, Homo sapiens
ttattatattgt

SEQ ID NO: 5462746 - DNA, 14 bp, Homo sapiens
ttattatatttaca

SEQ ID NO: 5462747 - DNA, 15 bp, Homo sapiens
ttattatatttacaa

SEQ ID NO: 5462748 - DNA, 17 bp, Homo sapiens
ttattatatttgacatg

SEQ ID NO: 5462749 - DNA, 17 bp, Homo sapiens
ttattatcaagtagact

SEQ ID NO: 5462750 - DNA, 15 bp, Homo sapiens
ttattatcattgaaa

SEQ ID NO: 5462751 - DNA, 16 bp, Homo sapiens
ttattatctaaagtgt

SEQ ID NO: 5462752 - DNA, 22 bp, Homo sapiens
ttattatctaaagtgtgttgtt

SEQ ID NO: 5462753 - DNA, 11 bp, Homo sapiens
ttattatgaaa

SEQ ID NO: 5462754 - DNA, 23 bp, Homo sapiens
ttattatgaaacttgtgtaaata

SEQ ID NO: 5462755 - DNA, 13 bp, Homo sapiens
ttattatgaagaa

SEQ ID NO: 5462756 - DNA, 19 bp, Homo sapiens
ttattatgaagaattgcca

SEQ ID NO: 5462757 - DNA, 15 bp, Homo sapiens
ttattatgaaggaat

SEQ ID NO: 5462758 - DNA, 20 bp, Homo sapiens
ttattatgatgttagaagaa

SEQ ID NO: 5462759 - DNA, 20 bp, Homo sapiens
ttattatgcataactgacaa

SEQ ID NO: 5462760 - DNA, 20 bp, Homo sapiens
ttattatggcttgtgaactg

SEQ ID NO: 5462761 - DNA, 21 bp, Homo sapiens
ttattatggcttgtgaactgc

SEQ ID NO: 5462762 - DNA, 13 bp, Homo sapiens
ttattatgtaaat

SEQ ID NO: 5462763 - DNA, 16 bp, Homo sapiens
ttattatgtaaatccc

SEQ ID NO: 5462764 - DNA, 22 bp, Homo sapiens
ttattatgtaaatcccattatt

SEQ ID NO: 5462765 - DNA, 19 bp, Homo sapiens
ttattatgtttattacaat

SEQ ID NO: 5462766 - DNA, 13 bp, Homo sapiens
ttattattaataa

SEQ ID NO: 5462767 - DNA, 11 bp, Homo sapiens
ttattattaga

SEQ ID NO: 5462768 - DNA, 13 bp, Homo sapiens
ttattattcctag

SEQ ID NO: 5462769 - DNA, 16 bp, Homo sapiens
ttcaaaatatattttg

SEQ ID NO: 5462770 - DNA, 14 bp, Homo sapiens
ttcaaaatattgag

SEQ ID NO: 5462771 - DNA, 14 bp, Homo sapiens
ttcaaaatatttta

SEQ ID NO: 5462772 - DNA, 17 bp, Homo sapiens
ttcaaaatccttccaaa

SEQ ID NO: 5462773 - DNA, 22 bp, Homo sapiens
ttcaaaatcgtttttaatttaa

SEQ ID NO: 5462774 - DNA, 20 bp, Homo sapiens
ttcaaaatgatattcaatct

SEQ ID NO: 5462775 - DNA, 14 bp, Homo sapiens
ttcaaaatgcatgt

SEQ ID NO: 5462776 - DNA, 23 bp, Homo sapiens
ttcaaaatggaaaattaattcta

SEQ ID NO: 5462777 - DNA, 14 bp, Homo sapiens
ttcaaaatgtatat

SEQ ID NO: 5462778 - DNA, 14 bp, Homo sapiens
ttcaaaatgtctgt

SEQ ID NO: 5462779 - DNA, 18 bp, Homo sapiens
ttcaaaatgtctgtagct

SEQ ID NO: 5462780 - DNA, 12 bp, Homo sapiens
ttcaaaatgtta

SEQ ID NO: 5462781 - DNA, 22 bp, Homo sapiens
ttcaaaatgttaataaaggttt

SEQ ID NO: 5462782 - DNA, 17 bp, Homo sapiens
ttcaaaatgttctattt

SEQ ID NO: 5462783 - DNA, 12 bp, Homo sapiens
ttcaaaattaat

SEQ ID NO: 5462784 - DNA, 14 bp, Homo sapiens
ttcaaaattcaaaa

SEQ ID NO: 5462785 - DNA, 18 bp, Homo sapiens
ttcaaaattctaaatgta

SEQ ID NO: 5462786 - DNA, 15 bp, Homo sapiens
ttcaaacaattcaat

SEQ ID NO: 5462787 - DNA, 16 bp, Homo sapiens
ttcaaacacaatggag

SEQ ID NO: 5462788 - DNA, 13 bp, Homo sapiens
ttcaaacacacac

SEQ ID NO: 5462789 - DNA, 16 bp, Homo sapiens
ttcaaacacacagtat

SEQ ID NO: 5462790 - DNA, 17 bp, Homo sapiens
ttcaaacagcatcaaaa

SEQ ID NO: 5462791 - DNA, 23 bp, Homo sapiens
ttcaaacaggtcgagctgtgctc

SEQ ID NO: 5462792 - DNA, 20 bp, Homo sapiens
ttcaaacagtatataacttt

SEQ ID NO: 5462793 - DNA, 14 bp, Homo sapiens
ttcaaacatatata

SEQ ID NO: 5462794 - DNA, 20 bp, Homo sapiens
ttcaaacatgccctcaggct

SEQ ID NO: 5462795 - DNA, 15 bp, Homo sapiens
ttcaaacatttacca

SEQ ID NO: 5462796 - DNA, 22 bp, Homo sapiens
ttcaaacattttgtatcaagga

SEQ ID NO: 5462797 - DNA, 16 bp, Homo sapiens
ttcaaaccaaagctgc

SEQ ID NO: 5462798 - DNA, 16 bp, Homo sapiens
ttcaaaccaaataaga

SEQ ID NO: 5462799 - DNA, 21 bp, Homo sapiens
ttcaaaccaatttcttccttc

SEQ ID NO: 5462800 - DNA, 20 bp, Homo sapiens
ttcaaaccagagaaaggaaa

SEQ ID NO: 5462801 - DNA, 14 bp, Homo sapiens
ttcaaaccagtttc

SEQ ID NO: 5462802 - DNA, 16 bp, Homo sapiens
ttcaaaccatttaatt

SEQ ID NO: 5462803 - DNA, 16 bp, Homo sapiens
ttcaaaccctcaagag

SEQ ID NO: 5462804 - DNA, 22 bp, Homo sapiens
ttcaaactactttgctgctaat

SEQ ID NO: 5462805 - DNA, 18 bp, Homo sapiens
ttcaaactattgggaggg

SEQ ID NO: 5462806 - DNA, 22 bp, Homo sapiens
ttcaaactccaaggttcccttg

SEQ ID NO: 5462807 - DNA, 14 bp, Homo sapiens
ttcaaactcctgac

SEQ ID NO: 5462808 - DNA, 15 bp, Homo sapiens
ttcaaactcctgacc

SEQ ID NO: 5462809 - DNA, 13 bp, Homo sapiens
ttcaaactgaaaa

SEQ ID NO: 5462810 - DNA, 23 bp, Homo sapiens
ttcaaactgctgcatactttgac

SEQ ID NO: 5462811 - DNA, 17 bp, Homo sapiens
ttcaaactgctggaaat

SEQ ID NO: 5462812 - DNA, 16 bp, Homo sapiens
ttcaaactggggcctc

SEQ ID NO: 5462813 - DNA, 21 bp, Homo sapiens
ttcaaactgtaaaccaatttt

SEQ ID NO: 5462814 - DNA, 13 bp, Homo sapiens
ttcaaactgtgaa

SEQ ID NO: 5462815 - DNA, 22 bp, Homo sapiens
ttcaaacttaaacaaaaaacta

SEQ ID NO: 5462816 - DNA, 14 bp, Homo sapiens
ttcaaacttttgaa

SEQ ID NO: 5462817 - DNA, 18 bp, Homo sapiens
ttcaaacttttgaaagat

SEQ ID NO: 5462818 - DNA, 17 bp, Homo sapiens
ttcaaagaaaaccctaa

SEQ ID NO: 5462819 - DNA, 15 bp, Homo sapiens
ttcaaagaaacttga

SEQ ID NO: 5462820 - DNA, 16 bp, Homo sapiens
ttcaaagaaacttgaa

SEQ ID NO: 5462821 - DNA, 21 bp, Homo sapiens
ttcaaagaaatccaaatttct

SEQ ID NO: 5462822 - DNA, 20 bp, Homo sapiens
ttcaaagaacccccctcccc

SEQ ID NO: 5462823 - DNA, 15 bp, Homo sapiens
ttcaaagagaaaaca

SEQ ID NO: 5462824 - DNA, 13 bp, Homo sapiens
ttcaaagagacta

SEQ ID NO: 5462825 - DNA, 23 bp, Homo sapiens
ttcaaagagactaatagagacac

SEQ ID NO: 5462826 - DNA, 22 bp, Homo sapiens
ttcaaagagatgggccttttct

SEQ ID NO: 5462827 - DNA, 18 bp, Homo sapiens
ttcaaagaggtgaacatt

SEQ ID NO: 5462828 - DNA, 13 bp, Homo sapiens
ttcaaagatgcat

SEQ ID NO: 5462829 - DNA, 16 bp, Homo sapiens
ttcaaagatgcatttt

SEQ ID NO: 5462830 - DNA, 12 bp, Homo sapiens
ttcaaagatgct

SEQ ID NO: 5462831 - DNA, 15 bp, Homo sapiens
ttcaaagcaaatgtc

SEQ ID NO: 5462832 - DNA, 21 bp, Homo sapiens
ttcaaagcacaataactagta

SEQ ID NO: 5462833 - DNA, 19 bp, Homo sapiens
ttcaaagcaccaaaataag

SEQ ID NO: 5462834 - DNA, 11 bp, Homo sapiens
ttcaaagcact

SEQ ID NO: 5462835 - DNA, 17 bp, Homo sapiens
ttcaaagcagcagccac

SEQ ID NO: 5462836 - DNA, 16 bp, Homo sapiens
ttcaaagcatgaaatg

SEQ ID NO: 5462837 - DNA, 13 bp, Homo sapiens
ttcaaagccctgc

SEQ ID NO: 5462838 - DNA, 17 bp, Homo sapiens
ttcaaagccttctccct

SEQ ID NO: 5462839 - DNA, 16 bp, Homo sapiens
ttcaaagctaaaatat

SEQ ID NO: 5462840 - DNA, 11 bp, Homo sapiens
ttcaaagctga

SEQ ID NO: 5462841 - DNA, 18 bp, Homo sapiens
ttcaaagctgaatatttt

SEQ ID NO: 5462842 - DNA, 23 bp, Homo sapiens
ttcaaagctgtgtgtttggaaga

SEQ ID NO: 5462843 - DNA, 17 bp, Homo sapiens
ttcaaagcttaaaaaga

SEQ ID NO: 5462844 - DNA, 20 bp, Homo sapiens
ttcaaaggaaaacaccttta

SEQ ID NO: 5462845 - DNA, 22 bp, Homo sapiens
ttcaaagggacggtcagtttgg

SEQ ID NO: 5462846 - DNA, 19 bp, Homo sapiens
ttcaaagggtaaattataa

SEQ ID NO: 5462847 - DNA, 20 bp, Homo sapiens
ttcaaagggtaaattataaa

SEQ ID NO: 5462848 - DNA, 17 bp, Homo sapiens
ttcaaaggtacttggat

SEQ ID NO: 5462849 - DNA, 18 bp, Homo sapiens
ttcaaagtaaaggcctcc

SEQ ID NO: 5462850 - DNA, 22 bp, Homo sapiens
ttcaaagtaaaggcctcctccc

SEQ ID NO: 5462851 - DNA, 19 bp, Homo sapiens
ttcaaagtagttttatttt

SEQ ID NO: 5462852 - DNA, 15 bp, Homo sapiens
ttcaaagtatataca

SEQ ID NO: 5462853 - DNA, 13 bp, Homo sapiens
ttcaaagtgtata

SEQ ID NO: 5462854 - DNA, 20 bp, Homo sapiens
ttcaaagtgttgtgttcctg

SEQ ID NO: 5462855 - DNA, 14 bp, Homo sapiens
ttcaaagttaagaa

SEQ ID NO: 5462856 - DNA, 15 bp, Homo sapiens
ttcaaagttgcctaa

SEQ ID NO: 5462857 - DNA, 21 bp, Homo sapiens
ttcaaagttttgttgtactta

SEQ ID NO: 5462858 - DNA, 13 bp, Homo sapiens
ttcaaataaagaa

SEQ ID NO: 5462859 - DNA, 13 bp, Homo sapiens
ttcaaataaagta

SEQ ID NO: 5462860 - DNA, 19 bp, Homo sapiens
ttcaaataaccctgaatca

SEQ ID NO: 5462861 - DNA, 19 bp, Homo sapiens
ttcaaataattaaatctct

SEQ ID NO: 5462862 - DNA, 15 bp, Homo sapiens
ttcaaatacaaagta

SEQ ID NO: 5462863 - DNA, 13 bp, Homo sapiens
ttcaaatactttt

SEQ ID NO: 5462864 - DNA, 15 bp, Homo sapiens
ttcaaatacttttgg

SEQ ID NO: 5462865 - DNA, 20 bp, Homo sapiens
ttcaaatatcaaaaggaaga

SEQ ID NO: 5462866 - DNA, 16 bp, Homo sapiens
ttcaaatatgtaaact

SEQ ID NO: 5462867 - DNA, 13 bp, Homo sapiens
ttcaaatattgaa

SEQ ID NO: 5462868 - DNA, 15 bp, Homo sapiens
ttcaaatatttacag

SEQ ID NO: 5462869 - DNA, 13 bp, Homo sapiens
ttcaaatatttgt

SEQ ID NO: 5462870 - DNA, 18 bp, Homo sapiens
ttcaaatcaagaaaataa

SEQ ID NO: 5462871 - DNA, 15 bp, Homo sapiens
ttcaaatcagagcag

SEQ ID NO: 5462872 - DNA, 15 bp, Homo sapiens
ttcaaatcagtgatc

SEQ ID NO: 5462873 - DNA, 17 bp, Homo sapiens
ttcaaatccttattgtt

SEQ ID NO: 5462874 - DNA, 17 bp, Homo sapiens
ttcaaatccttccaaaa

SEQ ID NO: 5462875 - DNA, 21 bp, Homo sapiens
ttcaaatctggtccatattta

SEQ ID NO: 5462876 - DNA, 18 bp, Homo sapiens
ttcaaatgaactttaaaa

SEQ ID NO: 5462877 - DNA, 15 bp, Homo sapiens
ttcaaatgaagattc

SEQ ID NO: 5462878 - DNA, 17 bp, Homo sapiens
ttcaaatgatccttcct

SEQ ID NO: 5462879 - DNA, 13 bp, Homo sapiens
ttcaaatgattat

SEQ ID NO: 5462880 - DNA, 18 bp, Homo sapiens
ttcaaatgctgtaacttt

SEQ ID NO: 5462881 - DNA, 17 bp, Homo sapiens
ttcaaatggagttggag

SEQ ID NO: 5462882 - DNA, 22 bp, Homo sapiens
ttcaaatgggagactctttgaa

SEQ ID NO: 5462883 - DNA, 21 bp, Homo sapiens
ttcaaatgggttttccacgct

SEQ ID NO: 5462884 - DNA, 22 bp, Homo sapiens
ttcaaatgtcatttcatacaaa

SEQ ID NO: 5462885 - DNA, 13 bp, Homo sapiens
ttcaaatgtgtaa

SEQ ID NO: 5462886 - DNA, 14 bp, Homo sapiens
ttcaaatgtgtaac

SEQ ID NO: 5462887 - DNA, 16 bp, Homo sapiens
ttcaaatgtgtaactt

SEQ ID NO: 5462888 - DNA, 21 bp, Homo sapiens
ttcaaatgtgttttggtcctg

SEQ ID NO: 5462889 - DNA, 15 bp, Homo sapiens
ttcaaatgttacaaa

SEQ ID NO: 5462890 - DNA, 21 bp, Homo sapiens
ttcaaatgttagagtttaatt

SEQ ID NO: 5462891 - DNA, 17 bp, Homo sapiens
ttcaaatgttttaaagt

SEQ ID NO: 5462892 - DNA, 22 bp, Homo sapiens
ttcaaattaatctttctatatt

SEQ ID NO: 5462893 - DNA, 20 bp, Homo sapiens
ttcaaattaggcaaatcttt

SEQ ID NO: 5462894 - DNA, 22 bp, Homo sapiens
ttcaaattcctatttttaaata

SEQ ID NO: 5462895 - DNA, 17 bp, Homo sapiens
ttcaaattgctgcttgg

SEQ ID NO: 5462896 - DNA, 14 bp, Homo sapiens
ttcaaattgtgtgt

SEQ ID NO: 5462897 - DNA, 14 bp, Homo sapiens
ttcaaatttgatga

SEQ ID NO: 5462898 - DNA, 12 bp, Homo sapiens
ttcaaatttgta

SEQ ID NO: 5462899 - DNA, 14 bp, Homo sapiens
ttcaaatttgtaat

SEQ ID NO: 5462900 - DNA, 15 bp, Homo sapiens
ttcaaatttgtacag

SEQ ID NO: 5462901 - DNA, 22 bp, Homo sapiens
ttcaaatttgtctggttaaaaa

SEQ ID NO: 5462902 - DNA, 17 bp, Homo sapiens
ttcaaattttatctgcc

SEQ ID NO: 5462903 - DNA, 21 bp, Homo sapiens
ttcaaattttttaaaagagac

SEQ ID NO: 5462904 - DNA, 20 bp, Homo sapiens
ttcaacaaatatcttgtgtt

SEQ ID NO: 5462905 - DNA, 21 bp, Homo sapiens
ttcaacaaatttcattgcact

SEQ ID NO: 5462906 - DNA, 17 bp, Homo sapiens
ttcaacaagcctgaaag

SEQ ID NO: 5462907 - DNA, 18 bp, Homo sapiens
ttcaacaattctaaaatg

SEQ ID NO: 5462908 - DNA, 19 bp, Homo sapiens
ttcaacaattggtgtcatt

SEQ ID NO: 5462909 - DNA, 15 bp, Homo sapiens
ttcaacaatttcaat

SEQ ID NO: 5462910 - DNA, 13 bp, Homo sapiens
ttcaacacatttt

SEQ ID NO: 5462911 - DNA, 15 bp, Homo sapiens
ttcaacacattttta

SEQ ID NO: 5462912 - DNA, 21 bp, Homo sapiens
ttcaacacttattttctgaat

SEQ ID NO: 5462913 - DNA, 23 bp, Homo sapiens
ttcaacagagccctattggctta

SEQ ID NO: 5462914 - DNA, 16 bp, Homo sapiens
ttcaacagccaagctg

SEQ ID NO: 5462915 - DNA, 21 bp, Homo sapiens
ttcaacagccaagctggcaca

SEQ ID NO: 5462916 - DNA, 16 bp, Homo sapiens
ttcaacaggagaattt

SEQ ID NO: 5462917 - DNA, 21 bp, Homo sapiens
ttcaacaggttttcctgaaga

SEQ ID NO: 5462918 - DNA, 16 bp, Homo sapiens
ttcaacagtgaagaca

SEQ ID NO: 5462919 - DNA, 14 bp, Homo sapiens
ttcaacagtttctc

SEQ ID NO: 5462920 - DNA, 18 bp, Homo sapiens
ttcaacatcaaaacttaa

SEQ ID NO: 5462921 - DNA, 14 bp, Homo sapiens
ttcaacatcaatgt

SEQ ID NO: 5462922 - DNA, 11 bp, Homo sapiens
ttcaacatgta

SEQ ID NO: 5462923 - DNA, 20 bp, Homo sapiens
ttcaaccacacctaaattaa

SEQ ID NO: 5462924 - DNA, 20 bp, Homo sapiens
ttcaaccagatttagctgaa

SEQ ID NO: 5462925 - DNA, 15 bp, Homo sapiens
ttcaaccagcatttt

SEQ ID NO: 5462926 - DNA, 22 bp, Homo sapiens
ttcaaccagggattgtttctgt

SEQ ID NO: 5462927 - DNA, 14 bp, Homo sapiens
ttcaaccatggact

SEQ ID NO: 5462928 - DNA, 21 bp, Homo sapiens
ttcaaccatggactttataag

SEQ ID NO: 5462929 - DNA, 15 bp, Homo sapiens
ttcaaccattcccca

SEQ ID NO: 5462930 - DNA, 17 bp, Homo sapiens
ttcaaccattccccatg

SEQ ID NO: 5462931 - DNA, 20 bp, Homo sapiens
ttcaaccattccccatggga

SEQ ID NO: 5462932 - DNA, 20 bp, Homo sapiens
ttcaacccccttaactgtat

SEQ ID NO: 5462933 - DNA, 17 bp, Homo sapiens
ttcaaccctgccctgca

SEQ ID NO: 5462934 - DNA, 15 bp, Homo sapiens
ttcaacctctagaat

SEQ ID NO: 5462935 - DNA, 22 bp, Homo sapiens
ttcaacctggtggcaccagatg

SEQ ID NO: 5462936 - DNA, 16 bp, Homo sapiens
ttcaacctgtgtctta

SEQ ID NO: 5462937 - DNA, 18 bp, Homo sapiens
ttcaaccttaccaaaaaa

SEQ ID NO: 5462938 - DNA, 15 bp, Homo sapiens
ttcaacgcagccctg

SEQ ID NO: 5462939 - DNA, 16 bp, Homo sapiens
ttcaacgcagccctgc

SEQ ID NO: 5462940 - DNA, 20 bp, Homo sapiens
ttcaacgcagccctgctttg

SEQ ID NO: 5462941 - DNA, 18 bp, Homo sapiens
ttcaacgttggtatgata

SEQ ID NO: 5462942 - DNA, 23 bp, Homo sapiens
ttcaactaatacatggtttaaag

SEQ ID NO: 5462943 - DNA, 12 bp, Homo sapiens
ttcaactcagac

SEQ ID NO: 5462944 - DNA, 13 bp, Homo sapiens
ttcaactccagaa

SEQ ID NO: 5462945 - DNA, 14 bp, Homo sapiens
ttcaactccagaag

SEQ ID NO: 5462946 - DNA, 21 bp, Homo sapiens
ttcaactccagaagtggggct

SEQ ID NO: 5462947 - DNA, 22 bp, Homo sapiens
ttcaactctgaatcaaaagctg

SEQ ID NO: 5462948 - DNA, 12 bp, Homo sapiens
ttcacataataa

SEQ ID NO: 5462949 - DNA, 19 bp, Homo sapiens
ttcacatagagatcatcct

SEQ ID NO: 5462950 - DNA, 23 bp, Homo sapiens
ttcacatagcccacttacattta

SEQ ID NO: 5462951 - DNA, 18 bp, Homo sapiens
ttcacatagctgtctaga

SEQ ID NO: 5462952 - DNA, 22 bp, Homo sapiens
ttcacatagtcctcagggctca

SEQ ID NO: 5462953 - DNA, 15 bp, Homo sapiens
ttcacatccaatgca

SEQ ID NO: 5462954 - DNA, 18 bp, Homo sapiens
ttcacatcctgtgtttct

SEQ ID NO: 5462955 - DNA, 19 bp, Homo sapiens
ttcacatcctgtgtttcta

SEQ ID NO: 5462956 - DNA, 21 bp, Homo sapiens
ttcacatcgcagattctccct

SEQ ID NO: 5462957 - DNA, 18 bp, Homo sapiens
ttcacatctaacctcatc

SEQ ID NO: 5462958 - DNA, 19 bp, Homo sapiens
ttcacatctaacctcatct

SEQ ID NO: 5462959 - DNA, 15 bp, Homo sapiens
ttcacatctcccatg

SEQ ID NO: 5462960 - DNA, 20 bp, Homo sapiens
ttcacatctctggaaattta

SEQ ID NO: 5462961 - DNA, 13 bp, Homo sapiens
ttcacatctctgt

SEQ ID NO: 5462962 - DNA, 13 bp, Homo sapiens
ttcacatgaacat

SEQ ID NO: 5462963 - DNA, 21 bp, Homo sapiens
ttcacatgattctcctgcctc

SEQ ID NO: 5462964 - DNA, 18 bp, Homo sapiens
ttcacatgcatcaagtta

SEQ ID NO: 5462965 - DNA, 13 bp, Homo sapiens
ttcacatgccttg

SEQ ID NO: 5462966 - DNA, 14 bp, Homo sapiens
ttcacatgccttgc

SEQ ID NO: 5462967 - DNA, 20 bp, Homo sapiens
ttcacatgctctaaaaacct

SEQ ID NO: 5462968 - DNA, 15 bp, Homo sapiens
ttcacatgttctaat

SEQ ID NO: 5462969 - DNA, 16 bp, Homo sapiens
ttcacatgttttcaaa

SEQ ID NO: 5462970 - DNA, 17 bp, Homo sapiens
ttcacatgttttcaaat

SEQ ID NO: 5462971 - DNA, 20 bp, Homo sapiens
ttcacatgttttcaaatgga

SEQ ID NO: 5462972 - DNA, 17 bp, Homo sapiens
ttcacattaactcaggc

SEQ ID NO: 5462973 - DNA, 22 bp, Homo sapiens
ttcacattaatatttgctgaca

SEQ ID NO: 5462974 - DNA, 18 bp, Homo sapiens
ttcacattaggctgttgg

SEQ ID NO: 5462975 - DNA, 23 bp, Homo sapiens
ttcacattcccctggggacccac

SEQ ID NO: 5462976 - DNA, 13 bp, Homo sapiens
ttcacattcttat

SEQ ID NO: 5462977 - DNA, 19 bp, Homo sapiens
ttcacattcttataaatat

SEQ ID NO: 5462978 - DNA, 19 bp, Homo sapiens
ttcacattgtttgctgcta

SEQ ID NO: 5462979 - DNA, 20 bp, Homo sapiens
ttcacatttgaaataaagta

SEQ ID NO: 5462980 - DNA, 14 bp, Homo sapiens
ttcacattttctca

SEQ ID NO: 5462981 - DNA, 17 bp, Homo sapiens
ttcacattttttttctt

SEQ ID NO: 5462982 - DNA, 14 bp, Homo sapiens
ttcaccaaaaccaa

SEQ ID NO: 5462983 - DNA, 18 bp, Homo sapiens
ttcaccaaaccatggata

SEQ ID NO: 5462984 - DNA, 15 bp, Homo sapiens
ttcaccaaagatctg

SEQ ID NO: 5462985 - DNA, 23 bp, Homo sapiens
ttcaccaagtccccttctgtgtt

SEQ ID NO: 5462986 - DNA, 16 bp, Homo sapiens
ttcaccaagtgcaata

SEQ ID NO: 5462987 - DNA, 21 bp, Homo sapiens
ttcaccacaaccctgttgcta

SEQ ID NO: 5462988 - DNA, 23 bp, Homo sapiens
ttcaccacaaccctgttgctaca

SEQ ID NO: 5462989 - DNA, 15 bp, Homo sapiens
ttcaccacagacttt

SEQ ID NO: 5462990 - DNA, 22 bp, Homo sapiens
ttcaccacatgtgcacatgcac

SEQ ID NO: 5462991 - DNA, 18 bp, Homo sapiens
ttcaccaccccctgtccc

SEQ ID NO: 5462992 - DNA, 16 bp, Homo sapiens
ttcaccacttcactga

SEQ ID NO: 5462993 - DNA, 14 bp, Homo sapiens
ttcaccagaagtta

SEQ ID NO: 5462994 - DNA, 12 bp, Homo sapiens
ttcaccagagca

SEQ ID NO: 5462995 - DNA, 17 bp, Homo sapiens
ttcaccagagcccatgc

SEQ ID NO: 5462996 - DNA, 19 bp, Homo sapiens
ttcaccagcaactctgact

SEQ ID NO: 5462997 - DNA, 13 bp, Homo sapiens
ttcaccagccctg

SEQ ID NO: 5462998 - DNA, 13 bp, Homo sapiens
ttcaccaggaaga

SEQ ID NO: 5462999 - DNA, 15 bp, Homo sapiens
ttcaccagtctgtct

SEQ ID NO: 5463000 - DNA, 22 bp, Homo sapiens
ttcaccagtctgtctactgtgg

SEQ ID NO: 5463001 - DNA, 15 bp, Homo sapiens
ttcaccagtgttcct

SEQ ID NO: 5463002 - DNA, 22 bp, Homo sapiens
ttcaccagtttccaagtttatt

SEQ ID NO: 5463003 - DNA, 17 bp, Homo sapiens
ttcaccatcaatcctga

SEQ ID NO: 5463004 - DNA, 15 bp, Homo sapiens
ttcaccatcatgtac

SEQ ID NO: 5463005 - DNA, 21 bp, Homo sapiens
ttcaccatccagagaccaaat

SEQ ID NO: 5463006 - DNA, 15 bp, Homo sapiens
ttcaccatctttgag

SEQ ID NO: 5463007 - DNA, 21 bp, Homo sapiens
ttcaccatgtaaaacaaaaaa

SEQ ID NO: 5463008 - DNA, 19 bp, Homo sapiens
ttcaccatgttagccagga

SEQ ID NO: 5463009 - DNA, 22 bp, Homo sapiens
ttcaccatgttggccaggctgg

SEQ ID NO: 5463010 - DNA, 15 bp, Homo sapiens
ttcaccattataatg

SEQ ID NO: 5463011 - DNA, 20 bp, Homo sapiens
ttcaccattataatgaattt

SEQ ID NO: 5463012 - DNA, 13 bp, Homo sapiens
ttcaccatttccg

SEQ ID NO: 5463013 - DNA, 18 bp, Homo sapiens
ttcacccatcttatcaag

SEQ ID NO: 5463014 - DNA, 21 bp, Homo sapiens
ttcaccccagtggccactcag

SEQ ID NO: 5463015 - DNA, 20 bp, Homo sapiens
ttcaccccatccctccttaa

SEQ ID NO: 5463016 - DNA, 14 bp, Homo sapiens
ttcacccccaactt

SEQ ID NO: 5463017 - DNA, 19 bp, Homo sapiens
ttcacccccctctgctgcc

SEQ ID NO: 5463018 - DNA, 21 bp, Homo sapiens
ttcaccccctgagatcccctg

SEQ ID NO: 5463019 - DNA, 16 bp, Homo sapiens
ttcaccccctttcctg

SEQ ID NO: 5463020 - DNA, 19 bp, Homo sapiens
ttcaccccctttcctggac

SEQ ID NO: 5463021 - DNA, 21 bp, Homo sapiens
ttcaccccggcaggccctgca

SEQ ID NO: 5463022 - DNA, 12 bp, Homo sapiens
ttcacccctccc

SEQ ID NO: 5463023 - DNA, 15 bp, Homo sapiens
ttcacccctcccttt

SEQ ID NO: 5463024 - DNA, 16 bp, Homo sapiens
ttcacccctccctttc

SEQ ID NO: 5463025 - DNA, 20 bp, Homo sapiens
ttcacccctccctttctccc

SEQ ID NO: 5463026 - DNA, 22 bp, Homo sapiens
ttcacccctccctttctcccct

SEQ ID NO: 5463027 - DNA, 15 bp, Homo sapiens
ttcacccctcttccc

SEQ ID NO: 5463028 - DNA, 17 bp, Homo sapiens
ttcacccctgcacttca

SEQ ID NO: 5463029 - DNA, 15 bp, Homo sapiens
ttcacccggctgggc

SEQ ID NO: 5463030 - DNA, 17 bp, Homo sapiens
ttcacccggctgggctc

SEQ ID NO: 5463031 - DNA, 22 bp, Homo sapiens
ttcaccctcaccccctcctggc

SEQ ID NO: 5463032 - DNA, 15 bp, Homo sapiens
ttcaccctgggcagt

SEQ ID NO: 5463033 - DNA, 17 bp, Homo sapiens
ttcaccgcattccaggg

SEQ ID NO: 5463034 - DNA, 17 bp, Homo sapiens
ttcacctaagtctctgt

SEQ ID NO: 5463035 - DNA, 21 bp, Homo sapiens
ttcacctaagtctctgtgaat

SEQ ID NO: 5463036 - DNA, 21 bp, Homo sapiens
ttcacctactaatgtctcttc

SEQ ID NO: 5463037 - DNA, 23 bp, Homo sapiens
ttcacctagcaacatatctctgc

SEQ ID NO: 5463038 - DNA, 13 bp, Homo sapiens
ttcacctatgtta

SEQ ID NO: 5463039 - DNA, 22 bp, Homo sapiens
ttcacctcactgaaaacatctg

SEQ ID NO: 5463040 - DNA, 17 bp, Homo sapiens
ttcacctcagcctggag

SEQ ID NO: 5463041 - DNA, 13 bp, Homo sapiens
ttcacctccttca

SEQ ID NO: 5463042 - DNA, 15 bp, Homo sapiens
ttcacctccttcaat

SEQ ID NO: 5463043 - DNA, 23 bp, Homo sapiens
ttcacctcggagggatggagaaa

SEQ ID NO: 5463044 - DNA, 22 bp, Homo sapiens
ttcacctctattcttgggaaac

SEQ ID NO: 5463045 - DNA, 19 bp, Homo sapiens
ttcacctctgggaccccag

SEQ ID NO: 5463046 - DNA, 22 bp, Homo sapiens
ttcacctctgggaccccagctg

SEQ ID NO: 5463047 - DNA, 13 bp, Homo sapiens
ttcacctcttcct

SEQ ID NO: 5463048 - DNA, 14 bp, Homo sapiens
ttcacctgaaatgc

SEQ ID NO: 5463049 - DNA, 12 bp, Homo sapiens
ttcacctgcagg

SEQ ID NO: 5463050 - DNA, 12 bp, Homo sapiens
ttcacctgggat

SEQ ID NO: 5463051 - DNA, 18 bp, Homo sapiens
ttcacctgggccctggag

SEQ ID NO: 5463052 - DNA, 11 bp, Homo sapiens
ttcacctgtaa

SEQ ID NO: 5463053 - DNA, 17 bp, Homo sapiens
ttcacctgtaaacctga

SEQ ID NO: 5463054 - DNA, 15 bp, Homo sapiens
ttcacctgttatgta

SEQ ID NO: 5463055 - DNA, 21 bp, Homo sapiens
ttcacctgtttttaagctgtt

SEQ ID NO: 5463056 - DNA, 13 bp, Homo sapiens
ttcaccttatgta

SEQ ID NO: 5463057 - DNA, 13 bp, Homo sapiens
ttcaccttcccct

SEQ ID NO: 5463058 - DNA, 17 bp, Homo sapiens
ttcaccttctgtgcatc

SEQ ID NO: 5463059 - DNA, 14 bp, Homo sapiens
ttcaccttggaagg

SEQ ID NO: 5463060 - DNA, 15 bp, Homo sapiens
ttcaccttggaaggg

SEQ ID NO: 5463061 - DNA, 13 bp, Homo sapiens
ttcacctttgtag

SEQ ID NO: 5463062 - DNA, 20 bp, Homo sapiens
ttcacctttgtccccaccgc

SEQ ID NO: 5463063 - DNA, 17 bp, Homo sapiens
ttcaccttttcttcaaa

SEQ ID NO: 5463064 - DNA, 15 bp, Homo sapiens
ttcacctttttaata

SEQ ID NO: 5463065 - DNA, 15 bp, Homo sapiens
ttcacgaactgttca

SEQ ID NO: 5463066 - DNA, 20 bp, Homo sapiens
ttcacgaagtgttgcatgga

SEQ ID NO: 5463067 - DNA, 23 bp, Homo sapiens
ttcacgacaatgttgagaagttc

SEQ ID NO: 5463068 - DNA, 17 bp, Homo sapiens
ttcacgccattctcctg

SEQ ID NO: 5463069 - DNA, 18 bp, Homo sapiens
ttcacgccattctcctgc

SEQ ID NO: 5463070 - DNA, 14 bp, Homo sapiens
ttcacgcccttggc

SEQ ID NO: 5463071 - DNA, 20 bp, Homo sapiens
ttcacgccgtaattctttct

SEQ ID NO: 5463072 - DNA, 19 bp, Homo sapiens
ttcacgcctgaggcaatta

SEQ ID NO: 5463073 - DNA, 21 bp, Homo sapiens
ttcacgcctgtaatcccagca

SEQ ID NO: 5463074 - DNA, 14 bp, Homo sapiens
ttcacgctggcttc

SEQ ID NO: 5463075 - DNA, 17 bp, Homo sapiens
ttcacgctggcttccag

SEQ ID NO: 5463076 - DNA, 18 bp, Homo sapiens
ttcacgctgtctcttctt

SEQ ID NO: 5463077 - DNA, 18 bp, Homo sapiens
ttcacggaagagccttgc

SEQ ID NO: 5463078 - DNA, 13 bp, Homo sapiens
ttcacggaagttt

SEQ ID NO: 5463079 - DNA, 22 bp, Homo sapiens
ttcacggaagttttcaatgatg

SEQ ID NO: 5463080 - DNA, 17 bp, Homo sapiens
ttcacggactctttgct

SEQ ID NO: 5463081 - DNA, 18 bp, Homo sapiens
ttcacggactctttgctg

SEQ ID NO: 5463082 - DNA, 14 bp, Homo sapiens
ttcacggcctggca

SEQ ID NO: 5463083 - DNA, 13 bp, Homo sapiens
ttcacgggcccca

SEQ ID NO: 5463084 - DNA, 16 bp, Homo sapiens
ttcacgtaatcctcct

SEQ ID NO: 5463085 - DNA, 23 bp, Homo sapiens
ttcacgtacaaaactctgtataa

SEQ ID NO: 5463086 - DNA, 16 bp, Homo sapiens
ttcacgtcactgccag

SEQ ID NO: 5463087 - DNA, 22 bp, Homo sapiens
ttcacgtcttggtgccttttgt

SEQ ID NO: 5463088 - DNA, 18 bp, Homo sapiens
ttcacgtggcctccgcag

SEQ ID NO: 5463089 - DNA, 15 bp, Homo sapiens
ttcacgtggtcctaa

SEQ ID NO: 5463090 - DNA, 19 bp, Homo sapiens
ttcacgtgttttccatccc

SEQ ID NO: 5463091 - DNA, 16 bp, Homo sapiens
ttcacgttctagtgaa

SEQ ID NO: 5463092 - DNA, 19 bp, Homo sapiens
ttcacgtttttctggacca

SEQ ID NO: 5463093 - DNA, 14 bp, Homo sapiens
ttcactaaaataaa

SEQ ID NO: 5463094 - DNA, 13 bp, Homo sapiens
ttcactaaagcag

SEQ ID NO: 5463095 - DNA, 20 bp, Homo sapiens
ttcactacaacattagaata

SEQ ID NO: 5463096 - DNA, 14 bp, Homo sapiens
ttcactaccaaatg

SEQ ID NO: 5463097 - DNA, 18 bp, Homo sapiens
ttcactactcatgcgtga

SEQ ID NO: 5463098 - DNA, 22 bp, Homo sapiens
ttcactagggaatcctgcggca

SEQ ID NO: 5463099 - DNA, 18 bp, Homo sapiens
ttcactatcttcttcaaa

SEQ ID NO: 5463100 - DNA, 17 bp, Homo sapiens
ttcactatgattttcta

SEQ ID NO: 5463101 - DNA, 20 bp, Homo sapiens
ttcactatttttatttatat

SEQ ID NO: 5463102 - DNA, 14 bp, Homo sapiens
ttcactcaagcact

SEQ ID NO: 5463103 - DNA, 15 bp, Homo sapiens
ttcactcaagcactg

SEQ ID NO: 5463104 - DNA, 16 bp, Homo sapiens
ttcactcacatagcca

SEQ ID NO: 5463105 - DNA, 15 bp, Homo sapiens
ttcactcagaattat

SEQ ID NO: 5463106 - DNA, 19 bp, Homo sapiens
ttcactcagccacacccca

SEQ ID NO: 5463107 - DNA, 16 bp, Homo sapiens
ttcactccagtcaaca

SEQ ID NO: 5463108 - DNA, 24 bp, Homo sapiens
ttcactccggtgtgcctgcagccc

SEQ ID NO: 5463109 - DNA, 23 bp, Homo sapiens
ttcactcctgcttctctcagcca

SEQ ID NO: 5463110 - DNA, 16 bp, Homo sapiens
ttcactctaagatgtt

SEQ ID NO: 5463111 - DNA, 19 bp, Homo sapiens
ttcactctatacttaatct

SEQ ID NO: 5463112 - DNA, 21 bp, Homo sapiens
ttcactctccattagaaaatt

SEQ ID NO: 5463113 - DNA, 18 bp, Homo sapiens
ttcactctcccagaggct

SEQ ID NO: 5463114 - DNA, 12 bp, Homo sapiens
ttcactctctga

SEQ ID NO: 5463115 - DNA, 13 bp, Homo sapiens
ttcactctctgaa

SEQ ID NO: 5463116 - DNA, 14 bp, Homo sapiens
ttcactctggcttc

SEQ ID NO: 5463117 - DNA, 15 bp, Homo sapiens
ttcactcttcacttg

SEQ ID NO: 5463118 - DNA, 18 bp, Homo sapiens
ttcactcttggagcctgc

SEQ ID NO: 5463119 - DNA, 19 bp, Homo sapiens
ttcactcttggagcctgca

SEQ ID NO: 5463120 - DNA, 16 bp, Homo sapiens
ttcactctttccagat

SEQ ID NO: 5463121 - DNA, 18 bp, Homo sapiens
ttcactgaaatgtttgga

SEQ ID NO: 5463122 - DNA, 22 bp, Homo sapiens
ttcactgaagaaaccttcagat

SEQ ID NO: 5463123 - DNA, 13 bp, Homo sapiens
ttcactgaagacg

SEQ ID NO: 5463124 - DNA, 15 bp, Homo sapiens
ttcactgaagtgaat

SEQ ID NO: 5463125 - DNA, 19 bp, Homo sapiens
ttcactgaagttctcctga

SEQ ID NO: 5463126 - DNA, 12 bp, Homo sapiens
ttcagtctgaat

SEQ ID NO: 5463127 - DNA, 14 bp, Homo sapiens
ttcagtctgctctc

SEQ ID NO: 5463128 - DNA, 19 bp, Homo sapiens
ttcagtcttaatactttat

SEQ ID NO: 5463129 - DNA, 14 bp, Homo sapiens
ttcagtcttgcctt

SEQ ID NO: 5463130 - DNA, 14 bp, Homo sapiens
ttcagtcttggtaa

SEQ ID NO: 5463131 - DNA, 20 bp, Homo sapiens
ttcagtcttggtaaaacatt

SEQ ID NO: 5463132 - DNA, 19 bp, Homo sapiens
ttcagtcttggtggttcta

SEQ ID NO: 5463133 - DNA, 14 bp, Homo sapiens
ttcagtcttttcct

SEQ ID NO: 5463134 - DNA, 20 bp, Homo sapiens
ttcagtgaagatgctgtaaa

SEQ ID NO: 5463135 - DNA, 12 bp, Homo sapiens
ttcagtgaagca

SEQ ID NO: 5463136 - DNA, 21 bp, Homo sapiens
ttcagtgaatatttttgtatt

SEQ ID NO: 5463137 - DNA, 22 bp, Homo sapiens
ttcagtgaatgtacccctttaa

SEQ ID NO: 5463138 - DNA, 13 bp, Homo sapiens
ttcagtgaatttg

SEQ ID NO: 5463139 - DNA, 18 bp, Homo sapiens
ttcagtgacaagtagggc

SEQ ID NO: 5463140 - DNA, 16 bp, Homo sapiens
ttcagtgactcctgct

SEQ ID NO: 5463141 - DNA, 18 bp, Homo sapiens
ttcagtgacttctggctt

SEQ ID NO: 5463142 - DNA, 22 bp, Homo sapiens
ttcagtgagagacgccctattt

SEQ ID NO: 5463143 - DNA, 21 bp, Homo sapiens
ttcagtgagcccctccccagc

SEQ ID NO: 5463144 - DNA, 22 bp, Homo sapiens
ttcagtgagcccctccccagcc

SEQ ID NO: 5463145 - DNA, 20 bp, Homo sapiens
ttcagtgagggtcttcttac

SEQ ID NO: 5463146 - DNA, 21 bp, Homo sapiens
ttcagtgataactcctaagag

SEQ ID NO: 5463147 - DNA, 13 bp, Homo sapiens
ttcagtgatatct

SEQ ID NO: 5463148 - DNA, 20 bp, Homo sapiens
ttcagtgatatctttctcat

SEQ ID NO: 5463149 - DNA, 19 bp, Homo sapiens
ttcagtgatcttcactgta

SEQ ID NO: 5463150 - DNA, 13 bp, Homo sapiens
ttcagtgatggca

SEQ ID NO: 5463151 - DNA, 21 bp, Homo sapiens
ttcagtgcaaattgtatctta

SEQ ID NO: 5463152 - DNA, 15 bp, Homo sapiens
ttcagtgcacctgcc

SEQ ID NO: 5463153 - DNA, 20 bp, Homo sapiens
ttcagtgcacctgcctcagc

SEQ ID NO: 5463154 - DNA, 21 bp, Homo sapiens
ttcagtgcacctgtggcctct

SEQ ID NO: 5463155 - DNA, 16 bp, Homo sapiens
ttcagtgccaaaaaca

SEQ ID NO: 5463156 - DNA, 23 bp, Homo sapiens
ttcagtgccacaaattgaaagct

SEQ ID NO: 5463157 - DNA, 13 bp, Homo sapiens
ttcagtgcctgct

SEQ ID NO: 5463158 - DNA, 12 bp, Homo sapiens
ttcagtgcctta

SEQ ID NO: 5463159 - DNA, 18 bp, Homo sapiens
ttcagtgccttatggaac

SEQ ID NO: 5463160 - DNA, 19 bp, Homo sapiens
ttcagtgccttatggaaca

SEQ ID NO: 5463161 - DNA, 21 bp, Homo sapiens
ttcagtgccttatggaacact

SEQ ID NO: 5463162 - DNA, 15 bp, Homo sapiens
ttcagtgccttcaac

SEQ ID NO: 5463163 - DNA, 13 bp, Homo sapiens
ttcagtgccttcc

SEQ ID NO: 5463164 - DNA, 13 bp, Homo sapiens
ttcagtgccttgg

SEQ ID NO: 5463165 - DNA, 13 bp, Homo sapiens
ttcagtgctggtg

SEQ ID NO: 5463166 - DNA, 19 bp, Homo sapiens
ttcagtgctgtggcctggg

SEQ ID NO: 5463167 - DNA, 21 bp, Homo sapiens
ttcagtgctgtggcctgggca

SEQ ID NO: 5463168 - DNA, 16 bp, Homo sapiens
ttcagtggaaatcaat

SEQ ID NO: 5463169 - DNA, 20 bp, Homo sapiens
ttcagtggaaatcaatcaga

SEQ ID NO: 5463170 - DNA, 19 bp, Homo sapiens
ttcagtggaacacaaatga

SEQ ID NO: 5463171 - DNA, 23 bp, Homo sapiens
ttcagtggaacacaaatgaaaat

SEQ ID NO: 5463172 - DNA, 18 bp, Homo sapiens
ttcagtggagctcagagg

SEQ ID NO: 5463173 - DNA, 17 bp, Homo sapiens
ttcagtggaggctggca

SEQ ID NO: 5463174 - DNA, 14 bp, Homo sapiens
ttcagtggcagctg

SEQ ID NO: 5463175 - DNA, 15 bp, Homo sapiens
ttcagtggcagctgc

SEQ ID NO: 5463176 - DNA, 19 bp, Homo sapiens
ttcagtgggttcagaacca

SEQ ID NO: 5463177 - DNA, 21 bp, Homo sapiens
ttcagtgtaatgtgacttcat

SEQ ID NO: 5463178 - DNA, 17 bp, Homo sapiens
ttcagtgtaatttcttt

SEQ ID NO: 5463179 - DNA, 12 bp, Homo sapiens
ttcagtgtacat

SEQ ID NO: 5463180 - DNA, 16 bp, Homo sapiens
ttcagtgtagttaatt

SEQ ID NO: 5463181 - DNA, 18 bp, Homo sapiens
ttcagtgtagttaattta

SEQ ID NO: 5463182 - DNA, 19 bp, Homo sapiens
ttcagtgtagttaatttat

SEQ ID NO: 5463183 - DNA, 15 bp, Homo sapiens
ttcagtgtatttcag

SEQ ID NO: 5463184 - DNA, 18 bp, Homo sapiens
ttcagtgtcccgggcccg

SEQ ID NO: 5463185 - DNA, 18 bp, Homo sapiens
ttcagtgttgacatagcc

SEQ ID NO: 5463186 - DNA, 21 bp, Homo sapiens
ttcagtgttgacatagccttt

SEQ ID NO: 5463187 - DNA, 15 bp, Homo sapiens
ttcagtgttgcatgt

SEQ ID NO: 5463188 - DNA, 21 bp, Homo sapiens
ttcagtgtttctggggagctg

SEQ ID NO: 5463189 - DNA, 14 bp, Homo sapiens
ttcagtgttttgct

SEQ ID NO: 5463190 - DNA, 18 bp, Homo sapiens
ttcagttaagaaaaaaat

SEQ ID NO: 5463191 - DNA, 20 bp, Homo sapiens
ttcagttaagttcttctccc

SEQ ID NO: 5463192 - DNA, 18 bp, Homo sapiens
ttcagttattaaatgata

SEQ ID NO: 5463193 - DNA, 21 bp, Homo sapiens
ttcagttcagcggttgaggag

SEQ ID NO: 5463194 - DNA, 15 bp, Homo sapiens
ttcagttcagcttta

SEQ ID NO: 5463195 - DNA, 10 bp, Homo sapiens
ttcagttcca

SEQ ID NO: 5463196 - DNA, 18 bp, Homo sapiens
ttcagttccaatacttca

SEQ ID NO: 5463197 - DNA, 17 bp, Homo sapiens
ttcagttccagcttttg

SEQ ID NO: 5463198 - DNA, 15 bp, Homo sapiens
ttcagttcccagaat

SEQ ID NO: 5463199 - DNA, 17 bp, Homo sapiens
ttcagttcccagaatca

SEQ ID NO: 5463200 - DNA, 18 bp, Homo sapiens
ttcagttcccgctctgca

SEQ ID NO: 5463201 - DNA, 15 bp, Homo sapiens
ttcagttctatttaa

SEQ ID NO: 5463202 - DNA, 17 bp, Homo sapiens
ttcagttctgtgtacat

SEQ ID NO: 5463203 - DNA, 20 bp, Homo sapiens
ttcagttctgtgtacatttt

SEQ ID NO: 5463204 - DNA, 18 bp, Homo sapiens
ttcagttctttctttttc

SEQ ID NO: 5463205 - DNA, 20 bp, Homo sapiens
ttcagttctttggattctaa

SEQ ID NO: 5463206 - DNA, 16 bp, Homo sapiens
ttcagttgcacttcta

SEQ ID NO: 5463207 - DNA, 14 bp, Homo sapiens
ttcagttgcgaaac

SEQ ID NO: 5463208 - DNA, 18 bp, Homo sapiens
ttcagttgcttgtcttct

SEQ ID NO: 5463209 - DNA, 16 bp, Homo sapiens
ttcagttgctttgccc

SEQ ID NO: 5463210 - DNA, 22 bp, Homo sapiens
ttcagttggttcgttctgtact

SEQ ID NO: 5463211 - DNA, 17 bp, Homo sapiens
ttcagttgtgtttgttg

SEQ ID NO: 5463212 - DNA, 15 bp, Homo sapiens
ttcagtttagaacct

SEQ ID NO: 5463213 - DNA, 15 bp, Homo sapiens
ttcagtttatctgtt

SEQ ID NO: 5463214 - DNA, 22 bp, Homo sapiens
ttcagtttatttgaaccaataa

SEQ ID NO: 5463215 - DNA, 19 bp, Homo sapiens
ttcagtttcaattcagtgc

SEQ ID NO: 5463216 - DNA, 19 bp, Homo sapiens
ttcagtttctaaaattgag

SEQ ID NO: 5463217 - DNA, 19 bp, Homo sapiens
ttcagtttctatcaacctt

SEQ ID NO: 5463218 - DNA, 17 bp, Homo sapiens
ttcagtttcttctgcgc

SEQ ID NO: 5463219 - DNA, 21 bp, Homo sapiens
ttcagtttgaaggctgcacac

SEQ ID NO: 5463220 - DNA, 22 bp, Homo sapiens
ttcagtttgtacaatccacaat

SEQ ID NO: 5463221 - DNA, 13 bp, Homo sapiens
ttcagtttgtata

SEQ ID NO: 5463222 - DNA, 12 bp, Homo sapiens
ttcagttttact

SEQ ID NO: 5463223 - DNA, 18 bp, Homo sapiens
ttcagttttactgcattt

SEQ ID NO: 5463224 - DNA, 12 bp, Homo sapiens
ttcagttttcag

SEQ ID NO: 5463225 - DNA, 16 bp, Homo sapiens
ttcagttttgatattt

SEQ ID NO: 5463226 - DNA, 13 bp, Homo sapiens
ttcagttttggtg

SEQ ID NO: 5463227 - DNA, 19 bp, Homo sapiens
ttcagtttttaacataatt

SEQ ID NO: 5463228 - DNA, 23 bp, Homo sapiens
ttcagtttttattaatctactgt

SEQ ID NO: 5463229 - DNA, 15 bp, Homo sapiens
ttcagtttttcactt

SEQ ID NO: 5463230 - DNA, 18 bp, Homo sapiens
ttcagtttttcatttgtt

SEQ ID NO: 5463231 - DNA, 13 bp, Homo sapiens
ttcagtttttgta

SEQ ID NO: 5463232 - DNA, 15 bp, Homo sapiens
ttcagtttttgtatc

SEQ ID NO: 5463233 - DNA, 16 bp, Homo sapiens
ttcagtttttgtgttt

SEQ ID NO: 5463234 - DNA, 19 bp, Homo sapiens
ttcagtttttttttttcca

SEQ ID NO: 5463235 - DNA, 19 bp, Homo sapiens
ttcataaaacggtgctttc

SEQ ID NO: 5463236 - DNA, 21 bp, Homo sapiens
ttcataaactgagcctctttt

SEQ ID NO: 5463237 - DNA, 13 bp, Homo sapiens
ttcataaagagaa

SEQ ID NO: 5463238 - DNA, 21 bp, Homo sapiens
ttcataaagcaccagcagtgt

SEQ ID NO: 5463239 - DNA, 23 bp, Homo sapiens
ttcataaagcaccagcagtgttt

SEQ ID NO: 5463240 - DNA, 15 bp, Homo sapiens
ttcataaagtaatga

SEQ ID NO: 5463241 - DNA, 16 bp, Homo sapiens
ttcataaagtacttga

SEQ ID NO: 5463242 - DNA, 12 bp, Homo sapiens
ttcataaatgaa

SEQ ID NO: 5463243 - DNA, 12 bp, Homo sapiens
ttcataaattaa

SEQ ID NO: 5463244 - DNA, 16 bp, Homo sapiens
ttcataaattaacaaa

SEQ ID NO: 5463245 - DNA, 22 bp, Homo sapiens
ttcataacaaaccatctggtgc

SEQ ID NO: 5463246 - DNA, 21 bp, Homo sapiens
ttcataacagtgccattgtct

SEQ ID NO: 5463247 - DNA, 17 bp, Homo sapiens
ttcataaccaacaatat

SEQ ID NO: 5463248 - DNA, 23 bp, Homo sapiens
ttcataactaatgaattgaaatt

SEQ ID NO: 5463249 - DNA, 13 bp, Homo sapiens
ttcataacttatt

SEQ ID NO: 5463250 - DNA, 14 bp, Homo sapiens
ttcataagacaaga

SEQ ID NO: 5463251 - DNA, 14 bp, Homo sapiens
ttcataagacactt

SEQ ID NO: 5463252 - DNA, 22 bp, Homo sapiens
ttcataagatattctttacaaa

SEQ ID NO: 5463253 - DNA, 14 bp, Homo sapiens
ttcataagatattt

SEQ ID NO: 5463254 - DNA, 16 bp, Homo sapiens
ttcataagctgaacca

SEQ ID NO: 5463255 - DNA, 14 bp, Homo sapiens
ttcataagctttgt

SEQ ID NO: 5463256 - DNA, 12 bp, Homo sapiens
ttcataaggaaa

SEQ ID NO: 5463257 - DNA, 13 bp, Homo sapiens
ttcataaggaaat

SEQ ID NO: 5463258 - DNA, 19 bp, Homo sapiens
ttcataaggcctgccctcc

SEQ ID NO: 5463259 - DNA, 16 bp, Homo sapiens
ttcataataaaagtga

SEQ ID NO: 5463260 - DNA, 14 bp, Homo sapiens
ttcataataaacta

SEQ ID NO: 5463261 - DNA, 21 bp, Homo sapiens
ttcataatatataaaagaaat

SEQ ID NO: 5463262 - DNA, 20 bp, Homo sapiens
ttcataatgaattataacag

SEQ ID NO: 5463263 - DNA, 13 bp, Homo sapiens
ttcataatgactt

SEQ ID NO: 5463264 - DNA, 15 bp, Homo sapiens
ttcataatgcagaag

SEQ ID NO: 5463265 - DNA, 11 bp, Homo sapiens
ttcataatggc

SEQ ID NO: 5463266 - DNA, 15 bp, Homo sapiens
ttcataattagaaca

SEQ ID NO: 5463267 - DNA, 13 bp, Homo sapiens
ttcataattcacc

SEQ ID NO: 5463268 - DNA, 13 bp, Homo sapiens
ttcataattcaga

SEQ ID NO: 5463269 - DNA, 12 bp, Homo sapiens
ttcataatttca

SEQ ID NO: 5463270 - DNA, 14 bp, Homo sapiens
ttcatacaaagcat

SEQ ID NO: 5463271 - DNA, 21 bp, Homo sapiens
ttcatacaaagtactgtcctc

SEQ ID NO: 5463272 - DNA, 22 bp, Homo sapiens
ttcatacaaagtactgtcctca

SEQ ID NO: 5463273 - DNA, 14 bp, Homo sapiens
ttcatacaacaaag

SEQ ID NO: 5463274 - DNA, 21 bp, Homo sapiens
ttcatacaagccaactggtat

SEQ ID NO: 5463275 - DNA, 12 bp, Homo sapiens
ttcatacaaggc

SEQ ID NO: 5463276 - DNA, 21 bp, Homo sapiens
ttcatacagggatggtgttca

SEQ ID NO: 5463277 - DNA, 18 bp, Homo sapiens
ttcataccagtcagtatt

SEQ ID NO: 5463278 - DNA, 20 bp, Homo sapiens
ttcataccagtcagtattcc

SEQ ID NO: 5463279 - DNA, 21 bp, Homo sapiens
ttcataccctctacctggatg

SEQ ID NO: 5463280 - DNA, 19 bp, Homo sapiens
ttcataccgcctcgtgcca

SEQ ID NO: 5463281 - DNA, 21 bp, Homo sapiens
ttcataccgcctcgtgccagc

SEQ ID NO: 5463282 - DNA, 18 bp, Homo sapiens
ttcatacctaagtactgt

SEQ ID NO: 5463283 - DNA, 20 bp, Homo sapiens
ttcatacctaagtactgtaa

SEQ ID NO: 5463284 - DNA, 23 bp, Homo sapiens
ttcatacggggtggctgaaagta

SEQ ID NO: 5463285 - DNA, 12 bp, Homo sapiens
ttcatactaaat

SEQ ID NO: 5463286 - DNA, 16 bp, Homo sapiens
ttcatactaaataaaa

SEQ ID NO: 5463287 - DNA, 14 bp, Homo sapiens
ttcatactacattt

SEQ ID NO: 5463288 - DNA, 15 bp, Homo sapiens
ttcatactcaaagag

SEQ ID NO: 5463289 - DNA, 14 bp, Homo sapiens
ttcatactctagat

SEQ ID NO: 5463290 - DNA, 23 bp, Homo sapiens
ttcatactctgttgcctcctctc

SEQ ID NO: 5463291 - DNA, 14 bp, Homo sapiens
ttcatactgaatga

SEQ ID NO: 5463292 - DNA, 15 bp, Homo sapiens
ttcatactgtagaaa

SEQ ID NO: 5463293 - DNA, 13 bp, Homo sapiens
ttcatacttgaac

SEQ ID NO: 5463294 - DNA, 15 bp, Homo sapiens
ttcatacttgaacgt

SEQ ID NO: 5463295 - DNA, 22 bp, Homo sapiens
ttcatactttccaacattatcc

SEQ ID NO: 5463296 - DNA, 22 bp, Homo sapiens
ttcatagacgcaaccttaactt

SEQ ID NO: 5463297 - DNA, 11 bp, Homo sapiens
ttcatagagaa

SEQ ID NO: 5463298 - DNA, 18 bp, Homo sapiens
ttcatagagatttgtcta

SEQ ID NO: 5463299 - DNA, 20 bp, Homo sapiens
ttcatagagatttgtctaat

SEQ ID NO: 5463300 - DNA, 23 bp, Homo sapiens
ttcatagagccctattctctcag

SEQ ID NO: 5463301 - DNA, 23 bp, Homo sapiens
ttcatagataccattttgaaata

SEQ ID NO: 5463302 - DNA, 15 bp, Homo sapiens
ttcatagatattgga

SEQ ID NO: 5463303 - DNA, 16 bp, Homo sapiens
ttcatagatattggaa

SEQ ID NO: 5463304 - DNA, 21 bp, Homo sapiens
ttcatagatttgaaaaacttt

SEQ ID NO: 5463305 - DNA, 17 bp, Homo sapiens
ttcattctgccaaagta

SEQ ID NO: 5463306 - DNA, 19 bp, Homo sapiens
ttcattctgctacttcact

SEQ ID NO: 5463307 - DNA, 22 bp, Homo sapiens
ttcattctggtccttagtaaat

SEQ ID NO: 5463308 - DNA, 14 bp, Homo sapiens
ttcattctggtctc

SEQ ID NO: 5463309 - DNA, 17 bp, Homo sapiens
ttcattctgtgatcatt

SEQ ID NO: 5463310 - DNA, 13 bp, Homo sapiens
ttcattcttaaca

SEQ ID NO: 5463311 - DNA, 23 bp, Homo sapiens
ttcattcttaacaagatatttat

SEQ ID NO: 5463312 - DNA, 16 bp, Homo sapiens
ttcattcttcagatat

SEQ ID NO: 5463313 - DNA, 16 bp, Homo sapiens
ttcattcttctctagc

SEQ ID NO: 5463314 - DNA, 13 bp, Homo sapiens
ttcattctttata

SEQ ID NO: 5463315 - DNA, 17 bp, Homo sapiens
ttcattgaatactttat

SEQ ID NO: 5463316 - DNA, 14 bp, Homo sapiens
ttcattgacctcat

SEQ ID NO: 5463317 - DNA, 17 bp, Homo sapiens
ttcattgacctcatcat

SEQ ID NO: 5463318 - DNA, 17 bp, Homo sapiens
ttcattgagagttttgt

SEQ ID NO: 5463319 - DNA, 19 bp, Homo sapiens
ttcattgagagttttgtct

SEQ ID NO: 5463320 - DNA, 18 bp, Homo sapiens
ttcattgaggataaattg

SEQ ID NO: 5463321 - DNA, 21 bp, Homo sapiens
ttcattgaggataaattgcca

SEQ ID NO: 5463322 - DNA, 22 bp, Homo sapiens
ttcattgaggataaattgccat

SEQ ID NO: 5463323 - DNA, 18 bp, Homo sapiens
ttcattgagttggttact

SEQ ID NO: 5463324 - DNA, 18 bp, Homo sapiens
ttcattgatttcctgtgt

SEQ ID NO: 5463325 - DNA, 13 bp, Homo sapiens
ttcattgcaaagt

SEQ ID NO: 5463326 - DNA, 16 bp, Homo sapiens
ttcattgcaattaaac

SEQ ID NO: 5463327 - DNA, 18 bp, Homo sapiens
ttcattgcacaatatatt

SEQ ID NO: 5463328 - DNA, 15 bp, Homo sapiens
ttcattgcactgcag

SEQ ID NO: 5463329 - DNA, 22 bp, Homo sapiens
ttcattgcactttcctttcaat

SEQ ID NO: 5463330 - DNA, 15 bp, Homo sapiens
ttcattgccagtgtc

SEQ ID NO: 5463331 - DNA, 16 bp, Homo sapiens
ttcattgccagtgtct

SEQ ID NO: 5463332 - DNA, 21 bp, Homo sapiens
ttcattgccttaactggagcc

SEQ ID NO: 5463333 - DNA, 15 bp, Homo sapiens
ttcattgcctttcca

SEQ ID NO: 5463334 - DNA, 23 bp, Homo sapiens
ttcattgctacacttacaagtaa

SEQ ID NO: 5463335 - DNA, 16 bp, Homo sapiens
ttcattgctggagaca

SEQ ID NO: 5463336 - DNA, 19 bp, Homo sapiens
ttcattgctgtgtcacact

SEQ ID NO: 5463337 - DNA, 15 bp, Homo sapiens
ttcattggatgcagt

SEQ ID NO: 5463338 - DNA, 22 bp, Homo sapiens
ttcattggcattctttgcaata

SEQ ID NO: 5463339 - DNA, 19 bp, Homo sapiens
ttcattggctatataaaat

SEQ ID NO: 5463340 - DNA, 14 bp, Homo sapiens
ttcattggttaaaa

SEQ ID NO: 5463341 - DNA, 17 bp, Homo sapiens
ttcattgtaaatcactt

SEQ ID NO: 5463342 - DNA, 15 bp, Homo sapiens
ttcattgtaaatgaa

SEQ ID NO: 5463343 - DNA, 21 bp, Homo sapiens
ttcattgtaaatgaacataat

SEQ ID NO: 5463344 - DNA, 19 bp, Homo sapiens
ttcattgtagattttgtta

SEQ ID NO: 5463345 - DNA, 15 bp, Homo sapiens
ttcattgtccctctt

SEQ ID NO: 5463346 - DNA, 12 bp, Homo sapiens
ttcattgtctct

SEQ ID NO: 5463347 - DNA, 14 bp, Homo sapiens
ttcattgtgattta

SEQ ID NO: 5463348 - DNA, 17 bp, Homo sapiens
ttcattgtggttatttt

SEQ ID NO: 5463349 - DNA, 16 bp, Homo sapiens
ttcattgtgtatgaga

SEQ ID NO: 5463350 - DNA, 16 bp, Homo sapiens
ttcattgtttgtttta

SEQ ID NO: 5463351 - DNA, 21 bp, Homo sapiens
ttcattgtttttaactttgct

SEQ ID NO: 5463352 - DNA, 17 bp, Homo sapiens
ttcatttaaaatgatta

SEQ ID NO: 5463353 - DNA, 12 bp, Homo sapiens
ttcatttaacac

SEQ ID NO: 5463354 - DNA, 13 bp, Homo sapiens
ttcatttaacact

SEQ ID NO: 5463355 - DNA, 13 bp, Homo sapiens
ttcatttaagaac

SEQ ID NO: 5463356 - DNA, 19 bp, Homo sapiens
ttcatttaagaacaagaga

SEQ ID NO: 5463357 - DNA, 20 bp, Homo sapiens
ttcatttacaacttccagat

SEQ ID NO: 5463358 - DNA, 21 bp, Homo sapiens
ttcatttacaacttccagatt

SEQ ID NO: 5463359 - DNA, 18 bp, Homo sapiens
ttcatttacaatttcaaa

SEQ ID NO: 5463360 - DNA, 13 bp, Homo sapiens
ttcatttactgtg

SEQ ID NO: 5463361 - DNA, 20 bp, Homo sapiens
ttcatttagataatttgaaa

SEQ ID NO: 5463362 - DNA, 19 bp, Homo sapiens
ttcatttaggtgaggaagc

SEQ ID NO: 5463363 - DNA, 18 bp, Homo sapiens
ttcatttagtgagttatt

SEQ ID NO: 5463364 - DNA, 21 bp, Homo sapiens
ttcatttattaagtatatttg

SEQ ID NO: 5463365 - DNA, 12 bp, Homo sapiens
ttcatttcactg

SEQ ID NO: 5463366 - DNA, 15 bp, Homo sapiens
ttcatttcagatttt

SEQ ID NO: 5463367 - DNA, 16 bp, Homo sapiens
ttcatttcatcctttc

SEQ ID NO: 5463368 - DNA, 23 bp, Homo sapiens
ttcatttcatcttgcaaatgttg

SEQ ID NO: 5463369 - DNA, 14 bp, Homo sapiens
ttcatttcatgtat

SEQ ID NO: 5463370 - DNA, 13 bp, Homo sapiens
ttcatttcattgt

SEQ ID NO: 5463371 - DNA, 14 bp, Homo sapiens
ttcatttccaccaa

SEQ ID NO: 5463372 - DNA, 13 bp, Homo sapiens
ttcatttcctcaa

SEQ ID NO: 5463373 - DNA, 16 bp, Homo sapiens
ttcatttcctcaaaaa

SEQ ID NO: 5463374 - DNA, 16 bp, Homo sapiens
ttcatttcctccgtca

SEQ ID NO: 5463375 - DNA, 21 bp, Homo sapiens
ttcatttcctctgagctgtta

SEQ ID NO: 5463376 - DNA, 16 bp, Homo sapiens
ttcatttcctgtgtct

SEQ ID NO: 5463377 - DNA, 16 bp, Homo sapiens
ttcatttctaaattta

SEQ ID NO: 5463378 - DNA, 13 bp, Homo sapiens
ttcatttctagac

SEQ ID NO: 5463379 - DNA, 13 bp, Homo sapiens
ttcatttctgata

SEQ ID NO: 5463380 - DNA, 12 bp, Homo sapiens
ttcatttctgca

SEQ ID NO: 5463381 - DNA, 14 bp, Homo sapiens
ttcatttctgtctc

SEQ ID NO: 5463382 - DNA, 20 bp, Homo sapiens
ttcatttctgtctcccctac

SEQ ID NO: 5463383 - DNA, 21 bp, Homo sapiens
ttcatttcttacgttctttca

SEQ ID NO: 5463384 - DNA, 13 bp, Homo sapiens
ttcatttcttatc

SEQ ID NO: 5463385 - DNA, 17 bp, Homo sapiens
ttcatttgacatttagt

SEQ ID NO: 5463386 - DNA, 18 bp, Homo sapiens
ttcatttgagaagtaaac

SEQ ID NO: 5463387 - DNA, 12 bp, Homo sapiens
ttcatttgcttt

SEQ ID NO: 5463388 - DNA, 19 bp, Homo sapiens
ttcatttggaaataagctg

SEQ ID NO: 5463389 - DNA, 22 bp, Homo sapiens
ttcatttggaggaatcacccca

SEQ ID NO: 5463390 - DNA, 19 bp, Homo sapiens
ttcatttggggcatttgta

SEQ ID NO: 5463391 - DNA, 20 bp, Homo sapiens
ttcatttggggcatttgtaa

SEQ ID NO: 5463392 - DNA, 22 bp, Homo sapiens
ttcatttggggcatttgtaaaa

SEQ ID NO: 5463393 - DNA, 15 bp, Homo sapiens
ttcatttggtgctgg

SEQ ID NO: 5463394 - DNA, 19 bp, Homo sapiens
ttcatttggtgttcctgga

SEQ ID NO: 5463395 - DNA, 13 bp, Homo sapiens
ttcatttgtacaa

SEQ ID NO: 5463396 - DNA, 11 bp, Homo sapiens
ttcatttgtat

SEQ ID NO: 5463397 - DNA, 18 bp, Homo sapiens
ttcatttgtatgtcaaag

SEQ ID NO: 5463398 - DNA, 13 bp, Homo sapiens
ttcatttgtgtca

SEQ ID NO: 5463399 - DNA, 15 bp, Homo sapiens
ttcatttgtgtcaat

SEQ ID NO: 5463400 - DNA, 15 bp, Homo sapiens
ttcatttgttttgct

SEQ ID NO: 5463401 - DNA, 16 bp, Homo sapiens
ttcattttaaaaagtc

SEQ ID NO: 5463402 - DNA, 18 bp, Homo sapiens
ttcattttaacatctgag

SEQ ID NO: 5463403 - DNA, 21 bp, Homo sapiens
ttcattttaacatgatttcaa

SEQ ID NO: 5463404 - DNA, 22 bp, Homo sapiens
ttcattttaatttatatttgaa

SEQ ID NO: 5463405 - DNA, 15 bp, Homo sapiens
ttcattttactcaga

SEQ ID NO: 5463406 - DNA, 18 bp, Homo sapiens
ttcattttagtattttag

SEQ ID NO: 5463407 - DNA, 23 bp, Homo sapiens
ttcattttagtccagatttttag

SEQ ID NO: 5463408 - DNA, 20 bp, Homo sapiens
ttcattttagtgtatcttta

SEQ ID NO: 5463409 - DNA, 22 bp, Homo sapiens
ttcattttatattgaaaaaaat

SEQ ID NO: 5463410 - DNA, 18 bp, Homo sapiens
ttcattttatatttaaaa

SEQ ID NO: 5463411 - DNA, 18 bp, Homo sapiens
ttcattttcatcactggg

SEQ ID NO: 5463412 - DNA, 13 bp, Homo sapiens
ttcattttcatct

SEQ ID NO: 5463413 - DNA, 14 bp, Homo sapiens
ttcattttccaata

SEQ ID NO: 5463414 - DNA, 14 bp, Homo sapiens
ttcattttctagat

SEQ ID NO: 5463415 - DNA, 21 bp, Homo sapiens
ttcattttctagatacaataa

SEQ ID NO: 5463416 - DNA, 13 bp, Homo sapiens
ttcattttctcta

SEQ ID NO: 5463417 - DNA, 19 bp, Homo sapiens
ttcattttgagctgaaatg

SEQ ID NO: 5463418 - DNA, 19 bp, Homo sapiens
ttcattttgagtattttta

SEQ ID NO: 5463419 - DNA, 11 bp, Homo sapiens
ttcattttgca

SEQ ID NO: 5463420 - DNA, 12 bp, Homo sapiens
ttcattttgcac

SEQ ID NO: 5463421 - DNA, 22 bp, Homo sapiens
ttcattttgcactgaggatatt

SEQ ID NO: 5463422 - DNA, 18 bp, Homo sapiens
ttcattttgcagaaggaa

SEQ ID NO: 5463423 - DNA, 13 bp, Homo sapiens
ttcattttgcttt

SEQ ID NO: 5463424 - DNA, 14 bp, Homo sapiens
ttcattttgcttta

SEQ ID NO: 5463425 - DNA, 23 bp, Homo sapiens
ttcattttggcaagaagactgta

SEQ ID NO: 5463426 - DNA, 21 bp, Homo sapiens
ttcattttgggccttgctaaa

SEQ ID NO: 5463427 - DNA, 12 bp, Homo sapiens
ttcattttggtt

SEQ ID NO: 5463428 - DNA, 18 bp, Homo sapiens
ttcatttttaaagcctgg

SEQ ID NO: 5463429 - DNA, 18 bp, Homo sapiens
ttcatttttaatcatgaa

SEQ ID NO: 5463430 - DNA, 18 bp, Homo sapiens
ttcatttttccatgacat

SEQ ID NO: 5463431 - DNA, 20 bp, Homo sapiens
ttcatttttccatgacattt

SEQ ID NO: 5463432 - DNA, 15 bp, Homo sapiens
ttcatttttcctaac

SEQ ID NO: 5463433 - DNA, 15 bp, Homo sapiens
ttcatttttctgtta

SEQ ID NO: 5463434 - DNA, 15 bp, Homo sapiens
ttcatttttgtaata

SEQ ID NO: 5463435 - DNA, 20 bp, Homo sapiens
ttcatttttgtaataacatt

SEQ ID NO: 5463436 - DNA, 18 bp, Homo sapiens
ttcattttttatgtattg

SEQ ID NO: 5463437 - DNA, 23 bp, Homo sapiens
ttcatttttttcactggagttac

SEQ ID NO: 5463438 - DNA, 18 bp, Homo sapiens
ttcattttttttaattga

SEQ ID NO: 5463439 - DNA, 16 bp, Homo sapiens
ttccaaaaaattaaaa

SEQ ID NO: 5463440 - DNA, 12 bp, Homo sapiens
ttccaaaaatac

SEQ ID NO: 5463441 - DNA, 22 bp, Homo sapiens
ttccaaaaattacttagtattg

SEQ ID NO: 5463442 - DNA, 15 bp, Homo sapiens
ttccaaaaattatta

SEQ ID NO: 5463443 - DNA, 14 bp, Homo sapiens
ttccaaaacaaaaa

SEQ ID NO: 5463444 - DNA, 17 bp, Homo sapiens
ttccaaaacctgcttcc

SEQ ID NO: 5463445 - DNA, 17 bp, Homo sapiens
ttccaaaagtactagca

SEQ ID NO: 5463446 - DNA, 19 bp, Homo sapiens
ttccaaaataatctatatt

SEQ ID NO: 5463447 - DNA, 23 bp, Homo sapiens
ttccaaaataatctatattaaat

SEQ ID NO: 5463448 - DNA, 15 bp, Homo sapiens
ttccaaaatacaatg

SEQ ID NO: 5463449 - DNA, 18 bp, Homo sapiens
ttccaaaatattgacatt

SEQ ID NO: 5463450 - DNA, 16 bp, Homo sapiens
ttccaaaatctcccat

SEQ ID NO: 5463451 - DNA, 18 bp, Homo sapiens
ttccaaaatctcccattt

SEQ ID NO: 5463452 - DNA, 19 bp, Homo sapiens
ttccaaaatctcccatttt

SEQ ID NO: 5463453 - DNA, 13 bp, Homo sapiens
ttccaaaatgttt

SEQ ID NO: 5463454 - DNA, 15 bp, Homo sapiens
ttccaaaattccatc

SEQ ID NO: 5463455 - DNA, 23 bp, Homo sapiens
ttccaaacagacaaaacagataa

SEQ ID NO: 5463456 - DNA, 16 bp, Homo sapiens
ttccaaacatccaaaa

SEQ ID NO: 5463457 - DNA, 17 bp, Homo sapiens
ttccaaaccagtttatt

SEQ ID NO: 5463458 - DNA, 21 bp, Homo sapiens
ttccaaaccagtttattctgt

SEQ ID NO: 5463459 - DNA, 16 bp, Homo sapiens
ttccaaaccctcctgg

SEQ ID NO: 5463460 - DNA, 18 bp, Homo sapiens
ttccaaaccctcctggga

SEQ ID NO: 5463461 - DNA, 16 bp, Homo sapiens
ttccaaacctgacaga

SEQ ID NO: 5463462 - DNA, 17 bp, Homo sapiens
ttccaaacctggttcat

SEQ ID NO: 5463463 - DNA, 20 bp, Homo sapiens
ttccaaaccttatctccaca

SEQ ID NO: 5463464 - DNA, 14 bp, Homo sapiens
ttccaaactaattt

SEQ ID NO: 5463465 - DNA, 20 bp, Homo sapiens
ttccaaactcttccctctct

SEQ ID NO: 5463466 - DNA, 17 bp, Homo sapiens
ttccaaactgttgtcta

SEQ ID NO: 5463467 - DNA, 20 bp, Homo sapiens
ttccaaacttctaaatgttg

SEQ ID NO: 5463468 - DNA, 12 bp, Homo sapiens
ttccaaagaaag

SEQ ID NO: 5463469 - DNA, 19 bp, Homo sapiens
ttccaaagaatattttgat

SEQ ID NO: 5463470 - DNA, 23 bp, Homo sapiens
ttccaaagagccatgtgtcatgt

SEQ ID NO: 5463471 - DNA, 11 bp, Homo sapiens
ttccaaagcaa

SEQ ID NO: 5463472 - DNA, 12 bp, Homo sapiens
ttccaaagcaaa

SEQ ID NO: 5463473 - DNA, 15 bp, Homo sapiens
ttccaaagcattttc

SEQ ID NO: 5463474 - DNA, 20 bp, Homo sapiens
ttccaaagccagtgaaatgt

SEQ ID NO: 5463475 - DNA, 11 bp, Homo sapiens
ttccaaagctc

SEQ ID NO: 5463476 - DNA, 17 bp, Homo sapiens
ttccaaagctgaagatc

SEQ ID NO: 5463477 - DNA, 19 bp, Homo sapiens
ttccaaagcttcgtcttgt

SEQ ID NO: 5463478 - DNA, 18 bp, Homo sapiens
ttccaaaggcagcgtgcc

SEQ ID NO: 5463479 - DNA, 21 bp, Homo sapiens
ttccaaaggcagcgtgccgag

SEQ ID NO: 5463480 - DNA, 13 bp, Homo sapiens
ttccaaaggttcc

SEQ ID NO: 5463481 - DNA, 13 bp, Homo sapiens
ttccaaagtacac

SEQ ID NO: 5463482 - DNA, 14 bp, Homo sapiens
ttccaaagtctcta

SEQ ID NO: 5463483 - DNA, 17 bp, Homo sapiens
ttccaaagtgcatgtca

SEQ ID NO: 5463484 - DNA, 15 bp, Homo sapiens
ttccattctggaagt

SEQ ID NO: 5463485 - DNA, 20 bp, Homo sapiens
ttccattctgggtgttttca

SEQ ID NO: 5463486 - DNA, 20 bp, Homo sapiens
ttccattcttggcatctact

SEQ ID NO: 5463487 - DNA, 13 bp, Homo sapiens
ttccattcttgtc

SEQ ID NO: 5463488 - DNA, 17 bp, Homo sapiens
ttccattcttttaaatg

SEQ ID NO: 5463489 - DNA, 17 bp, Homo sapiens
ttccattgaccagctct

SEQ ID NO: 5463490 - DNA, 15 bp, Homo sapiens
ttccattgatttttt

SEQ ID NO: 5463491 - DNA, 20 bp, Homo sapiens
ttccattgctcccagtgcca

SEQ ID NO: 5463492 - DNA, 19 bp, Homo sapiens
ttccattggaaaatttaag

SEQ ID NO: 5463493 - DNA, 17 bp, Homo sapiens
ttccattggatctcatt

SEQ ID NO: 5463494 - DNA, 13 bp, Homo sapiens
ttccattgttata

SEQ ID NO: 5463495 - DNA, 21 bp, Homo sapiens
ttccattgttgtcaaatgccc

SEQ ID NO: 5463496 - DNA, 17 bp, Homo sapiens
ttccatttacagtctct

SEQ ID NO: 5463497 - DNA, 23 bp, Homo sapiens
ttccatttacagtctctttcttc

SEQ ID NO: 5463498 - DNA, 18 bp, Homo sapiens
ttccatttatcctagaaa

SEQ ID NO: 5463499 - DNA, 23 bp, Homo sapiens
ttccatttatgttttttctgatt

SEQ ID NO: 5463500 - DNA, 16 bp, Homo sapiens
ttccatttattaagca

SEQ ID NO: 5463501 - DNA, 20 bp, Homo sapiens
ttccatttatttattcatgt

SEQ ID NO: 5463502 - DNA, 12 bp, Homo sapiens
ttccatttccaa

SEQ ID NO: 5463503 - DNA, 18 bp, Homo sapiens
ttccatttctactgtata

SEQ ID NO: 5463504 - DNA, 14 bp, Homo sapiens
ttccatttctcaat

SEQ ID NO: 5463505 - DNA, 23 bp, Homo sapiens
ttccatttctcaatcagtgcagt

SEQ ID NO: 5463506 - DNA, 15 bp, Homo sapiens
ttccatttctctctc

SEQ ID NO: 5463507 - DNA, 14 bp, Homo sapiens
ttccatttctgatg

SEQ ID NO: 5463508 - DNA, 13 bp, Homo sapiens
ttccatttcttcc

SEQ ID NO: 5463509 - DNA, 22 bp, Homo sapiens
ttccatttgaggatttagaagt

SEQ ID NO: 5463510 - DNA, 15 bp, Homo sapiens
ttccatttgcatttg

SEQ ID NO: 5463511 - DNA, 12 bp, Homo sapiens
ttccatttgctg

SEQ ID NO: 5463512 - DNA, 13 bp, Homo sapiens
ttccatttgctga

SEQ ID NO: 5463513 - DNA, 16 bp, Homo sapiens
ttccatttggtgacca

SEQ ID NO: 5463514 - DNA, 14 bp, Homo sapiens
ttccattttaagtg

SEQ ID NO: 5463515 - DNA, 18 bp, Homo sapiens
ttccattttaattttaaa

SEQ ID NO: 5463516 - DNA, 19 bp, Homo sapiens
ttccatttttactaaagca

SEQ ID NO: 5463517 - DNA, 19 bp, Homo sapiens
ttccatttttgtcagtctg

SEQ ID NO: 5463518 - DNA, 16 bp, Homo sapiens
ttcccaaacgcctccc

SEQ ID NO: 5463519 - DNA, 16 bp, Homo sapiens
ttcccaaagcactttt

SEQ ID NO: 5463520 - DNA, 17 bp, Homo sapiens
ttcccaaagtcctctgc

SEQ ID NO: 5463521 - DNA, 18 bp, Homo sapiens
ttcccaaagtcctctgct

SEQ ID NO: 5463522 - DNA, 20 bp, Homo sapiens
ttcccaaagtcctctgctcc

SEQ ID NO: 5463523 - DNA, 15 bp, Homo sapiens
ttcccaaatctcaaa

SEQ ID NO: 5463524 - DNA, 13 bp, Homo sapiens
ttcccaaatgtat

SEQ ID NO: 5463525 - DNA, 20 bp, Homo sapiens
ttcccaaattccctggacct

SEQ ID NO: 5463526 - DNA, 15 bp, Homo sapiens
ttcccaacacaaaga

SEQ ID NO: 5463527 - DNA, 14 bp, Homo sapiens
ttcccaacagcctt

SEQ ID NO: 5463528 - DNA, 23 bp, Homo sapiens
ttcccaacccccagcccccaccc

SEQ ID NO: 5463529 - DNA, 15 bp, Homo sapiens
ttcccaactcactgt

SEQ ID NO: 5463530 - DNA, 18 bp, Homo sapiens
ttcccaactcactgtgct

SEQ ID NO: 5463531 - DNA, 22 bp, Homo sapiens
ttcccaactcactgtgctccta

SEQ ID NO: 5463532 - DNA, 17 bp, Homo sapiens
ttcccaactctagctgg

SEQ ID NO: 5463533 - DNA, 18 bp, Homo sapiens
ttcccaactctagctggg

SEQ ID NO: 5463534 - DNA, 19 bp, Homo sapiens
ttcccaacttccctgttct

SEQ ID NO: 5463535 - DNA, 20 bp, Homo sapiens
ttcccaacttctcttgcttt

SEQ ID NO: 5463536 - DNA, 16 bp, Homo sapiens
ttcccaactttggaaa

SEQ ID NO: 5463537 - DNA, 17 bp, Homo sapiens
ttcccaactttggaaaa

SEQ ID NO: 5463538 - DNA, 15 bp, Homo sapiens
ttcccaagatgcctg

SEQ ID NO: 5463539 - DNA, 17 bp, Homo sapiens
ttcccaagcaaagactg

SEQ ID NO: 5463540 - DNA, 23 bp, Homo sapiens
ttcccaagccttcgggcgtctgt

SEQ ID NO: 5463541 - DNA, 14 bp, Homo sapiens
ttcccaagctccct

SEQ ID NO: 5463542 - DNA, 14 bp, Homo sapiens
ttcccaagctctgc

SEQ ID NO: 5463543 - DNA, 15 bp, Homo sapiens
ttcccaagctctgct

SEQ ID NO: 5463544 - DNA, 19 bp, Homo sapiens
ttcccaaggaagctccttc

SEQ ID NO: 5463545 - DNA, 21 bp, Homo sapiens
ttcccaaggaagctccttcct

SEQ ID NO: 5463546 - DNA, 13 bp, Homo sapiens
ttcccaaggacat

SEQ ID NO: 5463547 - DNA, 21 bp, Homo sapiens
ttcccaaggccagtctgaacc

SEQ ID NO: 5463548 - DNA, 19 bp, Homo sapiens
ttcccaagtatgccttaag

SEQ ID NO: 5463549 - DNA, 16 bp, Homo sapiens
ttcccaagtcctcgcc

SEQ ID NO: 5463550 - DNA, 20 bp, Homo sapiens
ttcccaagtcctcgcccccc

SEQ ID NO: 5463551 - DNA, 23 bp, Homo sapiens
ttcccaagtcctcgccccccgcc

SEQ ID NO: 5463552 - DNA, 14 bp, Homo sapiens
ttcccaataaaagt

SEQ ID NO: 5463553 - DNA, 15 bp, Homo sapiens
ttcccaataaaagtg

SEQ ID NO: 5463554 - DNA, 20 bp, Homo sapiens
ttcccaatagcaacgtagct

SEQ ID NO: 5463555 - DNA, 18 bp, Homo sapiens
ttcccaatatcatgtgat

SEQ ID NO: 5463556 - DNA, 17 bp, Homo sapiens
ttcccaatcagcactga

SEQ ID NO: 5463557 - DNA, 19 bp, Homo sapiens
ttcccaatcagcactgaaa

SEQ ID NO: 5463558 - DNA, 23 bp, Homo sapiens
ttcccaatctctacccctttctt

SEQ ID NO: 5463559 - DNA, 13 bp, Homo sapiens
ttcccaattaaaa

SEQ ID NO: 5463560 - DNA, 14 bp, Homo sapiens
ttcccaattatcaa

SEQ ID NO: 5463561 - DNA, 13 bp, Homo sapiens
ttcccaattgctt

SEQ ID NO: 5463562 - DNA, 22 bp, Homo sapiens
ttcccacaaaagacagacccag

SEQ ID NO: 5463563 - DNA, 13 bp, Homo sapiens
ttcccacaagcct

SEQ ID NO: 5463564 - DNA, 17 bp, Homo sapiens
ttcccacaagcctgcct

SEQ ID NO: 5463565 - DNA, 15 bp, Homo sapiens
ttcccacaattcttt

SEQ ID NO: 5463566 - DNA, 19 bp, Homo sapiens
ttcccacaattcttttgaa

SEQ ID NO: 5463567 - DNA, 14 bp, Homo sapiens
ttcccacacatatt

SEQ ID NO: 5463568 - DNA, 22 bp, Homo sapiens
ttcccacactgaaattctaaat

SEQ ID NO: 5463569 - DNA, 22 bp, Homo sapiens
ttcccacagcacaaccggtccc

SEQ ID NO: 5463570 - DNA, 20 bp, Homo sapiens
ttcccacagcattcctccat

SEQ ID NO: 5463571 - DNA, 19 bp, Homo sapiens
ttcccacagcctcttcctc

SEQ ID NO: 5463572 - DNA, 22 bp, Homo sapiens
ttcccaccaactcctatttccc

SEQ ID NO: 5463573 - DNA, 18 bp, Homo sapiens
ttcccaccaactctctct

SEQ ID NO: 5463574 - DNA, 15 bp, Homo sapiens
ttcccaccaaggtct

SEQ ID NO: 5463575 - DNA, 16 bp, Homo sapiens
ttcccaccaatcctca

SEQ ID NO: 5463576 - DNA, 15 bp, Homo sapiens
ttcccaccagcatgt

SEQ ID NO: 5463577 - DNA, 20 bp, Homo sapiens
ttcccaccccaacctgctct

SEQ ID NO: 5463578 - DNA, 12 bp, Homo sapiens
ttcccaccccta

SEQ ID NO: 5463579 - DNA, 19 bp, Homo sapiens
ttcccaccctccacctctc

SEQ ID NO: 5463580 - DNA, 18 bp, Homo sapiens
ttcccaccctcctgcccc

SEQ ID NO: 5463581 - DNA, 14 bp, Homo sapiens
ttcccacctactgc

SEQ ID NO: 5463582 - DNA, 14 bp, Homo sapiens
ttcccacctccctg

SEQ ID NO: 5463583 - DNA, 21 bp, Homo sapiens
ttcccacctccctgcccaggc

SEQ ID NO: 5463584 - DNA, 12 bp, Homo sapiens
ttcccacctctc

SEQ ID NO: 5463585 - DNA, 13 bp, Homo sapiens
ttcccaccttcca

SEQ ID NO: 5463586 - DNA, 14 bp, Homo sapiens
ttcccacgaggaat

SEQ ID NO: 5463587 - DNA, 20 bp, Homo sapiens
ttcccactaagctttctcct

SEQ ID NO: 5463588 - DNA, 15 bp, Homo sapiens
ttcccactcaccagc

SEQ ID NO: 5463589 - DNA, 18 bp, Homo sapiens
ttcccactcaccagccct

SEQ ID NO: 5463590 - DNA, 12 bp, Homo sapiens
ttcccactccag

SEQ ID NO: 5463591 - DNA, 14 bp, Homo sapiens
ttcccactccagct

SEQ ID NO: 5463592 - DNA, 16 bp, Homo sapiens
ttcccactccagctga

SEQ ID NO: 5463593 - DNA, 19 bp, Homo sapiens
ttcccactgcactccagcc

SEQ ID NO: 5463594 - DNA, 21 bp, Homo sapiens
ttcccactgcactccagcctg

SEQ ID NO: 5463595 - DNA, 21 bp, Homo sapiens
ttcccactggctcctccagca

SEQ ID NO: 5463596 - DNA, 23 bp, Homo sapiens
ttcccactggtccatctggtttt

SEQ ID NO: 5463597 - DNA, 13 bp, Homo sapiens
ttcccactgtcct

SEQ ID NO: 5463598 - DNA, 23 bp, Homo sapiens
ttcccactgtcctttctccaggc

SEQ ID NO: 5463599 - DNA, 15 bp, Homo sapiens
ttcccactgtttaag

SEQ ID NO: 5463600 - DNA, 20 bp, Homo sapiens
ttcccacttaaaaattaaat

SEQ ID NO: 5463601 - DNA, 18 bp, Homo sapiens
ttcccacttccacccccg

SEQ ID NO: 5463602 - DNA, 17 bp, Homo sapiens
ttcccactttcccaccc

SEQ ID NO: 5463603 - DNA, 20 bp, Homo sapiens
ttcccactttcccaccccac

SEQ ID NO: 5463604 - DNA, 13 bp, Homo sapiens
ttcccagaaggca

SEQ ID NO: 5463605 - DNA, 15 bp, Homo sapiens
ttcccagaagggagt

SEQ ID NO: 5463606 - DNA, 22 bp, Homo sapiens
ttcccagaagtggctactgact

SEQ ID NO: 5463607 - DNA, 13 bp, Homo sapiens
ttcccagaatcaa

SEQ ID NO: 5463608 - DNA, 15 bp, Homo sapiens
ttcccagaatcaaag

SEQ ID NO: 5463609 - DNA, 21 bp, Homo sapiens
ttcccagaccaggaaaggctt

SEQ ID NO: 5463610 - DNA, 20 bp, Homo sapiens
ttcccagaccccgcagcacg

SEQ ID NO: 5463611 - DNA, 21 bp, Homo sapiens
ttcccagaccttaagacactg

SEQ ID NO: 5463612 - DNA, 12 bp, Homo sapiens
ttcccagactct

SEQ ID NO: 5463613 - DNA, 22 bp, Homo sapiens
ttcccagagacaggaaaatcct

SEQ ID NO: 5463614 - DNA, 16 bp, Homo sapiens
ttcccagagaccttct

SEQ ID NO: 5463615 - DNA, 14 bp, Homo sapiens
ttcccagaggcaga

SEQ ID NO: 5463616 - DNA, 19 bp, Homo sapiens
ttcccagagtcatctgatt

SEQ ID NO: 5463617 - DNA, 12 bp, Homo sapiens
ttcccagagtgg

SEQ ID NO: 5463618 - DNA, 21 bp, Homo sapiens
ttcccagagtgtgaaacttcc

SEQ ID NO: 5463619 - DNA, 14 bp, Homo sapiens
ttcccagatacttc

SEQ ID NO: 5463620 - DNA, 20 bp, Homo sapiens
ttcccagcaacactccggtc

SEQ ID NO: 5463621 - DNA, 23 bp, Homo sapiens
ttcccagcagggccactcccggc

SEQ ID NO: 5463622 - DNA, 19 bp, Homo sapiens
ttcccagccatgcccagga

SEQ ID NO: 5463623 - DNA, 17 bp, Homo sapiens
ttcccagcccctcctcc

SEQ ID NO: 5463624 - DNA, 18 bp, Homo sapiens
ttcccagcccctcctccc

SEQ ID NO: 5463625 - DNA, 21 bp, Homo sapiens
ttcccagcccctgcagattct

SEQ ID NO: 5463626 - DNA, 20 bp, Homo sapiens
ttcccagcctgactagaact

SEQ ID NO: 5463627 - DNA, 14 bp, Homo sapiens
ttcccagctctccc

SEQ ID NO: 5463628 - DNA, 19 bp, Homo sapiens
ttcccagctctccctctgg

SEQ ID NO: 5463629 - DNA, 13 bp, Homo sapiens
ttcccagctggca

SEQ ID NO: 5463630 - DNA, 20 bp, Homo sapiens
ttcccaggaccctgaagggg

SEQ ID NO: 5463631 - DNA, 14 bp, Homo sapiens
ttcccaggagaaag

SEQ ID NO: 5463632 - DNA, 16 bp, Homo sapiens
ttcccaggcaaataaa

SEQ ID NO: 5463633 - DNA, 18 bp, Homo sapiens
ttcccaggcaaataaaat

SEQ ID NO: 5463634 - DNA, 14 bp, Homo sapiens
ttcccaggccaggg

SEQ ID NO: 5463635 - DNA, 17 bp, Homo sapiens
ttcccaggccagggctg

SEQ ID NO: 5463636 - DNA, 22 bp, Homo sapiens
ttcccaggccagggctgggtca

SEQ ID NO: 5463637 - DNA, 13 bp, Homo sapiens
ttcccagggaagt

SEQ ID NO: 5463638 - DNA, 21 bp, Homo sapiens
ttcccagggaccttggaaaca

SEQ ID NO: 5463639 - DNA, 18 bp, Homo sapiens
ttcccagggcacccaggc

SEQ ID NO: 5463640 - DNA, 15 bp, Homo sapiens
ttcccagggccgctt

SEQ ID NO: 5463641 - DNA, 19 bp, Homo sapiens
ttcccagggccgcttctcc

SEQ ID NO: 5463642 - DNA, 19 bp, Homo sapiens
ttcccagggtagcccgcct

SEQ ID NO: 5463643 - DNA, 20 bp, Homo sapiens
ttcccagggtagcccgcctg

SEQ ID NO: 5463644 - DNA, 19 bp, Homo sapiens
ttcccagtaaccctaagga

SEQ ID NO: 5463645 - DNA, 19 bp, Homo sapiens
ttcccagtaagtttcccct

SEQ ID NO: 5463646 - DNA, 22 bp, Homo sapiens
ttcccagtaagtttcccctctg

SEQ ID NO: 5463647 - DNA, 19 bp, Homo sapiens
ttcccagtatttttatacg

SEQ ID NO: 5463648 - DNA, 15 bp, Homo sapiens
ttcccagtctgtcga

SEQ ID NO: 5463649 - DNA, 17 bp, Homo sapiens
ttcccagtgagcctctg

SEQ ID NO: 5463650 - DNA, 18 bp, Homo sapiens
ttcccagtgagcctctgc

SEQ ID NO: 5463651 - DNA, 17 bp, Homo sapiens
ttcccagtggctgctgc

SEQ ID NO: 5463652 - DNA, 19 bp, Homo sapiens
ttcccagtggctgctgccc

SEQ ID NO: 5463653 - DNA, 20 bp, Homo sapiens
ttcccagtggctgctgccca

SEQ ID NO: 5463654 - DNA, 14 bp, Homo sapiens
ttcccagttaaaga

SEQ ID NO: 5463655 - DNA, 18 bp, Homo sapiens
ttcccagttggagctcca

SEQ ID NO: 5463656 - DNA, 16 bp, Homo sapiens
ttcccataattttctt

SEQ ID NO: 5463657 - DNA, 23 bp, Homo sapiens
ttcccatcactggagcaccaggc

SEQ ID NO: 5463658 - DNA, 14 bp, Homo sapiens
ttcccatccccagc

SEQ ID NO: 5463659 - DNA, 19 bp, Homo sapiens
ttcccatcctcttctttta

SEQ ID NO: 5463660 - DNA, 14 bp, Homo sapiens
ttcccatctccagg

SEQ ID NO: 5463661 - DNA, 15 bp, Homo sapiens
ttcccatctccaggg

SEQ ID NO: 5463662 - DNA, 21 bp, Homo sapiens
ttccctggaactcctggcctt

SEQ ID NO: 5463663 - DNA, 18 bp, Homo sapiens
ttccctggacaggcagcc

SEQ ID NO: 5463664 - DNA, 21 bp, Homo sapiens
ttccctggacaggcagcctcc

SEQ ID NO: 5463665 - DNA, 11 bp, Homo sapiens
ttccctggacc

SEQ ID NO: 5463666 - DNA, 17 bp, Homo sapiens
ttccctggagctgaggt

SEQ ID NO: 5463667 - DNA, 12 bp, Homo sapiens
ttccctggcctc

SEQ ID NO: 5463668 - DNA, 15 bp, Homo sapiens
ttccctggcggcccc

SEQ ID NO: 5463669 - DNA, 16 bp, Homo sapiens
ttccctggcgtcctct

SEQ ID NO: 5463670 - DNA, 18 bp, Homo sapiens
ttccctggctacttccct

SEQ ID NO: 5463671 - DNA, 22 bp, Homo sapiens
ttccctggctacttcccttcct

SEQ ID NO: 5463672 - DNA, 14 bp, Homo sapiens
ttccctggctcagg

SEQ ID NO: 5463673 - DNA, 15 bp, Homo sapiens
ttccctggctcaggg

SEQ ID NO: 5463674 - DNA, 16 bp, Homo sapiens
ttccctggctcaggga

SEQ ID NO: 5463675 - DNA, 17 bp, Homo sapiens
ttccctggctcagggat

SEQ ID NO: 5463676 - DNA, 14 bp, Homo sapiens
ttccctgggaaggc

SEQ ID NO: 5463677 - DNA, 14 bp, Homo sapiens
ttccctgggcctca

SEQ ID NO: 5463678 - DNA, 13 bp, Homo sapiens
ttccctgggctgc

SEQ ID NO: 5463679 - DNA, 11 bp, Homo sapiens
ttccctgggga

SEQ ID NO: 5463680 - DNA, 15 bp, Homo sapiens
ttccctggggcccca

SEQ ID NO: 5463681 - DNA, 21 bp, Homo sapiens
ttccctgggggcatcctgctt

SEQ ID NO: 5463682 - DNA, 23 bp, Homo sapiens
ttccctgggggcatcctgcttcc

SEQ ID NO: 5463683 - DNA, 21 bp, Homo sapiens
ttccctgggtggagcaggact

SEQ ID NO: 5463684 - DNA, 13 bp, Homo sapiens
ttccctgggttag

SEQ ID NO: 5463685 - DNA, 22 bp, Homo sapiens
ttccctgggtttgggagccagg

SEQ ID NO: 5463686 - DNA, 18 bp, Homo sapiens
ttccctggtaagaaaaag

SEQ ID NO: 5463687 - DNA, 23 bp, Homo sapiens
ttccctggtctggctctgctgga

SEQ ID NO: 5463688 - DNA, 16 bp, Homo sapiens
ttccctgtattttctt

SEQ ID NO: 5463689 - DNA, 16 bp, Homo sapiens
ttccctgtcagaggct

SEQ ID NO: 5463690 - DNA, 14 bp, Homo sapiens
ttccctgtgccact

SEQ ID NO: 5463691 - DNA, 12 bp, Homo sapiens
ttccctgtgctg

SEQ ID NO: 5463692 - DNA, 11 bp, Homo sapiens
ttccctgtggc

SEQ ID NO: 5463693 - DNA, 15 bp, Homo sapiens
ttccctgttctccct

SEQ ID NO: 5463694 - DNA, 19 bp, Homo sapiens
ttccctgttcttcctccag

SEQ ID NO: 5463695 - DNA, 13 bp, Homo sapiens
ttccctgttgaat

SEQ ID NO: 5463696 - DNA, 19 bp, Homo sapiens
ttccctgttttaaattata

SEQ ID NO: 5463697 - DNA, 18 bp, Homo sapiens
ttccctgttttcccccca

SEQ ID NO: 5463698 - DNA, 13 bp, Homo sapiens
ttcccttaacttt

SEQ ID NO: 5463699 - DNA, 17 bp, Homo sapiens
ttcccttacctgaaggc

SEQ ID NO: 5463700 - DNA, 21 bp, Homo sapiens
ttcccttagcctctcccaccc

SEQ ID NO: 5463701 - DNA, 15 bp, Homo sapiens
ttcccttattcctaa

SEQ ID NO: 5463702 - DNA, 15 bp, Homo sapiens
ttcccttattgcctc

SEQ ID NO: 5463703 - DNA, 22 bp, Homo sapiens
ttcccttcaaggtcatttactt

SEQ ID NO: 5463704 - DNA, 13 bp, Homo sapiens
ttcccttcagtac

SEQ ID NO: 5463705 - DNA, 15 bp, Homo sapiens
ttcccttcatctgga

SEQ ID NO: 5463706 - DNA, 16 bp, Homo sapiens
ttcccttcatctggaa

SEQ ID NO: 5463707 - DNA, 12 bp, Homo sapiens
ttcccttccaaa

SEQ ID NO: 5463708 - DNA, 15 bp, Homo sapiens
ttcccttcctcagca

SEQ ID NO: 5463709 - DNA, 14 bp, Homo sapiens
ttcccttcctccat

SEQ ID NO: 5463710 - DNA, 17 bp, Homo sapiens
ttcccttcctccatcct

SEQ ID NO: 5463711 - DNA, 21 bp, Homo sapiens
ttcccttcctcttcctgccct

SEQ ID NO: 5463712 - DNA, 17 bp, Homo sapiens
ttcccttcctcttcggc

SEQ ID NO: 5463713 - DNA, 14 bp, Homo sapiens
ttcccttcctgttc

SEQ ID NO: 5463714 - DNA, 12 bp, Homo sapiens
ttcccttccttc

SEQ ID NO: 5463715 - DNA, 19 bp, Homo sapiens
ttcccttcgacagcatttt

SEQ ID NO: 5463716 - DNA, 15 bp, Homo sapiens
ttcccttcggccaaa

SEQ ID NO: 5463717 - DNA, 21 bp, Homo sapiens
ttcccttcggccaaacagaca

SEQ ID NO: 5463718 - DNA, 21 bp, Homo sapiens
ttcccttctacaaggactcca

SEQ ID NO: 5463719 - DNA, 22 bp, Homo sapiens
ttcccttctccatctctctggc

SEQ ID NO: 5463720 - DNA, 20 bp, Homo sapiens
ttcccttctccccagccaga

SEQ ID NO: 5463721 - DNA, 16 bp, Homo sapiens
ttcccttctcccttgc

SEQ ID NO: 5463722 - DNA, 22 bp, Homo sapiens
ttcccttctcccttgccctccc

SEQ ID NO: 5463723 - DNA, 16 bp, Homo sapiens
ttcccttctctcagcc

SEQ ID NO: 5463724 - DNA, 12 bp, Homo sapiens
ttcccttctctt

SEQ ID NO: 5463725 - DNA, 15 bp, Homo sapiens
ttcccttctcttggg

SEQ ID NO: 5463726 - DNA, 13 bp, Homo sapiens
ttcccttgaccat

SEQ ID NO: 5463727 - DNA, 18 bp, Homo sapiens
ttcccttgattcaaataa

SEQ ID NO: 5463728 - DNA, 16 bp, Homo sapiens
ttcccttgcactgtat

SEQ ID NO: 5463729 - DNA, 14 bp, Homo sapiens
ttcccttgctttgt

SEQ ID NO: 5463730 - DNA, 15 bp, Homo sapiens
ttcccttggcctcag

SEQ ID NO: 5463731 - DNA, 17 bp, Homo sapiens
ttcccttggtggcaacc

SEQ ID NO: 5463732 - DNA, 16 bp, Homo sapiens
ttcccttgtaaacaga

SEQ ID NO: 5463733 - DNA, 17 bp, Homo sapiens
ttcccttgtgtcaagac

SEQ ID NO: 5463734 - DNA, 17 bp, Homo sapiens
ttccctttaaagccttt

SEQ ID NO: 5463735 - DNA, 19 bp, Homo sapiens
ttccctttacagctctcct

SEQ ID NO: 5463736 - DNA, 22 bp, Homo sapiens
ttccctttagctaagcacagat

SEQ ID NO: 5463737 - DNA, 16 bp, Homo sapiens
ttccctttatttctct

SEQ ID NO: 5463738 - DNA, 23 bp, Homo sapiens
ttccctttccccattcagtgaca

SEQ ID NO: 5463739 - DNA, 13 bp, Homo sapiens
ttccctttcctga

SEQ ID NO: 5463740 - DNA, 20 bp, Homo sapiens
ttccctttgacgccatccca

SEQ ID NO: 5463741 - DNA, 21 bp, Homo sapiens
ttccctttgacgccatcccag

SEQ ID NO: 5463742 - DNA, 23 bp, Homo sapiens
ttccctttgacttcagctgcctg

SEQ ID NO: 5463743 - DNA, 16 bp, Homo sapiens
ttccctttgctccacc

SEQ ID NO: 5463744 - DNA, 10 bp, Homo sapiens
ttccctttgg

SEQ ID NO: 5463745 - DNA, 14 bp, Homo sapiens
ttccctttgtcttt

SEQ ID NO: 5463746 - DNA, 15 bp, Homo sapiens
ttccctttgtgcaca

SEQ ID NO: 5463747 - DNA, 19 bp, Homo sapiens
ttcccttttaatcaactgt

SEQ ID NO: 5463748 - DNA, 17 bp, Homo sapiens
ttcccttttacatactg

SEQ ID NO: 5463749 - DNA, 19 bp, Homo sapiens
ttcccttttacatactgct

SEQ ID NO: 5463750 - DNA, 20 bp, Homo sapiens
ttcccttttccctcccagtt

SEQ ID NO: 5463751 - DNA, 22 bp, Homo sapiens
ttcccttttgactcttccgtgc

SEQ ID NO: 5463752 - DNA, 20 bp, Homo sapiens
ttcccttttggggcaagaca

SEQ ID NO: 5463753 - DNA, 21 bp, Homo sapiens
ttccctttttaaaaaatacca

SEQ ID NO: 5463754 - DNA, 15 bp, Homo sapiens
ttccctttttaaatg

SEQ ID NO: 5463755 - DNA, 16 bp, Homo sapiens
ttcccttttttcttcc

SEQ ID NO: 5463756 - DNA, 15 bp, Homo sapiens
ttccctttttttaag

SEQ ID NO: 5463757 - DNA, 20 bp, Homo sapiens
ttccgaaaaatcctcttcct

SEQ ID NO: 5463758 - DNA, 21 bp, Homo sapiens
ttccgaaaaatcctcttcctc

SEQ ID NO: 5463759 - DNA, 23 bp, Homo sapiens
ttccgaaaaatcctcttcctctg

SEQ ID NO: 5463760 - DNA, 20 bp, Homo sapiens
ttccgacaaccgatgctcca

SEQ ID NO: 5463761 - DNA, 23 bp, Homo sapiens
ttccgacaaccgatgctccagcc

SEQ ID NO: 5463762 - DNA, 21 bp, Homo sapiens
ttccgacacatttaccaaatt

SEQ ID NO: 5463763 - DNA, 16 bp, Homo sapiens
ttccgacatcccagac

SEQ ID NO: 5463764 - DNA, 18 bp, Homo sapiens
ttccgagatccccagggc

SEQ ID NO: 5463765 - DNA, 21 bp, Homo sapiens
ttccgagctgctttgtgggct

SEQ ID NO: 5463766 - DNA, 22 bp, Homo sapiens
ttccgatcaacatttatgacct

SEQ ID NO: 5463767 - DNA, 19 bp, Homo sapiens
ttccgcaccctccctagct

SEQ ID NO: 5463768 - DNA, 16 bp, Homo sapiens
ttccgcaccctgccta

SEQ ID NO: 5463769 - DNA, 21 bp, Homo sapiens
ttccgcactgggcacaggccg

SEQ ID NO: 5463770 - DNA, 15 bp, Homo sapiens
ttccgcactttccac

SEQ ID NO: 5463771 - DNA, 22 bp, Homo sapiens
ttccgcactttccacttcttcc

SEQ ID NO: 5463772 - DNA, 21 bp, Homo sapiens
ttccgcagcccctttccccac

SEQ ID NO: 5463773 - DNA, 17 bp, Homo sapiens
ttccgcaggcagactac

SEQ ID NO: 5463774 - DNA, 14 bp, Homo sapiens
ttccgcccctgcct

SEQ ID NO: 5463775 - DNA, 18 bp, Homo sapiens
ttccgcccctgcctgcca

SEQ ID NO: 5463776 - DNA, 12 bp, Homo sapiens
ttccgcctcact

SEQ ID NO: 5463777 - DNA, 14 bp, Homo sapiens
ttccgcctcactgg

SEQ ID NO: 5463778 - DNA, 20 bp, Homo sapiens
ttccgcgcccagcgctcgcc

SEQ ID NO: 5463779 - DNA, 21 bp, Homo sapiens
ttccgcgcccagcgctcgcca

SEQ ID NO: 5463780 - DNA, 12 bp, Homo sapiens
ttccgctgaggg

SEQ ID NO: 5463781 - DNA, 16 bp, Homo sapiens
ttccgctgtcacccag

SEQ ID NO: 5463782 - DNA, 21 bp, Homo sapiens
ttccggaatcctgtcctcagc

SEQ ID NO: 5463783 - DNA, 23 bp, Homo sapiens
ttccggattggcttgtgtgtttc

SEQ ID NO: 5463784 - DNA, 16 bp, Homo sapiens
ttccggcacactgcca

SEQ ID NO: 5463785 - DNA, 22 bp, Homo sapiens
ttccggccacatcattctgtgt

SEQ ID NO: 5463786 - DNA, 14 bp, Homo sapiens
ttccggcctgggca

SEQ ID NO: 5463787 - DNA, 19 bp, Homo sapiens
ttccgggaaaacagctatt

SEQ ID NO: 5463788 - DNA, 19 bp, Homo sapiens
ttccgggcaaatgccaggg

SEQ ID NO: 5463789 - DNA, 22 bp, Homo sapiens
ttccggggctgctggcctggcc

SEQ ID NO: 5463790 - DNA, 19 bp, Homo sapiens
ttccggtagggaggcagcc

SEQ ID NO: 5463791 - DNA, 20 bp, Homo sapiens
ttccgtaggtagatgtgtaa

SEQ ID NO: 5463792 - DNA, 16 bp, Homo sapiens
ttccgtattacatttt

SEQ ID NO: 5463793 - DNA, 16 bp, Homo sapiens
ttccgtatttaaagtt

SEQ ID NO: 5463794 - DNA, 21 bp, Homo sapiens
ttccgtcaacgttgtactgta

SEQ ID NO: 5463795 - DNA, 23 bp, Homo sapiens
ttccgtcacatatacaaaagcaa

SEQ ID NO: 5463796 - DNA, 14 bp, Homo sapiens
ttccgtcacatccc

SEQ ID NO: 5463797 - DNA, 19 bp, Homo sapiens
ttccgtcacatcccacccc

SEQ ID NO: 5463798 - DNA, 23 bp, Homo sapiens
ttccgtcacccttggtagagttt

SEQ ID NO: 5463799 - DNA, 21 bp, Homo sapiens
ttccgtcacttaaatttgttc

SEQ ID NO: 5463800 - DNA, 18 bp, Homo sapiens
ttccgtccccccccaggc

SEQ ID NO: 5463801 - DNA, 17 bp, Homo sapiens
ttccgtgaaaacggagc

SEQ ID NO: 5463802 - DNA, 15 bp, Homo sapiens
ttccgtgagacacaa

SEQ ID NO: 5463803 - DNA, 21 bp, Homo sapiens
ttccgtgagagtcatctcaaa

SEQ ID NO: 5463804 - DNA, 22 bp, Homo sapiens
ttccgtgagctatgataagatt

SEQ ID NO: 5463805 - DNA, 14 bp, Homo sapiens
ttccgtgcgtggca

SEQ ID NO: 5463806 - DNA, 19 bp, Homo sapiens
ttccgtggcaaccctcagc

SEQ ID NO: 5463807 - DNA, 15 bp, Homo sapiens
ttccgtgtccacccc

SEQ ID NO: 5463808 - DNA, 13 bp, Homo sapiens
ttccgtgtgttta

SEQ ID NO: 5463809 - DNA, 13 bp, Homo sapiens
ttccgttcatctg

SEQ ID NO: 5463810 - DNA, 20 bp, Homo sapiens
ttccgttcctccccctgctc

SEQ ID NO: 5463811 - DNA, 13 bp, Homo sapiens
ttccgtttacatt

SEQ ID NO: 5463812 - DNA, 14 bp, Homo sapiens
ttcctaaaacaccc

SEQ ID NO: 5463813 - DNA, 12 bp, Homo sapiens
ttcctaaaacag

SEQ ID NO: 5463814 - DNA, 15 bp, Homo sapiens
ttcctaaacataatt

SEQ ID NO: 5463815 - DNA, 18 bp, Homo sapiens
ttcctaaacataattgtg

SEQ ID NO: 5463816 - DNA, 14 bp, Homo sapiens
ttcctaaactccct

SEQ ID NO: 5463817 - DNA, 17 bp, Homo sapiens
ttcctaaactctgaaat

SEQ ID NO: 5463818 - DNA, 13 bp, Homo sapiens
ttcctaaagaaaa

SEQ ID NO: 5463819 - DNA, 13 bp, Homo sapiens
ttcctaaagccaa

SEQ ID NO: 5463820 - DNA, 20 bp, Homo sapiens
ttcctaaagccatcatgcct

SEQ ID NO: 5463821 - DNA, 19 bp, Homo sapiens
ttcctaaagtctctgctgc

SEQ ID NO: 5463822 - DNA, 13 bp, Homo sapiens
ttcctaaatatcc

SEQ ID NO: 5463823 - DNA, 16 bp, Homo sapiens
ttcctaaatcagcatt

SEQ ID NO: 5463824 - DNA, 16 bp, Homo sapiens
ttcctaaatgcagtga

SEQ ID NO: 5463825 - DNA, 16 bp, Homo sapiens
ttcctaacaaaatgag

SEQ ID NO: 5463826 - DNA, 17 bp, Homo sapiens
ttcctaacctgtcagaa

SEQ ID NO: 5463827 - DNA, 15 bp, Homo sapiens
ttcctaactagaatt

SEQ ID NO: 5463828 - DNA, 14 bp, Homo sapiens
ttcctaactgtgat

SEQ ID NO: 5463829 - DNA, 15 bp, Homo sapiens
ttcctaactgtgatt

SEQ ID NO: 5463830 - DNA, 13 bp, Homo sapiens
ttcctaacttatt

SEQ ID NO: 5463831 - DNA, 16 bp, Homo sapiens
ttcctaacttccttta

SEQ ID NO: 5463832 - DNA, 22 bp, Homo sapiens
ttcctaagacatttttcattca

SEQ ID NO: 5463833 - DNA, 13 bp, Homo sapiens
ttcctaagccact

SEQ ID NO: 5463834 - DNA, 19 bp, Homo sapiens
ttcctaagcctgtggctgt

SEQ ID NO: 5463835 - DNA, 18 bp, Homo sapiens
ttcctaaggaaactgctt

SEQ ID NO: 5463836 - DNA, 17 bp, Homo sapiens
ttcctaaggcacccaca

SEQ ID NO: 5463837 - DNA, 13 bp, Homo sapiens
ttcctaaggcatg

SEQ ID NO: 5463838 - DNA, 21 bp, Homo sapiens
ttcctaaggcccagctgccag

SEQ ID NO: 5463839 - DNA, 23 bp, Homo sapiens
ttcctaaggcccagctgccaggg

SEQ ID NO: 5463840 - DNA, 22 bp, Homo sapiens
ttcctaagtagctgggtttaca

SEQ ID NO: 5463841 - DNA, 16 bp, Homo sapiens
ttcctgtcttccaaat

SEQ ID NO: 5463842 - DNA, 24 bp, Homo sapiens
ttcctgtgaagtttaattgtctca

SEQ ID NO: 5463843 - DNA, 11 bp, Homo sapiens
ttcctgtgaca

SEQ ID NO: 5463844 - DNA, 17 bp, Homo sapiens
ttcctgtgactgttttt

SEQ ID NO: 5463845 - DNA, 12 bp, Homo sapiens
ttcctgtgagga

SEQ ID NO: 5463846 - DNA, 14 bp, Homo sapiens
ttcctgtgcacagc

SEQ ID NO: 5463847 - DNA, 17 bp, Homo sapiens
ttcctgtgccaggactc

SEQ ID NO: 5463848 - DNA, 16 bp, Homo sapiens
ttcctgtgccaggtga

SEQ ID NO: 5463849 - DNA, 15 bp, Homo sapiens
ttcctgtgccctcac

SEQ ID NO: 5463850 - DNA, 17 bp, Homo sapiens
ttcctgtgccctcaccc

SEQ ID NO: 5463851 - DNA, 18 bp, Homo sapiens
ttcctgtgcctttcctat

SEQ ID NO: 5463852 - DNA, 13 bp, Homo sapiens
ttcctgtggaaat

SEQ ID NO: 5463853 - DNA, 14 bp, Homo sapiens
ttcctgtggaaata

SEQ ID NO: 5463854 - DNA, 18 bp, Homo sapiens
ttcctgtggaaatatgca

SEQ ID NO: 5463855 - DNA, 19 bp, Homo sapiens
ttcctgtggaaatatgcaa

SEQ ID NO: 5463856 - DNA, 21 bp, Homo sapiens
ttcctgtggatgtaaagtgat

SEQ ID NO: 5463857 - DNA, 13 bp, Homo sapiens
ttcctgtggctcc

SEQ ID NO: 5463858 - DNA, 17 bp, Homo sapiens
ttcctgtgggccaggag

SEQ ID NO: 5463859 - DNA, 23 bp, Homo sapiens
ttcctgtgggccaggagctcagc

SEQ ID NO: 5463860 - DNA, 20 bp, Homo sapiens
ttcctgtgggtgttctttcc

SEQ ID NO: 5463861 - DNA, 22 bp, Homo sapiens
ttcctgtggttttattacaaat

SEQ ID NO: 5463862 - DNA, 18 bp, Homo sapiens
ttcctgtgtattctcatt

SEQ ID NO: 5463863 - DNA, 11 bp, Homo sapiens
ttcctgtgtca

SEQ ID NO: 5463864 - DNA, 11 bp, Homo sapiens
ttcctgtgtcc

SEQ ID NO: 5463865 - DNA, 14 bp, Homo sapiens
ttcctgtgtccaca

SEQ ID NO: 5463866 - DNA, 12 bp, Homo sapiens
ttcctgtgtctc

SEQ ID NO: 5463867 - DNA, 21 bp, Homo sapiens
ttcctgtgtgtactctgtcca

SEQ ID NO: 5463868 - DNA, 21 bp, Homo sapiens
ttcctgtgtgtccaaaactgc

SEQ ID NO: 5463869 - DNA, 10 bp, Homo sapiens
ttcctgtgtt

SEQ ID NO: 5463870 - DNA, 15 bp, Homo sapiens
ttcctgttcagcatt

SEQ ID NO: 5463871 - DNA, 21 bp, Homo sapiens
ttcctgttcagcattcttagc

SEQ ID NO: 5463872 - DNA, 14 bp, Homo sapiens
ttcctgttcagtaa

SEQ ID NO: 5463873 - DNA, 14 bp, Homo sapiens
ttcctgttccctcc

SEQ ID NO: 5463874 - DNA, 17 bp, Homo sapiens
ttcctgttctcagcatc

SEQ ID NO: 5463875 - DNA, 13 bp, Homo sapiens
ttcctgttctgaa

SEQ ID NO: 5463876 - DNA, 16 bp, Homo sapiens
ttcctgttctgtgtct

SEQ ID NO: 5463877 - DNA, 15 bp, Homo sapiens
ttcctgttgctctgt

SEQ ID NO: 5463878 - DNA, 19 bp, Homo sapiens
ttcctgttgctgtcttcag

SEQ ID NO: 5463879 - DNA, 23 bp, Homo sapiens
ttcctgttggaaggtagagccca

SEQ ID NO: 5463880 - DNA, 19 bp, Homo sapiens
ttcctgttggatttgttta

SEQ ID NO: 5463881 - DNA, 15 bp, Homo sapiens
ttcctgttggtttca

SEQ ID NO: 5463882 - DNA, 15 bp, Homo sapiens
ttcctgttgtgtaat

SEQ ID NO: 5463883 - DNA, 13 bp, Homo sapiens
ttcctgtttcaag

SEQ ID NO: 5463884 - DNA, 12 bp, Homo sapiens
ttcctgtttcta

SEQ ID NO: 5463885 - DNA, 13 bp, Homo sapiens
ttcctgtttgaaa

SEQ ID NO: 5463886 - DNA, 19 bp, Homo sapiens
ttcctgttttaagcagctc

SEQ ID NO: 5463887 - DNA, 22 bp, Homo sapiens
ttcctgttttgtacatagattt

SEQ ID NO: 5463888 - DNA, 22 bp, Homo sapiens
ttcctgtttttattattaacaa

SEQ ID NO: 5463889 - DNA, 19 bp, Homo sapiens
ttcctgtttttcacatttt

SEQ ID NO: 5463890 - DNA, 23 bp, Homo sapiens
ttcctgtttttcacattttcctt

SEQ ID NO: 5463891 - DNA, 22 bp, Homo sapiens
ttccttaaaatgtgagtgacct

SEQ ID NO: 5463892 - DNA, 15 bp, Homo sapiens
ttccttaaatgaact

SEQ ID NO: 5463893 - DNA, 18 bp, Homo sapiens
ttccttaaatgaactact

SEQ ID NO: 5463894 - DNA, 21 bp, Homo sapiens
ttccttaaatgaactactgct

SEQ ID NO: 5463895 - DNA, 22 bp, Homo sapiens
ttccttaaatgaactactgcta

SEQ ID NO: 5463896 - DNA, 17 bp, Homo sapiens
ttccttaaatgactttt

SEQ ID NO: 5463897 - DNA, 13 bp, Homo sapiens
ttccttaagagct

SEQ ID NO: 5463898 - DNA, 14 bp, Homo sapiens
ttccttaagagcta

SEQ ID NO: 5463899 - DNA, 12 bp, Homo sapiens
ttccttaagtat

SEQ ID NO: 5463900 - DNA, 20 bp, Homo sapiens
ttccttaagtatatcatgta

SEQ ID NO: 5463901 - DNA, 20 bp, Homo sapiens
ttccttaagtcagaacagca

SEQ ID NO: 5463902 - DNA, 18 bp, Homo sapiens
ttccttaagtggctgtga

SEQ ID NO: 5463903 - DNA, 17 bp, Homo sapiens
ttccttacataaacatc

SEQ ID NO: 5463904 - DNA, 13 bp, Homo sapiens
ttccttacctttt

SEQ ID NO: 5463905 - DNA, 15 bp, Homo sapiens
ttccttactagaaat

SEQ ID NO: 5463906 - DNA, 22 bp, Homo sapiens
ttccttagactcttttccttcc

SEQ ID NO: 5463907 - DNA, 14 bp, Homo sapiens
ttccttagatacct

SEQ ID NO: 5463908 - DNA, 16 bp, Homo sapiens
ttccttagcagctcag

SEQ ID NO: 5463909 - DNA, 16 bp, Homo sapiens
ttccttagcagcttct

SEQ ID NO: 5463910 - DNA, 17 bp, Homo sapiens
ttccttagctatttatc

SEQ ID NO: 5463911 - DNA, 13 bp, Homo sapiens
ttccttagctgta

SEQ ID NO: 5463912 - DNA, 22 bp, Homo sapiens
ttccttatagggaaaaatgcaa

SEQ ID NO: 5463913 - DNA, 15 bp, Homo sapiens
ttccttatcagaggc

SEQ ID NO: 5463914 - DNA, 18 bp, Homo sapiens
ttccttatccctctcttc

SEQ ID NO: 5463915 - DNA, 19 bp, Homo sapiens
ttccttatccctctcttcc

SEQ ID NO: 5463916 - DNA, 23 bp, Homo sapiens
ttccttatccctctcttcccctt

SEQ ID NO: 5463917 - DNA, 23 bp, Homo sapiens
ttccttatgtatatttaaaagaa

SEQ ID NO: 5463918 - DNA, 21 bp, Homo sapiens
ttccttatgtatcagtgtcct

SEQ ID NO: 5463919 - DNA, 17 bp, Homo sapiens
ttccttatttctctctc

SEQ ID NO: 5463920 - DNA, 19 bp, Homo sapiens
ttccttatttctctctcct

SEQ ID NO: 5463921 - DNA, 15 bp, Homo sapiens
ttccttatttgcctt

SEQ ID NO: 5463922 - DNA, 20 bp, Homo sapiens
ttccttatttgcttcattgt

SEQ ID NO: 5463923 - DNA, 20 bp, Homo sapiens
ttccttcaaataaagaaatt

SEQ ID NO: 5463924 - DNA, 19 bp, Homo sapiens
ttccttcaaatcctgccac

SEQ ID NO: 5463925 - DNA, 14 bp, Homo sapiens
ttccttcaagaatg

SEQ ID NO: 5463926 - DNA, 14 bp, Homo sapiens
ttccttcacccacc

SEQ ID NO: 5463927 - DNA, 16 bp, Homo sapiens
ttccttcactgcccca

SEQ ID NO: 5463928 - DNA, 19 bp, Homo sapiens
ttccttcagcactttagaa

SEQ ID NO: 5463929 - DNA, 13 bp, Homo sapiens
ttccttcaggttt

SEQ ID NO: 5463930 - DNA, 20 bp, Homo sapiens
ttccttcagtttgtaaagtc

SEQ ID NO: 5463931 - DNA, 14 bp, Homo sapiens
ttccttcataattt

SEQ ID NO: 5463932 - DNA, 18 bp, Homo sapiens
ttccttcataattttcaa

SEQ ID NO: 5463933 - DNA, 19 bp, Homo sapiens
ttccttcattcaacccacc

SEQ ID NO: 5463934 - DNA, 20 bp, Homo sapiens
ttccttccaaggtcactctt

SEQ ID NO: 5463935 - DNA, 12 bp, Homo sapiens
ttccttccacag

SEQ ID NO: 5463936 - DNA, 15 bp, Homo sapiens
ttccttccactaact

SEQ ID NO: 5463937 - DNA, 16 bp, Homo sapiens
ttccttccactgtagc

SEQ ID NO: 5463938 - DNA, 17 bp, Homo sapiens
ttccttccactgtagct

SEQ ID NO: 5463939 - DNA, 15 bp, Homo sapiens
ttccttccagaagag

SEQ ID NO: 5463940 - DNA, 14 bp, Homo sapiens
ttccttccagccca

SEQ ID NO: 5463941 - DNA, 21 bp, Homo sapiens
ttccttccatcaaaagatgta

SEQ ID NO: 5463942 - DNA, 19 bp, Homo sapiens
ttccttccatgctcccaac

SEQ ID NO: 5463943 - DNA, 21 bp, Homo sapiens
ttccttcccaactcactgtgc

SEQ ID NO: 5463944 - DNA, 16 bp, Homo sapiens
ttccttcccaggccct

SEQ ID NO: 5463945 - DNA, 20 bp, Homo sapiens
ttccttcccaggccctttgg

SEQ ID NO: 5463946 - DNA, 14 bp, Homo sapiens
ttccttccctctcc

SEQ ID NO: 5463947 - DNA, 15 bp, Homo sapiens
ttccttccctctctg

SEQ ID NO: 5463948 - DNA, 21 bp, Homo sapiens
ttccttccctgggctgtgcta

SEQ ID NO: 5463949 - DNA, 12 bp, Homo sapiens
ttccttcctaaa

SEQ ID NO: 5463950 - DNA, 17 bp, Homo sapiens
ttccttcctaaaataat

SEQ ID NO: 5463951 - DNA, 16 bp, Homo sapiens
ttccttcctccactgc

SEQ ID NO: 5463952 - DNA, 14 bp, Homo sapiens
ttccttcctccttt

SEQ ID NO: 5463953 - DNA, 23 bp, Homo sapiens
ttccttcctgcagacctggctgg

SEQ ID NO: 5463954 - DNA, 13 bp, Homo sapiens
ttccttcctgccc

SEQ ID NO: 5463955 - DNA, 14 bp, Homo sapiens
ttccttcctgttct

SEQ ID NO: 5463956 - DNA, 10 bp, Homo sapiens
ttccttcctt

SEQ ID NO: 5463957 - DNA, 18 bp, Homo sapiens
ttccttcgaaaggccttc

SEQ ID NO: 5463958 - DNA, 16 bp, Homo sapiens
ttccttctcatctgtg

SEQ ID NO: 5463959 - DNA, 21 bp, Homo sapiens
ttccttctcatcttgcctcat

SEQ ID NO: 5463960 - DNA, 19 bp, Homo sapiens
ttccttctcgtcttcctct

SEQ ID NO: 5463961 - DNA, 16 bp, Homo sapiens
ttccttctctgaaagt

SEQ ID NO: 5463962 - DNA, 16 bp, Homo sapiens
ttccttctctgaacac

SEQ ID NO: 5463963 - DNA, 20 bp, Homo sapiens
ttccttctgaagtctgagcc

SEQ ID NO: 5463964 - DNA, 13 bp, Homo sapiens
ttccttctgccct

SEQ ID NO: 5463965 - DNA, 13 bp, Homo sapiens
ttccttctgtaaa

SEQ ID NO: 5463966 - DNA, 14 bp, Homo sapiens
ttccttctgtagcc

SEQ ID NO: 5463967 - DNA, 20 bp, Homo sapiens
ttccttctgtgaaagtacat

SEQ ID NO: 5463968 - DNA, 14 bp, Homo sapiens
ttccttctgtgaag

SEQ ID NO: 5463969 - DNA, 18 bp, Homo sapiens
ttccttctttctcttccc

SEQ ID NO: 5463970 - DNA, 22 bp, Homo sapiens
ttccttctttgataatgttaaa

SEQ ID NO: 5463971 - DNA, 20 bp, Homo sapiens
ttccttctttgccctttact

SEQ ID NO: 5463972 - DNA, 23 bp, Homo sapiens
ttccttgaaccctaataagaccc

SEQ ID NO: 5463973 - DNA, 20 bp, Homo sapiens
ttccttgaccactggccctg

SEQ ID NO: 5463974 - DNA, 15 bp, Homo sapiens
ttccttgaccagcag

SEQ ID NO: 5463975 - DNA, 19 bp, Homo sapiens
ttccttgaccttcctctgg

SEQ ID NO: 5463976 - DNA, 17 bp, Homo sapiens
ttccttgagaaaaacaa

SEQ ID NO: 5463977 - DNA, 13 bp, Homo sapiens
ttccttgaggaca

SEQ ID NO: 5463978 - DNA, 21 bp, Homo sapiens
ttccttgagttgattcagctc

SEQ ID NO: 5463979 - DNA, 15 bp, Homo sapiens
ttccttgataatgtt

SEQ ID NO: 5463980 - DNA, 14 bp, Homo sapiens
ttccttgatcattt

SEQ ID NO: 5463981 - DNA, 13 bp, Homo sapiens
ttccttgcataca

SEQ ID NO: 5463982 - DNA, 14 bp, Homo sapiens
ttccttgccagtct

SEQ ID NO: 5463983 - DNA, 20 bp, Homo sapiens
ttccttgccccacagttgtg

SEQ ID NO: 5463984 - DNA, 16 bp, Homo sapiens
ttccttgcccctgctc

SEQ ID NO: 5463985 - DNA, 13 bp, Homo sapiens
ttccttgccttaa

SEQ ID NO: 5463986 - DNA, 13 bp, Homo sapiens
ttccttgctaatg

SEQ ID NO: 5463987 - DNA, 16 bp, Homo sapiens
ttccttgctctgcacc

SEQ ID NO: 5463988 - DNA, 17 bp, Homo sapiens
ttccttgctttctcttc

SEQ ID NO: 5463989 - DNA, 23 bp, Homo sapiens
ttccttgcttttatgtttgtaca

SEQ ID NO: 5463990 - DNA, 18 bp, Homo sapiens
ttccttggcatgccttcc

SEQ ID NO: 5463991 - DNA, 14 bp, Homo sapiens
ttccttggcccagc

SEQ ID NO: 5463992 - DNA, 13 bp, Homo sapiens
ttccttgggcaga

SEQ ID NO: 5463993 - DNA, 16 bp, Homo sapiens
ttccttgggcgtctcc

SEQ ID NO: 5463994 - DNA, 17 bp, Homo sapiens
ttccttgggcgtctccc

SEQ ID NO: 5463995 - DNA, 20 bp, Homo sapiens
ttccttgggcgtctccccca

SEQ ID NO: 5463996 - DNA, 10 bp, Homo sapiens
ttccttgggg

SEQ ID NO: 5463997 - DNA, 15 bp, Homo sapiens
ttccttggggcaggc

SEQ ID NO: 5463998 - DNA, 17 bp, Homo sapiens
ttccttggggcaggcag

SEQ ID NO: 5463999 - DNA, 23 bp, Homo sapiens
ttccttggggggccaaagaaggc

SEQ ID NO: 5464000 - DNA, 12 bp, Homo sapiens
ttccttgtactc

SEQ ID NO: 5464001 - DNA, 14 bp, Homo sapiens
ttccttgtactctt

SEQ ID NO: 5464002 - DNA, 15 bp, Homo sapiens
ttccttgtactctta

SEQ ID NO: 5464003 - DNA, 17 bp, Homo sapiens
ttccttgtactcttagg

SEQ ID NO: 5464004 - DNA, 19 bp, Homo sapiens
ttccttgtactcttaggat

SEQ ID NO: 5464005 - DNA, 20 bp, Homo sapiens
ttccttgtagccttttgact

SEQ ID NO: 5464006 - DNA, 16 bp, Homo sapiens
ttccttgtcaccagca

SEQ ID NO: 5464007 - DNA, 20 bp, Homo sapiens
ttccttgtccccacactcct

SEQ ID NO: 5464008 - DNA, 13 bp, Homo sapiens
ttccttgtctctg

SEQ ID NO: 5464009 - DNA, 12 bp, Homo sapiens
ttccttgtgctc

SEQ ID NO: 5464010 - DNA, 21 bp, Homo sapiens
ttccttgttacccatgaaaaa

SEQ ID NO: 5464011 - DNA, 21 bp, Homo sapiens
ttccttgtttatcagatacat

SEQ ID NO: 5464012 - DNA, 17 bp, Homo sapiens
ttcctttaaaaaaattt

SEQ ID NO: 5464013 - DNA, 15 bp, Homo sapiens
ttcctttaaaaaact

SEQ ID NO: 5464014 - DNA, 15 bp, Homo sapiens
ttcctttaaatactc

SEQ ID NO: 5464015 - DNA, 22 bp, Homo sapiens
ttcctttaaatactcccttttt

SEQ ID NO: 5464016 - DNA, 19 bp, Homo sapiens
ttcctttaaatggtaagag

SEQ ID NO: 5464017 - DNA, 19 bp, Homo sapiens
ttcctttaacaacatgttt

SEQ ID NO: 5464018 - DNA, 22 bp, Homo sapiens
ttcctttaacaacatgtttcca

SEQ ID NO: 5464019 - DNA, 13 bp, Homo sapiens
ttcctttactttc

SEQ ID NO: 5464020 - DNA, 15 bp, Homo sapiens
ttcctttactttccc

SEQ ID NO: 5464021 - DNA, 22 bp, Homo sapiens
ttctaactacaaaggtttaaat

SEQ ID NO: 5464022 - DNA, 20 bp, Homo sapiens
ttctaactctagtttgcaga

SEQ ID NO: 5464023 - DNA, 18 bp, Homo sapiens
ttctaactctattaatga

SEQ ID NO: 5464024 - DNA, 13 bp, Homo sapiens
ttctaactgtaaa

SEQ ID NO: 5464025 - DNA, 15 bp, Homo sapiens
ttctaactgtaaatc

SEQ ID NO: 5464026 - DNA, 19 bp, Homo sapiens
ttctaactgtaaatcactt

SEQ ID NO: 5464027 - DNA, 12 bp, Homo sapiens
ttctaacttttc

SEQ ID NO: 5464028 - DNA, 18 bp, Homo sapiens
ttctaagaaaagcatttt

SEQ ID NO: 5464029 - DNA, 18 bp, Homo sapiens
ttctaagaaatagagcca

SEQ ID NO: 5464030 - DNA, 18 bp, Homo sapiens
ttctaagaaatatctgtg

SEQ ID NO: 5464031 - DNA, 17 bp, Homo sapiens
ttctaagaaccaaaaaa

SEQ ID NO: 5464032 - DNA, 23 bp, Homo sapiens
ttctaagaagtgaaaatctacac

SEQ ID NO: 5464033 - DNA, 16 bp, Homo sapiens
ttctaagaagttactt

SEQ ID NO: 5464034 - DNA, 16 bp, Homo sapiens
ttctaagacagttttt

SEQ ID NO: 5464035 - DNA, 12 bp, Homo sapiens
ttctaagactca

SEQ ID NO: 5464036 - DNA, 16 bp, Homo sapiens
ttctaagactcaaatg

SEQ ID NO: 5464037 - DNA, 20 bp, Homo sapiens
ttctaagactcaaatgttct

SEQ ID NO: 5464038 - DNA, 21 bp, Homo sapiens
ttctaagactcaaatgttcta

SEQ ID NO: 5464039 - DNA, 17 bp, Homo sapiens
ttctaagactctgtgtg

SEQ ID NO: 5464040 - DNA, 20 bp, Homo sapiens
ttctaagacttactctaaga

SEQ ID NO: 5464041 - DNA, 13 bp, Homo sapiens
ttctaagagaagt

SEQ ID NO: 5464042 - DNA, 16 bp, Homo sapiens
ttctaagagcatagaa

SEQ ID NO: 5464043 - DNA, 21 bp, Homo sapiens
ttctaagatgtgatattctaa

SEQ ID NO: 5464044 - DNA, 12 bp, Homo sapiens
ttctaagatgtt

SEQ ID NO: 5464045 - DNA, 13 bp, Homo sapiens
ttctaagattcta

SEQ ID NO: 5464046 - DNA, 17 bp, Homo sapiens
ttctaagattctaaagg

SEQ ID NO: 5464047 - DNA, 14 bp, Homo sapiens
ttctaagattctga

SEQ ID NO: 5464048 - DNA, 21 bp, Homo sapiens
ttctaagcttatttctaacta

SEQ ID NO: 5464049 - DNA, 23 bp, Homo sapiens
ttctaaggaaatggagaagctct

SEQ ID NO: 5464050 - DNA, 14 bp, Homo sapiens
ttctaaggaatgca

SEQ ID NO: 5464051 - DNA, 21 bp, Homo sapiens
ttctaaggacctgaaattcca

SEQ ID NO: 5464052 - DNA, 23 bp, Homo sapiens
ttctaaggacctgaaattccaaa

SEQ ID NO: 5464053 - DNA, 15 bp, Homo sapiens
ttctaaggacttttt

SEQ ID NO: 5464054 - DNA, 21 bp, Homo sapiens
ttctaaggactttttcttagg

SEQ ID NO: 5464055 - DNA, 23 bp, Homo sapiens
ttctaaggactttttcttaggtt

SEQ ID NO: 5464056 - DNA, 23 bp, Homo sapiens
ttctaaggagtaacttgcaagtt

SEQ ID NO: 5464057 - DNA, 20 bp, Homo sapiens
ttctaaggatagcctttgta

SEQ ID NO: 5464058 - DNA, 23 bp, Homo sapiens
ttctaaggcaggaatttgagagt

SEQ ID NO: 5464059 - DNA, 15 bp, Homo sapiens
ttctaaggcctagga

SEQ ID NO: 5464060 - DNA, 17 bp, Homo sapiens
ttctaaggcctaggatt

SEQ ID NO: 5464061 - DNA, 18 bp, Homo sapiens
ttctaaggctctgagagt

SEQ ID NO: 5464062 - DNA, 20 bp, Homo sapiens
ttctaaggctctgagagtct

SEQ ID NO: 5464063 - DNA, 17 bp, Homo sapiens
ttctaagggaaaaagtt

SEQ ID NO: 5464064 - DNA, 21 bp, Homo sapiens
ttctaagggaggcacttcctc

SEQ ID NO: 5464065 - DNA, 17 bp, Homo sapiens
ttctaagggatccagag

SEQ ID NO: 5464066 - DNA, 22 bp, Homo sapiens
ttctaagggatccagagacctg

SEQ ID NO: 5464067 - DNA, 20 bp, Homo sapiens
ttctaaggtccggtgttcta

SEQ ID NO: 5464068 - DNA, 21 bp, Homo sapiens
ttctaaggtccggtgttctaa

SEQ ID NO: 5464069 - DNA, 12 bp, Homo sapiens
ttctaaggtgtg

SEQ ID NO: 5464070 - DNA, 20 bp, Homo sapiens
ttctaagtaaaaccacagca

SEQ ID NO: 5464071 - DNA, 24 bp, Homo sapiens
ttctaagtaaaaccacagcagttg

SEQ ID NO: 5464072 - DNA, 20 bp, Homo sapiens
ttctaagtaaatacaatttt

SEQ ID NO: 5464073 - DNA, 17 bp, Homo sapiens
ttctaagtctttccatt

SEQ ID NO: 5464074 - DNA, 15 bp, Homo sapiens
ttctaagtgagatgt

SEQ ID NO: 5464075 - DNA, 17 bp, Homo sapiens
ttctaagtggcgtgtgc

SEQ ID NO: 5464076 - DNA, 15 bp, Homo sapiens
ttctaagtgtaacct

SEQ ID NO: 5464077 - DNA, 16 bp, Homo sapiens
ttctaagtgtaacctc

SEQ ID NO: 5464078 - DNA, 14 bp, Homo sapiens
ttctaagtgtactt

SEQ ID NO: 5464079 - DNA, 21 bp, Homo sapiens
ttctaagttcatgtttgtaaa

SEQ ID NO: 5464080 - DNA, 20 bp, Homo sapiens
ttctaagttgagtatattat

SEQ ID NO: 5464081 - DNA, 13 bp, Homo sapiens
ttctaataaagta

SEQ ID NO: 5464082 - DNA, 19 bp, Homo sapiens
ttctaataaatcaatgtga

SEQ ID NO: 5464083 - DNA, 16 bp, Homo sapiens
ttctaataaattatac

SEQ ID NO: 5464084 - DNA, 14 bp, Homo sapiens
ttctaataactgca

SEQ ID NO: 5464085 - DNA, 19 bp, Homo sapiens
ttctaataagctagttgaa

SEQ ID NO: 5464086 - DNA, 23 bp, Homo sapiens
ttctaataagctagttgaatact

SEQ ID NO: 5464087 - DNA, 17 bp, Homo sapiens
ttctaatacaagcatat

SEQ ID NO: 5464088 - DNA, 19 bp, Homo sapiens
ttctaatacactctaaatt

SEQ ID NO: 5464089 - DNA, 22 bp, Homo sapiens
ttctaatactttgtttattgta

SEQ ID NO: 5464090 - DNA, 14 bp, Homo sapiens
ttctaatagtttta

SEQ ID NO: 5464091 - DNA, 22 bp, Homo sapiens
ttctaatatccaacacaactat

SEQ ID NO: 5464092 - DNA, 15 bp, Homo sapiens
ttctaatcataacat

SEQ ID NO: 5464093 - DNA, 16 bp, Homo sapiens
ttctaatctctttatt

SEQ ID NO: 5464094 - DNA, 13 bp, Homo sapiens
ttctaatctgcta

SEQ ID NO: 5464095 - DNA, 16 bp, Homo sapiens
ttctaatcttaaatca

SEQ ID NO: 5464096 - DNA, 23 bp, Homo sapiens
ttctaatcttgttaaattgctta

SEQ ID NO: 5464097 - DNA, 10 bp, Homo sapiens
ttctaatgac

SEQ ID NO: 5464098 - DNA, 11 bp, Homo sapiens
ttctaatgacc

SEQ ID NO: 5464099 - DNA, 16 bp, Homo sapiens
ttctaatgacccagat

SEQ ID NO: 5464100 - DNA, 12 bp, Homo sapiens
ttctaatgcata

SEQ ID NO: 5464101 - DNA, 16 bp, Homo sapiens
ttctaatgctgatatg

SEQ ID NO: 5464102 - DNA, 13 bp, Homo sapiens
ttctaatgctgca

SEQ ID NO: 5464103 - DNA, 16 bp, Homo sapiens
ttctaatggaatggtt

SEQ ID NO: 5464104 - DNA, 22 bp, Homo sapiens
ttctaatggtaacttttgtagt

SEQ ID NO: 5464105 - DNA, 14 bp, Homo sapiens
ttctaatgtttact

SEQ ID NO: 5464106 - DNA, 15 bp, Homo sapiens
ttctaatgtttacta

SEQ ID NO: 5464107 - DNA, 13 bp, Homo sapiens
ttctaattaaaga

SEQ ID NO: 5464108 - DNA, 16 bp, Homo sapiens
ttctaattagattaac

SEQ ID NO: 5464109 - DNA, 16 bp, Homo sapiens
ttctaattatgtagct

SEQ ID NO: 5464110 - DNA, 23 bp, Homo sapiens
ttctaattatgtagctctttgtc

SEQ ID NO: 5464111 - DNA, 17 bp, Homo sapiens
ttctaattcctgtttgt

SEQ ID NO: 5464112 - DNA, 17 bp, Homo sapiens
ttctaattcttcattat

SEQ ID NO: 5464113 - DNA, 17 bp, Homo sapiens
ttctaattggcatgaag

SEQ ID NO: 5464114 - DNA, 18 bp, Homo sapiens
ttctaattggctttacta

SEQ ID NO: 5464115 - DNA, 22 bp, Homo sapiens
ttctaattggtttttactgaaa

SEQ ID NO: 5464116 - DNA, 18 bp, Homo sapiens
ttctaattgttttgtgtg

SEQ ID NO: 5464117 - DNA, 14 bp, Homo sapiens
ttctaatttatatt

SEQ ID NO: 5464118 - DNA, 20 bp, Homo sapiens
ttctaatttatattatccat

SEQ ID NO: 5464119 - DNA, 18 bp, Homo sapiens
ttctaatttattttctca

SEQ ID NO: 5464120 - DNA, 19 bp, Homo sapiens
ttctaatttattttctcaa

SEQ ID NO: 5464121 - DNA, 21 bp, Homo sapiens
ttctaatttcaaaaatataac

SEQ ID NO: 5464122 - DNA, 21 bp, Homo sapiens
ttctaatttgcactaatgtgt

SEQ ID NO: 5464123 - DNA, 21 bp, Homo sapiens
ttctacaaagcactagagaat

SEQ ID NO: 5464124 - DNA, 15 bp, Homo sapiens
ttctacaaccagagc

SEQ ID NO: 5464125 - DNA, 16 bp, Homo sapiens
ttctacaaccagagcc

SEQ ID NO: 5464126 - DNA, 23 bp, Homo sapiens
ttctacaaccagagccccccaca

SEQ ID NO: 5464127 - DNA, 16 bp, Homo sapiens
ttctacaaggactcca

SEQ ID NO: 5464128 - DNA, 22 bp, Homo sapiens
ttctacaaggactccattggat

SEQ ID NO: 5464129 - DNA, 16 bp, Homo sapiens
ttctacaataatttgt

SEQ ID NO: 5464130 - DNA, 21 bp, Homo sapiens
ttctacaatacaacacattga

SEQ ID NO: 5464131 - DNA, 17 bp, Homo sapiens
ttctacaatctatttat

SEQ ID NO: 5464132 - DNA, 20 bp, Homo sapiens
ttctacacactcagccacaa

SEQ ID NO: 5464133 - DNA, 17 bp, Homo sapiens
ttctacacatgtaaaat

SEQ ID NO: 5464134 - DNA, 18 bp, Homo sapiens
ttctacacatttcatcta

SEQ ID NO: 5464135 - DNA, 19 bp, Homo sapiens
ttctacacatttcatctaa

SEQ ID NO: 5464136 - DNA, 20 bp, Homo sapiens
ttctacacatttcatctaat

SEQ ID NO: 5464137 - DNA, 16 bp, Homo sapiens
ttctacacctggacca

SEQ ID NO: 5464138 - DNA, 22 bp, Homo sapiens
ttctacacctgttgcacctcag

SEQ ID NO: 5464139 - DNA, 16 bp, Homo sapiens
ttctacacgtcctttc

SEQ ID NO: 5464140 - DNA, 17 bp, Homo sapiens
ttctacactctcctggg

SEQ ID NO: 5464141 - DNA, 23 bp, Homo sapiens
ttctacactgggtgctgatcctt

SEQ ID NO: 5464142 - DNA, 18 bp, Homo sapiens
ttctacagaacctgaggg

SEQ ID NO: 5464143 - DNA, 13 bp, Homo sapiens
ttctacagaataa

SEQ ID NO: 5464144 - DNA, 16 bp, Homo sapiens
ttctacagcaaattta

SEQ ID NO: 5464145 - DNA, 15 bp, Homo sapiens
ttctacagtggtttt

SEQ ID NO: 5464146 - DNA, 16 bp, Homo sapiens
ttctacatgactgggc

SEQ ID NO: 5464147 - DNA, 22 bp, Homo sapiens
ttctacatgactgggcctccct

SEQ ID NO: 5464148 - DNA, 14 bp, Homo sapiens
ttctacatggcttt

SEQ ID NO: 5464149 - DNA, 20 bp, Homo sapiens
ttctacattcagattatatg

SEQ ID NO: 5464150 - DNA, 20 bp, Homo sapiens
ttctacatttgagggcccag

SEQ ID NO: 5464151 - DNA, 22 bp, Homo sapiens
ttctaccaccgcatcctcactg

SEQ ID NO: 5464152 - DNA, 17 bp, Homo sapiens
ttctaccactggtgtaa

SEQ ID NO: 5464153 - DNA, 15 bp, Homo sapiens
ttctaccatttcaga

SEQ ID NO: 5464154 - DNA, 18 bp, Homo sapiens
ttctacccaacggccctg

SEQ ID NO: 5464155 - DNA, 18 bp, Homo sapiens
ttctacccagagccttct

SEQ ID NO: 5464156 - DNA, 20 bp, Homo sapiens
ttctacccagagccttctcc

SEQ ID NO: 5464157 - DNA, 22 bp, Homo sapiens
ttctacccagagccttctcctg

SEQ ID NO: 5464158 - DNA, 21 bp, Homo sapiens
ttctacccagcgagccctggt

SEQ ID NO: 5464159 - DNA, 14 bp, Homo sapiens
ttctacccaggtgc

SEQ ID NO: 5464160 - DNA, 17 bp, Homo sapiens
ttctaccccaaggccag

SEQ ID NO: 5464161 - DNA, 14 bp, Homo sapiens
ttctaccctggaaa

SEQ ID NO: 5464162 - DNA, 21 bp, Homo sapiens
ttctaccctgttgcaaaggaa

SEQ ID NO: 5464163 - DNA, 16 bp, Homo sapiens
ttctacctacatattt

SEQ ID NO: 5464164 - DNA, 11 bp, Homo sapiens
ttctacctcag

SEQ ID NO: 5464165 - DNA, 23 bp, Homo sapiens
ttctacctgcaggcggggctcct

SEQ ID NO: 5464166 - DNA, 19 bp, Homo sapiens
ttctaccttgaggtctttt

SEQ ID NO: 5464167 - DNA, 20 bp, Homo sapiens
ttctaccttgttgtgtttct

SEQ ID NO: 5464168 - DNA, 23 bp, Homo sapiens
ttctacgacccttttgagcctag

SEQ ID NO: 5464169 - DNA, 22 bp, Homo sapiens
ttctacgcaattgacaaacccg

SEQ ID NO: 5464170 - DNA, 13 bp, Homo sapiens
ttctacgccaggg

SEQ ID NO: 5464171 - DNA, 20 bp, Homo sapiens
ttctacggatcatcaacaag

SEQ ID NO: 5464172 - DNA, 22 bp, Homo sapiens
ttctacggatcatcaacaagat

SEQ ID NO: 5464173 - DNA, 22 bp, Homo sapiens
ttctacgtataaatatgaaatg

SEQ ID NO: 5464174 - DNA, 20 bp, Homo sapiens
ttctacgtcatgtattttat

SEQ ID NO: 5464175 - DNA, 21 bp, Homo sapiens
ttctacgtcatgtattttatg

SEQ ID NO: 5464176 - DNA, 14 bp, Homo sapiens
ttctactatataca

SEQ ID NO: 5464177 - DNA, 13 bp, Homo sapiens
ttctactatttat

SEQ ID NO: 5464178 - DNA, 20 bp, Homo sapiens
ttctactcacttttcccact

SEQ ID NO: 5464179 - DNA, 18 bp, Homo sapiens
ttctactcatatatatct

SEQ ID NO: 5464180 - DNA, 22 bp, Homo sapiens
ttctactcgagttacagacaaa

SEQ ID NO: 5464181 - DNA, 19 bp, Homo sapiens
ttctactctcccatggctt

SEQ ID NO: 5464182 - DNA, 17 bp, Homo sapiens
ttctactcttaagtttc

SEQ ID NO: 5464183 - DNA, 21 bp, Homo sapiens
ttctactcttaagtttctcag

SEQ ID NO: 5464184 - DNA, 20 bp, Homo sapiens
ttctactgagtccctggcaa

SEQ ID NO: 5464185 - DNA, 24 bp, Homo sapiens
ttctactgccttgaaaaatgacaa

SEQ ID NO: 5464186 - DNA, 13 bp, Homo sapiens
ttctactgctctc

SEQ ID NO: 5464187 - DNA, 20 bp, Homo sapiens
ttctactgctctcctccacc

SEQ ID NO: 5464188 - DNA, 23 bp, Homo sapiens
ttctactggcctgtaatctacca

SEQ ID NO: 5464189 - DNA, 18 bp, Homo sapiens
ttctactgtataaacaaa

SEQ ID NO: 5464190 - DNA, 13 bp, Homo sapiens
ttctacttcccct

SEQ ID NO: 5464191 - DNA, 15 bp, Homo sapiens
ttctacttcccctgg

SEQ ID NO: 5464192 - DNA, 13 bp, Homo sapiens
ttctacttgaagt

SEQ ID NO: 5464193 - DNA, 22 bp, Homo sapiens
ttctacttgcttattacattta

SEQ ID NO: 5464194 - DNA, 15 bp, Homo sapiens
ttctactttgcccct

SEQ ID NO: 5464195 - DNA, 13 bp, Homo sapiens
ttctacttttaaa

SEQ ID NO: 5464196 - DNA, 17 bp, Homo sapiens
ttctactttttccttcc

SEQ ID NO: 5464197 - DNA, 20 bp, Homo sapiens
ttctcctggagatagctggg

SEQ ID NO: 5464198 - DNA, 23 bp, Homo sapiens
ttctcctggagatagctggggct

SEQ ID NO: 5464199 - DNA, 12 bp, Homo sapiens
ttctcctggagc

SEQ ID NO: 5464200 - DNA, 14 bp, Homo sapiens
ttctcctggaggca

SEQ ID NO: 5464201 - DNA, 21 bp, Homo sapiens
ttctcctggcccctgcctgct

SEQ ID NO: 5464202 - DNA, 22 bp, Homo sapiens
ttctcctgggcccgctttgcct

SEQ ID NO: 5464203 - DNA, 16 bp, Homo sapiens
ttctcctggtgactca

SEQ ID NO: 5464204 - DNA, 18 bp, Homo sapiens
ttctcctggtgactcaaa

SEQ ID NO: 5464205 - DNA, 18 bp, Homo sapiens
ttctcctggtgtttttct

SEQ ID NO: 5464206 - DNA, 14 bp, Homo sapiens
ttctcctgtcagag

SEQ ID NO: 5464207 - DNA, 16 bp, Homo sapiens
ttctcctgtccctcca

SEQ ID NO: 5464208 - DNA, 16 bp, Homo sapiens
ttctcctgtgaatgga

SEQ ID NO: 5464209 - DNA, 20 bp, Homo sapiens
ttctcctgtgaatggaggca

SEQ ID NO: 5464210 - DNA, 12 bp, Homo sapiens
ttctcctgtgct

SEQ ID NO: 5464211 - DNA, 20 bp, Homo sapiens
ttctccttaagagacaattt

SEQ ID NO: 5464212 - DNA, 15 bp, Homo sapiens
ttctccttagtcttc

SEQ ID NO: 5464213 - DNA, 22 bp, Homo sapiens
ttctccttccaactgctgcccc

SEQ ID NO: 5464214 - DNA, 21 bp, Homo sapiens
ttctccttgaatatctttcga

SEQ ID NO: 5464215 - DNA, 23 bp, Homo sapiens
ttctccttgataacagctaccat

SEQ ID NO: 5464216 - DNA, 19 bp, Homo sapiens
ttctccttgattttaaaat

SEQ ID NO: 5464217 - DNA, 12 bp, Homo sapiens
ttctcctttaaa

SEQ ID NO: 5464218 - DNA, 20 bp, Homo sapiens
ttctcctttattgctcctgt

SEQ ID NO: 5464219 - DNA, 14 bp, Homo sapiens
ttctcctttgcaat

SEQ ID NO: 5464220 - DNA, 21 bp, Homo sapiens
ttctcctttggcatgtttaat

SEQ ID NO: 5464221 - DNA, 22 bp, Homo sapiens
ttctcctttggcatgtttaatt

SEQ ID NO: 5464222 - DNA, 12 bp, Homo sapiens
ttctcctttgta

SEQ ID NO: 5464223 - DNA, 17 bp, Homo sapiens
ttctcctttgtactttg

SEQ ID NO: 5464224 - DNA, 18 bp, Homo sapiens
ttctccttttcctctctc

SEQ ID NO: 5464225 - DNA, 16 bp, Homo sapiens
ttctccttttgaaaag

SEQ ID NO: 5464226 - DNA, 16 bp, Homo sapiens
ttctcctttttacccc

SEQ ID NO: 5464227 - DNA, 13 bp, Homo sapiens
ttctcctttttct

SEQ ID NO: 5464228 - DNA, 23 bp, Homo sapiens
ttctcgcaaaaacgtatctccta

SEQ ID NO: 5464229 - DNA, 15 bp, Homo sapiens
ttctcgcaactgaag

SEQ ID NO: 5464230 - DNA, 18 bp, Homo sapiens
ttctcgcaactgaaggaa

SEQ ID NO: 5464231 - DNA, 15 bp, Homo sapiens
ttctcgccccttccc

SEQ ID NO: 5464232 - DNA, 23 bp, Homo sapiens
ttctcgccccttccctctctccc

SEQ ID NO: 5464233 - DNA, 17 bp, Homo sapiens
ttctcgcctaggatttc

SEQ ID NO: 5464234 - DNA, 23 bp, Homo sapiens
ttctcgcctaggatttcagccat

SEQ ID NO: 5464235 - DNA, 12 bp, Homo sapiens
ttctcggagacc

SEQ ID NO: 5464236 - DNA, 17 bp, Homo sapiens
ttctcggagctggccca

SEQ ID NO: 5464237 - DNA, 18 bp, Homo sapiens
ttctcggagctggcccag

SEQ ID NO: 5464238 - DNA, 16 bp, Homo sapiens
ttctcggccagcccgt

SEQ ID NO: 5464239 - DNA, 19 bp, Homo sapiens
ttctcggtccactcttgtt

SEQ ID NO: 5464240 - DNA, 17 bp, Homo sapiens
ttctcgtagatgctgcc

SEQ ID NO: 5464241 - DNA, 14 bp, Homo sapiens
ttctcgtccccctc

SEQ ID NO: 5464242 - DNA, 22 bp, Homo sapiens
ttctcgtccccctccctgccca

SEQ ID NO: 5464243 - DNA, 19 bp, Homo sapiens
ttctcgtcctcgtttgtgt

SEQ ID NO: 5464244 - DNA, 16 bp, Homo sapiens
ttctcgtcttcctctc

SEQ ID NO: 5464245 - DNA, 18 bp, Homo sapiens
ttctcgtcttcctctctc

SEQ ID NO: 5464246 - DNA, 14 bp, Homo sapiens
ttctcgtgacccag

SEQ ID NO: 5464247 - DNA, 21 bp, Homo sapiens
ttctcgtgctgcatccctgtg

SEQ ID NO: 5464248 - DNA, 14 bp, Homo sapiens
ttctcgttgcccta

SEQ ID NO: 5464249 - DNA, 15 bp, Homo sapiens
ttctcgttgcctctg

SEQ ID NO: 5464250 - DNA, 18 bp, Homo sapiens
ttctcgttgtcacaccca

SEQ ID NO: 5464251 - DNA, 19 bp, Homo sapiens
ttctctaaactgtttctta

SEQ ID NO: 5464252 - DNA, 14 bp, Homo sapiens
ttctctaaccctat

SEQ ID NO: 5464253 - DNA, 21 bp, Homo sapiens
ttctctaacttcaaggcccat

SEQ ID NO: 5464254 - DNA, 19 bp, Homo sapiens
ttctctaagagaacaatgt

SEQ ID NO: 5464255 - DNA, 22 bp, Homo sapiens
ttctctaagatgaatccaaatg

SEQ ID NO: 5464256 - DNA, 15 bp, Homo sapiens
ttctctaagcctggc

SEQ ID NO: 5464257 - DNA, 23 bp, Homo sapiens
ttctctaagttccactgagctcc

SEQ ID NO: 5464258 - DNA, 13 bp, Homo sapiens
ttctctaataata

SEQ ID NO: 5464259 - DNA, 14 bp, Homo sapiens
ttctctaataataa

SEQ ID NO: 5464260 - DNA, 12 bp, Homo sapiens
ttctctaatatg

SEQ ID NO: 5464261 - DNA, 23 bp, Homo sapiens
ttctctacaggcctcttcctgtt

SEQ ID NO: 5464262 - DNA, 20 bp, Homo sapiens
ttctctacccatctccccca

SEQ ID NO: 5464263 - DNA, 21 bp, Homo sapiens
ttctctacccatctcccccat

SEQ ID NO: 5464264 - DNA, 15 bp, Homo sapiens
ttctctactctggaa

SEQ ID NO: 5464265 - DNA, 16 bp, Homo sapiens
ttctctagaagctgtc

SEQ ID NO: 5464266 - DNA, 19 bp, Homo sapiens
ttctctagaggctggcaag

SEQ ID NO: 5464267 - DNA, 18 bp, Homo sapiens
ttctctagctctctaggc

SEQ ID NO: 5464268 - DNA, 22 bp, Homo sapiens
ttctctagctctctaggcctct

SEQ ID NO: 5464269 - DNA, 20 bp, Homo sapiens
ttctctagctgatcagaatt

SEQ ID NO: 5464270 - DNA, 15 bp, Homo sapiens
ttctctagtcatttg

SEQ ID NO: 5464271 - DNA, 18 bp, Homo sapiens
ttctctagtcatttgtta

SEQ ID NO: 5464272 - DNA, 19 bp, Homo sapiens
ttctctagtttcccctctc

SEQ ID NO: 5464273 - DNA, 20 bp, Homo sapiens
ttctctagtttgattaaatt

SEQ ID NO: 5464274 - DNA, 16 bp, Homo sapiens
ttctctataaaaaata

SEQ ID NO: 5464275 - DNA, 21 bp, Homo sapiens
ttctctataaaaaatatgtat

SEQ ID NO: 5464276 - DNA, 19 bp, Homo sapiens
ttctctataaagggtcagg

SEQ ID NO: 5464277 - DNA, 23 bp, Homo sapiens
ttctctataggtcatgatttctg

SEQ ID NO: 5464278 - DNA, 15 bp, Homo sapiens
ttctctatcctctct

SEQ ID NO: 5464279 - DNA, 17 bp, Homo sapiens
ttctctatcctctctct

SEQ ID NO: 5464280 - DNA, 22 bp, Homo sapiens
ttctctatcctctctctctcta

SEQ ID NO: 5464281 - DNA, 21 bp, Homo sapiens
ttctctatgaaaagcaactga

SEQ ID NO: 5464282 - DNA, 14 bp, Homo sapiens
ttctctatgtacag

SEQ ID NO: 5464283 - DNA, 21 bp, Homo sapiens
ttctctatgtacgataaagta

SEQ ID NO: 5464284 - DNA, 15 bp, Homo sapiens
ttctctattaaaatg

SEQ ID NO: 5464285 - DNA, 17 bp, Homo sapiens
ttctctattgtaatttt

SEQ ID NO: 5464286 - DNA, 19 bp, Homo sapiens
ttctctattgtaattttgt

SEQ ID NO: 5464287 - DNA, 18 bp, Homo sapiens
ttctctattttcataatc

SEQ ID NO: 5464288 - DNA, 22 bp, Homo sapiens
ttctctattttgcctttaaatt

SEQ ID NO: 5464289 - DNA, 20 bp, Homo sapiens
ttctctcaacaccatgattc

SEQ ID NO: 5464290 - DNA, 23 bp, Homo sapiens
ttctctcaaccttggccttctcc

SEQ ID NO: 5464291 - DNA, 19 bp, Homo sapiens
ttctctcaaggagaggcaa

SEQ ID NO: 5464292 - DNA, 14 bp, Homo sapiens
ttctctcaatccct

SEQ ID NO: 5464293 - DNA, 20 bp, Homo sapiens
ttctctcaatttgggtccca

SEQ ID NO: 5464294 - DNA, 14 bp, Homo sapiens
ttctctcagctccc

SEQ ID NO: 5464295 - DNA, 16 bp, Homo sapiens
ttctctcagctcccag

SEQ ID NO: 5464296 - DNA, 19 bp, Homo sapiens
ttctctcagctcccaggcc

SEQ ID NO: 5464297 - DNA, 22 bp, Homo sapiens
ttctctcaggtgcgtgccacat

SEQ ID NO: 5464298 - DNA, 19 bp, Homo sapiens
ttctctcatagaacattga

SEQ ID NO: 5464299 - DNA, 21 bp, Homo sapiens
ttctctcatcggaggcccatg

SEQ ID NO: 5464300 - DNA, 23 bp, Homo sapiens
ttctctcatctcttagctcccct

SEQ ID NO: 5464301 - DNA, 22 bp, Homo sapiens
ttctctccacagtgttgtgccc

SEQ ID NO: 5464302 - DNA, 15 bp, Homo sapiens
ttctctccaggctgt

SEQ ID NO: 5464303 - DNA, 19 bp, Homo sapiens
ttctctccaggctgtttct

SEQ ID NO: 5464304 - DNA, 12 bp, Homo sapiens
ttctctccattt

SEQ ID NO: 5464305 - DNA, 13 bp, Homo sapiens
ttctctcccacac

SEQ ID NO: 5464306 - DNA, 22 bp, Homo sapiens
ttctctcccacgtgcacagctt

SEQ ID NO: 5464307 - DNA, 14 bp, Homo sapiens
ttctctccccaacc

SEQ ID NO: 5464308 - DNA, 17 bp, Homo sapiens
ttctctccccagccccc

SEQ ID NO: 5464309 - DNA, 19 bp, Homo sapiens
ttctctcccctcacatcct

SEQ ID NO: 5464310 - DNA, 17 bp, Homo sapiens
ttctctccgacttcccc

SEQ ID NO: 5464311 - DNA, 23 bp, Homo sapiens
ttctctccggatggaatcacagc

SEQ ID NO: 5464312 - DNA, 12 bp, Homo sapiens
ttctctcctccc

SEQ ID NO: 5464313 - DNA, 17 bp, Homo sapiens
ttctctcctccccaaat

SEQ ID NO: 5464314 - DNA, 11 bp, Homo sapiens
ttctctcctgg

SEQ ID NO: 5464315 - DNA, 12 bp, Homo sapiens
ttctctcctggc

SEQ ID NO: 5464316 - DNA, 22 bp, Homo sapiens
ttctctcctgtacctcttgagc

SEQ ID NO: 5464317 - DNA, 21 bp, Homo sapiens
ttctctccttaattttatatg

SEQ ID NO: 5464318 - DNA, 18 bp, Homo sapiens
ttctctccttcttccctg

SEQ ID NO: 5464319 - DNA, 23 bp, Homo sapiens
ttctctccttcttccctgtttta

SEQ ID NO: 5464320 - DNA, 22 bp, Homo sapiens
ttctctccttggcctttcctgg

SEQ ID NO: 5464321 - DNA, 17 bp, Homo sapiens
ttctctcggctccccat

SEQ ID NO: 5464322 - DNA, 20 bp, Homo sapiens
ttctctcggggcgacccctc

SEQ ID NO: 5464323 - DNA, 23 bp, Homo sapiens
ttctctctaaaaataaaatgatg

SEQ ID NO: 5464324 - DNA, 17 bp, Homo sapiens
ttctctctacagtgcca

SEQ ID NO: 5464325 - DNA, 22 bp, Homo sapiens
ttctctctatggtaaagatatt

SEQ ID NO: 5464326 - DNA, 13 bp, Homo sapiens
ttctctctcactc

SEQ ID NO: 5464327 - DNA, 23 bp, Homo sapiens
ttctctctcaggccaccacagag

SEQ ID NO: 5464328 - DNA, 12 bp, Homo sapiens
ttctctctccac

SEQ ID NO: 5464329 - DNA, 15 bp, Homo sapiens
ttctctctccagggt

SEQ ID NO: 5464330 - DNA, 20 bp, Homo sapiens
ttctctctccatttggaatt

SEQ ID NO: 5464331 - DNA, 20 bp, Homo sapiens
ttctctctccctgtcacaca

SEQ ID NO: 5464332 - DNA, 22 bp, Homo sapiens
ttctctctccctgtcacacact

SEQ ID NO: 5464333 - DNA, 18 bp, Homo sapiens
ttctctctcctctctgct

SEQ ID NO: 5464334 - DNA, 13 bp, Homo sapiens
ttctctctctctc

SEQ ID NO: 5464335 - DNA, 21 bp, Homo sapiens
ttctctctctctcaaaattat

SEQ ID NO: 5464336 - DNA, 21 bp, Homo sapiens
ttctctctctctcacacacac

SEQ ID NO: 5464337 - DNA, 16 bp, Homo sapiens
ttctctctctctttgt

SEQ ID NO: 5464338 - DNA, 21 bp, Homo sapiens
ttctctctgcctgtgagccag

SEQ ID NO: 5464339 - DNA, 14 bp, Homo sapiens
ttctctctgctcag

SEQ ID NO: 5464340 - DNA, 11 bp, Homo sapiens
ttctctctgga

SEQ ID NO: 5464341 - DNA, 17 bp, Homo sapiens
ttctctctggagcccct

SEQ ID NO: 5464342 - DNA, 14 bp, Homo sapiens
ttctctctggatgg

SEQ ID NO: 5464343 - DNA, 17 bp, Homo sapiens
ttctctctggcttctct

SEQ ID NO: 5464344 - DNA, 13 bp, Homo sapiens
ttctctctgtgtg

SEQ ID NO: 5464345 - DNA, 17 bp, Homo sapiens
ttctctctgttacacac

SEQ ID NO: 5464346 - DNA, 20 bp, Homo sapiens
ttctctcttataaattctgt

SEQ ID NO: 5464347 - DNA, 19 bp, Homo sapiens
ttctctcttcaatctctgg

SEQ ID NO: 5464348 - DNA, 13 bp, Homo sapiens
ttctctcttctct

SEQ ID NO: 5464349 - DNA, 14 bp, Homo sapiens
ttctctcttctctc

SEQ ID NO: 5464350 - DNA, 20 bp, Homo sapiens
ttctctctttatacagctgt

SEQ ID NO: 5464351 - DNA, 21 bp, Homo sapiens
ttctctctttatacagctgta

SEQ ID NO: 5464352 - DNA, 16 bp, Homo sapiens
ttctctctttctaagg

SEQ ID NO: 5464353 - DNA, 20 bp, Homo sapiens
ttctctcttttaaagtattt

SEQ ID NO: 5464354 - DNA, 15 bp, Homo sapiens
ttctctcttttcctc

SEQ ID NO: 5464355 - DNA, 19 bp, Homo sapiens
ttctctgaacacaggcagc

SEQ ID NO: 5464356 - DNA, 16 bp, Homo sapiens
ttctctgaagggaggt

SEQ ID NO: 5464357 - DNA, 15 bp, Homo sapiens
ttctctgaatcagaa

SEQ ID NO: 5464358 - DNA, 16 bp, Homo sapiens
ttctctgaatcagaaa

SEQ ID NO: 5464359 - DNA, 21 bp, Homo sapiens
ttctctgaatcagaaaagcta

SEQ ID NO: 5464360 - DNA, 11 bp, Homo sapiens
ttctctgactt

SEQ ID NO: 5464361 - DNA, 12 bp, Homo sapiens
ttctctgacttc

SEQ ID NO: 5464362 - DNA, 16 bp, Homo sapiens
ttctctgacttctgcc

SEQ ID NO: 5464363 - DNA, 14 bp, Homo sapiens
ttctctgagaacca

SEQ ID NO: 5464364 - DNA, 20 bp, Homo sapiens
ttctctgagaaccaaaagat

SEQ ID NO: 5464365 - DNA, 15 bp, Homo sapiens
ttctctgagctttgt

SEQ ID NO: 5464366 - DNA, 13 bp, Homo sapiens
ttctctgaggaag

SEQ ID NO: 5464367 - DNA, 18 bp, Homo sapiens
ttctctgaggaagctggg

SEQ ID NO: 5464368 - DNA, 20 bp, Homo sapiens
ttctctgaggacactaacca

SEQ ID NO: 5464369 - DNA, 16 bp, Homo sapiens
ttctctgatacagaaa

SEQ ID NO: 5464370 - DNA, 14 bp, Homo sapiens
ttctctgcaacact

SEQ ID NO: 5464371 - DNA, 22 bp, Homo sapiens
ttctctgcaatgcttctgtagc

SEQ ID NO: 5464372 - DNA, 23 bp, Homo sapiens
ttctctgcaatgcttctgtagct

SEQ ID NO: 5464373 - DNA, 13 bp, Homo sapiens
ttctggcaggacc

SEQ ID NO: 5464374 - DNA, 14 bp, Homo sapiens
ttctggcaggacct

SEQ ID NO: 5464375 - DNA, 16 bp, Homo sapiens
ttctggcataattttt

SEQ ID NO: 5464376 - DNA, 17 bp, Homo sapiens
ttctggccacatcagcc

SEQ ID NO: 5464377 - DNA, 15 bp, Homo sapiens
ttctggccaggaagc

SEQ ID NO: 5464378 - DNA, 14 bp, Homo sapiens
ttctggcctctgct

SEQ ID NO: 5464379 - DNA, 19 bp, Homo sapiens
ttctggcctctggcctggg

SEQ ID NO: 5464380 - DNA, 20 bp, Homo sapiens
ttctggcctgccttcgttaa

SEQ ID NO: 5464381 - DNA, 12 bp, Homo sapiens
ttctggcctgtt

SEQ ID NO: 5464382 - DNA, 13 bp, Homo sapiens
ttctggcctgtta

SEQ ID NO: 5464383 - DNA, 12 bp, Homo sapiens
ttctggccttga

SEQ ID NO: 5464384 - DNA, 13 bp, Homo sapiens
ttctggccttgac

SEQ ID NO: 5464385 - DNA, 17 bp, Homo sapiens
ttctggccttgtaagac

SEQ ID NO: 5464386 - DNA, 16 bp, Homo sapiens
ttctggctatgcattt

SEQ ID NO: 5464387 - DNA, 13 bp, Homo sapiens
ttctggctccaag

SEQ ID NO: 5464388 - DNA, 22 bp, Homo sapiens
ttctggctccaaggtgctctgt

SEQ ID NO: 5464389 - DNA, 14 bp, Homo sapiens
ttctggctccctct

SEQ ID NO: 5464390 - DNA, 13 bp, Homo sapiens
ttctggctcctgt

SEQ ID NO: 5464391 - DNA, 16 bp, Homo sapiens
ttctggctctcccatt

SEQ ID NO: 5464392 - DNA, 19 bp, Homo sapiens
ttctggctgaacactggca

SEQ ID NO: 5464393 - DNA, 11 bp, Homo sapiens
ttctggctgcc

SEQ ID NO: 5464394 - DNA, 22 bp, Homo sapiens
ttctggctggagcctagaacag

SEQ ID NO: 5464395 - DNA, 19 bp, Homo sapiens
ttctggctgtgatcttaaa

SEQ ID NO: 5464396 - DNA, 20 bp, Homo sapiens
ttctggctgtgatcttaaaa

SEQ ID NO: 5464397 - DNA, 15 bp, Homo sapiens
ttctggctgtttgag

SEQ ID NO: 5464398 - DNA, 14 bp, Homo sapiens
ttctggctttgttc

SEQ ID NO: 5464399 - DNA, 17 bp, Homo sapiens
ttctggctttttgaatt

SEQ ID NO: 5464400 - DNA, 21 bp, Homo sapiens
ttctggcttttttgtggggtt

SEQ ID NO: 5464401 - DNA, 21 bp, Homo sapiens
ttctgggaaaaacaacatcat

SEQ ID NO: 5464402 - DNA, 13 bp, Homo sapiens
ttctgggaaaggt

SEQ ID NO: 5464403 - DNA, 16 bp, Homo sapiens
ttctgggaaaggtgct

SEQ ID NO: 5464404 - DNA, 17 bp, Homo sapiens
ttctgggaaatggcttg

SEQ ID NO: 5464405 - DNA, 20 bp, Homo sapiens
ttctgggaaatgttttaatg

SEQ ID NO: 5464406 - DNA, 21 bp, Homo sapiens
ttctgggaaatgttttaatgc

SEQ ID NO: 5464407 - DNA, 13 bp, Homo sapiens
ttctgggaagaaa

SEQ ID NO: 5464408 - DNA, 15 bp, Homo sapiens
ttctgggaatcatgt

SEQ ID NO: 5464409 - DNA, 10 bp, Homo sapiens
ttctgggaca

SEQ ID NO: 5464410 - DNA, 15 bp, Homo sapiens
ttctgggagcagaaa

SEQ ID NO: 5464411 - DNA, 22 bp, Homo sapiens
ttctgggagcagaaacagccat

SEQ ID NO: 5464412 - DNA, 16 bp, Homo sapiens
ttctgggaggaagcag

SEQ ID NO: 5464413 - DNA, 23 bp, Homo sapiens
ttctgggcacagtggactcagca

SEQ ID NO: 5464414 - DNA, 13 bp, Homo sapiens
ttctgggcagagc

SEQ ID NO: 5464415 - DNA, 20 bp, Homo sapiens
ttctgggcagagcctgtccc

SEQ ID NO: 5464416 - DNA, 22 bp, Homo sapiens
ttctgggcatggcagggccagg

SEQ ID NO: 5464417 - DNA, 23 bp, Homo sapiens
ttctgggcctaattttttaaaga

SEQ ID NO: 5464418 - DNA, 10 bp, Homo sapiens
ttctgggctc

SEQ ID NO: 5464419 - DNA, 12 bp, Homo sapiens
ttctgggctctg

SEQ ID NO: 5464420 - DNA, 15 bp, Homo sapiens
ttctgggctctggac

SEQ ID NO: 5464421 - DNA, 16 bp, Homo sapiens
ttctgggctctggact

SEQ ID NO: 5464422 - DNA, 17 bp, Homo sapiens
ttctgggctctggactc

SEQ ID NO: 5464423 - DNA, 19 bp, Homo sapiens
ttctgggctctggactcca

SEQ ID NO: 5464424 - DNA, 14 bp, Homo sapiens
ttctgggctgatgg

SEQ ID NO: 5464425 - DNA, 22 bp, Homo sapiens
ttctgggctgcgggaggccctg

SEQ ID NO: 5464426 - DNA, 16 bp, Homo sapiens
ttctgggcttcatctg

SEQ ID NO: 5464427 - DNA, 14 bp, Homo sapiens
ttctggggaaagac

SEQ ID NO: 5464428 - DNA, 21 bp, Homo sapiens
ttctggggaaagacactgcct

SEQ ID NO: 5464429 - DNA, 22 bp, Homo sapiens
ttctggggaaagacactgcctg

SEQ ID NO: 5464430 - DNA, 20 bp, Homo sapiens
ttctggggaaaggggacaag

SEQ ID NO: 5464431 - DNA, 23 bp, Homo sapiens
ttctggggagctggacagtggag

SEQ ID NO: 5464432 - DNA, 21 bp, Homo sapiens
ttctggggaggaagggccagg

SEQ ID NO: 5464433 - DNA, 20 bp, Homo sapiens
ttctggggcaggctgggcca

SEQ ID NO: 5464434 - DNA, 14 bp, Homo sapiens
ttctggggccagcc

SEQ ID NO: 5464435 - DNA, 16 bp, Homo sapiens
ttctggggccagcccc

SEQ ID NO: 5464436 - DNA, 22 bp, Homo sapiens
ttctggggccagcccctccccg

SEQ ID NO: 5464437 - DNA, 20 bp, Homo sapiens
ttctggggcccaggaagccc

SEQ ID NO: 5464438 - DNA, 21 bp, Homo sapiens
ttctggggcccaggaagccca

SEQ ID NO: 5464439 - DNA, 23 bp, Homo sapiens
ttctggggcccctttttactccc

SEQ ID NO: 5464440 - DNA, 21 bp, Homo sapiens
ttctggggcccgcctgccacc

SEQ ID NO: 5464441 - DNA, 23 bp, Homo sapiens
ttctggggcccgcctgccacctc

SEQ ID NO: 5464442 - DNA, 22 bp, Homo sapiens
ttctggggcctaataaaactga

SEQ ID NO: 5464443 - DNA, 21 bp, Homo sapiens
ttctggggctgagagtggggc

SEQ ID NO: 5464444 - DNA, 17 bp, Homo sapiens
ttctggggctgggcctg

SEQ ID NO: 5464445 - DNA, 15 bp, Homo sapiens
ttctgggggaaaaag

SEQ ID NO: 5464446 - DNA, 23 bp, Homo sapiens
ttctgggggaaaaagccatatca

SEQ ID NO: 5464447 - DNA, 19 bp, Homo sapiens
ttctggggggacccagtgc

SEQ ID NO: 5464448 - DNA, 19 bp, Homo sapiens
ttctggggggatatttcct

SEQ ID NO: 5464449 - DNA, 15 bp, Homo sapiens
ttctggggtccccag

SEQ ID NO: 5464450 - DNA, 16 bp, Homo sapiens
ttctggggtggggctt

SEQ ID NO: 5464451 - DNA, 22 bp, Homo sapiens
ttctggggtggggcttggaagg

SEQ ID NO: 5464452 - DNA, 16 bp, Homo sapiens
ttctgggtagaagcca

SEQ ID NO: 5464453 - DNA, 17 bp, Homo sapiens
ttctgggtagaagccac

SEQ ID NO: 5464454 - DNA, 18 bp, Homo sapiens
ttctgggtagtcccctgt

SEQ ID NO: 5464455 - DNA, 15 bp, Homo sapiens
ttctgggtccaggga

SEQ ID NO: 5464456 - DNA, 14 bp, Homo sapiens
ttctgggtccctgc

SEQ ID NO: 5464457 - DNA, 14 bp, Homo sapiens
ttctgggtcttctg

SEQ ID NO: 5464458 - DNA, 21 bp, Homo sapiens
ttctgggtgaaacccttttct

SEQ ID NO: 5464459 - DNA, 15 bp, Homo sapiens
ttctgggtgatttct

SEQ ID NO: 5464460 - DNA, 16 bp, Homo sapiens
ttctgggtgatttcta

SEQ ID NO: 5464461 - DNA, 18 bp, Homo sapiens
ttctgggtgctagatcca

SEQ ID NO: 5464462 - DNA, 18 bp, Homo sapiens
ttctgggtggctcctgcc

SEQ ID NO: 5464463 - DNA, 19 bp, Homo sapiens
ttctgggtggggcagtggg

SEQ ID NO: 5464464 - DNA, 15 bp, Homo sapiens
ttctgggtgtgttct

SEQ ID NO: 5464465 - DNA, 15 bp, Homo sapiens
ttctgggtgttttca

SEQ ID NO: 5464466 - DNA, 18 bp, Homo sapiens
ttctgggttaacagtaaa

SEQ ID NO: 5464467 - DNA, 20 bp, Homo sapiens
ttctgggttctcaattctgt

SEQ ID NO: 5464468 - DNA, 23 bp, Homo sapiens
ttctgggttctcaattctgtctc

SEQ ID NO: 5464469 - DNA, 15 bp, Homo sapiens
ttctgggtttgccca

SEQ ID NO: 5464470 - DNA, 16 bp, Homo sapiens
ttctgggtttgcccag

SEQ ID NO: 5464471 - DNA, 20 bp, Homo sapiens
ttctgggtttgcccagtcct

SEQ ID NO: 5464472 - DNA, 15 bp, Homo sapiens
ttctgggttttctga

SEQ ID NO: 5464473 - DNA, 19 bp, Homo sapiens
ttctggtaagactgctggt

SEQ ID NO: 5464474 - DNA, 18 bp, Homo sapiens
ttctggtactctcctaga

SEQ ID NO: 5464475 - DNA, 15 bp, Homo sapiens
ttctggtactttctg

SEQ ID NO: 5464476 - DNA, 13 bp, Homo sapiens
ttctggtaggaag

SEQ ID NO: 5464477 - DNA, 20 bp, Homo sapiens
ttctggtaggaatagcatgt

SEQ ID NO: 5464478 - DNA, 15 bp, Homo sapiens
ttctggtaggttctg

SEQ ID NO: 5464479 - DNA, 21 bp, Homo sapiens
ttctggtaggttctgtctgtg

SEQ ID NO: 5464480 - DNA, 14 bp, Homo sapiens
ttctggtataaagc

SEQ ID NO: 5464481 - DNA, 14 bp, Homo sapiens
ttctggtatacatt

SEQ ID NO: 5464482 - DNA, 15 bp, Homo sapiens
ttctggtattcacag

SEQ ID NO: 5464483 - DNA, 17 bp, Homo sapiens
ttctggtattcacagaa

SEQ ID NO: 5464484 - DNA, 11 bp, Homo sapiens
ttctggtcaca

SEQ ID NO: 5464485 - DNA, 18 bp, Homo sapiens
ttctggtcccctgtggtg

SEQ ID NO: 5464486 - DNA, 19 bp, Homo sapiens
ttctggtcctgttttctaa

SEQ ID NO: 5464487 - DNA, 20 bp, Homo sapiens
ttctggtggcaaatgaattt

SEQ ID NO: 5464488 - DNA, 22 bp, Homo sapiens
ttctggtggcagtaacatgcaa

SEQ ID NO: 5464489 - DNA, 16 bp, Homo sapiens
ttctggtgggacaatg

SEQ ID NO: 5464490 - DNA, 23 bp, Homo sapiens
ttctggtggggctgtcctgctgc

SEQ ID NO: 5464491 - DNA, 14 bp, Homo sapiens
ttctggtgggttga

SEQ ID NO: 5464492 - DNA, 20 bp, Homo sapiens
ttctggtggttctgctgtta

SEQ ID NO: 5464493 - DNA, 16 bp, Homo sapiens
ttctggtggtttgatt

SEQ ID NO: 5464494 - DNA, 20 bp, Homo sapiens
ttctggtggtttgattgttt

SEQ ID NO: 5464495 - DNA, 14 bp, Homo sapiens
ttctggtgtctgct

SEQ ID NO: 5464496 - DNA, 12 bp, Homo sapiens
ttctggtgtgaa

SEQ ID NO: 5464497 - DNA, 18 bp, Homo sapiens
ttctggtgttacacatac

SEQ ID NO: 5464498 - DNA, 13 bp, Homo sapiens
ttctggtgttcct

SEQ ID NO: 5464499 - DNA, 21 bp, Homo sapiens
ttctggtgttttatttcctat

SEQ ID NO: 5464500 - DNA, 22 bp, Homo sapiens
ttctggttagctcagccccagc

SEQ ID NO: 5464501 - DNA, 14 bp, Homo sapiens
ttctggttccaaac

SEQ ID NO: 5464502 - DNA, 13 bp, Homo sapiens
ttctggttccatt

SEQ ID NO: 5464503 - DNA, 17 bp, Homo sapiens
ttctggttccctgctgc

SEQ ID NO: 5464504 - DNA, 23 bp, Homo sapiens
ttctggttctgtgtcctctgcct

SEQ ID NO: 5464505 - DNA, 13 bp, Homo sapiens
ttctggttcttga

SEQ ID NO: 5464506 - DNA, 14 bp, Homo sapiens
ttctggttcttgaa

SEQ ID NO: 5464507 - DNA, 22 bp, Homo sapiens
ttctgtaaaagttactaatata

SEQ ID NO: 5464508 - DNA, 17 bp, Homo sapiens
ttctgtaaaatgtctgt

SEQ ID NO: 5464509 - DNA, 18 bp, Homo sapiens
ttctgtaaacagaataaa

SEQ ID NO: 5464510 - DNA, 19 bp, Homo sapiens
ttctgtaaactcaaaactt

SEQ ID NO: 5464511 - DNA, 13 bp, Homo sapiens
ttctgtaaataac

SEQ ID NO: 5464512 - DNA, 14 bp, Homo sapiens
ttctgtaacaaatt

SEQ ID NO: 5464513 - DNA, 16 bp, Homo sapiens
ttctgtaacacagaat

SEQ ID NO: 5464514 - DNA, 19 bp, Homo sapiens
ttctgtaacacagaatata

SEQ ID NO: 5464515 - DNA, 17 bp, Homo sapiens
ttctgtaagagaaaata

SEQ ID NO: 5464516 - DNA, 22 bp, Homo sapiens
ttctgtaagagaaaatattact

SEQ ID NO: 5464517 - DNA, 21 bp, Homo sapiens
ttctgtaatactaagtcctca

SEQ ID NO: 5464518 - DNA, 23 bp, Homo sapiens
ttctgtaatactaagtcctcaga

SEQ ID NO: 5464519 - DNA, 21 bp, Homo sapiens
ttctgtaatatttacaatgta

SEQ ID NO: 5464520 - DNA, 23 bp, Homo sapiens
ttctgtaatatttacaatgtatt

SEQ ID NO: 5464521 - DNA, 21 bp, Homo sapiens
ttctgtaatcaatatcccaac

SEQ ID NO: 5464522 - DNA, 17 bp, Homo sapiens
ttctgtaatgtaaataa

SEQ ID NO: 5464523 - DNA, 14 bp, Homo sapiens
ttctgtaattacat

SEQ ID NO: 5464524 - DNA, 17 bp, Homo sapiens
ttctgtacagtttgtga

SEQ ID NO: 5464525 - DNA, 16 bp, Homo sapiens
ttctgtacatagccta

SEQ ID NO: 5464526 - DNA, 22 bp, Homo sapiens
ttctgtacatgcattgagctct

SEQ ID NO: 5464527 - DNA, 17 bp, Homo sapiens
ttctgtaccaaagtgtt

SEQ ID NO: 5464528 - DNA, 13 bp, Homo sapiens
ttctgtaccagtt

SEQ ID NO: 5464529 - DNA, 14 bp, Homo sapiens
ttctgtaccagtta

SEQ ID NO: 5464530 - DNA, 21 bp, Homo sapiens
ttctgtaccagttaatttttc

SEQ ID NO: 5464531 - DNA, 21 bp, Homo sapiens
ttctgtactaaacatttcctt

SEQ ID NO: 5464532 - DNA, 20 bp, Homo sapiens
ttctgtactgatttttgtaa

SEQ ID NO: 5464533 - DNA, 21 bp, Homo sapiens
ttctgtacttccaatttataa

SEQ ID NO: 5464534 - DNA, 13 bp, Homo sapiens
ttctgtacttcct

SEQ ID NO: 5464535 - DNA, 19 bp, Homo sapiens
ttctgtactttttggcata

SEQ ID NO: 5464536 - DNA, 21 bp, Homo sapiens
ttctgtagaaaagaaaacatt

SEQ ID NO: 5464537 - DNA, 21 bp, Homo sapiens
ttctgtagaatgctgtagaat

SEQ ID NO: 5464538 - DNA, 19 bp, Homo sapiens
ttctgtagacttttgaaaa

SEQ ID NO: 5464539 - DNA, 20 bp, Homo sapiens
ttctgtagagccttctgatg

SEQ ID NO: 5464540 - DNA, 16 bp, Homo sapiens
ttctgtagctattctt

SEQ ID NO: 5464541 - DNA, 14 bp, Homo sapiens
ttctgtaggagaga

SEQ ID NO: 5464542 - DNA, 16 bp, Homo sapiens
ttctgtaggttctgtg

SEQ ID NO: 5464543 - DNA, 21 bp, Homo sapiens
ttctgtagtactccttaagaa

SEQ ID NO: 5464544 - DNA, 14 bp, Homo sapiens
ttctgtagtcattt

SEQ ID NO: 5464545 - DNA, 23 bp, Homo sapiens
ttctgtagttgcagctgatgcct

SEQ ID NO: 5464546 - DNA, 14 bp, Homo sapiens
ttctgtagttttta

SEQ ID NO: 5464547 - DNA, 20 bp, Homo sapiens
ttctgtagtttttaattaaa

SEQ ID NO: 5464548 - DNA, 21 bp, Homo sapiens
ttctgtataaagcctgtattc

SEQ ID NO: 5464549 - DNA, 24 bp, Homo sapiens
ttctgtatacaaccctggcattat

SEQ ID NO: 5464550 - DNA, 21 bp, Homo sapiens
ttcttgacaaaacctaacttg

SEQ ID NO: 5464551 - DNA, 15 bp, Homo sapiens
ttcttgactccttgg

SEQ ID NO: 5464552 - DNA, 24 bp, Homo sapiens
ttcttgactccttggtgctaaaga

SEQ ID NO: 5464553 - DNA, 15 bp, Homo sapiens
ttcttgacttatatt

SEQ ID NO: 5464554 - DNA, 18 bp, Homo sapiens
ttcttgagctagaccaag

SEQ ID NO: 5464555 - DNA, 15 bp, Homo sapiens
ttcttgagctgttgt

SEQ ID NO: 5464556 - DNA, 23 bp, Homo sapiens
ttcttgaggggaagctagtcttt

SEQ ID NO: 5464557 - DNA, 19 bp, Homo sapiens
ttcttgaggggaccaggag

SEQ ID NO: 5464558 - DNA, 21 bp, Homo sapiens
ttcttgaggtctcttttctct

SEQ ID NO: 5464559 - DNA, 15 bp, Homo sapiens
ttcttgagtagatct

SEQ ID NO: 5464560 - DNA, 19 bp, Homo sapiens
ttcttgagtagatctgctt

SEQ ID NO: 5464561 - DNA, 21 bp, Homo sapiens
ttcttgatcaacatcttttct

SEQ ID NO: 5464562 - DNA, 14 bp, Homo sapiens
ttcttgatgtaaaa

SEQ ID NO: 5464563 - DNA, 19 bp, Homo sapiens
ttcttgatgtaaaatcttg

SEQ ID NO: 5464564 - DNA, 21 bp, Homo sapiens
ttcttgatgtcactatttgtt

SEQ ID NO: 5464565 - DNA, 15 bp, Homo sapiens
ttcttgcaagctcca

SEQ ID NO: 5464566 - DNA, 16 bp, Homo sapiens
ttcttgcaagctccag

SEQ ID NO: 5464567 - DNA, 21 bp, Homo sapiens
ttcttgcaagctccagtagct

SEQ ID NO: 5464568 - DNA, 13 bp, Homo sapiens
ttcttgcactatt

SEQ ID NO: 5464569 - DNA, 16 bp, Homo sapiens
ttcttgcactccttcc

SEQ ID NO: 5464570 - DNA, 19 bp, Homo sapiens
ttcttgcactgtatccaag

SEQ ID NO: 5464571 - DNA, 14 bp, Homo sapiens
ttcttgcagattct

SEQ ID NO: 5464572 - DNA, 15 bp, Homo sapiens
ttcttgcagattcta

SEQ ID NO: 5464573 - DNA, 19 bp, Homo sapiens
ttcttgcagtcatcagaag

SEQ ID NO: 5464574 - DNA, 16 bp, Homo sapiens
ttcttgcattgacatt

SEQ ID NO: 5464575 - DNA, 16 bp, Homo sapiens
ttcttgccaatgaggt

SEQ ID NO: 5464576 - DNA, 15 bp, Homo sapiens
ttcttgccacacagt

SEQ ID NO: 5464577 - DNA, 14 bp, Homo sapiens
ttcttgccaccctc

SEQ ID NO: 5464578 - DNA, 19 bp, Homo sapiens
ttcttgccaccctctggga

SEQ ID NO: 5464579 - DNA, 12 bp, Homo sapiens
ttcttgccagct

SEQ ID NO: 5464580 - DNA, 13 bp, Homo sapiens
ttcttgccagctc

SEQ ID NO: 5464581 - DNA, 14 bp, Homo sapiens
ttcttgccctgagc

SEQ ID NO: 5464582 - DNA, 19 bp, Homo sapiens
ttcttgcccttcataccct

SEQ ID NO: 5464583 - DNA, 20 bp, Homo sapiens
ttcttgcctctgtccccttc

SEQ ID NO: 5464584 - DNA, 16 bp, Homo sapiens
ttcttgcctctgtgct

SEQ ID NO: 5464585 - DNA, 22 bp, Homo sapiens
ttcttgcctctgtgctgtgtgt

SEQ ID NO: 5464586 - DNA, 15 bp, Homo sapiens
ttcttgcctgctggg

SEQ ID NO: 5464587 - DNA, 12 bp, Homo sapiens
ttcttgccttcc

SEQ ID NO: 5464588 - DNA, 19 bp, Homo sapiens
ttcttgcggcaccgcccac

SEQ ID NO: 5464589 - DNA, 15 bp, Homo sapiens
ttcttgctaagctcc

SEQ ID NO: 5464590 - DNA, 21 bp, Homo sapiens
ttcttgctacaccccttttcc

SEQ ID NO: 5464591 - DNA, 15 bp, Homo sapiens
ttcttgctagtattc

SEQ ID NO: 5464592 - DNA, 12 bp, Homo sapiens
ttcttgctcctg

SEQ ID NO: 5464593 - DNA, 16 bp, Homo sapiens
ttcttgctctctctcc

SEQ ID NO: 5464594 - DNA, 14 bp, Homo sapiens
ttcttgctgcagcc

SEQ ID NO: 5464595 - DNA, 21 bp, Homo sapiens
ttcttgctgccatgatgtata

SEQ ID NO: 5464596 - DNA, 14 bp, Homo sapiens
ttcttgctgcccac

SEQ ID NO: 5464597 - DNA, 15 bp, Homo sapiens
ttcttgctgcccaca

SEQ ID NO: 5464598 - DNA, 18 bp, Homo sapiens
ttcttgctgctagaactt

SEQ ID NO: 5464599 - DNA, 21 bp, Homo sapiens
ttcttgctgctagaacttttt

SEQ ID NO: 5464600 - DNA, 23 bp, Homo sapiens
ttcttgctgctagaactttttta

SEQ ID NO: 5464601 - DNA, 20 bp, Homo sapiens
ttcttgctggctctgagaat

SEQ ID NO: 5464602 - DNA, 14 bp, Homo sapiens
ttcttgcttctggc

SEQ ID NO: 5464603 - DNA, 19 bp, Homo sapiens
ttcttgcttctttctagaa

SEQ ID NO: 5464604 - DNA, 17 bp, Homo sapiens
ttcttgcttgtaaaaat

SEQ ID NO: 5464605 - DNA, 23 bp, Homo sapiens
ttcttgcttgtacctctggctga

SEQ ID NO: 5464606 - DNA, 13 bp, Homo sapiens
ttcttgcttgtgt

SEQ ID NO: 5464607 - DNA, 19 bp, Homo sapiens
ttcttgctttagaaaacat

SEQ ID NO: 5464608 - DNA, 19 bp, Homo sapiens
ttcttgctttcacaaatat

SEQ ID NO: 5464609 - DNA, 21 bp, Homo sapiens
ttcttggaactgtcccagcta

SEQ ID NO: 5464610 - DNA, 17 bp, Homo sapiens
ttcttggacacttaatt

SEQ ID NO: 5464611 - DNA, 21 bp, Homo sapiens
ttcttggacacttaattctgt

SEQ ID NO: 5464612 - DNA, 23 bp, Homo sapiens
ttcttggacacttaattctgttc

SEQ ID NO: 5464613 - DNA, 15 bp, Homo sapiens
ttcttggagaacttt

SEQ ID NO: 5464614 - DNA, 19 bp, Homo sapiens
ttcttggatctttttgcag

SEQ ID NO: 5464615 - DNA, 16 bp, Homo sapiens
ttcttggattacttta

SEQ ID NO: 5464616 - DNA, 14 bp, Homo sapiens
ttcttggattttta

SEQ ID NO: 5464617 - DNA, 23 bp, Homo sapiens
ttcttggcaaaagccttgtgtat

SEQ ID NO: 5464618 - DNA, 13 bp, Homo sapiens
ttcttggcatcta

SEQ ID NO: 5464619 - DNA, 17 bp, Homo sapiens
ttcttggccatgggagg

SEQ ID NO: 5464620 - DNA, 22 bp, Homo sapiens
ttcttggcttaatcattttcat

SEQ ID NO: 5464621 - DNA, 16 bp, Homo sapiens
ttcttgggagaaaatc

SEQ ID NO: 5464622 - DNA, 22 bp, Homo sapiens
ttcttgggcccggtccacaggt

SEQ ID NO: 5464623 - DNA, 12 bp, Homo sapiens
ttcttggggaga

SEQ ID NO: 5464624 - DNA, 17 bp, Homo sapiens
ttcttggggcccagtgc

SEQ ID NO: 5464625 - DNA, 18 bp, Homo sapiens
ttcttggggtactcttga

SEQ ID NO: 5464626 - DNA, 21 bp, Homo sapiens
ttcttgggtctgccctgccca

SEQ ID NO: 5464627 - DNA, 19 bp, Homo sapiens
ttcttggtaactgattacc

SEQ ID NO: 5464628 - DNA, 16 bp, Homo sapiens
ttcttggtagagattc

SEQ ID NO: 5464629 - DNA, 18 bp, Homo sapiens
ttcttggtgactgtccca

SEQ ID NO: 5464630 - DNA, 21 bp, Homo sapiens
ttcttggtggcagaatgaaaa

SEQ ID NO: 5464631 - DNA, 22 bp, Homo sapiens
ttcttggtggcagaatgaaaat

SEQ ID NO: 5464632 - DNA, 20 bp, Homo sapiens
ttcttggtgtttgactgtaa

SEQ ID NO: 5464633 - DNA, 17 bp, Homo sapiens
ttcttggttcataaatg

SEQ ID NO: 5464634 - DNA, 19 bp, Homo sapiens
ttcttggttcataaatgaa

SEQ ID NO: 5464635 - DNA, 13 bp, Homo sapiens
ttcttggttcctg

SEQ ID NO: 5464636 - DNA, 16 bp, Homo sapiens
ttcttggttgaggaaa

SEQ ID NO: 5464637 - DNA, 16 bp, Homo sapiens
ttcttggttggctggc

SEQ ID NO: 5464638 - DNA, 20 bp, Homo sapiens
ttcttggttggctggccttc

SEQ ID NO: 5464639 - DNA, 15 bp, Homo sapiens
ttcttggttgttaat

SEQ ID NO: 5464640 - DNA, 19 bp, Homo sapiens
ttcttggtttatgtcttgt

SEQ ID NO: 5464641 - DNA, 16 bp, Homo sapiens
ttcttggtttcagcca

SEQ ID NO: 5464642 - DNA, 15 bp, Homo sapiens
ttcttggtttgggga

SEQ ID NO: 5464643 - DNA, 16 bp, Homo sapiens
ttcttggtttgtaaat

SEQ ID NO: 5464644 - DNA, 18 bp, Homo sapiens
ttcttggtttgtaaatta

SEQ ID NO: 5464645 - DNA, 20 bp, Homo sapiens
ttcttgtaaaactgtgacat

SEQ ID NO: 5464646 - DNA, 21 bp, Homo sapiens
ttcttgtaaaactgtgacatt

SEQ ID NO: 5464647 - DNA, 15 bp, Homo sapiens
ttcttgtaaatgttt

SEQ ID NO: 5464648 - DNA, 16 bp, Homo sapiens
ttcttgtaaatgtttc

SEQ ID NO: 5464649 - DNA, 21 bp, Homo sapiens
ttcttgtaatttaaacaggcc

SEQ ID NO: 5464650 - DNA, 23 bp, Homo sapiens
ttcttgtagccatggctgggcgt

SEQ ID NO: 5464651 - DNA, 13 bp, Homo sapiens
ttcttgtagtagt

SEQ ID NO: 5464652 - DNA, 20 bp, Homo sapiens
ttcttgtatcaaattcaata

SEQ ID NO: 5464653 - DNA, 18 bp, Homo sapiens
ttcttgtattaagaatga

SEQ ID NO: 5464654 - DNA, 22 bp, Homo sapiens
ttcttgtattttaataaacttt

SEQ ID NO: 5464655 - DNA, 13 bp, Homo sapiens
ttcttgtcaaaaa

SEQ ID NO: 5464656 - DNA, 19 bp, Homo sapiens
ttcttgtcaccccagttcc

SEQ ID NO: 5464657 - DNA, 20 bp, Homo sapiens
ttcttgtcagacataaagcc

SEQ ID NO: 5464658 - DNA, 19 bp, Homo sapiens
ttcttgtcataaaatgcat

SEQ ID NO: 5464659 - DNA, 20 bp, Homo sapiens
ttcttgtccacattctactt

SEQ ID NO: 5464660 - DNA, 11 bp, Homo sapiens
ttcttgtctat

SEQ ID NO: 5464661 - DNA, 23 bp, Homo sapiens
ttcttgtctatagttgtcagtat

SEQ ID NO: 5464662 - DNA, 12 bp, Homo sapiens
ttcttgtctctc

SEQ ID NO: 5464663 - DNA, 15 bp, Homo sapiens
ttcttgtctctctgg

SEQ ID NO: 5464664 - DNA, 13 bp, Homo sapiens
ttcttgtctctga

SEQ ID NO: 5464665 - DNA, 16 bp, Homo sapiens
ttcttgtcttttcaga

SEQ ID NO: 5464666 - DNA, 11 bp, Homo sapiens
ttcttgtgaaa

SEQ ID NO: 5464667 - DNA, 13 bp, Homo sapiens
ttcttgtgaaatg

SEQ ID NO: 5464668 - DNA, 17 bp, Homo sapiens
ttcttgtgatcttgctc

SEQ ID NO: 5464669 - DNA, 17 bp, Homo sapiens
ttcttgtgccctgggcc

SEQ ID NO: 5464670 - DNA, 14 bp, Homo sapiens
ttcttgtgcctcag

SEQ ID NO: 5464671 - DNA, 15 bp, Homo sapiens
ttcttgtgcctcagc

SEQ ID NO: 5464672 - DNA, 14 bp, Homo sapiens
ttcttgtgcttttc

SEQ ID NO: 5464673 - DNA, 21 bp, Homo sapiens
ttcttgtggaagacacttgct

SEQ ID NO: 5464674 - DNA, 19 bp, Homo sapiens
ttcttgtggttaaaaacct

SEQ ID NO: 5464675 - DNA, 13 bp, Homo sapiens
ttcttgtgtagat

SEQ ID NO: 5464676 - DNA, 18 bp, Homo sapiens
ttcttgtgtagatttgaa

SEQ ID NO: 5464677 - DNA, 19 bp, Homo sapiens
ttcttgtgtagatttgaaa

SEQ ID NO: 5464678 - DNA, 20 bp, Homo sapiens
ttcttgtgtagatttgaaaa

SEQ ID NO: 5464679 - DNA, 17 bp, Homo sapiens
ttcttgtgtcctgatga

SEQ ID NO: 5464680 - DNA, 16 bp, Homo sapiens
ttcttgtgtctgtttt

SEQ ID NO: 5464681 - DNA, 17 bp, Homo sapiens
ttcttgtgttgttttct

SEQ ID NO: 5464682 - DNA, 18 bp, Homo sapiens
ttcttgtgttgttttctc

SEQ ID NO: 5464683 - DNA, 19 bp, Homo sapiens
ttcttgtgttgttttctct

SEQ ID NO: 5464684 - DNA, 21 bp, Homo sapiens
ttcttgtgttgttttctctga

SEQ ID NO: 5464685 - DNA, 14 bp, Homo sapiens
ttcttgtgtttgaa

SEQ ID NO: 5464686 - DNA, 22 bp, Homo sapiens
ttcttgtgttttactgtcagat

SEQ ID NO: 5464687 - DNA, 22 bp, Homo sapiens
ttcttgttcatccaaggaacct

SEQ ID NO: 5464688 - DNA, 20 bp, Homo sapiens
ttcttgttcatgttttgcta

SEQ ID NO: 5464689 - DNA, 12 bp, Homo sapiens
ttcttgttgctt

SEQ ID NO: 5464690 - DNA, 14 bp, Homo sapiens
ttcttgttggtgca

SEQ ID NO: 5464691 - DNA, 13 bp, Homo sapiens
ttcttgttgttta

SEQ ID NO: 5464692 - DNA, 14 bp, Homo sapiens
ttcttgtttaccaa

SEQ ID NO: 5464693 - DNA, 22 bp, Homo sapiens
ttcttgtttaccaaagaagagt

SEQ ID NO: 5464694 - DNA, 16 bp, Homo sapiens
ttcttgtttccttgtt

SEQ ID NO: 5464695 - DNA, 11 bp, Homo sapiens
ttcttgtttct

SEQ ID NO: 5464696 - DNA, 13 bp, Homo sapiens
ttcttgtttctta

SEQ ID NO: 5464697 - DNA, 19 bp, Homo sapiens
ttcttgtttcttattaggc

SEQ ID NO: 5464698 - DNA, 18 bp, Homo sapiens
ttcttgtttgtcagcatc

SEQ ID NO: 5464699 - DNA, 19 bp, Homo sapiens
ttcttgtttgtcagcatct

SEQ ID NO: 5464700 - DNA, 20 bp, Homo sapiens
ttctttaaaatgtaaagcca

SEQ ID NO: 5464701 - DNA, 14 bp, Homo sapiens
ttctttaaatatga

SEQ ID NO: 5464702 - DNA, 16 bp, Homo sapiens
ttctttaaatcaaaag

SEQ ID NO: 5464703 - DNA, 13 bp, Homo sapiens
ttctttaaattat

SEQ ID NO: 5464704 - DNA, 15 bp, Homo sapiens
ttctttaaattatgt

SEQ ID NO: 5464705 - DNA, 14 bp, Homo sapiens
ttctttaacatatc

SEQ ID NO: 5464706 - DNA, 14 bp, Homo sapiens
ttctttaaccagtc

SEQ ID NO: 5464707 - DNA, 16 bp, Homo sapiens
ttctttaaccttgtat

SEQ ID NO: 5464708 - DNA, 19 bp, Homo sapiens
ttctttaaccttgtataaa

SEQ ID NO: 5464709 - DNA, 14 bp, Homo sapiens
ttctttaaggaaga

SEQ ID NO: 5464710 - DNA, 15 bp, Homo sapiens
ttctttaaggagata

SEQ ID NO: 5464711 - DNA, 16 bp, Homo sapiens
ttctttaatcaaaagt

SEQ ID NO: 5464712 - DNA, 17 bp, Homo sapiens
ttctttaatcaaaagtc

SEQ ID NO: 5464713 - DNA, 14 bp, Homo sapiens
ttctttacctgaga

SEQ ID NO: 5464714 - DNA, 20 bp, Homo sapiens
ttctttacctgagaccagtt

SEQ ID NO: 5464715 - DNA, 16 bp, Homo sapiens
ttctttaccttcattt

SEQ ID NO: 5464716 - DNA, 15 bp, Homo sapiens
ttctttactgcactc

SEQ ID NO: 5464717 - DNA, 19 bp, Homo sapiens
ttctttactggtgatttct

SEQ ID NO: 5464718 - DNA, 12 bp, Homo sapiens
ttctttagaaaa

SEQ ID NO: 5464719 - DNA, 11 bp, Homo sapiens
ttctttagaac

SEQ ID NO: 5464720 - DNA, 16 bp, Homo sapiens
ttctttagaattttta

SEQ ID NO: 5464721 - DNA, 17 bp, Homo sapiens
ttctttagagaactgaa

SEQ ID NO: 5464722 - DNA, 23 bp, Homo sapiens
ttctttagagaactgaaaagaga

SEQ ID NO: 5464723 - DNA, 23 bp, Homo sapiens
ttctttagagaatccgtattgaa

SEQ ID NO: 5464724 - DNA, 15 bp, Homo sapiens
ttctttagagatgct

SEQ ID NO: 5464725 - DNA, 14 bp, Homo sapiens
ttctttagagatta

SEQ ID NO: 5464726 - DNA, 23 bp, Homo sapiens
ttctttagatggtggcacattcc

SEQ ID NO: 5464727 - DNA, 22 bp, Homo sapiens
ttctttagatttttaaattgga

SEQ ID NO: 5464728 - DNA, 20 bp, Homo sapiens
ttctttagcttacctgggca

SEQ ID NO: 5464729 - DNA, 17 bp, Homo sapiens
ttgaagccactgaagct

SEQ ID NO: 5464730 - DNA, 14 bp, Homo sapiens
ttgaagccatgtct

SEQ ID NO: 5464731 - DNA, 17 bp, Homo sapiens
ttgaagccatgtctaca

SEQ ID NO: 5464732 - DNA, 13 bp, Homo sapiens
ttgaagcctgccc

SEQ ID NO: 5464733 - DNA, 13 bp, Homo sapiens
ttgaagcctttgt

SEQ ID NO: 5464734 - DNA, 23 bp, Homo sapiens
ttgaagcgagtcatttcgttccc

SEQ ID NO: 5464735 - DNA, 19 bp, Homo sapiens
ttgaagctaattattttaa

SEQ ID NO: 5464736 - DNA, 15 bp, Homo sapiens
ttgaagctcaactgt

SEQ ID NO: 5464737 - DNA, 16 bp, Homo sapiens
ttgaagctcaactgtt

SEQ ID NO: 5464738 - DNA, 18 bp, Homo sapiens
ttgaagctgaaaatataa

SEQ ID NO: 5464739 - DNA, 14 bp, Homo sapiens
ttgaagctgctgtc

SEQ ID NO: 5464740 - DNA, 17 bp, Homo sapiens
ttgaagctgctgtctct

SEQ ID NO: 5464741 - DNA, 18 bp, Homo sapiens
ttgaagctgggctgtctc

SEQ ID NO: 5464742 - DNA, 20 bp, Homo sapiens
ttgaagctgggctgtctctc

SEQ ID NO: 5464743 - DNA, 23 bp, Homo sapiens
ttgaagctgttgctatttgtatt

SEQ ID NO: 5464744 - DNA, 11 bp, Homo sapiens
ttgaaggaaac

SEQ ID NO: 5464745 - DNA, 22 bp, Homo sapiens
ttgaaggaaagctatatctatt

SEQ ID NO: 5464746 - DNA, 21 bp, Homo sapiens
ttgaaggaaatgagtggccag

SEQ ID NO: 5464747 - DNA, 22 bp, Homo sapiens
ttgaaggaaatgagtggccagc

SEQ ID NO: 5464748 - DNA, 19 bp, Homo sapiens
ttgaaggaacttaaaactt

SEQ ID NO: 5464749 - DNA, 19 bp, Homo sapiens
ttgaaggaagccaaattta

SEQ ID NO: 5464750 - DNA, 20 bp, Homo sapiens
ttgaaggaagccaaatttat

SEQ ID NO: 5464751 - DNA, 18 bp, Homo sapiens
ttgaaggaatacaatata

SEQ ID NO: 5464752 - DNA, 14 bp, Homo sapiens
ttgaaggactaata

SEQ ID NO: 5464753 - DNA, 14 bp, Homo sapiens
ttgaaggagaatgg

SEQ ID NO: 5464754 - DNA, 15 bp, Homo sapiens
ttgaaggagaatggc

SEQ ID NO: 5464755 - DNA, 23 bp, Homo sapiens
ttgaaggagtttaaaaggaggct

SEQ ID NO: 5464756 - DNA, 16 bp, Homo sapiens
ttgaaggatgctgtct

SEQ ID NO: 5464757 - DNA, 13 bp, Homo sapiens
ttgaaggattgca

SEQ ID NO: 5464758 - DNA, 19 bp, Homo sapiens
ttgaaggattgcatcctgc

SEQ ID NO: 5464759 - DNA, 12 bp, Homo sapiens
ttgaaggcaaaa

SEQ ID NO: 5464760 - DNA, 17 bp, Homo sapiens
ttgaaggcaaaattgca

SEQ ID NO: 5464761 - DNA, 17 bp, Homo sapiens
ttgaaggcagaaagcaa

SEQ ID NO: 5464762 - DNA, 14 bp, Homo sapiens
ttgaaggcagtctg

SEQ ID NO: 5464763 - DNA, 15 bp, Homo sapiens
ttgaaggccctgctg

SEQ ID NO: 5464764 - DNA, 15 bp, Homo sapiens
ttgaaggcctggaat

SEQ ID NO: 5464765 - DNA, 12 bp, Homo sapiens
ttgaaggcttaa

SEQ ID NO: 5464766 - DNA, 23 bp, Homo sapiens
ttgaaggcttaattgactgaaat

SEQ ID NO: 5464767 - DNA, 14 bp, Homo sapiens
ttgaagggaaatca

SEQ ID NO: 5464768 - DNA, 21 bp, Homo sapiens
ttgaagggagaagacactgca

SEQ ID NO: 5464769 - DNA, 16 bp, Homo sapiens
ttgaagggcaagaaat

SEQ ID NO: 5464770 - DNA, 15 bp, Homo sapiens
ttgaagggccagagc

SEQ ID NO: 5464771 - DNA, 15 bp, Homo sapiens
ttgaaggtacacccc

SEQ ID NO: 5464772 - DNA, 15 bp, Homo sapiens
ttgaaggtagaatgt

SEQ ID NO: 5464773 - DNA, 19 bp, Homo sapiens
ttgaaggtcttgatttgtt

SEQ ID NO: 5464774 - DNA, 23 bp, Homo sapiens
ttgaaggtgctgacggccaggga

SEQ ID NO: 5464775 - DNA, 16 bp, Homo sapiens
ttgaaggtgctgccac

SEQ ID NO: 5464776 - DNA, 23 bp, Homo sapiens
ttgaaggttaaaggaaaagcaca

SEQ ID NO: 5464777 - DNA, 17 bp, Homo sapiens
ttgaaggtttcagatga

SEQ ID NO: 5464778 - DNA, 16 bp, Homo sapiens
ttgaagtaaacttttt

SEQ ID NO: 5464779 - DNA, 20 bp, Homo sapiens
ttgaagtaacttatttgact

SEQ ID NO: 5464780 - DNA, 15 bp, Homo sapiens
ttgaagtaagttcat

SEQ ID NO: 5464781 - DNA, 18 bp, Homo sapiens
ttgaagtaatcccgccac

SEQ ID NO: 5464782 - DNA, 15 bp, Homo sapiens
ttgaagtacttgcca

SEQ ID NO: 5464783 - DNA, 21 bp, Homo sapiens
ttgaagtacttgccagaagtt

SEQ ID NO: 5464784 - DNA, 12 bp, Homo sapiens
ttgaagtattta

SEQ ID NO: 5464785 - DNA, 18 bp, Homo sapiens
ttgaagtattttgctgga

SEQ ID NO: 5464786 - DNA, 15 bp, Homo sapiens
ttgaagtcaccttgt

SEQ ID NO: 5464787 - DNA, 14 bp, Homo sapiens
ttgaagtcatcata

SEQ ID NO: 5464788 - DNA, 19 bp, Homo sapiens
ttgaagtcatcataaaagg

SEQ ID NO: 5464789 - DNA, 15 bp, Homo sapiens
ttgaagtcattgtcc

SEQ ID NO: 5464790 - DNA, 15 bp, Homo sapiens
ttgaagtctgctcat

SEQ ID NO: 5464791 - DNA, 13 bp, Homo sapiens
ttgaagtcttgta

SEQ ID NO: 5464792 - DNA, 14 bp, Homo sapiens
ttgaagtcttgtat

SEQ ID NO: 5464793 - DNA, 21 bp, Homo sapiens
ttgaagtctttaatattttaa

SEQ ID NO: 5464794 - DNA, 18 bp, Homo sapiens
ttgaagtgactgttgtac

SEQ ID NO: 5464795 - DNA, 21 bp, Homo sapiens
ttgaagtgcagctcatgtttt

SEQ ID NO: 5464796 - DNA, 13 bp, Homo sapiens
ttgaagtggaaaa

SEQ ID NO: 5464797 - DNA, 13 bp, Homo sapiens
ttgaagtggctgg

SEQ ID NO: 5464798 - DNA, 17 bp, Homo sapiens
ttgaagtgtaggcagac

SEQ ID NO: 5464799 - DNA, 19 bp, Homo sapiens
ttgaagtgtaggcagacac

SEQ ID NO: 5464800 - DNA, 16 bp, Homo sapiens
ttgaagtgtataatat

SEQ ID NO: 5464801 - DNA, 14 bp, Homo sapiens
ttgaagtgtcttct

SEQ ID NO: 5464802 - DNA, 19 bp, Homo sapiens
ttgaagttagctttaactt

SEQ ID NO: 5464803 - DNA, 22 bp, Homo sapiens
ttgaagttagtggaaatctgaa

SEQ ID NO: 5464804 - DNA, 21 bp, Homo sapiens
ttgaagttcatggtgatcagt

SEQ ID NO: 5464805 - DNA, 20 bp, Homo sapiens
ttgaagttctgaaatttaac

SEQ ID NO: 5464806 - DNA, 22 bp, Homo sapiens
ttgaagttgggtgtttccagaa

SEQ ID NO: 5464807 - DNA, 23 bp, Homo sapiens
ttgaagttgggtgtttccagaat

SEQ ID NO: 5464808 - DNA, 19 bp, Homo sapiens
ttgaagttgttactaacta

SEQ ID NO: 5464809 - DNA, 19 bp, Homo sapiens
ttgaagtttacatttttat

SEQ ID NO: 5464810 - DNA, 22 bp, Homo sapiens
ttgaagtttcaagttttaaagt

SEQ ID NO: 5464811 - DNA, 18 bp, Homo sapiens
ttgaataaaaaacatttg

SEQ ID NO: 5464812 - DNA, 19 bp, Homo sapiens
ttgaataaaaaacatttgt

SEQ ID NO: 5464813 - DNA, 20 bp, Homo sapiens
ttgaataaaaaacatttgta

SEQ ID NO: 5464814 - DNA, 19 bp, Homo sapiens
ttgaataaaaaatagacat

SEQ ID NO: 5464815 - DNA, 17 bp, Homo sapiens
ttgaataaaaacctttt

SEQ ID NO: 5464816 - DNA, 12 bp, Homo sapiens
ttgaataaaaag

SEQ ID NO: 5464817 - DNA, 20 bp, Homo sapiens
ttgaataaaaagtgaacttt

SEQ ID NO: 5464818 - DNA, 20 bp, Homo sapiens
ttgaataaaaatagaaacct

SEQ ID NO: 5464819 - DNA, 21 bp, Homo sapiens
ttgaataaacaccactggatt

SEQ ID NO: 5464820 - DNA, 23 bp, Homo sapiens
ttgaataaacaccactggattaa

SEQ ID NO: 5464821 - DNA, 22 bp, Homo sapiens
ttgaataaactctcccctttct

SEQ ID NO: 5464822 - DNA, 12 bp, Homo sapiens
ttgaataaagaa

SEQ ID NO: 5464823 - DNA, 15 bp, Homo sapiens
ttgaataaagtctga

SEQ ID NO: 5464824 - DNA, 16 bp, Homo sapiens
ttgaataaagtctgag

SEQ ID NO: 5464825 - DNA, 17 bp, Homo sapiens
ttgaataaatgagaaaa

SEQ ID NO: 5464826 - DNA, 13 bp, Homo sapiens
ttgaataaatgtc

SEQ ID NO: 5464827 - DNA, 14 bp, Homo sapiens
ttgaataaatgtca

SEQ ID NO: 5464828 - DNA, 14 bp, Homo sapiens
ttgaataaattatg

SEQ ID NO: 5464829 - DNA, 14 bp, Homo sapiens
ttgaataagagtga

SEQ ID NO: 5464830 - DNA, 15 bp, Homo sapiens
ttgaataaggaaatg

SEQ ID NO: 5464831 - DNA, 16 bp, Homo sapiens
ttgaataagtattctt

SEQ ID NO: 5464832 - DNA, 14 bp, Homo sapiens
ttgaataataaatc

SEQ ID NO: 5464833 - DNA, 16 bp, Homo sapiens
ttgaataataaatcga

SEQ ID NO: 5464834 - DNA, 21 bp, Homo sapiens
ttgaataatacgtgtgtacct

SEQ ID NO: 5464835 - DNA, 23 bp, Homo sapiens
ttgaataatgacagatggtgaag

SEQ ID NO: 5464836 - DNA, 14 bp, Homo sapiens
ttgaataatgtagt

SEQ ID NO: 5464837 - DNA, 16 bp, Homo sapiens
ttgaataatgtctaga

SEQ ID NO: 5464838 - DNA, 22 bp, Homo sapiens
ttgaataatgtctagattttga

SEQ ID NO: 5464839 - DNA, 23 bp, Homo sapiens
ttgaataatgtctagattttgaa

SEQ ID NO: 5464840 - DNA, 16 bp, Homo sapiens
ttgaatacatttgtat

SEQ ID NO: 5464841 - DNA, 22 bp, Homo sapiens
ttgaataccattaaaactgctt

SEQ ID NO: 5464842 - DNA, 18 bp, Homo sapiens
ttgaatacccccagagac

SEQ ID NO: 5464843 - DNA, 18 bp, Homo sapiens
ttgaatactgtctgtatc

SEQ ID NO: 5464844 - DNA, 19 bp, Homo sapiens
ttgaatactgtctgtatct

SEQ ID NO: 5464845 - DNA, 20 bp, Homo sapiens
ttgaatactgtctgtatctt

SEQ ID NO: 5464846 - DNA, 17 bp, Homo sapiens
ttgaatactttgaatgt

SEQ ID NO: 5464847 - DNA, 21 bp, Homo sapiens
ttgaatagacagaggtttcat

SEQ ID NO: 5464848 - DNA, 17 bp, Homo sapiens
ttgaataggtagtatca

SEQ ID NO: 5464849 - DNA, 18 bp, Homo sapiens
ttgaatagtggaacattt

SEQ ID NO: 5464850 - DNA, 21 bp, Homo sapiens
ttgaatagttgcttaattttg

SEQ ID NO: 5464851 - DNA, 18 bp, Homo sapiens
ttgaatataaacactata

SEQ ID NO: 5464852 - DNA, 22 bp, Homo sapiens
ttgaatataagaaaatgcttga

SEQ ID NO: 5464853 - DNA, 11 bp, Homo sapiens
ttgaatatatc

SEQ ID NO: 5464854 - DNA, 20 bp, Homo sapiens
ttgaatatatcagaatctgt

SEQ ID NO: 5464855 - DNA, 21 bp, Homo sapiens
ttgaatatattttatcttggt

SEQ ID NO: 5464856 - DNA, 19 bp, Homo sapiens
ttgaatatcagttgacaga

SEQ ID NO: 5464857 - DNA, 14 bp, Homo sapiens
ttgaatatgattaa

SEQ ID NO: 5464858 - DNA, 23 bp, Homo sapiens
ttgaatatgccttaatttagaaa

SEQ ID NO: 5464859 - DNA, 15 bp, Homo sapiens
ttgaatattatatat

SEQ ID NO: 5464860 - DNA, 18 bp, Homo sapiens
ttgaatattcctggactt

SEQ ID NO: 5464861 - DNA, 13 bp, Homo sapiens
ttgaatatttaag

SEQ ID NO: 5464862 - DNA, 16 bp, Homo sapiens
ttgaatatttaagcaa

SEQ ID NO: 5464863 - DNA, 21 bp, Homo sapiens
ttgaatatttaagcaataaaa

SEQ ID NO: 5464864 - DNA, 22 bp, Homo sapiens
ttgaatatttagcataaattta

SEQ ID NO: 5464865 - DNA, 15 bp, Homo sapiens
ttgaatatttgctta

SEQ ID NO: 5464866 - DNA, 22 bp, Homo sapiens
ttgaatatttgtcgatatttcc

SEQ ID NO: 5464867 - DNA, 18 bp, Homo sapiens
ttgaatattttttgaagg

SEQ ID NO: 5464868 - DNA, 15 bp, Homo sapiens
ttgaatcaaagtgat

SEQ ID NO: 5464869 - DNA, 19 bp, Homo sapiens
ttgaatcaatctggcttct

SEQ ID NO: 5464870 - DNA, 13 bp, Homo sapiens
ttgaatcacagta

SEQ ID NO: 5464871 - DNA, 15 bp, Homo sapiens
ttgaatcacatgaat

SEQ ID NO: 5464872 - DNA, 22 bp, Homo sapiens
ttgaatcagatggtgtcattta

SEQ ID NO: 5464873 - DNA, 23 bp, Homo sapiens
ttgaatcatgtagtatcaaatat

SEQ ID NO: 5464874 - DNA, 17 bp, Homo sapiens
ttgaatccatgcttggg

SEQ ID NO: 5464875 - DNA, 19 bp, Homo sapiens
ttgaatccatgcttgggtg

SEQ ID NO: 5464876 - DNA, 17 bp, Homo sapiens
ttgaatcgcttgcttgt

SEQ ID NO: 5464877 - DNA, 19 bp, Homo sapiens
ttgaatctataaaagaatt

SEQ ID NO: 5464878 - DNA, 21 bp, Homo sapiens
ttgaatctcataatttataca

SEQ ID NO: 5464879 - DNA, 23 bp, Homo sapiens
ttgaatctctaaaatgctgttct

SEQ ID NO: 5464880 - DNA, 14 bp, Homo sapiens
ttgaatctctgtat

SEQ ID NO: 5464881 - DNA, 24 bp, Homo sapiens
ttgaatctgattggacattttctt

SEQ ID NO: 5464882 - DNA, 19 bp, Homo sapiens
ttgaatctgttactgaaat

SEQ ID NO: 5464883 - DNA, 21 bp, Homo sapiens
ttgaatctgttactgaaatga

SEQ ID NO: 5464884 - DNA, 13 bp, Homo sapiens
ttgaatcttggga

SEQ ID NO: 5464885 - DNA, 14 bp, Homo sapiens
ttgaatctttaatt

SEQ ID NO: 5464886 - DNA, 12 bp, Homo sapiens
ttgaatgaaaaa

SEQ ID NO: 5464887 - DNA, 18 bp, Homo sapiens
ttgaatgaaaaatttaag

SEQ ID NO: 5464888 - DNA, 21 bp, Homo sapiens
ttgaatgaaaaatttaagcat

SEQ ID NO: 5464889 - DNA, 22 bp, Homo sapiens
ttgaatgaaaaatttaagcatt

SEQ ID NO: 5464890 - DNA, 20 bp, Homo sapiens
ttgaatgaaacaagcaggtg

SEQ ID NO: 5464891 - DNA, 17 bp, Homo sapiens
ttgaatgaaattccact

SEQ ID NO: 5464892 - DNA, 17 bp, Homo sapiens
ttgaatgacaacagaag

SEQ ID NO: 5464893 - DNA, 20 bp, Homo sapiens
ttgaatgacaacagaagctt

SEQ ID NO: 5464894 - DNA, 20 bp, Homo sapiens
ttgaatgagatgattcagaa

SEQ ID NO: 5464895 - DNA, 12 bp, Homo sapiens
ttgaatgatgcc

SEQ ID NO: 5464896 - DNA, 21 bp, Homo sapiens
ttgaatgatttttctttacaa

SEQ ID NO: 5464897 - DNA, 12 bp, Homo sapiens
ttgaatgcagaa

SEQ ID NO: 5464898 - DNA, 16 bp, Homo sapiens
ttgaatgcagaaaaca

SEQ ID NO: 5464899 - DNA, 19 bp, Homo sapiens
ttgaatgcctcataaatta

SEQ ID NO: 5464900 - DNA, 21 bp, Homo sapiens
ttgaatgccttatttttgaat

SEQ ID NO: 5464901 - DNA, 16 bp, Homo sapiens
ttgaatgcttaaatga

SEQ ID NO: 5464902 - DNA, 18 bp, Homo sapiens
ttgaatgcttaaatgatc

SEQ ID NO: 5464903 - DNA, 15 bp, Homo sapiens
ttgaatgctttttga

SEQ ID NO: 5464904 - DNA, 19 bp, Homo sapiens
ttgaatggattaaatggca

SEQ ID NO: 5464905 - DNA, 20 bp, Homo sapiens
ttgaatggattaaatggcac

SEQ ID NO: 5464906 - DNA, 15 bp, Homo sapiens
ttgagagactgccat

SEQ ID NO: 5464907 - DNA, 19 bp, Homo sapiens
ttgagagagaaatgctgtt

SEQ ID NO: 5464908 - DNA, 15 bp, Homo sapiens
ttgagagagatgtgt

SEQ ID NO: 5464909 - DNA, 22 bp, Homo sapiens
ttgagagcccgcgtgctggaga

SEQ ID NO: 5464910 - DNA, 23 bp, Homo sapiens
ttgagagcccgcgtgctggagaa

SEQ ID NO: 5464911 - DNA, 18 bp, Homo sapiens
ttgagaggaggacttggt

SEQ ID NO: 5464912 - DNA, 13 bp, Homo sapiens
ttgagagtgtgac

SEQ ID NO: 5464913 - DNA, 18 bp, Homo sapiens
ttgagagttttgtcttga

SEQ ID NO: 5464914 - DNA, 12 bp, Homo sapiens
ttgagataagtt

SEQ ID NO: 5464915 - DNA, 18 bp, Homo sapiens
ttgagatactttttcttt

SEQ ID NO: 5464916 - DNA, 17 bp, Homo sapiens
ttgagatagaagaactg

SEQ ID NO: 5464917 - DNA, 17 bp, Homo sapiens
ttgagatagttttcatc

SEQ ID NO: 5464918 - DNA, 22 bp, Homo sapiens
ttgagatagttttcatccataa

SEQ ID NO: 5464919 - DNA, 21 bp, Homo sapiens
ttgagatattaatgcccagac

SEQ ID NO: 5464920 - DNA, 15 bp, Homo sapiens
ttgagatcagcctgg

SEQ ID NO: 5464921 - DNA, 19 bp, Homo sapiens
ttgagatctggggaggcag

SEQ ID NO: 5464922 - DNA, 18 bp, Homo sapiens
ttgagatgagtttctggg

SEQ ID NO: 5464923 - DNA, 21 bp, Homo sapiens
ttgagatgagtttctggggaa

SEQ ID NO: 5464924 - DNA, 13 bp, Homo sapiens
ttgagatgatatt

SEQ ID NO: 5464925 - DNA, 21 bp, Homo sapiens
ttgagatgctgtaggtggtat

SEQ ID NO: 5464926 - DNA, 14 bp, Homo sapiens
ttgagatggagtct

SEQ ID NO: 5464927 - DNA, 21 bp, Homo sapiens
ttgagatggagtttctctctt

SEQ ID NO: 5464928 - DNA, 23 bp, Homo sapiens
ttgagatggggataaaatgacta

SEQ ID NO: 5464929 - DNA, 17 bp, Homo sapiens
ttgagatggtgaggctg

SEQ ID NO: 5464930 - DNA, 13 bp, Homo sapiens
ttgagatgtacat

SEQ ID NO: 5464931 - DNA, 19 bp, Homo sapiens
ttgagatgtgttcctcctg

SEQ ID NO: 5464932 - DNA, 17 bp, Homo sapiens
ttgagattagagggagg

SEQ ID NO: 5464933 - DNA, 22 bp, Homo sapiens
ttgagattcaagacaagagctg

SEQ ID NO: 5464934 - DNA, 21 bp, Homo sapiens
ttgagattcacatgctggctc

SEQ ID NO: 5464935 - DNA, 15 bp, Homo sapiens
ttgagattgtcctca

SEQ ID NO: 5464936 - DNA, 16 bp, Homo sapiens
ttgagatttacccaga

SEQ ID NO: 5464937 - DNA, 18 bp, Homo sapiens
ttgagatttttaagaact

SEQ ID NO: 5464938 - DNA, 19 bp, Homo sapiens
ttgagattttttttccgtg

SEQ ID NO: 5464939 - DNA, 18 bp, Homo sapiens
ttgagcaactttcttaca

SEQ ID NO: 5464940 - DNA, 18 bp, Homo sapiens
ttgagcaaggcaagaagt

SEQ ID NO: 5464941 - DNA, 15 bp, Homo sapiens
ttgagcaattcattt

SEQ ID NO: 5464942 - DNA, 21 bp, Homo sapiens
ttgagcacaaaacctgtccta

SEQ ID NO: 5464943 - DNA, 14 bp, Homo sapiens
ttgagcacaatctg

SEQ ID NO: 5464944 - DNA, 11 bp, Homo sapiens
ttgagcacagg

SEQ ID NO: 5464945 - DNA, 16 bp, Homo sapiens
ttgagcactcagtcta

SEQ ID NO: 5464946 - DNA, 19 bp, Homo sapiens
ttgagcactggtctctctt

SEQ ID NO: 5464947 - DNA, 12 bp, Homo sapiens
ttgagcagctga

SEQ ID NO: 5464948 - DNA, 12 bp, Homo sapiens
ttgagcaggagc

SEQ ID NO: 5464949 - DNA, 18 bp, Homo sapiens
ttgagcaggattagataa

SEQ ID NO: 5464950 - DNA, 12 bp, Homo sapiens
ttgagcagggct

SEQ ID NO: 5464951 - DNA, 16 bp, Homo sapiens
ttgagcagggctcagc

SEQ ID NO: 5464952 - DNA, 22 bp, Homo sapiens
ttgagcagtggcctacaaatca

SEQ ID NO: 5464953 - DNA, 19 bp, Homo sapiens
ttgagcatcaatcttgtta

SEQ ID NO: 5464954 - DNA, 15 bp, Homo sapiens
ttgagcatcacagaa

SEQ ID NO: 5464955 - DNA, 16 bp, Homo sapiens
ttgagcatcacagaat

SEQ ID NO: 5464956 - DNA, 19 bp, Homo sapiens
ttgagcatgcacagctgct

SEQ ID NO: 5464957 - DNA, 20 bp, Homo sapiens
ttgagcattcaaatgaagat

SEQ ID NO: 5464958 - DNA, 17 bp, Homo sapiens
ttgagcatttttaaggg

SEQ ID NO: 5464959 - DNA, 12 bp, Homo sapiens
ttgagccacagt

SEQ ID NO: 5464960 - DNA, 17 bp, Homo sapiens
ttgagccaggtggatgt

SEQ ID NO: 5464961 - DNA, 17 bp, Homo sapiens
ttgagccagttaccttt

SEQ ID NO: 5464962 - DNA, 23 bp, Homo sapiens
ttgagccagttacctttgctgtc

SEQ ID NO: 5464963 - DNA, 19 bp, Homo sapiens
ttgagccatgctacagtta

SEQ ID NO: 5464964 - DNA, 21 bp, Homo sapiens
ttgagcccaggagttcaagac

SEQ ID NO: 5464965 - DNA, 17 bp, Homo sapiens
ttgagcccattcttctg

SEQ ID NO: 5464966 - DNA, 14 bp, Homo sapiens
ttgagccccaagtc

SEQ ID NO: 5464967 - DNA, 17 bp, Homo sapiens
ttgagccccagtgctgg

SEQ ID NO: 5464968 - DNA, 12 bp, Homo sapiens
ttgagcccctga

SEQ ID NO: 5464969 - DNA, 14 bp, Homo sapiens
ttgagccctcccca

SEQ ID NO: 5464970 - DNA, 21 bp, Homo sapiens
ttgagccctgccactcaatgg

SEQ ID NO: 5464971 - DNA, 20 bp, Homo sapiens
ttgagccctggaccccaggc

SEQ ID NO: 5464972 - DNA, 13 bp, Homo sapiens
ttgagcctccccc

SEQ ID NO: 5464973 - DNA, 18 bp, Homo sapiens
ttgagcctggctgtccaa

SEQ ID NO: 5464974 - DNA, 14 bp, Homo sapiens
ttgagcctgggagg

SEQ ID NO: 5464975 - DNA, 15 bp, Homo sapiens
ttgagccttttatta

SEQ ID NO: 5464976 - DNA, 15 bp, Homo sapiens
ttgagcgtgcgcact

SEQ ID NO: 5464977 - DNA, 23 bp, Homo sapiens
ttgagcgtgcgcactgcatggga

SEQ ID NO: 5464978 - DNA, 23 bp, Homo sapiens
ttgagcgtgcgtctgtgtgtgcc

SEQ ID NO: 5464979 - DNA, 15 bp, Homo sapiens
ttgagctatgactta

SEQ ID NO: 5464980 - DNA, 16 bp, Homo sapiens
ttgagctatgatatgt

SEQ ID NO: 5464981 - DNA, 16 bp, Homo sapiens
ttgagctattcacctc

SEQ ID NO: 5464982 - DNA, 15 bp, Homo sapiens
ttgagctattgctgt

SEQ ID NO: 5464983 - DNA, 23 bp, Homo sapiens
ttgagctcagacccccactctca

SEQ ID NO: 5464984 - DNA, 19 bp, Homo sapiens
ttgagctctgtaacttaca

SEQ ID NO: 5464985 - DNA, 14 bp, Homo sapiens
ttgagctgagatgg

SEQ ID NO: 5464986 - DNA, 21 bp, Homo sapiens
ttgagctgcctgctctgcagc

SEQ ID NO: 5464987 - DNA, 16 bp, Homo sapiens
ttgagctgccttccct

SEQ ID NO: 5464988 - DNA, 18 bp, Homo sapiens
ttgagctgttttccctga

SEQ ID NO: 5464989 - DNA, 23 bp, Homo sapiens
ttgagcttacaattaggaactga

SEQ ID NO: 5464990 - DNA, 18 bp, Homo sapiens
ttgagcttctcctctgct

SEQ ID NO: 5464991 - DNA, 15 bp, Homo sapiens
ttgaggaaaaatatg

SEQ ID NO: 5464992 - DNA, 20 bp, Homo sapiens
ttgaggaaaaatatgtgaag

SEQ ID NO: 5464993 - DNA, 23 bp, Homo sapiens
ttgaggaaaacaagcattcacaa

SEQ ID NO: 5464994 - DNA, 17 bp, Homo sapiens
ttgaggaaaattaatat

SEQ ID NO: 5464995 - DNA, 14 bp, Homo sapiens
ttgaggaaagaaat

SEQ ID NO: 5464996 - DNA, 13 bp, Homo sapiens
ttgaggaaatatt

SEQ ID NO: 5464997 - DNA, 15 bp, Homo sapiens
ttgaggaaatattaa

SEQ ID NO: 5464998 - DNA, 16 bp, Homo sapiens
ttgaggaaatattaat

SEQ ID NO: 5464999 - DNA, 17 bp, Homo sapiens
ttgaggaaatttgcagc

SEQ ID NO: 5465000 - DNA, 14 bp, Homo sapiens
ttgaggaactgtac

SEQ ID NO: 5465001 - DNA, 17 bp, Homo sapiens
ttgaggaagttttgtct

SEQ ID NO: 5465002 - DNA, 18 bp, Homo sapiens
ttgaggaataaatgcctt

SEQ ID NO: 5465003 - DNA, 21 bp, Homo sapiens
ttgaggaatatttcaagctct

SEQ ID NO: 5465004 - DNA, 22 bp, Homo sapiens
ttgaggaattcagaagtggaga

SEQ ID NO: 5465005 - DNA, 19 bp, Homo sapiens
ttgaggacaaagaaaactg

SEQ ID NO: 5465006 - DNA, 14 bp, Homo sapiens
ttgaggacacatgt

SEQ ID NO: 5465007 - DNA, 16 bp, Homo sapiens
ttgaggacacatgtcc

SEQ ID NO: 5465008 - DNA, 15 bp, Homo sapiens
ttgaggacactgata

SEQ ID NO: 5465009 - DNA, 21 bp, Homo sapiens
ttgaggacctccacctgggag

SEQ ID NO: 5465010 - DNA, 22 bp, Homo sapiens
ttgaggacctccacctgggaga

SEQ ID NO: 5465011 - DNA, 16 bp, Homo sapiens
ttgaggagcatgtttt

SEQ ID NO: 5465012 - DNA, 17 bp, Homo sapiens
ttgaggagctgcactga

SEQ ID NO: 5465013 - DNA, 23 bp, Homo sapiens
ttgaggaggggcacctgccaccg

SEQ ID NO: 5465014 - DNA, 17 bp, Homo sapiens
ttgaggagttgcctgac

SEQ ID NO: 5465015 - DNA, 18 bp, Homo sapiens
ttgaggataaaaaggaag

SEQ ID NO: 5465016 - DNA, 21 bp, Homo sapiens
ttgaggataaaaaggaaggag

SEQ ID NO: 5465017 - DNA, 23 bp, Homo sapiens
ttgaggataaaaaggaaggagag

SEQ ID NO: 5465018 - DNA, 17 bp, Homo sapiens
ttgaggataaattgcca

SEQ ID NO: 5465019 - DNA, 21 bp, Homo sapiens
ttgaggataaattgccataat

SEQ ID NO: 5465020 - DNA, 14 bp, Homo sapiens
ttgaggattagttt

SEQ ID NO: 5465021 - DNA, 15 bp, Homo sapiens
ttgaggattttgagt

SEQ ID NO: 5465022 - DNA, 17 bp, Homo sapiens
ttgaggattttgagtat

SEQ ID NO: 5465023 - DNA, 21 bp, Homo sapiens
ttgaggcaaaggccagcagca

SEQ ID NO: 5465024 - DNA, 19 bp, Homo sapiens
ttgaggcaaatctaaaatt

SEQ ID NO: 5465025 - DNA, 18 bp, Homo sapiens
ttgaggcaagtgtgggcc

SEQ ID NO: 5465026 - DNA, 17 bp, Homo sapiens
ttgaggcacaaatcact

SEQ ID NO: 5465027 - DNA, 14 bp, Homo sapiens
ttgaggcatgcaca

SEQ ID NO: 5465028 - DNA, 16 bp, Homo sapiens
ttgaggcatgcacatc

SEQ ID NO: 5465029 - DNA, 21 bp, Homo sapiens
ttgaggccaagaatattgcaa

SEQ ID NO: 5465030 - DNA, 21 bp, Homo sapiens
ttgaggccaagatggctgctg

SEQ ID NO: 5465031 - DNA, 19 bp, Homo sapiens
ttgaggccaggactttgag

SEQ ID NO: 5465032 - DNA, 15 bp, Homo sapiens
ttgaggccaggctag

SEQ ID NO: 5465033 - DNA, 22 bp, Homo sapiens
ttgaggcccccgtcagggagag

SEQ ID NO: 5465034 - DNA, 19 bp, Homo sapiens
ttgaggcctgccctcaggg

SEQ ID NO: 5465035 - DNA, 21 bp, Homo sapiens
ttgaggcgggaaccctctggg

SEQ ID NO: 5465036 - DNA, 19 bp, Homo sapiens
ttgaggcggtttcctgaat

SEQ ID NO: 5465037 - DNA, 15 bp, Homo sapiens
ttgaggctaaaacaa

SEQ ID NO: 5465038 - DNA, 21 bp, Homo sapiens
ttgaggctctgtcactgagca

SEQ ID NO: 5465039 - DNA, 19 bp, Homo sapiens
ttgaggctgtcacagtcct

SEQ ID NO: 5465040 - DNA, 13 bp, Homo sapiens
ttgaggctttgtg

SEQ ID NO: 5465041 - DNA, 15 bp, Homo sapiens
ttgaggctttgtgtt

SEQ ID NO: 5465042 - DNA, 23 bp, Homo sapiens
ttgagggacaaatttaaaacaaa

SEQ ID NO: 5465043 - DNA, 22 bp, Homo sapiens
ttgagggacaagttgtttatgt

SEQ ID NO: 5465044 - DNA, 18 bp, Homo sapiens
ttgagggactgcctctgc

SEQ ID NO: 5465045 - DNA, 20 bp, Homo sapiens
ttgagggatttttttataaa

SEQ ID NO: 5465046 - DNA, 17 bp, Homo sapiens
ttgagggcaagccacca

SEQ ID NO: 5465047 - DNA, 20 bp, Homo sapiens
ttgagggcattagtactttg

SEQ ID NO: 5465048 - DNA, 20 bp, Homo sapiens
ttgagggcatttggcttcct

SEQ ID NO: 5465049 - DNA, 14 bp, Homo sapiens
ttgagggcccagag

SEQ ID NO: 5465050 - DNA, 15 bp, Homo sapiens
ttgagggcccagagc

SEQ ID NO: 5465051 - DNA, 14 bp, Homo sapiens
ttgagggctgcagt

SEQ ID NO: 5465052 - DNA, 15 bp, Homo sapiens
ttgagggctgcagtt

SEQ ID NO: 5465053 - DNA, 14 bp, Homo sapiens
ttgaggggaccagg

SEQ ID NO: 5465054 - DNA, 15 bp, Homo sapiens
ttgaggggaccagga

SEQ ID NO: 5465055 - DNA, 16 bp, Homo sapiens
ttgaggggattaatat

SEQ ID NO: 5465056 - DNA, 19 bp, Homo sapiens
ttgaggggcaactccagaa

SEQ ID NO: 5465057 - DNA, 11 bp, Homo sapiens
ttgaggggcag

SEQ ID NO: 5465058 - DNA, 18 bp, Homo sapiens
ttgaggggccaggggcag

SEQ ID NO: 5465059 - DNA, 19 bp, Homo sapiens
ttgaggggccaggggcagg

SEQ ID NO: 5465060 - DNA, 20 bp, Homo sapiens
ttgaggggccaggggcaggc

SEQ ID NO: 5465061 - DNA, 15 bp, Homo sapiens
ttgaggggctcctgg

SEQ ID NO: 5465062 - DNA, 22 bp, Homo sapiens
ttgaggggctggccttcctgcc

SEQ ID NO: 5465063 - DNA, 18 bp, Homo sapiens
ttgagggtaataaactta

SEQ ID NO: 5465064 - DNA, 21 bp, Homo sapiens
ttgagggtgggggtgctctct

SEQ ID NO: 5465065 - DNA, 20 bp, Homo sapiens
ttgagggttcacctctgcct

SEQ ID NO: 5465066 - DNA, 16 bp, Homo sapiens
ttgagggttgggctgg

SEQ ID NO: 5465067 - DNA, 23 bp, Homo sapiens
ttgaggtagaccaggatttctaa

SEQ ID NO: 5465068 - DNA, 18 bp, Homo sapiens
ttgaggtagaggaaaatc

SEQ ID NO: 5465069 - DNA, 16 bp, Homo sapiens
ttgaggtctcttttct

SEQ ID NO: 5465070 - DNA, 17 bp, Homo sapiens
ttgaggtctgctcggcc

SEQ ID NO: 5465071 - DNA, 16 bp, Homo sapiens
ttgaggtctgttcttt

SEQ ID NO: 5465072 - DNA, 19 bp, Homo sapiens
ttgaggtctttctcctcag

SEQ ID NO: 5465073 - DNA, 21 bp, Homo sapiens
ttgaggtctttctcctcagga

SEQ ID NO: 5465074 - DNA, 18 bp, Homo sapiens
ttgaggtcttttgacatg

SEQ ID NO: 5465075 - DNA, 22 bp, Homo sapiens
ttgaggtcttttgacatgtgga

SEQ ID NO: 5465076 - DNA, 23 bp, Homo sapiens
ttgaggtcttttgacatgtggaa

SEQ ID NO: 5465077 - DNA, 22 bp, Homo sapiens
ttgaggtggaagccctccttcc

SEQ ID NO: 5465078 - DNA, 19 bp, Homo sapiens
ttgaggtgggtgggcctga

SEQ ID NO: 5465079 - DNA, 21 bp, Homo sapiens
ttgaggtggtctgaatgttct

SEQ ID NO: 5465080 - DNA, 19 bp, Homo sapiens
ttgaggtgtcagagaaaat

SEQ ID NO: 5465081 - DNA, 18 bp, Homo sapiens
ttgaggttaaaatataaa

SEQ ID NO: 5465082 - DNA, 19 bp, Homo sapiens
ttgcaatatcgatcagatg

SEQ ID NO: 5465083 - DNA, 22 bp, Homo sapiens
ttgcaatccaggctgttctcag

SEQ ID NO: 5465084 - DNA, 16 bp, Homo sapiens
ttgcaatctaatctga

SEQ ID NO: 5465085 - DNA, 13 bp, Homo sapiens
ttgcaatctataa

SEQ ID NO: 5465086 - DNA, 19 bp, Homo sapiens
ttgcaatggatcagccaag

SEQ ID NO: 5465087 - DNA, 19 bp, Homo sapiens
ttgcaatggctatatggca

SEQ ID NO: 5465088 - DNA, 13 bp, Homo sapiens
ttgcaatgtattt

SEQ ID NO: 5465089 - DNA, 17 bp, Homo sapiens
ttgcaattcatgtaaca

SEQ ID NO: 5465090 - DNA, 13 bp, Homo sapiens
ttgcaattgctct

SEQ ID NO: 5465091 - DNA, 17 bp, Homo sapiens
ttgcaattgctcttctc

SEQ ID NO: 5465092 - DNA, 14 bp, Homo sapiens
ttgcaattgtttaa

SEQ ID NO: 5465093 - DNA, 22 bp, Homo sapiens
ttgcaattgtttaagaatcatg

SEQ ID NO: 5465094 - DNA, 23 bp, Homo sapiens
ttgcaattgtttaagaatcatgg

SEQ ID NO: 5465095 - DNA, 15 bp, Homo sapiens
ttgcaatttcttagg

SEQ ID NO: 5465096 - DNA, 15 bp, Homo sapiens
ttgcaatttgagcca

SEQ ID NO: 5465097 - DNA, 20 bp, Homo sapiens
ttgcaattttaacacacata

SEQ ID NO: 5465098 - DNA, 16 bp, Homo sapiens
ttgcacaaaaagcaca

SEQ ID NO: 5465099 - DNA, 17 bp, Homo sapiens
ttgcacaactctactgt

SEQ ID NO: 5465100 - DNA, 19 bp, Homo sapiens
ttgcacaagcttgtatata

SEQ ID NO: 5465101 - DNA, 21 bp, Homo sapiens
ttgcacaagcttgtatataca

SEQ ID NO: 5465102 - DNA, 17 bp, Homo sapiens
ttgcacaagttccctgg

SEQ ID NO: 5465103 - DNA, 9 bp, Homo sapiens
ttgcacaat

SEQ ID NO: 5465104 - DNA, 14 bp, Homo sapiens
ttgcacaatatatt

SEQ ID NO: 5465105 - DNA, 19 bp, Homo sapiens
ttgcacaatattgaacttt

SEQ ID NO: 5465106 - DNA, 20 bp, Homo sapiens
ttgcacaatattgaactttt

SEQ ID NO: 5465107 - DNA, 11 bp, Homo sapiens
ttgcacaattt

SEQ ID NO: 5465108 - DNA, 12 bp, Homo sapiens
ttgcacaatttg

SEQ ID NO: 5465109 - DNA, 18 bp, Homo sapiens
ttgcacaattttgtccta

SEQ ID NO: 5465110 - DNA, 22 bp, Homo sapiens
ttgcacacagatgtgaaatgaa

SEQ ID NO: 5465111 - DNA, 18 bp, Homo sapiens
ttgcacacccactgcccc

SEQ ID NO: 5465112 - DNA, 21 bp, Homo sapiens
ttgcacaccttttccccagga

SEQ ID NO: 5465113 - DNA, 23 bp, Homo sapiens
ttgcacaccttttccccaggagc

SEQ ID NO: 5465114 - DNA, 13 bp, Homo sapiens
ttgcacacttccc

SEQ ID NO: 5465115 - DNA, 20 bp, Homo sapiens
ttgcacactttggtaccaga

SEQ ID NO: 5465116 - DNA, 15 bp, Homo sapiens
ttgcacagaagtcct

SEQ ID NO: 5465117 - DNA, 17 bp, Homo sapiens
ttgcacagaagtcctgt

SEQ ID NO: 5465118 - DNA, 13 bp, Homo sapiens
ttgcacagacatc

SEQ ID NO: 5465119 - DNA, 18 bp, Homo sapiens
ttgcacagccaaatttaa

SEQ ID NO: 5465120 - DNA, 22 bp, Homo sapiens
ttgcacagccaacgagacacat

SEQ ID NO: 5465121 - DNA, 16 bp, Homo sapiens
ttgcacagctggagaa

SEQ ID NO: 5465122 - DNA, 18 bp, Homo sapiens
ttgcacaggatgctggcc

SEQ ID NO: 5465123 - DNA, 14 bp, Homo sapiens
ttgcacaggccact

SEQ ID NO: 5465124 - DNA, 21 bp, Homo sapiens
ttgcacaggccacttgctcag

SEQ ID NO: 5465125 - DNA, 17 bp, Homo sapiens
ttgcacagtccctcctg

SEQ ID NO: 5465126 - DNA, 18 bp, Homo sapiens
ttgcacagtccctcctgt

SEQ ID NO: 5465127 - DNA, 12 bp, Homo sapiens
ttgcacagtgga

SEQ ID NO: 5465128 - DNA, 15 bp, Homo sapiens
ttgcacatcattcat

SEQ ID NO: 5465129 - DNA, 14 bp, Homo sapiens
ttgcacatctctgc

SEQ ID NO: 5465130 - DNA, 15 bp, Homo sapiens
ttgcacatcttggct

SEQ ID NO: 5465131 - DNA, 23 bp, Homo sapiens
ttgcacattaaatgactcttccc

SEQ ID NO: 5465132 - DNA, 13 bp, Homo sapiens
ttgcacattagga

SEQ ID NO: 5465133 - DNA, 14 bp, Homo sapiens
ttgcacattccaaa

SEQ ID NO: 5465134 - DNA, 16 bp, Homo sapiens
ttgcacattttgattt

SEQ ID NO: 5465135 - DNA, 15 bp, Homo sapiens
ttgcaccactgcact

SEQ ID NO: 5465136 - DNA, 18 bp, Homo sapiens
ttgcaccagttttatcca

SEQ ID NO: 5465137 - DNA, 19 bp, Homo sapiens
ttgcaccagttttatccat

SEQ ID NO: 5465138 - DNA, 20 bp, Homo sapiens
ttgcaccatactccttgctt

SEQ ID NO: 5465139 - DNA, 14 bp, Homo sapiens
ttgcaccattttca

SEQ ID NO: 5465140 - DNA, 16 bp, Homo sapiens
ttgcacccagccctgg

SEQ ID NO: 5465141 - DNA, 13 bp, Homo sapiens
ttgcacccctcac

SEQ ID NO: 5465142 - DNA, 24 bp, Homo sapiens
ttgcacccctcactctggcctcag

SEQ ID NO: 5465143 - DNA, 17 bp, Homo sapiens
ttgcaccgcctgccctc

SEQ ID NO: 5465144 - DNA, 21 bp, Homo sapiens
ttgcacctcagcctcccaagt

SEQ ID NO: 5465145 - DNA, 16 bp, Homo sapiens
ttgcacctctgctgat

SEQ ID NO: 5465146 - DNA, 14 bp, Homo sapiens
ttgcacctgagacc

SEQ ID NO: 5465147 - DNA, 14 bp, Homo sapiens
ttgcacctgagcct

SEQ ID NO: 5465148 - DNA, 21 bp, Homo sapiens
ttgcacctgcagccaagcaaa

SEQ ID NO: 5465149 - DNA, 16 bp, Homo sapiens
ttgcacctgcaggctt

SEQ ID NO: 5465150 - DNA, 14 bp, Homo sapiens
ttgcacctgctctc

SEQ ID NO: 5465151 - DNA, 13 bp, Homo sapiens
ttgcacctgtccc

SEQ ID NO: 5465152 - DNA, 20 bp, Homo sapiens
ttgcaccttttcatgtacag

SEQ ID NO: 5465153 - DNA, 21 bp, Homo sapiens
ttgcaccttttcatgtacagc

SEQ ID NO: 5465154 - DNA, 14 bp, Homo sapiens
ttgcacgcctcccc

SEQ ID NO: 5465155 - DNA, 21 bp, Homo sapiens
ttgcacgcctcccccctcact

SEQ ID NO: 5465156 - DNA, 13 bp, Homo sapiens
ttgcacggctgct

SEQ ID NO: 5465157 - DNA, 16 bp, Homo sapiens
ttgcacggctgctcgg

SEQ ID NO: 5465158 - DNA, 17 bp, Homo sapiens
ttgcacggtttgtgaga

SEQ ID NO: 5465159 - DNA, 14 bp, Homo sapiens
ttgcacgtgtgttt

SEQ ID NO: 5465160 - DNA, 20 bp, Homo sapiens
ttgcacgtgtgtttttctat

SEQ ID NO: 5465161 - DNA, 23 bp, Homo sapiens
ttgcacgtgtgtttttctattaa

SEQ ID NO: 5465162 - DNA, 20 bp, Homo sapiens
ttgcactaaaagtgatgtga

SEQ ID NO: 5465163 - DNA, 21 bp, Homo sapiens
ttgcactaaaagtgatgtgat

SEQ ID NO: 5465164 - DNA, 14 bp, Homo sapiens
ttgcactaaaatga

SEQ ID NO: 5465165 - DNA, 19 bp, Homo sapiens
ttgcactaaataaactact

SEQ ID NO: 5465166 - DNA, 19 bp, Homo sapiens
ttgcactacataatctctg

SEQ ID NO: 5465167 - DNA, 15 bp, Homo sapiens
ttgcactatctttca

SEQ ID NO: 5465168 - DNA, 21 bp, Homo sapiens
ttgcactattgagtcttcatg

SEQ ID NO: 5465169 - DNA, 16 bp, Homo sapiens
ttgcactcaagttgtt

SEQ ID NO: 5465170 - DNA, 17 bp, Homo sapiens
ttgcactcaagttgttt

SEQ ID NO: 5465171 - DNA, 19 bp, Homo sapiens
ttgcactcaagttgtttaa

SEQ ID NO: 5465172 - DNA, 16 bp, Homo sapiens
ttgcactccagcctgg

SEQ ID NO: 5465173 - DNA, 20 bp, Homo sapiens
ttgcactccagcctgggcaa

SEQ ID NO: 5465174 - DNA, 15 bp, Homo sapiens
ttgcactcctcacac

SEQ ID NO: 5465175 - DNA, 15 bp, Homo sapiens
ttgcactccttccct

SEQ ID NO: 5465176 - DNA, 20 bp, Homo sapiens
ttgcactctagcctggcaac

SEQ ID NO: 5465177 - DNA, 17 bp, Homo sapiens
ttgcactctagcctggg

SEQ ID NO: 5465178 - DNA, 13 bp, Homo sapiens
ttgcactgaagtt

SEQ ID NO: 5465179 - DNA, 16 bp, Homo sapiens
ttgcactgaagttttt

SEQ ID NO: 5465180 - DNA, 18 bp, Homo sapiens
ttgcactgaagtttttga

SEQ ID NO: 5465181 - DNA, 20 bp, Homo sapiens
ttgcactgaagtttttgaaa

SEQ ID NO: 5465182 - DNA, 16 bp, Homo sapiens
ttgcactgagggccac

SEQ ID NO: 5465183 - DNA, 21 bp, Homo sapiens
ttgcactgatgtccctccttt

SEQ ID NO: 5465184 - DNA, 15 bp, Homo sapiens
ttgcactgccccctg

SEQ ID NO: 5465185 - DNA, 14 bp, Homo sapiens
ttgcactgcttata

SEQ ID NO: 5465186 - DNA, 16 bp, Homo sapiens
ttgcactggaatatct

SEQ ID NO: 5465187 - DNA, 17 bp, Homo sapiens
ttgcactggagttctat

SEQ ID NO: 5465188 - DNA, 12 bp, Homo sapiens
ttgcactgtaat

SEQ ID NO: 5465189 - DNA, 20 bp, Homo sapiens
ttgcactgtaatgaggaaaa

SEQ ID NO: 5465190 - DNA, 12 bp, Homo sapiens
ttgcactgtctg

SEQ ID NO: 5465191 - DNA, 16 bp, Homo sapiens
ttgcactgtgggggct

SEQ ID NO: 5465192 - DNA, 22 bp, Homo sapiens
ttgcacttatatagcacctttc

SEQ ID NO: 5465193 - DNA, 15 bp, Homo sapiens
ttgcacttatgtact

SEQ ID NO: 5465194 - DNA, 17 bp, Homo sapiens
ttgcacttatgtacttg

SEQ ID NO: 5465195 - DNA, 22 bp, Homo sapiens
ttgcacttgattaagcttttgt

SEQ ID NO: 5465196 - DNA, 17 bp, Homo sapiens
ttgcacttgtgattatt

SEQ ID NO: 5465197 - DNA, 17 bp, Homo sapiens
ttgcactttagacattt

SEQ ID NO: 5465198 - DNA, 23 bp, Homo sapiens
ttgcactttcctttcaataaagt

SEQ ID NO: 5465199 - DNA, 14 bp, Homo sapiens
ttgcactttgtagt

SEQ ID NO: 5465200 - DNA, 14 bp, Homo sapiens
ttgcacttttgaat

SEQ ID NO: 5465201 - DNA, 22 bp, Homo sapiens
ttgcacttttgaatgtccaaaa

SEQ ID NO: 5465202 - DNA, 17 bp, Homo sapiens
ttgcactttttcttaat

SEQ ID NO: 5465203 - DNA, 18 bp, Homo sapiens
ttgcagaaaagcacctgc

SEQ ID NO: 5465204 - DNA, 20 bp, Homo sapiens
ttgcagaaaagcacctgccg

SEQ ID NO: 5465205 - DNA, 12 bp, Homo sapiens
ttgcagaaagga

SEQ ID NO: 5465206 - DNA, 19 bp, Homo sapiens
ttgcagaactaaactcatt

SEQ ID NO: 5465207 - DNA, 14 bp, Homo sapiens
ttgcagaactgcca

SEQ ID NO: 5465208 - DNA, 11 bp, Homo sapiens
ttgcagaactt

SEQ ID NO: 5465209 - DNA, 13 bp, Homo sapiens
ttgcagaagaggg

SEQ ID NO: 5465210 - DNA, 16 bp, Homo sapiens
ttgcagaaggaaatga

SEQ ID NO: 5465211 - DNA, 19 bp, Homo sapiens
ttgcagaaggaaatgatgg

SEQ ID NO: 5465212 - DNA, 21 bp, Homo sapiens
ttgcagaaggcaaggccctgc

SEQ ID NO: 5465213 - DNA, 16 bp, Homo sapiens
ttgcagaatgatgcag

SEQ ID NO: 5465214 - DNA, 21 bp, Homo sapiens
ttgcagaattaactataacaa

SEQ ID NO: 5465215 - DNA, 11 bp, Homo sapiens
ttgcagacagg

SEQ ID NO: 5465216 - DNA, 23 bp, Homo sapiens
ttgcagacagtccttaatgctga

SEQ ID NO: 5465217 - DNA, 22 bp, Homo sapiens
ttgcagacagtgttttgcacat

SEQ ID NO: 5465218 - DNA, 17 bp, Homo sapiens
ttgcagaccaggaagga

SEQ ID NO: 5465219 - DNA, 16 bp, Homo sapiens
ttgcagacctgggact

SEQ ID NO: 5465220 - DNA, 17 bp, Homo sapiens
ttgcagacctgggactt

SEQ ID NO: 5465221 - DNA, 22 bp, Homo sapiens
ttgcagacgggcaagaagctgc

SEQ ID NO: 5465222 - DNA, 20 bp, Homo sapiens
ttgcagactagaattctagt

SEQ ID NO: 5465223 - DNA, 22 bp, Homo sapiens
ttgcagactggtgttaatgagt

SEQ ID NO: 5465224 - DNA, 12 bp, Homo sapiens
ttgcagaggagc

SEQ ID NO: 5465225 - DNA, 16 bp, Homo sapiens
ttgcagaggagcccag

SEQ ID NO: 5465226 - DNA, 19 bp, Homo sapiens
ttgcagaggtccaaatgat

SEQ ID NO: 5465227 - DNA, 22 bp, Homo sapiens
ttgcagagtggaaactcagccg

SEQ ID NO: 5465228 - DNA, 22 bp, Homo sapiens
ttgcagataaactgatgtttga

SEQ ID NO: 5465229 - DNA, 17 bp, Homo sapiens
ttgcagataattctgga

SEQ ID NO: 5465230 - DNA, 22 bp, Homo sapiens
ttgcagatagaatttggcccag

SEQ ID NO: 5465231 - DNA, 23 bp, Homo sapiens
ttgcagatagaatttggcccaga

SEQ ID NO: 5465232 - DNA, 18 bp, Homo sapiens
ttgcagatatctgcatgt

SEQ ID NO: 5465233 - DNA, 15 bp, Homo sapiens
ttgcagatattctct

SEQ ID NO: 5465234 - DNA, 14 bp, Homo sapiens
ttgcagatatttga

SEQ ID NO: 5465235 - DNA, 14 bp, Homo sapiens
ttgcagatgaaaaa

SEQ ID NO: 5465236 - DNA, 23 bp, Homo sapiens
ttgcagatgaaatgttctgttca

SEQ ID NO: 5465237 - DNA, 14 bp, Homo sapiens
ttgcagatgacaaa

SEQ ID NO: 5465238 - DNA, 13 bp, Homo sapiens
ttgcagatggaaa

SEQ ID NO: 5465239 - DNA, 20 bp, Homo sapiens
ttgcagatgtattgactgta

SEQ ID NO: 5465240 - DNA, 16 bp, Homo sapiens
ttgcagatgttcaaat

SEQ ID NO: 5465241 - DNA, 12 bp, Homo sapiens
ttgcagcagagg

SEQ ID NO: 5465242 - DNA, 17 bp, Homo sapiens
ttgcagcagaggagctg

SEQ ID NO: 5465243 - DNA, 13 bp, Homo sapiens
ttgcagcagggct

SEQ ID NO: 5465244 - DNA, 14 bp, Homo sapiens
ttgcagcagtacca

SEQ ID NO: 5465245 - DNA, 15 bp, Homo sapiens
ttgcagcatttacta

SEQ ID NO: 5465246 - DNA, 16 bp, Homo sapiens
ttgcagcatttactat

SEQ ID NO: 5465247 - DNA, 12 bp, Homo sapiens
ttgcagcatttt

SEQ ID NO: 5465248 - DNA, 13 bp, Homo sapiens
ttgcagccaggag

SEQ ID NO: 5465249 - DNA, 15 bp, Homo sapiens
ttgcagcccaaggac

SEQ ID NO: 5465250 - DNA, 21 bp, Homo sapiens
ttgcagcccttgtgatgtgat

SEQ ID NO: 5465251 - DNA, 17 bp, Homo sapiens
ttgcagccgcagagaaa

SEQ ID NO: 5465252 - DNA, 19 bp, Homo sapiens
ttgcagccgcagagaaatg

SEQ ID NO: 5465253 - DNA, 19 bp, Homo sapiens
ttgcagcctaagaagaagg

SEQ ID NO: 5465254 - DNA, 19 bp, Homo sapiens
ttgcagcgattaataacag

SEQ ID NO: 5465255 - DNA, 23 bp, Homo sapiens
ttgcagctcccattctatgtgtc

SEQ ID NO: 5465256 - DNA, 9 bp, Homo sapiens
ttgcagctg

SEQ ID NO: 5465257 - DNA, 17 bp, Homo sapiens
ttgcagctgctcttgca

SEQ ID NO: 5465258 - DNA, 14 bp, Homo sapiens
ttgcagctgctggt

SEQ ID NO: 5465259 - DNA, 23 bp, Homo sapiens
ttgcagctgcttttgcagaaatc

SEQ ID NO: 5465260 - DNA, 22 bp, Homo sapiens
ttgcagctggcccactgctggc

SEQ ID NO: 5465261 - DNA, 20 bp, Homo sapiens
ttgccttaaaagaaatctct

SEQ ID NO: 5465262 - DNA, 16 bp, Homo sapiens
ttgccttaaagaaagt

SEQ ID NO: 5465263 - DNA, 22 bp, Homo sapiens
ttgccttagcacttctttcctc

SEQ ID NO: 5465264 - DNA, 22 bp, Homo sapiens
ttgccttaggaagtgacttgaa

SEQ ID NO: 5465265 - DNA, 19 bp, Homo sapiens
ttgccttatgggctgaagt

SEQ ID NO: 5465266 - DNA, 16 bp, Homo sapiens
ttgccttatttctcat

SEQ ID NO: 5465267 - DNA, 22 bp, Homo sapiens
ttgccttatttctcattgcctc

SEQ ID NO: 5465268 - DNA, 17 bp, Homo sapiens
ttgccttatttgtctgt

SEQ ID NO: 5465269 - DNA, 19 bp, Homo sapiens
ttgccttatttgtctgtaa

SEQ ID NO: 5465270 - DNA, 23 bp, Homo sapiens
ttgccttcaaaaatgtgctgcct

SEQ ID NO: 5465271 - DNA, 16 bp, Homo sapiens
ttgccttcccctgtct

SEQ ID NO: 5465272 - DNA, 13 bp, Homo sapiens
ttgccttcccctt

SEQ ID NO: 5465273 - DNA, 23 bp, Homo sapiens
ttgccttcctcgtgcagagctgg

SEQ ID NO: 5465274 - DNA, 23 bp, Homo sapiens
ttgccttcctttctccaggacca

SEQ ID NO: 5465275 - DNA, 17 bp, Homo sapiens
ttgccttctacttttaa

SEQ ID NO: 5465276 - DNA, 17 bp, Homo sapiens
ttgccttctagacactg

SEQ ID NO: 5465277 - DNA, 20 bp, Homo sapiens
ttgccttctcaccagctgca

SEQ ID NO: 5465278 - DNA, 20 bp, Homo sapiens
ttgccttctgaaatgtgacc

SEQ ID NO: 5465279 - DNA, 21 bp, Homo sapiens
ttgccttctggagctgggaga

SEQ ID NO: 5465280 - DNA, 14 bp, Homo sapiens
ttgccttctgggga

SEQ ID NO: 5465281 - DNA, 19 bp, Homo sapiens
ttgccttctggtttcttcc

SEQ ID NO: 5465282 - DNA, 15 bp, Homo sapiens
ttgccttctttactc

SEQ ID NO: 5465283 - DNA, 18 bp, Homo sapiens
ttgccttctttgaagaag

SEQ ID NO: 5465284 - DNA, 18 bp, Homo sapiens
ttgccttgaaccacttcc

SEQ ID NO: 5465285 - DNA, 17 bp, Homo sapiens
ttgccttgcagaactgc

SEQ ID NO: 5465286 - DNA, 18 bp, Homo sapiens
ttgccttgcttctcccat

SEQ ID NO: 5465287 - DNA, 18 bp, Homo sapiens
ttgccttggctgcagttt

SEQ ID NO: 5465288 - DNA, 16 bp, Homo sapiens
ttgccttgggcctggg

SEQ ID NO: 5465289 - DNA, 13 bp, Homo sapiens
ttgcctttaacag

SEQ ID NO: 5465290 - DNA, 15 bp, Homo sapiens
ttgcctttaatattt

SEQ ID NO: 5465291 - DNA, 23 bp, Homo sapiens
ttgcctttagtgatcacagcagc

SEQ ID NO: 5465292 - DNA, 12 bp, Homo sapiens
ttgcctttccag

SEQ ID NO: 5465293 - DNA, 16 bp, Homo sapiens
ttgcctttcgaggcct

SEQ ID NO: 5465294 - DNA, 11 bp, Homo sapiens
ttgcctttctc

SEQ ID NO: 5465295 - DNA, 14 bp, Homo sapiens
ttgcctttctgtgt

SEQ ID NO: 5465296 - DNA, 17 bp, Homo sapiens
ttgcctttctgtgttta

SEQ ID NO: 5465297 - DNA, 17 bp, Homo sapiens
ttgcctttgaagagtga

SEQ ID NO: 5465298 - DNA, 19 bp, Homo sapiens
ttgcctttgtaatatgaga

SEQ ID NO: 5465299 - DNA, 21 bp, Homo sapiens
ttgcctttgtaatatgagaat

SEQ ID NO: 5465300 - DNA, 13 bp, Homo sapiens
ttgcctttgtggc

SEQ ID NO: 5465301 - DNA, 18 bp, Homo sapiens
ttgcctttgtggccttcc

SEQ ID NO: 5465302 - DNA, 19 bp, Homo sapiens
ttgccttttatgtaaattt

SEQ ID NO: 5465303 - DNA, 12 bp, Homo sapiens
ttgccttttgtt

SEQ ID NO: 5465304 - DNA, 15 bp, Homo sapiens
ttgccttttgttaat

SEQ ID NO: 5465305 - DNA, 18 bp, Homo sapiens
ttgcctttttacagccaa

SEQ ID NO: 5465306 - DNA, 17 bp, Homo sapiens
ttgcctttttataactt

SEQ ID NO: 5465307 - DNA, 22 bp, Homo sapiens
ttgcctttttcattttccaata

SEQ ID NO: 5465308 - DNA, 22 bp, Homo sapiens
ttgccttttttctatatcaaaa

SEQ ID NO: 5465309 - DNA, 22 bp, Homo sapiens
ttgcgaaaattgcgaaatctgt

SEQ ID NO: 5465310 - DNA, 21 bp, Homo sapiens
ttgcgaccaccaacacacagg

SEQ ID NO: 5465311 - DNA, 18 bp, Homo sapiens
ttgcgacggagagaaaaa

SEQ ID NO: 5465312 - DNA, 15 bp, Homo sapiens
ttgcgacttgtcaca

SEQ ID NO: 5465313 - DNA, 15 bp, Homo sapiens
ttgcgagaattttca

SEQ ID NO: 5465314 - DNA, 16 bp, Homo sapiens
ttgcgagagatgtgtg

SEQ ID NO: 5465315 - DNA, 20 bp, Homo sapiens
ttgcgagcaccaagtacaag

SEQ ID NO: 5465316 - DNA, 21 bp, Homo sapiens
ttgcgcctcggtatctggctt

SEQ ID NO: 5465317 - DNA, 13 bp, Homo sapiens
ttgcgctcagggg

SEQ ID NO: 5465318 - DNA, 20 bp, Homo sapiens
ttgcgctcaggggctccatg

SEQ ID NO: 5465319 - DNA, 15 bp, Homo sapiens
ttgcgctcctggccc

SEQ ID NO: 5465320 - DNA, 19 bp, Homo sapiens
ttgcgctcctggcccagcc

SEQ ID NO: 5465321 - DNA, 21 bp, Homo sapiens
ttgcgctcctggcccagcctt

SEQ ID NO: 5465322 - DNA, 20 bp, Homo sapiens
ttgcggaactcttcctggaa

SEQ ID NO: 5465323 - DNA, 16 bp, Homo sapiens
ttgcggcaaaaggaaa

SEQ ID NO: 5465324 - DNA, 21 bp, Homo sapiens
ttgcggcaccgcccacccaca

SEQ ID NO: 5465325 - DNA, 21 bp, Homo sapiens
ttgcggccagtattagactgg

SEQ ID NO: 5465326 - DNA, 12 bp, Homo sapiens
ttgcggccccag

SEQ ID NO: 5465327 - DNA, 16 bp, Homo sapiens
ttgcggccccaggagg

SEQ ID NO: 5465328 - DNA, 23 bp, Homo sapiens
ttgcggggcttttaaaaggaaaa

SEQ ID NO: 5465329 - DNA, 21 bp, Homo sapiens
ttgcgggggagctggaaataa

SEQ ID NO: 5465330 - DNA, 14 bp, Homo sapiens
ttgcggttcaggaa

SEQ ID NO: 5465331 - DNA, 19 bp, Homo sapiens
ttgcgtaaatggttttcaa

SEQ ID NO: 5465332 - DNA, 18 bp, Homo sapiens
ttgcgtacacagagaagg

SEQ ID NO: 5465333 - DNA, 23 bp, Homo sapiens
ttgcgtacacagagaaggctatg

SEQ ID NO: 5465334 - DNA, 14 bp, Homo sapiens
ttgcgtcctgcaga

SEQ ID NO: 5465335 - DNA, 20 bp, Homo sapiens
ttgcgtgacactctccttgc

SEQ ID NO: 5465336 - DNA, 20 bp, Homo sapiens
ttgcgtgtcaatttccctca

SEQ ID NO: 5465337 - DNA, 23 bp, Homo sapiens
ttgcgtgtctgtttccttctctt

SEQ ID NO: 5465338 - DNA, 21 bp, Homo sapiens
ttgcgtgtgtcataaagttga

SEQ ID NO: 5465339 - DNA, 14 bp, Homo sapiens
ttgcgttcaaagag

SEQ ID NO: 5465340 - DNA, 20 bp, Homo sapiens
ttgcgttggtctctgcattt

SEQ ID NO: 5465341 - DNA, 23 bp, Homo sapiens
ttgctaaaaaagcatatataact

SEQ ID NO: 5465342 - DNA, 12 bp, Homo sapiens
ttgctaaaagaa

SEQ ID NO: 5465343 - DNA, 15 bp, Homo sapiens
ttgctaaaagaagag

SEQ ID NO: 5465344 - DNA, 17 bp, Homo sapiens
ttgctaaaagaagagag

SEQ ID NO: 5465345 - DNA, 15 bp, Homo sapiens
ttgctaaaagtgcat

SEQ ID NO: 5465346 - DNA, 23 bp, Homo sapiens
ttgctaaacgactccgagaacaa

SEQ ID NO: 5465347 - DNA, 12 bp, Homo sapiens
ttgctaaagcac

SEQ ID NO: 5465348 - DNA, 21 bp, Homo sapiens
ttgctaaagcactttgcactt

SEQ ID NO: 5465349 - DNA, 22 bp, Homo sapiens
ttgctaaagcactttgcactta

SEQ ID NO: 5465350 - DNA, 13 bp, Homo sapiens
ttgctaaagtcag

SEQ ID NO: 5465351 - DNA, 15 bp, Homo sapiens
ttgctaaatatttct

SEQ ID NO: 5465352 - DNA, 20 bp, Homo sapiens
ttgctaaattataaaattga

SEQ ID NO: 5465353 - DNA, 22 bp, Homo sapiens
ttgctaaattataaaattgaaa

SEQ ID NO: 5465354 - DNA, 15 bp, Homo sapiens
ttgctaactgaactt

SEQ ID NO: 5465355 - DNA, 16 bp, Homo sapiens
ttgctaactgaacttt

SEQ ID NO: 5465356 - DNA, 12 bp, Homo sapiens
ttgctaactggg

SEQ ID NO: 5465357 - DNA, 14 bp, Homo sapiens
ttgctaactgggaa

SEQ ID NO: 5465358 - DNA, 19 bp, Homo sapiens
ttgctaactgggaagaaca

SEQ ID NO: 5465359 - DNA, 20 bp, Homo sapiens
ttgctaactgggttaaatat

SEQ ID NO: 5465360 - DNA, 20 bp, Homo sapiens
ttgctaagaatgtctatttc

SEQ ID NO: 5465361 - DNA, 16 bp, Homo sapiens
ttgctaagatgctcta

SEQ ID NO: 5465362 - DNA, 18 bp, Homo sapiens
ttgctaagcattccaact

SEQ ID NO: 5465363 - DNA, 17 bp, Homo sapiens
ttgctaagtaaatctct

SEQ ID NO: 5465364 - DNA, 19 bp, Homo sapiens
ttgctaataccaaaattga

SEQ ID NO: 5465365 - DNA, 18 bp, Homo sapiens
ttgctaatatttccagaa

SEQ ID NO: 5465366 - DNA, 18 bp, Homo sapiens
ttgctaatcaaagccagg

SEQ ID NO: 5465367 - DNA, 21 bp, Homo sapiens
ttgctaatcaaagccagggtc

SEQ ID NO: 5465368 - DNA, 18 bp, Homo sapiens
ttgctaatcgggttgtca

SEQ ID NO: 5465369 - DNA, 14 bp, Homo sapiens
ttgctaattgctgt

SEQ ID NO: 5465370 - DNA, 17 bp, Homo sapiens
ttgctaattttctcaaa

SEQ ID NO: 5465371 - DNA, 22 bp, Homo sapiens
ttgctacaaatttatgcatttc

SEQ ID NO: 5465372 - DNA, 15 bp, Homo sapiens
ttgctacaataaatg

SEQ ID NO: 5465373 - DNA, 19 bp, Homo sapiens
ttgctacaataaatgctga

SEQ ID NO: 5465374 - DNA, 21 bp, Homo sapiens
ttgctacatcagagtgtattt

SEQ ID NO: 5465375 - DNA, 19 bp, Homo sapiens
ttgctaccaatctgtgaga

SEQ ID NO: 5465376 - DNA, 23 bp, Homo sapiens
ttgctaccaatctgtgagaagtt

SEQ ID NO: 5465377 - DNA, 19 bp, Homo sapiens
ttgctaccacagacttgca

SEQ ID NO: 5465378 - DNA, 20 bp, Homo sapiens
ttgctaccagtatttagaag

SEQ ID NO: 5465379 - DNA, 23 bp, Homo sapiens
ttgctaccagtatttagaagcca

SEQ ID NO: 5465380 - DNA, 18 bp, Homo sapiens
ttgctacctcagtgctcc

SEQ ID NO: 5465381 - DNA, 19 bp, Homo sapiens
ttgctacctcagtgctcct

SEQ ID NO: 5465382 - DNA, 20 bp, Homo sapiens
ttgctacgattccactgaaa

SEQ ID NO: 5465383 - DNA, 22 bp, Homo sapiens
ttgctacttcctgcctggtctc

SEQ ID NO: 5465384 - DNA, 17 bp, Homo sapiens
ttgctagaaacataatt

SEQ ID NO: 5465385 - DNA, 20 bp, Homo sapiens
ttgctagaaacataattttt

SEQ ID NO: 5465386 - DNA, 20 bp, Homo sapiens
ttgctagacaaggttgctgt

SEQ ID NO: 5465387 - DNA, 14 bp, Homo sapiens
ttgctagagctcct

SEQ ID NO: 5465388 - DNA, 15 bp, Homo sapiens
ttgctagagctcctc

SEQ ID NO: 5465389 - DNA, 16 bp, Homo sapiens
ttgctagcaaacaaat

SEQ ID NO: 5465390 - DNA, 23 bp, Homo sapiens
ttgctagcagtaaaagatgaagt

SEQ ID NO: 5465391 - DNA, 17 bp, Homo sapiens
ttgctagctagccagcc

SEQ ID NO: 5465392 - DNA, 16 bp, Homo sapiens
ttgctagctatgtgac

SEQ ID NO: 5465393 - DNA, 22 bp, Homo sapiens
ttgctaggagctcccctgtttg

SEQ ID NO: 5465394 - DNA, 19 bp, Homo sapiens
ttgctaggcctcttgctga

SEQ ID NO: 5465395 - DNA, 13 bp, Homo sapiens
ttgctaggtataa

SEQ ID NO: 5465396 - DNA, 23 bp, Homo sapiens
ttgctaggtataaaaaataagta

SEQ ID NO: 5465397 - DNA, 17 bp, Homo sapiens
ttgctagtatcttgggt

SEQ ID NO: 5465398 - DNA, 22 bp, Homo sapiens
ttgctagtattcgctgtgttca

SEQ ID NO: 5465399 - DNA, 18 bp, Homo sapiens
ttgctagtctagtttcct

SEQ ID NO: 5465400 - DNA, 18 bp, Homo sapiens
ttgctagtgatacactgt

SEQ ID NO: 5465401 - DNA, 23 bp, Homo sapiens
ttgctagtgatacactgtatcta

SEQ ID NO: 5465402 - DNA, 13 bp, Homo sapiens
ttgctagtgtctt

SEQ ID NO: 5465403 - DNA, 19 bp, Homo sapiens
ttgctagttggagtgcttg

SEQ ID NO: 5465404 - DNA, 17 bp, Homo sapiens
ttgctataatcattagt

SEQ ID NO: 5465405 - DNA, 18 bp, Homo sapiens
ttgctataatcattagtt

SEQ ID NO: 5465406 - DNA, 14 bp, Homo sapiens
ttgctatacatgtt

SEQ ID NO: 5465407 - DNA, 22 bp, Homo sapiens
ttgctatacatgttggaaatgt

SEQ ID NO: 5465408 - DNA, 16 bp, Homo sapiens
ttgctatataaataaa

SEQ ID NO: 5465409 - DNA, 19 bp, Homo sapiens
ttgctatatataaagacaa

SEQ ID NO: 5465410 - DNA, 22 bp, Homo sapiens
ttgctatcgccctcctttccct

SEQ ID NO: 5465411 - DNA, 15 bp, Homo sapiens
ttgctatcttaattt

SEQ ID NO: 5465412 - DNA, 16 bp, Homo sapiens
ttgctatcttaatttt

SEQ ID NO: 5465413 - DNA, 16 bp, Homo sapiens
ttgctatcttttctgg

SEQ ID NO: 5465414 - DNA, 20 bp, Homo sapiens
ttgctatgagctggggatgt

SEQ ID NO: 5465415 - DNA, 17 bp, Homo sapiens
ttgctatgtaagggtct

SEQ ID NO: 5465416 - DNA, 18 bp, Homo sapiens
ttgctatgttactatttt

SEQ ID NO: 5465417 - DNA, 21 bp, Homo sapiens
ttgctatgttactattttcta

SEQ ID NO: 5465418 - DNA, 14 bp, Homo sapiens
ttgctattagagca

SEQ ID NO: 5465419 - DNA, 17 bp, Homo sapiens
ttgctattagagcattg

SEQ ID NO: 5465420 - DNA, 14 bp, Homo sapiens
ttgctattctgtcc

SEQ ID NO: 5465421 - DNA, 17 bp, Homo sapiens
ttgctattctgtcccta

SEQ ID NO: 5465422 - DNA, 19 bp, Homo sapiens
ttgctattgtaaatatgtt

SEQ ID NO: 5465423 - DNA, 9 bp, Homo sapiens
ttgctattt

SEQ ID NO: 5465424 - DNA, 18 bp, Homo sapiens
ttgctatttacaaatgaa

SEQ ID NO: 5465425 - DNA, 16 bp, Homo sapiens
ttgctatttttgtaaa

SEQ ID NO: 5465426 - DNA, 16 bp, Homo sapiens
ttgctcaaaaatctgt

SEQ ID NO: 5465427 - DNA, 12 bp, Homo sapiens
ttgctcaaaatc

SEQ ID NO: 5465428 - DNA, 22 bp, Homo sapiens
ttgctcaagttcattgatgacc

SEQ ID NO: 5465429 - DNA, 13 bp, Homo sapiens
ttgctcaatatga

SEQ ID NO: 5465430 - DNA, 20 bp, Homo sapiens
ttgctcaattccaagacagt

SEQ ID NO: 5465431 - DNA, 15 bp, Homo sapiens
ttgctcacagctgta

SEQ ID NO: 5465432 - DNA, 12 bp, Homo sapiens
ttgctcacccag

SEQ ID NO: 5465433 - DNA, 17 bp, Homo sapiens
ttgctcacccaggacct

SEQ ID NO: 5465434 - DNA, 13 bp, Homo sapiens
ttgctcacccagt

SEQ ID NO: 5465435 - DNA, 18 bp, Homo sapiens
ttgctcaccgactcacct

SEQ ID NO: 5465436 - DNA, 13 bp, Homo sapiens
ttgctcacctggg

SEQ ID NO: 5465437 - DNA, 21 bp, Homo sapiens
ttggaatgggagtctgaaatg

SEQ ID NO: 5465438 - DNA, 17 bp, Homo sapiens
ttggaatgttacatctg

SEQ ID NO: 5465439 - DNA, 13 bp, Homo sapiens
ttggaatgttgtt

SEQ ID NO: 5465440 - DNA, 22 bp, Homo sapiens
ttggaatgttgttaaatgctat

SEQ ID NO: 5465441 - DNA, 15 bp, Homo sapiens
ttggaattaaaacaa

SEQ ID NO: 5465442 - DNA, 16 bp, Homo sapiens
ttggaattaaaacaat

SEQ ID NO: 5465443 - DNA, 19 bp, Homo sapiens
ttggaattaacctggtgct

SEQ ID NO: 5465444 - DNA, 23 bp, Homo sapiens
ttggaattagaacccttgcacag

SEQ ID NO: 5465445 - DNA, 19 bp, Homo sapiens
ttggaattagatgtttata

SEQ ID NO: 5465446 - DNA, 23 bp, Homo sapiens
ttggaattagatgtttatatcaa

SEQ ID NO: 5465447 - DNA, 17 bp, Homo sapiens
ttggaattcactttatt

SEQ ID NO: 5465448 - DNA, 17 bp, Homo sapiens
ttggaattcgctttcta

SEQ ID NO: 5465449 - DNA, 14 bp, Homo sapiens
ttggaattctgctt

SEQ ID NO: 5465450 - DNA, 16 bp, Homo sapiens
ttggaattctgcttct

SEQ ID NO: 5465451 - DNA, 17 bp, Homo sapiens
ttggaattggtgtatat

SEQ ID NO: 5465452 - DNA, 12 bp, Homo sapiens
ttggaatttgca

SEQ ID NO: 5465453 - DNA, 23 bp, Homo sapiens
ttggaattttctttcatacatta

SEQ ID NO: 5465454 - DNA, 21 bp, Homo sapiens
ttggaattttgtaaaaagaaa

SEQ ID NO: 5465455 - DNA, 13 bp, Homo sapiens
ttggacaaaatga

SEQ ID NO: 5465456 - DNA, 20 bp, Homo sapiens
ttggacaaatcacatatttt

SEQ ID NO: 5465457 - DNA, 15 bp, Homo sapiens
ttggacaacagctct

SEQ ID NO: 5465458 - DNA, 14 bp, Homo sapiens
ttggacacactgta

SEQ ID NO: 5465459 - DNA, 14 bp, Homo sapiens
ttggacacgctcag

SEQ ID NO: 5465460 - DNA, 18 bp, Homo sapiens
ttggacagaaaatgcaat

SEQ ID NO: 5465461 - DNA, 19 bp, Homo sapiens
ttggacagaagcagctctt

SEQ ID NO: 5465462 - DNA, 17 bp, Homo sapiens
ttggacagatttcagta

SEQ ID NO: 5465463 - DNA, 15 bp, Homo sapiens
ttggacagccccctt

SEQ ID NO: 5465464 - DNA, 22 bp, Homo sapiens
ttggacagctgactgaatgcag

SEQ ID NO: 5465465 - DNA, 16 bp, Homo sapiens
ttggacagctgataaa

SEQ ID NO: 5465466 - DNA, 20 bp, Homo sapiens
ttggacaggagatcagcagc

SEQ ID NO: 5465467 - DNA, 16 bp, Homo sapiens
ttggacagtaagattt

SEQ ID NO: 5465468 - DNA, 15 bp, Homo sapiens
ttggacagtttacca

SEQ ID NO: 5465469 - DNA, 16 bp, Homo sapiens
ttggacatagatattt

SEQ ID NO: 5465470 - DNA, 17 bp, Homo sapiens
ttggacatagatatttt

SEQ ID NO: 5465471 - DNA, 15 bp, Homo sapiens
ttggacatcagtgtt

SEQ ID NO: 5465472 - DNA, 16 bp, Homo sapiens
ttggacatcagtgttt

SEQ ID NO: 5465473 - DNA, 23 bp, Homo sapiens
ttggacatgtccatgaccagaag

SEQ ID NO: 5465474 - DNA, 18 bp, Homo sapiens
ttggacattaagcatcac

SEQ ID NO: 5465475 - DNA, 14 bp, Homo sapiens
ttggacattttatg

SEQ ID NO: 5465476 - DNA, 14 bp, Homo sapiens
ttggaccagatcta

SEQ ID NO: 5465477 - DNA, 17 bp, Homo sapiens
ttggacccagggcctga

SEQ ID NO: 5465478 - DNA, 16 bp, Homo sapiens
ttggaccccagctggg

SEQ ID NO: 5465479 - DNA, 15 bp, Homo sapiens
ttggaccctgaggcc

SEQ ID NO: 5465480 - DNA, 19 bp, Homo sapiens
ttggaccctgaggcccaga

SEQ ID NO: 5465481 - DNA, 15 bp, Homo sapiens
ttggacccttggaaa

SEQ ID NO: 5465482 - DNA, 17 bp, Homo sapiens
ttggacctaatccaagc

SEQ ID NO: 5465483 - DNA, 18 bp, Homo sapiens
ttggacctatcaaaaact

SEQ ID NO: 5465484 - DNA, 21 bp, Homo sapiens
ttggacctccaggggctcctg

SEQ ID NO: 5465485 - DNA, 16 bp, Homo sapiens
ttggacctctgctctg

SEQ ID NO: 5465486 - DNA, 18 bp, Homo sapiens
ttggacctctgctctgag

SEQ ID NO: 5465487 - DNA, 22 bp, Homo sapiens
ttggaccttacgatcaggcaca

SEQ ID NO: 5465488 - DNA, 13 bp, Homo sapiens
ttggacggcctga

SEQ ID NO: 5465489 - DNA, 17 bp, Homo sapiens
ttggacgggatgacctc

SEQ ID NO: 5465490 - DNA, 19 bp, Homo sapiens
ttggactagccagaattct

SEQ ID NO: 5465491 - DNA, 12 bp, Homo sapiens
ttggactcagcc

SEQ ID NO: 5465492 - DNA, 15 bp, Homo sapiens
ttggactcagcccac

SEQ ID NO: 5465493 - DNA, 19 bp, Homo sapiens
ttggactcagcccacctgc

SEQ ID NO: 5465494 - DNA, 14 bp, Homo sapiens
ttggactccatctc

SEQ ID NO: 5465495 - DNA, 13 bp, Homo sapiens
ttggactctctgt

SEQ ID NO: 5465496 - DNA, 19 bp, Homo sapiens
ttggactctctgtggtccc

SEQ ID NO: 5465497 - DNA, 17 bp, Homo sapiens
ttggactcttgctcttt

SEQ ID NO: 5465498 - DNA, 14 bp, Homo sapiens
ttggactgacattt

SEQ ID NO: 5465499 - DNA, 16 bp, Homo sapiens
ttggactgatttgtgg

SEQ ID NO: 5465500 - DNA, 15 bp, Homo sapiens
ttggactggatgcat

SEQ ID NO: 5465501 - DNA, 15 bp, Homo sapiens
ttggacttctgaaga

SEQ ID NO: 5465502 - DNA, 13 bp, Homo sapiens
ttggacttctggg

SEQ ID NO: 5465503 - DNA, 17 bp, Homo sapiens
ttggacttgagaaagat

SEQ ID NO: 5465504 - DNA, 13 bp, Homo sapiens
ttggacttgagga

SEQ ID NO: 5465505 - DNA, 12 bp, Homo sapiens
ttggactttgtt

SEQ ID NO: 5465506 - DNA, 14 bp, Homo sapiens
ttggactttgttac

SEQ ID NO: 5465507 - DNA, 22 bp, Homo sapiens
ttggactttgtttcctccttgt

SEQ ID NO: 5465508 - DNA, 20 bp, Homo sapiens
ttggacttttcgttaacatt

SEQ ID NO: 5465509 - DNA, 22 bp, Homo sapiens
ttggacttttcgttaacattga

SEQ ID NO: 5465510 - DNA, 19 bp, Homo sapiens
ttggagaaaaaaatcaacc

SEQ ID NO: 5465511 - DNA, 15 bp, Homo sapiens
ttggagaaaagcact

SEQ ID NO: 5465512 - DNA, 17 bp, Homo sapiens
ttggagaaaagcactta

SEQ ID NO: 5465513 - DNA, 21 bp, Homo sapiens
ttggagaaatgtcataaatta

SEQ ID NO: 5465514 - DNA, 22 bp, Homo sapiens
ttggagaaccagggctcttctc

SEQ ID NO: 5465515 - DNA, 17 bp, Homo sapiens
ttggagaaggtctgtgg

SEQ ID NO: 5465516 - DNA, 21 bp, Homo sapiens
ttggagaaggtctgtggtgca

SEQ ID NO: 5465517 - DNA, 18 bp, Homo sapiens
ttggagaagtctcagcta

SEQ ID NO: 5465518 - DNA, 16 bp, Homo sapiens
ttggagacaattacaa

SEQ ID NO: 5465519 - DNA, 11 bp, Homo sapiens
ttggagacaga

SEQ ID NO: 5465520 - DNA, 17 bp, Homo sapiens
ttggagacattcctggg

SEQ ID NO: 5465521 - DNA, 22 bp, Homo sapiens
ttggagaccctgcaaacagaac

SEQ ID NO: 5465522 - DNA, 15 bp, Homo sapiens
ttggagactctgtgg

SEQ ID NO: 5465523 - DNA, 11 bp, Homo sapiens
ttggagactga

SEQ ID NO: 5465524 - DNA, 22 bp, Homo sapiens
ttggagactttctttaaattat

SEQ ID NO: 5465525 - DNA, 14 bp, Homo sapiens
ttggagagaatcat

SEQ ID NO: 5465526 - DNA, 14 bp, Homo sapiens
ttggagagagattc

SEQ ID NO: 5465527 - DNA, 15 bp, Homo sapiens
ttggagagcagcagg

SEQ ID NO: 5465528 - DNA, 14 bp, Homo sapiens
ttggagagcagctg

SEQ ID NO: 5465529 - DNA, 15 bp, Homo sapiens
ttggagagcagctgg

SEQ ID NO: 5465530 - DNA, 15 bp, Homo sapiens
ttggagagccctgga

SEQ ID NO: 5465531 - DNA, 23 bp, Homo sapiens
ttggagagctcagtacagggcag

SEQ ID NO: 5465532 - DNA, 12 bp, Homo sapiens
ttggagaggagg

SEQ ID NO: 5465533 - DNA, 20 bp, Homo sapiens
ttggagagggacgaagaaag

SEQ ID NO: 5465534 - DNA, 15 bp, Homo sapiens
ttggagagtttcctg

SEQ ID NO: 5465535 - DNA, 20 bp, Homo sapiens
ttggagatctttgcttcctt

SEQ ID NO: 5465536 - DNA, 17 bp, Homo sapiens
ttggagatgcagccttc

SEQ ID NO: 5465537 - DNA, 17 bp, Homo sapiens
ttggagatggcaggaga

SEQ ID NO: 5465538 - DNA, 21 bp, Homo sapiens
ttggagattactaactgtgga

SEQ ID NO: 5465539 - DNA, 21 bp, Homo sapiens
ttggagcaaagaaggagctga

SEQ ID NO: 5465540 - DNA, 23 bp, Homo sapiens
ttggagcacctgggccccactgg

SEQ ID NO: 5465541 - DNA, 23 bp, Homo sapiens
ttggagcagagacggcagcccca

SEQ ID NO: 5465542 - DNA, 15 bp, Homo sapiens
ttggagcagcaggcc

SEQ ID NO: 5465543 - DNA, 22 bp, Homo sapiens
ttggagcagcaggcctctggga

SEQ ID NO: 5465544 - DNA, 23 bp, Homo sapiens
ttggagcaggcaaaaaagggaca

SEQ ID NO: 5465545 - DNA, 22 bp, Homo sapiens
ttggagcaggggttggtcaagg

SEQ ID NO: 5465546 - DNA, 18 bp, Homo sapiens
ttggagcatttatgtaga

SEQ ID NO: 5465547 - DNA, 20 bp, Homo sapiens
ttggagcatttatgtagaca

SEQ ID NO: 5465548 - DNA, 11 bp, Homo sapiens
ttggagccact

SEQ ID NO: 5465549 - DNA, 12 bp, Homo sapiens
ttggagccactc

SEQ ID NO: 5465550 - DNA, 20 bp, Homo sapiens
ttggagccactcctgtcccg

SEQ ID NO: 5465551 - DNA, 18 bp, Homo sapiens
ttggagccccctggcggc

SEQ ID NO: 5465552 - DNA, 20 bp, Homo sapiens
ttggagccccctggcggcag

SEQ ID NO: 5465553 - DNA, 16 bp, Homo sapiens
ttggagccttccaccg

SEQ ID NO: 5465554 - DNA, 23 bp, Homo sapiens
ttggagccttccaccggcactca

SEQ ID NO: 5465555 - DNA, 20 bp, Homo sapiens
ttggagcgagcatcccccaa

SEQ ID NO: 5465556 - DNA, 17 bp, Homo sapiens
ttggagcgtttttgctg

SEQ ID NO: 5465557 - DNA, 13 bp, Homo sapiens
ttggagctctgag

SEQ ID NO: 5465558 - DNA, 14 bp, Homo sapiens
ttggagctgactgt

SEQ ID NO: 5465559 - DNA, 13 bp, Homo sapiens
ttggagctgcttg

SEQ ID NO: 5465560 - DNA, 21 bp, Homo sapiens
ttggagcttttttctttaaga

SEQ ID NO: 5465561 - DNA, 22 bp, Homo sapiens
ttggaggaagcatccaaagatt

SEQ ID NO: 5465562 - DNA, 23 bp, Homo sapiens
ttggaggaagcatccaaagattg

SEQ ID NO: 5465563 - DNA, 22 bp, Homo sapiens
ttggaggaagtatgagtgctga

SEQ ID NO: 5465564 - DNA, 14 bp, Homo sapiens
ttggaggaagttgg

SEQ ID NO: 5465565 - DNA, 11 bp, Homo sapiens
ttggaggacag

SEQ ID NO: 5465566 - DNA, 13 bp, Homo sapiens
ttggaggacagtg

SEQ ID NO: 5465567 - DNA, 15 bp, Homo sapiens
ttggaggacagtggg

SEQ ID NO: 5465568 - DNA, 14 bp, Homo sapiens
ttggaggagactgg

SEQ ID NO: 5465569 - DNA, 16 bp, Homo sapiens
ttggaggagactgggc

SEQ ID NO: 5465570 - DNA, 17 bp, Homo sapiens
ttggaggagactgggca

SEQ ID NO: 5465571 - DNA, 14 bp, Homo sapiens
ttggaggagagagc

SEQ ID NO: 5465572 - DNA, 15 bp, Homo sapiens
ttggaggagagagcc

SEQ ID NO: 5465573 - DNA, 21 bp, Homo sapiens
ttggaggaggggtatgaagta

SEQ ID NO: 5465574 - DNA, 17 bp, Homo sapiens
ttggaggcccctgggct

SEQ ID NO: 5465575 - DNA, 23 bp, Homo sapiens
ttggaggcccttttctggctcct

SEQ ID NO: 5465576 - DNA, 23 bp, Homo sapiens
ttggaggcctcaccctgcttggg

SEQ ID NO: 5465577 - DNA, 14 bp, Homo sapiens
ttggaggcctcaga

SEQ ID NO: 5465578 - DNA, 16 bp, Homo sapiens
ttggaggcctttagat

SEQ ID NO: 5465579 - DNA, 13 bp, Homo sapiens
ttggaggctgctg

SEQ ID NO: 5465580 - DNA, 20 bp, Homo sapiens
ttggagggaaagccagcctg

SEQ ID NO: 5465581 - DNA, 20 bp, Homo sapiens
ttggagggaaccaccagcgt

SEQ ID NO: 5465582 - DNA, 11 bp, Homo sapiens
ttggagggcac

SEQ ID NO: 5465583 - DNA, 22 bp, Homo sapiens
ttggagggcccacttgtatcct

SEQ ID NO: 5465584 - DNA, 19 bp, Homo sapiens
ttggaggggaaatggggaa

SEQ ID NO: 5465585 - DNA, 12 bp, Homo sapiens
ttggaggggcag

SEQ ID NO: 5465586 - DNA, 15 bp, Homo sapiens
ttggaggggggagcc

SEQ ID NO: 5465587 - DNA, 22 bp, Homo sapiens
ttggagggtctgggggcagctg

SEQ ID NO: 5465588 - DNA, 22 bp, Homo sapiens
ttggagggtgggagagcccagc

SEQ ID NO: 5465589 - DNA, 20 bp, Homo sapiens
ttggaggtatcctgtgtgtc

SEQ ID NO: 5465590 - DNA, 17 bp, Homo sapiens
ttggaggtcacagctgg

SEQ ID NO: 5465591 - DNA, 18 bp, Homo sapiens
ttggaggtcacagctgga

SEQ ID NO: 5465592 - DNA, 14 bp, Homo sapiens
ttggagtagaatgt

SEQ ID NO: 5465593 - DNA, 23 bp, Homo sapiens
ttggagtgataatattgtttccc

SEQ ID NO: 5465594 - DNA, 15 bp, Homo sapiens
ttggagtgcagtggc

SEQ ID NO: 5465595 - DNA, 12 bp, Homo sapiens
ttggagtgcccc

SEQ ID NO: 5465596 - DNA, 13 bp, Homo sapiens
ttggagtgcccca

SEQ ID NO: 5465597 - DNA, 18 bp, Homo sapiens
ttggagtgccccaaggag

SEQ ID NO: 5465598 - DNA, 17 bp, Homo sapiens
ttggagtgctcttccca

SEQ ID NO: 5465599 - DNA, 19 bp, Homo sapiens
ttggagtgcttaaaaatgc

SEQ ID NO: 5465600 - DNA, 18 bp, Homo sapiens
ttggagtgttatgtattt

SEQ ID NO: 5465601 - DNA, 13 bp, Homo sapiens
ttggagttaaaat

SEQ ID NO: 5465602 - DNA, 15 bp, Homo sapiens
ttggagttaaaatgt

SEQ ID NO: 5465603 - DNA, 14 bp, Homo sapiens
ttggagttcattca

SEQ ID NO: 5465604 - DNA, 21 bp, Homo sapiens
ttggagttttatttttaagaa

SEQ ID NO: 5465605 - DNA, 13 bp, Homo sapiens
ttggataaatcat

SEQ ID NO: 5465606 - DNA, 21 bp, Homo sapiens
ttggataaccttccttctaaa

SEQ ID NO: 5465607 - DNA, 12 bp, Homo sapiens
ttggataagtag

SEQ ID NO: 5465608 - DNA, 21 bp, Homo sapiens
ttggataagtttctattctgt

SEQ ID NO: 5465609 - DNA, 23 bp, Homo sapiens
ttggataatattcattggttaac

SEQ ID NO: 5465610 - DNA, 14 bp, Homo sapiens
ttggatacacacat

SEQ ID NO: 5465611 - DNA, 13 bp, Homo sapiens
ttggatacagctg

SEQ ID NO: 5465612 - DNA, 20 bp, Homo sapiens
ttggataggagcttccagat

SEQ ID NO: 5465613 - DNA, 13 bp, Homo sapiens
ttggatatttttg

SEQ ID NO: 5465614 - DNA, 18 bp, Homo sapiens
ttggatcaagcagaaaac

SEQ ID NO: 5465615 - DNA, 12 bp, Homo sapiens
ttggatcagagg

SEQ ID NO: 5465616 - DNA, 16 bp, Homo sapiens
ttggggcctggcttgc

SEQ ID NO: 5465617 - DNA, 21 bp, Homo sapiens
ttggggcctggcttgctccag

SEQ ID NO: 5465618 - DNA, 13 bp, Homo sapiens
ttggggctcccag

SEQ ID NO: 5465619 - DNA, 15 bp, Homo sapiens
ttggggctcccagcc

SEQ ID NO: 5465620 - DNA, 12 bp, Homo sapiens
ttggggctcctt

SEQ ID NO: 5465621 - DNA, 23 bp, Homo sapiens
ttggggctcctttcccctctcat

SEQ ID NO: 5465622 - DNA, 15 bp, Homo sapiens
ttggggctcttgatc

SEQ ID NO: 5465623 - DNA, 12 bp, Homo sapiens
ttggggctgggg

SEQ ID NO: 5465624 - DNA, 15 bp, Homo sapiens
ttggggctgggggcc

SEQ ID NO: 5465625 - DNA, 20 bp, Homo sapiens
ttggggcttatcagaactcc

SEQ ID NO: 5465626 - DNA, 15 bp, Homo sapiens
ttggggcttcacagc

SEQ ID NO: 5465627 - DNA, 14 bp, Homo sapiens
ttggggcttcttgg

SEQ ID NO: 5465628 - DNA, 15 bp, Homo sapiens
ttggggcttttggtg

SEQ ID NO: 5465629 - DNA, 13 bp, Homo sapiens
ttgggggaaaaaa

SEQ ID NO: 5465630 - DNA, 20 bp, Homo sapiens
ttgggggaaaaaaaaaaaag

SEQ ID NO: 5465631 - DNA, 19 bp, Homo sapiens
ttgggggacgtttctcatt

SEQ ID NO: 5465632 - DNA, 17 bp, Homo sapiens
ttgggggcaccatctgg

SEQ ID NO: 5465633 - DNA, 15 bp, Homo sapiens
ttgggggcaggtcag

SEQ ID NO: 5465634 - DNA, 13 bp, Homo sapiens
ttgggggccagca

SEQ ID NO: 5465635 - DNA, 15 bp, Homo sapiens
ttgggggctcagcaa

SEQ ID NO: 5465636 - DNA, 12 bp, Homo sapiens
ttgggggctggt

SEQ ID NO: 5465637 - DNA, 16 bp, Homo sapiens
ttgggggctgtgggga

SEQ ID NO: 5465638 - DNA, 22 bp, Homo sapiens
ttggggggaaataccttgagca

SEQ ID NO: 5465639 - DNA, 17 bp, Homo sapiens
ttggggggactctgagc

SEQ ID NO: 5465640 - DNA, 23 bp, Homo sapiens
ttggggggagtaaagaattattt

SEQ ID NO: 5465641 - DNA, 15 bp, Homo sapiens
ttggggggccacccg

SEQ ID NO: 5465642 - DNA, 13 bp, Homo sapiens
ttggggggctgag

SEQ ID NO: 5465643 - DNA, 17 bp, Homo sapiens
ttgggggggctgccttt

SEQ ID NO: 5465644 - DNA, 15 bp, Homo sapiens
ttggggggtgggaga

SEQ ID NO: 5465645 - DNA, 20 bp, Homo sapiens
ttgggggtcacccatggcct

SEQ ID NO: 5465646 - DNA, 17 bp, Homo sapiens
ttgggggtcagcatcca

SEQ ID NO: 5465647 - DNA, 16 bp, Homo sapiens
ttgggggtcagtgctg

SEQ ID NO: 5465648 - DNA, 19 bp, Homo sapiens
ttgggggtcagtgctgcct

SEQ ID NO: 5465649 - DNA, 13 bp, Homo sapiens
ttgggggtgggag

SEQ ID NO: 5465650 - DNA, 17 bp, Homo sapiens
ttgggggtgtggctctg

SEQ ID NO: 5465651 - DNA, 20 bp, Homo sapiens
ttgggggttttcaatgtgaa

SEQ ID NO: 5465652 - DNA, 17 bp, Homo sapiens
ttggggtacccactgct

SEQ ID NO: 5465653 - DNA, 23 bp, Homo sapiens
ttggggtactcttgatgtgaaga

SEQ ID NO: 5465654 - DNA, 15 bp, Homo sapiens
ttggggtagagagga

SEQ ID NO: 5465655 - DNA, 13 bp, Homo sapiens
ttggggtcagcca

SEQ ID NO: 5465656 - DNA, 15 bp, Homo sapiens
ttggggtcagccagg

SEQ ID NO: 5465657 - DNA, 16 bp, Homo sapiens
ttggggtcagccaggg

SEQ ID NO: 5465658 - DNA, 22 bp, Homo sapiens
ttggggtccctcaggttccttt

SEQ ID NO: 5465659 - DNA, 17 bp, Homo sapiens
ttggggtcctgggctgg

SEQ ID NO: 5465660 - DNA, 16 bp, Homo sapiens
ttggggtgagaggtga

SEQ ID NO: 5465661 - DNA, 22 bp, Homo sapiens
ttggggtgcccctctccttctt

SEQ ID NO: 5465662 - DNA, 15 bp, Homo sapiens
ttggggtgcttcctt

SEQ ID NO: 5465663 - DNA, 11 bp, Homo sapiens
ttggggtgggg

SEQ ID NO: 5465664 - DNA, 21 bp, Homo sapiens
ttggggtggggcgggaggcca

SEQ ID NO: 5465665 - DNA, 17 bp, Homo sapiens
ttggggtgggggccagg

SEQ ID NO: 5465666 - DNA, 18 bp, Homo sapiens
ttggggtgggggccaggc

SEQ ID NO: 5465667 - DNA, 20 bp, Homo sapiens
ttggggtgggtataaaagat

SEQ ID NO: 5465668 - DNA, 21 bp, Homo sapiens
ttggggtgtctttttttggtg

SEQ ID NO: 5465669 - DNA, 20 bp, Homo sapiens
ttggggttcccccagacaga

SEQ ID NO: 5465670 - DNA, 15 bp, Homo sapiens
ttggggttgcaacaa

SEQ ID NO: 5465671 - DNA, 15 bp, Homo sapiens
ttggggttgcccagc

SEQ ID NO: 5465672 - DNA, 22 bp, Homo sapiens
ttggggtttgatttgcttttga

SEQ ID NO: 5465673 - DNA, 16 bp, Homo sapiens
ttggggttttttaata

SEQ ID NO: 5465674 - DNA, 23 bp, Homo sapiens
ttggggttttttttttctgaata

SEQ ID NO: 5465675 - DNA, 19 bp, Homo sapiens
ttgggtaagtcccccaggg

SEQ ID NO: 5465676 - DNA, 21 bp, Homo sapiens
ttgggtagggtaggggaagga

SEQ ID NO: 5465677 - DNA, 19 bp, Homo sapiens
ttgggtatgaactaaaaag

SEQ ID NO: 5465678 - DNA, 18 bp, Homo sapiens
ttgggtatgtagaactgt

SEQ ID NO: 5465679 - DNA, 17 bp, Homo sapiens
ttgggtatgtctacctg

SEQ ID NO: 5465680 - DNA, 20 bp, Homo sapiens
ttgggtcaagaagtgatctt

SEQ ID NO: 5465681 - DNA, 16 bp, Homo sapiens
ttgggtcaaggacagg

SEQ ID NO: 5465682 - DNA, 19 bp, Homo sapiens
ttgggtcaaggacagggct

SEQ ID NO: 5465683 - DNA, 14 bp, Homo sapiens
ttgggtcagctggc

SEQ ID NO: 5465684 - DNA, 12 bp, Homo sapiens
ttgggtcattga

SEQ ID NO: 5465685 - DNA, 20 bp, Homo sapiens
ttgggtcattgacctctcag

SEQ ID NO: 5465686 - DNA, 21 bp, Homo sapiens
ttgggtcatttagaagcctga

SEQ ID NO: 5465687 - DNA, 11 bp, Homo sapiens
ttgggtccagt

SEQ ID NO: 5465688 - DNA, 14 bp, Homo sapiens
ttgggtcctgggtc

SEQ ID NO: 5465689 - DNA, 15 bp, Homo sapiens
ttgggtctattccag

SEQ ID NO: 5465690 - DNA, 17 bp, Homo sapiens
ttgggtctattccagct

SEQ ID NO: 5465691 - DNA, 18 bp, Homo sapiens
ttgggtctattccagctc

SEQ ID NO: 5465692 - DNA, 17 bp, Homo sapiens
ttgggtctctctccatt

SEQ ID NO: 5465693 - DNA, 20 bp, Homo sapiens
ttgggtctctctcggcccct

SEQ ID NO: 5465694 - DNA, 13 bp, Homo sapiens
ttgggtgaagagc

SEQ ID NO: 5465695 - DNA, 12 bp, Homo sapiens
ttgggtgaatct

SEQ ID NO: 5465696 - DNA, 14 bp, Homo sapiens
ttgggtgaatttca

SEQ ID NO: 5465697 - DNA, 22 bp, Homo sapiens
ttgggtgaccagccactcaaag

SEQ ID NO: 5465698 - DNA, 20 bp, Homo sapiens
ttgggtgcaagagggagcac

SEQ ID NO: 5465699 - DNA, 18 bp, Homo sapiens
ttgggtgcctcctgcagt

SEQ ID NO: 5465700 - DNA, 21 bp, Homo sapiens
ttgggtgggattttttccctt

SEQ ID NO: 5465701 - DNA, 22 bp, Homo sapiens
ttgggtgggggctgtggccctg

SEQ ID NO: 5465702 - DNA, 21 bp, Homo sapiens
ttgggtgtaacaggtctcctc

SEQ ID NO: 5465703 - DNA, 23 bp, Homo sapiens
ttgggtgtaacaggtctcctctt

SEQ ID NO: 5465704 - DNA, 19 bp, Homo sapiens
ttgggtgtagatttctgac

SEQ ID NO: 5465705 - DNA, 17 bp, Homo sapiens
ttgggtgtattctctgt

SEQ ID NO: 5465706 - DNA, 20 bp, Homo sapiens
ttgggtgtctccttaagctg

SEQ ID NO: 5465707 - DNA, 14 bp, Homo sapiens
ttgggtgtttccag

SEQ ID NO: 5465708 - DNA, 18 bp, Homo sapiens
ttgggtgtttttcatgtt

SEQ ID NO: 5465709 - DNA, 21 bp, Homo sapiens
ttgggttaaaaaaaaaaaaag

SEQ ID NO: 5465710 - DNA, 15 bp, Homo sapiens
ttgggttagacctac

SEQ ID NO: 5465711 - DNA, 22 bp, Homo sapiens
ttgggttcatgatgcagtctcc

SEQ ID NO: 5465712 - DNA, 17 bp, Homo sapiens
ttgggttcattattgga

SEQ ID NO: 5465713 - DNA, 17 bp, Homo sapiens
ttgggttccaaccaggc

SEQ ID NO: 5465714 - DNA, 15 bp, Homo sapiens
ttgggttgatctctt

SEQ ID NO: 5465715 - DNA, 23 bp, Homo sapiens
ttgggttgattctcgactgcttt

SEQ ID NO: 5465716 - DNA, 16 bp, Homo sapiens
ttgggttgcaaagcta

SEQ ID NO: 5465717 - DNA, 16 bp, Homo sapiens
ttgggtttggccaggg

SEQ ID NO: 5465718 - DNA, 17 bp, Homo sapiens
ttgggtttggccaggga

SEQ ID NO: 5465719 - DNA, 15 bp, Homo sapiens
ttgggttttatcagt

SEQ ID NO: 5465720 - DNA, 15 bp, Homo sapiens
ttgggtttttttcct

SEQ ID NO: 5465721 - DNA, 19 bp, Homo sapiens
ttggtaaaaatgctgctct

SEQ ID NO: 5465722 - DNA, 14 bp, Homo sapiens
ttggtaaacctttt

SEQ ID NO: 5465723 - DNA, 19 bp, Homo sapiens
ttggtaaagactggctttt

SEQ ID NO: 5465724 - DNA, 18 bp, Homo sapiens
ttggtaaaggtatgtaaa

SEQ ID NO: 5465725 - DNA, 15 bp, Homo sapiens
ttggtaaagtccttt

SEQ ID NO: 5465726 - DNA, 20 bp, Homo sapiens
ttggtaaagtccttttcttg

SEQ ID NO: 5465727 - DNA, 22 bp, Homo sapiens
ttggtaaatttccccaacagtg

SEQ ID NO: 5465728 - DNA, 15 bp, Homo sapiens
ttggtaaatttttga

SEQ ID NO: 5465729 - DNA, 17 bp, Homo sapiens
ttggtaaatttttgaaa

SEQ ID NO: 5465730 - DNA, 19 bp, Homo sapiens
ttggtaacatcctttctat

SEQ ID NO: 5465731 - DNA, 17 bp, Homo sapiens
ttggtaacttgctgtga

SEQ ID NO: 5465732 - DNA, 15 bp, Homo sapiens
ttggtaacttttgtg

SEQ ID NO: 5465733 - DNA, 18 bp, Homo sapiens
ttggtaagatgactctga

SEQ ID NO: 5465734 - DNA, 20 bp, Homo sapiens
ttggtaagatgactctgaga

SEQ ID NO: 5465735 - DNA, 19 bp, Homo sapiens
ttggtaaggcctctggact

SEQ ID NO: 5465736 - DNA, 14 bp, Homo sapiens
ttggtaataacaaa

SEQ ID NO: 5465737 - DNA, 22 bp, Homo sapiens
ttggtaatgatgttgataattt

SEQ ID NO: 5465738 - DNA, 23 bp, Homo sapiens
ttggtaattctgtgtaacaagag

SEQ ID NO: 5465739 - DNA, 22 bp, Homo sapiens
ttggtaattttttttgtttttt

SEQ ID NO: 5465740 - DNA, 23 bp, Homo sapiens
ttggtaattttttttgttttttg

SEQ ID NO: 5465741 - DNA, 18 bp, Homo sapiens
ttggtacagttcataatt

SEQ ID NO: 5465742 - DNA, 18 bp, Homo sapiens
ttggtacagttgcaggag

SEQ ID NO: 5465743 - DNA, 20 bp, Homo sapiens
ttggtacatggccagtgtga

SEQ ID NO: 5465744 - DNA, 12 bp, Homo sapiens
ttggtaccagat

SEQ ID NO: 5465745 - DNA, 21 bp, Homo sapiens
ttggtaccctggacagtgcct

SEQ ID NO: 5465746 - DNA, 21 bp, Homo sapiens
ttggtaccttaatttgactgt

SEQ ID NO: 5465747 - DNA, 16 bp, Homo sapiens
ttggtaccttgcacac

SEQ ID NO: 5465748 - DNA, 17 bp, Homo sapiens
ttggtactataaaagct

SEQ ID NO: 5465749 - DNA, 23 bp, Homo sapiens
ttggtactttccacaaatctata

SEQ ID NO: 5465750 - DNA, 14 bp, Homo sapiens
ttggtacttttaac

SEQ ID NO: 5465751 - DNA, 21 bp, Homo sapiens
ttggtagacttggacatctct

SEQ ID NO: 5465752 - DNA, 12 bp, Homo sapiens
ttggtagagttt

SEQ ID NO: 5465753 - DNA, 17 bp, Homo sapiens
ttggtagatattcagga

SEQ ID NO: 5465754 - DNA, 16 bp, Homo sapiens
ttggtagatcttcaat

SEQ ID NO: 5465755 - DNA, 22 bp, Homo sapiens
ttggtagattattcataatgtg

SEQ ID NO: 5465756 - DNA, 20 bp, Homo sapiens
ttggtaggaagcctgaggca

SEQ ID NO: 5465757 - DNA, 21 bp, Homo sapiens
ttggtaggcttatcaaaatct

SEQ ID NO: 5465758 - DNA, 13 bp, Homo sapiens
ttggtaggtaaat

SEQ ID NO: 5465759 - DNA, 15 bp, Homo sapiens
ttggtagttaacaca

SEQ ID NO: 5465760 - DNA, 20 bp, Homo sapiens
ttggtataatgtttaaatca

SEQ ID NO: 5465761 - DNA, 15 bp, Homo sapiens
ttggtatacaggtgg

SEQ ID NO: 5465762 - DNA, 18 bp, Homo sapiens
ttggtatagccatgattt

SEQ ID NO: 5465763 - DNA, 14 bp, Homo sapiens
ttggtataggaatg

SEQ ID NO: 5465764 - DNA, 22 bp, Homo sapiens
ttggtataggaatgtagaagtc

SEQ ID NO: 5465765 - DNA, 18 bp, Homo sapiens
ttggtatatttgtagata

SEQ ID NO: 5465766 - DNA, 16 bp, Homo sapiens
ttggtatcaagaaagt

SEQ ID NO: 5465767 - DNA, 16 bp, Homo sapiens
ttggtatgaaacaaat

SEQ ID NO: 5465768 - DNA, 17 bp, Homo sapiens
ttggtatgatgctgccg

SEQ ID NO: 5465769 - DNA, 20 bp, Homo sapiens
ttggtatggtaaagagatgt

SEQ ID NO: 5465770 - DNA, 13 bp, Homo sapiens
ttggtatgtgcca

SEQ ID NO: 5465771 - DNA, 15 bp, Homo sapiens
ttggtatgtgccagg

SEQ ID NO: 5465772 - DNA, 15 bp, Homo sapiens
ttggtattaaagaat

SEQ ID NO: 5465773 - DNA, 14 bp, Homo sapiens
ttggtattgtattt

SEQ ID NO: 5465774 - DNA, 12 bp, Homo sapiens
ttggtattttat

SEQ ID NO: 5465775 - DNA, 16 bp, Homo sapiens
ttggtattttcagaga

SEQ ID NO: 5465776 - DNA, 10 bp, Homo sapiens
ttggtcaaat

SEQ ID NO: 5465777 - DNA, 17 bp, Homo sapiens
ttggtcacaaagctatt

SEQ ID NO: 5465778 - DNA, 15 bp, Homo sapiens
ttggtcactccagta

SEQ ID NO: 5465779 - DNA, 17 bp, Homo sapiens
ttggtcagagccactct

SEQ ID NO: 5465780 - DNA, 22 bp, Homo sapiens
ttggtcagagtaagctgctttt

SEQ ID NO: 5465781 - DNA, 12 bp, Homo sapiens
ttggtcagcttt

SEQ ID NO: 5465782 - DNA, 20 bp, Homo sapiens
ttggtcaggaactattaatt

SEQ ID NO: 5465783 - DNA, 13 bp, Homo sapiens
ttggtcatctctc

SEQ ID NO: 5465784 - DNA, 12 bp, Homo sapiens
ttggtcatttgc

SEQ ID NO: 5465785 - DNA, 14 bp, Homo sapiens
ttggtccacttttc

SEQ ID NO: 5465786 - DNA, 16 bp, Homo sapiens
ttggtcccaagcctga

SEQ ID NO: 5465787 - DNA, 23 bp, Homo sapiens
ttggtcccaagcctgatacttta

SEQ ID NO: 5465788 - DNA, 22 bp, Homo sapiens
ttggtcccccttccatggactt

SEQ ID NO: 5465789 - DNA, 21 bp, Homo sapiens
ttggtcccgtggatgctcttt

SEQ ID NO: 5465790 - DNA, 15 bp, Homo sapiens
ttggtccctggtccc

SEQ ID NO: 5465791 - DNA, 14 bp, Homo sapiens
ttggtcctctctct

SEQ ID NO: 5465792 - DNA, 15 bp, Homo sapiens
ttggtcctctctctg

SEQ ID NO: 5465793 - DNA, 17 bp, Homo sapiens
ttggtcctctgatttca

SEQ ID NO: 5465794 - DNA, 13 bp, Homo sapiens
ttggtttggcctc

SEQ ID NO: 5465795 - DNA, 17 bp, Homo sapiens
ttggtttggggagaaat

SEQ ID NO: 5465796 - DNA, 19 bp, Homo sapiens
ttggtttgggggcgccctc

SEQ ID NO: 5465797 - DNA, 20 bp, Homo sapiens
ttggttttaaaaaagcatta

SEQ ID NO: 5465798 - DNA, 14 bp, Homo sapiens
ttggttttaaaagc

SEQ ID NO: 5465799 - DNA, 19 bp, Homo sapiens
ttggttttaaaagcacaat

SEQ ID NO: 5465800 - DNA, 23 bp, Homo sapiens
ttggttttaaacctttaatgaga

SEQ ID NO: 5465801 - DNA, 21 bp, Homo sapiens
ttggttttatactatattaac

SEQ ID NO: 5465802 - DNA, 16 bp, Homo sapiens
ttggttttatgatgac

SEQ ID NO: 5465803 - DNA, 19 bp, Homo sapiens
ttggttttatgatgacgta

SEQ ID NO: 5465804 - DNA, 15 bp, Homo sapiens
ttggttttctactgt

SEQ ID NO: 5465805 - DNA, 14 bp, Homo sapiens
ttggttttctcctt

SEQ ID NO: 5465806 - DNA, 15 bp, Homo sapiens
ttggttttctctctg

SEQ ID NO: 5465807 - DNA, 12 bp, Homo sapiens
ttggttttgaca

SEQ ID NO: 5465808 - DNA, 13 bp, Homo sapiens
ttggttttgactg

SEQ ID NO: 5465809 - DNA, 14 bp, Homo sapiens
ttggttttggaaaa

SEQ ID NO: 5465810 - DNA, 19 bp, Homo sapiens
ttggttttgtaaaattcca

SEQ ID NO: 5465811 - DNA, 13 bp, Homo sapiens
ttggttttgtatt

SEQ ID NO: 5465812 - DNA, 17 bp, Homo sapiens
ttggttttgttcccctc

SEQ ID NO: 5465813 - DNA, 18 bp, Homo sapiens
ttggttttgttcccctcc

SEQ ID NO: 5465814 - DNA, 16 bp, Homo sapiens
ttggttttgtttctga

SEQ ID NO: 5465815 - DNA, 22 bp, Homo sapiens
ttggtttttacatagttgagat

SEQ ID NO: 5465816 - DNA, 21 bp, Homo sapiens
ttggtttttgtcttgcatttt

SEQ ID NO: 5465817 - DNA, 23 bp, Homo sapiens
ttggtttttttgtacaatatgaa

SEQ ID NO: 5465818 - DNA, 13 bp, Homo sapiens
ttgtaaaaaaagc

SEQ ID NO: 5465819 - DNA, 14 bp, Homo sapiens
ttgtaaaaaaagca

SEQ ID NO: 5465820 - DNA, 16 bp, Homo sapiens
ttgtaaaaaaagcaaa

SEQ ID NO: 5465821 - DNA, 21 bp, Homo sapiens
ttgtaaaaaaagcaaaaatga

SEQ ID NO: 5465822 - DNA, 22 bp, Homo sapiens
ttgtaaaaaaggaacacccgga

SEQ ID NO: 5465823 - DNA, 22 bp, Homo sapiens
ttgtaaaaaattcacataataa

SEQ ID NO: 5465824 - DNA, 21 bp, Homo sapiens
ttgtaaaaacagcattgcttt

SEQ ID NO: 5465825 - DNA, 13 bp, Homo sapiens
ttgtaaaaacttt

SEQ ID NO: 5465826 - DNA, 13 bp, Homo sapiens
ttgtaaaaagaaa

SEQ ID NO: 5465827 - DNA, 14 bp, Homo sapiens
ttgtaaaaagaaaa

SEQ ID NO: 5465828 - DNA, 23 bp, Homo sapiens
ttgtaaaaagtagattaaaatat

SEQ ID NO: 5465829 - DNA, 13 bp, Homo sapiens
ttgtaaaaatgta

SEQ ID NO: 5465830 - DNA, 11 bp, Homo sapiens
ttgtaaaacaa

SEQ ID NO: 5465831 - DNA, 14 bp, Homo sapiens
ttgtaaaacaatgc

SEQ ID NO: 5465832 - DNA, 22 bp, Homo sapiens
ttgtaaaacaatgccatgaaca

SEQ ID NO: 5465833 - DNA, 14 bp, Homo sapiens
ttgtaaaacagcct

SEQ ID NO: 5465834 - DNA, 15 bp, Homo sapiens
ttgtaaaacagtggt

SEQ ID NO: 5465835 - DNA, 21 bp, Homo sapiens
ttgtaaaacctgtcaatgata

SEQ ID NO: 5465836 - DNA, 23 bp, Homo sapiens
ttgtaaaacctgtcaatgataca

SEQ ID NO: 5465837 - DNA, 14 bp, Homo sapiens
ttgtaaaactacac

SEQ ID NO: 5465838 - DNA, 13 bp, Homo sapiens
ttgtaaaactgtt

SEQ ID NO: 5465839 - DNA, 16 bp, Homo sapiens
ttgtaaaactgttatt

SEQ ID NO: 5465840 - DNA, 16 bp, Homo sapiens
ttgtaaaacttctgct

SEQ ID NO: 5465841 - DNA, 21 bp, Homo sapiens
ttgtaaaagaacagtaaacat

SEQ ID NO: 5465842 - DNA, 23 bp, Homo sapiens
ttgtaaaagaacagtaaacattg

SEQ ID NO: 5465843 - DNA, 16 bp, Homo sapiens
ttgtaaaagagctgtt

SEQ ID NO: 5465844 - DNA, 17 bp, Homo sapiens
ttgtaaaagcaacatca

SEQ ID NO: 5465845 - DNA, 23 bp, Homo sapiens
ttgtaaaagcaacatcagcttga

SEQ ID NO: 5465846 - DNA, 17 bp, Homo sapiens
ttgtaaaagcattttgt

SEQ ID NO: 5465847 - DNA, 19 bp, Homo sapiens
ttgtaaaagcattttgtaa

SEQ ID NO: 5465848 - DNA, 20 bp, Homo sapiens
ttgtaaaagcattttgtaat

SEQ ID NO: 5465849 - DNA, 18 bp, Homo sapiens
ttgtaaaagtctagttac

SEQ ID NO: 5465850 - DNA, 21 bp, Homo sapiens
ttgtaaaataaaaccaccaaa

SEQ ID NO: 5465851 - DNA, 17 bp, Homo sapiens
ttgtaaaatagaaaaag

SEQ ID NO: 5465852 - DNA, 20 bp, Homo sapiens
ttgtaaaatatcgtgtgtgt

SEQ ID NO: 5465853 - DNA, 17 bp, Homo sapiens
ttgtaaaatgacaatca

SEQ ID NO: 5465854 - DNA, 18 bp, Homo sapiens
ttgtaaaatgcacccatc

SEQ ID NO: 5465855 - DNA, 22 bp, Homo sapiens
ttgtaaaatgcttttcactttc

SEQ ID NO: 5465856 - DNA, 20 bp, Homo sapiens
ttgtaaaatggtgtgaccac

SEQ ID NO: 5465857 - DNA, 15 bp, Homo sapiens
ttgtaaaatgtatta

SEQ ID NO: 5465858 - DNA, 18 bp, Homo sapiens
ttgtaaaatgtattatgt

SEQ ID NO: 5465859 - DNA, 18 bp, Homo sapiens
ttgtaaaattgttcctga

SEQ ID NO: 5465860 - DNA, 15 bp, Homo sapiens
ttgtaaacaaactct

SEQ ID NO: 5465861 - DNA, 22 bp, Homo sapiens
ttgtaaacaaactgtgtaactg

SEQ ID NO: 5465862 - DNA, 18 bp, Homo sapiens
ttgtaaacagaaattgca

SEQ ID NO: 5465863 - DNA, 15 bp, Homo sapiens
ttgtaaacatgtgtt

SEQ ID NO: 5465864 - DNA, 14 bp, Homo sapiens
ttgtaaacgtcttt

SEQ ID NO: 5465865 - DNA, 15 bp, Homo sapiens
ttgtaaacgtctttt

SEQ ID NO: 5465866 - DNA, 23 bp, Homo sapiens
ttgtaaacgtctttttaagcctt

SEQ ID NO: 5465867 - DNA, 14 bp, Homo sapiens
ttgtaaactgttgt

SEQ ID NO: 5465868 - DNA, 15 bp, Homo sapiens
ttgtaaacttgaaag

SEQ ID NO: 5465869 - DNA, 12 bp, Homo sapiens
ttgtaaactttg

SEQ ID NO: 5465870 - DNA, 14 bp, Homo sapiens
ttgtaaactttttc

SEQ ID NO: 5465871 - DNA, 23 bp, Homo sapiens
ttgtaaagaaaaatatttaatgt

SEQ ID NO: 5465872 - DNA, 20 bp, Homo sapiens
ttgtaaagaaatttactata

SEQ ID NO: 5465873 - DNA, 21 bp, Homo sapiens
ttgtaaagacagagtgaattt

SEQ ID NO: 5465874 - DNA, 12 bp, Homo sapiens
ttgtaaagactg

SEQ ID NO: 5465875 - DNA, 21 bp, Homo sapiens
ttgtaaagactggttttctgc

SEQ ID NO: 5465876 - DNA, 13 bp, Homo sapiens
ttgtaaagagttg

SEQ ID NO: 5465877 - DNA, 13 bp, Homo sapiens
ttgtaaagatatt

SEQ ID NO: 5465878 - DNA, 21 bp, Homo sapiens
ttgtaaagatattgtatctcc

SEQ ID NO: 5465879 - DNA, 22 bp, Homo sapiens
ttgtaaagatattgtatctcct

SEQ ID NO: 5465880 - DNA, 23 bp, Homo sapiens
ttgtaaagatattgtatctcctt

SEQ ID NO: 5465881 - DNA, 18 bp, Homo sapiens
ttgtaaagatttctgttc

SEQ ID NO: 5465882 - DNA, 13 bp, Homo sapiens
ttgtaaaggaaat

SEQ ID NO: 5465883 - DNA, 14 bp, Homo sapiens
ttgtaaaggaaata

SEQ ID NO: 5465884 - DNA, 18 bp, Homo sapiens
ttgtaaaggactatttat

SEQ ID NO: 5465885 - DNA, 18 bp, Homo sapiens
ttgtaaaggtcagagtca

SEQ ID NO: 5465886 - DNA, 14 bp, Homo sapiens
ttgtaaagtaaaat

SEQ ID NO: 5465887 - DNA, 16 bp, Homo sapiens
ttgtaaagtgaagaat

SEQ ID NO: 5465888 - DNA, 20 bp, Homo sapiens
ttgtaaataaagtctatttt

SEQ ID NO: 5465889 - DNA, 21 bp, Homo sapiens
ttgtaaataaagtctattttt

SEQ ID NO: 5465890 - DNA, 15 bp, Homo sapiens
ttgtaaataaataga

SEQ ID NO: 5465891 - DNA, 15 bp, Homo sapiens
ttgtaaataaatttt

SEQ ID NO: 5465892 - DNA, 17 bp, Homo sapiens
ttgtaaataaattttgt

SEQ ID NO: 5465893 - DNA, 16 bp, Homo sapiens
ttgtaaataagagatt

SEQ ID NO: 5465894 - DNA, 19 bp, Homo sapiens
ttgtaaataatgcttaaca

SEQ ID NO: 5465895 - DNA, 16 bp, Homo sapiens
ttgtaaataattttct

SEQ ID NO: 5465896 - DNA, 19 bp, Homo sapiens
ttgtaaatacaattcaaac

SEQ ID NO: 5465897 - DNA, 14 bp, Homo sapiens
ttgtaaatacacat

SEQ ID NO: 5465898 - DNA, 22 bp, Homo sapiens
ttgtaaatactccattatttta

SEQ ID NO: 5465899 - DNA, 12 bp, Homo sapiens
ttgtaaatataa

SEQ ID NO: 5465900 - DNA, 13 bp, Homo sapiens
ttgtaaatataaa

SEQ ID NO: 5465901 - DNA, 18 bp, Homo sapiens
ttgtaaatatataaatat

SEQ ID NO: 5465902 - DNA, 22 bp, Homo sapiens
ttgtaaatatggggatagtctg

SEQ ID NO: 5465903 - DNA, 11 bp, Homo sapiens
ttgtaaatatt

SEQ ID NO: 5465904 - DNA, 14 bp, Homo sapiens
ttgtaaatattgtg

SEQ ID NO: 5465905 - DNA, 15 bp, Homo sapiens
ttgtaaatattgttt

SEQ ID NO: 5465906 - DNA, 17 bp, Homo sapiens
ttgtaaatcctgtgttt

SEQ ID NO: 5465907 - DNA, 14 bp, Homo sapiens
ttgtaaatcttttt

SEQ ID NO: 5465908 - DNA, 16 bp, Homo sapiens
ttgtaaatgaaactta

SEQ ID NO: 5465909 - DNA, 18 bp, Homo sapiens
ttgtaaatgaccaagaaa

SEQ ID NO: 5465910 - DNA, 11 bp, Homo sapiens
ttgtaaatgat

SEQ ID NO: 5465911 - DNA, 12 bp, Homo sapiens
ttgtaaatgcta

SEQ ID NO: 5465912 - DNA, 19 bp, Homo sapiens
ttgtaaatgctattatact

SEQ ID NO: 5465913 - DNA, 14 bp, Homo sapiens
ttgtaaatgctcgt

SEQ ID NO: 5465914 - DNA, 18 bp, Homo sapiens
ttgtaaatgctcgtgtga

SEQ ID NO: 5465915 - DNA, 21 bp, Homo sapiens
ttgtaaatgctcgtgtgattt

SEQ ID NO: 5465916 - DNA, 20 bp, Homo sapiens
ttgtaaatgctgtaaatatt

SEQ ID NO: 5465917 - DNA, 11 bp, Homo sapiens
ttgtaaatgtg

SEQ ID NO: 5465918 - DNA, 18 bp, Homo sapiens
ttgtaaatgtgcttttaa

SEQ ID NO: 5465919 - DNA, 22 bp, Homo sapiens
ttgtaaatgtgttggacaaatg

SEQ ID NO: 5465920 - DNA, 12 bp, Homo sapiens
ttgtaaatgttt

SEQ ID NO: 5465921 - DNA, 23 bp, Homo sapiens
ttgtaaatgtttaatatctgact

SEQ ID NO: 5465922 - DNA, 22 bp, Homo sapiens
ttgtaaattaaacataaaacaa

SEQ ID NO: 5465923 - DNA, 15 bp, Homo sapiens
ttgtaaattaacttt

SEQ ID NO: 5465924 - DNA, 14 bp, Homo sapiens
ttgtaaattaatct

SEQ ID NO: 5465925 - DNA, 20 bp, Homo sapiens
ttgtaaattaggaggctcaa

SEQ ID NO: 5465926 - DNA, 16 bp, Homo sapiens
ttgtaaattatatttg

SEQ ID NO: 5465927 - DNA, 17 bp, Homo sapiens
ttgtaaattatatttgt

SEQ ID NO: 5465928 - DNA, 13 bp, Homo sapiens
ttgtaaattctga

SEQ ID NO: 5465929 - DNA, 14 bp, Homo sapiens
ttgtaaattctgat

SEQ ID NO: 5465930 - DNA, 15 bp, Homo sapiens
ttgtaaattctgatt

SEQ ID NO: 5465931 - DNA, 13 bp, Homo sapiens
ttgtaaattgaat

SEQ ID NO: 5465932 - DNA, 12 bp, Homo sapiens
ttgtaaattgtg

SEQ ID NO: 5465933 - DNA, 19 bp, Homo sapiens
ttgtaaatttatgtgatgg

SEQ ID NO: 5465934 - DNA, 19 bp, Homo sapiens
ttgtaaatttcagggtttt

SEQ ID NO: 5465935 - DNA, 14 bp, Homo sapiens
ttgtaaatttctct

SEQ ID NO: 5465936 - DNA, 20 bp, Homo sapiens
ttgtaaatttggatttacga

SEQ ID NO: 5465937 - DNA, 14 bp, Homo sapiens
ttgtaaattttaga

SEQ ID NO: 5465938 - DNA, 17 bp, Homo sapiens
ttgtaacaagaaaacat

SEQ ID NO: 5465939 - DNA, 23 bp, Homo sapiens
ttgtaacatccaataggaatgct

SEQ ID NO: 5465940 - DNA, 14 bp, Homo sapiens
ttgtaaccatttct

SEQ ID NO: 5465941 - DNA, 15 bp, Homo sapiens
ttgtaaccatttctc

SEQ ID NO: 5465942 - DNA, 14 bp, Homo sapiens
ttgtaacccactga

SEQ ID NO: 5465943 - DNA, 14 bp, Homo sapiens
ttgtaacctcagct

SEQ ID NO: 5465944 - DNA, 16 bp, Homo sapiens
ttgtaacgttgctgtg

SEQ ID NO: 5465945 - DNA, 9 bp, Homo sapiens
ttgtaacta

SEQ ID NO: 5465946 - DNA, 18 bp, Homo sapiens
ttgtaactaaaataattt

SEQ ID NO: 5465947 - DNA, 21 bp, Homo sapiens
ttgtaactaaaataattttgt

SEQ ID NO: 5465948 - DNA, 22 bp, Homo sapiens
ttgtaactatgtttaaagtaat

SEQ ID NO: 5465949 - DNA, 16 bp, Homo sapiens
ttgtaactctttggct

SEQ ID NO: 5465950 - DNA, 14 bp, Homo sapiens
ttgtaacttatatt

SEQ ID NO: 5465951 - DNA, 17 bp, Homo sapiens
ttgtaacttatgtagat

SEQ ID NO: 5465952 - DNA, 16 bp, Homo sapiens
ttgtaactttgcatgt

SEQ ID NO: 5465953 - DNA, 17 bp, Homo sapiens
ttgtaactttgcatgtt

SEQ ID NO: 5465954 - DNA, 14 bp, Homo sapiens
ttgtaagaaaacca

SEQ ID NO: 5465955 - DNA, 18 bp, Homo sapiens
ttgtaagaaaaccaaaat

SEQ ID NO: 5465956 - DNA, 23 bp, Homo sapiens
ttgtaagaaaccaatcaagataa

SEQ ID NO: 5465957 - DNA, 11 bp, Homo sapiens
ttgtaagaaat

SEQ ID NO: 5465958 - DNA, 14 bp, Homo sapiens
ttgtaagaaatact

SEQ ID NO: 5465959 - DNA, 17 bp, Homo sapiens
ttgtaagaaatactgta

SEQ ID NO: 5465960 - DNA, 24 bp, Homo sapiens
ttgtaagaaggcaatattaaccta

SEQ ID NO: 5465961 - DNA, 20 bp, Homo sapiens
ttgtaagacacacagccttt

SEQ ID NO: 5465962 - DNA, 23 bp, Homo sapiens
ttgtaagacacacagcctttctg

SEQ ID NO: 5465963 - DNA, 14 bp, Homo sapiens
ttgtaagacatttg

SEQ ID NO: 5465964 - DNA, 17 bp, Homo sapiens
ttgtaagagtgtagaag

SEQ ID NO: 5465965 - DNA, 19 bp, Homo sapiens
ttgtaagagtgtagaagca

SEQ ID NO: 5465966 - DNA, 17 bp, Homo sapiens
ttgtaagattttgaaaa

SEQ ID NO: 5465967 - DNA, 19 bp, Homo sapiens
ttgtaagattttgaaaact

SEQ ID NO: 5465968 - DNA, 13 bp, Homo sapiens
ttgtaagccagag

SEQ ID NO: 5465969 - DNA, 15 bp, Homo sapiens
ttgtaagccagagtc

SEQ ID NO: 5465970 - DNA, 17 bp, Homo sapiens
ttgtaagccagagtcaa

SEQ ID NO: 5465971 - DNA, 13 bp, Homo sapiens
ttgtaagccctct

SEQ ID NO: 5465972 - DNA, 23 bp, Homo sapiens
ttgtaagccctctttaatgctgt

SEQ ID NO: 5465973 - DNA, 21 bp, Homo sapiens
ttgtccacagtctcccattct

SEQ ID NO: 5465974 - DNA, 16 bp, Homo sapiens
ttgtccaccatgctct

SEQ ID NO: 5465975 - DNA, 17 bp, Homo sapiens
ttgtccaccttctgcca

SEQ ID NO: 5465976 - DNA, 23 bp, Homo sapiens
ttgtccacggggctcactctggc

SEQ ID NO: 5465977 - DNA, 20 bp, Homo sapiens
ttgtccacttcattttgtat

SEQ ID NO: 5465978 - DNA, 20 bp, Homo sapiens
ttgtccacttgtaagaatgt

SEQ ID NO: 5465979 - DNA, 18 bp, Homo sapiens
ttgtccagagctgcttcc

SEQ ID NO: 5465980 - DNA, 19 bp, Homo sapiens
ttgtccagagctgcttccc

SEQ ID NO: 5465981 - DNA, 17 bp, Homo sapiens
ttgtccaggaagtcaga

SEQ ID NO: 5465982 - DNA, 22 bp, Homo sapiens
ttgtccaggtctagaaggccag

SEQ ID NO: 5465983 - DNA, 21 bp, Homo sapiens
ttgtccaggtgagaacatcca

SEQ ID NO: 5465984 - DNA, 17 bp, Homo sapiens
ttgtccaggttgatctt

SEQ ID NO: 5465985 - DNA, 23 bp, Homo sapiens
ttgtccagttcaggaatttttgt

SEQ ID NO: 5465986 - DNA, 11 bp, Homo sapiens
ttgtccatctt

SEQ ID NO: 5465987 - DNA, 13 bp, Homo sapiens
ttgtccatcttgt

SEQ ID NO: 5465988 - DNA, 20 bp, Homo sapiens
ttgtccattgtaaatctgaa

SEQ ID NO: 5465989 - DNA, 16 bp, Homo sapiens
ttgtccatttaaaaat

SEQ ID NO: 5465990 - DNA, 14 bp, Homo sapiens
ttgtccatttgtaa

SEQ ID NO: 5465991 - DNA, 15 bp, Homo sapiens
ttgtccatttgtaaa

SEQ ID NO: 5465992 - DNA, 20 bp, Homo sapiens
ttgtcccactcaagccaagc

SEQ ID NO: 5465993 - DNA, 17 bp, Homo sapiens
ttgtcccagaattttct

SEQ ID NO: 5465994 - DNA, 20 bp, Homo sapiens
ttgtcccatctctaccccct

SEQ ID NO: 5465995 - DNA, 22 bp, Homo sapiens
ttgtcccattttccccttcctc

SEQ ID NO: 5465996 - DNA, 23 bp, Homo sapiens
ttgtccccaaatccgaacctcct

SEQ ID NO: 5465997 - DNA, 13 bp, Homo sapiens
ttgtccccagctc

SEQ ID NO: 5465998 - DNA, 15 bp, Homo sapiens
ttgtccccagggccc

SEQ ID NO: 5465999 - DNA, 20 bp, Homo sapiens
ttgtccccagggcccctccc

SEQ ID NO: 5466000 - DNA, 14 bp, Homo sapiens
ttgtcccccaactt

SEQ ID NO: 5466001 - DNA, 18 bp, Homo sapiens
ttgtcccccaacttgaga

SEQ ID NO: 5466002 - DNA, 21 bp, Homo sapiens
ttgtcccctaagagtgtttaa

SEQ ID NO: 5466003 - DNA, 18 bp, Homo sapiens
ttgtcccctcacctccac

SEQ ID NO: 5466004 - DNA, 14 bp, Homo sapiens
ttgtcccctcttga

SEQ ID NO: 5466005 - DNA, 21 bp, Homo sapiens
ttgtcccctgcctgtgcctgc

SEQ ID NO: 5466006 - DNA, 18 bp, Homo sapiens
ttgtcccgattgtaactc

SEQ ID NO: 5466007 - DNA, 20 bp, Homo sapiens
ttgtccctctcactccccag

SEQ ID NO: 5466008 - DNA, 15 bp, Homo sapiens
ttgtccctctgcccc

SEQ ID NO: 5466009 - DNA, 16 bp, Homo sapiens
ttgtccctctgctacg

SEQ ID NO: 5466010 - DNA, 17 bp, Homo sapiens
ttgtccctgctcctccc

SEQ ID NO: 5466011 - DNA, 19 bp, Homo sapiens
ttgtccctgctcctcccaa

SEQ ID NO: 5466012 - DNA, 18 bp, Homo sapiens
ttgtccctggcttcctta

SEQ ID NO: 5466013 - DNA, 21 bp, Homo sapiens
ttgtccctggggcactccccc

SEQ ID NO: 5466014 - DNA, 18 bp, Homo sapiens
ttgtccctggtgcagagg

SEQ ID NO: 5466015 - DNA, 15 bp, Homo sapiens
ttgtccctgtgccta

SEQ ID NO: 5466016 - DNA, 14 bp, Homo sapiens
ttgtccctgtttca

SEQ ID NO: 5466017 - DNA, 15 bp, Homo sapiens
ttgtcccttccagga

SEQ ID NO: 5466018 - DNA, 13 bp, Homo sapiens
ttgtccctttccc

SEQ ID NO: 5466019 - DNA, 18 bp, Homo sapiens
ttgtccgtgttcatacat

SEQ ID NO: 5466020 - DNA, 15 bp, Homo sapiens
ttgtcctagcacaga

SEQ ID NO: 5466021 - DNA, 23 bp, Homo sapiens
ttgtcctagcacagatggccagc

SEQ ID NO: 5466022 - DNA, 16 bp, Homo sapiens
ttgtcctattagtgtt

SEQ ID NO: 5466023 - DNA, 22 bp, Homo sapiens
ttgtcctcagccccgcgtggaa

SEQ ID NO: 5466024 - DNA, 21 bp, Homo sapiens
ttgtcctcccaggaaccaaaa

SEQ ID NO: 5466025 - DNA, 15 bp, Homo sapiens
ttgtcctccccttgg

SEQ ID NO: 5466026 - DNA, 13 bp, Homo sapiens
ttgtcctcctgct

SEQ ID NO: 5466027 - DNA, 15 bp, Homo sapiens
ttgtcctcctgctgc

SEQ ID NO: 5466028 - DNA, 19 bp, Homo sapiens
ttgtcctcctgctgccagt

SEQ ID NO: 5466029 - DNA, 19 bp, Homo sapiens
ttgtcctccttttcacttt

SEQ ID NO: 5466030 - DNA, 22 bp, Homo sapiens
ttgtcctctcagagcctcagct

SEQ ID NO: 5466031 - DNA, 22 bp, Homo sapiens
ttgtcctgaatggctttgtctt

SEQ ID NO: 5466032 - DNA, 16 bp, Homo sapiens
ttgtcctgactgtctg

SEQ ID NO: 5466033 - DNA, 16 bp, Homo sapiens
ttgtcctgatttctta

SEQ ID NO: 5466034 - DNA, 17 bp, Homo sapiens
ttgtcctgcagagctgg

SEQ ID NO: 5466035 - DNA, 12 bp, Homo sapiens
ttgtcctgccag

SEQ ID NO: 5466036 - DNA, 15 bp, Homo sapiens
ttgtcctgccagctg

SEQ ID NO: 5466037 - DNA, 21 bp, Homo sapiens
ttgtcctgccagctgccttcc

SEQ ID NO: 5466038 - DNA, 17 bp, Homo sapiens
ttgtcctgcctcttgtt

SEQ ID NO: 5466039 - DNA, 20 bp, Homo sapiens
ttgtcctgcctgcaatattt

SEQ ID NO: 5466040 - DNA, 19 bp, Homo sapiens
ttgtcctgtatagcaacct

SEQ ID NO: 5466041 - DNA, 11 bp, Homo sapiens
ttgtcctgtga

SEQ ID NO: 5466042 - DNA, 20 bp, Homo sapiens
ttgtcctgtgtcatctgtca

SEQ ID NO: 5466043 - DNA, 14 bp, Homo sapiens
ttgtcctgtgtcta

SEQ ID NO: 5466044 - DNA, 13 bp, Homo sapiens
ttgtcctgtttct

SEQ ID NO: 5466045 - DNA, 15 bp, Homo sapiens
ttgtccttcagagct

SEQ ID NO: 5466046 - DNA, 16 bp, Homo sapiens
ttgtccttcctgtgcc

SEQ ID NO: 5466047 - DNA, 17 bp, Homo sapiens
ttgtccttgaagcttgt

SEQ ID NO: 5466048 - DNA, 19 bp, Homo sapiens
ttgtccttgaagcttgtat

SEQ ID NO: 5466049 - DNA, 16 bp, Homo sapiens
ttgtccttgctcctgg

SEQ ID NO: 5466050 - DNA, 19 bp, Homo sapiens
ttgtccttgctcctggaac

SEQ ID NO: 5466051 - DNA, 20 bp, Homo sapiens
ttgtcctttaaaaaagaaaa

SEQ ID NO: 5466052 - DNA, 17 bp, Homo sapiens
ttgtcctttaactatca

SEQ ID NO: 5466053 - DNA, 17 bp, Homo sapiens
ttgtcctttcccttcag

SEQ ID NO: 5466054 - DNA, 19 bp, Homo sapiens
ttgtcctttgagaaagaaa

SEQ ID NO: 5466055 - DNA, 20 bp, Homo sapiens
ttgtcctttgagaaagaaat

SEQ ID NO: 5466056 - DNA, 15 bp, Homo sapiens
ttgtcctttgattcc

SEQ ID NO: 5466057 - DNA, 14 bp, Homo sapiens
ttgtccttttcata

SEQ ID NO: 5466058 - DNA, 21 bp, Homo sapiens
ttgtcctttttcactttgaaa

SEQ ID NO: 5466059 - DNA, 15 bp, Homo sapiens
ttgtcgtggttctta

SEQ ID NO: 5466060 - DNA, 20 bp, Homo sapiens
ttgtcgtttttagctttgtg

SEQ ID NO: 5466061 - DNA, 16 bp, Homo sapiens
ttgtctaaagatcttt

SEQ ID NO: 5466062 - DNA, 22 bp, Homo sapiens
ttgtctaaagttactactgatt

SEQ ID NO: 5466063 - DNA, 20 bp, Homo sapiens
ttgtctaagaaacattggaa

SEQ ID NO: 5466064 - DNA, 23 bp, Homo sapiens
ttgtctaagaaacattggaagca

SEQ ID NO: 5466065 - DNA, 21 bp, Homo sapiens
ttgtctaagaaattgaatact

SEQ ID NO: 5466066 - DNA, 23 bp, Homo sapiens
ttgtctaataaatattgacttct

SEQ ID NO: 5466067 - DNA, 17 bp, Homo sapiens
ttgtctactcctagaag

SEQ ID NO: 5466068 - DNA, 16 bp, Homo sapiens
ttgtctacttgctcca

SEQ ID NO: 5466069 - DNA, 18 bp, Homo sapiens
ttgtctagggtgttctgt

SEQ ID NO: 5466070 - DNA, 20 bp, Homo sapiens
ttgtctagggtgttctgtac

SEQ ID NO: 5466071 - DNA, 16 bp, Homo sapiens
ttgtctataaagcatt

SEQ ID NO: 5466072 - DNA, 18 bp, Homo sapiens
ttgtctataaagcattta

SEQ ID NO: 5466073 - DNA, 16 bp, Homo sapiens
ttgtctatgaagttgc

SEQ ID NO: 5466074 - DNA, 19 bp, Homo sapiens
ttgtctatgaagttgctgt

SEQ ID NO: 5466075 - DNA, 20 bp, Homo sapiens
ttgtctatgggactcaatgc

SEQ ID NO: 5466076 - DNA, 13 bp, Homo sapiens
ttgtctattattg

SEQ ID NO: 5466077 - DNA, 22 bp, Homo sapiens
ttgtctattattgaaatagttt

SEQ ID NO: 5466078 - DNA, 12 bp, Homo sapiens
ttgtctatttat

SEQ ID NO: 5466079 - DNA, 20 bp, Homo sapiens
ttgtctatttgtctcttaca

SEQ ID NO: 5466080 - DNA, 11 bp, Homo sapiens
ttgtctatttt

SEQ ID NO: 5466081 - DNA, 12 bp, Homo sapiens
ttgtctatttta

SEQ ID NO: 5466082 - DNA, 13 bp, Homo sapiens
ttgtctattttaa

SEQ ID NO: 5466083 - DNA, 16 bp, Homo sapiens
ttgtctatttttgtct

SEQ ID NO: 5466084 - DNA, 18 bp, Homo sapiens
ttgtctcaacgcctcccc

SEQ ID NO: 5466085 - DNA, 20 bp, Homo sapiens
ttgtctcaacgcctccccct

SEQ ID NO: 5466086 - DNA, 13 bp, Homo sapiens
ttgtctcaagatt

SEQ ID NO: 5466087 - DNA, 13 bp, Homo sapiens
ttgtctcaccagc

SEQ ID NO: 5466088 - DNA, 12 bp, Homo sapiens
ttgtctcactgt

SEQ ID NO: 5466089 - DNA, 16 bp, Homo sapiens
ttgtctcagattttat

SEQ ID NO: 5466090 - DNA, 15 bp, Homo sapiens
ttgtctcagttggaa

SEQ ID NO: 5466091 - DNA, 18 bp, Homo sapiens
ttgtctcattttaatgta

SEQ ID NO: 5466092 - DNA, 19 bp, Homo sapiens
ttgtctcattttggtctgt

SEQ ID NO: 5466093 - DNA, 16 bp, Homo sapiens
ttgtctccaaagaaga

SEQ ID NO: 5466094 - DNA, 16 bp, Homo sapiens
ttgtctccacttgtat

SEQ ID NO: 5466095 - DNA, 18 bp, Homo sapiens
ttgtctcccctgttcccc

SEQ ID NO: 5466096 - DNA, 16 bp, Homo sapiens
ttgtctccctggccct

SEQ ID NO: 5466097 - DNA, 19 bp, Homo sapiens
ttgtctcctacctgctgct

SEQ ID NO: 5466098 - DNA, 13 bp, Homo sapiens
ttgtctccttcca

SEQ ID NO: 5466099 - DNA, 17 bp, Homo sapiens
ttgtctcgaaataattt

SEQ ID NO: 5466100 - DNA, 18 bp, Homo sapiens
ttgtctctacaaaaaata

SEQ ID NO: 5466101 - DNA, 14 bp, Homo sapiens
ttgtctctactttt

SEQ ID NO: 5466102 - DNA, 14 bp, Homo sapiens
ttgtctctcttcag

SEQ ID NO: 5466103 - DNA, 19 bp, Homo sapiens
ttgtctctcttcagactct

SEQ ID NO: 5466104 - DNA, 11 bp, Homo sapiens
ttgtctctgag

SEQ ID NO: 5466105 - DNA, 12 bp, Homo sapiens
ttgtctctgagg

SEQ ID NO: 5466106 - DNA, 13 bp, Homo sapiens
ttgtctctgatgc

SEQ ID NO: 5466107 - DNA, 14 bp, Homo sapiens
ttgtctctgatgca

SEQ ID NO: 5466108 - DNA, 22 bp, Homo sapiens
ttgtctctgcaaactgccttct

SEQ ID NO: 5466109 - DNA, 12 bp, Homo sapiens
ttgtctctgtag

SEQ ID NO: 5466110 - DNA, 13 bp, Homo sapiens
ttgtctctgtaga

SEQ ID NO: 5466111 - DNA, 21 bp, Homo sapiens
ttgtctctgttggtccactgt

SEQ ID NO: 5466112 - DNA, 22 bp, Homo sapiens
ttgtctctgttggtccactgtg

SEQ ID NO: 5466113 - DNA, 23 bp, Homo sapiens
ttgtctctgttggtccactgtgt

SEQ ID NO: 5466114 - DNA, 13 bp, Homo sapiens
ttgtctgaaacat

SEQ ID NO: 5466115 - DNA, 17 bp, Homo sapiens
ttgtctgaacccaggca

SEQ ID NO: 5466116 - DNA, 15 bp, Homo sapiens
ttgtctgaacttgca

SEQ ID NO: 5466117 - DNA, 17 bp, Homo sapiens
ttgtctgaagtcactgc

SEQ ID NO: 5466118 - DNA, 21 bp, Homo sapiens
ttgtctgaagtcactgcacag

SEQ ID NO: 5466119 - DNA, 21 bp, Homo sapiens
ttgtctgaggcctcatccctc

SEQ ID NO: 5466120 - DNA, 18 bp, Homo sapiens
ttgtctgattgaaacatg

SEQ ID NO: 5466121 - DNA, 20 bp, Homo sapiens
ttgtctgatttatggttttt

SEQ ID NO: 5466122 - DNA, 22 bp, Homo sapiens
ttgtctgatttttaaagtactt

SEQ ID NO: 5466123 - DNA, 12 bp, Homo sapiens
ttgtctgcctcc

SEQ ID NO: 5466124 - DNA, 14 bp, Homo sapiens
ttgtctgctcccaa

SEQ ID NO: 5466125 - DNA, 18 bp, Homo sapiens
ttgtctgctgcctccaag

SEQ ID NO: 5466126 - DNA, 13 bp, Homo sapiens
ttgtctgctgctc

SEQ ID NO: 5466127 - DNA, 16 bp, Homo sapiens
ttgtctgctgctccca

SEQ ID NO: 5466128 - DNA, 21 bp, Homo sapiens
ttgtctggcaaggactttgta

SEQ ID NO: 5466129 - DNA, 16 bp, Homo sapiens
ttgtctggctgtggcc

SEQ ID NO: 5466130 - DNA, 20 bp, Homo sapiens
ttgtctggctgtggcccctc

SEQ ID NO: 5466131 - DNA, 22 bp, Homo sapiens
ttgtctggctgtggcccctcct

SEQ ID NO: 5466132 - DNA, 12 bp, Homo sapiens
ttgtctgggtgc

SEQ ID NO: 5466133 - DNA, 18 bp, Homo sapiens
ttgtctggttaaaaaata

SEQ ID NO: 5466134 - DNA, 17 bp, Homo sapiens
ttgtctgtaaaaaatgg

SEQ ID NO: 5466135 - DNA, 12 bp, Homo sapiens
ttgtctgtccag

SEQ ID NO: 5466136 - DNA, 17 bp, Homo sapiens
ttgtctgtcctggtcag

SEQ ID NO: 5466137 - DNA, 12 bp, Homo sapiens
ttgtctgtctac

SEQ ID NO: 5466138 - DNA, 17 bp, Homo sapiens
ttgtctgtctccctccc

SEQ ID NO: 5466139 - DNA, 16 bp, Homo sapiens
ttgtctgtgataacag

SEQ ID NO: 5466140 - DNA, 23 bp, Homo sapiens
ttgtctgtgcttccttggttcat

SEQ ID NO: 5466141 - DNA, 14 bp, Homo sapiens
ttgtctgtgtgcta

SEQ ID NO: 5466142 - DNA, 17 bp, Homo sapiens
ttgtctgtgtgctacta

SEQ ID NO: 5466143 - DNA, 21 bp, Homo sapiens
ttgtctgtgtgctactaacag

SEQ ID NO: 5466144 - DNA, 17 bp, Homo sapiens
ttgtctgtgtgctgtaa

SEQ ID NO: 5466145 - DNA, 18 bp, Homo sapiens
ttgtctgtgttgctgttt

SEQ ID NO: 5466146 - DNA, 18 bp, Homo sapiens
ttgtcttaaaaaatgtga

SEQ ID NO: 5466147 - DNA, 13 bp, Homo sapiens
ttgtcttaaaaat

SEQ ID NO: 5466148 - DNA, 16 bp, Homo sapiens
ttgtcttaaaaattta

SEQ ID NO: 5466149 - DNA, 17 bp, Homo sapiens
ttgtcttaaataaaaga

SEQ ID NO: 5466150 - DNA, 15 bp, Homo sapiens
ttgtcttaagtgttt

SEQ ID NO: 5466151 - DNA, 17 bp, Homo sapiens
ttgttactttgaatagt

SEQ ID NO: 5466152 - DNA, 17 bp, Homo sapiens
ttgttagaaagtgctta

SEQ ID NO: 5466153 - DNA, 17 bp, Homo sapiens
ttgttagaccagaaagt

SEQ ID NO: 5466154 - DNA, 21 bp, Homo sapiens
ttgttagatctgtagggactt

SEQ ID NO: 5466155 - DNA, 23 bp, Homo sapiens
ttgttagcaaactatttcagtga

SEQ ID NO: 5466156 - DNA, 17 bp, Homo sapiens
ttgttagcccttcagat

SEQ ID NO: 5466157 - DNA, 19 bp, Homo sapiens
ttgttaggagatgtcatca

SEQ ID NO: 5466158 - DNA, 21 bp, Homo sapiens
ttgttaggccaaagacaaata

SEQ ID NO: 5466159 - DNA, 22 bp, Homo sapiens
ttgttaggccaaagacaaatag

SEQ ID NO: 5466160 - DNA, 13 bp, Homo sapiens
ttgttagggctgc

SEQ ID NO: 5466161 - DNA, 15 bp, Homo sapiens
ttgttagtaaacata

SEQ ID NO: 5466162 - DNA, 19 bp, Homo sapiens
ttgttagtatgaggcattt

SEQ ID NO: 5466163 - DNA, 22 bp, Homo sapiens
ttgttagtatgaggcatttgtt

SEQ ID NO: 5466164 - DNA, 16 bp, Homo sapiens
ttgttagtgatttgct

SEQ ID NO: 5466165 - DNA, 18 bp, Homo sapiens
ttgttagtggacttgttt

SEQ ID NO: 5466166 - DNA, 17 bp, Homo sapiens
ttgttagtttacaatat

SEQ ID NO: 5466167 - DNA, 22 bp, Homo sapiens
ttgttagtttctgagttttacc

SEQ ID NO: 5466168 - DNA, 12 bp, Homo sapiens
ttgttataaata

SEQ ID NO: 5466169 - DNA, 19 bp, Homo sapiens
ttgttataacttcataaaa

SEQ ID NO: 5466170 - DNA, 16 bp, Homo sapiens
ttgttatacttcaaaa

SEQ ID NO: 5466171 - DNA, 15 bp, Homo sapiens
ttgttatataattta

SEQ ID NO: 5466172 - DNA, 18 bp, Homo sapiens
ttgttatattacttgcct

SEQ ID NO: 5466173 - DNA, 13 bp, Homo sapiens
ttgttatcagtaa

SEQ ID NO: 5466174 - DNA, 22 bp, Homo sapiens
ttgttatcagtacaattctttg

SEQ ID NO: 5466175 - DNA, 20 bp, Homo sapiens
ttgttatcctcttgtatact

SEQ ID NO: 5466176 - DNA, 13 bp, Homo sapiens
ttgttatctggga

SEQ ID NO: 5466177 - DNA, 16 bp, Homo sapiens
ttgttatgaaaatcct

SEQ ID NO: 5466178 - DNA, 22 bp, Homo sapiens
ttgttatgaaaatcctatatct

SEQ ID NO: 5466179 - DNA, 21 bp, Homo sapiens
ttgttatgccatgatttttgg

SEQ ID NO: 5466180 - DNA, 19 bp, Homo sapiens
ttgttatgtacaaactagt

SEQ ID NO: 5466181 - DNA, 16 bp, Homo sapiens
ttgttatgtctagaaa

SEQ ID NO: 5466182 - DNA, 21 bp, Homo sapiens
ttgttattaaaaaaacacaaa

SEQ ID NO: 5466183 - DNA, 14 bp, Homo sapiens
ttgttattatataa

SEQ ID NO: 5466184 - DNA, 23 bp, Homo sapiens
ttgttattatataattacatatt

SEQ ID NO: 5466185 - DNA, 16 bp, Homo sapiens
ttgttattattgttaa

SEQ ID NO: 5466186 - DNA, 20 bp, Homo sapiens
ttgttattccatcaataaat

SEQ ID NO: 5466187 - DNA, 21 bp, Homo sapiens
ttgttattccatcaataaatg

SEQ ID NO: 5466188 - DNA, 13 bp, Homo sapiens
ttgttattcctag

SEQ ID NO: 5466189 - DNA, 23 bp, Homo sapiens
ttgttattgatgttgctgttatt

SEQ ID NO: 5466190 - DNA, 14 bp, Homo sapiens
ttgttattgcctct

SEQ ID NO: 5466191 - DNA, 11 bp, Homo sapiens
ttgttattgtg

SEQ ID NO: 5466192 - DNA, 13 bp, Homo sapiens
ttgttattgtgaa

SEQ ID NO: 5466193 - DNA, 14 bp, Homo sapiens
ttgttattgtggaa

SEQ ID NO: 5466194 - DNA, 17 bp, Homo sapiens
ttgttatttacactggt

SEQ ID NO: 5466195 - DNA, 14 bp, Homo sapiens
ttgttatttattga

SEQ ID NO: 5466196 - DNA, 15 bp, Homo sapiens
ttgttatttattgaa

SEQ ID NO: 5466197 - DNA, 17 bp, Homo sapiens
ttgttattttattgcct

SEQ ID NO: 5466198 - DNA, 14 bp, Homo sapiens
ttgttcaaaatgca

SEQ ID NO: 5466199 - DNA, 13 bp, Homo sapiens
ttgttcaaacatt

SEQ ID NO: 5466200 - DNA, 21 bp, Homo sapiens
ttgttcaaactttctgccttc

SEQ ID NO: 5466201 - DNA, 13 bp, Homo sapiens
ttgttcaactatt

SEQ ID NO: 5466202 - DNA, 22 bp, Homo sapiens
ttgttcaataataaatattttt

SEQ ID NO: 5466203 - DNA, 17 bp, Homo sapiens
ttgttcaatgttccatt

SEQ ID NO: 5466204 - DNA, 23 bp, Homo sapiens
ttgttcacataacgccaccatca

SEQ ID NO: 5466205 - DNA, 16 bp, Homo sapiens
ttgttcaccagtgctt

SEQ ID NO: 5466206 - DNA, 15 bp, Homo sapiens
ttgttcaccttctgt

SEQ ID NO: 5466207 - DNA, 15 bp, Homo sapiens
ttgttcactgcagca

SEQ ID NO: 5466208 - DNA, 18 bp, Homo sapiens
ttgttcagtcacttgttt

SEQ ID NO: 5466209 - DNA, 16 bp, Homo sapiens
ttgttcagtgaggtat

SEQ ID NO: 5466210 - DNA, 17 bp, Homo sapiens
ttgttcagttgacttac

SEQ ID NO: 5466211 - DNA, 18 bp, Homo sapiens
ttgttcatacatattttt

SEQ ID NO: 5466212 - DNA, 17 bp, Homo sapiens
ttgttcatattaagaat

SEQ ID NO: 5466213 - DNA, 14 bp, Homo sapiens
ttgttcatgtttgg

SEQ ID NO: 5466214 - DNA, 19 bp, Homo sapiens
ttgttcatgtttggtgcat

SEQ ID NO: 5466215 - DNA, 17 bp, Homo sapiens
ttgttcattttgagctg

SEQ ID NO: 5466216 - DNA, 15 bp, Homo sapiens
ttgttccaaatgtgt

SEQ ID NO: 5466217 - DNA, 16 bp, Homo sapiens
ttgttccaatgccaca

SEQ ID NO: 5466218 - DNA, 21 bp, Homo sapiens
ttgttccacttgtttgcactg

SEQ ID NO: 5466219 - DNA, 11 bp, Homo sapiens
ttgttccagtt

SEQ ID NO: 5466220 - DNA, 12 bp, Homo sapiens
ttgttcccacaa

SEQ ID NO: 5466221 - DNA, 15 bp, Homo sapiens
ttgttcccacacaca

SEQ ID NO: 5466222 - DNA, 15 bp, Homo sapiens
ttgttcccctcctcc

SEQ ID NO: 5466223 - DNA, 19 bp, Homo sapiens
ttgttcccctcctccactc

SEQ ID NO: 5466224 - DNA, 20 bp, Homo sapiens
ttgttcccctcctccactct

SEQ ID NO: 5466225 - DNA, 22 bp, Homo sapiens
ttgttcccgatggtctctctcc

SEQ ID NO: 5466226 - DNA, 17 bp, Homo sapiens
ttgttccctatgaaaga

SEQ ID NO: 5466227 - DNA, 18 bp, Homo sapiens
ttgttccctatgaaagat

SEQ ID NO: 5466228 - DNA, 18 bp, Homo sapiens
ttgttccctcattctgca

SEQ ID NO: 5466229 - DNA, 14 bp, Homo sapiens
ttgttccctctccc

SEQ ID NO: 5466230 - DNA, 11 bp, Homo sapiens
ttgttcctcta

SEQ ID NO: 5466231 - DNA, 14 bp, Homo sapiens
ttgttcctgaaatg

SEQ ID NO: 5466232 - DNA, 11 bp, Homo sapiens
ttgttcctgat

SEQ ID NO: 5466233 - DNA, 13 bp, Homo sapiens
ttgttcctgcttt

SEQ ID NO: 5466234 - DNA, 14 bp, Homo sapiens
ttgttcctgctttc

SEQ ID NO: 5466235 - DNA, 15 bp, Homo sapiens
ttgttcctgctttct

SEQ ID NO: 5466236 - DNA, 22 bp, Homo sapiens
ttgttcctgctttctctttcag

SEQ ID NO: 5466237 - DNA, 11 bp, Homo sapiens
ttgttcctgtg

SEQ ID NO: 5466238 - DNA, 19 bp, Homo sapiens
ttgttcctgtgtattctca

SEQ ID NO: 5466239 - DNA, 15 bp, Homo sapiens
ttgttcctgtttatt

SEQ ID NO: 5466240 - DNA, 16 bp, Homo sapiens
ttgttcctgtttattt

SEQ ID NO: 5466241 - DNA, 16 bp, Homo sapiens
ttgttccttaccttta

SEQ ID NO: 5466242 - DNA, 22 bp, Homo sapiens
ttgttccttacctttacataat

SEQ ID NO: 5466243 - DNA, 23 bp, Homo sapiens
ttgttcgcacaatctacactgcc

SEQ ID NO: 5466244 - DNA, 17 bp, Homo sapiens
ttgttcgtttcatcagg

SEQ ID NO: 5466245 - DNA, 22 bp, Homo sapiens
ttgttctacatggctttgataa

SEQ ID NO: 5466246 - DNA, 21 bp, Homo sapiens
ttgttctagaatcatgtattt

SEQ ID NO: 5466247 - DNA, 11 bp, Homo sapiens
ttgttctagac

SEQ ID NO: 5466248 - DNA, 18 bp, Homo sapiens
ttgttctagacttcccca

SEQ ID NO: 5466249 - DNA, 16 bp, Homo sapiens
ttgttctagttttcag

SEQ ID NO: 5466250 - DNA, 13 bp, Homo sapiens
ttgttctattttt

SEQ ID NO: 5466251 - DNA, 16 bp, Homo sapiens
ttgttctatttttcaa

SEQ ID NO: 5466252 - DNA, 18 bp, Homo sapiens
ttgttctatttttcaatc

SEQ ID NO: 5466253 - DNA, 16 bp, Homo sapiens
ttgttctcagaatccc

SEQ ID NO: 5466254 - DNA, 23 bp, Homo sapiens
ttgttctcagaatcccttaacag

SEQ ID NO: 5466255 - DNA, 23 bp, Homo sapiens
ttgttctccgggtgtggcctcag

SEQ ID NO: 5466256 - DNA, 18 bp, Homo sapiens
ttgttctctctatggtaa

SEQ ID NO: 5466257 - DNA, 14 bp, Homo sapiens
ttgttctctcttgg

SEQ ID NO: 5466258 - DNA, 20 bp, Homo sapiens
ttgttctctggaacctgact

SEQ ID NO: 5466259 - DNA, 12 bp, Homo sapiens
ttgttctctggg

SEQ ID NO: 5466260 - DNA, 14 bp, Homo sapiens
ttgttctctgtcca

SEQ ID NO: 5466261 - DNA, 23 bp, Homo sapiens
ttgttctgaaatgtcagttctga

SEQ ID NO: 5466262 - DNA, 16 bp, Homo sapiens
ttgttctgactttttg

SEQ ID NO: 5466263 - DNA, 12 bp, Homo sapiens
ttgttctgaggg

SEQ ID NO: 5466264 - DNA, 13 bp, Homo sapiens
ttgttctgagggg

SEQ ID NO: 5466265 - DNA, 14 bp, Homo sapiens
ttgttctgcagaga

SEQ ID NO: 5466266 - DNA, 16 bp, Homo sapiens
ttgttctgcctggaga

SEQ ID NO: 5466267 - DNA, 23 bp, Homo sapiens
ttgttctgctacccactgccaga

SEQ ID NO: 5466268 - DNA, 19 bp, Homo sapiens
ttgttctgctgttctctag

SEQ ID NO: 5466269 - DNA, 12 bp, Homo sapiens
ttgttctgcttt

SEQ ID NO: 5466270 - DNA, 22 bp, Homo sapiens
ttgttctggctcttccaggctg

SEQ ID NO: 5466271 - DNA, 12 bp, Homo sapiens
ttgttctgggct

SEQ ID NO: 5466272 - DNA, 13 bp, Homo sapiens
ttgttctgggctc

SEQ ID NO: 5466273 - DNA, 11 bp, Homo sapiens
ttgttctgtat

SEQ ID NO: 5466274 - DNA, 12 bp, Homo sapiens
ttgttctgtata

SEQ ID NO: 5466275 - DNA, 14 bp, Homo sapiens
ttgttctgtcacca

SEQ ID NO: 5466276 - DNA, 18 bp, Homo sapiens
ttgttctgtggtcacagt

SEQ ID NO: 5466277 - DNA, 14 bp, Homo sapiens
ttgttctgttaact

SEQ ID NO: 5466278 - DNA, 15 bp, Homo sapiens
ttgttctgttaactg

SEQ ID NO: 5466279 - DNA, 14 bp, Homo sapiens
ttgttctgttgtct

SEQ ID NO: 5466280 - DNA, 15 bp, Homo sapiens
ttgttctgttgtctg

SEQ ID NO: 5466281 - DNA, 17 bp, Homo sapiens
ttgttcttaattgcact

SEQ ID NO: 5466282 - DNA, 18 bp, Homo sapiens
ttgttcttagggcttgga

SEQ ID NO: 5466283 - DNA, 19 bp, Homo sapiens
ttgttcttataagaagaag

SEQ ID NO: 5466284 - DNA, 14 bp, Homo sapiens
ttgttcttccaaag

SEQ ID NO: 5466285 - DNA, 12 bp, Homo sapiens
ttgttcttgata

SEQ ID NO: 5466286 - DNA, 13 bp, Homo sapiens
ttgttcttgatag

SEQ ID NO: 5466287 - DNA, 19 bp, Homo sapiens
ttgttcttggcaataaatt

SEQ ID NO: 5466288 - DNA, 12 bp, Homo sapiens
ttgttcttggtt

SEQ ID NO: 5466289 - DNA, 17 bp, Homo sapiens
ttgttcttggtttgtaa

SEQ ID NO: 5466290 - DNA, 20 bp, Homo sapiens
ttgttcttggtttgtaaatt

SEQ ID NO: 5466291 - DNA, 19 bp, Homo sapiens
ttgttcttgtaaaactgtg

SEQ ID NO: 5466292 - DNA, 15 bp, Homo sapiens
ttgttcttgtattta

SEQ ID NO: 5466293 - DNA, 17 bp, Homo sapiens
ttgttcttgtattttaa

SEQ ID NO: 5466294 - DNA, 20 bp, Homo sapiens
ttgttcttgtttttaagttt

SEQ ID NO: 5466295 - DNA, 14 bp, Homo sapiens
ttgttctttcatat

SEQ ID NO: 5466296 - DNA, 12 bp, Homo sapiens
ttgttctttgct

SEQ ID NO: 5466297 - DNA, 12 bp, Homo sapiens
ttgttctttgtg

SEQ ID NO: 5466298 - DNA, 16 bp, Homo sapiens
ttgttctttgtgtttt

SEQ ID NO: 5466299 - DNA, 15 bp, Homo sapiens
ttgttctttgtttag

SEQ ID NO: 5466300 - DNA, 17 bp, Homo sapiens
ttgttcttttgtttcat

SEQ ID NO: 5466301 - DNA, 15 bp, Homo sapiens
ttgttgaaaatggtt

SEQ ID NO: 5466302 - DNA, 21 bp, Homo sapiens
ttgttgaaaatggtttcaagt

SEQ ID NO: 5466303 - DNA, 15 bp, Homo sapiens
ttgttgaaagaaagt

SEQ ID NO: 5466304 - DNA, 14 bp, Homo sapiens
ttgttgaaagtaaa

SEQ ID NO: 5466305 - DNA, 16 bp, Homo sapiens
ttgttgaaatcttttt

SEQ ID NO: 5466306 - DNA, 18 bp, Homo sapiens
ttgttgaaattttgcaaa

SEQ ID NO: 5466307 - DNA, 17 bp, Homo sapiens
ttgttgaacaggtgttt

SEQ ID NO: 5466308 - DNA, 16 bp, Homo sapiens
ttgttgaacatacttc

SEQ ID NO: 5466309 - DNA, 15 bp, Homo sapiens
ttgttgaactgttag

SEQ ID NO: 5466310 - DNA, 22 bp, Homo sapiens
ttgttgaactgttagaatgtaa

SEQ ID NO: 5466311 - DNA, 20 bp, Homo sapiens
ttgttgaagtgctgttttat

SEQ ID NO: 5466312 - DNA, 19 bp, Homo sapiens
ttgttgaagtttgaaccac

SEQ ID NO: 5466313 - DNA, 15 bp, Homo sapiens
ttgttgaatgactga

SEQ ID NO: 5466314 - DNA, 13 bp, Homo sapiens
ttgttgaatgtat

SEQ ID NO: 5466315 - DNA, 17 bp, Homo sapiens
ttgttgacagcttggaa

SEQ ID NO: 5466316 - DNA, 18 bp, Homo sapiens
ttgttgacagttctgaag

SEQ ID NO: 5466317 - DNA, 15 bp, Homo sapiens
ttgttgactgtgatt

SEQ ID NO: 5466318 - DNA, 18 bp, Homo sapiens
ttgttgagctattgctgt

SEQ ID NO: 5466319 - DNA, 22 bp, Homo sapiens
ttgttgagctgtcatcaacatt

SEQ ID NO: 5466320 - DNA, 11 bp, Homo sapiens
ttgttgatatt

SEQ ID NO: 5466321 - DNA, 19 bp, Homo sapiens
ttgttgatattggttctat

SEQ ID NO: 5466322 - DNA, 15 bp, Homo sapiens
ttgttgatattgttt

SEQ ID NO: 5466323 - DNA, 22 bp, Homo sapiens
ttgttgatccccacactgcctt

SEQ ID NO: 5466324 - DNA, 15 bp, Homo sapiens
ttgttgatcttttaa

SEQ ID NO: 5466325 - DNA, 17 bp, Homo sapiens
ttgttgattctctccat

SEQ ID NO: 5466326 - DNA, 14 bp, Homo sapiens
ttgttgcaaaggtc

SEQ ID NO: 5466327 - DNA, 18 bp, Homo sapiens
ttgttgcaagatgtgaat

SEQ ID NO: 5466328 - DNA, 19 bp, Homo sapiens
ttgttgcaagtactgctgt

SEQ ID NO: 5466329 - DNA, 20 bp, Homo sapiens
ttgttgcaccaattaagtgt

SEQ ID NO: 5466330 - DNA, 20 bp, Homo sapiens
ttgttgcactgaagtttgat

SEQ ID NO: 5466331 - DNA, 17 bp, Homo sapiens
tttaaagttcttatttt

SEQ ID NO: 5466332 - DNA, 20 bp, Homo sapiens
tttaaagttgtataaaaaca

SEQ ID NO: 5466333 - DNA, 17 bp, Homo sapiens
tttaaagttgtttgtgc

SEQ ID NO: 5466334 - DNA, 16 bp, Homo sapiens
tttaaagtttaaatac

SEQ ID NO: 5466335 - DNA, 17 bp, Homo sapiens
tttaaagtttaaatacc

SEQ ID NO: 5466336 - DNA, 18 bp, Homo sapiens
tttaaagtttggtattgt

SEQ ID NO: 5466337 - DNA, 20 bp, Homo sapiens
tttaaagttttatatgcata

SEQ ID NO: 5466338 - DNA, 16 bp, Homo sapiens
tttaaataaaagcaca

SEQ ID NO: 5466339 - DNA, 12 bp, Homo sapiens
tttaaataaaat

SEQ ID NO: 5466340 - DNA, 17 bp, Homo sapiens
tttaaataaaatagagt

SEQ ID NO: 5466341 - DNA, 12 bp, Homo sapiens
tttaaataaact

SEQ ID NO: 5466342 - DNA, 19 bp, Homo sapiens
tttaaataaagacctatgt

SEQ ID NO: 5466343 - DNA, 13 bp, Homo sapiens
tttaaataaagta

SEQ ID NO: 5466344 - DNA, 17 bp, Homo sapiens
tttaaataaagtttgga

SEQ ID NO: 5466345 - DNA, 20 bp, Homo sapiens
tttaaataaatgttattgtc

SEQ ID NO: 5466346 - DNA, 21 bp, Homo sapiens
tttaaataaattaagatccta

SEQ ID NO: 5466347 - DNA, 21 bp, Homo sapiens
tttaaataacctctggccctt

SEQ ID NO: 5466348 - DNA, 12 bp, Homo sapiens
tttaaataagat

SEQ ID NO: 5466349 - DNA, 12 bp, Homo sapiens
tttaaataataa

SEQ ID NO: 5466350 - DNA, 21 bp, Homo sapiens
tttaaataatttaactaccct

SEQ ID NO: 5466351 - DNA, 11 bp, Homo sapiens
tttaaatacat

SEQ ID NO: 5466352 - DNA, 20 bp, Homo sapiens
tttaaatacccatcttcatt

SEQ ID NO: 5466353 - DNA, 20 bp, Homo sapiens
tttaaatacgcactacatgt

SEQ ID NO: 5466354 - DNA, 15 bp, Homo sapiens
tttaaatagatgaca

SEQ ID NO: 5466355 - DNA, 22 bp, Homo sapiens
tttaaatagcattatcttatca

SEQ ID NO: 5466356 - DNA, 15 bp, Homo sapiens
tttaaatagcctaaa

SEQ ID NO: 5466357 - DNA, 18 bp, Homo sapiens
tttaaatagtttacttca

SEQ ID NO: 5466358 - DNA, 14 bp, Homo sapiens
tttaaatataaata

SEQ ID NO: 5466359 - DNA, 16 bp, Homo sapiens
tttaaatataattctg

SEQ ID NO: 5466360 - DNA, 18 bp, Homo sapiens
tttaaatattaatcaact

SEQ ID NO: 5466361 - DNA, 19 bp, Homo sapiens
tttaaatattatgctgctt

SEQ ID NO: 5466362 - DNA, 16 bp, Homo sapiens
tttaaatcaaaaactt

SEQ ID NO: 5466363 - DNA, 17 bp, Homo sapiens
tttaaatcaaaaacttt

SEQ ID NO: 5466364 - DNA, 14 bp, Homo sapiens
tttaaatcaaggaa

SEQ ID NO: 5466365 - DNA, 18 bp, Homo sapiens
tttaaatcaaggaaaggc

SEQ ID NO: 5466366 - DNA, 19 bp, Homo sapiens
tttaaatcaagtattttgt

SEQ ID NO: 5466367 - DNA, 11 bp, Homo sapiens
tttaaatcatt

SEQ ID NO: 5466368 - DNA, 14 bp, Homo sapiens
tttaaatcattaga

SEQ ID NO: 5466369 - DNA, 16 bp, Homo sapiens
tttaaatcctaccaaa

SEQ ID NO: 5466370 - DNA, 14 bp, Homo sapiens
tttaaatctgtgat

SEQ ID NO: 5466371 - DNA, 20 bp, Homo sapiens
tttaaatctgtttttctaac

SEQ ID NO: 5466372 - DNA, 16 bp, Homo sapiens
tttaaatctttgttaa

SEQ ID NO: 5466373 - DNA, 17 bp, Homo sapiens
tttaaatctttgttaaa

SEQ ID NO: 5466374 - DNA, 23 bp, Homo sapiens
tttaaatctttgttaaaatatag

SEQ ID NO: 5466375 - DNA, 13 bp, Homo sapiens
tttaaatgaaagt

SEQ ID NO: 5466376 - DNA, 21 bp, Homo sapiens
tttaaatgaaagtgagacttt

SEQ ID NO: 5466377 - DNA, 14 bp, Homo sapiens
tttaaatgaagaaa

SEQ ID NO: 5466378 - DNA, 19 bp, Homo sapiens
tttaaatgacagtaatatt

SEQ ID NO: 5466379 - DNA, 19 bp, Homo sapiens
tttaaatgacgcacaaact

SEQ ID NO: 5466380 - DNA, 20 bp, Homo sapiens
tttaaatgactgaagtgcta

SEQ ID NO: 5466381 - DNA, 18 bp, Homo sapiens
tttaaatgatatttaggt

SEQ ID NO: 5466382 - DNA, 15 bp, Homo sapiens
tttaaatgattccaa

SEQ ID NO: 5466383 - DNA, 16 bp, Homo sapiens
tttaaatgattccaaa

SEQ ID NO: 5466384 - DNA, 18 bp, Homo sapiens
tttaaatgattccaaata

SEQ ID NO: 5466385 - DNA, 24 bp, Homo sapiens
tttaaatgcacagttctatttgct

SEQ ID NO: 5466386 - DNA, 17 bp, Homo sapiens
tttaaatgcatgtctta

SEQ ID NO: 5466387 - DNA, 18 bp, Homo sapiens
tttaaatgcatgtcttaa

SEQ ID NO: 5466388 - DNA, 19 bp, Homo sapiens
tttaaatgcatgtcttaaa

SEQ ID NO: 5466389 - DNA, 18 bp, Homo sapiens
tttaaatgccaaaatgta

SEQ ID NO: 5466390 - DNA, 16 bp, Homo sapiens
tttaaatgccacaaga

SEQ ID NO: 5466391 - DNA, 12 bp, Homo sapiens
tttaaatgcttt

SEQ ID NO: 5466392 - DNA, 17 bp, Homo sapiens
tttaaatgcttttaaat

SEQ ID NO: 5466393 - DNA, 14 bp, Homo sapiens
tttaaatggacaga

SEQ ID NO: 5466394 - DNA, 12 bp, Homo sapiens
tttaaatggcat

SEQ ID NO: 5466395 - DNA, 19 bp, Homo sapiens
tttaaatgggtgaaaaatg

SEQ ID NO: 5466396 - DNA, 15 bp, Homo sapiens
tttaaatgtaaagat

SEQ ID NO: 5466397 - DNA, 11 bp, Homo sapiens
tttaaatgtac

SEQ ID NO: 5466398 - DNA, 13 bp, Homo sapiens
tttaaatgtatac

SEQ ID NO: 5466399 - DNA, 15 bp, Homo sapiens
tttaaatgtatacta

SEQ ID NO: 5466400 - DNA, 12 bp, Homo sapiens
tttaaatgtcta

SEQ ID NO: 5466401 - DNA, 13 bp, Homo sapiens
tttaaatgtgaat

SEQ ID NO: 5466402 - DNA, 15 bp, Homo sapiens
tttaaatgtgcttca

SEQ ID NO: 5466403 - DNA, 18 bp, Homo sapiens
tttaaatgtgtacaatgt

SEQ ID NO: 5466404 - DNA, 13 bp, Homo sapiens
tttaaatgtgtat

SEQ ID NO: 5466405 - DNA, 21 bp, Homo sapiens
tttaaatgttgaaatcttaaa

SEQ ID NO: 5466406 - DNA, 22 bp, Homo sapiens
tttaaattagaaaatattctct

SEQ ID NO: 5466407 - DNA, 19 bp, Homo sapiens
tttaaattataaggactgc

SEQ ID NO: 5466408 - DNA, 16 bp, Homo sapiens
tttaaattatgtataa

SEQ ID NO: 5466409 - DNA, 15 bp, Homo sapiens
tttaaattattatct

SEQ ID NO: 5466410 - DNA, 19 bp, Homo sapiens
tttaaattccactgaaaat

SEQ ID NO: 5466411 - DNA, 20 bp, Homo sapiens
tttaaattccactgaaaatt

SEQ ID NO: 5466412 - DNA, 17 bp, Homo sapiens
tttaaattctcagtcat

SEQ ID NO: 5466413 - DNA, 15 bp, Homo sapiens
tttaaattctccaac

SEQ ID NO: 5466414 - DNA, 12 bp, Homo sapiens
tttaaattctga

SEQ ID NO: 5466415 - DNA, 14 bp, Homo sapiens
tttaaattctgaga

SEQ ID NO: 5466416 - DNA, 17 bp, Homo sapiens
tttaaattctttttcaa

SEQ ID NO: 5466417 - DNA, 17 bp, Homo sapiens
tttaaattgcatttcta

SEQ ID NO: 5466418 - DNA, 12 bp, Homo sapiens
tttaaattggag

SEQ ID NO: 5466419 - DNA, 19 bp, Homo sapiens
tttaaattggagaaaagca

SEQ ID NO: 5466420 - DNA, 23 bp, Homo sapiens
tttaaattggagaaaagcactta

SEQ ID NO: 5466421 - DNA, 14 bp, Homo sapiens
tttaaattgtttca

SEQ ID NO: 5466422 - DNA, 17 bp, Homo sapiens
tttaaattgtttcatat

SEQ ID NO: 5466423 - DNA, 14 bp, Homo sapiens
tttaaatttcaaat

SEQ ID NO: 5466424 - DNA, 18 bp, Homo sapiens
tttaaattttacccttta

SEQ ID NO: 5466425 - DNA, 12 bp, Homo sapiens
tttaaattttct

SEQ ID NO: 5466426 - DNA, 13 bp, Homo sapiens
tttaaattttctc

SEQ ID NO: 5466427 - DNA, 14 bp, Homo sapiens
tttaaattttctcc

SEQ ID NO: 5466428 - DNA, 24 bp, Homo sapiens
tttaaattttctttttgtttcact

SEQ ID NO: 5466429 - DNA, 19 bp, Homo sapiens
tttaaattttgtatgccaa

SEQ ID NO: 5466430 - DNA, 16 bp, Homo sapiens
tttaaatttttatttt

SEQ ID NO: 5466431 - DNA, 13 bp, Homo sapiens
tttaaatttttgt

SEQ ID NO: 5466432 - DNA, 12 bp, Homo sapiens
tttaacaaaaaa

SEQ ID NO: 5466433 - DNA, 15 bp, Homo sapiens
tttaacaaaaaccaa

SEQ ID NO: 5466434 - DNA, 15 bp, Homo sapiens
tttaacaaaagcaag

SEQ ID NO: 5466435 - DNA, 13 bp, Homo sapiens
tttaacaaaattt

SEQ ID NO: 5466436 - DNA, 22 bp, Homo sapiens
tttaacaaacgcattaagaggt

SEQ ID NO: 5466437 - DNA, 15 bp, Homo sapiens
tttaacaaactaaaa

SEQ ID NO: 5466438 - DNA, 16 bp, Homo sapiens
tttaacaaactaaaaa

SEQ ID NO: 5466439 - DNA, 15 bp, Homo sapiens
tttaacaaatctaat

SEQ ID NO: 5466440 - DNA, 15 bp, Homo sapiens
tttaacaagaagatg

SEQ ID NO: 5466441 - DNA, 20 bp, Homo sapiens
tttaacaagaagatgaatgg

SEQ ID NO: 5466442 - DNA, 14 bp, Homo sapiens
tttaacaagatgtt

SEQ ID NO: 5466443 - DNA, 18 bp, Homo sapiens
tttaacaataactactgt

SEQ ID NO: 5466444 - DNA, 20 bp, Homo sapiens
tttaacaataactactgtgt

SEQ ID NO: 5466445 - DNA, 21 bp, Homo sapiens
tttaacaataactactgtgtt

SEQ ID NO: 5466446 - DNA, 16 bp, Homo sapiens
tttaacaatctaacaa

SEQ ID NO: 5466447 - DNA, 20 bp, Homo sapiens
tttaacaatgacaagatgtt

SEQ ID NO: 5466448 - DNA, 14 bp, Homo sapiens
tttaacaattgtct

SEQ ID NO: 5466449 - DNA, 16 bp, Homo sapiens
tttaacaattgtctta

SEQ ID NO: 5466450 - DNA, 18 bp, Homo sapiens
tttaacaattgtcttaaa

SEQ ID NO: 5466451 - DNA, 18 bp, Homo sapiens
tttaacaatttattctga

SEQ ID NO: 5466452 - DNA, 19 bp, Homo sapiens
tttaacaatttattctgat

SEQ ID NO: 5466453 - DNA, 22 bp, Homo sapiens
tttaacaccaacactgtaacat

SEQ ID NO: 5466454 - DNA, 17 bp, Homo sapiens
tttaacacctgatgtgt

SEQ ID NO: 5466455 - DNA, 21 bp, Homo sapiens
tttaacaccttttttgtgggg

SEQ ID NO: 5466456 - DNA, 14 bp, Homo sapiens
tttaacacttaaat

SEQ ID NO: 5466457 - DNA, 22 bp, Homo sapiens
tttaacacttctgtatgcatca

SEQ ID NO: 5466458 - DNA, 11 bp, Homo sapiens
tttaacagaaa

SEQ ID NO: 5466459 - DNA, 18 bp, Homo sapiens
tttaacagaaaaatgaaa

SEQ ID NO: 5466460 - DNA, 18 bp, Homo sapiens
tttaacagaaactttcaa

SEQ ID NO: 5466461 - DNA, 21 bp, Homo sapiens
tttaacagaaactttcaaaag

SEQ ID NO: 5466462 - DNA, 13 bp, Homo sapiens
tttaacagaaatg

SEQ ID NO: 5466463 - DNA, 15 bp, Homo sapiens
tttaacagaaatgta

SEQ ID NO: 5466464 - DNA, 14 bp, Homo sapiens
tttaacagaaattg

SEQ ID NO: 5466465 - DNA, 12 bp, Homo sapiens
tttaacagacat

SEQ ID NO: 5466466 - DNA, 18 bp, Homo sapiens
tttaacagatatttaaat

SEQ ID NO: 5466467 - DNA, 18 bp, Homo sapiens
tttaacagcatgacaaaa

SEQ ID NO: 5466468 - DNA, 17 bp, Homo sapiens
tttaacagctgaattat

SEQ ID NO: 5466469 - DNA, 18 bp, Homo sapiens
tttaacaggaagatctta

SEQ ID NO: 5466470 - DNA, 23 bp, Homo sapiens
tttaacagggtctctagtgctgt

SEQ ID NO: 5466471 - DNA, 20 bp, Homo sapiens
tttaacaggttttcttctaa

SEQ ID NO: 5466472 - DNA, 21 bp, Homo sapiens
tttaacaggttttcttctaat

SEQ ID NO: 5466473 - DNA, 16 bp, Homo sapiens
tttaacataagctatt

SEQ ID NO: 5466474 - DNA, 21 bp, Homo sapiens
tttaacataatggttgtgaaa

SEQ ID NO: 5466475 - DNA, 19 bp, Homo sapiens
tttaacatacaagaaaatg

SEQ ID NO: 5466476 - DNA, 18 bp, Homo sapiens
tttaacatagcagctggt

SEQ ID NO: 5466477 - DNA, 22 bp, Homo sapiens
tttaacatagcagctggttaac

SEQ ID NO: 5466478 - DNA, 18 bp, Homo sapiens
tttaacatatcattcaga

SEQ ID NO: 5466479 - DNA, 11 bp, Homo sapiens
tttaacatctt

SEQ ID NO: 5466480 - DNA, 17 bp, Homo sapiens
tttaacatgatttcaaa

SEQ ID NO: 5466481 - DNA, 11 bp, Homo sapiens
tttaacatgcc

SEQ ID NO: 5466482 - DNA, 21 bp, Homo sapiens
tttaacatggttcaggtacac

SEQ ID NO: 5466483 - DNA, 12 bp, Homo sapiens
tttaacattatt

SEQ ID NO: 5466484 - DNA, 17 bp, Homo sapiens
tttaacattcacagccc

SEQ ID NO: 5466485 - DNA, 12 bp, Homo sapiens
tttaacattcct

SEQ ID NO: 5466486 - DNA, 23 bp, Homo sapiens
tttaacattcctcatgaatgtaa

SEQ ID NO: 5466487 - DNA, 13 bp, Homo sapiens
tttaacatttgcc

SEQ ID NO: 5466488 - DNA, 22 bp, Homo sapiens
tttaacatttgccttgcagaac

SEQ ID NO: 5466489 - DNA, 14 bp, Homo sapiens
tttaacattttaca

SEQ ID NO: 5466490 - DNA, 20 bp, Homo sapiens
tttaacattttggaaattgt

SEQ ID NO: 5466491 - DNA, 16 bp, Homo sapiens
tttaacattttgttct

SEQ ID NO: 5466492 - DNA, 17 bp, Homo sapiens
tttaacattttgttctt

SEQ ID NO: 5466493 - DNA, 19 bp, Homo sapiens
tttaaccaaaacatgtctc

SEQ ID NO: 5466494 - DNA, 13 bp, Homo sapiens
tttaaccaaaggt

SEQ ID NO: 5466495 - DNA, 21 bp, Homo sapiens
tttaaccaaaggtgaaggaat

SEQ ID NO: 5466496 - DNA, 13 bp, Homo sapiens
tttaaccaaataa

SEQ ID NO: 5466497 - DNA, 21 bp, Homo sapiens
tttaaccacagtgaaagttga

SEQ ID NO: 5466498 - DNA, 18 bp, Homo sapiens
tttaaccaggggtcctaa

SEQ ID NO: 5466499 - DNA, 17 bp, Homo sapiens
tttaaccataaatcaat

SEQ ID NO: 5466500 - DNA, 21 bp, Homo sapiens
tttaaccatggtgcttgttaa

SEQ ID NO: 5466501 - DNA, 18 bp, Homo sapiens
tttaaccattattatgca

SEQ ID NO: 5466502 - DNA, 17 bp, Homo sapiens
tttaacccccctgtaca

SEQ ID NO: 5466503 - DNA, 19 bp, Homo sapiens
tttaacccccctgtacaca

SEQ ID NO: 5466504 - DNA, 17 bp, Homo sapiens
tttaaccccgtcaacaa

SEQ ID NO: 5466505 - DNA, 12 bp, Homo sapiens
tttaaccctcac

SEQ ID NO: 5466506 - DNA, 20 bp, Homo sapiens
tttaaccctttaatgaactt

SEQ ID NO: 5466507 - DNA, 14 bp, Homo sapiens
tttaaccctttctg

SEQ ID NO: 5466508 - DNA, 18 bp, Homo sapiens
tttaaccgtttttcaaga

SEQ ID NO: 5466509 - DNA, 17 bp, Homo sapiens
tttaacctcccctctcc

SEQ ID NO: 5466510 - DNA, 17 bp, Homo sapiens
tttaacctctttaagta

SEQ ID NO: 5466511 - DNA, 20 bp, Homo sapiens
tttaattacctggtgagtaa

SEQ ID NO: 5466512 - DNA, 22 bp, Homo sapiens
tttaattactggaattcttctg

SEQ ID NO: 5466513 - DNA, 18 bp, Homo sapiens
tttaattagaatggataa

SEQ ID NO: 5466514 - DNA, 21 bp, Homo sapiens
tttaattaggggttgctaaga

SEQ ID NO: 5466515 - DNA, 20 bp, Homo sapiens
tttaattagtgctaagtgtg

SEQ ID NO: 5466516 - DNA, 21 bp, Homo sapiens
tttaattagtgctaagtgtga

SEQ ID NO: 5466517 - DNA, 14 bp, Homo sapiens
tttaattataaaaa

SEQ ID NO: 5466518 - DNA, 21 bp, Homo sapiens
tttaattatctgcatttatct

SEQ ID NO: 5466519 - DNA, 13 bp, Homo sapiens
tttaattatgaaa

SEQ ID NO: 5466520 - DNA, 21 bp, Homo sapiens
tttaattatgaaaactagcat

SEQ ID NO: 5466521 - DNA, 22 bp, Homo sapiens
tttaattatgaaaactagcatt

SEQ ID NO: 5466522 - DNA, 18 bp, Homo sapiens
tttaattattaactacat

SEQ ID NO: 5466523 - DNA, 15 bp, Homo sapiens
tttaattatttaaat

SEQ ID NO: 5466524 - DNA, 17 bp, Homo sapiens
tttaattattttaaaat

SEQ ID NO: 5466525 - DNA, 15 bp, Homo sapiens
tttaattattttctg

SEQ ID NO: 5466526 - DNA, 12 bp, Homo sapiens
tttaattcaaga

SEQ ID NO: 5466527 - DNA, 18 bp, Homo sapiens
tttaattcataattagaa

SEQ ID NO: 5466528 - DNA, 12 bp, Homo sapiens
tttaattcatat

SEQ ID NO: 5466529 - DNA, 23 bp, Homo sapiens
tttaattcatcccaactgtcttt

SEQ ID NO: 5466530 - DNA, 16 bp, Homo sapiens
tttaattcatgtttct

SEQ ID NO: 5466531 - DNA, 11 bp, Homo sapiens
tttaattccat

SEQ ID NO: 5466532 - DNA, 13 bp, Homo sapiens
tttaattccatga

SEQ ID NO: 5466533 - DNA, 22 bp, Homo sapiens
tttaattctaaaagagaaggga

SEQ ID NO: 5466534 - DNA, 12 bp, Homo sapiens
tttaattctctc

SEQ ID NO: 5466535 - DNA, 14 bp, Homo sapiens
tttaattctttcta

SEQ ID NO: 5466536 - DNA, 18 bp, Homo sapiens
tttaattgacatactcag

SEQ ID NO: 5466537 - DNA, 19 bp, Homo sapiens
tttaattgatttttcttct

SEQ ID NO: 5466538 - DNA, 14 bp, Homo sapiens
tttaattgctttga

SEQ ID NO: 5466539 - DNA, 15 bp, Homo sapiens
tttaattgtaaactg

SEQ ID NO: 5466540 - DNA, 16 bp, Homo sapiens
tttaattgtaaactgt

SEQ ID NO: 5466541 - DNA, 17 bp, Homo sapiens
tttaattgtaaactgta

SEQ ID NO: 5466542 - DNA, 19 bp, Homo sapiens
tttaattgtaattgtctca

SEQ ID NO: 5466543 - DNA, 21 bp, Homo sapiens
tttaattgtaggtcaatgaaa

SEQ ID NO: 5466544 - DNA, 12 bp, Homo sapiens
tttaattgtata

SEQ ID NO: 5466545 - DNA, 15 bp, Homo sapiens
tttaattgtataagt

SEQ ID NO: 5466546 - DNA, 13 bp, Homo sapiens
tttaattgtattt

SEQ ID NO: 5466547 - DNA, 12 bp, Homo sapiens
tttaattgtcat

SEQ ID NO: 5466548 - DNA, 13 bp, Homo sapiens
tttaattgtcatg

SEQ ID NO: 5466549 - DNA, 14 bp, Homo sapiens
tttaattgtcatgg

SEQ ID NO: 5466550 - DNA, 15 bp, Homo sapiens
tttaattgtttaaaa

SEQ ID NO: 5466551 - DNA, 22 bp, Homo sapiens
tttaatttaaactgtgttttag

SEQ ID NO: 5466552 - DNA, 14 bp, Homo sapiens
tttaatttagatat

SEQ ID NO: 5466553 - DNA, 23 bp, Homo sapiens
tttaatttagatattttccatat

SEQ ID NO: 5466554 - DNA, 19 bp, Homo sapiens
tttaatttagtaaatgtta

SEQ ID NO: 5466555 - DNA, 22 bp, Homo sapiens
tttaatttatatcaggtgtata

SEQ ID NO: 5466556 - DNA, 14 bp, Homo sapiens
tttaatttatttca

SEQ ID NO: 5466557 - DNA, 20 bp, Homo sapiens
tttaatttcaagcttatttt

SEQ ID NO: 5466558 - DNA, 21 bp, Homo sapiens
tttaatttctaagaagttact

SEQ ID NO: 5466559 - DNA, 16 bp, Homo sapiens
tttaatttgaaatatg

SEQ ID NO: 5466560 - DNA, 22 bp, Homo sapiens
tttaatttgatgaaagctgatt

SEQ ID NO: 5466561 - DNA, 20 bp, Homo sapiens
tttaatttgccaaaataatg

SEQ ID NO: 5466562 - DNA, 12 bp, Homo sapiens
tttaatttgctt

SEQ ID NO: 5466563 - DNA, 18 bp, Homo sapiens
tttaatttggcttttctt

SEQ ID NO: 5466564 - DNA, 17 bp, Homo sapiens
tttaatttgtaataaaa

SEQ ID NO: 5466565 - DNA, 13 bp, Homo sapiens
tttaattttaatg

SEQ ID NO: 5466566 - DNA, 14 bp, Homo sapiens
tttaattttaattt

SEQ ID NO: 5466567 - DNA, 13 bp, Homo sapiens
tttaattttagag

SEQ ID NO: 5466568 - DNA, 15 bp, Homo sapiens
tttaattttcacaaa

SEQ ID NO: 5466569 - DNA, 21 bp, Homo sapiens
tttaattttcacaaaatgtct

SEQ ID NO: 5466570 - DNA, 14 bp, Homo sapiens
tttaattttcactt

SEQ ID NO: 5466571 - DNA, 15 bp, Homo sapiens
tttaattttcaggtc

SEQ ID NO: 5466572 - DNA, 14 bp, Homo sapiens
tttaattttgatat

SEQ ID NO: 5466573 - DNA, 22 bp, Homo sapiens
tttaattttgatatacattgtg

SEQ ID NO: 5466574 - DNA, 14 bp, Homo sapiens
tttaatttttaaat

SEQ ID NO: 5466575 - DNA, 17 bp, Homo sapiens
tttaatttttaaatgca

SEQ ID NO: 5466576 - DNA, 15 bp, Homo sapiens
tttaatttttccttt

SEQ ID NO: 5466577 - DNA, 18 bp, Homo sapiens
tttaattttttctctttg

SEQ ID NO: 5466578 - DNA, 17 bp, Homo sapiens
tttaattttttttagta

SEQ ID NO: 5466579 - DNA, 15 bp, Homo sapiens
tttacaaaaatataa

SEQ ID NO: 5466580 - DNA, 11 bp, Homo sapiens
tttacaaaaga

SEQ ID NO: 5466581 - DNA, 20 bp, Homo sapiens
tttacaaaagaggagcactt

SEQ ID NO: 5466582 - DNA, 13 bp, Homo sapiens
tttacaaaagatg

SEQ ID NO: 5466583 - DNA, 14 bp, Homo sapiens
tttacaaaatattc

SEQ ID NO: 5466584 - DNA, 17 bp, Homo sapiens
tttacaaaccattacct

SEQ ID NO: 5466585 - DNA, 19 bp, Homo sapiens
tttacaaaccattacctgt

SEQ ID NO: 5466586 - DNA, 15 bp, Homo sapiens
tttacaaagaaacaa

SEQ ID NO: 5466587 - DNA, 16 bp, Homo sapiens
tttacaaagtgtgtat

SEQ ID NO: 5466588 - DNA, 18 bp, Homo sapiens
tttacaaagtgtgtatta

SEQ ID NO: 5466589 - DNA, 23 bp, Homo sapiens
tttacaaatattaagaaaatatt

SEQ ID NO: 5466590 - DNA, 15 bp, Homo sapiens
tttacaaatgaagta

SEQ ID NO: 5466591 - DNA, 23 bp, Homo sapiens
tttacaaatgatttcgtgactgt

SEQ ID NO: 5466592 - DNA, 12 bp, Homo sapiens
tttacaaatgtt

SEQ ID NO: 5466593 - DNA, 20 bp, Homo sapiens
tttacaaatgttaaaatgtg

SEQ ID NO: 5466594 - DNA, 21 bp, Homo sapiens
tttacaaattcctttcagagt

SEQ ID NO: 5466595 - DNA, 19 bp, Homo sapiens
tttacaaatttaattttgc

SEQ ID NO: 5466596 - DNA, 14 bp, Homo sapiens
tttacaacaaacac

SEQ ID NO: 5466597 - DNA, 15 bp, Homo sapiens
tttacaacaaacact

SEQ ID NO: 5466598 - DNA, 14 bp, Homo sapiens
tttacaacacttta

SEQ ID NO: 5466599 - DNA, 20 bp, Homo sapiens
tttacaacactttaatgggt

SEQ ID NO: 5466600 - DNA, 22 bp, Homo sapiens
tttacaaccatactttatatat

SEQ ID NO: 5466601 - DNA, 13 bp, Homo sapiens
tttacaactgaaa

SEQ ID NO: 5466602 - DNA, 22 bp, Homo sapiens
tttacaacttccagatttgagc

SEQ ID NO: 5466603 - DNA, 12 bp, Homo sapiens
tttacaagaaat

SEQ ID NO: 5466604 - DNA, 19 bp, Homo sapiens
tttacaagaagtttattct

SEQ ID NO: 5466605 - DNA, 20 bp, Homo sapiens
tttacaagaattgtccatgt

SEQ ID NO: 5466606 - DNA, 20 bp, Homo sapiens
tttacaagacaacattgtaa

SEQ ID NO: 5466607 - DNA, 17 bp, Homo sapiens
tttacaagatccatttg

SEQ ID NO: 5466608 - DNA, 17 bp, Homo sapiens
tttacaagcaggcactg

SEQ ID NO: 5466609 - DNA, 17 bp, Homo sapiens
tttacaagggagaagac

SEQ ID NO: 5466610 - DNA, 15 bp, Homo sapiens
tttacaagtgtatat

SEQ ID NO: 5466611 - DNA, 14 bp, Homo sapiens
tttacaataaagaa

SEQ ID NO: 5466612 - DNA, 15 bp, Homo sapiens
tttacaataaagaat

SEQ ID NO: 5466613 - DNA, 16 bp, Homo sapiens
tttacaataaataatc

SEQ ID NO: 5466614 - DNA, 21 bp, Homo sapiens
tttacaatcagccacattcta

SEQ ID NO: 5466615 - DNA, 16 bp, Homo sapiens
tttacaatctgtatct

SEQ ID NO: 5466616 - DNA, 16 bp, Homo sapiens
tttacaatgatttgta

SEQ ID NO: 5466617 - DNA, 16 bp, Homo sapiens
tttacaatgtaattat

SEQ ID NO: 5466618 - DNA, 14 bp, Homo sapiens
tttacaatgtatta

SEQ ID NO: 5466619 - DNA, 16 bp, Homo sapiens
tttacaattgaaatga

SEQ ID NO: 5466620 - DNA, 18 bp, Homo sapiens
tttacaatttacaaagtg

SEQ ID NO: 5466621 - DNA, 22 bp, Homo sapiens
tttacaatttagcttacatttt

SEQ ID NO: 5466622 - DNA, 15 bp, Homo sapiens
tttacaatttcaaaa

SEQ ID NO: 5466623 - DNA, 16 bp, Homo sapiens
tttacacaaatgtgat

SEQ ID NO: 5466624 - DNA, 18 bp, Homo sapiens
tttacacaatagaattat

SEQ ID NO: 5466625 - DNA, 12 bp, Homo sapiens
tttacacaatta

SEQ ID NO: 5466626 - DNA, 14 bp, Homo sapiens
tttacacaattctt

SEQ ID NO: 5466627 - DNA, 19 bp, Homo sapiens
tttacacacttgcatgaat

SEQ ID NO: 5466628 - DNA, 14 bp, Homo sapiens
tttacacagaaaca

SEQ ID NO: 5466629 - DNA, 15 bp, Homo sapiens
tttacacagaaacac

SEQ ID NO: 5466630 - DNA, 19 bp, Homo sapiens
tttacacagaaacactgcc

SEQ ID NO: 5466631 - DNA, 20 bp, Homo sapiens
tttacacagaaacactgcct

SEQ ID NO: 5466632 - DNA, 15 bp, Homo sapiens
tttacacagagaaat

SEQ ID NO: 5466633 - DNA, 18 bp, Homo sapiens
tttacacagcaattttgt

SEQ ID NO: 5466634 - DNA, 23 bp, Homo sapiens
tttacacagtgagactgtacata

SEQ ID NO: 5466635 - DNA, 23 bp, Homo sapiens
tttacaccaatttggtaaaaatg

SEQ ID NO: 5466636 - DNA, 17 bp, Homo sapiens
tttacaccacactttca

SEQ ID NO: 5466637 - DNA, 21 bp, Homo sapiens
tttacaccagttcctttcaat

SEQ ID NO: 5466638 - DNA, 14 bp, Homo sapiens
tttacacgagattt

SEQ ID NO: 5466639 - DNA, 22 bp, Homo sapiens
tttacacggagcggattgcaaa

SEQ ID NO: 5466640 - DNA, 16 bp, Homo sapiens
tttacacgtctatgca

SEQ ID NO: 5466641 - DNA, 19 bp, Homo sapiens
tttacacgtctatgcaatt

SEQ ID NO: 5466642 - DNA, 21 bp, Homo sapiens
tttacactaatatatggacct

SEQ ID NO: 5466643 - DNA, 22 bp, Homo sapiens
tttacactaatatatggaccta

SEQ ID NO: 5466644 - DNA, 19 bp, Homo sapiens
tttacactattatttccta

SEQ ID NO: 5466645 - DNA, 21 bp, Homo sapiens
tttacactattgtgaatattt

SEQ ID NO: 5466646 - DNA, 19 bp, Homo sapiens
tttacactctgtattgaaa

SEQ ID NO: 5466647 - DNA, 14 bp, Homo sapiens
tttacactggtcta

SEQ ID NO: 5466648 - DNA, 18 bp, Homo sapiens
tttacactggtctaatgt

SEQ ID NO: 5466649 - DNA, 15 bp, Homo sapiens
tttacacttttgaga

SEQ ID NO: 5466650 - DNA, 13 bp, Homo sapiens
tttacagaaaaag

SEQ ID NO: 5466651 - DNA, 16 bp, Homo sapiens
tttacagaaaaatctt

SEQ ID NO: 5466652 - DNA, 17 bp, Homo sapiens
tttacagaaaaatcttg

SEQ ID NO: 5466653 - DNA, 20 bp, Homo sapiens
tttacagaatgcattaaaaa

SEQ ID NO: 5466654 - DNA, 16 bp, Homo sapiens
tttacagagaatctga

SEQ ID NO: 5466655 - DNA, 21 bp, Homo sapiens
tttacagagaggatacattta

SEQ ID NO: 5466656 - DNA, 20 bp, Homo sapiens
tttacagaggacagtatttg

SEQ ID NO: 5466657 - DNA, 17 bp, Homo sapiens
tttacagatgaatgtat

SEQ ID NO: 5466658 - DNA, 12 bp, Homo sapiens
tttacagatgtt

SEQ ID NO: 5466659 - DNA, 23 bp, Homo sapiens
tttacagatttattcctttgtta

SEQ ID NO: 5466660 - DNA, 15 bp, Homo sapiens
tttacagcactactc

SEQ ID NO: 5466661 - DNA, 18 bp, Homo sapiens
tttacagcactactctgt

SEQ ID NO: 5466662 - DNA, 16 bp, Homo sapiens
tttacagcagcaatat

SEQ ID NO: 5466663 - DNA, 21 bp, Homo sapiens
tttacagcccttggcttgtgt

SEQ ID NO: 5466664 - DNA, 13 bp, Homo sapiens
tttacagctgcct

SEQ ID NO: 5466665 - DNA, 15 bp, Homo sapiens
tttacagctgcctgc

SEQ ID NO: 5466666 - DNA, 20 bp, Homo sapiens
tttacagctgtgctccacac

SEQ ID NO: 5466667 - DNA, 16 bp, Homo sapiens
tttacagctttacaca

SEQ ID NO: 5466668 - DNA, 23 bp, Homo sapiens
tttacagctttcatgattagcaa

SEQ ID NO: 5466669 - DNA, 19 bp, Homo sapiens
tttacaggaaagatgcatt

SEQ ID NO: 5466670 - DNA, 16 bp, Homo sapiens
tttacaggaacccagc

SEQ ID NO: 5466671 - DNA, 14 bp, Homo sapiens
tttacaggaacttc

SEQ ID NO: 5466672 - DNA, 14 bp, Homo sapiens
tttacaggagggcc

SEQ ID NO: 5466673 - DNA, 22 bp, Homo sapiens
tttacaggccctgctcctgcag

SEQ ID NO: 5466674 - DNA, 18 bp, Homo sapiens
tttacagggagcctcctg

SEQ ID NO: 5466675 - DNA, 20 bp, Homo sapiens
tttacagggagcctcctgcc

SEQ ID NO: 5466676 - DNA, 15 bp, Homo sapiens
tttacaggtttgaat

SEQ ID NO: 5466677 - DNA, 17 bp, Homo sapiens
tttacaggtttgaatta

SEQ ID NO: 5466678 - DNA, 16 bp, Homo sapiens
tttacagtatcttcaa

SEQ ID NO: 5466679 - DNA, 16 bp, Homo sapiens
tttacagtccttcaaa

SEQ ID NO: 5466680 - DNA, 16 bp, Homo sapiens
tttacagtctatttga

SEQ ID NO: 5466681 - DNA, 13 bp, Homo sapiens
tttacagtctctg

SEQ ID NO: 5466682 - DNA, 18 bp, Homo sapiens
tttacagtctctgttgta

SEQ ID NO: 5466683 - DNA, 22 bp, Homo sapiens
tttacagtctctttcttccttt

SEQ ID NO: 5466684 - DNA, 19 bp, Homo sapiens
tttacagtgaaaatgtaag

SEQ ID NO: 5466685 - DNA, 17 bp, Homo sapiens
tttacagtgaagaaagc

SEQ ID NO: 5466686 - DNA, 21 bp, Homo sapiens
tttacagtgaccttttcttca

SEQ ID NO: 5466687 - DNA, 23 bp, Homo sapiens
tttacagtgaccttttcttcatt

SEQ ID NO: 5466688 - DNA, 22 bp, Homo sapiens
tttacagtgatagaacaaaaga

SEQ ID NO: 5466689 - DNA, 13 bp, Homo sapiens
tttataaaagcaa

SEQ ID NO: 5466690 - DNA, 16 bp, Homo sapiens
tttataaaatggctgt

SEQ ID NO: 5466691 - DNA, 18 bp, Homo sapiens
tttataaaattaaagaaa

SEQ ID NO: 5466692 - DNA, 20 bp, Homo sapiens
tttataaaattaaagaaaat

SEQ ID NO: 5466693 - DNA, 16 bp, Homo sapiens
tttataaaattagaaa

SEQ ID NO: 5466694 - DNA, 15 bp, Homo sapiens
tttataaacagaaat

SEQ ID NO: 5466695 - DNA, 23 bp, Homo sapiens
tttataaacagaaatggaaagca

SEQ ID NO: 5466696 - DNA, 13 bp, Homo sapiens
tttataaacagtt

SEQ ID NO: 5466697 - DNA, 15 bp, Homo sapiens
tttataaactacaaa

SEQ ID NO: 5466698 - DNA, 14 bp, Homo sapiens
tttataaactagat

SEQ ID NO: 5466699 - DNA, 19 bp, Homo sapiens
tttataaactaggtaaaat

SEQ ID NO: 5466700 - DNA, 14 bp, Homo sapiens
tttataaactgaga

SEQ ID NO: 5466701 - DNA, 17 bp, Homo sapiens
tttataaactgagaggt

SEQ ID NO: 5466702 - DNA, 12 bp, Homo sapiens
tttataaagcag

SEQ ID NO: 5466703 - DNA, 19 bp, Homo sapiens
tttataaagcagattacct

SEQ ID NO: 5466704 - DNA, 13 bp, Homo sapiens
tttataaagcagt

SEQ ID NO: 5466705 - DNA, 12 bp, Homo sapiens
tttataaagcat

SEQ ID NO: 5466706 - DNA, 19 bp, Homo sapiens
tttataaagccaagaattg

SEQ ID NO: 5466707 - DNA, 21 bp, Homo sapiens
tttataaagctgttcttgaaa

SEQ ID NO: 5466708 - DNA, 20 bp, Homo sapiens
tttataaataaaatcatgta

SEQ ID NO: 5466709 - DNA, 22 bp, Homo sapiens
tttataaatataagccttttat

SEQ ID NO: 5466710 - DNA, 15 bp, Homo sapiens
tttataaatatgtga

SEQ ID NO: 5466711 - DNA, 21 bp, Homo sapiens
tttataaatatgtgaaaatga

SEQ ID NO: 5466712 - DNA, 21 bp, Homo sapiens
tttataaatattaggcataaa

SEQ ID NO: 5466713 - DNA, 22 bp, Homo sapiens
tttataaatattaggcataaat

SEQ ID NO: 5466714 - DNA, 23 bp, Homo sapiens
tttataaatattaggcataaatt

SEQ ID NO: 5466715 - DNA, 22 bp, Homo sapiens
tttataaatcgcttttgataat

SEQ ID NO: 5466716 - DNA, 12 bp, Homo sapiens
tttataaatgaa

SEQ ID NO: 5466717 - DNA, 14 bp, Homo sapiens
tttataaatgaaga

SEQ ID NO: 5466718 - DNA, 13 bp, Homo sapiens
tttataaatgcta

SEQ ID NO: 5466719 - DNA, 15 bp, Homo sapiens
tttataaatgctatt

SEQ ID NO: 5466720 - DNA, 16 bp, Homo sapiens
tttataaatgctattt

SEQ ID NO: 5466721 - DNA, 13 bp, Homo sapiens
tttataaatgtgt

SEQ ID NO: 5466722 - DNA, 16 bp, Homo sapiens
tttataaattaaatat

SEQ ID NO: 5466723 - DNA, 14 bp, Homo sapiens
tttataacaaatat

SEQ ID NO: 5466724 - DNA, 19 bp, Homo sapiens
tttataacaacgtcttttt

SEQ ID NO: 5466725 - DNA, 23 bp, Homo sapiens
tttataacaacgtctttttgttt

SEQ ID NO: 5466726 - DNA, 22 bp, Homo sapiens
tttataacagttataaagaaag

SEQ ID NO: 5466727 - DNA, 23 bp, Homo sapiens
tttataacagttataaagaaaga

SEQ ID NO: 5466728 - DNA, 20 bp, Homo sapiens
tttataacatctttattgaa

SEQ ID NO: 5466729 - DNA, 19 bp, Homo sapiens
tttataactaatatggttt

SEQ ID NO: 5466730 - DNA, 16 bp, Homo sapiens
tttataactattcagt

SEQ ID NO: 5466731 - DNA, 16 bp, Homo sapiens
tttataactcatcata

SEQ ID NO: 5466732 - DNA, 20 bp, Homo sapiens
tttataactcatcataaaat

SEQ ID NO: 5466733 - DNA, 17 bp, Homo sapiens
tttataagaaaaacttt

SEQ ID NO: 5466734 - DNA, 15 bp, Homo sapiens
tttataagaaagcct

SEQ ID NO: 5466735 - DNA, 23 bp, Homo sapiens
tttataagaaagcctgagtactc

SEQ ID NO: 5466736 - DNA, 13 bp, Homo sapiens
tttataagaattt

SEQ ID NO: 5466737 - DNA, 23 bp, Homo sapiens
tttataagcaaatttcaaaagac

SEQ ID NO: 5466738 - DNA, 17 bp, Homo sapiens
tttataagcatcattat

SEQ ID NO: 5466739 - DNA, 20 bp, Homo sapiens
tttataagcatttgtattat

SEQ ID NO: 5466740 - DNA, 22 bp, Homo sapiens
tttataagcccaaatggctctg

SEQ ID NO: 5466741 - DNA, 19 bp, Homo sapiens
tttataaggttgtctgttt

SEQ ID NO: 5466742 - DNA, 21 bp, Homo sapiens
tttataagtgactttaaactt

SEQ ID NO: 5466743 - DNA, 18 bp, Homo sapiens
tttataagttcacaaaat

SEQ ID NO: 5466744 - DNA, 23 bp, Homo sapiens
tttataataaactcttaagagaa

SEQ ID NO: 5466745 - DNA, 15 bp, Homo sapiens
tttataataaactgt

SEQ ID NO: 5466746 - DNA, 13 bp, Homo sapiens
tttataatagatt

SEQ ID NO: 5466747 - DNA, 18 bp, Homo sapiens
tttataatataaatcaat

SEQ ID NO: 5466748 - DNA, 23 bp, Homo sapiens
tttataatataaatcaatcttat

SEQ ID NO: 5466749 - DNA, 14 bp, Homo sapiens
tttataatattcat

SEQ ID NO: 5466750 - DNA, 21 bp, Homo sapiens
tttataatattcatacaacaa

SEQ ID NO: 5466751 - DNA, 22 bp, Homo sapiens
tttataatattcatacaacaaa

SEQ ID NO: 5466752 - DNA, 15 bp, Homo sapiens
tttataatcaatgaa

SEQ ID NO: 5466753 - DNA, 12 bp, Homo sapiens
tttataatctga

SEQ ID NO: 5466754 - DNA, 14 bp, Homo sapiens
tttataatctgaag

SEQ ID NO: 5466755 - DNA, 12 bp, Homo sapiens
tttataatgtat

SEQ ID NO: 5466756 - DNA, 15 bp, Homo sapiens
tttataatgtatttg

SEQ ID NO: 5466757 - DNA, 22 bp, Homo sapiens
tttataatgtcaaatgaaacct

SEQ ID NO: 5466758 - DNA, 16 bp, Homo sapiens
tttataattaaagaaa

SEQ ID NO: 5466759 - DNA, 15 bp, Homo sapiens
tttataattaaagat

SEQ ID NO: 5466760 - DNA, 13 bp, Homo sapiens
tttataattaatc

SEQ ID NO: 5466761 - DNA, 18 bp, Homo sapiens
tttataattcagtatgtt

SEQ ID NO: 5466762 - DNA, 20 bp, Homo sapiens
tttataattctcattaaaag

SEQ ID NO: 5466763 - DNA, 18 bp, Homo sapiens
tttataattggtgctatt

SEQ ID NO: 5466764 - DNA, 15 bp, Homo sapiens
tttataattgtacaa

SEQ ID NO: 5466765 - DNA, 20 bp, Homo sapiens
tttataattgtacaaaatta

SEQ ID NO: 5466766 - DNA, 20 bp, Homo sapiens
tttataattgtttataaaac

SEQ ID NO: 5466767 - DNA, 15 bp, Homo sapiens
tttataattttaaga

SEQ ID NO: 5466768 - DNA, 22 bp, Homo sapiens
tttataattttgtgaagcaaaa

SEQ ID NO: 5466769 - DNA, 12 bp, Homo sapiens
tttatacaaaat

SEQ ID NO: 5466770 - DNA, 16 bp, Homo sapiens
tttatacaaaataatt

SEQ ID NO: 5466771 - DNA, 18 bp, Homo sapiens
tttatacaaaataattta

SEQ ID NO: 5466772 - DNA, 17 bp, Homo sapiens
tttatacaaatgtctta

SEQ ID NO: 5466773 - DNA, 23 bp, Homo sapiens
tttatacaacagtgctaaaaatg

SEQ ID NO: 5466774 - DNA, 21 bp, Homo sapiens
tttatacacaactttgcaaat

SEQ ID NO: 5466775 - DNA, 13 bp, Homo sapiens
tttatacacacag

SEQ ID NO: 5466776 - DNA, 16 bp, Homo sapiens
tttatacacacaggag

SEQ ID NO: 5466777 - DNA, 22 bp, Homo sapiens
tttatacacagattctgccttg

SEQ ID NO: 5466778 - DNA, 16 bp, Homo sapiens
tttatacaccagcaat

SEQ ID NO: 5466779 - DNA, 14 bp, Homo sapiens
tttatacactgtaa

SEQ ID NO: 5466780 - DNA, 19 bp, Homo sapiens
tttatacactgtaagcttt

SEQ ID NO: 5466781 - DNA, 23 bp, Homo sapiens
tttatacagatgccatatagtgt

SEQ ID NO: 5466782 - DNA, 13 bp, Homo sapiens
tttatacagctgt

SEQ ID NO: 5466783 - DNA, 21 bp, Homo sapiens
tttatacagctgtattgtctg

SEQ ID NO: 5466784 - DNA, 18 bp, Homo sapiens
tttatacagtagtgagaa

SEQ ID NO: 5466785 - DNA, 18 bp, Homo sapiens
tttatacagtgccttgct

SEQ ID NO: 5466786 - DNA, 13 bp, Homo sapiens
tttatacagtgta

SEQ ID NO: 5466787 - DNA, 19 bp, Homo sapiens
tttatacagttttaaagaa

SEQ ID NO: 5466788 - DNA, 13 bp, Homo sapiens
tttatacataaac

SEQ ID NO: 5466789 - DNA, 20 bp, Homo sapiens
tttatacataaacaagacca

SEQ ID NO: 5466790 - DNA, 15 bp, Homo sapiens
tttatacataaacag

SEQ ID NO: 5466791 - DNA, 11 bp, Homo sapiens
tttatacatag

SEQ ID NO: 5466792 - DNA, 21 bp, Homo sapiens
tttatacatagtcacaaaaat

SEQ ID NO: 5466793 - DNA, 15 bp, Homo sapiens
tttatacatatcaga

SEQ ID NO: 5466794 - DNA, 13 bp, Homo sapiens
tttatacattagt

SEQ ID NO: 5466795 - DNA, 16 bp, Homo sapiens
tttataccattcagat

SEQ ID NO: 5466796 - DNA, 22 bp, Homo sapiens
tttatacccttgacttaacttt

SEQ ID NO: 5466797 - DNA, 17 bp, Homo sapiens
tttatacctgtttaaat

SEQ ID NO: 5466798 - DNA, 14 bp, Homo sapiens
tttatacggaaaaa

SEQ ID NO: 5466799 - DNA, 13 bp, Homo sapiens
tttatactataaa

SEQ ID NO: 5466800 - DNA, 17 bp, Homo sapiens
tttatactctcttccct

SEQ ID NO: 5466801 - DNA, 18 bp, Homo sapiens
tttatactctttctgtat

SEQ ID NO: 5466802 - DNA, 14 bp, Homo sapiens
tttatactgaatat

SEQ ID NO: 5466803 - DNA, 15 bp, Homo sapiens
tttatactgcactta

SEQ ID NO: 5466804 - DNA, 16 bp, Homo sapiens
tttatactgcacttta

SEQ ID NO: 5466805 - DNA, 21 bp, Homo sapiens
tttatactgcactttagtgta

SEQ ID NO: 5466806 - DNA, 22 bp, Homo sapiens
tttatactgctctataaatagt

SEQ ID NO: 5466807 - DNA, 20 bp, Homo sapiens
tttatactgggtttcaagaa

SEQ ID NO: 5466808 - DNA, 16 bp, Homo sapiens
tttatactgtagcaat

SEQ ID NO: 5466809 - DNA, 18 bp, Homo sapiens
tttatactgtagcaatat

SEQ ID NO: 5466810 - DNA, 20 bp, Homo sapiens
tttatactgtatttctaaga

SEQ ID NO: 5466811 - DNA, 19 bp, Homo sapiens
tttatactgtgaagttaca

SEQ ID NO: 5466812 - DNA, 23 bp, Homo sapiens
tttatactgtgaagttacatgca

SEQ ID NO: 5466813 - DNA, 14 bp, Homo sapiens
tttatacttgggta

SEQ ID NO: 5466814 - DNA, 19 bp, Homo sapiens
tttatactttaaagtattt

SEQ ID NO: 5466815 - DNA, 22 bp, Homo sapiens
tttatactttgctgttgaagaa

SEQ ID NO: 5466816 - DNA, 22 bp, Homo sapiens
tttatagaaggaatttgtactt

SEQ ID NO: 5466817 - DNA, 17 bp, Homo sapiens
tttatagaatttaatat

SEQ ID NO: 5466818 - DNA, 22 bp, Homo sapiens
tttatagaatttaatatatata

SEQ ID NO: 5466819 - DNA, 16 bp, Homo sapiens
tttatagacattatgt

SEQ ID NO: 5466820 - DNA, 19 bp, Homo sapiens
tttatagagataagataaa

SEQ ID NO: 5466821 - DNA, 18 bp, Homo sapiens
tttatagagttcatagaa

SEQ ID NO: 5466822 - DNA, 14 bp, Homo sapiens
tttatagatcattt

SEQ ID NO: 5466823 - DNA, 22 bp, Homo sapiens
tttatagcaagatattgatcaa

SEQ ID NO: 5466824 - DNA, 17 bp, Homo sapiens
tttatagctattactgt

SEQ ID NO: 5466825 - DNA, 14 bp, Homo sapiens
tttatagctttatt

SEQ ID NO: 5466826 - DNA, 12 bp, Homo sapiens
tttataggaaaa

SEQ ID NO: 5466827 - DNA, 14 bp, Homo sapiens
tttataggataact

SEQ ID NO: 5466828 - DNA, 13 bp, Homo sapiens
tttataggcagat

SEQ ID NO: 5466829 - DNA, 20 bp, Homo sapiens
tttataggcagctgtcctgt

SEQ ID NO: 5466830 - DNA, 16 bp, Homo sapiens
tttatagggcttttat

SEQ ID NO: 5466831 - DNA, 15 bp, Homo sapiens
tttataggtgaaaga

SEQ ID NO: 5466832 - DNA, 18 bp, Homo sapiens
tttataggtgagaaaaaa

SEQ ID NO: 5466833 - DNA, 14 bp, Homo sapiens
tttataggttttat

SEQ ID NO: 5466834 - DNA, 22 bp, Homo sapiens
tttatagtagatttttaacaaa

SEQ ID NO: 5466835 - DNA, 18 bp, Homo sapiens
tttatagtatgtgacttt

SEQ ID NO: 5466836 - DNA, 19 bp, Homo sapiens
tttatagtgcacaaaatga

SEQ ID NO: 5466837 - DNA, 13 bp, Homo sapiens
tttatagtggaaa

SEQ ID NO: 5466838 - DNA, 18 bp, Homo sapiens
tttatagttaatctataa

SEQ ID NO: 5466839 - DNA, 16 bp, Homo sapiens
tttatagttgtatttt

SEQ ID NO: 5466840 - DNA, 17 bp, Homo sapiens
tttatataaagaaaatc

SEQ ID NO: 5466841 - DNA, 17 bp, Homo sapiens
tttatataaagtattct

SEQ ID NO: 5466842 - DNA, 22 bp, Homo sapiens
tttatataaataaatgtttcta

SEQ ID NO: 5466843 - DNA, 13 bp, Homo sapiens
tttatataactgt

SEQ ID NO: 5466844 - DNA, 13 bp, Homo sapiens
tttatataagctt

SEQ ID NO: 5466845 - DNA, 23 bp, Homo sapiens
tttatataaggtcatagattctt

SEQ ID NO: 5466846 - DNA, 22 bp, Homo sapiens
tttatataagtctgttatttat

SEQ ID NO: 5466847 - DNA, 20 bp, Homo sapiens
tttatataataaagtattcc

SEQ ID NO: 5466848 - DNA, 21 bp, Homo sapiens
tttatataatgcatgtattca

SEQ ID NO: 5466849 - DNA, 22 bp, Homo sapiens
tttatataatggtatgcttgca

SEQ ID NO: 5466850 - DNA, 19 bp, Homo sapiens
tttatataattatgttatt

SEQ ID NO: 5466851 - DNA, 19 bp, Homo sapiens
tttatatactttttcatga

SEQ ID NO: 5466852 - DNA, 15 bp, Homo sapiens
tttatatagaaacac

SEQ ID NO: 5466853 - DNA, 20 bp, Homo sapiens
tttatatagatgtcagcaat

SEQ ID NO: 5466854 - DNA, 18 bp, Homo sapiens
tttatatataaaataaat

SEQ ID NO: 5466855 - DNA, 23 bp, Homo sapiens
tttatatataaaataaatatact

SEQ ID NO: 5466856 - DNA, 15 bp, Homo sapiens
tttatatatacagta

SEQ ID NO: 5466857 - DNA, 21 bp, Homo sapiens
tttatatatacagtaacttta

SEQ ID NO: 5466858 - DNA, 22 bp, Homo sapiens
tttatatatctaagttcacagt

SEQ ID NO: 5466859 - DNA, 16 bp, Homo sapiens
tttatatatgaagttg

SEQ ID NO: 5466860 - DNA, 23 bp, Homo sapiens
tttatatatgaatattacatgta

SEQ ID NO: 5466861 - DNA, 14 bp, Homo sapiens
tttatatattatat

SEQ ID NO: 5466862 - DNA, 18 bp, Homo sapiens
tttatatattatgtgaag

SEQ ID NO: 5466863 - DNA, 20 bp, Homo sapiens
tttatatattatgtgaagaa

SEQ ID NO: 5466864 - DNA, 21 bp, Homo sapiens
tttatatattatgtgaagaat

SEQ ID NO: 5466865 - DNA, 14 bp, Homo sapiens
tttatatattgaaa

SEQ ID NO: 5466866 - DNA, 13 bp, Homo sapiens
tttatttttgtaa

SEQ ID NO: 5466867 - DNA, 23 bp, Homo sapiens
tttattttttaaaaaaacaaatg

SEQ ID NO: 5466868 - DNA, 16 bp, Homo sapiens
tttattttttaaatgt

SEQ ID NO: 5466869 - DNA, 17 bp, Homo sapiens
tttattttttaagtatt

SEQ ID NO: 5466870 - DNA, 15 bp, Homo sapiens
tttattttttataca

SEQ ID NO: 5466871 - DNA, 16 bp, Homo sapiens
tttattttttatacag

SEQ ID NO: 5466872 - DNA, 18 bp, Homo sapiens
tttattttttctacacag

SEQ ID NO: 5466873 - DNA, 17 bp, Homo sapiens
tttattttttcttctgt

SEQ ID NO: 5466874 - DNA, 16 bp, Homo sapiens
tttattttttgggaaa

SEQ ID NO: 5466875 - DNA, 17 bp, Homo sapiens
tttattttttgggccat

SEQ ID NO: 5466876 - DNA, 21 bp, Homo sapiens
tttattttttgggccattacc

SEQ ID NO: 5466877 - DNA, 18 bp, Homo sapiens
tttattttttgtaactct

SEQ ID NO: 5466878 - DNA, 16 bp, Homo sapiens
tttattttttgtgagt

SEQ ID NO: 5466879 - DNA, 17 bp, Homo sapiens
tttatttttttattctt

SEQ ID NO: 5466880 - DNA, 18 bp, Homo sapiens
tttatttttttcccatga

SEQ ID NO: 5466881 - DNA, 17 bp, Homo sapiens
tttatttttttctgaat

SEQ ID NO: 5466882 - DNA, 16 bp, Homo sapiens
tttattttttttctgt

SEQ ID NO: 5466883 - DNA, 15 bp, Homo sapiens
tttcaaaaaaataaa

SEQ ID NO: 5466884 - DNA, 13 bp, Homo sapiens
tttcaaaaaccag

SEQ ID NO: 5466885 - DNA, 17 bp, Homo sapiens
tttcaaaaaccagccag

SEQ ID NO: 5466886 - DNA, 13 bp, Homo sapiens
tttcaaaaataaa

SEQ ID NO: 5466887 - DNA, 16 bp, Homo sapiens
tttcaaaaatataact

SEQ ID NO: 5466888 - DNA, 12 bp, Homo sapiens
tttcaaaaatgc

SEQ ID NO: 5466889 - DNA, 13 bp, Homo sapiens
tttcaaaaatgct

SEQ ID NO: 5466890 - DNA, 12 bp, Homo sapiens
tttcaaaaccag

SEQ ID NO: 5466891 - DNA, 21 bp, Homo sapiens
tttcaaaaccaggtccaatga

SEQ ID NO: 5466892 - DNA, 21 bp, Homo sapiens
tttcaaaacggatccgggcaa

SEQ ID NO: 5466893 - DNA, 21 bp, Homo sapiens
tttcaaaagaagacatctgtg

SEQ ID NO: 5466894 - DNA, 13 bp, Homo sapiens
tttcaaaagacat

SEQ ID NO: 5466895 - DNA, 14 bp, Homo sapiens
tttcaaaagcaaac

SEQ ID NO: 5466896 - DNA, 21 bp, Homo sapiens
tttcaaaaggaagggtggctt

SEQ ID NO: 5466897 - DNA, 22 bp, Homo sapiens
tttcaaaaggaagggtggcttt

SEQ ID NO: 5466898 - DNA, 17 bp, Homo sapiens
tttcaaaaggtaatggt

SEQ ID NO: 5466899 - DNA, 13 bp, Homo sapiens
tttcaaaagtgga

SEQ ID NO: 5466900 - DNA, 23 bp, Homo sapiens
tttcaaaagtggattttcctgaa

SEQ ID NO: 5466901 - DNA, 18 bp, Homo sapiens
tttcaaaataaaatatca

SEQ ID NO: 5466902 - DNA, 19 bp, Homo sapiens
tttcaaaatacatttgtaa

SEQ ID NO: 5466903 - DNA, 21 bp, Homo sapiens
tttcaaaatagaaaagttatt

SEQ ID NO: 5466904 - DNA, 20 bp, Homo sapiens
tttcaaaatagacaagtttt

SEQ ID NO: 5466905 - DNA, 16 bp, Homo sapiens
tttcaaaatatgtgta

SEQ ID NO: 5466906 - DNA, 19 bp, Homo sapiens
tttcaaaatcagtttttca

SEQ ID NO: 5466907 - DNA, 21 bp, Homo sapiens
tttcaaaatcagtttttcata

SEQ ID NO: 5466908 - DNA, 13 bp, Homo sapiens
tttcaaaatgcat

SEQ ID NO: 5466909 - DNA, 19 bp, Homo sapiens
tttcaaaatgcatgtgatt

SEQ ID NO: 5466910 - DNA, 13 bp, Homo sapiens
tttcaaaatgctt

SEQ ID NO: 5466911 - DNA, 13 bp, Homo sapiens
tttcaaaattaat

SEQ ID NO: 5466912 - DNA, 14 bp, Homo sapiens
tttcaaaattaata

SEQ ID NO: 5466913 - DNA, 15 bp, Homo sapiens
tttcaaaattaatag

SEQ ID NO: 5466914 - DNA, 22 bp, Homo sapiens
tttcaaaattgttacaaattgt

SEQ ID NO: 5466915 - DNA, 19 bp, Homo sapiens
tttcaaacaatcaagttga

SEQ ID NO: 5466916 - DNA, 22 bp, Homo sapiens
tttcaaacaatcaagttgactc

SEQ ID NO: 5466917 - DNA, 19 bp, Homo sapiens
tttcaaacatatataacaa

SEQ ID NO: 5466918 - DNA, 15 bp, Homo sapiens
tttcaaaccagcttc

SEQ ID NO: 5466919 - DNA, 24 bp, Homo sapiens
tttcaaaccagtatacaagataag

SEQ ID NO: 5466920 - DNA, 22 bp, Homo sapiens
tttcaaactgagtaaattggaa

SEQ ID NO: 5466921 - DNA, 16 bp, Homo sapiens
tttcaaacttactatt

SEQ ID NO: 5466922 - DNA, 22 bp, Homo sapiens
tttcaaacttactattttgaca

SEQ ID NO: 5466923 - DNA, 16 bp, Homo sapiens
tttcaaagaaaacaga

SEQ ID NO: 5466924 - DNA, 22 bp, Homo sapiens
tttcaaagaaagactgtaagct

SEQ ID NO: 5466925 - DNA, 21 bp, Homo sapiens
tttcaaagaaatccaaatttc

SEQ ID NO: 5466926 - DNA, 13 bp, Homo sapiens
tttcaaagactgc

SEQ ID NO: 5466927 - DNA, 14 bp, Homo sapiens
tttcaaagcaattg

SEQ ID NO: 5466928 - DNA, 12 bp, Homo sapiens
tttcaaagcaca

SEQ ID NO: 5466929 - DNA, 13 bp, Homo sapiens
tttcaaagcactt

SEQ ID NO: 5466930 - DNA, 20 bp, Homo sapiens
tttcaaagcacttaagtgtt

SEQ ID NO: 5466931 - DNA, 17 bp, Homo sapiens
tttcaaagctttttcca

SEQ ID NO: 5466932 - DNA, 21 bp, Homo sapiens
tttcaaagtgatagaaaagtg

SEQ ID NO: 5466933 - DNA, 14 bp, Homo sapiens
tttcaaataaggaa

SEQ ID NO: 5466934 - DNA, 16 bp, Homo sapiens
tttcaaatatgtaaac

SEQ ID NO: 5466935 - DNA, 17 bp, Homo sapiens
tttcaaatatgtaaact

SEQ ID NO: 5466936 - DNA, 19 bp, Homo sapiens
tttcaaatatgtaaacttt

SEQ ID NO: 5466937 - DNA, 20 bp, Homo sapiens
tttcaaatatgtaaacttta

SEQ ID NO: 5466938 - DNA, 21 bp, Homo sapiens
tttcaaatatgtaaactttaa

SEQ ID NO: 5466939 - DNA, 19 bp, Homo sapiens
tttcaaatcaagaaaataa

SEQ ID NO: 5466940 - DNA, 21 bp, Homo sapiens
tttcaaatctgtaattaccat

SEQ ID NO: 5466941 - DNA, 23 bp, Homo sapiens
tttcaaatgagtttaaaaaaata

SEQ ID NO: 5466942 - DNA, 16 bp, Homo sapiens
tttcaaatgcagcaat

SEQ ID NO: 5466943 - DNA, 22 bp, Homo sapiens
tttcaaatgcagcaatcccact

SEQ ID NO: 5466944 - DNA, 23 bp, Homo sapiens
tttcaaatgcagtccagtgagaa

SEQ ID NO: 5466945 - DNA, 12 bp, Homo sapiens
tttcaaatgtgc

SEQ ID NO: 5466946 - DNA, 17 bp, Homo sapiens
tttcaaatgtgcaattt

SEQ ID NO: 5466947 - DNA, 18 bp, Homo sapiens
tttcaaattaatgttcca

SEQ ID NO: 5466948 - DNA, 19 bp, Homo sapiens
tttcaaattgcctttcttg

SEQ ID NO: 5466949 - DNA, 20 bp, Homo sapiens
tttcaaattgcctttcttga

SEQ ID NO: 5466950 - DNA, 21 bp, Homo sapiens
tttcaaattggactttcaaaa

SEQ ID NO: 5466951 - DNA, 14 bp, Homo sapiens
tttcaaattgtatc

SEQ ID NO: 5466952 - DNA, 21 bp, Homo sapiens
tttcaaatttagaaactaatt

SEQ ID NO: 5466953 - DNA, 13 bp, Homo sapiens
tttcaacaaattt

SEQ ID NO: 5466954 - DNA, 23 bp, Homo sapiens
tttcaacaagtagctaaagtctg

SEQ ID NO: 5466955 - DNA, 14 bp, Homo sapiens
tttcaacaattaga

SEQ ID NO: 5466956 - DNA, 23 bp, Homo sapiens
tttcaacagatgaccgtgtacaa

SEQ ID NO: 5466957 - DNA, 17 bp, Homo sapiens
tttcaacagtgaagaca

SEQ ID NO: 5466958 - DNA, 17 bp, Homo sapiens
tttcaacagtttcaaaa

SEQ ID NO: 5466959 - DNA, 22 bp, Homo sapiens
tttcaacataattatgggaaca

SEQ ID NO: 5466960 - DNA, 18 bp, Homo sapiens
tttcaacatgagtgtatt

SEQ ID NO: 5466961 - DNA, 16 bp, Homo sapiens
tttcaacatggataca

SEQ ID NO: 5466962 - DNA, 20 bp, Homo sapiens
tttcaaccaactatttttga

SEQ ID NO: 5466963 - DNA, 18 bp, Homo sapiens
tttcaaccagcattttac

SEQ ID NO: 5466964 - DNA, 21 bp, Homo sapiens
tttcaaccccaccctgtttgg

SEQ ID NO: 5466965 - DNA, 23 bp, Homo sapiens
tttcaaccccaccctgtttggat

SEQ ID NO: 5466966 - DNA, 14 bp, Homo sapiens
tttcaactccagaa

SEQ ID NO: 5466967 - DNA, 18 bp, Homo sapiens
tttcaactgctgtaaaat

SEQ ID NO: 5466968 - DNA, 15 bp, Homo sapiens
tttcaactgtttcag

SEQ ID NO: 5466969 - DNA, 15 bp, Homo sapiens
tttcaacttaaatca

SEQ ID NO: 5466970 - DNA, 13 bp, Homo sapiens
tttcaacttattt

SEQ ID NO: 5466971 - DNA, 16 bp, Homo sapiens
tttcaacttatttctg

SEQ ID NO: 5466972 - DNA, 17 bp, Homo sapiens
tttcaacttatttctga

SEQ ID NO: 5466973 - DNA, 12 bp, Homo sapiens
tttcaacttcaa

SEQ ID NO: 5466974 - DNA, 20 bp, Homo sapiens
tttcaacttggaaaaagaaa

SEQ ID NO: 5466975 - DNA, 13 bp, Homo sapiens
tttcaagaaaact

SEQ ID NO: 5466976 - DNA, 16 bp, Homo sapiens
tttcaagaaaactgga

SEQ ID NO: 5466977 - DNA, 17 bp, Homo sapiens
tttcaagaaaactggaa

SEQ ID NO: 5466978 - DNA, 15 bp, Homo sapiens
tttcaagaaaatctt

SEQ ID NO: 5466979 - DNA, 17 bp, Homo sapiens
tttcaagaaaatctttg

SEQ ID NO: 5466980 - DNA, 16 bp, Homo sapiens
tttcaagaacctggaa

SEQ ID NO: 5466981 - DNA, 13 bp, Homo sapiens
tttcaagaacttg

SEQ ID NO: 5466982 - DNA, 12 bp, Homo sapiens
tttcaagaatga

SEQ ID NO: 5466983 - DNA, 13 bp, Homo sapiens
tttcaagaatgtt

SEQ ID NO: 5466984 - DNA, 22 bp, Homo sapiens
tttcaagaatgtttcagttata

SEQ ID NO: 5466985 - DNA, 18 bp, Homo sapiens
tttcaagacccctgtctt

SEQ ID NO: 5466986 - DNA, 15 bp, Homo sapiens
tttcaagagaagaaa

SEQ ID NO: 5466987 - DNA, 20 bp, Homo sapiens
tttcaagagaagaaaaaatt

SEQ ID NO: 5466988 - DNA, 23 bp, Homo sapiens
tttcaagagaagaaaaaattaag

SEQ ID NO: 5466989 - DNA, 23 bp, Homo sapiens
tttcaagaggagcccccaccctg

SEQ ID NO: 5466990 - DNA, 19 bp, Homo sapiens
tttcaagatacatgttgta

SEQ ID NO: 5466991 - DNA, 15 bp, Homo sapiens
tttcaagatccaaat

SEQ ID NO: 5466992 - DNA, 22 bp, Homo sapiens
tttcaagatctaaatcatatat

SEQ ID NO: 5466993 - DNA, 17 bp, Homo sapiens
tttcaagattctaaagc

SEQ ID NO: 5466994 - DNA, 21 bp, Homo sapiens
tttcaagattgatcattttta

SEQ ID NO: 5466995 - DNA, 20 bp, Homo sapiens
tttcaagcacaacccaccac

SEQ ID NO: 5466996 - DNA, 20 bp, Homo sapiens
tttcaagcagcatcttctgg

SEQ ID NO: 5466997 - DNA, 14 bp, Homo sapiens
tttcaagcatctcc

SEQ ID NO: 5466998 - DNA, 16 bp, Homo sapiens
tttcaagcggtgccta

SEQ ID NO: 5466999 - DNA, 14 bp, Homo sapiens
tttcaagctgcact

SEQ ID NO: 5467000 - DNA, 18 bp, Homo sapiens
tttcaagcttattttgga

SEQ ID NO: 5467001 - DNA, 23 bp, Homo sapiens
tttcaaggaatggaatcttctcc

SEQ ID NO: 5467002 - DNA, 22 bp, Homo sapiens
tttcaaggcacattgaaatact

SEQ ID NO: 5467003 - DNA, 21 bp, Homo sapiens
tttcaaggcactctagattcc

SEQ ID NO: 5467004 - DNA, 22 bp, Homo sapiens
tttcaaggcactctagattcca

SEQ ID NO: 5467005 - DNA, 17 bp, Homo sapiens
tttcaaggccctcagca

SEQ ID NO: 5467006 - DNA, 19 bp, Homo sapiens
tttcaagggctttcctgtg

SEQ ID NO: 5467007 - DNA, 15 bp, Homo sapiens
tttcaagggttgctt

SEQ ID NO: 5467008 - DNA, 16 bp, Homo sapiens
tttcaaggttctaacc

SEQ ID NO: 5467009 - DNA, 18 bp, Homo sapiens
tttcaagtaataaaacaa

SEQ ID NO: 5467010 - DNA, 18 bp, Homo sapiens
tttcaagtacactgaatt

SEQ ID NO: 5467011 - DNA, 15 bp, Homo sapiens
tttcaagtatttaag

SEQ ID NO: 5467012 - DNA, 23 bp, Homo sapiens
tttcaagtcaaattaataatctt

SEQ ID NO: 5467013 - DNA, 21 bp, Homo sapiens
tttcaagtgaatctaaaagct

SEQ ID NO: 5467014 - DNA, 13 bp, Homo sapiens
tttcaagtgccta

SEQ ID NO: 5467015 - DNA, 17 bp, Homo sapiens
tttcaagtgttttcaca

SEQ ID NO: 5467016 - DNA, 18 bp, Homo sapiens
tttcaagttattcaaatt

SEQ ID NO: 5467017 - DNA, 22 bp, Homo sapiens
tttcaagttgcagtcagaagat

SEQ ID NO: 5467018 - DNA, 13 bp, Homo sapiens
tttcaagtttact

SEQ ID NO: 5467019 - DNA, 15 bp, Homo sapiens
tttcaagtttttcat

SEQ ID NO: 5467020 - DNA, 16 bp, Homo sapiens
tttcaagtttttcata

SEQ ID NO: 5467021 - DNA, 19 bp, Homo sapiens
tttcaagtttttcatactg

SEQ ID NO: 5467022 - DNA, 22 bp, Homo sapiens
tttcaataaagaaaaaaatagt

SEQ ID NO: 5467023 - DNA, 12 bp, Homo sapiens
tttcaataaagt

SEQ ID NO: 5467024 - DNA, 15 bp, Homo sapiens
tttcaataaagtttg

SEQ ID NO: 5467025 - DNA, 18 bp, Homo sapiens
tttcaataaagtttgatc

SEQ ID NO: 5467026 - DNA, 21 bp, Homo sapiens
tttcaataaagtttgatcttc

SEQ ID NO: 5467027 - DNA, 16 bp, Homo sapiens
tttcaataaatttctg

SEQ ID NO: 5467028 - DNA, 18 bp, Homo sapiens
tttcaataaatttctgct

SEQ ID NO: 5467029 - DNA, 18 bp, Homo sapiens
tttcaataacaaagcaca

SEQ ID NO: 5467030 - DNA, 22 bp, Homo sapiens
tttcaataagtgttgtaccata

SEQ ID NO: 5467031 - DNA, 17 bp, Homo sapiens
tttcaatactgtcccac

SEQ ID NO: 5467032 - DNA, 20 bp, Homo sapiens
tttcaatagcgtgtgtagat

SEQ ID NO: 5467033 - DNA, 18 bp, Homo sapiens
tttcaatatattgaactt

SEQ ID NO: 5467034 - DNA, 12 bp, Homo sapiens
tttcaatatcaa

SEQ ID NO: 5467035 - DNA, 13 bp, Homo sapiens
tttcaatatttgt

SEQ ID NO: 5467036 - DNA, 14 bp, Homo sapiens
tttcaatattttaa

SEQ ID NO: 5467037 - DNA, 22 bp, Homo sapiens
tttcaatcaactttactgtaat

SEQ ID NO: 5467038 - DNA, 14 bp, Homo sapiens
tttcaatcactgtc

SEQ ID NO: 5467039 - DNA, 21 bp, Homo sapiens
tttcaatcactgtcctccaca

SEQ ID NO: 5467040 - DNA, 15 bp, Homo sapiens
tttcaatccacagta

SEQ ID NO: 5467041 - DNA, 18 bp, Homo sapiens
tttcaatcgtaaaatttc

SEQ ID NO: 5467042 - DNA, 19 bp, Homo sapiens
tttcaatctcgtatagaag

SEQ ID NO: 5467043 - DNA, 13 bp, Homo sapiens
tttcattttactg

SEQ ID NO: 5467044 - DNA, 15 bp, Homo sapiens
tttcattttagacat

SEQ ID NO: 5467045 - DNA, 22 bp, Homo sapiens
tttcattttagtgtatctttaa

SEQ ID NO: 5467046 - DNA, 23 bp, Homo sapiens
tttcattttagtgtatctttaaa

SEQ ID NO: 5467047 - DNA, 11 bp, Homo sapiens
tttcattttca

SEQ ID NO: 5467048 - DNA, 17 bp, Homo sapiens
tttcattttcattaaaa

SEQ ID NO: 5467049 - DNA, 16 bp, Homo sapiens
tttcattttctctcag

SEQ ID NO: 5467050 - DNA, 16 bp, Homo sapiens
tttcattttgaaaagt

SEQ ID NO: 5467051 - DNA, 22 bp, Homo sapiens
tttcattttgtaacaaatgaac

SEQ ID NO: 5467052 - DNA, 17 bp, Homo sapiens
tttcatttttaaatgtg

SEQ ID NO: 5467053 - DNA, 20 bp, Homo sapiens
tttcatttttttccaggctg

SEQ ID NO: 5467054 - DNA, 20 bp, Homo sapiens
tttcatttttttctctctgg

SEQ ID NO: 5467055 - DNA, 17 bp, Homo sapiens
tttccaaaaaaatactg

SEQ ID NO: 5467056 - DNA, 18 bp, Homo sapiens
tttccaaaaacaaagtgc

SEQ ID NO: 5467057 - DNA, 21 bp, Homo sapiens
tttccaaaaacaaagtgcaaa

SEQ ID NO: 5467058 - DNA, 23 bp, Homo sapiens
tttccaaaaacaaagtgcaaagc

SEQ ID NO: 5467059 - DNA, 12 bp, Homo sapiens
tttccaaaacat

SEQ ID NO: 5467060 - DNA, 22 bp, Homo sapiens
tttccaaaacctcagttaaact

SEQ ID NO: 5467061 - DNA, 19 bp, Homo sapiens
tttccaaaataatctatat

SEQ ID NO: 5467062 - DNA, 15 bp, Homo sapiens
tttccaaagataatg

SEQ ID NO: 5467063 - DNA, 18 bp, Homo sapiens
tttccaaagctgaagatc

SEQ ID NO: 5467064 - DNA, 14 bp, Homo sapiens
tttccaaagtgcat

SEQ ID NO: 5467065 - DNA, 15 bp, Homo sapiens
tttccaaagtgcatg

SEQ ID NO: 5467066 - DNA, 15 bp, Homo sapiens
tttccaaataaaatg

SEQ ID NO: 5467067 - DNA, 22 bp, Homo sapiens
tttccaaatattctaaaaaaga

SEQ ID NO: 5467068 - DNA, 13 bp, Homo sapiens
tttccaaatgaac

SEQ ID NO: 5467069 - DNA, 23 bp, Homo sapiens
tttccaaatgatcctagtaattg

SEQ ID NO: 5467070 - DNA, 14 bp, Homo sapiens
tttccaaattaaaa

SEQ ID NO: 5467071 - DNA, 13 bp, Homo sapiens
tttccaaattatt

SEQ ID NO: 5467072 - DNA, 14 bp, Homo sapiens
tttccaacacacaa

SEQ ID NO: 5467073 - DNA, 18 bp, Homo sapiens
tttccaacaccacagaca

SEQ ID NO: 5467074 - DNA, 22 bp, Homo sapiens
tttccaacattatcctgtgtga

SEQ ID NO: 5467075 - DNA, 17 bp, Homo sapiens
tttccaacgtttggaag

SEQ ID NO: 5467076 - DNA, 12 bp, Homo sapiens
tttccaactact

SEQ ID NO: 5467077 - DNA, 17 bp, Homo sapiens
tttccaactggcactct

SEQ ID NO: 5467078 - DNA, 15 bp, Homo sapiens
tttccaacttgtctg

SEQ ID NO: 5467079 - DNA, 18 bp, Homo sapiens
tttccaacttgtctggga

SEQ ID NO: 5467080 - DNA, 14 bp, Homo sapiens
tttccaagaaattt

SEQ ID NO: 5467081 - DNA, 16 bp, Homo sapiens
tttccaagaggctgta

SEQ ID NO: 5467082 - DNA, 12 bp, Homo sapiens
tttccaagcaaa

SEQ ID NO: 5467083 - DNA, 14 bp, Homo sapiens
tttccaagcaaatg

SEQ ID NO: 5467084 - DNA, 18 bp, Homo sapiens
tttccaagcaaatgttac

SEQ ID NO: 5467085 - DNA, 20 bp, Homo sapiens
tttccaagcaaatgttacat

SEQ ID NO: 5467086 - DNA, 17 bp, Homo sapiens
tttccaagccctcagct

SEQ ID NO: 5467087 - DNA, 22 bp, Homo sapiens
tttccaaggagctgagaataga

SEQ ID NO: 5467088 - DNA, 15 bp, Homo sapiens
tttccaagtaaaata

SEQ ID NO: 5467089 - DNA, 15 bp, Homo sapiens
tttccaagtaagagt

SEQ ID NO: 5467090 - DNA, 14 bp, Homo sapiens
tttccaagtaatat

SEQ ID NO: 5467091 - DNA, 18 bp, Homo sapiens
tttccaagtaatataatg

SEQ ID NO: 5467092 - DNA, 15 bp, Homo sapiens
tttccaagtatttca

SEQ ID NO: 5467093 - DNA, 20 bp, Homo sapiens
tttccaagtcatttttgttt

SEQ ID NO: 5467094 - DNA, 16 bp, Homo sapiens
tttccaagtcctttaa

SEQ ID NO: 5467095 - DNA, 15 bp, Homo sapiens
tttccaagtgtataa

SEQ ID NO: 5467096 - DNA, 18 bp, Homo sapiens
tttccaagtgtataatgt

SEQ ID NO: 5467097 - DNA, 15 bp, Homo sapiens
tttccaatagaaaga

SEQ ID NO: 5467098 - DNA, 14 bp, Homo sapiens
tttccaatatgtga

SEQ ID NO: 5467099 - DNA, 15 bp, Homo sapiens
tttccaatatgtgat

SEQ ID NO: 5467100 - DNA, 17 bp, Homo sapiens
tttccaatattttaata

SEQ ID NO: 5467101 - DNA, 19 bp, Homo sapiens
tttccaatattttaataaa

SEQ ID NO: 5467102 - DNA, 22 bp, Homo sapiens
tttccaatgacattttgttgga

SEQ ID NO: 5467103 - DNA, 19 bp, Homo sapiens
tttccaatgcttcttataa

SEQ ID NO: 5467104 - DNA, 17 bp, Homo sapiens
tttccaatgttttattg

SEQ ID NO: 5467105 - DNA, 15 bp, Homo sapiens
tttccaattctcctt

SEQ ID NO: 5467106 - DNA, 22 bp, Homo sapiens
tttccacaagattcccagagac

SEQ ID NO: 5467107 - DNA, 15 bp, Homo sapiens
tttccacacagcctg

SEQ ID NO: 5467108 - DNA, 12 bp, Homo sapiens
tttccacaccat

SEQ ID NO: 5467109 - DNA, 17 bp, Homo sapiens
tttccacacctggcact

SEQ ID NO: 5467110 - DNA, 15 bp, Homo sapiens
tttccacactatgtg

SEQ ID NO: 5467111 - DNA, 13 bp, Homo sapiens
tttccacagattt

SEQ ID NO: 5467112 - DNA, 13 bp, Homo sapiens
tttccacatggca

SEQ ID NO: 5467113 - DNA, 17 bp, Homo sapiens
tttccacatttgtcaca

SEQ ID NO: 5467114 - DNA, 23 bp, Homo sapiens
tttccaccaagggtatctgctgc

SEQ ID NO: 5467115 - DNA, 23 bp, Homo sapiens
tttccaccacagccagcacctgg

SEQ ID NO: 5467116 - DNA, 19 bp, Homo sapiens
tttccaccaggccgtgcct

SEQ ID NO: 5467117 - DNA, 20 bp, Homo sapiens
tttccaccataccttagaga

SEQ ID NO: 5467118 - DNA, 12 bp, Homo sapiens
tttccacccaga

SEQ ID NO: 5467119 - DNA, 15 bp, Homo sapiens
tttccacccagaccc

SEQ ID NO: 5467120 - DNA, 22 bp, Homo sapiens
tttccaccttttgtttttccag

SEQ ID NO: 5467121 - DNA, 23 bp, Homo sapiens
tttccaccttttgtttttccagt

SEQ ID NO: 5467122 - DNA, 19 bp, Homo sapiens
tttccacgctgatgtttat

SEQ ID NO: 5467123 - DNA, 16 bp, Homo sapiens
tttccacggaaacaga

SEQ ID NO: 5467124 - DNA, 14 bp, Homo sapiens
tttccactactgct

SEQ ID NO: 5467125 - DNA, 15 bp, Homo sapiens
tttccactccaagat

SEQ ID NO: 5467126 - DNA, 18 bp, Homo sapiens
tttccactcctcctagcc

SEQ ID NO: 5467127 - DNA, 14 bp, Homo sapiens
tttccactctggat

SEQ ID NO: 5467128 - DNA, 20 bp, Homo sapiens
tttccactgaacaaaaccta

SEQ ID NO: 5467129 - DNA, 15 bp, Homo sapiens
tttccactgccaaaa

SEQ ID NO: 5467130 - DNA, 23 bp, Homo sapiens
tttccactggcttttgcctgtaa

SEQ ID NO: 5467131 - DNA, 16 bp, Homo sapiens
tttccactgtaattaa

SEQ ID NO: 5467132 - DNA, 16 bp, Homo sapiens
tttccacttctctggg

SEQ ID NO: 5467133 - DNA, 16 bp, Homo sapiens
tttccacttcttcctt

SEQ ID NO: 5467134 - DNA, 19 bp, Homo sapiens
tttccacttgccctgtgtt

SEQ ID NO: 5467135 - DNA, 15 bp, Homo sapiens
tttccacttgtgggc

SEQ ID NO: 5467136 - DNA, 16 bp, Homo sapiens
tttccacttttgttct

SEQ ID NO: 5467137 - DNA, 21 bp, Homo sapiens
tttccagaaaatataaatgca

SEQ ID NO: 5467138 - DNA, 23 bp, Homo sapiens
tttccagaaaatataaatgcatg

SEQ ID NO: 5467139 - DNA, 17 bp, Homo sapiens
tttccagaaattcttca

SEQ ID NO: 5467140 - DNA, 21 bp, Homo sapiens
tttccagaattgagagatgtt

SEQ ID NO: 5467141 - DNA, 18 bp, Homo sapiens
tttccagacttccttgag

SEQ ID NO: 5467142 - DNA, 12 bp, Homo sapiens
tttccagagcat

SEQ ID NO: 5467143 - DNA, 21 bp, Homo sapiens
tttccagattcttccactggc

SEQ ID NO: 5467144 - DNA, 17 bp, Homo sapiens
tttccagatttggggta

SEQ ID NO: 5467145 - DNA, 23 bp, Homo sapiens
tttccagcaaaatggaagcaaag

SEQ ID NO: 5467146 - DNA, 22 bp, Homo sapiens
tttccagcatttttataaacta

SEQ ID NO: 5467147 - DNA, 13 bp, Homo sapiens
tttccagcctatc

SEQ ID NO: 5467148 - DNA, 20 bp, Homo sapiens
tttccagctaagcctgatga

SEQ ID NO: 5467149 - DNA, 12 bp, Homo sapiens
tttccagctgcc

SEQ ID NO: 5467150 - DNA, 17 bp, Homo sapiens
tttccagcttgcattga

SEQ ID NO: 5467151 - DNA, 16 bp, Homo sapiens
tttccaggaaaaaata

SEQ ID NO: 5467152 - DNA, 21 bp, Homo sapiens
tttccaggaaaaaataaaaag

SEQ ID NO: 5467153 - DNA, 18 bp, Homo sapiens
tttccaggaaaaagaact

SEQ ID NO: 5467154 - DNA, 19 bp, Homo sapiens
tttccaggaaaaagaactt

SEQ ID NO: 5467155 - DNA, 18 bp, Homo sapiens
tttccaggactctttgaa

SEQ ID NO: 5467156 - DNA, 22 bp, Homo sapiens
tttccaggactgtttcaaacat

SEQ ID NO: 5467157 - DNA, 22 bp, Homo sapiens
tttccaggctatgtataaaata

SEQ ID NO: 5467158 - DNA, 23 bp, Homo sapiens
tttccaggctatgtataaaatac

SEQ ID NO: 5467159 - DNA, 11 bp, Homo sapiens
tttccagggag

SEQ ID NO: 5467160 - DNA, 23 bp, Homo sapiens
tttccagggcatccgcagcccag

SEQ ID NO: 5467161 - DNA, 16 bp, Homo sapiens
tttccaggtcagaaac

SEQ ID NO: 5467162 - DNA, 18 bp, Homo sapiens
tttccaggttctgaaaga

SEQ ID NO: 5467163 - DNA, 19 bp, Homo sapiens
tttccaggtttaagctgtt

SEQ ID NO: 5467164 - DNA, 15 bp, Homo sapiens
tttccagtattgaaa

SEQ ID NO: 5467165 - DNA, 20 bp, Homo sapiens
tttccagtattgaaaacttc

SEQ ID NO: 5467166 - DNA, 21 bp, Homo sapiens
tttccagtattgaaaacttca

SEQ ID NO: 5467167 - DNA, 14 bp, Homo sapiens
tttccagtctcttg

SEQ ID NO: 5467168 - DNA, 18 bp, Homo sapiens
tttccagtctcttgtaca

SEQ ID NO: 5467169 - DNA, 12 bp, Homo sapiens
tttccagtctgt

SEQ ID NO: 5467170 - DNA, 19 bp, Homo sapiens
tttccagtgagcttatcat

SEQ ID NO: 5467171 - DNA, 14 bp, Homo sapiens
tttccagtgctgct

SEQ ID NO: 5467172 - DNA, 15 bp, Homo sapiens
tttccagtgctgctc

SEQ ID NO: 5467173 - DNA, 23 bp, Homo sapiens
tttccagtggtcatgctcagcct

SEQ ID NO: 5467174 - DNA, 22 bp, Homo sapiens
tttccagttttttgccactgca

SEQ ID NO: 5467175 - DNA, 16 bp, Homo sapiens
tttccataagctattt

SEQ ID NO: 5467176 - DNA, 22 bp, Homo sapiens
tttccatacgtgcccatttcac

SEQ ID NO: 5467177 - DNA, 22 bp, Homo sapiens
tttccatagctactatatgcat

SEQ ID NO: 5467178 - DNA, 20 bp, Homo sapiens
tttccatagctcttcacttc

SEQ ID NO: 5467179 - DNA, 19 bp, Homo sapiens
tttccatagtgttaactgt

SEQ ID NO: 5467180 - DNA, 18 bp, Homo sapiens
tttccatatagtttgttt

SEQ ID NO: 5467181 - DNA, 12 bp, Homo sapiens
tttccatatatt

SEQ ID NO: 5467182 - DNA, 17 bp, Homo sapiens
tttccatatattggcac

SEQ ID NO: 5467183 - DNA, 17 bp, Homo sapiens
tttccatatttttacaa

SEQ ID NO: 5467184 - DNA, 21 bp, Homo sapiens
tttccatatttttttccttac

SEQ ID NO: 5467185 - DNA, 17 bp, Homo sapiens
tttccatcatctctttt

SEQ ID NO: 5467186 - DNA, 21 bp, Homo sapiens
tttccatcatctcttttccca

SEQ ID NO: 5467187 - DNA, 16 bp, Homo sapiens
tttccatcatgtctgt

SEQ ID NO: 5467188 - DNA, 14 bp, Homo sapiens
tttccatcatttta

SEQ ID NO: 5467189 - DNA, 19 bp, Homo sapiens
tttccatcattttacagtg

SEQ ID NO: 5467190 - DNA, 12 bp, Homo sapiens
tttccatccaaa

SEQ ID NO: 5467191 - DNA, 13 bp, Homo sapiens
tttccatccaaac

SEQ ID NO: 5467192 - DNA, 15 bp, Homo sapiens
tttccatccaaacct

SEQ ID NO: 5467193 - DNA, 13 bp, Homo sapiens
tttccatcccact

SEQ ID NO: 5467194 - DNA, 13 bp, Homo sapiens
tttccatctaaaa

SEQ ID NO: 5467195 - DNA, 12 bp, Homo sapiens
tttccatcttta

SEQ ID NO: 5467196 - DNA, 16 bp, Homo sapiens
tttccatgaaaacgtt

SEQ ID NO: 5467197 - DNA, 23 bp, Homo sapiens
tttccatgacagtagcatactga

SEQ ID NO: 5467198 - DNA, 22 bp, Homo sapiens
tttccatgacatttttcctctc

SEQ ID NO: 5467199 - DNA, 20 bp, Homo sapiens
tttccatgactgcattttac

SEQ ID NO: 5467200 - DNA, 17 bp, Homo sapiens
tttccatgatacaaaga

SEQ ID NO: 5467201 - DNA, 13 bp, Homo sapiens
tttccatgggaaa

SEQ ID NO: 5467202 - DNA, 20 bp, Homo sapiens
tttccatgtatgcataataa

SEQ ID NO: 5467203 - DNA, 17 bp, Homo sapiens
tttccatgttgctgcca

SEQ ID NO: 5467204 - DNA, 12 bp, Homo sapiens
tttccatgtttt

SEQ ID NO: 5467205 - DNA, 15 bp, Homo sapiens
tttccattaactatt

SEQ ID NO: 5467206 - DNA, 13 bp, Homo sapiens
tttccattccaga

SEQ ID NO: 5467207 - DNA, 14 bp, Homo sapiens
tttccattccagaa

SEQ ID NO: 5467208 - DNA, 22 bp, Homo sapiens
tttccattcgtgaaaacacatt

SEQ ID NO: 5467209 - DNA, 15 bp, Homo sapiens
tttccattctgcaga

SEQ ID NO: 5467210 - DNA, 18 bp, Homo sapiens
tttccattgaccagctct

SEQ ID NO: 5467211 - DNA, 20 bp, Homo sapiens
tttccattgaccagctctct

SEQ ID NO: 5467212 - DNA, 22 bp, Homo sapiens
tttccattgtgtggcctggtgg

SEQ ID NO: 5467213 - DNA, 22 bp, Homo sapiens
tttccatttattgtttgaaatg

SEQ ID NO: 5467214 - DNA, 13 bp, Homo sapiens
tttccatttattt

SEQ ID NO: 5467215 - DNA, 18 bp, Homo sapiens
tttccatttctgatgtct

SEQ ID NO: 5467216 - DNA, 18 bp, Homo sapiens
tttccatttcttcagagg

SEQ ID NO: 5467217 - DNA, 18 bp, Homo sapiens
tttccatttcttcctcac

SEQ ID NO: 5467218 - DNA, 14 bp, Homo sapiens
tttccatttgcatt

SEQ ID NO: 5467219 - DNA, 23 bp, Homo sapiens
tttccatttgggcacattttact

SEQ ID NO: 5467220 - DNA, 18 bp, Homo sapiens
tttccattttataaatgt

SEQ ID NO: 5467221 - DNA, 22 bp, Homo sapiens
tttctagctataacaactctat

SEQ ID NO: 5467222 - DNA, 14 bp, Homo sapiens
tttctaggaagaat

SEQ ID NO: 5467223 - DNA, 16 bp, Homo sapiens
tttctaggaagaattt

SEQ ID NO: 5467224 - DNA, 21 bp, Homo sapiens
tttctaggaagaattttaaaa

SEQ ID NO: 5467225 - DNA, 21 bp, Homo sapiens
tttctaggactgaattatgaa

SEQ ID NO: 5467226 - DNA, 15 bp, Homo sapiens
tttctagggaaatga

SEQ ID NO: 5467227 - DNA, 21 bp, Homo sapiens
tttctagtaacagtatttcca

SEQ ID NO: 5467228 - DNA, 20 bp, Homo sapiens
tttctagtacacttttatga

SEQ ID NO: 5467229 - DNA, 23 bp, Homo sapiens
tttctagtacctgtgactcttag

SEQ ID NO: 5467230 - DNA, 18 bp, Homo sapiens
tttctagtggtctttgta

SEQ ID NO: 5467231 - DNA, 21 bp, Homo sapiens
tttctagtggtctttgtaaga

SEQ ID NO: 5467232 - DNA, 23 bp, Homo sapiens
tttctagtggtctttgtaagagt

SEQ ID NO: 5467233 - DNA, 15 bp, Homo sapiens
tttctagtgtatact

SEQ ID NO: 5467234 - DNA, 13 bp, Homo sapiens
tttctagttgaaa

SEQ ID NO: 5467235 - DNA, 16 bp, Homo sapiens
tttctagttgtaatgt

SEQ ID NO: 5467236 - DNA, 16 bp, Homo sapiens
tttctagtttggcaca

SEQ ID NO: 5467237 - DNA, 13 bp, Homo sapiens
tttctagtttgtt

SEQ ID NO: 5467238 - DNA, 14 bp, Homo sapiens
tttctagtttgttt

SEQ ID NO: 5467239 - DNA, 20 bp, Homo sapiens
tttctagttttttttctagt

SEQ ID NO: 5467240 - DNA, 13 bp, Homo sapiens
tttctataaatca

SEQ ID NO: 5467241 - DNA, 13 bp, Homo sapiens
tttctataaatga

SEQ ID NO: 5467242 - DNA, 23 bp, Homo sapiens
tttctataattgtagtaattgct

SEQ ID NO: 5467243 - DNA, 13 bp, Homo sapiens
tttctatacagta

SEQ ID NO: 5467244 - DNA, 23 bp, Homo sapiens
tttctatacagtagcttgaaatt

SEQ ID NO: 5467245 - DNA, 17 bp, Homo sapiens
tttctatactgtttgta

SEQ ID NO: 5467246 - DNA, 13 bp, Homo sapiens
tttctatactttt

SEQ ID NO: 5467247 - DNA, 13 bp, Homo sapiens
tttctatagccaa

SEQ ID NO: 5467248 - DNA, 13 bp, Homo sapiens
tttctatagctct

SEQ ID NO: 5467249 - DNA, 23 bp, Homo sapiens
tttctatataaaatgtattcaag

SEQ ID NO: 5467250 - DNA, 23 bp, Homo sapiens
tttctatatgtaacttcagatgt

SEQ ID NO: 5467251 - DNA, 17 bp, Homo sapiens
tttctatatttgtaact

SEQ ID NO: 5467252 - DNA, 20 bp, Homo sapiens
tttctatcaaccttcaagta

SEQ ID NO: 5467253 - DNA, 17 bp, Homo sapiens
tttctatcccccttaaa

SEQ ID NO: 5467254 - DNA, 19 bp, Homo sapiens
tttctatcgttctctcttt

SEQ ID NO: 5467255 - DNA, 16 bp, Homo sapiens
tttctatctaaatgat

SEQ ID NO: 5467256 - DNA, 15 bp, Homo sapiens
tttctatctgcaaat

SEQ ID NO: 5467257 - DNA, 14 bp, Homo sapiens
tttctatgaaaatg

SEQ ID NO: 5467258 - DNA, 14 bp, Homo sapiens
tttctatgcaggca

SEQ ID NO: 5467259 - DNA, 21 bp, Homo sapiens
tttctatgctgagtttgtgct

SEQ ID NO: 5467260 - DNA, 17 bp, Homo sapiens
tttctatggcatattga

SEQ ID NO: 5467261 - DNA, 18 bp, Homo sapiens
tttctatggctttcaaag

SEQ ID NO: 5467262 - DNA, 23 bp, Homo sapiens
tttctatgggtgttatcacctag

SEQ ID NO: 5467263 - DNA, 15 bp, Homo sapiens
tttctatgtaaatta

SEQ ID NO: 5467264 - DNA, 19 bp, Homo sapiens
tttctatgtagaactgttc

SEQ ID NO: 5467265 - DNA, 21 bp, Homo sapiens
tttctatgtcatttttaatgt

SEQ ID NO: 5467266 - DNA, 20 bp, Homo sapiens
tttctatgtgttttttgcaa

SEQ ID NO: 5467267 - DNA, 16 bp, Homo sapiens
tttctattaaaagact

SEQ ID NO: 5467268 - DNA, 17 bp, Homo sapiens
tttctattaaaagactc

SEQ ID NO: 5467269 - DNA, 14 bp, Homo sapiens
tttctattaaaggt

SEQ ID NO: 5467270 - DNA, 20 bp, Homo sapiens
tttctattaatatcaactct

SEQ ID NO: 5467271 - DNA, 22 bp, Homo sapiens
tttctattaatatcaactctga

SEQ ID NO: 5467272 - DNA, 15 bp, Homo sapiens
tttctattaatcatt

SEQ ID NO: 5467273 - DNA, 13 bp, Homo sapiens
tttctattccaaa

SEQ ID NO: 5467274 - DNA, 22 bp, Homo sapiens
tttctattccttatgggatcat

SEQ ID NO: 5467275 - DNA, 14 bp, Homo sapiens
tttctattccttct

SEQ ID NO: 5467276 - DNA, 17 bp, Homo sapiens
tttctattgaaaaatca

SEQ ID NO: 5467277 - DNA, 20 bp, Homo sapiens
tttctatttagttatttaag

SEQ ID NO: 5467278 - DNA, 13 bp, Homo sapiens
tttctatttcata

SEQ ID NO: 5467279 - DNA, 14 bp, Homo sapiens
tttctatttcataa

SEQ ID NO: 5467280 - DNA, 19 bp, Homo sapiens
tttctattttaccactaat

SEQ ID NO: 5467281 - DNA, 14 bp, Homo sapiens
tttctattttctct

SEQ ID NO: 5467282 - DNA, 15 bp, Homo sapiens
tttctatttttatct

SEQ ID NO: 5467283 - DNA, 23 bp, Homo sapiens
tttctattttttataaatatcat

SEQ ID NO: 5467284 - DNA, 17 bp, Homo sapiens
tttctcaaaaagctgct

SEQ ID NO: 5467285 - DNA, 19 bp, Homo sapiens
tttctcaaaagcatttatc

SEQ ID NO: 5467286 - DNA, 22 bp, Homo sapiens
tttctcaaaagcatttatcatt

SEQ ID NO: 5467287 - DNA, 22 bp, Homo sapiens
tttctcaaagccccattaactg

SEQ ID NO: 5467288 - DNA, 14 bp, Homo sapiens
tttctcaaagtttt

SEQ ID NO: 5467289 - DNA, 23 bp, Homo sapiens
tttctcaaataaagttcaaagca

SEQ ID NO: 5467290 - DNA, 16 bp, Homo sapiens
tttctcaaatctgctt

SEQ ID NO: 5467291 - DNA, 13 bp, Homo sapiens
tttctcaaatctt

SEQ ID NO: 5467292 - DNA, 15 bp, Homo sapiens
tttctcaagtttaaa

SEQ ID NO: 5467293 - DNA, 15 bp, Homo sapiens
tttctcaatgcttag

SEQ ID NO: 5467294 - DNA, 18 bp, Homo sapiens
tttctcaatgtcttccca

SEQ ID NO: 5467295 - DNA, 18 bp, Homo sapiens
tttctcacagaagatgaa

SEQ ID NO: 5467296 - DNA, 12 bp, Homo sapiens
tttctcacatgt

SEQ ID NO: 5467297 - DNA, 17 bp, Homo sapiens
tttctcacccaggcaat

SEQ ID NO: 5467298 - DNA, 16 bp, Homo sapiens
tttctcactaaatctt

SEQ ID NO: 5467299 - DNA, 13 bp, Homo sapiens
tttctcactgaaa

SEQ ID NO: 5467300 - DNA, 20 bp, Homo sapiens
tttctcagaatccaaagatc

SEQ ID NO: 5467301 - DNA, 20 bp, Homo sapiens
tttctcagctcccatttcta

SEQ ID NO: 5467302 - DNA, 13 bp, Homo sapiens
tttctcagctgtg

SEQ ID NO: 5467303 - DNA, 22 bp, Homo sapiens
tttctcaggctaggccagcagg

SEQ ID NO: 5467304 - DNA, 17 bp, Homo sapiens
tttctcagggtcactgt

SEQ ID NO: 5467305 - DNA, 20 bp, Homo sapiens
tttctcataatgtgaaatat

SEQ ID NO: 5467306 - DNA, 13 bp, Homo sapiens
tttctcatctgta

SEQ ID NO: 5467307 - DNA, 20 bp, Homo sapiens
tttctcatgtgctttgtagc

SEQ ID NO: 5467308 - DNA, 21 bp, Homo sapiens
tttctcatgttccttttgaaa

SEQ ID NO: 5467309 - DNA, 16 bp, Homo sapiens
tttctcattcttgttt

SEQ ID NO: 5467310 - DNA, 22 bp, Homo sapiens
tttctcattgatcacagatgtg

SEQ ID NO: 5467311 - DNA, 15 bp, Homo sapiens
tttctcattgcctct

SEQ ID NO: 5467312 - DNA, 20 bp, Homo sapiens
tttctcattgcctcttctac

SEQ ID NO: 5467313 - DNA, 22 bp, Homo sapiens
tttctccaaataaaaattagat

SEQ ID NO: 5467314 - DNA, 15 bp, Homo sapiens
tttctccaagagcta

SEQ ID NO: 5467315 - DNA, 17 bp, Homo sapiens
tttctccaatatcagtg

SEQ ID NO: 5467316 - DNA, 13 bp, Homo sapiens
tttctccacactc

SEQ ID NO: 5467317 - DNA, 15 bp, Homo sapiens
tttctccacactcca

SEQ ID NO: 5467318 - DNA, 19 bp, Homo sapiens
tttctccacactccactga

SEQ ID NO: 5467319 - DNA, 23 bp, Homo sapiens
tttctccagcccatgctggctgg

SEQ ID NO: 5467320 - DNA, 21 bp, Homo sapiens
tttctccagctcagaacccag

SEQ ID NO: 5467321 - DNA, 15 bp, Homo sapiens
tttctccaggccctc

SEQ ID NO: 5467322 - DNA, 15 bp, Homo sapiens
tttctccagggtcag

SEQ ID NO: 5467323 - DNA, 20 bp, Homo sapiens
tttctccaggtttgctgtgt

SEQ ID NO: 5467324 - DNA, 16 bp, Homo sapiens
tttctccatcccctcc

SEQ ID NO: 5467325 - DNA, 16 bp, Homo sapiens
tttctccatggagttg

SEQ ID NO: 5467326 - DNA, 11 bp, Homo sapiens
tttctccatgt

SEQ ID NO: 5467327 - DNA, 15 bp, Homo sapiens
tttctccatgtctgt

SEQ ID NO: 5467328 - DNA, 16 bp, Homo sapiens
tttctccattaaactt

SEQ ID NO: 5467329 - DNA, 19 bp, Homo sapiens
tttctcccaagaaacctga

SEQ ID NO: 5467330 - DNA, 20 bp, Homo sapiens
tttctcccaggccaggctcc

SEQ ID NO: 5467331 - DNA, 18 bp, Homo sapiens
tttctcccagtatgtttt

SEQ ID NO: 5467332 - DNA, 23 bp, Homo sapiens
tttctcccagtatgttttaacaa

SEQ ID NO: 5467333 - DNA, 13 bp, Homo sapiens
tttctccccctgg

SEQ ID NO: 5467334 - DNA, 12 bp, Homo sapiens
tttctccccgct

SEQ ID NO: 5467335 - DNA, 14 bp, Homo sapiens
tttctcccctgccc

SEQ ID NO: 5467336 - DNA, 17 bp, Homo sapiens
tttctcccctgccccca

SEQ ID NO: 5467337 - DNA, 22 bp, Homo sapiens
tttctcccctgcccccaggact

SEQ ID NO: 5467338 - DNA, 15 bp, Homo sapiens
tttctccctcaccca

SEQ ID NO: 5467339 - DNA, 15 bp, Homo sapiens
tttctccctcacccc

SEQ ID NO: 5467340 - DNA, 22 bp, Homo sapiens
tttctccctctcactgtctgag

SEQ ID NO: 5467341 - DNA, 13 bp, Homo sapiens
tttctccctctgg

SEQ ID NO: 5467342 - DNA, 12 bp, Homo sapiens
tttctccctgga

SEQ ID NO: 5467343 - DNA, 15 bp, Homo sapiens
tttctccctgtccct

SEQ ID NO: 5467344 - DNA, 15 bp, Homo sapiens
tttctccctgttcct

SEQ ID NO: 5467345 - DNA, 19 bp, Homo sapiens
tttctccctttatgtatct

SEQ ID NO: 5467346 - DNA, 17 bp, Homo sapiens
tttctccgggtcctcct

SEQ ID NO: 5467347 - DNA, 14 bp, Homo sapiens
tttctccgttgtgg

SEQ ID NO: 5467348 - DNA, 15 bp, Homo sapiens
tttctcctcaggaca

SEQ ID NO: 5467349 - DNA, 17 bp, Homo sapiens
tttctcctcatccattt

SEQ ID NO: 5467350 - DNA, 20 bp, Homo sapiens
tttctcctcatccatttctt

SEQ ID NO: 5467351 - DNA, 14 bp, Homo sapiens
tttctcctccatgg

SEQ ID NO: 5467352 - DNA, 12 bp, Homo sapiens
tttctcctcccc

SEQ ID NO: 5467353 - DNA, 18 bp, Homo sapiens
tttctcctccccaaggac

SEQ ID NO: 5467354 - DNA, 16 bp, Homo sapiens
tttctcctcccttcct

SEQ ID NO: 5467355 - DNA, 20 bp, Homo sapiens
tttctcctctgctatgcatt

SEQ ID NO: 5467356 - DNA, 17 bp, Homo sapiens
tttctcctctgcttctt

SEQ ID NO: 5467357 - DNA, 21 bp, Homo sapiens
tttctcctctttgaacatggt

SEQ ID NO: 5467358 - DNA, 16 bp, Homo sapiens
tttctcctgcaaattt

SEQ ID NO: 5467359 - DNA, 20 bp, Homo sapiens
tttctcctgcatgtgtatat

SEQ ID NO: 5467360 - DNA, 22 bp, Homo sapiens
tttctcctgcatgtgtatatat

SEQ ID NO: 5467361 - DNA, 13 bp, Homo sapiens
tttctcctgcccc

SEQ ID NO: 5467362 - DNA, 12 bp, Homo sapiens
tttctcctgtga

SEQ ID NO: 5467363 - DNA, 14 bp, Homo sapiens
tttctcctgtgaat

SEQ ID NO: 5467364 - DNA, 20 bp, Homo sapiens
tttctcctgtggtttgctcc

SEQ ID NO: 5467365 - DNA, 21 bp, Homo sapiens
tttctcctgtttattcccatc

SEQ ID NO: 5467366 - DNA, 19 bp, Homo sapiens
tttctccttagtcttctca

SEQ ID NO: 5467367 - DNA, 14 bp, Homo sapiens
tttctccttcccaa

SEQ ID NO: 5467368 - DNA, 22 bp, Homo sapiens
tttctccttgaaatgagtaaaa

SEQ ID NO: 5467369 - DNA, 18 bp, Homo sapiens
tttctcctttaattgtaa

SEQ ID NO: 5467370 - DNA, 22 bp, Homo sapiens
tttctcctttaattgtaaagta

SEQ ID NO: 5467371 - DNA, 16 bp, Homo sapiens
tttctcctttgataaa

SEQ ID NO: 5467372 - DNA, 20 bp, Homo sapiens
tttctcctttgcaatagcag

SEQ ID NO: 5467373 - DNA, 14 bp, Homo sapiens
tttctccttttcct

SEQ ID NO: 5467374 - DNA, 16 bp, Homo sapiens
tttctccttttcctat

SEQ ID NO: 5467375 - DNA, 16 bp, Homo sapiens
tttctccttttgtgtt

SEQ ID NO: 5467376 - DNA, 19 bp, Homo sapiens
tttctccttttgtgttcca

SEQ ID NO: 5467377 - DNA, 15 bp, Homo sapiens
tttctcgacagatga

SEQ ID NO: 5467378 - DNA, 19 bp, Homo sapiens
tttctcgagtccaaaatca

SEQ ID NO: 5467379 - DNA, 22 bp, Homo sapiens
tttctcgctgtcctttctagag

SEQ ID NO: 5467380 - DNA, 20 bp, Homo sapiens
tttctcggtccactcttgtt

SEQ ID NO: 5467381 - DNA, 15 bp, Homo sapiens
tttctcgtccccctc

SEQ ID NO: 5467382 - DNA, 19 bp, Homo sapiens
tttctcgtccccctccctg

SEQ ID NO: 5467383 - DNA, 19 bp, Homo sapiens
tttctcgtgctgcatccct

SEQ ID NO: 5467384 - DNA, 15 bp, Homo sapiens
tttctcgttccagaa

SEQ ID NO: 5467385 - DNA, 13 bp, Homo sapiens
tttctctaaactg

SEQ ID NO: 5467386 - DNA, 15 bp, Homo sapiens
tttctctaataataa

SEQ ID NO: 5467387 - DNA, 21 bp, Homo sapiens
tttctctaataataaatagtt

SEQ ID NO: 5467388 - DNA, 15 bp, Homo sapiens
tttctctaatgcttg

SEQ ID NO: 5467389 - DNA, 23 bp, Homo sapiens
tttctctaatgttgtatcatact

SEQ ID NO: 5467390 - DNA, 19 bp, Homo sapiens
tttctctactttaaatttt

SEQ ID NO: 5467391 - DNA, 16 bp, Homo sapiens
tttctctagaagctgt

SEQ ID NO: 5467392 - DNA, 20 bp, Homo sapiens
tttctctagaagctgtctgc

SEQ ID NO: 5467393 - DNA, 19 bp, Homo sapiens
tttctctagctgatcagaa

SEQ ID NO: 5467394 - DNA, 23 bp, Homo sapiens
tttctctataaagggtcaggccc

SEQ ID NO: 5467395 - DNA, 13 bp, Homo sapiens
tttctctatgtac

SEQ ID NO: 5467396 - DNA, 22 bp, Homo sapiens
tttctctcaaatgatacagtca

SEQ ID NO: 5467397 - DNA, 14 bp, Homo sapiens
tttctctcagcata

SEQ ID NO: 5467398 - DNA, 20 bp, Homo sapiens
tttctctccagcctgacttg

SEQ ID NO: 5467399 - DNA, 23 bp, Homo sapiens
tttctttttttttttttttgaga

SEQ ID NO: 5467400 - DNA, 10 bp, Homo sapiens
tttgaaaaaa

SEQ ID NO: 5467401 - DNA, 14 bp, Homo sapiens
tttgaaaaaaagca

SEQ ID NO: 5467402 - DNA, 22 bp, Homo sapiens
tttgaaaaaaagtttctattta

SEQ ID NO: 5467403 - DNA, 13 bp, Homo sapiens
tttgaaaaaactt

SEQ ID NO: 5467404 - DNA, 23 bp, Homo sapiens
tttgaaaaaattaaaatctttct

SEQ ID NO: 5467405 - DNA, 20 bp, Homo sapiens
tttgaaaaagcagacagaag

SEQ ID NO: 5467406 - DNA, 23 bp, Homo sapiens
tttgaaaaagctggtctttgagc

SEQ ID NO: 5467407 - DNA, 13 bp, Homo sapiens
tttgaaaaagtta

SEQ ID NO: 5467408 - DNA, 12 bp, Homo sapiens
tttgaaaaatat

SEQ ID NO: 5467409 - DNA, 13 bp, Homo sapiens
tttgaaaaatatt

SEQ ID NO: 5467410 - DNA, 14 bp, Homo sapiens
tttgaaaacagaaa

SEQ ID NO: 5467411 - DNA, 15 bp, Homo sapiens
tttgaaaacatataa

SEQ ID NO: 5467412 - DNA, 18 bp, Homo sapiens
tttgaaaacgtttcaaag

SEQ ID NO: 5467413 - DNA, 23 bp, Homo sapiens
tttgaaaactacattttaacatg

SEQ ID NO: 5467414 - DNA, 14 bp, Homo sapiens
tttgaaaactgaca

SEQ ID NO: 5467415 - DNA, 21 bp, Homo sapiens
tttgaaaactgacatcagatt

SEQ ID NO: 5467416 - DNA, 22 bp, Homo sapiens
tttgaaaactgacatcagattt

SEQ ID NO: 5467417 - DNA, 13 bp, Homo sapiens
tttgaaaagaatt

SEQ ID NO: 5467418 - DNA, 23 bp, Homo sapiens
tttgaaaagcaatattgtatatt

SEQ ID NO: 5467419 - DNA, 13 bp, Homo sapiens
tttgaaaagctat

SEQ ID NO: 5467420 - DNA, 19 bp, Homo sapiens
tttgaaaagctattagcca

SEQ ID NO: 5467421 - DNA, 20 bp, Homo sapiens
tttgaaaaggcggtactagt

SEQ ID NO: 5467422 - DNA, 11 bp, Homo sapiens
tttgaaaagta

SEQ ID NO: 5467423 - DNA, 11 bp, Homo sapiens
tttgaaaatag

SEQ ID NO: 5467424 - DNA, 18 bp, Homo sapiens
tttgaaaatagttattca

SEQ ID NO: 5467425 - DNA, 15 bp, Homo sapiens
tttgaaaatatttct

SEQ ID NO: 5467426 - DNA, 16 bp, Homo sapiens
tttgaaaatgctctta

SEQ ID NO: 5467427 - DNA, 19 bp, Homo sapiens
tttgaaaatgtttttaagt

SEQ ID NO: 5467428 - DNA, 23 bp, Homo sapiens
tttgaaaattacatgttttttca

SEQ ID NO: 5467429 - DNA, 20 bp, Homo sapiens
tttgaaaattacctttaatg

SEQ ID NO: 5467430 - DNA, 18 bp, Homo sapiens
tttgaaaattatgcaaaa

SEQ ID NO: 5467431 - DNA, 24 bp, Homo sapiens
tttgaaaattatgcaaaagcagct

SEQ ID NO: 5467432 - DNA, 21 bp, Homo sapiens
tttgaaacacacagtgaccaa

SEQ ID NO: 5467433 - DNA, 23 bp, Homo sapiens
tttgaaacactggttttaaatat

SEQ ID NO: 5467434 - DNA, 14 bp, Homo sapiens
tttgaaacccacag

SEQ ID NO: 5467435 - DNA, 17 bp, Homo sapiens
tttgaaacccacagttt

SEQ ID NO: 5467436 - DNA, 22 bp, Homo sapiens
tttgaaacccctgtaggcctca

SEQ ID NO: 5467437 - DNA, 21 bp, Homo sapiens
tttgaaactaactcatagatt

SEQ ID NO: 5467438 - DNA, 17 bp, Homo sapiens
tttgaaactcgagacca

SEQ ID NO: 5467439 - DNA, 13 bp, Homo sapiens
tttgaaagaagca

SEQ ID NO: 5467440 - DNA, 18 bp, Homo sapiens
tttgaaagaagcaagaca

SEQ ID NO: 5467441 - DNA, 19 bp, Homo sapiens
tttgaaagaaggaagactt

SEQ ID NO: 5467442 - DNA, 20 bp, Homo sapiens
tttgaaagacagagtcttca

SEQ ID NO: 5467443 - DNA, 12 bp, Homo sapiens
tttgaaagcttt

SEQ ID NO: 5467444 - DNA, 17 bp, Homo sapiens
tttgaaaggaaaaacag

SEQ ID NO: 5467445 - DNA, 19 bp, Homo sapiens
tttgaaaggtcagaatttt

SEQ ID NO: 5467446 - DNA, 16 bp, Homo sapiens
tttgaaagtctgtcct

SEQ ID NO: 5467447 - DNA, 21 bp, Homo sapiens
tttgaaagtgaataaacttca

SEQ ID NO: 5467448 - DNA, 18 bp, Homo sapiens
tttgaaagtgcctttgca

SEQ ID NO: 5467449 - DNA, 22 bp, Homo sapiens
tttgaaagtgggtttcaattta

SEQ ID NO: 5467450 - DNA, 14 bp, Homo sapiens
tttgaaataagcta

SEQ ID NO: 5467451 - DNA, 15 bp, Homo sapiens
tttgaaatacctcat

SEQ ID NO: 5467452 - DNA, 18 bp, Homo sapiens
tttgaaatactaaaagca

SEQ ID NO: 5467453 - DNA, 19 bp, Homo sapiens
tttgaaatactaaaagcaa

SEQ ID NO: 5467454 - DNA, 19 bp, Homo sapiens
tttgaaatagattttttca

SEQ ID NO: 5467455 - DNA, 19 bp, Homo sapiens
tttgaaatagtctgtgtga

SEQ ID NO: 5467456 - DNA, 20 bp, Homo sapiens
tttgaaatagtctgtgtgaa

SEQ ID NO: 5467457 - DNA, 21 bp, Homo sapiens
tttgaaatagttcaaactgca

SEQ ID NO: 5467458 - DNA, 15 bp, Homo sapiens
tttgaaatataattt

SEQ ID NO: 5467459 - DNA, 15 bp, Homo sapiens
tttgaaatatgcatg

SEQ ID NO: 5467460 - DNA, 19 bp, Homo sapiens
tttgaaatatggaactgta

SEQ ID NO: 5467461 - DNA, 23 bp, Homo sapiens
tttgaaatatggaactgtaataa

SEQ ID NO: 5467462 - DNA, 14 bp, Homo sapiens
tttgaaatattgac

SEQ ID NO: 5467463 - DNA, 15 bp, Homo sapiens
tttgaaatcagtaaa

SEQ ID NO: 5467464 - DNA, 23 bp, Homo sapiens
tttgaaatgacatgttcctttaa

SEQ ID NO: 5467465 - DNA, 20 bp, Homo sapiens
tttgaaatgaggtctgttta

SEQ ID NO: 5467466 - DNA, 21 bp, Homo sapiens
tttgaaatgaggtctgtttaa

SEQ ID NO: 5467467 - DNA, 15 bp, Homo sapiens
tttgaaatgatatga

SEQ ID NO: 5467468 - DNA, 13 bp, Homo sapiens
tttgaaatggaaa

SEQ ID NO: 5467469 - DNA, 22 bp, Homo sapiens
tttgaaatgggcatttatttta

SEQ ID NO: 5467470 - DNA, 21 bp, Homo sapiens
tttgaaatgtcgatcaagaga

SEQ ID NO: 5467471 - DNA, 23 bp, Homo sapiens
tttgaaatgtggttttcctgaaa

SEQ ID NO: 5467472 - DNA, 23 bp, Homo sapiens
tttgaaatgtttaataaagcttt

SEQ ID NO: 5467473 - DNA, 15 bp, Homo sapiens
tttgaaattctgaat

SEQ ID NO: 5467474 - DNA, 16 bp, Homo sapiens
tttgaaattctgaatt

SEQ ID NO: 5467475 - DNA, 18 bp, Homo sapiens
tttgaaattctgaatttg

SEQ ID NO: 5467476 - DNA, 21 bp, Homo sapiens
tttgaaattgaacctttgtgc

SEQ ID NO: 5467477 - DNA, 22 bp, Homo sapiens
tttgaaattgttccttggagaa

SEQ ID NO: 5467478 - DNA, 17 bp, Homo sapiens
tttgaaattttatttag

SEQ ID NO: 5467479 - DNA, 16 bp, Homo sapiens
tttgaacaactcgaat

SEQ ID NO: 5467480 - DNA, 15 bp, Homo sapiens
tttgaacagggcaaa

SEQ ID NO: 5467481 - DNA, 21 bp, Homo sapiens
tttgaacagttggctgtatga

SEQ ID NO: 5467482 - DNA, 12 bp, Homo sapiens
tttgaacatctc

SEQ ID NO: 5467483 - DNA, 15 bp, Homo sapiens
tttgaacattaatgt

SEQ ID NO: 5467484 - DNA, 20 bp, Homo sapiens
tttgaacccccgccatcctt

SEQ ID NO: 5467485 - DNA, 23 bp, Homo sapiens
tttgaacctttttttttgaaaca

SEQ ID NO: 5467486 - DNA, 18 bp, Homo sapiens
tttgaacgcttaagtcat

SEQ ID NO: 5467487 - DNA, 19 bp, Homo sapiens
tttgaacgtgcttctttgt

SEQ ID NO: 5467488 - DNA, 17 bp, Homo sapiens
tttgaactaagaaactt

SEQ ID NO: 5467489 - DNA, 22 bp, Homo sapiens
tttgaactaagaaacttttgta

SEQ ID NO: 5467490 - DNA, 22 bp, Homo sapiens
tttgaactaatttcttagagaa

SEQ ID NO: 5467491 - DNA, 15 bp, Homo sapiens
tttgaactcagatct

SEQ ID NO: 5467492 - DNA, 18 bp, Homo sapiens
tttgaactccgctgcctt

SEQ ID NO: 5467493 - DNA, 22 bp, Homo sapiens
tttgaactccgctgccttcctt

SEQ ID NO: 5467494 - DNA, 17 bp, Homo sapiens
tttgaactcttctcatt

SEQ ID NO: 5467495 - DNA, 22 bp, Homo sapiens
tttgaactcttctcattacttg

SEQ ID NO: 5467496 - DNA, 17 bp, Homo sapiens
tttgaactgataaagat

SEQ ID NO: 5467497 - DNA, 19 bp, Homo sapiens
tttgaactggcaattgtct

SEQ ID NO: 5467498 - DNA, 13 bp, Homo sapiens
tttgaacttgtca

SEQ ID NO: 5467499 - DNA, 13 bp, Homo sapiens
tttgaactttcat

SEQ ID NO: 5467500 - DNA, 15 bp, Homo sapiens
tttgaactttggaac

SEQ ID NO: 5467501 - DNA, 12 bp, Homo sapiens
tttgaagaaaac

SEQ ID NO: 5467502 - DNA, 18 bp, Homo sapiens
tttgaagacacagcctcc

SEQ ID NO: 5467503 - DNA, 18 bp, Homo sapiens
tttgaagaccaatcaaat

SEQ ID NO: 5467504 - DNA, 20 bp, Homo sapiens
tttgaagaccaatcaaatat

SEQ ID NO: 5467505 - DNA, 23 bp, Homo sapiens
tttgaagacccgctacaaaacgc

SEQ ID NO: 5467506 - DNA, 20 bp, Homo sapiens
tttgaagacgtggactcctc

SEQ ID NO: 5467507 - DNA, 21 bp, Homo sapiens
tttgaagactgattttaaaac

SEQ ID NO: 5467508 - DNA, 15 bp, Homo sapiens
tttgaagaggaaaat

SEQ ID NO: 5467509 - DNA, 17 bp, Homo sapiens
tttgaagataataatct

SEQ ID NO: 5467510 - DNA, 20 bp, Homo sapiens
tttgaagatctgatttatac

SEQ ID NO: 5467511 - DNA, 17 bp, Homo sapiens
tttgaagatttaattac

SEQ ID NO: 5467512 - DNA, 12 bp, Homo sapiens
tttgaagcaact

SEQ ID NO: 5467513 - DNA, 12 bp, Homo sapiens
tttgaagcagct

SEQ ID NO: 5467514 - DNA, 13 bp, Homo sapiens
tttgaagcagctc

SEQ ID NO: 5467515 - DNA, 20 bp, Homo sapiens
tttgaagcatagctacaatt

SEQ ID NO: 5467516 - DNA, 21 bp, Homo sapiens
tttgaagcatagctacaattt

SEQ ID NO: 5467517 - DNA, 20 bp, Homo sapiens
tttgaagcatgctctgtaag

SEQ ID NO: 5467518 - DNA, 17 bp, Homo sapiens
tttgaagccttttgttt

SEQ ID NO: 5467519 - DNA, 19 bp, Homo sapiens
tttgaagctaattatttta

SEQ ID NO: 5467520 - DNA, 17 bp, Homo sapiens
tttgaagctcaactgtt

SEQ ID NO: 5467521 - DNA, 16 bp, Homo sapiens
tttgaagctcagaaag

SEQ ID NO: 5467522 - DNA, 18 bp, Homo sapiens
tttgaagctgaaaatata

SEQ ID NO: 5467523 - DNA, 13 bp, Homo sapiens
tttgaagctgctg

SEQ ID NO: 5467524 - DNA, 14 bp, Homo sapiens
tttgaagctgctgt

SEQ ID NO: 5467525 - DNA, 13 bp, Homo sapiens
tttgaaggaaaca

SEQ ID NO: 5467526 - DNA, 22 bp, Homo sapiens
tttgaaggaaatgagtggccag

SEQ ID NO: 5467527 - DNA, 15 bp, Homo sapiens
tttgaaggagaatgg

SEQ ID NO: 5467528 - DNA, 20 bp, Homo sapiens
tttgaagggagaagacactg

SEQ ID NO: 5467529 - DNA, 21 bp, Homo sapiens
tttgaagggagaagacactgc

SEQ ID NO: 5467530 - DNA, 21 bp, Homo sapiens
tttgaaggtagaatgttttca

SEQ ID NO: 5467531 - DNA, 18 bp, Homo sapiens
tttgaaggtagttgcaaa

SEQ ID NO: 5467532 - DNA, 15 bp, Homo sapiens
tttgaaggtgggaaa

SEQ ID NO: 5467533 - DNA, 20 bp, Homo sapiens
tttgaaggtttcagatgagg

SEQ ID NO: 5467534 - DNA, 18 bp, Homo sapiens
tttgaagtaaattaaaca

SEQ ID NO: 5467535 - DNA, 16 bp, Homo sapiens
tttgaagtacaattgt

SEQ ID NO: 5467536 - DNA, 23 bp, Homo sapiens
tttgaagtagtttgtataacttc

SEQ ID NO: 5467537 - DNA, 22 bp, Homo sapiens
tttgaagtccctgtttgggaat

SEQ ID NO: 5467538 - DNA, 14 bp, Homo sapiens
tttgaagtctgctc

SEQ ID NO: 5467539 - DNA, 15 bp, Homo sapiens
tttgaagtgcctctg

SEQ ID NO: 5467540 - DNA, 15 bp, Homo sapiens
tttgaagtgctgttt

SEQ ID NO: 5467541 - DNA, 20 bp, Homo sapiens
tttgaagtgtaggcagacac

SEQ ID NO: 5467542 - DNA, 22 bp, Homo sapiens
tttgaagtgtaggcagacacag

SEQ ID NO: 5467543 - DNA, 11 bp, Homo sapiens
tttgaagtgtt

SEQ ID NO: 5467544 - DNA, 20 bp, Homo sapiens
tttgaagttacaaacctgta

SEQ ID NO: 5467545 - DNA, 17 bp, Homo sapiens
tttgaagttagctttaa

SEQ ID NO: 5467546 - DNA, 23 bp, Homo sapiens
tttgaagttagctttaacttaaa

SEQ ID NO: 5467547 - DNA, 15 bp, Homo sapiens
tttgaagtttacatt

SEQ ID NO: 5467548 - DNA, 21 bp, Homo sapiens
tttgaataaaaagtgaacttt

SEQ ID NO: 5467549 - DNA, 22 bp, Homo sapiens
tttgaataaaaagtgaactttt

SEQ ID NO: 5467550 - DNA, 18 bp, Homo sapiens
tttgaataaagaatactt

SEQ ID NO: 5467551 - DNA, 13 bp, Homo sapiens
tttgaataaatgt

SEQ ID NO: 5467552 - DNA, 15 bp, Homo sapiens
tttgaataaatgtca

SEQ ID NO: 5467553 - DNA, 17 bp, Homo sapiens
tttgaataaattatgag

SEQ ID NO: 5467554 - DNA, 13 bp, Homo sapiens
tttgaataacata

SEQ ID NO: 5467555 - DNA, 21 bp, Homo sapiens
tttgaataatgacagatggtg

SEQ ID NO: 5467556 - DNA, 15 bp, Homo sapiens
tttgaataatgtagt

SEQ ID NO: 5467557 - DNA, 15 bp, Homo sapiens
tttgaatacccccag

SEQ ID NO: 5467558 - DNA, 19 bp, Homo sapiens
tttgaatagaggccaaatt

SEQ ID NO: 5467559 - DNA, 18 bp, Homo sapiens
tttgaatataaacactat

SEQ ID NO: 5467560 - DNA, 13 bp, Homo sapiens
tttgaatatcatt

SEQ ID NO: 5467561 - DNA, 19 bp, Homo sapiens
tttgaatattaagctaaaa

SEQ ID NO: 5467562 - DNA, 16 bp, Homo sapiens
tttgaatattactcct

SEQ ID NO: 5467563 - DNA, 16 bp, Homo sapiens
tttgaatattagcatt

SEQ ID NO: 5467564 - DNA, 19 bp, Homo sapiens
tttgaatcaataatatatt

SEQ ID NO: 5467565 - DNA, 18 bp, Homo sapiens
tttgaatcaatgtattaa

SEQ ID NO: 5467566 - DNA, 22 bp, Homo sapiens
tttgaatccaaatctgtcctct

SEQ ID NO: 5467567 - DNA, 21 bp, Homo sapiens
tttgaatcctggctctgattt

SEQ ID NO: 5467568 - DNA, 23 bp, Homo sapiens
tttgaatcgcttgcttgttgaaa

SEQ ID NO: 5467569 - DNA, 20 bp, Homo sapiens
tttgaatctcataatttata

SEQ ID NO: 5467570 - DNA, 19 bp, Homo sapiens
tttgaatctgagtgaattg

SEQ ID NO: 5467571 - DNA, 19 bp, Homo sapiens
tttgaatctttaattaaaa

SEQ ID NO: 5467572 - DNA, 21 bp, Homo sapiens
tttgaatgaaaaatttaagca

SEQ ID NO: 5467573 - DNA, 14 bp, Homo sapiens
tttgaatgaaaaca

SEQ ID NO: 5467574 - DNA, 17 bp, Homo sapiens
tttgaatgcagaagcaa

SEQ ID NO: 5467575 - DNA, 23 bp, Homo sapiens
tttgccccatgataaaataagta

SEQ ID NO: 5467576 - DNA, 23 bp, Homo sapiens
tttgcccccaaacccccattctg

SEQ ID NO: 5467577 - DNA, 14 bp, Homo sapiens
tttgccccttgagc

SEQ ID NO: 5467578 - DNA, 21 bp, Homo sapiens
tttgcccggggggaaaaagat

SEQ ID NO: 5467579 - DNA, 18 bp, Homo sapiens
tttgccctccctctctgc

SEQ ID NO: 5467580 - DNA, 13 bp, Homo sapiens
tttgccctgcctg

SEQ ID NO: 5467581 - DNA, 17 bp, Homo sapiens
tttgccctgctgccctc

SEQ ID NO: 5467582 - DNA, 23 bp, Homo sapiens
tttgccctgctgccctccccctc

SEQ ID NO: 5467583 - DNA, 22 bp, Homo sapiens
tttgccctggagcctcagcagc

SEQ ID NO: 5467584 - DNA, 21 bp, Homo sapiens
tttgccctggtagggcagtaa

SEQ ID NO: 5467585 - DNA, 15 bp, Homo sapiens
tttgcccttaaggac

SEQ ID NO: 5467586 - DNA, 19 bp, Homo sapiens
tttgcccttacctgtctct

SEQ ID NO: 5467587 - DNA, 15 bp, Homo sapiens
tttgcccttcactgt

SEQ ID NO: 5467588 - DNA, 19 bp, Homo sapiens
tttgcctaaatccaaagaa

SEQ ID NO: 5467589 - DNA, 16 bp, Homo sapiens
tttgcctaattcctgg

SEQ ID NO: 5467590 - DNA, 14 bp, Homo sapiens
tttgcctatcttta

SEQ ID NO: 5467591 - DNA, 16 bp, Homo sapiens
tttgcctatctttaaa

SEQ ID NO: 5467592 - DNA, 14 bp, Homo sapiens
tttgcctcaaataa

SEQ ID NO: 5467593 - DNA, 23 bp, Homo sapiens
tttgcctcaaataaaaagtgctt

SEQ ID NO: 5467594 - DNA, 20 bp, Homo sapiens
tttgcctcagtagatactaa

SEQ ID NO: 5467595 - DNA, 22 bp, Homo sapiens
tttgcctccagaagcactggga

SEQ ID NO: 5467596 - DNA, 11 bp, Homo sapiens
tttgcctcctg

SEQ ID NO: 5467597 - DNA, 13 bp, Homo sapiens
tttgcctctgcac

SEQ ID NO: 5467598 - DNA, 14 bp, Homo sapiens
tttgcctctgccca

SEQ ID NO: 5467599 - DNA, 13 bp, Homo sapiens
tttgcctctgcct

SEQ ID NO: 5467600 - DNA, 19 bp, Homo sapiens
tttgcctctgtcctcccat

SEQ ID NO: 5467601 - DNA, 16 bp, Homo sapiens
tttgcctcttctttgt

SEQ ID NO: 5467602 - DNA, 16 bp, Homo sapiens
tttgcctgaggctgta

SEQ ID NO: 5467603 - DNA, 18 bp, Homo sapiens
tttgcctgcaagagaatc

SEQ ID NO: 5467604 - DNA, 13 bp, Homo sapiens
tttgcctgctgta

SEQ ID NO: 5467605 - DNA, 18 bp, Homo sapiens
tttgcctgcttctttcca

SEQ ID NO: 5467606 - DNA, 18 bp, Homo sapiens
tttgcctgttaaatcgta

SEQ ID NO: 5467607 - DNA, 15 bp, Homo sapiens
tttgcctgttcagtt

SEQ ID NO: 5467608 - DNA, 22 bp, Homo sapiens
tttgcctgttcagttacagaaa

SEQ ID NO: 5467609 - DNA, 21 bp, Homo sapiens
tttgccttaggaagtgacttg

SEQ ID NO: 5467610 - DNA, 17 bp, Homo sapiens
tttgccttcctttctcc

SEQ ID NO: 5467611 - DNA, 22 bp, Homo sapiens
tttgccttcctttctccaggac

SEQ ID NO: 5467612 - DNA, 22 bp, Homo sapiens
tttgccttctactccccttaat

SEQ ID NO: 5467613 - DNA, 14 bp, Homo sapiens
tttgccttgcagaa

SEQ ID NO: 5467614 - DNA, 19 bp, Homo sapiens
tttgccttgggcctttcat

SEQ ID NO: 5467615 - DNA, 12 bp, Homo sapiens
tttgcctttaaa

SEQ ID NO: 5467616 - DNA, 17 bp, Homo sapiens
tttgcctttaggcagga

SEQ ID NO: 5467617 - DNA, 15 bp, Homo sapiens
tttgcctttctggga

SEQ ID NO: 5467618 - DNA, 20 bp, Homo sapiens
tttgccttttaaattctttt

SEQ ID NO: 5467619 - DNA, 17 bp, Homo sapiens
tttgcgatgtgttttat

SEQ ID NO: 5467620 - DNA, 21 bp, Homo sapiens
tttgcgcacaacttaaaaagt

SEQ ID NO: 5467621 - DNA, 22 bp, Homo sapiens
tttgcgcctcggtatctggctt

SEQ ID NO: 5467622 - DNA, 21 bp, Homo sapiens
tttgcgctcctggcccagcct

SEQ ID NO: 5467623 - DNA, 16 bp, Homo sapiens
tttgcgctctgggttt

SEQ ID NO: 5467624 - DNA, 22 bp, Homo sapiens
tttgcgcttatttggaaatttt

SEQ ID NO: 5467625 - DNA, 21 bp, Homo sapiens
tttgcggatgagggcatgtgc

SEQ ID NO: 5467626 - DNA, 22 bp, Homo sapiens
tttgcggccagtattagactgg

SEQ ID NO: 5467627 - DNA, 18 bp, Homo sapiens
tttgctaaaaaagcatat

SEQ ID NO: 5467628 - DNA, 12 bp, Homo sapiens
tttgctaaaaga

SEQ ID NO: 5467629 - DNA, 14 bp, Homo sapiens
tttgctaaagacat

SEQ ID NO: 5467630 - DNA, 15 bp, Homo sapiens
tttgctaaatgtgag

SEQ ID NO: 5467631 - DNA, 16 bp, Homo sapiens
tttgctaaatgtgagt

SEQ ID NO: 5467632 - DNA, 17 bp, Homo sapiens
tttgctaactggttaaa

SEQ ID NO: 5467633 - DNA, 23 bp, Homo sapiens
tttgctaagtaaatctcttctgt

SEQ ID NO: 5467634 - DNA, 19 bp, Homo sapiens
tttgctaagtgtatgatgt

SEQ ID NO: 5467635 - DNA, 14 bp, Homo sapiens
tttgctaatgaatt

SEQ ID NO: 5467636 - DNA, 16 bp, Homo sapiens
tttgctaatgaatttt

SEQ ID NO: 5467637 - DNA, 12 bp, Homo sapiens
tttgctaatgct

SEQ ID NO: 5467638 - DNA, 15 bp, Homo sapiens
tttgctacaataaat

SEQ ID NO: 5467639 - DNA, 14 bp, Homo sapiens
tttgctactaagtt

SEQ ID NO: 5467640 - DNA, 19 bp, Homo sapiens
tttgctagactctagacaa

SEQ ID NO: 5467641 - DNA, 13 bp, Homo sapiens
tttgctagttttt

SEQ ID NO: 5467642 - DNA, 15 bp, Homo sapiens
tttgctatgtaaggg

SEQ ID NO: 5467643 - DNA, 23 bp, Homo sapiens
tttgctattcccattgtgacagc

SEQ ID NO: 5467644 - DNA, 20 bp, Homo sapiens
tttgctattgacaagtcatt

SEQ ID NO: 5467645 - DNA, 14 bp, Homo sapiens
tttgctatttacaa

SEQ ID NO: 5467646 - DNA, 21 bp, Homo sapiens
tttgctatttacaaatgaagt

SEQ ID NO: 5467647 - DNA, 12 bp, Homo sapiens
tttgctcaacag

SEQ ID NO: 5467648 - DNA, 23 bp, Homo sapiens
tttgctcacacggggtattttag

SEQ ID NO: 5467649 - DNA, 16 bp, Homo sapiens
tttgctcacctggggt

SEQ ID NO: 5467650 - DNA, 15 bp, Homo sapiens
tttgctcagaggaat

SEQ ID NO: 5467651 - DNA, 14 bp, Homo sapiens
tttgctcagtgtcc

SEQ ID NO: 5467652 - DNA, 13 bp, Homo sapiens
tttgctcatattt

SEQ ID NO: 5467653 - DNA, 12 bp, Homo sapiens
tttgctcatgga

SEQ ID NO: 5467654 - DNA, 11 bp, Homo sapiens
tttgctcatgt

SEQ ID NO: 5467655 - DNA, 16 bp, Homo sapiens
tttgctcatgtaatgt

SEQ ID NO: 5467656 - DNA, 19 bp, Homo sapiens
tttgctccaccccactcac

SEQ ID NO: 5467657 - DNA, 13 bp, Homo sapiens
tttgctcccagtt

SEQ ID NO: 5467658 - DNA, 22 bp, Homo sapiens
tttgctccccttccccttcctt

SEQ ID NO: 5467659 - DNA, 13 bp, Homo sapiens
tttgctccttcag

SEQ ID NO: 5467660 - DNA, 18 bp, Homo sapiens
tttgctctagtcttgctt

SEQ ID NO: 5467661 - DNA, 19 bp, Homo sapiens
tttgctctcaaggcttgga

SEQ ID NO: 5467662 - DNA, 22 bp, Homo sapiens
tttgctctccctcccttctttc

SEQ ID NO: 5467663 - DNA, 21 bp, Homo sapiens
tttgctctgaccgattccttt

SEQ ID NO: 5467664 - DNA, 21 bp, Homo sapiens
tttgctctggaggaagttctc

SEQ ID NO: 5467665 - DNA, 14 bp, Homo sapiens
tttgctcttataaa

SEQ ID NO: 5467666 - DNA, 12 bp, Homo sapiens
tttgctcttgcc

SEQ ID NO: 5467667 - DNA, 19 bp, Homo sapiens
tttgctgaaaacattacat

SEQ ID NO: 5467668 - DNA, 22 bp, Homo sapiens
tttgctgaaagatatgtatatt

SEQ ID NO: 5467669 - DNA, 20 bp, Homo sapiens
tttgctgaataacaacaatt

SEQ ID NO: 5467670 - DNA, 18 bp, Homo sapiens
tttgctgaattcatctat

SEQ ID NO: 5467671 - DNA, 15 bp, Homo sapiens
tttgctgaattcctt

SEQ ID NO: 5467672 - DNA, 18 bp, Homo sapiens
tttgctgagttgttctaa

SEQ ID NO: 5467673 - DNA, 15 bp, Homo sapiens
tttgctgatttctag

SEQ ID NO: 5467674 - DNA, 13 bp, Homo sapiens
tttgctgcaaaga

SEQ ID NO: 5467675 - DNA, 18 bp, Homo sapiens
tttgctgcaaagagaaac

SEQ ID NO: 5467676 - DNA, 20 bp, Homo sapiens
tttgctgcacaaacatgaaa

SEQ ID NO: 5467677 - DNA, 13 bp, Homo sapiens
tttgctgcagaga

SEQ ID NO: 5467678 - DNA, 14 bp, Homo sapiens
tttgctgcatttta

SEQ ID NO: 5467679 - DNA, 10 bp, Homo sapiens
tttgctgcca

SEQ ID NO: 5467680 - DNA, 14 bp, Homo sapiens
tttgctgccccagc

SEQ ID NO: 5467681 - DNA, 19 bp, Homo sapiens
tttgctgccttctgtctct

SEQ ID NO: 5467682 - DNA, 14 bp, Homo sapiens
tttgctgctgataa

SEQ ID NO: 5467683 - DNA, 15 bp, Homo sapiens
tttgctgctgtggaa

SEQ ID NO: 5467684 - DNA, 23 bp, Homo sapiens
tttgctggagaagtgtgtttctt

SEQ ID NO: 5467685 - DNA, 20 bp, Homo sapiens
tttgctggagctctgcccat

SEQ ID NO: 5467686 - DNA, 19 bp, Homo sapiens
tttgctggagtcctgttct

SEQ ID NO: 5467687 - DNA, 20 bp, Homo sapiens
tttgctggagtctccagatg

SEQ ID NO: 5467688 - DNA, 17 bp, Homo sapiens
tttgctgggagaatttt

SEQ ID NO: 5467689 - DNA, 12 bp, Homo sapiens
tttgctggttat

SEQ ID NO: 5467690 - DNA, 22 bp, Homo sapiens
tttgctggttataacagcaaat

SEQ ID NO: 5467691 - DNA, 22 bp, Homo sapiens
tttgctgtaatgttaatattga

SEQ ID NO: 5467692 - DNA, 18 bp, Homo sapiens
tttgctgtagtgtttctt

SEQ ID NO: 5467693 - DNA, 18 bp, Homo sapiens
tttgctgtatatttgtga

SEQ ID NO: 5467694 - DNA, 13 bp, Homo sapiens
tttgctgtctttc

SEQ ID NO: 5467695 - DNA, 21 bp, Homo sapiens
tttgctgtctttctctaaata

SEQ ID NO: 5467696 - DNA, 17 bp, Homo sapiens
tttgctgtgaggctgtc

SEQ ID NO: 5467697 - DNA, 23 bp, Homo sapiens
tttgctgtgctgtacattactgt

SEQ ID NO: 5467698 - DNA, 12 bp, Homo sapiens
tttgctgtgctt

SEQ ID NO: 5467699 - DNA, 11 bp, Homo sapiens
tttgctgttcg

SEQ ID NO: 5467700 - DNA, 21 bp, Homo sapiens
tttgctgttgattcagacttt

SEQ ID NO: 5467701 - DNA, 12 bp, Homo sapiens
tttgcttaaaat

SEQ ID NO: 5467702 - DNA, 16 bp, Homo sapiens
tttgcttaaaatatgt

SEQ ID NO: 5467703 - DNA, 20 bp, Homo sapiens
tttgcttaaaatatgtgaag

SEQ ID NO: 5467704 - DNA, 21 bp, Homo sapiens
tttgcttaaactaatgaacaa

SEQ ID NO: 5467705 - DNA, 17 bp, Homo sapiens
tttgcttaacattagat

SEQ ID NO: 5467706 - DNA, 22 bp, Homo sapiens
tttgcttaacattagatgtcat

SEQ ID NO: 5467707 - DNA, 23 bp, Homo sapiens
tttgcttaatttccttctgttaa

SEQ ID NO: 5467708 - DNA, 23 bp, Homo sapiens
tttgcttaccaaaagctcagggc

SEQ ID NO: 5467709 - DNA, 23 bp, Homo sapiens
tttgcttaccttgttttgccagt

SEQ ID NO: 5467710 - DNA, 17 bp, Homo sapiens
tttgcttaccttttcct

SEQ ID NO: 5467711 - DNA, 18 bp, Homo sapiens
tttgcttaccttttccta

SEQ ID NO: 5467712 - DNA, 16 bp, Homo sapiens
tttgcttataaactgg

SEQ ID NO: 5467713 - DNA, 13 bp, Homo sapiens
tttgcttatttat

SEQ ID NO: 5467714 - DNA, 14 bp, Homo sapiens
tttgcttattttac

SEQ ID NO: 5467715 - DNA, 13 bp, Homo sapiens
tttgcttcataaa

SEQ ID NO: 5467716 - DNA, 12 bp, Homo sapiens
tttgcttcatag

SEQ ID NO: 5467717 - DNA, 20 bp, Homo sapiens
tttgcttcattgtactacct

SEQ ID NO: 5467718 - DNA, 18 bp, Homo sapiens
tttgcttcccctccagga

SEQ ID NO: 5467719 - DNA, 14 bp, Homo sapiens
tttgcttctagagc

SEQ ID NO: 5467720 - DNA, 16 bp, Homo sapiens
tttgcttctctctcta

SEQ ID NO: 5467721 - DNA, 20 bp, Homo sapiens
tttgcttctctttcccccac

SEQ ID NO: 5467722 - DNA, 17 bp, Homo sapiens
tttgcttcttatggtat

SEQ ID NO: 5467723 - DNA, 22 bp, Homo sapiens
tttgcttcttcccttaaaattt

SEQ ID NO: 5467724 - DNA, 14 bp, Homo sapiens
tttgcttgaacaca

SEQ ID NO: 5467725 - DNA, 15 bp, Homo sapiens
tttgcttgatccaga

SEQ ID NO: 5467726 - DNA, 16 bp, Homo sapiens
tttgcttgattaaaca

SEQ ID NO: 5467727 - DNA, 19 bp, Homo sapiens
tttgcttgcgtgctgggac

SEQ ID NO: 5467728 - DNA, 19 bp, Homo sapiens
tttgcttggaaattccttg

SEQ ID NO: 5467729 - DNA, 16 bp, Homo sapiens
tttgcttggcagagag

SEQ ID NO: 5467730 - DNA, 18 bp, Homo sapiens
tttgcttggtgctggttt

SEQ ID NO: 5467731 - DNA, 20 bp, Homo sapiens
tttgcttggtgctggtttat

SEQ ID NO: 5467732 - DNA, 18 bp, Homo sapiens
tttgctttaccttcctga

SEQ ID NO: 5467733 - DNA, 15 bp, Homo sapiens
tttgctttctcgtgg

SEQ ID NO: 5467734 - DNA, 13 bp, Homo sapiens
tttgctttctggt

SEQ ID NO: 5467735 - DNA, 18 bp, Homo sapiens
tttgctttcttgtctttt

SEQ ID NO: 5467736 - DNA, 15 bp, Homo sapiens
tttgctttgcccagc

SEQ ID NO: 5467737 - DNA, 17 bp, Homo sapiens
tttgctttgggattttc

SEQ ID NO: 5467738 - DNA, 18 bp, Homo sapiens
tttgctttgggattttct

SEQ ID NO: 5467739 - DNA, 20 bp, Homo sapiens
tttgctttgggtttgtggca

SEQ ID NO: 5467740 - DNA, 15 bp, Homo sapiens
tttgctttggtctgt

SEQ ID NO: 5467741 - DNA, 16 bp, Homo sapiens
tttgctttgtgatttt

SEQ ID NO: 5467742 - DNA, 14 bp, Homo sapiens
tttgctttgttata

SEQ ID NO: 5467743 - DNA, 16 bp, Homo sapiens
tttgcttttccctagt

SEQ ID NO: 5467744 - DNA, 14 bp, Homo sapiens
tttgctttttctga

SEQ ID NO: 5467745 - DNA, 14 bp, Homo sapiens
tttgctttttgcta

SEQ ID NO: 5467746 - DNA, 17 bp, Homo sapiens
tttggaaaaaactctga

SEQ ID NO: 5467747 - DNA, 18 bp, Homo sapiens
tttggaaaaaactctgaa

SEQ ID NO: 5467748 - DNA, 11 bp, Homo sapiens
tttggaaaaat

SEQ ID NO: 5467749 - DNA, 21 bp, Homo sapiens
tttggaaaaatgggtctttta

SEQ ID NO: 5467750 - DNA, 13 bp, Homo sapiens
tttggaaaaatgt

SEQ ID NO: 5467751 - DNA, 18 bp, Homo sapiens
tttggaaaagacagaaaa

SEQ ID NO: 5467752 - DNA, 21 bp, Homo sapiens
tttggaaaattcagataatgg

SEQ ID NO: 5467753 - DNA, 14 bp, Homo sapiens
tttggaaacaacat

SEQ ID NO: 5467754 - DNA, 15 bp, Homo sapiens
tttgtatgtataatt

SEQ ID NO: 5467755 - DNA, 13 bp, Homo sapiens
tttgtatgtatgt

SEQ ID NO: 5467756 - DNA, 16 bp, Homo sapiens
tttgtatgtcactatt

SEQ ID NO: 5467757 - DNA, 12 bp, Homo sapiens
tttgtatgtgtg

SEQ ID NO: 5467758 - DNA, 19 bp, Homo sapiens
tttgtatgtttagtagaaa

SEQ ID NO: 5467759 - DNA, 13 bp, Homo sapiens
tttgtattaacaa

SEQ ID NO: 5467760 - DNA, 16 bp, Homo sapiens
tttgtattaagaaagg

SEQ ID NO: 5467761 - DNA, 17 bp, Homo sapiens
tttgtattaataaagca

SEQ ID NO: 5467762 - DNA, 13 bp, Homo sapiens
tttgtattaccat

SEQ ID NO: 5467763 - DNA, 20 bp, Homo sapiens
tttgtattactttctctgta

SEQ ID NO: 5467764 - DNA, 22 bp, Homo sapiens
tttgtattactttctctgtagt

SEQ ID NO: 5467765 - DNA, 22 bp, Homo sapiens
tttgtattataattgttgatat

SEQ ID NO: 5467766 - DNA, 23 bp, Homo sapiens
tttgtattattgctgttgcttga

SEQ ID NO: 5467767 - DNA, 19 bp, Homo sapiens
tttgtattcaaatttgtgt

SEQ ID NO: 5467768 - DNA, 15 bp, Homo sapiens
tttgtattctctcct

SEQ ID NO: 5467769 - DNA, 16 bp, Homo sapiens
tttgtattctctgagc

SEQ ID NO: 5467770 - DNA, 16 bp, Homo sapiens
tttgtattctctgcaa

SEQ ID NO: 5467771 - DNA, 21 bp, Homo sapiens
tttgtattctttactaaagat

SEQ ID NO: 5467772 - DNA, 17 bp, Homo sapiens
tttgtattgagggccag

SEQ ID NO: 5467773 - DNA, 23 bp, Homo sapiens
tttgtattgtaaaaaattcacat

SEQ ID NO: 5467774 - DNA, 13 bp, Homo sapiens
tttgtattgtcct

SEQ ID NO: 5467775 - DNA, 22 bp, Homo sapiens
tttgtattgtcctattagtgtt

SEQ ID NO: 5467776 - DNA, 17 bp, Homo sapiens
tttgtattgtttctaca

SEQ ID NO: 5467777 - DNA, 14 bp, Homo sapiens
tttgtatttaatga

SEQ ID NO: 5467778 - DNA, 16 bp, Homo sapiens
tttgtatttattaatt

SEQ ID NO: 5467779 - DNA, 18 bp, Homo sapiens
tttgtatttattaatttg

SEQ ID NO: 5467780 - DNA, 11 bp, Homo sapiens
tttgtatttct

SEQ ID NO: 5467781 - DNA, 16 bp, Homo sapiens
tttgtatttcttttat

SEQ ID NO: 5467782 - DNA, 22 bp, Homo sapiens
tttgtattttacatgggccagt

SEQ ID NO: 5467783 - DNA, 16 bp, Homo sapiens
tttgtattttgtgtga

SEQ ID NO: 5467784 - DNA, 14 bp, Homo sapiens
tttgtatttttagt

SEQ ID NO: 5467785 - DNA, 16 bp, Homo sapiens
tttgtatttttagtag

SEQ ID NO: 5467786 - DNA, 14 bp, Homo sapiens
tttgtatttttgaa

SEQ ID NO: 5467787 - DNA, 18 bp, Homo sapiens
tttgtatttttgaataaa

SEQ ID NO: 5467788 - DNA, 19 bp, Homo sapiens
tttgtatttttttccaagt

SEQ ID NO: 5467789 - DNA, 21 bp, Homo sapiens
tttgtcaacagatttaaagaa

SEQ ID NO: 5467790 - DNA, 9 bp, Homo sapiens
tttgtcaag

SEQ ID NO: 5467791 - DNA, 19 bp, Homo sapiens
tttgtcaccctaacttcgt

SEQ ID NO: 5467792 - DNA, 17 bp, Homo sapiens
tttgtcacttatttcct

SEQ ID NO: 5467793 - DNA, 17 bp, Homo sapiens
tttgtcacttctgctgt

SEQ ID NO: 5467794 - DNA, 13 bp, Homo sapiens
tttgtcacttgcc

SEQ ID NO: 5467795 - DNA, 23 bp, Homo sapiens
tttgtcacttgccacatggtgtc

SEQ ID NO: 5467796 - DNA, 22 bp, Homo sapiens
tttgtcagaactagaatttgat

SEQ ID NO: 5467797 - DNA, 15 bp, Homo sapiens
tttgtcagacttcca

SEQ ID NO: 5467798 - DNA, 14 bp, Homo sapiens
tttgtcagacttta

SEQ ID NO: 5467799 - DNA, 18 bp, Homo sapiens
tttgtcagaggaacaaac

SEQ ID NO: 5467800 - DNA, 17 bp, Homo sapiens
tttgtcagattcacaca

SEQ ID NO: 5467801 - DNA, 21 bp, Homo sapiens
tttgtcagggagtgttcccta

SEQ ID NO: 5467802 - DNA, 19 bp, Homo sapiens
tttgtcagtctgagtcatc

SEQ ID NO: 5467803 - DNA, 20 bp, Homo sapiens
tttgtcatagttatgtgatt

SEQ ID NO: 5467804 - DNA, 17 bp, Homo sapiens
tttgtcatatattcatg

SEQ ID NO: 5467805 - DNA, 20 bp, Homo sapiens
tttgtcatatattcatgtaa

SEQ ID NO: 5467806 - DNA, 21 bp, Homo sapiens
tttgtcatatattcatgtaat

SEQ ID NO: 5467807 - DNA, 22 bp, Homo sapiens
tttgtcatcagatggaaatatt

SEQ ID NO: 5467808 - DNA, 18 bp, Homo sapiens
tttgtcatgacagtgctt

SEQ ID NO: 5467809 - DNA, 22 bp, Homo sapiens
tttgtcatgacagtgcttgcat

SEQ ID NO: 5467810 - DNA, 23 bp, Homo sapiens
tttgtcattcaagcctgtgaata

SEQ ID NO: 5467811 - DNA, 22 bp, Homo sapiens
tttgtcattcagttctaggcct

SEQ ID NO: 5467812 - DNA, 12 bp, Homo sapiens
tttgtcatttta

SEQ ID NO: 5467813 - DNA, 18 bp, Homo sapiens
tttgtcattttaaaatct

SEQ ID NO: 5467814 - DNA, 16 bp, Homo sapiens
tttgtcattttatgaa

SEQ ID NO: 5467815 - DNA, 18 bp, Homo sapiens
tttgtcattttatgaata

SEQ ID NO: 5467816 - DNA, 12 bp, Homo sapiens
tttgtcattttc

SEQ ID NO: 5467817 - DNA, 16 bp, Homo sapiens
tttgtccaaacaggtg

SEQ ID NO: 5467818 - DNA, 21 bp, Homo sapiens
tttgtccaaacaggtgctggc

SEQ ID NO: 5467819 - DNA, 22 bp, Homo sapiens
tttgtccaaacaggtgctggcc

SEQ ID NO: 5467820 - DNA, 15 bp, Homo sapiens
tttgtccaaataaat

SEQ ID NO: 5467821 - DNA, 20 bp, Homo sapiens
tttgtccaatggctgtaaac

SEQ ID NO: 5467822 - DNA, 15 bp, Homo sapiens
tttgtccacacaaga

SEQ ID NO: 5467823 - DNA, 23 bp, Homo sapiens
tttgtccaccttttaagttaatg

SEQ ID NO: 5467824 - DNA, 15 bp, Homo sapiens
tttgtccacttgtaa

SEQ ID NO: 5467825 - DNA, 20 bp, Homo sapiens
tttgtccattgtaaatctga

SEQ ID NO: 5467826 - DNA, 13 bp, Homo sapiens
tttgtccatttgt

SEQ ID NO: 5467827 - DNA, 19 bp, Homo sapiens
tttgtccattttaaaaacc

SEQ ID NO: 5467828 - DNA, 16 bp, Homo sapiens
tttgtcccaaaacaaa

SEQ ID NO: 5467829 - DNA, 19 bp, Homo sapiens
tttgtcccagaattttctg

SEQ ID NO: 5467830 - DNA, 17 bp, Homo sapiens
tttgtccccagggcccc

SEQ ID NO: 5467831 - DNA, 15 bp, Homo sapiens
tttgtcccccaactt

SEQ ID NO: 5467832 - DNA, 16 bp, Homo sapiens
tttgtcccccaacttg

SEQ ID NO: 5467833 - DNA, 12 bp, Homo sapiens
tttgtcccctca

SEQ ID NO: 5467834 - DNA, 14 bp, Homo sapiens
tttgtcccttgaaa

SEQ ID NO: 5467835 - DNA, 18 bp, Homo sapiens
tttgtcctcctgctgcca

SEQ ID NO: 5467836 - DNA, 13 bp, Homo sapiens
tttgtcctgaatg

SEQ ID NO: 5467837 - DNA, 17 bp, Homo sapiens
tttgtcctgactgtctg

SEQ ID NO: 5467838 - DNA, 20 bp, Homo sapiens
tttgtcctgactgtctgcta

SEQ ID NO: 5467839 - DNA, 19 bp, Homo sapiens
tttgtcctgatgcttttgt

SEQ ID NO: 5467840 - DNA, 18 bp, Homo sapiens
tttgtcctgcatcatctt

SEQ ID NO: 5467841 - DNA, 19 bp, Homo sapiens
tttgtccttgcacctgagc

SEQ ID NO: 5467842 - DNA, 16 bp, Homo sapiens
tttgtcctttatgtat

SEQ ID NO: 5467843 - DNA, 22 bp, Homo sapiens
tttgtcctttttcactttgaaa

SEQ ID NO: 5467844 - DNA, 16 bp, Homo sapiens
tttgtcgaatttttat

SEQ ID NO: 5467845 - DNA, 22 bp, Homo sapiens
tttgtcgagcatttcttctact

SEQ ID NO: 5467846 - DNA, 19 bp, Homo sapiens
tttgtcgctcatgtgtgca

SEQ ID NO: 5467847 - DNA, 17 bp, Homo sapiens
tttgtctacttgctcca

SEQ ID NO: 5467848 - DNA, 15 bp, Homo sapiens
tttgtctatgaagtt

SEQ ID NO: 5467849 - DNA, 22 bp, Homo sapiens
tttgtctcagaagtgaaaatct

SEQ ID NO: 5467850 - DNA, 18 bp, Homo sapiens
tttgtctcagttggaaat

SEQ ID NO: 5467851 - DNA, 19 bp, Homo sapiens
tttgtctcatcccattctg

SEQ ID NO: 5467852 - DNA, 18 bp, Homo sapiens
tttgtctccaaagaagat

SEQ ID NO: 5467853 - DNA, 22 bp, Homo sapiens
tttgtctccaaagaagatagct

SEQ ID NO: 5467854 - DNA, 22 bp, Homo sapiens
tttgtctcctactctgtgtaaa

SEQ ID NO: 5467855 - DNA, 17 bp, Homo sapiens
tttgtctcctttccact

SEQ ID NO: 5467856 - DNA, 18 bp, Homo sapiens
tttgtctctgagaagcat

SEQ ID NO: 5467857 - DNA, 19 bp, Homo sapiens
tttgtctcttagaaatact

SEQ ID NO: 5467858 - DNA, 14 bp, Homo sapiens
tttgtctctttgca

SEQ ID NO: 5467859 - DNA, 19 bp, Homo sapiens
tttgtctgccccaagtttt

SEQ ID NO: 5467860 - DNA, 13 bp, Homo sapiens
tttgtctggcctc

SEQ ID NO: 5467861 - DNA, 13 bp, Homo sapiens
tttgtctggttaa

SEQ ID NO: 5467862 - DNA, 13 bp, Homo sapiens
tttgtctgtcgtg

SEQ ID NO: 5467863 - DNA, 12 bp, Homo sapiens
tttgtctgtgtg

SEQ ID NO: 5467864 - DNA, 17 bp, Homo sapiens
tttgtctgtgtgctact

SEQ ID NO: 5467865 - DNA, 22 bp, Homo sapiens
tttgtcttaaaaaatgtgaaat

SEQ ID NO: 5467866 - DNA, 19 bp, Homo sapiens
tttgtcttatatatatttc

SEQ ID NO: 5467867 - DNA, 16 bp, Homo sapiens
tttgtcttgcattttt

SEQ ID NO: 5467868 - DNA, 15 bp, Homo sapiens
tttgtcttgtacttc

SEQ ID NO: 5467869 - DNA, 14 bp, Homo sapiens
tttgtctttaaaca

SEQ ID NO: 5467870 - DNA, 17 bp, Homo sapiens
tttgtctttctttgtca

SEQ ID NO: 5467871 - DNA, 19 bp, Homo sapiens
tttgtctttggtgaacatt

SEQ ID NO: 5467872 - DNA, 21 bp, Homo sapiens
tttgtcttttaatccatttca

SEQ ID NO: 5467873 - DNA, 18 bp, Homo sapiens
tttgtctttttcctactc

SEQ ID NO: 5467874 - DNA, 20 bp, Homo sapiens
tttgtgaaacagacttgtat

SEQ ID NO: 5467875 - DNA, 17 bp, Homo sapiens
tttgtgaaagtggcaag

SEQ ID NO: 5467876 - DNA, 20 bp, Homo sapiens
tttgtgaaagtggcaagctc

SEQ ID NO: 5467877 - DNA, 16 bp, Homo sapiens
tttgtgaaatcagtat

SEQ ID NO: 5467878 - DNA, 23 bp, Homo sapiens
tttgtgaaatcagtatcagaata

SEQ ID NO: 5467879 - DNA, 22 bp, Homo sapiens
tttgtgaaatgatggtgaaagt

SEQ ID NO: 5467880 - DNA, 17 bp, Homo sapiens
tttgtgaactgtcatga

SEQ ID NO: 5467881 - DNA, 17 bp, Homo sapiens
tttgtgaagcaaaattt

SEQ ID NO: 5467882 - DNA, 17 bp, Homo sapiens
tttgtgaagccctgttg

SEQ ID NO: 5467883 - DNA, 18 bp, Homo sapiens
tttgtgaaggtgatttat

SEQ ID NO: 5467884 - DNA, 20 bp, Homo sapiens
tttgtgaagtgattgacatt

SEQ ID NO: 5467885 - DNA, 18 bp, Homo sapiens
tttgtgaatagaactctg

SEQ ID NO: 5467886 - DNA, 16 bp, Homo sapiens
tttgtgaatccatctt

SEQ ID NO: 5467887 - DNA, 16 bp, Homo sapiens
tttgtgaatctttgtg

SEQ ID NO: 5467888 - DNA, 17 bp, Homo sapiens
tttgtgaatggattgga

SEQ ID NO: 5467889 - DNA, 15 bp, Homo sapiens
tttgtgaattaggct

SEQ ID NO: 5467890 - DNA, 22 bp, Homo sapiens
tttgtgaattaggctgtaacta

SEQ ID NO: 5467891 - DNA, 13 bp, Homo sapiens
tttgtgaatttgc

SEQ ID NO: 5467892 - DNA, 21 bp, Homo sapiens
tttgtgaatttgcaacagtaa

SEQ ID NO: 5467893 - DNA, 18 bp, Homo sapiens
tttgtgactaattgtata

SEQ ID NO: 5467894 - DNA, 20 bp, Homo sapiens
tttgtgactatatagagatg

SEQ ID NO: 5467895 - DNA, 17 bp, Homo sapiens
tttgtgacttcttcttc

SEQ ID NO: 5467896 - DNA, 15 bp, Homo sapiens
tttgtgactttttaa

SEQ ID NO: 5467897 - DNA, 20 bp, Homo sapiens
tttgtgagctttacttcttt

SEQ ID NO: 5467898 - DNA, 18 bp, Homo sapiens
tttgtgagtcaatacata

SEQ ID NO: 5467899 - DNA, 14 bp, Homo sapiens
tttgtgataattta

SEQ ID NO: 5467900 - DNA, 22 bp, Homo sapiens
tttgtgatatgcacaatgtaga

SEQ ID NO: 5467901 - DNA, 17 bp, Homo sapiens
tttgtgatcagcattgt

SEQ ID NO: 5467902 - DNA, 19 bp, Homo sapiens
tttgtgatcagcattgtga

SEQ ID NO: 5467903 - DNA, 17 bp, Homo sapiens
tttgtgatgaacatatt

SEQ ID NO: 5467904 - DNA, 14 bp, Homo sapiens
tttgtgatgatgct

SEQ ID NO: 5467905 - DNA, 14 bp, Homo sapiens
tttgtgatgcattt

SEQ ID NO: 5467906 - DNA, 18 bp, Homo sapiens
tttgtgatggagtgctgt

SEQ ID NO: 5467907 - DNA, 20 bp, Homo sapiens
tttgtgattcaatctgtaaa

SEQ ID NO: 5467908 - DNA, 16 bp, Homo sapiens
tttgtgattttacatt

SEQ ID NO: 5467909 - DNA, 15 bp, Homo sapiens
tttgtgcaaagccaa

SEQ ID NO: 5467910 - DNA, 11 bp, Homo sapiens
tttgtgcagaa

SEQ ID NO: 5467911 - DNA, 22 bp, Homo sapiens
tttgtgcattatctagatactg

SEQ ID NO: 5467912 - DNA, 15 bp, Homo sapiens
tttgtgcattttcta

SEQ ID NO: 5467913 - DNA, 21 bp, Homo sapiens
tttgtgccatgttcaaaagaa

SEQ ID NO: 5467914 - DNA, 22 bp, Homo sapiens
tttgtgccattatatttgcatt

SEQ ID NO: 5467915 - DNA, 23 bp, Homo sapiens
tttgtgccattatatttgcatta

SEQ ID NO: 5467916 - DNA, 15 bp, Homo sapiens
tttgtgcctttggcc

SEQ ID NO: 5467917 - DNA, 17 bp, Homo sapiens
tttgtgcctttggcctg

SEQ ID NO: 5467918 - DNA, 20 bp, Homo sapiens
tttgtgctagaaattttcaa

SEQ ID NO: 5467919 - DNA, 15 bp, Homo sapiens
tttgtgctctttcct

SEQ ID NO: 5467920 - DNA, 12 bp, Homo sapiens
tttgtgcttcta

SEQ ID NO: 5467921 - DNA, 15 bp, Homo sapiens
tttgtgcttgttctt

SEQ ID NO: 5467922 - DNA, 11 bp, Homo sapiens
tttgtgcttta

SEQ ID NO: 5467923 - DNA, 17 bp, Homo sapiens
tttgtgctttcctgaaa

SEQ ID NO: 5467924 - DNA, 15 bp, Homo sapiens
tttgtgctttgaaaa

SEQ ID NO: 5467925 - DNA, 17 bp, Homo sapiens
tttgtgcttttagtaaa

SEQ ID NO: 5467926 - DNA, 18 bp, Homo sapiens
tttgtgctttttgtcatg

SEQ ID NO: 5467927 - DNA, 19 bp, Homo sapiens
tttgtgctttttgtcatgt

SEQ ID NO: 5467928 - DNA, 14 bp, Homo sapiens
tttgtggaaacagc

SEQ ID NO: 5467929 - DNA, 21 bp, Homo sapiens
tttgtggacgagagggctgtg

SEQ ID NO: 5467930 - DNA, 16 bp, Homo sapiens
tttgtggaggactttg

SEQ ID NO: 5467931 - DNA, 16 bp, Homo sapiens
ttttaagtgcaacatt

SEQ ID NO: 5467932 - DNA, 23 bp, Homo sapiens
ttttaagtgcaacatttctgtat

SEQ ID NO: 5467933 - DNA, 16 bp, Homo sapiens
ttttaagtgctgcatt

SEQ ID NO: 5467934 - DNA, 19 bp, Homo sapiens
ttttaagtgctttgtaatg

SEQ ID NO: 5467935 - DNA, 19 bp, Homo sapiens
ttttaagtggactctctga

SEQ ID NO: 5467936 - DNA, 21 bp, Homo sapiens
ttttaagtggactctctgaca

SEQ ID NO: 5467937 - DNA, 18 bp, Homo sapiens
ttttaagtgggctcctga

SEQ ID NO: 5467938 - DNA, 18 bp, Homo sapiens
ttttaagttaatagattt

SEQ ID NO: 5467939 - DNA, 21 bp, Homo sapiens
ttttaagttacacatttttca

SEQ ID NO: 5467940 - DNA, 13 bp, Homo sapiens
ttttaagttctta

SEQ ID NO: 5467941 - DNA, 15 bp, Homo sapiens
ttttaagttgtcaaa

SEQ ID NO: 5467942 - DNA, 23 bp, Homo sapiens
ttttaagttgtcaaagaagcttc

SEQ ID NO: 5467943 - DNA, 18 bp, Homo sapiens
ttttaagttgtttgcatg

SEQ ID NO: 5467944 - DNA, 13 bp, Homo sapiens
ttttaagtttgca

SEQ ID NO: 5467945 - DNA, 16 bp, Homo sapiens
ttttaagtttgcactc

SEQ ID NO: 5467946 - DNA, 23 bp, Homo sapiens
ttttaataaaaatacacatgaaa

SEQ ID NO: 5467947 - DNA, 21 bp, Homo sapiens
ttttaataaaattgacaacat

SEQ ID NO: 5467948 - DNA, 15 bp, Homo sapiens
ttttaataaactttt

SEQ ID NO: 5467949 - DNA, 13 bp, Homo sapiens
ttttaataaagta

SEQ ID NO: 5467950 - DNA, 14 bp, Homo sapiens
ttttaataaatttc

SEQ ID NO: 5467951 - DNA, 18 bp, Homo sapiens
ttttaataaccacaaaca

SEQ ID NO: 5467952 - DNA, 13 bp, Homo sapiens
ttttaataagaac

SEQ ID NO: 5467953 - DNA, 19 bp, Homo sapiens
ttttaataccacagctatt

SEQ ID NO: 5467954 - DNA, 16 bp, Homo sapiens
ttttaatacctttaaa

SEQ ID NO: 5467955 - DNA, 12 bp, Homo sapiens
ttttaatagaac

SEQ ID NO: 5467956 - DNA, 21 bp, Homo sapiens
ttttaatagtcattccaaata

SEQ ID NO: 5467957 - DNA, 13 bp, Homo sapiens
ttttaatatacta

SEQ ID NO: 5467958 - DNA, 23 bp, Homo sapiens
ttttaatatactaaccatttctt

SEQ ID NO: 5467959 - DNA, 22 bp, Homo sapiens
ttttaatattaacttttaatgg

SEQ ID NO: 5467960 - DNA, 22 bp, Homo sapiens
ttttaatatttatgtttaagtg

SEQ ID NO: 5467961 - DNA, 23 bp, Homo sapiens
ttttaatcagcaatattgcctgt

SEQ ID NO: 5467962 - DNA, 20 bp, Homo sapiens
ttttaatcatgaaattactt

SEQ ID NO: 5467963 - DNA, 22 bp, Homo sapiens
ttttaatccatttcaggactct

SEQ ID NO: 5467964 - DNA, 14 bp, Homo sapiens
ttttaatcccctgc

SEQ ID NO: 5467965 - DNA, 18 bp, Homo sapiens
ttttaatccgccaatatt

SEQ ID NO: 5467966 - DNA, 19 bp, Homo sapiens
ttttaatccgccaatatta

SEQ ID NO: 5467967 - DNA, 23 bp, Homo sapiens
ttttaatcctgtaccaaatctga

SEQ ID NO: 5467968 - DNA, 22 bp, Homo sapiens
ttttaatcgtttttgttttaag

SEQ ID NO: 5467969 - DNA, 18 bp, Homo sapiens
ttttaatctactgcattt

SEQ ID NO: 5467970 - DNA, 14 bp, Homo sapiens
ttttaatcttagct

SEQ ID NO: 5467971 - DNA, 17 bp, Homo sapiens
ttttaatgaaatcaaat

SEQ ID NO: 5467972 - DNA, 18 bp, Homo sapiens
ttttaatgaaatcaaatg

SEQ ID NO: 5467973 - DNA, 13 bp, Homo sapiens
ttttaatgaactt

SEQ ID NO: 5467974 - DNA, 13 bp, Homo sapiens
ttttaatgaattt

SEQ ID NO: 5467975 - DNA, 21 bp, Homo sapiens
ttttaatgaatttaaggcaaa

SEQ ID NO: 5467976 - DNA, 14 bp, Homo sapiens
ttttaatgataaaa

SEQ ID NO: 5467977 - DNA, 22 bp, Homo sapiens
ttttaatgatactgtctaagaa

SEQ ID NO: 5467978 - DNA, 21 bp, Homo sapiens
ttttaatgctaatcttgtgaa

SEQ ID NO: 5467979 - DNA, 18 bp, Homo sapiens
ttttaatgctgtttctaa

SEQ ID NO: 5467980 - DNA, 21 bp, Homo sapiens
ttttaatgctgtttctaagaa

SEQ ID NO: 5467981 - DNA, 14 bp, Homo sapiens
ttttaatggaaacc

SEQ ID NO: 5467982 - DNA, 22 bp, Homo sapiens
ttttaatggcagcagaaaactt

SEQ ID NO: 5467983 - DNA, 22 bp, Homo sapiens
ttttaatgtaaaggttttctca

SEQ ID NO: 5467984 - DNA, 19 bp, Homo sapiens
ttttaatgtaattgattgt

SEQ ID NO: 5467985 - DNA, 22 bp, Homo sapiens
ttttaatgtatatttgctgcaa

SEQ ID NO: 5467986 - DNA, 19 bp, Homo sapiens
ttttaatgtatctatttgt

SEQ ID NO: 5467987 - DNA, 12 bp, Homo sapiens
ttttaatgtgaa

SEQ ID NO: 5467988 - DNA, 13 bp, Homo sapiens
ttttaatgtgaag

SEQ ID NO: 5467989 - DNA, 20 bp, Homo sapiens
ttttaatgtgaagacatttt

SEQ ID NO: 5467990 - DNA, 21 bp, Homo sapiens
ttttaatgtgagacagcaagt

SEQ ID NO: 5467991 - DNA, 17 bp, Homo sapiens
ttttaatgtgctctgta

SEQ ID NO: 5467992 - DNA, 20 bp, Homo sapiens
ttttaatgtgctctgtacct

SEQ ID NO: 5467993 - DNA, 20 bp, Homo sapiens
ttttaatgttaactttcaaa

SEQ ID NO: 5467994 - DNA, 16 bp, Homo sapiens
ttttaattaaaaacta

SEQ ID NO: 5467995 - DNA, 16 bp, Homo sapiens
ttttaattaagcagaa

SEQ ID NO: 5467996 - DNA, 15 bp, Homo sapiens
ttttaattacagaag

SEQ ID NO: 5467997 - DNA, 21 bp, Homo sapiens
ttttaattactgctataaata

SEQ ID NO: 5467998 - DNA, 14 bp, Homo sapiens
ttttaattattgtt

SEQ ID NO: 5467999 - DNA, 20 bp, Homo sapiens
ttttaattatttaaatgtac

SEQ ID NO: 5468000 - DNA, 20 bp, Homo sapiens
ttttaattcaggtgataact

SEQ ID NO: 5468001 - DNA, 19 bp, Homo sapiens
ttttaattccaatatgatg

SEQ ID NO: 5468002 - DNA, 14 bp, Homo sapiens
ttttaattctctgt

SEQ ID NO: 5468003 - DNA, 19 bp, Homo sapiens
ttttaattgaaactagtta

SEQ ID NO: 5468004 - DNA, 20 bp, Homo sapiens
ttttaattgcaacaatgcaa

SEQ ID NO: 5468005 - DNA, 12 bp, Homo sapiens
ttttaattgtca

SEQ ID NO: 5468006 - DNA, 22 bp, Homo sapiens
ttttaattgttcattgctagta

SEQ ID NO: 5468007 - DNA, 14 bp, Homo sapiens
ttttaattgtttaa

SEQ ID NO: 5468008 - DNA, 21 bp, Homo sapiens
ttttaatttaacaaactaaaa

SEQ ID NO: 5468009 - DNA, 17 bp, Homo sapiens
ttttaatttaacatgaa

SEQ ID NO: 5468010 - DNA, 21 bp, Homo sapiens
ttttaatttaatttttccttt

SEQ ID NO: 5468011 - DNA, 18 bp, Homo sapiens
ttttaatttagtaaatgt

SEQ ID NO: 5468012 - DNA, 23 bp, Homo sapiens
ttttaatttatgagtttttgata

SEQ ID NO: 5468013 - DNA, 12 bp, Homo sapiens
ttttaatttcca

SEQ ID NO: 5468014 - DNA, 14 bp, Homo sapiens
ttttaatttctaca

SEQ ID NO: 5468015 - DNA, 16 bp, Homo sapiens
ttttaatttgaatcag

SEQ ID NO: 5468016 - DNA, 21 bp, Homo sapiens
ttttaatttgaccagaaaata

SEQ ID NO: 5468017 - DNA, 13 bp, Homo sapiens
ttttaatttgata

SEQ ID NO: 5468018 - DNA, 17 bp, Homo sapiens
ttttaatttgatacaaa

SEQ ID NO: 5468019 - DNA, 20 bp, Homo sapiens
ttttaatttgatgaaagctg

SEQ ID NO: 5468020 - DNA, 20 bp, Homo sapiens
ttttaatttggtagatgaca

SEQ ID NO: 5468021 - DNA, 17 bp, Homo sapiens
ttttaatttggttttca

SEQ ID NO: 5468022 - DNA, 21 bp, Homo sapiens
ttttaatttggttttcacatt

SEQ ID NO: 5468023 - DNA, 17 bp, Homo sapiens
ttttaattttaaaatgt

SEQ ID NO: 5468024 - DNA, 21 bp, Homo sapiens
ttttaattttcacaaaatgtc

SEQ ID NO: 5468025 - DNA, 16 bp, Homo sapiens
ttttaattttcagttc

SEQ ID NO: 5468026 - DNA, 23 bp, Homo sapiens
ttttaattttcctctaattaaaa

SEQ ID NO: 5468027 - DNA, 23 bp, Homo sapiens
ttttaattttgatatacattgtg

SEQ ID NO: 5468028 - DNA, 21 bp, Homo sapiens
ttttaattttgtaaaggtgaa

SEQ ID NO: 5468029 - DNA, 22 bp, Homo sapiens
ttttaattttgtaaaggtgaaa

SEQ ID NO: 5468030 - DNA, 15 bp, Homo sapiens
ttttaattttgtatt

SEQ ID NO: 5468031 - DNA, 16 bp, Homo sapiens
ttttaattttgtattt

SEQ ID NO: 5468032 - DNA, 13 bp, Homo sapiens
ttttacaaaacat

SEQ ID NO: 5468033 - DNA, 16 bp, Homo sapiens
ttttacaaaactgctt

SEQ ID NO: 5468034 - DNA, 13 bp, Homo sapiens
ttttacaaagaaa

SEQ ID NO: 5468035 - DNA, 11 bp, Homo sapiens
ttttacaaagg

SEQ ID NO: 5468036 - DNA, 18 bp, Homo sapiens
ttttacaaaggctgtatt

SEQ ID NO: 5468037 - DNA, 12 bp, Homo sapiens
ttttacaaataa

SEQ ID NO: 5468038 - DNA, 14 bp, Homo sapiens
ttttacaaatgtta

SEQ ID NO: 5468039 - DNA, 15 bp, Homo sapiens
ttttacaaattaata

SEQ ID NO: 5468040 - DNA, 18 bp, Homo sapiens
ttttacaaattaatattt

SEQ ID NO: 5468041 - DNA, 20 bp, Homo sapiens
ttttacaaattcctttcaga

SEQ ID NO: 5468042 - DNA, 14 bp, Homo sapiens
ttttacaaattgtt

SEQ ID NO: 5468043 - DNA, 16 bp, Homo sapiens
ttttacaaatttaatt

SEQ ID NO: 5468044 - DNA, 13 bp, Homo sapiens
ttttacaagaagt

SEQ ID NO: 5468045 - DNA, 14 bp, Homo sapiens
ttttacaagaagta

SEQ ID NO: 5468046 - DNA, 17 bp, Homo sapiens
ttttacaagaagtttat

SEQ ID NO: 5468047 - DNA, 21 bp, Homo sapiens
ttttacaagagagtgaaattt

SEQ ID NO: 5468048 - DNA, 17 bp, Homo sapiens
ttttacaatctgtatct

SEQ ID NO: 5468049 - DNA, 14 bp, Homo sapiens
ttttacaatgattt

SEQ ID NO: 5468050 - DNA, 16 bp, Homo sapiens
ttttacaatgtaatta

SEQ ID NO: 5468051 - DNA, 16 bp, Homo sapiens
ttttacaattgaaatg

SEQ ID NO: 5468052 - DNA, 15 bp, Homo sapiens
ttttacacagaaaca

SEQ ID NO: 5468053 - DNA, 17 bp, Homo sapiens
ttttacacagaaacact

SEQ ID NO: 5468054 - DNA, 14 bp, Homo sapiens
ttttacacagagaa

SEQ ID NO: 5468055 - DNA, 23 bp, Homo sapiens
ttttacactaatatatggaccta

SEQ ID NO: 5468056 - DNA, 22 bp, Homo sapiens
ttttacactattgtgaatattt

SEQ ID NO: 5468057 - DNA, 17 bp, Homo sapiens
ttttacagagaatctga

SEQ ID NO: 5468058 - DNA, 23 bp, Homo sapiens
ttttacagagaggatacatttaa

SEQ ID NO: 5468059 - DNA, 20 bp, Homo sapiens
ttttacagagcttgaaaact

SEQ ID NO: 5468060 - DNA, 16 bp, Homo sapiens
ttttacagctacttta

SEQ ID NO: 5468061 - DNA, 19 bp, Homo sapiens
ttttacagctttacacaca

SEQ ID NO: 5468062 - DNA, 13 bp, Homo sapiens
ttttacagtatat

SEQ ID NO: 5468063 - DNA, 22 bp, Homo sapiens
ttttacagtatatcttaagata

SEQ ID NO: 5468064 - DNA, 17 bp, Homo sapiens
ttttacagtctctgttg

SEQ ID NO: 5468065 - DNA, 17 bp, Homo sapiens
ttttacagtgacctttt

SEQ ID NO: 5468066 - DNA, 16 bp, Homo sapiens
ttttacatactgctgt

SEQ ID NO: 5468067 - DNA, 18 bp, Homo sapiens
ttttacatacttttgcaa

SEQ ID NO: 5468068 - DNA, 20 bp, Homo sapiens
ttttacatacttttgcaaaa

SEQ ID NO: 5468069 - DNA, 11 bp, Homo sapiens
ttttacatgaa

SEQ ID NO: 5468070 - DNA, 15 bp, Homo sapiens
ttttacatgaagtat

SEQ ID NO: 5468071 - DNA, 18 bp, Homo sapiens
ttttacatgaagtatttt

SEQ ID NO: 5468072 - DNA, 23 bp, Homo sapiens
ttttacatgctggttacctgttc

SEQ ID NO: 5468073 - DNA, 9 bp, Homo sapiens
ttttacatt

SEQ ID NO: 5468074 - DNA, 13 bp, Homo sapiens
ttttacattaaat

SEQ ID NO: 5468075 - DNA, 12 bp, Homo sapiens
ttttacattaca

SEQ ID NO: 5468076 - DNA, 21 bp, Homo sapiens
ttttacattatgcaaataaaa

SEQ ID NO: 5468077 - DNA, 12 bp, Homo sapiens
ttttacatttca

SEQ ID NO: 5468078 - DNA, 11 bp, Homo sapiens
ttttaccaaag

SEQ ID NO: 5468079 - DNA, 14 bp, Homo sapiens
ttttaccaaagcat

SEQ ID NO: 5468080 - DNA, 20 bp, Homo sapiens
ttttaccaactctatactca

SEQ ID NO: 5468081 - DNA, 15 bp, Homo sapiens
ttttaccaagagtaa

SEQ ID NO: 5468082 - DNA, 17 bp, Homo sapiens
ttttaccaagagtaact

SEQ ID NO: 5468083 - DNA, 13 bp, Homo sapiens
ttttaccaagttt

SEQ ID NO: 5468084 - DNA, 14 bp, Homo sapiens
ttttaccaattcca

SEQ ID NO: 5468085 - DNA, 15 bp, Homo sapiens
ttttaccaattccaa

SEQ ID NO: 5468086 - DNA, 13 bp, Homo sapiens
ttttaccagctcc

SEQ ID NO: 5468087 - DNA, 15 bp, Homo sapiens
ttttaccagctttta

SEQ ID NO: 5468088 - DNA, 16 bp, Homo sapiens
ttttaccataatctta

SEQ ID NO: 5468089 - DNA, 15 bp, Homo sapiens
ttttaccattagcat

SEQ ID NO: 5468090 - DNA, 22 bp, Homo sapiens
ttttaccattttgcgatgtgtt

SEQ ID NO: 5468091 - DNA, 18 bp, Homo sapiens
ttttacccatatcccctc

SEQ ID NO: 5468092 - DNA, 18 bp, Homo sapiens
ttttaccgtttcttccct

SEQ ID NO: 5468093 - DNA, 18 bp, Homo sapiens
ttttacctaccacagtgt

SEQ ID NO: 5468094 - DNA, 15 bp, Homo sapiens
ttttacctctctctg

SEQ ID NO: 5468095 - DNA, 16 bp, Homo sapiens
ttttacctctctctgg

SEQ ID NO: 5468096 - DNA, 16 bp, Homo sapiens
ttttacgctagattaa

SEQ ID NO: 5468097 - DNA, 21 bp, Homo sapiens
ttttacgctagattaaaatat

SEQ ID NO: 5468098 - DNA, 14 bp, Homo sapiens
ttttacggaattcc

SEQ ID NO: 5468099 - DNA, 17 bp, Homo sapiens
ttttacggaattccaat

SEQ ID NO: 5468100 - DNA, 18 bp, Homo sapiens
ttttacggaattccaata

SEQ ID NO: 5468101 - DNA, 19 bp, Homo sapiens
ttttacgtccatctcttgt

SEQ ID NO: 5468102 - DNA, 23 bp, Homo sapiens
ttttacgtgcaaacaacctgaat

SEQ ID NO: 5468103 - DNA, 16 bp, Homo sapiens
ttttactaagatcaca

SEQ ID NO: 5468104 - DNA, 20 bp, Homo sapiens
ttttactaagttttcaaatt

SEQ ID NO: 5468105 - DNA, 16 bp, Homo sapiens
ttttactaatatatat

SEQ ID NO: 5468106 - DNA, 21 bp, Homo sapiens
ttttactaatatatattttaa

SEQ ID NO: 5468107 - DNA, 14 bp, Homo sapiens
ttttactactgtgg

SEQ ID NO: 5468108 - DNA, 18 bp, Homo sapiens
ttttactcaggctttcta

SEQ ID NO: 5468109 - DNA, 18 bp, Homo sapiens
ttttcaaaataaagcttt

SEQ ID NO: 5468110 - DNA, 21 bp, Homo sapiens
ttttcaaaataaagcttttgc

SEQ ID NO: 5468111 - DNA, 22 bp, Homo sapiens
ttttcaaaataaagcttttgca

SEQ ID NO: 5468112 - DNA, 18 bp, Homo sapiens
ttttcaaaatacttcttt

SEQ ID NO: 5468113 - DNA, 19 bp, Homo sapiens
ttttcaaaatagaaaagtt

SEQ ID NO: 5468114 - DNA, 20 bp, Homo sapiens
ttttcaaaatagaaaagtta

SEQ ID NO: 5468115 - DNA, 21 bp, Homo sapiens
ttttcaaaattgttacaaatt

SEQ ID NO: 5468116 - DNA, 15 bp, Homo sapiens
ttttcaaagacttca

SEQ ID NO: 5468117 - DNA, 13 bp, Homo sapiens
ttttcaaagcaat

SEQ ID NO: 5468118 - DNA, 17 bp, Homo sapiens
ttttcaaataataggta

SEQ ID NO: 5468119 - DNA, 15 bp, Homo sapiens
ttttcaaatagattt

SEQ ID NO: 5468120 - DNA, 15 bp, Homo sapiens
ttttcaaatattgaa

SEQ ID NO: 5468121 - DNA, 16 bp, Homo sapiens
ttttcaaatattgaat

SEQ ID NO: 5468122 - DNA, 13 bp, Homo sapiens
ttttcaaatcatt

SEQ ID NO: 5468123 - DNA, 21 bp, Homo sapiens
ttttcaaatcattccttagat

SEQ ID NO: 5468124 - DNA, 22 bp, Homo sapiens
ttttcaaatcatttttgagact

SEQ ID NO: 5468125 - DNA, 17 bp, Homo sapiens
ttttcaaatgcagcaat

SEQ ID NO: 5468126 - DNA, 15 bp, Homo sapiens
ttttcaaatgtcagc

SEQ ID NO: 5468127 - DNA, 19 bp, Homo sapiens
ttttcaaattgtatctagt

SEQ ID NO: 5468128 - DNA, 18 bp, Homo sapiens
ttttcaacaagcctgaaa

SEQ ID NO: 5468129 - DNA, 14 bp, Homo sapiens
ttttcaacaattag

SEQ ID NO: 5468130 - DNA, 22 bp, Homo sapiens
ttttcaacactgaaaaaatact

SEQ ID NO: 5468131 - DNA, 18 bp, Homo sapiens
ttttcaacagtgaagaca

SEQ ID NO: 5468132 - DNA, 23 bp, Homo sapiens
ttttcaaccagataacatacctt

SEQ ID NO: 5468133 - DNA, 16 bp, Homo sapiens
ttttcaaccagattta

SEQ ID NO: 5468134 - DNA, 16 bp, Homo sapiens
ttttcaaccagcattt

SEQ ID NO: 5468135 - DNA, 17 bp, Homo sapiens
ttttcaaccagcatttt

SEQ ID NO: 5468136 - DNA, 20 bp, Homo sapiens
ttttcaaccagcattttact

SEQ ID NO: 5468137 - DNA, 19 bp, Homo sapiens
ttttcaacctctagaattt

SEQ ID NO: 5468138 - DNA, 22 bp, Homo sapiens
ttttcaacgcagccctgctttg

SEQ ID NO: 5468139 - DNA, 13 bp, Homo sapiens
ttttcaactgcca

SEQ ID NO: 5468140 - DNA, 14 bp, Homo sapiens
ttttcaactggctg

SEQ ID NO: 5468141 - DNA, 15 bp, Homo sapiens
ttttcaacttggaaa

SEQ ID NO: 5468142 - DNA, 17 bp, Homo sapiens
ttttcaagaaaattttg

SEQ ID NO: 5468143 - DNA, 19 bp, Homo sapiens
ttttcaagaaaattttgca

SEQ ID NO: 5468144 - DNA, 21 bp, Homo sapiens
ttttcaagagaagaaaaaatt

SEQ ID NO: 5468145 - DNA, 13 bp, Homo sapiens
ttttcaagattga

SEQ ID NO: 5468146 - DNA, 23 bp, Homo sapiens
ttttcaagcaaaacagttctcag

SEQ ID NO: 5468147 - DNA, 14 bp, Homo sapiens
ttttcaagcaaagt

SEQ ID NO: 5468148 - DNA, 15 bp, Homo sapiens
ttttcaagcagcatc

SEQ ID NO: 5468149 - DNA, 18 bp, Homo sapiens
ttttcaagcatctcctga

SEQ ID NO: 5468150 - DNA, 19 bp, Homo sapiens
ttttcaaggaagaaaacgg

SEQ ID NO: 5468151 - DNA, 12 bp, Homo sapiens
ttttcaaggcat

SEQ ID NO: 5468152 - DNA, 14 bp, Homo sapiens
ttttcaaggcattt

SEQ ID NO: 5468153 - DNA, 16 bp, Homo sapiens
ttttcaaggccctcag

SEQ ID NO: 5468154 - DNA, 15 bp, Homo sapiens
ttttcaaggccttca

SEQ ID NO: 5468155 - DNA, 22 bp, Homo sapiens
ttttcaagtaattttcatatta

SEQ ID NO: 5468156 - DNA, 12 bp, Homo sapiens
ttttcaagtatt

SEQ ID NO: 5468157 - DNA, 17 bp, Homo sapiens
ttttcaagtatttaagc

SEQ ID NO: 5468158 - DNA, 20 bp, Homo sapiens
ttttcaagtatttaagccta

SEQ ID NO: 5468159 - DNA, 20 bp, Homo sapiens
ttttcaagttattcagaaat

SEQ ID NO: 5468160 - DNA, 18 bp, Homo sapiens
ttttcaagttgcagtcag

SEQ ID NO: 5468161 - DNA, 13 bp, Homo sapiens
ttttcaagttgta

SEQ ID NO: 5468162 - DNA, 12 bp, Homo sapiens
ttttcaataaat

SEQ ID NO: 5468163 - DNA, 18 bp, Homo sapiens
ttttcaataaatttctgc

SEQ ID NO: 5468164 - DNA, 19 bp, Homo sapiens
ttttcaataactggaacac

SEQ ID NO: 5468165 - DNA, 23 bp, Homo sapiens
ttttcaataactggaacactcta

SEQ ID NO: 5468166 - DNA, 17 bp, Homo sapiens
ttttcaatactgtccca

SEQ ID NO: 5468167 - DNA, 18 bp, Homo sapiens
ttttcaatatattgaact

SEQ ID NO: 5468168 - DNA, 13 bp, Homo sapiens
ttttcaatatgca

SEQ ID NO: 5468169 - DNA, 17 bp, Homo sapiens
ttttcaatatgcaagca

SEQ ID NO: 5468170 - DNA, 13 bp, Homo sapiens
ttttcaatcttct

SEQ ID NO: 5468171 - DNA, 21 bp, Homo sapiens
ttttcaatgaattaagaaaga

SEQ ID NO: 5468172 - DNA, 20 bp, Homo sapiens
ttttcaatgcaatgcatctg

SEQ ID NO: 5468173 - DNA, 14 bp, Homo sapiens
ttttcaattaaacg

SEQ ID NO: 5468174 - DNA, 22 bp, Homo sapiens
ttttcaattcaaaaatgtacaa

SEQ ID NO: 5468175 - DNA, 18 bp, Homo sapiens
ttttcaattttgcatgct

SEQ ID NO: 5468176 - DNA, 14 bp, Homo sapiens
ttttcacaaataaa

SEQ ID NO: 5468177 - DNA, 18 bp, Homo sapiens
ttttcacaacatatcaga

SEQ ID NO: 5468178 - DNA, 21 bp, Homo sapiens
ttttcacaatgtgaaactgaa

SEQ ID NO: 5468179 - DNA, 18 bp, Homo sapiens
ttttcacagcaacatttt

SEQ ID NO: 5468180 - DNA, 23 bp, Homo sapiens
ttttcacaggtgtggtgtaattt

SEQ ID NO: 5468181 - DNA, 20 bp, Homo sapiens
ttttcacagtatgggctaca

SEQ ID NO: 5468182 - DNA, 15 bp, Homo sapiens
ttttcacagttctct

SEQ ID NO: 5468183 - DNA, 15 bp, Homo sapiens
ttttcacataaatgc

SEQ ID NO: 5468184 - DNA, 16 bp, Homo sapiens
ttttcacatatctagt

SEQ ID NO: 5468185 - DNA, 13 bp, Homo sapiens
ttttcacatgaac

SEQ ID NO: 5468186 - DNA, 14 bp, Homo sapiens
ttttcacatgaaca

SEQ ID NO: 5468187 - DNA, 23 bp, Homo sapiens
ttttcacatgaacatactggctg

SEQ ID NO: 5468188 - DNA, 18 bp, Homo sapiens
ttttcacattcttataaa

SEQ ID NO: 5468189 - DNA, 11 bp, Homo sapiens
ttttcaccaat

SEQ ID NO: 5468190 - DNA, 18 bp, Homo sapiens
ttttcaccatctttctaa

SEQ ID NO: 5468191 - DNA, 20 bp, Homo sapiens
ttttcaccccacccttcccc

SEQ ID NO: 5468192 - DNA, 17 bp, Homo sapiens
ttttcacccttctactc

SEQ ID NO: 5468193 - DNA, 18 bp, Homo sapiens
ttttcaccgagcagaggt

SEQ ID NO: 5468194 - DNA, 15 bp, Homo sapiens
ttttcacctgaaatg

SEQ ID NO: 5468195 - DNA, 15 bp, Homo sapiens
ttttcacggaagttt

SEQ ID NO: 5468196 - DNA, 14 bp, Homo sapiens
ttttcactaaaagt

SEQ ID NO: 5468197 - DNA, 21 bp, Homo sapiens
ttttcactctaagtcatgtat

SEQ ID NO: 5468198 - DNA, 20 bp, Homo sapiens
ttttcactgctggctgcctt

SEQ ID NO: 5468199 - DNA, 21 bp, Homo sapiens
ttttcactggcataaatctga

SEQ ID NO: 5468200 - DNA, 13 bp, Homo sapiens
ttttcacttctgt

SEQ ID NO: 5468201 - DNA, 15 bp, Homo sapiens
ttttcacttgtctcc

SEQ ID NO: 5468202 - DNA, 21 bp, Homo sapiens
ttttcacttgtcttgctctta

SEQ ID NO: 5468203 - DNA, 17 bp, Homo sapiens
ttttcagaaaaagaaat

SEQ ID NO: 5468204 - DNA, 16 bp, Homo sapiens
ttttcagaaaatatta

SEQ ID NO: 5468205 - DNA, 22 bp, Homo sapiens
ttttcagaaaatattatgtgtt

SEQ ID NO: 5468206 - DNA, 20 bp, Homo sapiens
ttttcagaaagtttgaagca

SEQ ID NO: 5468207 - DNA, 18 bp, Homo sapiens
ttttcagaacctcttccc

SEQ ID NO: 5468208 - DNA, 21 bp, Homo sapiens
ttttcagaagtcagcctacat

SEQ ID NO: 5468209 - DNA, 16 bp, Homo sapiens
ttttcagaatctgaat

SEQ ID NO: 5468210 - DNA, 16 bp, Homo sapiens
ttttcagaatgctctt

SEQ ID NO: 5468211 - DNA, 14 bp, Homo sapiens
ttttcagactcaga

SEQ ID NO: 5468212 - DNA, 16 bp, Homo sapiens
ttttcagactcagact

SEQ ID NO: 5468213 - DNA, 16 bp, Homo sapiens
ttttcagacttgtcaa

SEQ ID NO: 5468214 - DNA, 14 bp, Homo sapiens
ttttcagagaatta

SEQ ID NO: 5468215 - DNA, 23 bp, Homo sapiens
ttttcagagaattatctcaagta

SEQ ID NO: 5468216 - DNA, 22 bp, Homo sapiens
ttttcagagtcatttatgagca

SEQ ID NO: 5468217 - DNA, 13 bp, Homo sapiens
ttttcagatataa

SEQ ID NO: 5468218 - DNA, 22 bp, Homo sapiens
ttttcagatataaaagactgac

SEQ ID NO: 5468219 - DNA, 18 bp, Homo sapiens
ttttcagattcaggcatt

SEQ ID NO: 5468220 - DNA, 14 bp, Homo sapiens
ttttcagatttgca

SEQ ID NO: 5468221 - DNA, 21 bp, Homo sapiens
ttttcagcatcaaacatgaaa

SEQ ID NO: 5468222 - DNA, 13 bp, Homo sapiens
ttttcagcattga

SEQ ID NO: 5468223 - DNA, 19 bp, Homo sapiens
ttttcagccaatttgtctc

SEQ ID NO: 5468224 - DNA, 19 bp, Homo sapiens
ttttcagctaggaacaaat

SEQ ID NO: 5468225 - DNA, 12 bp, Homo sapiens
ttttcagctccc

SEQ ID NO: 5468226 - DNA, 15 bp, Homo sapiens
ttttcagctgcaagg

SEQ ID NO: 5468227 - DNA, 15 bp, Homo sapiens
ttttcagcttctgct

SEQ ID NO: 5468228 - DNA, 23 bp, Homo sapiens
ttttcaggaccttagttccagca

SEQ ID NO: 5468229 - DNA, 23 bp, Homo sapiens
ttttcaggctcgccaaggcctag

SEQ ID NO: 5468230 - DNA, 22 bp, Homo sapiens
ttttcagggctggctcctgatc

SEQ ID NO: 5468231 - DNA, 21 bp, Homo sapiens
ttttcaggtgctcaaaatgca

SEQ ID NO: 5468232 - DNA, 15 bp, Homo sapiens
ttttcagtaccaaag

SEQ ID NO: 5468233 - DNA, 23 bp, Homo sapiens
ttttcagtagggctacaaaacct

SEQ ID NO: 5468234 - DNA, 15 bp, Homo sapiens
ttttcagtcatataa

SEQ ID NO: 5468235 - DNA, 18 bp, Homo sapiens
ttttcagtgatcttcact

SEQ ID NO: 5468236 - DNA, 18 bp, Homo sapiens
ttttcagttataatttca

SEQ ID NO: 5468237 - DNA, 24 bp, Homo sapiens
ttttcagttcaaagtcatgatgtt

SEQ ID NO: 5468238 - DNA, 16 bp, Homo sapiens
ttttcagttccaagaa

SEQ ID NO: 5468239 - DNA, 16 bp, Homo sapiens
ttttcagttgtttgtt

SEQ ID NO: 5468240 - DNA, 22 bp, Homo sapiens
ttttcagttgtttgtttttgct

SEQ ID NO: 5468241 - DNA, 22 bp, Homo sapiens
ttttcagtttatttgaaccaat

SEQ ID NO: 5468242 - DNA, 13 bp, Homo sapiens
ttttcataactta

SEQ ID NO: 5468243 - DNA, 17 bp, Homo sapiens
ttttcataagatatttt

SEQ ID NO: 5468244 - DNA, 16 bp, Homo sapiens
ttttcatacattttct

SEQ ID NO: 5468245 - DNA, 21 bp, Homo sapiens
ttttcatacattttctaagaa

SEQ ID NO: 5468246 - DNA, 21 bp, Homo sapiens
ttttcatactcttaagtgtaa

SEQ ID NO: 5468247 - DNA, 18 bp, Homo sapiens
ttttcatacttttacctt

SEQ ID NO: 5468248 - DNA, 17 bp, Homo sapiens
ttttcataggtctgaaa

SEQ ID NO: 5468249 - DNA, 16 bp, Homo sapiens
ttttcatatttgcact

SEQ ID NO: 5468250 - DNA, 22 bp, Homo sapiens
ttttcatattttaatttcaagc

SEQ ID NO: 5468251 - DNA, 15 bp, Homo sapiens
ttttcatcactggga

SEQ ID NO: 5468252 - DNA, 22 bp, Homo sapiens
ttttcatcattgttgtgtataa

SEQ ID NO: 5468253 - DNA, 23 bp, Homo sapiens
ttttcatcattgttgtgtataat

SEQ ID NO: 5468254 - DNA, 11 bp, Homo sapiens
ttttcatccat

SEQ ID NO: 5468255 - DNA, 22 bp, Homo sapiens
ttttcatcccgtatcacagtgt

SEQ ID NO: 5468256 - DNA, 22 bp, Homo sapiens
ttttcatccctgccaagaactc

SEQ ID NO: 5468257 - DNA, 15 bp, Homo sapiens
ttttcatcctggcct

SEQ ID NO: 5468258 - DNA, 16 bp, Homo sapiens
ttttcatcctggcctc

SEQ ID NO: 5468259 - DNA, 18 bp, Homo sapiens
ttttcatcctggcctcct

SEQ ID NO: 5468260 - DNA, 11 bp, Homo sapiens
ttttcatcctt

SEQ ID NO: 5468261 - DNA, 22 bp, Homo sapiens
ttttcatccttttttctcttct

SEQ ID NO: 5468262 - DNA, 13 bp, Homo sapiens
ttttcatctcatt

SEQ ID NO: 5468263 - DNA, 23 bp, Homo sapiens
ttttcatctcattaattcaatta

SEQ ID NO: 5468264 - DNA, 17 bp, Homo sapiens
ttttcatctgaaaagca

SEQ ID NO: 5468265 - DNA, 12 bp, Homo sapiens
ttttcatctgtt

SEQ ID NO: 5468266 - DNA, 16 bp, Homo sapiens
ttttcatcttcagttg

SEQ ID NO: 5468267 - DNA, 18 bp, Homo sapiens
ttttcatgacagaatata

SEQ ID NO: 5468268 - DNA, 14 bp, Homo sapiens
ttttcatgacataa

SEQ ID NO: 5468269 - DNA, 22 bp, Homo sapiens
ttttcatgcgatgacacttgta

SEQ ID NO: 5468270 - DNA, 16 bp, Homo sapiens
ttttcatgctccacta

SEQ ID NO: 5468271 - DNA, 20 bp, Homo sapiens
ttttcatggcccttcaaatt

SEQ ID NO: 5468272 - DNA, 21 bp, Homo sapiens
ttttcatggtgaaaatgtact

SEQ ID NO: 5468273 - DNA, 18 bp, Homo sapiens
ttttcatgtaagtttaat

SEQ ID NO: 5468274 - DNA, 14 bp, Homo sapiens
ttttcatgtacagc

SEQ ID NO: 5468275 - DNA, 14 bp, Homo sapiens
ttttcatgtgtgat

SEQ ID NO: 5468276 - DNA, 20 bp, Homo sapiens
ttttcattagcaaaaaaagt

SEQ ID NO: 5468277 - DNA, 23 bp, Homo sapiens
ttttcattagcaaaaaaagttgt

SEQ ID NO: 5468278 - DNA, 16 bp, Homo sapiens
ttttcattagcagttg

SEQ ID NO: 5468279 - DNA, 19 bp, Homo sapiens
ttttcattatttggaaatt

SEQ ID NO: 5468280 - DNA, 16 bp, Homo sapiens
ttttcattcatgaata

SEQ ID NO: 5468281 - DNA, 12 bp, Homo sapiens
ttttcattccct

SEQ ID NO: 5468282 - DNA, 14 bp, Homo sapiens
ttttcattctcctc

SEQ ID NO: 5468283 - DNA, 16 bp, Homo sapiens
ttttcattctgccaaa

SEQ ID NO: 5468284 - DNA, 19 bp, Homo sapiens
ttttcattgaggataaatt

SEQ ID NO: 5468285 - DNA, 13 bp, Homo sapiens
ttttcatttatct

SEQ ID NO: 5468286 - DNA, 14 bp, Homo sapiens
ttttgcaagggaat

SEQ ID NO: 5468287 - DNA, 18 bp, Homo sapiens
ttttgcaaggtaaaattt

SEQ ID NO: 5468288 - DNA, 21 bp, Homo sapiens
ttttgcaaggttccacagagt

SEQ ID NO: 5468289 - DNA, 22 bp, Homo sapiens
ttttgcaagtgaaggtttacaa

SEQ ID NO: 5468290 - DNA, 23 bp, Homo sapiens
ttttgcaagtgaaggtttacaat

SEQ ID NO: 5468291 - DNA, 12 bp, Homo sapiens
ttttgcaataag

SEQ ID NO: 5468292 - DNA, 22 bp, Homo sapiens
ttttgcaattggaataatcact

SEQ ID NO: 5468293 - DNA, 10 bp, Homo sapiens
ttttgcacaa

SEQ ID NO: 5468294 - DNA, 22 bp, Homo sapiens
ttttgcacaccttttccccagg

SEQ ID NO: 5468295 - DNA, 17 bp, Homo sapiens
ttttgcacagccaaatt

SEQ ID NO: 5468296 - DNA, 20 bp, Homo sapiens
ttttgcacatcatgtatctg

SEQ ID NO: 5468297 - DNA, 17 bp, Homo sapiens
ttttgcaccccatgctg

SEQ ID NO: 5468298 - DNA, 21 bp, Homo sapiens
ttttgcaccccatgctgttga

SEQ ID NO: 5468299 - DNA, 16 bp, Homo sapiens
ttttgcacccctccca

SEQ ID NO: 5468300 - DNA, 17 bp, Homo sapiens
ttttgcacccctcccat

SEQ ID NO: 5468301 - DNA, 21 bp, Homo sapiens
ttttgcacgtcttgctatttg

SEQ ID NO: 5468302 - DNA, 14 bp, Homo sapiens
ttttgcactagaac

SEQ ID NO: 5468303 - DNA, 13 bp, Homo sapiens
ttttgcactgaca

SEQ ID NO: 5468304 - DNA, 21 bp, Homo sapiens
ttttgcactgaggatattcag

SEQ ID NO: 5468305 - DNA, 19 bp, Homo sapiens
ttttgcactgctcaattct

SEQ ID NO: 5468306 - DNA, 15 bp, Homo sapiens
ttttgcactgtctgt

SEQ ID NO: 5468307 - DNA, 16 bp, Homo sapiens
ttttgcagaaggaaat

SEQ ID NO: 5468308 - DNA, 18 bp, Homo sapiens
ttttgcagaaggaaatga

SEQ ID NO: 5468309 - DNA, 18 bp, Homo sapiens
ttttgcagcagaggagct

SEQ ID NO: 5468310 - DNA, 12 bp, Homo sapiens
ttttgcagcttt

SEQ ID NO: 5468311 - DNA, 22 bp, Homo sapiens
ttttgcaggggactgggccatg

SEQ ID NO: 5468312 - DNA, 9 bp, Homo sapiens
ttttgcagt

SEQ ID NO: 5468313 - DNA, 16 bp, Homo sapiens
ttttgcagtaactgtt

SEQ ID NO: 5468314 - DNA, 15 bp, Homo sapiens
ttttgcataatgcaa

SEQ ID NO: 5468315 - DNA, 21 bp, Homo sapiens
ttttgcatagttctagtgcag

SEQ ID NO: 5468316 - DNA, 20 bp, Homo sapiens
ttttgcatctcacaaacata

SEQ ID NO: 5468317 - DNA, 12 bp, Homo sapiens
ttttgcatgaaa

SEQ ID NO: 5468318 - DNA, 22 bp, Homo sapiens
ttttgcatggcacttgcatctg

SEQ ID NO: 5468319 - DNA, 15 bp, Homo sapiens
ttttgcatgtctgca

SEQ ID NO: 5468320 - DNA, 14 bp, Homo sapiens
ttttgcatgtttaa

SEQ ID NO: 5468321 - DNA, 17 bp, Homo sapiens
ttttgcatgtttaataa

SEQ ID NO: 5468322 - DNA, 14 bp, Homo sapiens
ttttgcattattca

SEQ ID NO: 5468323 - DNA, 16 bp, Homo sapiens
ttttgcattccagaat

SEQ ID NO: 5468324 - DNA, 18 bp, Homo sapiens
ttttgcattccagaatct

SEQ ID NO: 5468325 - DNA, 19 bp, Homo sapiens
ttttgcattccagaatctt

SEQ ID NO: 5468326 - DNA, 22 bp, Homo sapiens
ttttgcattgtgtgagcttcta

SEQ ID NO: 5468327 - DNA, 13 bp, Homo sapiens
ttttgcatttatg

SEQ ID NO: 5468328 - DNA, 22 bp, Homo sapiens
ttttgcatttctcttcctaaat

SEQ ID NO: 5468329 - DNA, 15 bp, Homo sapiens
ttttgccaacattgc

SEQ ID NO: 5468330 - DNA, 23 bp, Homo sapiens
ttttgccacaaagaagattctta

SEQ ID NO: 5468331 - DNA, 14 bp, Homo sapiens
ttttgccacagctt

SEQ ID NO: 5468332 - DNA, 23 bp, Homo sapiens
ttttgccactgcaaacaataaac

SEQ ID NO: 5468333 - DNA, 20 bp, Homo sapiens
ttttgccactgcctttcaga

SEQ ID NO: 5468334 - DNA, 17 bp, Homo sapiens
ttttgccagttttccct

SEQ ID NO: 5468335 - DNA, 19 bp, Homo sapiens
ttttgccagttttccctgg

SEQ ID NO: 5468336 - DNA, 15 bp, Homo sapiens
ttttgccattaaact

SEQ ID NO: 5468337 - DNA, 19 bp, Homo sapiens
ttttgcccattttgaatca

SEQ ID NO: 5468338 - DNA, 13 bp, Homo sapiens
ttttgccctcctg

SEQ ID NO: 5468339 - DNA, 18 bp, Homo sapiens
ttttgcccttcacagtgt

SEQ ID NO: 5468340 - DNA, 19 bp, Homo sapiens
ttttgccctttagggctgt

SEQ ID NO: 5468341 - DNA, 23 bp, Homo sapiens
ttttgccggctggtgaattcaaa

SEQ ID NO: 5468342 - DNA, 13 bp, Homo sapiens
ttttgcctatctt

SEQ ID NO: 5468343 - DNA, 17 bp, Homo sapiens
ttttgcctatctttaaa

SEQ ID NO: 5468344 - DNA, 18 bp, Homo sapiens
ttttgcctatctttaaac

SEQ ID NO: 5468345 - DNA, 14 bp, Homo sapiens
ttttgcctcatgaa

SEQ ID NO: 5468346 - DNA, 12 bp, Homo sapiens
ttttgcctctgc

SEQ ID NO: 5468347 - DNA, 21 bp, Homo sapiens
ttttgcctgacaattgcaaat

SEQ ID NO: 5468348 - DNA, 20 bp, Homo sapiens
ttttgcctgagaaggggcag

SEQ ID NO: 5468349 - DNA, 12 bp, Homo sapiens
ttttgcctggct

SEQ ID NO: 5468350 - DNA, 13 bp, Homo sapiens
ttttgcctggctg

SEQ ID NO: 5468351 - DNA, 22 bp, Homo sapiens
ttttgcctggctgtggaggcct

SEQ ID NO: 5468352 - DNA, 17 bp, Homo sapiens
ttttgccttcattacct

SEQ ID NO: 5468353 - DNA, 15 bp, Homo sapiens
ttttgccttttgcaa

SEQ ID NO: 5468354 - DNA, 14 bp, Homo sapiens
ttttgcgatgtgtt

SEQ ID NO: 5468355 - DNA, 18 bp, Homo sapiens
ttttgcgatgtgttttat

SEQ ID NO: 5468356 - DNA, 15 bp, Homo sapiens
ttttgcgatttcaca

SEQ ID NO: 5468357 - DNA, 17 bp, Homo sapiens
ttttgcgtacacagaga

SEQ ID NO: 5468358 - DNA, 11 bp, Homo sapiens
ttttgctaact

SEQ ID NO: 5468359 - DNA, 14 bp, Homo sapiens
ttttgctaactggg

SEQ ID NO: 5468360 - DNA, 23 bp, Homo sapiens
ttttgctaaggagaagctaatat

SEQ ID NO: 5468361 - DNA, 19 bp, Homo sapiens
ttttgctaggagccccagc

SEQ ID NO: 5468362 - DNA, 11 bp, Homo sapiens
ttttgctatac

SEQ ID NO: 5468363 - DNA, 19 bp, Homo sapiens
ttttgctccttctgtgttt

SEQ ID NO: 5468364 - DNA, 16 bp, Homo sapiens
ttttgctctaaaatat

SEQ ID NO: 5468365 - DNA, 13 bp, Homo sapiens
ttttgctgctgct

SEQ ID NO: 5468366 - DNA, 13 bp, Homo sapiens
ttttgctggaata

SEQ ID NO: 5468367 - DNA, 22 bp, Homo sapiens
ttttgctgtaatgttaatattg

SEQ ID NO: 5468368 - DNA, 11 bp, Homo sapiens
ttttgctgtct

SEQ ID NO: 5468369 - DNA, 17 bp, Homo sapiens
ttttgctgtctttctct

SEQ ID NO: 5468370 - DNA, 15 bp, Homo sapiens
ttttgctgtgctgta

SEQ ID NO: 5468371 - DNA, 13 bp, Homo sapiens
ttttgctgttcca

SEQ ID NO: 5468372 - DNA, 19 bp, Homo sapiens
ttttgctgtttattaaaaa

SEQ ID NO: 5468373 - DNA, 18 bp, Homo sapiens
ttttgctgtttcctttta

SEQ ID NO: 5468374 - DNA, 15 bp, Homo sapiens
ttttgcttaaaattt

SEQ ID NO: 5468375 - DNA, 16 bp, Homo sapiens
ttttgcttaaaatttt

SEQ ID NO: 5468376 - DNA, 18 bp, Homo sapiens
ttttgcttaacattagat

SEQ ID NO: 5468377 - DNA, 13 bp, Homo sapiens
ttttgctttaatt

SEQ ID NO: 5468378 - DNA, 19 bp, Homo sapiens
ttttgctttaattccatga

SEQ ID NO: 5468379 - DNA, 21 bp, Homo sapiens
ttttgctttagagaatgccac

SEQ ID NO: 5468380 - DNA, 11 bp, Homo sapiens
ttttgctttat

SEQ ID NO: 5468381 - DNA, 13 bp, Homo sapiens
ttttgctttgtta

SEQ ID NO: 5468382 - DNA, 13 bp, Homo sapiens
ttttgctttgttt

SEQ ID NO: 5468383 - DNA, 17 bp, Homo sapiens
ttttgcttttatccact

SEQ ID NO: 5468384 - DNA, 12 bp, Homo sapiens
ttttgcttttta

SEQ ID NO: 5468385 - DNA, 17 bp, Homo sapiens
ttttgctttttctgact

SEQ ID NO: 5468386 - DNA, 20 bp, Homo sapiens
ttttgctttttctgactcca

SEQ ID NO: 5468387 - DNA, 11 bp, Homo sapiens
ttttggaaact

SEQ ID NO: 5468388 - DNA, 17 bp, Homo sapiens
ttttggaaagtcagaat

SEQ ID NO: 5468389 - DNA, 21 bp, Homo sapiens
ttttggaactaaagcaaattt

SEQ ID NO: 5468390 - DNA, 20 bp, Homo sapiens
ttttggaagattttcagtct

SEQ ID NO: 5468391 - DNA, 16 bp, Homo sapiens
ttttggaatctagaag

SEQ ID NO: 5468392 - DNA, 19 bp, Homo sapiens
ttttggaattggtgtatat

SEQ ID NO: 5468393 - DNA, 13 bp, Homo sapiens
ttttggaattgtc

SEQ ID NO: 5468394 - DNA, 21 bp, Homo sapiens
ttttggacctaaacattattt

SEQ ID NO: 5468395 - DNA, 15 bp, Homo sapiens
ttttggactagccag

SEQ ID NO: 5468396 - DNA, 19 bp, Homo sapiens
ttttggactctctgtggtc

SEQ ID NO: 5468397 - DNA, 18 bp, Homo sapiens
ttttggagaaaaattaca

SEQ ID NO: 5468398 - DNA, 15 bp, Homo sapiens
ttttggaggtgctta

SEQ ID NO: 5468399 - DNA, 16 bp, Homo sapiens
ttttggagtgttatgt

SEQ ID NO: 5468400 - DNA, 17 bp, Homo sapiens
ttttggagtgttatgta

SEQ ID NO: 5468401 - DNA, 23 bp, Homo sapiens
ttttggatcataaactggaaata

SEQ ID NO: 5468402 - DNA, 17 bp, Homo sapiens
ttttggatcttgaatgt

SEQ ID NO: 5468403 - DNA, 16 bp, Homo sapiens
ttttggatgcagtgct

SEQ ID NO: 5468404 - DNA, 11 bp, Homo sapiens
ttttggatgcc

SEQ ID NO: 5468405 - DNA, 18 bp, Homo sapiens
ttttggatggtgttacat

SEQ ID NO: 5468406 - DNA, 21 bp, Homo sapiens
ttttggatgttgctatagtga

SEQ ID NO: 5468407 - DNA, 18 bp, Homo sapiens
ttttggattgtcaaagag

SEQ ID NO: 5468408 - DNA, 23 bp, Homo sapiens
ttttggatttagagactgtaaat

SEQ ID NO: 5468409 - DNA, 19 bp, Homo sapiens
ttttggcaaaactctactt

SEQ ID NO: 5468410 - DNA, 22 bp, Homo sapiens
ttttggcaatacatttgatttg

SEQ ID NO: 5468411 - DNA, 22 bp, Homo sapiens
ttttggcaatgactcaaagtct

SEQ ID NO: 5468412 - DNA, 11 bp, Homo sapiens
ttttggcacct

SEQ ID NO: 5468413 - DNA, 14 bp, Homo sapiens
ttttggcattcctc

SEQ ID NO: 5468414 - DNA, 23 bp, Homo sapiens
ttttggcctcatctctgcctgac

SEQ ID NO: 5468415 - DNA, 17 bp, Homo sapiens
ttttggcgctattacaa

SEQ ID NO: 5468416 - DNA, 20 bp, Homo sapiens
ttttggctagagtttccact

SEQ ID NO: 5468417 - DNA, 14 bp, Homo sapiens
ttttggctcagagt

SEQ ID NO: 5468418 - DNA, 16 bp, Homo sapiens
ttttggctcagagtcc

SEQ ID NO: 5468419 - DNA, 14 bp, Homo sapiens
ttttggctctgaag

SEQ ID NO: 5468420 - DNA, 22 bp, Homo sapiens
ttttggctgagtactggaataa

SEQ ID NO: 5468421 - DNA, 14 bp, Homo sapiens
ttttggctgctgaa

SEQ ID NO: 5468422 - DNA, 19 bp, Homo sapiens
ttttggctgtgacctcttc

SEQ ID NO: 5468423 - DNA, 21 bp, Homo sapiens
ttttggctgtgacctcttcaa

SEQ ID NO: 5468424 - DNA, 17 bp, Homo sapiens
ttttggctgttttccct

SEQ ID NO: 5468425 - DNA, 17 bp, Homo sapiens
ttttggcttcatttcaa

SEQ ID NO: 5468426 - DNA, 14 bp, Homo sapiens
ttttggctttctcc

SEQ ID NO: 5468427 - DNA, 16 bp, Homo sapiens
ttttggctttctccct

SEQ ID NO: 5468428 - DNA, 17 bp, Homo sapiens
ttttgggacaattgttt

SEQ ID NO: 5468429 - DNA, 20 bp, Homo sapiens
ttttgggaggggatggcaga

SEQ ID NO: 5468430 - DNA, 12 bp, Homo sapiens
ttttgggatgtc

SEQ ID NO: 5468431 - DNA, 21 bp, Homo sapiens
ttttgggatttgttgaaatct

SEQ ID NO: 5468432 - DNA, 14 bp, Homo sapiens
ttttgggccattac

SEQ ID NO: 5468433 - DNA, 17 bp, Homo sapiens
ttttgggctcaaagccc

SEQ ID NO: 5468434 - DNA, 22 bp, Homo sapiens
ttttgggctcctttttctccct

SEQ ID NO: 5468435 - DNA, 19 bp, Homo sapiens
ttttggggaaaaaagcaca

SEQ ID NO: 5468436 - DNA, 20 bp, Homo sapiens
ttttggggaaaaaagcacat

SEQ ID NO: 5468437 - DNA, 22 bp, Homo sapiens
ttttggggattttcaaaagata

SEQ ID NO: 5468438 - DNA, 18 bp, Homo sapiens
ttttggggcatcctggat

SEQ ID NO: 5468439 - DNA, 18 bp, Homo sapiens
ttttgggggtcaggcagc

SEQ ID NO: 5468440 - DNA, 18 bp, Homo sapiens
ttttgggggtgggtctgg

SEQ ID NO: 5468441 - DNA, 18 bp, Homo sapiens
ttttgggggtgtgagtgt

SEQ ID NO: 5468442 - DNA, 19 bp, Homo sapiens
ttttgggggtttttaatct

SEQ ID NO: 5468443 - DNA, 18 bp, Homo sapiens
ttttggggtgtgacctca

SEQ ID NO: 5468444 - DNA, 21 bp, Homo sapiens
ttttgggtaaaatctgtaatt

SEQ ID NO: 5468445 - DNA, 17 bp, Homo sapiens
ttttgggtactggagct

SEQ ID NO: 5468446 - DNA, 19 bp, Homo sapiens
ttttgggtactttctatct

SEQ ID NO: 5468447 - DNA, 16 bp, Homo sapiens
ttttggtaataacaaa

SEQ ID NO: 5468448 - DNA, 20 bp, Homo sapiens
ttttggtaatatatatattt

SEQ ID NO: 5468449 - DNA, 14 bp, Homo sapiens
ttttggtacaaaaa

SEQ ID NO: 5468450 - DNA, 17 bp, Homo sapiens
ttttggtagagaaggag

SEQ ID NO: 5468451 - DNA, 13 bp, Homo sapiens
ttttggtatttat

SEQ ID NO: 5468452 - DNA, 14 bp, Homo sapiens
ttttggtatttatg

SEQ ID NO: 5468453 - DNA, 16 bp, Homo sapiens
ttttggtatttgaaac

SEQ ID NO: 5468454 - DNA, 18 bp, Homo sapiens
ttttggtatttgtttgta

SEQ ID NO: 5468455 - DNA, 19 bp, Homo sapiens
ttttggtccaaattcttta

SEQ ID NO: 5468456 - DNA, 15 bp, Homo sapiens
ttttggtccttcttt

SEQ ID NO: 5468457 - DNA, 14 bp, Homo sapiens
ttttggtctttttg

SEQ ID NO: 5468458 - DNA, 17 bp, Homo sapiens
ttttggtgcacaaatac

SEQ ID NO: 5468459 - DNA, 17 bp, Homo sapiens
ttttggtggatgtaaat

SEQ ID NO: 5468460 - DNA, 16 bp, Homo sapiens
ttttggtggtgaaatt

SEQ ID NO: 5468461 - DNA, 16 bp, Homo sapiens
ttttggttatttctaa

SEQ ID NO: 5468462 - DNA, 19 bp, Homo sapiens
ttttggttatttctaaacc

SEQ ID NO: 5468463 - DNA, 22 bp, Homo sapiens
ttttggttcattttcagattca

SEQ ID NO: 5468464 - DNA, 16 bp, Homo sapiens
ttttggttcttagttc

SEQ ID NO: 5468465 - DNA, 14 bp, Homo sapiens
tttttccccaaagt

SEQ ID NO: 5468466 - DNA, 16 bp, Homo sapiens
tttttccccaaagtct

SEQ ID NO: 5468467 - DNA, 12 bp, Homo sapiens
tttttccccctt

SEQ ID NO: 5468468 - DNA, 20 bp, Homo sapiens
tttttccccgattttccaga

SEQ ID NO: 5468469 - DNA, 23 bp, Homo sapiens
tttttcccttcatctgggcactg

SEQ ID NO: 5468470 - DNA, 11 bp, Homo sapiens
tttttcccttt

SEQ ID NO: 5468471 - DNA, 16 bp, Homo sapiens
tttttccgtaaaaatg

SEQ ID NO: 5468472 - DNA, 11 bp, Homo sapiens
tttttccgtgt

SEQ ID NO: 5468473 - DNA, 15 bp, Homo sapiens
tttttcctagaagtg

SEQ ID NO: 5468474 - DNA, 18 bp, Homo sapiens
tttttcctagccctctca

SEQ ID NO: 5468475 - DNA, 15 bp, Homo sapiens
tttttcctagcctgt

SEQ ID NO: 5468476 - DNA, 22 bp, Homo sapiens
tttttcctatgaccataaaatt

SEQ ID NO: 5468477 - DNA, 18 bp, Homo sapiens
tttttcctcatgtaacat

SEQ ID NO: 5468478 - DNA, 13 bp, Homo sapiens
tttttcctcccag

SEQ ID NO: 5468479 - DNA, 11 bp, Homo sapiens
tttttcctcct

SEQ ID NO: 5468480 - DNA, 16 bp, Homo sapiens
tttttcctctaagtgc

SEQ ID NO: 5468481 - DNA, 16 bp, Homo sapiens
tttttcctctaatatg

SEQ ID NO: 5468482 - DNA, 12 bp, Homo sapiens
tttttcctctgt

SEQ ID NO: 5468483 - DNA, 18 bp, Homo sapiens
tttttcctgcatgttctg

SEQ ID NO: 5468484 - DNA, 20 bp, Homo sapiens
tttttccttacataaacatc

SEQ ID NO: 5468485 - DNA, 16 bp, Homo sapiens
tttttccttactgtgc

SEQ ID NO: 5468486 - DNA, 21 bp, Homo sapiens
tttttccttcaagaatgcagt

SEQ ID NO: 5468487 - DNA, 17 bp, Homo sapiens
tttttccttcataattt

SEQ ID NO: 5468488 - DNA, 15 bp, Homo sapiens
tttttccttctctgg

SEQ ID NO: 5468489 - DNA, 17 bp, Homo sapiens
tttttcctttttctgat

SEQ ID NO: 5468490 - DNA, 13 bp, Homo sapiens
tttttcgtgtttt

SEQ ID NO: 5468491 - DNA, 22 bp, Homo sapiens
tttttctaaacaagaaccattt

SEQ ID NO: 5468492 - DNA, 15 bp, Homo sapiens
tttttctaactacaa

SEQ ID NO: 5468493 - DNA, 15 bp, Homo sapiens
tttttctaagagaag

SEQ ID NO: 5468494 - DNA, 23 bp, Homo sapiens
tttttctaagtgtaacctcagta

SEQ ID NO: 5468495 - DNA, 22 bp, Homo sapiens
tttttctacacagtaaaaactt

SEQ ID NO: 5468496 - DNA, 21 bp, Homo sapiens
tttttctaccataagtgacac

SEQ ID NO: 5468497 - DNA, 18 bp, Homo sapiens
tttttctacttttaaaga

SEQ ID NO: 5468498 - DNA, 14 bp, Homo sapiens
tttttctagtacac

SEQ ID NO: 5468499 - DNA, 19 bp, Homo sapiens
tttttctagtttggcacat

SEQ ID NO: 5468500 - DNA, 15 bp, Homo sapiens
tttttctataaatca

SEQ ID NO: 5468501 - DNA, 11 bp, Homo sapiens
tttttctatga

SEQ ID NO: 5468502 - DNA, 10 bp, Homo sapiens
tttttctcaa

SEQ ID NO: 5468503 - DNA, 12 bp, Homo sapiens
tttttctcaaat

SEQ ID NO: 5468504 - DNA, 11 bp, Homo sapiens
tttttctctaa

SEQ ID NO: 5468505 - DNA, 16 bp, Homo sapiens
tttttctctaatgctt

SEQ ID NO: 5468506 - DNA, 12 bp, Homo sapiens
tttttctctttc

SEQ ID NO: 5468507 - DNA, 14 bp, Homo sapiens
tttttctctttctc

SEQ ID NO: 5468508 - DNA, 9 bp, Homo sapiens
tttttctga

SEQ ID NO: 5468509 - DNA, 22 bp, Homo sapiens
tttttctgaataaaaaagattc

SEQ ID NO: 5468510 - DNA, 18 bp, Homo sapiens
tttttctgactccagtgg

SEQ ID NO: 5468511 - DNA, 11 bp, Homo sapiens
tttttctgatt

SEQ ID NO: 5468512 - DNA, 16 bp, Homo sapiens
tttttctgatttgtcc

SEQ ID NO: 5468513 - DNA, 13 bp, Homo sapiens
tttttctgcacag

SEQ ID NO: 5468514 - DNA, 16 bp, Homo sapiens
tttttctgcacagctt

SEQ ID NO: 5468515 - DNA, 22 bp, Homo sapiens
tttttctgcactatatgcaaac

SEQ ID NO: 5468516 - DNA, 14 bp, Homo sapiens
tttttctgcactga

SEQ ID NO: 5468517 - DNA, 13 bp, Homo sapiens
tttttctgcagaa

SEQ ID NO: 5468518 - DNA, 12 bp, Homo sapiens
tttttctgcctc

SEQ ID NO: 5468519 - DNA, 13 bp, Homo sapiens
tttttctgcctcc

SEQ ID NO: 5468520 - DNA, 20 bp, Homo sapiens
tttttctgctttagacttga

SEQ ID NO: 5468521 - DNA, 11 bp, Homo sapiens
tttttctggaa

SEQ ID NO: 5468522 - DNA, 21 bp, Homo sapiens
tttttctggaccaaggtgaag

SEQ ID NO: 5468523 - DNA, 16 bp, Homo sapiens
tttttctggccttgac

SEQ ID NO: 5468524 - DNA, 22 bp, Homo sapiens
tttttctggctgtgatcttaaa

SEQ ID NO: 5468525 - DNA, 13 bp, Homo sapiens
tttttctgggctt

SEQ ID NO: 5468526 - DNA, 18 bp, Homo sapiens
tttttctgtaactgtgct

SEQ ID NO: 5468527 - DNA, 11 bp, Homo sapiens
tttttctgtat

SEQ ID NO: 5468528 - DNA, 20 bp, Homo sapiens
tttttctgtgataactctgc

SEQ ID NO: 5468529 - DNA, 12 bp, Homo sapiens
tttttcttaaaa

SEQ ID NO: 5468530 - DNA, 19 bp, Homo sapiens
tttttcttaaatatgtata

SEQ ID NO: 5468531 - DNA, 14 bp, Homo sapiens
tttttcttaacaag

SEQ ID NO: 5468532 - DNA, 21 bp, Homo sapiens
tttttcttaatatatagcatt

SEQ ID NO: 5468533 - DNA, 15 bp, Homo sapiens
tttttcttacacatt

SEQ ID NO: 5468534 - DNA, 13 bp, Homo sapiens
tttttcttatcca

SEQ ID NO: 5468535 - DNA, 16 bp, Homo sapiens
tttttcttcactgcaa

SEQ ID NO: 5468536 - DNA, 12 bp, Homo sapiens
tttttcttcagc

SEQ ID NO: 5468537 - DNA, 11 bp, Homo sapiens
tttttcttccc

SEQ ID NO: 5468538 - DNA, 14 bp, Homo sapiens
tttttcttcgctgg

SEQ ID NO: 5468539 - DNA, 11 bp, Homo sapiens
tttttcttctg

SEQ ID NO: 5468540 - DNA, 14 bp, Homo sapiens
tttttcttctttta

SEQ ID NO: 5468541 - DNA, 14 bp, Homo sapiens
tttttcttgatctt

SEQ ID NO: 5468542 - DNA, 18 bp, Homo sapiens
tttttcttgctgttcagt

SEQ ID NO: 5468543 - DNA, 12 bp, Homo sapiens
tttttcttggga

SEQ ID NO: 5468544 - DNA, 12 bp, Homo sapiens
tttttcttgtct

SEQ ID NO: 5468545 - DNA, 22 bp, Homo sapiens
tttttcttgtctataaagcatt

SEQ ID NO: 5468546 - DNA, 16 bp, Homo sapiens
tttttctttataaact

SEQ ID NO: 5468547 - DNA, 18 bp, Homo sapiens
tttttctttgtatttatt

SEQ ID NO: 5468548 - DNA, 13 bp, Homo sapiens
tttttcttttgta

SEQ ID NO: 5468549 - DNA, 23 bp, Homo sapiens
tttttctttttccagtgttctat

SEQ ID NO: 5468550 - DNA, 20 bp, Homo sapiens
tttttcttttttttttctgt

SEQ ID NO: 5468551 - DNA, 18 bp, Homo sapiens
tttttgaaaaagagattt

SEQ ID NO: 5468552 - DNA, 15 bp, Homo sapiens
tttttgaaaaatatt

SEQ ID NO: 5468553 - DNA, 16 bp, Homo sapiens
tttttgaaaagagaag

SEQ ID NO: 5468554 - DNA, 16 bp, Homo sapiens
tttttgaaacccacag

SEQ ID NO: 5468555 - DNA, 19 bp, Homo sapiens
tttttgaaacccacagttt

SEQ ID NO: 5468556 - DNA, 23 bp, Homo sapiens
tttttgaaaggcatgttcctctg

SEQ ID NO: 5468557 - DNA, 23 bp, Homo sapiens
tttttgaaatcagtaaacactgt

SEQ ID NO: 5468558 - DNA, 23 bp, Homo sapiens
tttttgaactaagaaacttttgt

SEQ ID NO: 5468559 - DNA, 16 bp, Homo sapiens
tttttgaacttttcat

SEQ ID NO: 5468560 - DNA, 22 bp, Homo sapiens
tttttgaaggcagaaagcaaaa

SEQ ID NO: 5468561 - DNA, 23 bp, Homo sapiens
tttttgaaggcagaaagcaaaat

SEQ ID NO: 5468562 - DNA, 23 bp, Homo sapiens
tttttgaagtaaattaaacattt

SEQ ID NO: 5468563 - DNA, 15 bp, Homo sapiens
tttttgaagtcttgt

SEQ ID NO: 5468564 - DNA, 12 bp, Homo sapiens
tttttgaagtgt

SEQ ID NO: 5468565 - DNA, 15 bp, Homo sapiens
tttttgaatatgcct

SEQ ID NO: 5468566 - DNA, 12 bp, Homo sapiens
tttttgaattct

SEQ ID NO: 5468567 - DNA, 13 bp, Homo sapiens
tttttgacactga

SEQ ID NO: 5468568 - DNA, 13 bp, Homo sapiens
tttttgacagaat

SEQ ID NO: 5468569 - DNA, 18 bp, Homo sapiens
tttttgaccagtttcttt

SEQ ID NO: 5468570 - DNA, 12 bp, Homo sapiens
tttttgactttt

SEQ ID NO: 5468571 - DNA, 23 bp, Homo sapiens
tttttgactttttttgtatgtgt

SEQ ID NO: 5468572 - DNA, 16 bp, Homo sapiens
tttttgagacagagtc

SEQ ID NO: 5468573 - DNA, 20 bp, Homo sapiens
tttttgagacagagtctcgc

SEQ ID NO: 5468574 - DNA, 18 bp, Homo sapiens
tttttgaggtatcactgc

SEQ ID NO: 5468575 - DNA, 14 bp, Homo sapiens
tttttgagtactgt

SEQ ID NO: 5468576 - DNA, 16 bp, Homo sapiens
tttttgagtcaaagac

SEQ ID NO: 5468577 - DNA, 15 bp, Homo sapiens
tttttgagtgacagc

SEQ ID NO: 5468578 - DNA, 20 bp, Homo sapiens
tttttgagttttcttatata

SEQ ID NO: 5468579 - DNA, 17 bp, Homo sapiens
tttttgataatccaaag

SEQ ID NO: 5468580 - DNA, 13 bp, Homo sapiens
tttttgatagcat

SEQ ID NO: 5468581 - DNA, 12 bp, Homo sapiens
tttttgatatag

SEQ ID NO: 5468582 - DNA, 12 bp, Homo sapiens
tttttgatatat

SEQ ID NO: 5468583 - DNA, 18 bp, Homo sapiens
tttttgatcaaatgtaca

SEQ ID NO: 5468584 - DNA, 22 bp, Homo sapiens
tttttgatcaatgtatatgaag

SEQ ID NO: 5468585 - DNA, 19 bp, Homo sapiens
tttttgatcatccctttct

SEQ ID NO: 5468586 - DNA, 15 bp, Homo sapiens
tttttgatgcctttt

SEQ ID NO: 5468587 - DNA, 18 bp, Homo sapiens
tttttgattaacaatgta

SEQ ID NO: 5468588 - DNA, 18 bp, Homo sapiens
tttttgatttatcaatat

SEQ ID NO: 5468589 - DNA, 11 bp, Homo sapiens
tttttgcaaaa

SEQ ID NO: 5468590 - DNA, 11 bp, Homo sapiens
tttttgcaata

SEQ ID NO: 5468591 - DNA, 14 bp, Homo sapiens
tttttgcaataagg

SEQ ID NO: 5468592 - DNA, 20 bp, Homo sapiens
tttttgcacatgtttcctct

SEQ ID NO: 5468593 - DNA, 19 bp, Homo sapiens
tttttgcaccccatgctgt

SEQ ID NO: 5468594 - DNA, 22 bp, Homo sapiens
tttttgcaccccatgctgttga

SEQ ID NO: 5468595 - DNA, 16 bp, Homo sapiens
tttttgcaggggactg

SEQ ID NO: 5468596 - DNA, 21 bp, Homo sapiens
tttttgccaaaatatcatgtt

SEQ ID NO: 5468597 - DNA, 19 bp, Homo sapiens
tttttgccacaaagaagat

SEQ ID NO: 5468598 - DNA, 20 bp, Homo sapiens
tttttgccactgcaaacaat

SEQ ID NO: 5468599 - DNA, 11 bp, Homo sapiens
tttttgctata

SEQ ID NO: 5468600 - DNA, 13 bp, Homo sapiens
tttttgctgtgta

SEQ ID NO: 5468601 - DNA, 14 bp, Homo sapiens
tttttgctgttagt

SEQ ID NO: 5468602 - DNA, 14 bp, Homo sapiens
tttttgcttaacat

SEQ ID NO: 5468603 - DNA, 18 bp, Homo sapiens
tttttgcttctactttca

SEQ ID NO: 5468604 - DNA, 23 bp, Homo sapiens
tttttggaaaagagctgggatcc

SEQ ID NO: 5468605 - DNA, 17 bp, Homo sapiens
tttttggaaagtcagaa

SEQ ID NO: 5468606 - DNA, 15 bp, Homo sapiens
tttttggaagtgaaa

SEQ ID NO: 5468607 - DNA, 19 bp, Homo sapiens
tttttggaagtgaaaactt

SEQ ID NO: 5468608 - DNA, 9 bp, Homo sapiens
tttttggat

SEQ ID NO: 5468609 - DNA, 21 bp, Homo sapiens
tttttggatggcttaagcctg

SEQ ID NO: 5468610 - DNA, 16 bp, Homo sapiens
tttttggatttagctt

SEQ ID NO: 5468611 - DNA, 15 bp, Homo sapiens
tttttggatttctgt

SEQ ID NO: 5468612 - DNA, 19 bp, Homo sapiens
tttttggcaacaggagaga

SEQ ID NO: 5468613 - DNA, 15 bp, Homo sapiens
tttttggcattatct

SEQ ID NO: 5468614 - DNA, 16 bp, Homo sapiens
tttttggctagagttt

SEQ ID NO: 5468615 - DNA, 20 bp, Homo sapiens
tttttgggcagcaatttaaa

SEQ ID NO: 5468616 - DNA, 15 bp, Homo sapiens
tttttgggggctttc

SEQ ID NO: 5468617 - DNA, 15 bp, Homo sapiens
tttttgggtttggcc

SEQ ID NO: 5468618 - DNA, 23 bp, Homo sapiens
tttttggtaataacaaacgtgtt

SEQ ID NO: 5468619 - DNA, 14 bp, Homo sapiens
tttttggtaattat

SEQ ID NO: 5468620 - DNA, 12 bp, Homo sapiens
tttttggtacaa

SEQ ID NO: 5468621 - DNA, 15 bp, Homo sapiens
tttttggtataatgt

SEQ ID NO: 5468622 - DNA, 20 bp, Homo sapiens
tttttggtataatgtttaaa

SEQ ID NO: 5468623 - DNA, 12 bp, Homo sapiens
tttttggtcaaa

SEQ ID NO: 5468624 - DNA, 22 bp, Homo sapiens
tttttggtcttctgttgacatt

SEQ ID NO: 5468625 - DNA, 17 bp, Homo sapiens
tttttggtgtatttgag

SEQ ID NO: 5468626 - DNA, 21 bp, Homo sapiens
tttttggttaaaaaaaagaat

SEQ ID NO: 5468627 - DNA, 15 bp, Homo sapiens
tttttggttttaaaa

SEQ ID NO: 5468628 - DNA, 19 bp, Homo sapiens
tttttggttttctccttcc

SEQ ID NO: 5468629 - DNA, 13 bp, Homo sapiens
tttttgtaaactg

SEQ ID NO: 5468630 - DNA, 16 bp, Homo sapiens
tttttgtaaagtgtgg

SEQ ID NO: 5468631 - DNA, 12 bp, Homo sapiens
tttttgtaaatg

SEQ ID NO: 5468632 - DNA, 12 bp, Homo sapiens
tttttgtaacta

SEQ ID NO: 5468633 - DNA, 15 bp, Homo sapiens
tttttgtaactacaa

SEQ ID NO: 5468634 - DNA, 14 bp, Homo sapiens
tttttgtaactctt

SEQ ID NO: 5468635 - DNA, 12 bp, Homo sapiens
tttttgtaataa

SEQ ID NO: 5468636 - DNA, 18 bp, Homo sapiens
tttttgtaataacattta

SEQ ID NO: 5468637 - DNA, 13 bp, Homo sapiens
tttttgtaattta

SEQ ID NO: 5468638 - DNA, 11 bp, Homo sapiens
tttttgtacat

SEQ ID NO: 5468639 - DNA, 18 bp, Homo sapiens
tttttgtacattacacta

SEQ ID NO: 5468640 - DNA, 16 bp, Homo sapiens
tttttgtacctggtga

SEQ ID NO: 5468641 - DNA, 11 bp, Homo sapiens
tttttgtactt

SEQ ID NO: 5468642 - DNA, 12 bp, Homo sapiens
tttttgtacttt

SEQ ID NO: 5468643 - DNA, 19 bp, Homo sapiens
tttttgtagcactgacaga

SEQ ID NO: 5468644 - DNA, 20 bp, Homo sapiens
tttttgtagtgacctgttta

SEQ ID NO: 5468645 - DNA, 18 bp, Homo sapiens
tttttgtataaaatagac

SEQ ID NO: 5468646 - DNA, 15 bp, Homo sapiens
tttttgtatattaca

SEQ ID NO: 5468647 - DNA, 15 bp, Homo sapiens
tttttgtatgtgaac

SEQ ID NO: 5468648 - DNA, 12 bp, Homo sapiens
gtaattattttc

SEQ ID NO: 5468649 - DNA, 13 bp, Homo sapiens
gtaattcaagaaa

SEQ ID NO: 5468650 - DNA, 14 bp, Homo sapiens
gtaattcaagaaaa

SEQ ID NO: 5468651 - DNA, 13 bp, Homo sapiens
gtaattcaggact

SEQ ID NO: 5468652 - DNA, 22 bp, Homo sapiens
gtaattcattgagcagttagct

SEQ ID NO: 5468653 - DNA, 17 bp, Homo sapiens
gtaattcccatctgctt

SEQ ID NO: 5468654 - DNA, 17 bp, Homo sapiens
gtaattcgtttgctaga

SEQ ID NO: 5468655 - DNA, 18 bp, Homo sapiens
gtaattctaccctgaaag

SEQ ID NO: 5468656 - DNA, 22 bp, Homo sapiens
gtaattctccctaaggaatctg

SEQ ID NO: 5468657 - DNA, 21 bp, Homo sapiens
gtaattctgtcattcctaaaa

SEQ ID NO: 5468658 - DNA, 12 bp, Homo sapiens
gtaattcttatg

SEQ ID NO: 5468659 - DNA, 15 bp, Homo sapiens
gtaattcttcagttg

SEQ ID NO: 5468660 - DNA, 20 bp, Homo sapiens
gtaattcttctgcctcagcc

SEQ ID NO: 5468661 - DNA, 16 bp, Homo sapiens
gtaattctttctgtct

SEQ ID NO: 5468662 - DNA, 15 bp, Homo sapiens
gtaattgaacttatc

SEQ ID NO: 5468663 - DNA, 21 bp, Homo sapiens
gtaattgacagagtaaaagta

SEQ ID NO: 5468664 - DNA, 15 bp, Homo sapiens
gtaattgacatgtgc

SEQ ID NO: 5468665 - DNA, 19 bp, Homo sapiens
gtaattgcatgacaaacct

SEQ ID NO: 5468666 - DNA, 20 bp, Homo sapiens
gtaattgcctacaataaaaa

SEQ ID NO: 5468667 - DNA, 15 bp, Homo sapiens
gtaattgcttacatt

SEQ ID NO: 5468668 - DNA, 13 bp, Homo sapiens
gtaattggaatct

SEQ ID NO: 5468669 - DNA, 16 bp, Homo sapiens
gtaattggaatcttca

SEQ ID NO: 5468670 - DNA, 17 bp, Homo sapiens
gtaattggaatcttcac

SEQ ID NO: 5468671 - DNA, 23 bp, Homo sapiens
gtaattggaatcttcacctcaga

SEQ ID NO: 5468672 - DNA, 12 bp, Homo sapiens
gtaattgggaac

SEQ ID NO: 5468673 - DNA, 14 bp, Homo sapiens
gtaattgggaactg

SEQ ID NO: 5468674 - DNA, 13 bp, Homo sapiens
gtaattgtacaat

SEQ ID NO: 5468675 - DNA, 16 bp, Homo sapiens
gtaattgtacaataaa

SEQ ID NO: 5468676 - DNA, 17 bp, Homo sapiens
gtaattgtacaataaat

SEQ ID NO: 5468677 - DNA, 18 bp, Homo sapiens
gtaattgtacaataaatt

SEQ ID NO: 5468678 - DNA, 18 bp, Homo sapiens
gtaattgtactaaagcca

SEQ ID NO: 5468679 - DNA, 17 bp, Homo sapiens
gtaattgtagacctgtt

SEQ ID NO: 5468680 - DNA, 19 bp, Homo sapiens
gtaattgttgtttgtatgt

SEQ ID NO: 5468681 - DNA, 14 bp, Homo sapiens
gtaatttaaacagg

SEQ ID NO: 5468682 - DNA, 16 bp, Homo sapiens
gtaatttaaacaggcc

SEQ ID NO: 5468683 - DNA, 22 bp, Homo sapiens
gtaatttaaacatttgttcctg

SEQ ID NO: 5468684 - DNA, 23 bp, Homo sapiens
gtaatttaaatgaaagaaaattg

SEQ ID NO: 5468685 - DNA, 15 bp, Homo sapiens
gtaatttaatgaaaa

SEQ ID NO: 5468686 - DNA, 19 bp, Homo sapiens
gtaatttaattccccttcc

SEQ ID NO: 5468687 - DNA, 23 bp, Homo sapiens
gtaatttatagtttatacagttt

SEQ ID NO: 5468688 - DNA, 14 bp, Homo sapiens
gtaatttatatggt

SEQ ID NO: 5468689 - DNA, 18 bp, Homo sapiens
gtaatttatattccattt

SEQ ID NO: 5468690 - DNA, 11 bp, Homo sapiens
gtaatttatgc

SEQ ID NO: 5468691 - DNA, 13 bp, Homo sapiens
gtaatttattgtc

SEQ ID NO: 5468692 - DNA, 15 bp, Homo sapiens
gtaatttattgtctg

SEQ ID NO: 5468693 - DNA, 21 bp, Homo sapiens
gtaatttattgtctgtctaca

SEQ ID NO: 5468694 - DNA, 12 bp, Homo sapiens
gtaatttcaaaa

SEQ ID NO: 5468695 - DNA, 19 bp, Homo sapiens
gtaatttcgccttaaactc

SEQ ID NO: 5468696 - DNA, 18 bp, Homo sapiens
gtaatttctaaagcagtt

SEQ ID NO: 5468697 - DNA, 20 bp, Homo sapiens
gtaatttctgtgtattttga

SEQ ID NO: 5468698 - DNA, 21 bp, Homo sapiens
gtaatttctgtgtattttgag

SEQ ID NO: 5468699 - DNA, 16 bp, Homo sapiens
gtaatttgaggacaac

SEQ ID NO: 5468700 - DNA, 20 bp, Homo sapiens
gtaatttgatggtatttctt

SEQ ID NO: 5468701 - DNA, 23 bp, Homo sapiens
gtaatttgatggtatttctttct

SEQ ID NO: 5468702 - DNA, 18 bp, Homo sapiens
gtaatttggatctcttct

SEQ ID NO: 5468703 - DNA, 14 bp, Homo sapiens
gtaatttgtaaagt

SEQ ID NO: 5468704 - DNA, 17 bp, Homo sapiens
gtaatttgtacaggggc

SEQ ID NO: 5468705 - DNA, 17 bp, Homo sapiens
gtaatttgtgatacaat

SEQ ID NO: 5468706 - DNA, 21 bp, Homo sapiens
gtaatttgtgtaataaagtgt

SEQ ID NO: 5468707 - DNA, 11 bp, Homo sapiens
gtaattttaaa

SEQ ID NO: 5468708 - DNA, 20 bp, Homo sapiens
gtaattttatgagctgtgag

SEQ ID NO: 5468709 - DNA, 19 bp, Homo sapiens
gtaattttattttaaaatt

SEQ ID NO: 5468710 - DNA, 23 bp, Homo sapiens
gtaattttcggatgggagagttt

SEQ ID NO: 5468711 - DNA, 13 bp, Homo sapiens
gtaattttctgat

SEQ ID NO: 5468712 - DNA, 17 bp, Homo sapiens
gtaattttgcacagaca

SEQ ID NO: 5468713 - DNA, 19 bp, Homo sapiens
gtaattttgtatcacctct

SEQ ID NO: 5468714 - DNA, 16 bp, Homo sapiens
gtaattttgtgaaaga

SEQ ID NO: 5468715 - DNA, 14 bp, Homo sapiens
gtaattttgtgtaa

SEQ ID NO: 5468716 - DNA, 13 bp, Homo sapiens
gtaatttttctgt

SEQ ID NO: 5468717 - DNA, 15 bp, Homo sapiens
gtaatttttctgtat

SEQ ID NO: 5468718 - DNA, 21 bp, Homo sapiens
gtaatttttggggaaaaaagc

SEQ ID NO: 5468719 - DNA, 14 bp, Homo sapiens
gtaattttttaaat

SEQ ID NO: 5468720 - DNA, 17 bp, Homo sapiens
gtaattttttaaatgaa

SEQ ID NO: 5468721 - DNA, 15 bp, Homo sapiens
gtaatttttttcacc

SEQ ID NO: 5468722 - DNA, 16 bp, Homo sapiens
gtaatttttttcttat

SEQ ID NO: 5468723 - DNA, 20 bp, Homo sapiens
gtaatttttttgaaaaaagt

SEQ ID NO: 5468724 - DNA, 17 bp, Homo sapiens
gtaatttttttgtaaag

SEQ ID NO: 5468725 - DNA, 22 bp, Homo sapiens
gtaattttttttgttttttgta

SEQ ID NO: 5468726 - DNA, 16 bp, Homo sapiens
gtaatttttttttgta

SEQ ID NO: 5468727 - DNA, 13 bp, Homo sapiens
gtacaaaaaagtt

SEQ ID NO: 5468728 - DNA, 15 bp, Homo sapiens
gtacaaaaaagttat

SEQ ID NO: 5468729 - DNA, 12 bp, Homo sapiens
gtacaaaaacaa

SEQ ID NO: 5468730 - DNA, 23 bp, Homo sapiens
gtacaaaaggagaagaggaacat

SEQ ID NO: 5468731 - DNA, 14 bp, Homo sapiens
gtacaaaagggaca

SEQ ID NO: 5468732 - DNA, 15 bp, Homo sapiens
gtacaaaagtaccat

SEQ ID NO: 5468733 - DNA, 16 bp, Homo sapiens
gtacaaaagtaccata

SEQ ID NO: 5468734 - DNA, 21 bp, Homo sapiens
gtacaaaataaagttacattg

SEQ ID NO: 5468735 - DNA, 18 bp, Homo sapiens
gtacaaaatgaattgcct

SEQ ID NO: 5468736 - DNA, 14 bp, Homo sapiens
gtacaaaatggtcc

SEQ ID NO: 5468737 - DNA, 14 bp, Homo sapiens
gtacaaacatgaaa

SEQ ID NO: 5468738 - DNA, 16 bp, Homo sapiens
gtacaaacatgaaaaa

SEQ ID NO: 5468739 - DNA, 18 bp, Homo sapiens
gtacaaactaaggtgcta

SEQ ID NO: 5468740 - DNA, 14 bp, Homo sapiens
gtacaaagatactt

SEQ ID NO: 5468741 - DNA, 16 bp, Homo sapiens
gtacaaagatatgcta

SEQ ID NO: 5468742 - DNA, 21 bp, Homo sapiens
gtacaaagattagtttcaatg

SEQ ID NO: 5468743 - DNA, 16 bp, Homo sapiens
gtacaaagtaaaaata

SEQ ID NO: 5468744 - DNA, 20 bp, Homo sapiens
gtacaaagtattaagcatat

SEQ ID NO: 5468745 - DNA, 17 bp, Homo sapiens
gtacaaagttttccttt

SEQ ID NO: 5468746 - DNA, 11 bp, Homo sapiens
gtacaaataaa

SEQ ID NO: 5468747 - DNA, 13 bp, Homo sapiens
gtacaaataaacc

SEQ ID NO: 5468748 - DNA, 20 bp, Homo sapiens
gtacaaataatattgccttg

SEQ ID NO: 5468749 - DNA, 22 bp, Homo sapiens
gtacaaataatttagaaataaa

SEQ ID NO: 5468750 - DNA, 13 bp, Homo sapiens
gtacaaatataag

SEQ ID NO: 5468751 - DNA, 20 bp, Homo sapiens
gtacaaatataagaataaaa

SEQ ID NO: 5468752 - DNA, 21 bp, Homo sapiens
gtacaaatattcctgtttctg

SEQ ID NO: 5468753 - DNA, 17 bp, Homo sapiens
gtacaaatgaagaaagt

SEQ ID NO: 5468754 - DNA, 18 bp, Homo sapiens
gtacaaatgtaagcaaag

SEQ ID NO: 5468755 - DNA, 15 bp, Homo sapiens
gtacaaatgtatttt

SEQ ID NO: 5468756 - DNA, 17 bp, Homo sapiens
gtacaaatgtattttga

SEQ ID NO: 5468757 - DNA, 12 bp, Homo sapiens
gtacaaatgtgt

SEQ ID NO: 5468758 - DNA, 22 bp, Homo sapiens
gtacaaattataaaaagccact

SEQ ID NO: 5468759 - DNA, 23 bp, Homo sapiens
gtacaaattatacataataaagt

SEQ ID NO: 5468760 - DNA, 22 bp, Homo sapiens
gtacaacatttatatattgtct

SEQ ID NO: 5468761 - DNA, 11 bp, Homo sapiens
gtacaaccctg

SEQ ID NO: 5468762 - DNA, 12 bp, Homo sapiens
gtacaaccctga

SEQ ID NO: 5468763 - DNA, 16 bp, Homo sapiens
gtacaaccggatgcca

SEQ ID NO: 5468764 - DNA, 17 bp, Homo sapiens
gtacaactttttaaata

SEQ ID NO: 5468765 - DNA, 15 bp, Homo sapiens
gtacaagatctcagg

SEQ ID NO: 5468766 - DNA, 14 bp, Homo sapiens
gtacaagctgtaaa

SEQ ID NO: 5468767 - DNA, 15 bp, Homo sapiens
gtacaaggggcccag

SEQ ID NO: 5468768 - DNA, 18 bp, Homo sapiens
gtacaaggtatgtacagt

SEQ ID NO: 5468769 - DNA, 17 bp, Homo sapiens
gtacaagtagttctgta

SEQ ID NO: 5468770 - DNA, 21 bp, Homo sapiens
gtacaagtagttctgtatttg

SEQ ID NO: 5468771 - DNA, 23 bp, Homo sapiens
gtacaagtatataatatgtcacc

SEQ ID NO: 5468772 - DNA, 23 bp, Homo sapiens
gtacaagtggtaatttttgtaca

SEQ ID NO: 5468773 - DNA, 17 bp, Homo sapiens
gtacaagttctggcaag

SEQ ID NO: 5468774 - DNA, 13 bp, Homo sapiens
gtacaagttgctt

SEQ ID NO: 5468775 - DNA, 20 bp, Homo sapiens
gtacaagttgctttgttaca

SEQ ID NO: 5468776 - DNA, 16 bp, Homo sapiens
gtacaagttttgtata

SEQ ID NO: 5468777 - DNA, 21 bp, Homo sapiens
gtacaataagttacttgaaat

SEQ ID NO: 5468778 - DNA, 20 bp, Homo sapiens
gtacaataatctctatttga

SEQ ID NO: 5468779 - DNA, 13 bp, Homo sapiens
gtacaatacaatg

SEQ ID NO: 5468780 - DNA, 14 bp, Homo sapiens
gtacaatacaatgt

SEQ ID NO: 5468781 - DNA, 17 bp, Homo sapiens
gtacaatacaatgtaca

SEQ ID NO: 5468782 - DNA, 20 bp, Homo sapiens
gtacaatagtatacatttta

SEQ ID NO: 5468783 - DNA, 14 bp, Homo sapiens
gtacaatattttaa

SEQ ID NO: 5468784 - DNA, 18 bp, Homo sapiens
gtacaatattttaagcat

SEQ ID NO: 5468785 - DNA, 20 bp, Homo sapiens
gtacaatattttaagcatta

SEQ ID NO: 5468786 - DNA, 24 bp, Homo sapiens
gtacaatattttaagcattactct

SEQ ID NO: 5468787 - DNA, 21 bp, Homo sapiens
gtacaatcaaaacacactact

SEQ ID NO: 5468788 - DNA, 22 bp, Homo sapiens
gtacaatcatgaacagctctga

SEQ ID NO: 5468789 - DNA, 17 bp, Homo sapiens
gtacaatcctttgagtt

SEQ ID NO: 5468790 - DNA, 23 bp, Homo sapiens
gtacaatcgacatcctagcccca

SEQ ID NO: 5468791 - DNA, 23 bp, Homo sapiens
gtacaatctttcaccaagtaaat

SEQ ID NO: 5468792 - DNA, 21 bp, Homo sapiens
gtacaatgactttattgcatc

SEQ ID NO: 5468793 - DNA, 13 bp, Homo sapiens
gtacaatggttta

SEQ ID NO: 5468794 - DNA, 12 bp, Homo sapiens
gtacaatgtgag

SEQ ID NO: 5468795 - DNA, 21 bp, Homo sapiens
gtacaattaattatcttttca

SEQ ID NO: 5468796 - DNA, 13 bp, Homo sapiens
gtacaattactgt

SEQ ID NO: 5468797 - DNA, 14 bp, Homo sapiens
gtacaattatgtct

SEQ ID NO: 5468798 - DNA, 18 bp, Homo sapiens
gtacaattctttgttgct

SEQ ID NO: 5468799 - DNA, 14 bp, Homo sapiens
gtacaattgatctt

SEQ ID NO: 5468800 - DNA, 23 bp, Homo sapiens
gtacaattttaaagttcttattt

SEQ ID NO: 5468801 - DNA, 22 bp, Homo sapiens
gtacacaacttagaaaccaaat

SEQ ID NO: 5468802 - DNA, 21 bp, Homo sapiens
gtacacaccctccagcacaga

SEQ ID NO: 5468803 - DNA, 23 bp, Homo sapiens
gtacacaccctccagcacagact

SEQ ID NO: 5468804 - DNA, 14 bp, Homo sapiens
gtacacactttatt

SEQ ID NO: 5468805 - DNA, 15 bp, Homo sapiens
gtacacactttattt

SEQ ID NO: 5468806 - DNA, 15 bp, Homo sapiens
gtacacagagctaag

SEQ ID NO: 5468807 - DNA, 20 bp, Homo sapiens
gtacacagagctaaggccaa

SEQ ID NO: 5468808 - DNA, 19 bp, Homo sapiens
gtacacagagggacttgag

SEQ ID NO: 5468809 - DNA, 20 bp, Homo sapiens
gtacacagagggacttgagc

SEQ ID NO: 5468810 - DNA, 14 bp, Homo sapiens
gtacacataagcca

SEQ ID NO: 5468811 - DNA, 23 bp, Homo sapiens
gtacacatctattctcaaagcta

SEQ ID NO: 5468812 - DNA, 14 bp, Homo sapiens
gtacacatttctta

SEQ ID NO: 5468813 - DNA, 21 bp, Homo sapiens
gtacacatttcttaaaacaca

SEQ ID NO: 5468814 - DNA, 14 bp, Homo sapiens
gtacaccccacctc

SEQ ID NO: 5468815 - DNA, 14 bp, Homo sapiens
gtacacctccccct

SEQ ID NO: 5468816 - DNA, 15 bp, Homo sapiens
gtacacctgcggggc

SEQ ID NO: 5468817 - DNA, 18 bp, Homo sapiens
gtacacgggaccagctca

SEQ ID NO: 5468818 - DNA, 14 bp, Homo sapiens
gtacacgtgtaaca

SEQ ID NO: 5468819 - DNA, 12 bp, Homo sapiens
gtacactaacat

SEQ ID NO: 5468820 - DNA, 22 bp, Homo sapiens
gtacactcagccactgtcacag

SEQ ID NO: 5468821 - DNA, 14 bp, Homo sapiens
gtacactctgctgt

SEQ ID NO: 5468822 - DNA, 14 bp, Homo sapiens
gtacactgaatatt

SEQ ID NO: 5468823 - DNA, 17 bp, Homo sapiens
gtacactgcatctcaag

SEQ ID NO: 5468824 - DNA, 12 bp, Homo sapiens
gtacactgctgt

SEQ ID NO: 5468825 - DNA, 11 bp, Homo sapiens
gtacactgtgt

SEQ ID NO: 5468826 - DNA, 23 bp, Homo sapiens
gtacactgttcccaatatgtagc

SEQ ID NO: 5468827 - DNA, 19 bp, Homo sapiens
gtactgttcatacagtttt

SEQ ID NO: 5468828 - DNA, 14 bp, Homo sapiens
gtactgttctgtgt

SEQ ID NO: 5468829 - DNA, 15 bp, Homo sapiens
gtactgttctgtgtc

SEQ ID NO: 5468830 - DNA, 18 bp, Homo sapiens
gtactgttctgtgtcttt

SEQ ID NO: 5468831 - DNA, 19 bp, Homo sapiens
gtactgttgaaaaagataa

SEQ ID NO: 5468832 - DNA, 18 bp, Homo sapiens
gtactgttgctttaatat

SEQ ID NO: 5468833 - DNA, 18 bp, Homo sapiens
gtactgttttctgggcca

SEQ ID NO: 5468834 - DNA, 14 bp, Homo sapiens
gtacttaactgtgt

SEQ ID NO: 5468835 - DNA, 21 bp, Homo sapiens
gtacttaagctcccctgcctt

SEQ ID NO: 5468836 - DNA, 22 bp, Homo sapiens
gtacttaagctcccctgcctta

SEQ ID NO: 5468837 - DNA, 15 bp, Homo sapiens
gtacttaataaattc

SEQ ID NO: 5468838 - DNA, 20 bp, Homo sapiens
gtacttaatttacttaagtg

SEQ ID NO: 5468839 - DNA, 21 bp, Homo sapiens
gtacttacactgaaatccaaa

SEQ ID NO: 5468840 - DNA, 16 bp, Homo sapiens
gtacttacccggagaa

SEQ ID NO: 5468841 - DNA, 23 bp, Homo sapiens
gtacttacccggagaaggccgct

SEQ ID NO: 5468842 - DNA, 17 bp, Homo sapiens
gtacttagagtttctgt

SEQ ID NO: 5468843 - DNA, 19 bp, Homo sapiens
gtacttagccagttcaaag

SEQ ID NO: 5468844 - DNA, 23 bp, Homo sapiens
gtacttaggcttggctgccctgt

SEQ ID NO: 5468845 - DNA, 20 bp, Homo sapiens
gtacttattttccaataaaa

SEQ ID NO: 5468846 - DNA, 21 bp, Homo sapiens
gtacttcaaatccttgaagat

SEQ ID NO: 5468847 - DNA, 21 bp, Homo sapiens
gtacttcactgtcaggaagaa

SEQ ID NO: 5468848 - DNA, 14 bp, Homo sapiens
gtacttcagcaaga

SEQ ID NO: 5468849 - DNA, 17 bp, Homo sapiens
gtacttcagtcttggag

SEQ ID NO: 5468850 - DNA, 14 bp, Homo sapiens
gtacttccactgat

SEQ ID NO: 5468851 - DNA, 20 bp, Homo sapiens
gtacttcccgggccagggct

SEQ ID NO: 5468852 - DNA, 15 bp, Homo sapiens
gtacttcctcctgat

SEQ ID NO: 5468853 - DNA, 18 bp, Homo sapiens
gtacttcctcctgatggc

SEQ ID NO: 5468854 - DNA, 19 bp, Homo sapiens
gtacttcctctaggaaatg

SEQ ID NO: 5468855 - DNA, 16 bp, Homo sapiens
gtacttcctctgtgaa

SEQ ID NO: 5468856 - DNA, 21 bp, Homo sapiens
gtacttcctctgtgaactgtg

SEQ ID NO: 5468857 - DNA, 12 bp, Homo sapiens
gtacttcctgtg

SEQ ID NO: 5468858 - DNA, 13 bp, Homo sapiens
gtacttcctgtgt

SEQ ID NO: 5468859 - DNA, 12 bp, Homo sapiens
gtacttctaaga

SEQ ID NO: 5468860 - DNA, 16 bp, Homo sapiens
gtacttctccaccctg

SEQ ID NO: 5468861 - DNA, 21 bp, Homo sapiens
gtacttctccaccctgctctc

SEQ ID NO: 5468862 - DNA, 15 bp, Homo sapiens
gtacttctgtgttca

SEQ ID NO: 5468863 - DNA, 16 bp, Homo sapiens
gtacttcttattgcaa

SEQ ID NO: 5468864 - DNA, 23 bp, Homo sapiens
gtacttcttcatccatagacaca

SEQ ID NO: 5468865 - DNA, 18 bp, Homo sapiens
gtacttcttctgtaatat

SEQ ID NO: 5468866 - DNA, 18 bp, Homo sapiens
gtacttcttgaatataaa

SEQ ID NO: 5468867 - DNA, 21 bp, Homo sapiens
gtacttgaccgtttttatatt

SEQ ID NO: 5468868 - DNA, 24 bp, Homo sapiens
gtacttgaccgtttttatattact

SEQ ID NO: 5468869 - DNA, 22 bp, Homo sapiens
gtacttgactacctactggtgt

SEQ ID NO: 5468870 - DNA, 14 bp, Homo sapiens
gtacttgatactga

SEQ ID NO: 5468871 - DNA, 21 bp, Homo sapiens
gtacttgatttttcaaagact

SEQ ID NO: 5468872 - DNA, 22 bp, Homo sapiens
gtacttgccctgaccatgcatt

SEQ ID NO: 5468873 - DNA, 23 bp, Homo sapiens
gtacttgccctgaccatgcattt

SEQ ID NO: 5468874 - DNA, 17 bp, Homo sapiens
gtacttgctcaataaag

SEQ ID NO: 5468875 - DNA, 18 bp, Homo sapiens
gtacttgctccttttgct

SEQ ID NO: 5468876 - DNA, 12 bp, Homo sapiens
gtacttgctctc

SEQ ID NO: 5468877 - DNA, 18 bp, Homo sapiens
gtacttgctcttgatgcc

SEQ ID NO: 5468878 - DNA, 18 bp, Homo sapiens
gtacttgctgctatttta

SEQ ID NO: 5468879 - DNA, 16 bp, Homo sapiens
gtacttggagggctca

SEQ ID NO: 5468880 - DNA, 13 bp, Homo sapiens
gtacttggcacca

SEQ ID NO: 5468881 - DNA, 23 bp, Homo sapiens
gtacttggcccccttcaggagcc

SEQ ID NO: 5468882 - DNA, 13 bp, Homo sapiens
gtacttggtccaa

SEQ ID NO: 5468883 - DNA, 15 bp, Homo sapiens
gtacttggtccaact

SEQ ID NO: 5468884 - DNA, 18 bp, Homo sapiens
gtacttgtaatatgtata

SEQ ID NO: 5468885 - DNA, 23 bp, Homo sapiens
gtacttgtcctcagcttgggctt

SEQ ID NO: 5468886 - DNA, 20 bp, Homo sapiens
gtacttgtgaaacacagctg

SEQ ID NO: 5468887 - DNA, 21 bp, Homo sapiens
gtacttgtgaaacacagctgt

SEQ ID NO: 5468888 - DNA, 20 bp, Homo sapiens
gtacttgtggacacagctct

SEQ ID NO: 5468889 - DNA, 16 bp, Homo sapiens
gtacttgtttctctgt

SEQ ID NO: 5468890 - DNA, 15 bp, Homo sapiens
gtacttgtttgctat

SEQ ID NO: 5468891 - DNA, 16 bp, Homo sapiens
gtactttaaaaaggaa

SEQ ID NO: 5468892 - DNA, 14 bp, Homo sapiens
gtactttaaaaatt

SEQ ID NO: 5468893 - DNA, 21 bp, Homo sapiens
gtactttagggaaacctttgc

SEQ ID NO: 5468894 - DNA, 19 bp, Homo sapiens
gtactttatattttctata

SEQ ID NO: 5468895 - DNA, 22 bp, Homo sapiens
gtactttatgaaaaaaatatat

SEQ ID NO: 5468896 - DNA, 18 bp, Homo sapiens
gtactttattcttgctgg

SEQ ID NO: 5468897 - DNA, 16 bp, Homo sapiens
gtactttcacatctct

SEQ ID NO: 5468898 - DNA, 21 bp, Homo sapiens
gtactttcacatctctgtaga

SEQ ID NO: 5468899 - DNA, 20 bp, Homo sapiens
gtactttcccaggttgacta

SEQ ID NO: 5468900 - DNA, 23 bp, Homo sapiens
gtactttctatctcatctgtctc

SEQ ID NO: 5468901 - DNA, 16 bp, Homo sapiens
gtactttctgttaaaa

SEQ ID NO: 5468902 - DNA, 23 bp, Homo sapiens
gtactttgtctaagaaacattgg

SEQ ID NO: 5468903 - DNA, 20 bp, Homo sapiens
gtactttgttaaaaacactg

SEQ ID NO: 5468904 - DNA, 12 bp, Homo sapiens
gtactttgtttt

SEQ ID NO: 5468905 - DNA, 23 bp, Homo sapiens
gtactttgtttttccatgtgttt

SEQ ID NO: 5468906 - DNA, 16 bp, Homo sapiens
gtacttttaaaaacat

SEQ ID NO: 5468907 - DNA, 17 bp, Homo sapiens
gtacttttaaaaacata

SEQ ID NO: 5468908 - DNA, 15 bp, Homo sapiens
gtacttttattgatg

SEQ ID NO: 5468909 - DNA, 17 bp, Homo sapiens
gtacttttcattctctt

SEQ ID NO: 5468910 - DNA, 22 bp, Homo sapiens
gtacttttcattctcttttaat

SEQ ID NO: 5468911 - DNA, 14 bp, Homo sapiens
gtacttttccattt

SEQ ID NO: 5468912 - DNA, 13 bp, Homo sapiens
gtacttttccttt

SEQ ID NO: 5468913 - DNA, 19 bp, Homo sapiens
gtacttttctggttccaaa

SEQ ID NO: 5468914 - DNA, 20 bp, Homo sapiens
gtacttttctggttccaaac

SEQ ID NO: 5468915 - DNA, 23 bp, Homo sapiens
gtacttttgtgttactgcagtga

SEQ ID NO: 5468916 - DNA, 15 bp, Homo sapiens
gtactttttgtgaag

SEQ ID NO: 5468917 - DNA, 13 bp, Homo sapiens
gtactttttgttt

SEQ ID NO: 5468918 - DNA, 16 bp, Homo sapiens
gtacttttttcaaata

SEQ ID NO: 5468919 - DNA, 16 bp, Homo sapiens
gtacttttttcttaag

SEQ ID NO: 5468920 - DNA, 20 bp, Homo sapiens
gtagaaaaaaaaattcacat

SEQ ID NO: 5468921 - DNA, 22 bp, Homo sapiens
gtagaaaaaggggcctgagtgg

SEQ ID NO: 5468922 - DNA, 10 bp, Homo sapiens
gtagaaaaat

SEQ ID NO: 5468923 - DNA, 15 bp, Homo sapiens
gtagaaaaataaaga

SEQ ID NO: 5468924 - DNA, 19 bp, Homo sapiens
gtagaaaaattattagaac

SEQ ID NO: 5468925 - DNA, 16 bp, Homo sapiens
gtagaaaaattgtttc

SEQ ID NO: 5468926 - DNA, 16 bp, Homo sapiens
gtagaaaactccaggg

SEQ ID NO: 5468927 - DNA, 23 bp, Homo sapiens
gtagaaaacttcaaggaaaataa

SEQ ID NO: 5468928 - DNA, 18 bp, Homo sapiens
gtagaaaagaaaacattt

SEQ ID NO: 5468929 - DNA, 18 bp, Homo sapiens
gtagaaaagagacttctc

SEQ ID NO: 5468930 - DNA, 20 bp, Homo sapiens
gtagaaaagggaactgaaca

SEQ ID NO: 5468931 - DNA, 13 bp, Homo sapiens
gtagaaaatgtga

SEQ ID NO: 5468932 - DNA, 18 bp, Homo sapiens
gtagaaaatgtgaccctc

SEQ ID NO: 5468933 - DNA, 18 bp, Homo sapiens
gtagaaacacagttttga

SEQ ID NO: 5468934 - DNA, 21 bp, Homo sapiens
gtagaaagacagagctgggat

SEQ ID NO: 5468935 - DNA, 21 bp, Homo sapiens
gtagaaagacatctgcctgta

SEQ ID NO: 5468936 - DNA, 21 bp, Homo sapiens
gtagaaagcaaacaaaattgt

SEQ ID NO: 5468937 - DNA, 17 bp, Homo sapiens
gtagaaagctaatacaa

SEQ ID NO: 5468938 - DNA, 21 bp, Homo sapiens
gtagaaagctaatacaaaact

SEQ ID NO: 5468939 - DNA, 17 bp, Homo sapiens
gtagaaaggcctttaaa

SEQ ID NO: 5468940 - DNA, 22 bp, Homo sapiens
gtagaaagttgtaaaatagaaa

SEQ ID NO: 5468941 - DNA, 17 bp, Homo sapiens
gtagaaataatatgcat

SEQ ID NO: 5468942 - DNA, 12 bp, Homo sapiens
gtagaaatgatt

SEQ ID NO: 5468943 - DNA, 22 bp, Homo sapiens
gtagaaatggttgtattagatg

SEQ ID NO: 5468944 - DNA, 15 bp, Homo sapiens
gtagaaattcttaat

SEQ ID NO: 5468945 - DNA, 22 bp, Homo sapiens
gtagaaattttatctcttcttc

SEQ ID NO: 5468946 - DNA, 22 bp, Homo sapiens
gtagaacacaaggtcatttgct

SEQ ID NO: 5468947 - DNA, 16 bp, Homo sapiens
gtagaactcactctgg

SEQ ID NO: 5468948 - DNA, 19 bp, Homo sapiens
gtagaactcactctgggct

SEQ ID NO: 5468949 - DNA, 20 bp, Homo sapiens
gtagaactcactctgggctg

SEQ ID NO: 5468950 - DNA, 13 bp, Homo sapiens
gtagaactcagca

SEQ ID NO: 5468951 - DNA, 12 bp, Homo sapiens
gtagaactctgc

SEQ ID NO: 5468952 - DNA, 17 bp, Homo sapiens
gtagaactttaaaagaa

SEQ ID NO: 5468953 - DNA, 20 bp, Homo sapiens
gtagaactttattaagtaaa

SEQ ID NO: 5468954 - DNA, 15 bp, Homo sapiens
gtagaagaaagcaaa

SEQ ID NO: 5468955 - DNA, 19 bp, Homo sapiens
gtagaagaagtgaacactt

SEQ ID NO: 5468956 - DNA, 16 bp, Homo sapiens
gtagaagagggagaag

SEQ ID NO: 5468957 - DNA, 12 bp, Homo sapiens
gtagaagatggc

SEQ ID NO: 5468958 - DNA, 20 bp, Homo sapiens
gtagaagatttgatgctgga

SEQ ID NO: 5468959 - DNA, 18 bp, Homo sapiens
gtagaagcaaaggcagga

SEQ ID NO: 5468960 - DNA, 11 bp, Homo sapiens
gtagaagccac

SEQ ID NO: 5468961 - DNA, 15 bp, Homo sapiens
gtagaagccaccctt

SEQ ID NO: 5468962 - DNA, 21 bp, Homo sapiens
gtagaagccacccttccctgc

SEQ ID NO: 5468963 - DNA, 15 bp, Homo sapiens
gtagaaggagccttg

SEQ ID NO: 5468964 - DNA, 12 bp, Homo sapiens
gtagaaggcaca

SEQ ID NO: 5468965 - DNA, 14 bp, Homo sapiens
gtagaagggaaagc

SEQ ID NO: 5468966 - DNA, 19 bp, Homo sapiens
gtagaaggttgacacagtt

SEQ ID NO: 5468967 - DNA, 12 bp, Homo sapiens
gtagaagtagtt

SEQ ID NO: 5468968 - DNA, 21 bp, Homo sapiens
gtagaagtcttagatgtatat

SEQ ID NO: 5468969 - DNA, 21 bp, Homo sapiens
gtagaagtgagtttgtaaata

SEQ ID NO: 5468970 - DNA, 14 bp, Homo sapiens
gtagaagtttttgt

SEQ ID NO: 5468971 - DNA, 19 bp, Homo sapiens
gtagaagtttttgtactgt

SEQ ID NO: 5468972 - DNA, 17 bp, Homo sapiens
gtagaataaatgaagaa

SEQ ID NO: 5468973 - DNA, 14 bp, Homo sapiens
gtagaataataata

SEQ ID NO: 5468974 - DNA, 19 bp, Homo sapiens
gtagaatagcctgtggcct

SEQ ID NO: 5468975 - DNA, 15 bp, Homo sapiens
gtagaataggcaggg

SEQ ID NO: 5468976 - DNA, 14 bp, Homo sapiens
gtagaatctgtgta

SEQ ID NO: 5468977 - DNA, 17 bp, Homo sapiens
gtagaatgctgtagaat

SEQ ID NO: 5468978 - DNA, 23 bp, Homo sapiens
gtagaatggttgagtgcaaatcc

SEQ ID NO: 5468979 - DNA, 19 bp, Homo sapiens
gtagaatgtaaagcttgtc

SEQ ID NO: 5468980 - DNA, 19 bp, Homo sapiens
gtagaatgtattgtacctt

SEQ ID NO: 5468981 - DNA, 15 bp, Homo sapiens
gtagaattatatcta

SEQ ID NO: 5468982 - DNA, 22 bp, Homo sapiens
gtagaattatctaatttataaa

SEQ ID NO: 5468983 - DNA, 13 bp, Homo sapiens
gtagaattccttc

SEQ ID NO: 5468984 - DNA, 21 bp, Homo sapiens
gtagaattcgcagtgatatac

SEQ ID NO: 5468985 - DNA, 17 bp, Homo sapiens
gtagaattgaaaatgca

SEQ ID NO: 5468986 - DNA, 15 bp, Homo sapiens
gtagaattgcattga

SEQ ID NO: 5468987 - DNA, 18 bp, Homo sapiens
gtagaattgggaagctgg

SEQ ID NO: 5468988 - DNA, 14 bp, Homo sapiens
gtagaattgtatat

SEQ ID NO: 5468989 - DNA, 15 bp, Homo sapiens
gtagacaactggtcc

SEQ ID NO: 5468990 - DNA, 21 bp, Homo sapiens
gtagacacactatcatagtta

SEQ ID NO: 5468991 - DNA, 14 bp, Homo sapiens
gtagacacttactt

SEQ ID NO: 5468992 - DNA, 16 bp, Homo sapiens
gtagacagttgggttt

SEQ ID NO: 5468993 - DNA, 15 bp, Homo sapiens
gtagacatttataac

SEQ ID NO: 5468994 - DNA, 21 bp, Homo sapiens
gtagacattttaacaagaaga

SEQ ID NO: 5468995 - DNA, 14 bp, Homo sapiens
gtagaccaaaataa

SEQ ID NO: 5468996 - DNA, 15 bp, Homo sapiens
gtagaccactgtcct

SEQ ID NO: 5468997 - DNA, 15 bp, Homo sapiens
gtagacccctggctg

SEQ ID NO: 5468998 - DNA, 16 bp, Homo sapiens
gtagacctagggagga

SEQ ID NO: 5468999 - DNA, 20 bp, Homo sapiens
gtagacctagggaggacctt

SEQ ID NO: 5469000 - DNA, 16 bp, Homo sapiens
gtagacctgattttca

SEQ ID NO: 5469001 - DNA, 18 bp, Homo sapiens
gtagacctgattttcaaa

SEQ ID NO: 5469002 - DNA, 22 bp, Homo sapiens
gtagaccttgagggtgggccag

SEQ ID NO: 5469003 - DNA, 23 bp, Homo sapiens
gtagacgtgcacgcacactgtct

SEQ ID NO: 5469004 - DNA, 13 bp, Homo sapiens
tccagcccctcct

SEQ ID NO: 5469005 - DNA, 23 bp, Homo sapiens
tccagcccctctggtcgctcctg

SEQ ID NO: 5469006 - DNA, 22 bp, Homo sapiens
tccagcccctggatgcagcctc

SEQ ID NO: 5469007 - DNA, 13 bp, Homo sapiens
tccagcccctgtc

SEQ ID NO: 5469008 - DNA, 20 bp, Homo sapiens
tccagccccttcaattattt

SEQ ID NO: 5469009 - DNA, 18 bp, Homo sapiens
tccagccccttctcagaa

SEQ ID NO: 5469010 - DNA, 21 bp, Homo sapiens
tccagccccttctcagaatct

SEQ ID NO: 5469011 - DNA, 16 bp, Homo sapiens
tccagcccctttccaa

SEQ ID NO: 5469012 - DNA, 17 bp, Homo sapiens
tccagcccctttccaaa

SEQ ID NO: 5469013 - DNA, 22 bp, Homo sapiens
tccagcccctttgcctctgtcc

SEQ ID NO: 5469014 - DNA, 14 bp, Homo sapiens
tccagcccgggagc

SEQ ID NO: 5469015 - DNA, 18 bp, Homo sapiens
tccagcccgggagcctag

SEQ ID NO: 5469016 - DNA, 19 bp, Homo sapiens
tccagccctattctgccac

SEQ ID NO: 5469017 - DNA, 11 bp, Homo sapiens
tccagccctcc

SEQ ID NO: 5469018 - DNA, 18 bp, Homo sapiens
tccagccctccgccagcc

SEQ ID NO: 5469019 - DNA, 21 bp, Homo sapiens
tccagccctccgccagccctg

SEQ ID NO: 5469020 - DNA, 23 bp, Homo sapiens
tccagccctgactaaactaccac

SEQ ID NO: 5469021 - DNA, 19 bp, Homo sapiens
tccagccctgcccaccctc

SEQ ID NO: 5469022 - DNA, 17 bp, Homo sapiens
tccagccctggctgaag

SEQ ID NO: 5469023 - DNA, 21 bp, Homo sapiens
tccagccctggctgaaggact

SEQ ID NO: 5469024 - DNA, 13 bp, Homo sapiens
tccagccctgggc

SEQ ID NO: 5469025 - DNA, 17 bp, Homo sapiens
tccagccgaagctgcag

SEQ ID NO: 5469026 - DNA, 21 bp, Homo sapiens
tccagccgccattgccaccag

SEQ ID NO: 5469027 - DNA, 21 bp, Homo sapiens
tccagccgtgtgtgcatgtgc

SEQ ID NO: 5469028 - DNA, 12 bp, Homo sapiens
tccagcctagag

SEQ ID NO: 5469029 - DNA, 11 bp, Homo sapiens
tccagcctcac

SEQ ID NO: 5469030 - DNA, 21 bp, Homo sapiens
tccagcctcacagatgctggc

SEQ ID NO: 5469031 - DNA, 15 bp, Homo sapiens
tccagcctcagcccc

SEQ ID NO: 5469032 - DNA, 12 bp, Homo sapiens
tccagcctccag

SEQ ID NO: 5469033 - DNA, 15 bp, Homo sapiens
tccagcctcccctcc

SEQ ID NO: 5469034 - DNA, 20 bp, Homo sapiens
tccagcctcccctcccctgg

SEQ ID NO: 5469035 - DNA, 20 bp, Homo sapiens
tccagcctccctgtctccag

SEQ ID NO: 5469036 - DNA, 16 bp, Homo sapiens
tccagcctcctgctgg

SEQ ID NO: 5469037 - DNA, 17 bp, Homo sapiens
tccagcctctcccggct

SEQ ID NO: 5469038 - DNA, 19 bp, Homo sapiens
tccagcctctcccggctgc

SEQ ID NO: 5469039 - DNA, 13 bp, Homo sapiens
tccagcctctgcc

SEQ ID NO: 5469040 - DNA, 21 bp, Homo sapiens
tccagcctctgccgctgccat

SEQ ID NO: 5469041 - DNA, 21 bp, Homo sapiens
tccagcctctgttcccctagt

SEQ ID NO: 5469042 - DNA, 14 bp, Homo sapiens
tccagcctgaagag

SEQ ID NO: 5469043 - DNA, 21 bp, Homo sapiens
tccagcctgacatcaaaaaag

SEQ ID NO: 5469044 - DNA, 20 bp, Homo sapiens
tccagcctgagatgtaggct

SEQ ID NO: 5469045 - DNA, 20 bp, Homo sapiens
tccagcctgagcgacagtga

SEQ ID NO: 5469046 - DNA, 20 bp, Homo sapiens
tccagcctgagtgacagagc

SEQ ID NO: 5469047 - DNA, 24 bp, Homo sapiens
tccagcctgagtgacagagcgaga

SEQ ID NO: 5469048 - DNA, 13 bp, Homo sapiens
tccagcctgccac

SEQ ID NO: 5469049 - DNA, 20 bp, Homo sapiens
tccagcctgcccaagcccag

SEQ ID NO: 5469050 - DNA, 16 bp, Homo sapiens
tccagcctgccccgga

SEQ ID NO: 5469051 - DNA, 20 bp, Homo sapiens
tccagcctgctgcctgcttt

SEQ ID NO: 5469052 - DNA, 12 bp, Homo sapiens
tccagcctggac

SEQ ID NO: 5469053 - DNA, 17 bp, Homo sapiens
tccagcctggaccccca

SEQ ID NO: 5469054 - DNA, 18 bp, Homo sapiens
tccagcctggacccccag

SEQ ID NO: 5469055 - DNA, 22 bp, Homo sapiens
tccagcctggacccccagcttt

SEQ ID NO: 5469056 - DNA, 17 bp, Homo sapiens
tccagcctgggacacac

SEQ ID NO: 5469057 - DNA, 12 bp, Homo sapiens
tccagcctgggc

SEQ ID NO: 5469058 - DNA, 18 bp, Homo sapiens
tccagcctgggcgacaga

SEQ ID NO: 5469059 - DNA, 13 bp, Homo sapiens
tccagcctgggga

SEQ ID NO: 5469060 - DNA, 18 bp, Homo sapiens
tccagcctggggacccca

SEQ ID NO: 5469061 - DNA, 19 bp, Homo sapiens
tccagcctggggaccccac

SEQ ID NO: 5469062 - DNA, 20 bp, Homo sapiens
tccagcctggggaccccact

SEQ ID NO: 5469063 - DNA, 17 bp, Homo sapiens
tccagcctggggtctgg

SEQ ID NO: 5469064 - DNA, 20 bp, Homo sapiens
tccagcctgggtcacagagt

SEQ ID NO: 5469065 - DNA, 23 bp, Homo sapiens
tccagcctgggtcacagagtgag

SEQ ID NO: 5469066 - DNA, 17 bp, Homo sapiens
tccagcctgggtgacag

SEQ ID NO: 5469067 - DNA, 24 bp, Homo sapiens
tccagcctgggtgacagagcaagt

SEQ ID NO: 5469068 - DNA, 13 bp, Homo sapiens
tccagcctggtgg

SEQ ID NO: 5469069 - DNA, 22 bp, Homo sapiens
tccagcctggtggcccagctat

SEQ ID NO: 5469070 - DNA, 20 bp, Homo sapiens
tccagcctggtttagcctgg

SEQ ID NO: 5469071 - DNA, 21 bp, Homo sapiens
tccagcctgtcggccacaccc

SEQ ID NO: 5469072 - DNA, 22 bp, Homo sapiens
tccagcctgtcggccacacccc

SEQ ID NO: 5469073 - DNA, 23 bp, Homo sapiens
tccagcctgtcggccacacccca

SEQ ID NO: 5469074 - DNA, 23 bp, Homo sapiens
tccagccttaatagacttctctt

SEQ ID NO: 5469075 - DNA, 20 bp, Homo sapiens
tccagccttatgtgttacat

SEQ ID NO: 5469076 - DNA, 14 bp, Homo sapiens
tccagccttccagg

SEQ ID NO: 5469077 - DNA, 15 bp, Homo sapiens
tccagccttccaggt

SEQ ID NO: 5469078 - DNA, 14 bp, Homo sapiens
tccagcgaaatggt

SEQ ID NO: 5469079 - DNA, 20 bp, Homo sapiens
tccagcgatggtgctgccca

SEQ ID NO: 5469080 - DNA, 21 bp, Homo sapiens
tccagcgcctgccctccctgg

SEQ ID NO: 5469081 - DNA, 19 bp, Homo sapiens
tccagcggggcttctgggc

SEQ ID NO: 5469082 - DNA, 19 bp, Homo sapiens
tccagcggttgcctttttt

SEQ ID NO: 5469083 - DNA, 20 bp, Homo sapiens
tccagcgtcactccagtgct

SEQ ID NO: 5469084 - DNA, 14 bp, Homo sapiens
tccagcgtcctcag

SEQ ID NO: 5469085 - DNA, 18 bp, Homo sapiens
tccagcgtctgctgttga

SEQ ID NO: 5469086 - DNA, 16 bp, Homo sapiens
tccagcgtcttctaga

SEQ ID NO: 5469087 - DNA, 17 bp, Homo sapiens
tccagcgtggtgtgaga

SEQ ID NO: 5469088 - DNA, 20 bp, Homo sapiens
tccagctagtgacccacatg

SEQ ID NO: 5469089 - DNA, 20 bp, Homo sapiens
tccagctataacagtaggga

SEQ ID NO: 5469090 - DNA, 14 bp, Homo sapiens
tccagctcaccagc

SEQ ID NO: 5469091 - DNA, 17 bp, Homo sapiens
tccagctcaccagcccc

SEQ ID NO: 5469092 - DNA, 20 bp, Homo sapiens
tccagctcagaacccagggc

SEQ ID NO: 5469093 - DNA, 23 bp, Homo sapiens
tccagctcagccctggcctggct

SEQ ID NO: 5469094 - DNA, 11 bp, Homo sapiens
tccagctcagt

SEQ ID NO: 5469095 - DNA, 12 bp, Homo sapiens
tccagctcagtc

SEQ ID NO: 5469096 - DNA, 14 bp, Homo sapiens
tccagctcagtccc

SEQ ID NO: 5469097 - DNA, 22 bp, Homo sapiens
tccagctcagtcccacagcccc

SEQ ID NO: 5469098 - DNA, 16 bp, Homo sapiens
tccagctcatctgcca

SEQ ID NO: 5469099 - DNA, 16 bp, Homo sapiens
tccagctcattcattt

SEQ ID NO: 5469100 - DNA, 19 bp, Homo sapiens
tccagctcattcattttat

SEQ ID NO: 5469101 - DNA, 10 bp, Homo sapiens
tccagctcca

SEQ ID NO: 5469102 - DNA, 12 bp, Homo sapiens
tccagctccaac

SEQ ID NO: 5469103 - DNA, 16 bp, Homo sapiens
tccagctccaacctgc

SEQ ID NO: 5469104 - DNA, 15 bp, Homo sapiens
tccagctcccactcc

SEQ ID NO: 5469105 - DNA, 20 bp, Homo sapiens
tccagctcccactccctttc

SEQ ID NO: 5469106 - DNA, 18 bp, Homo sapiens
tccagctccccccaagat

SEQ ID NO: 5469107 - DNA, 15 bp, Homo sapiens
tccagctccctagac

SEQ ID NO: 5469108 - DNA, 19 bp, Homo sapiens
tccagctccctagactgca

SEQ ID NO: 5469109 - DNA, 17 bp, Homo sapiens
tccagctccctgtgccc

SEQ ID NO: 5469110 - DNA, 20 bp, Homo sapiens
tccagctccctgtgccccca

SEQ ID NO: 5469111 - DNA, 21 bp, Homo sapiens
tccagctcctctaggggcagc

SEQ ID NO: 5469112 - DNA, 18 bp, Homo sapiens
tccagctcctgccccgcc

SEQ ID NO: 5469113 - DNA, 13 bp, Homo sapiens
tccagctcctgta

SEQ ID NO: 5469114 - DNA, 18 bp, Homo sapiens
tccagctctaataaaaca

SEQ ID NO: 5469115 - DNA, 13 bp, Homo sapiens
tccagctctgaca

SEQ ID NO: 5469116 - DNA, 19 bp, Homo sapiens
tccagctctgacatccctt

SEQ ID NO: 5469117 - DNA, 23 bp, Homo sapiens
tccagctctgacatcccttcctg

SEQ ID NO: 5469118 - DNA, 13 bp, Homo sapiens
tccagctctgccc

SEQ ID NO: 5469119 - DNA, 12 bp, Homo sapiens
tccagctctgga

SEQ ID NO: 5469120 - DNA, 15 bp, Homo sapiens
tccagctctggaggg

SEQ ID NO: 5469121 - DNA, 20 bp, Homo sapiens
tccagctctggaggggaggg

SEQ ID NO: 5469122 - DNA, 22 bp, Homo sapiens
tccagctctggcttcctgctga

SEQ ID NO: 5469123 - DNA, 18 bp, Homo sapiens
tccagctctgggagccct

SEQ ID NO: 5469124 - DNA, 13 bp, Homo sapiens
tccagctctgtgg

SEQ ID NO: 5469125 - DNA, 17 bp, Homo sapiens
tccagctctgtgggccc

SEQ ID NO: 5469126 - DNA, 18 bp, Homo sapiens
tccagctctgtgggccct

SEQ ID NO: 5469127 - DNA, 11 bp, Homo sapiens
tccagctcttg

SEQ ID NO: 5469128 - DNA, 17 bp, Homo sapiens
tccagctctttagaatg

SEQ ID NO: 5469129 - DNA, 18 bp, Homo sapiens
tccagctctttcctcctt

SEQ ID NO: 5469130 - DNA, 14 bp, Homo sapiens
tccagctgactaaa

SEQ ID NO: 5469131 - DNA, 16 bp, Homo sapiens
tccagctgagcgccag

SEQ ID NO: 5469132 - DNA, 17 bp, Homo sapiens
tccagctgagtcctggg

SEQ ID NO: 5469133 - DNA, 22 bp, Homo sapiens
tccagctgattttaactttttt

SEQ ID NO: 5469134 - DNA, 13 bp, Homo sapiens
tccagctgccccg

SEQ ID NO: 5469135 - DNA, 22 bp, Homo sapiens
tccagctgccccggcccctccc

SEQ ID NO: 5469136 - DNA, 17 bp, Homo sapiens
tccagctgcctattgat

SEQ ID NO: 5469137 - DNA, 13 bp, Homo sapiens
tccagctgcctgg

SEQ ID NO: 5469138 - DNA, 16 bp, Homo sapiens
tccagctgcctgggcc

SEQ ID NO: 5469139 - DNA, 17 bp, Homo sapiens
tccagctgcctgggccc

SEQ ID NO: 5469140 - DNA, 11 bp, Homo sapiens
tccagctgctc

SEQ ID NO: 5469141 - DNA, 14 bp, Homo sapiens
tccagctgctgaga

SEQ ID NO: 5469142 - DNA, 17 bp, Homo sapiens
tccagctgctgtcttct

SEQ ID NO: 5469143 - DNA, 23 bp, Homo sapiens
tccagctggaattgctgctctct

SEQ ID NO: 5469144 - DNA, 24 bp, Homo sapiens
tccagctggaattgctgctctctg

SEQ ID NO: 5469145 - DNA, 20 bp, Homo sapiens
tccagctggatcccagggaa

SEQ ID NO: 5469146 - DNA, 11 bp, Homo sapiens
tccagctggcc

SEQ ID NO: 5469147 - DNA, 21 bp, Homo sapiens
tccagctggccgggagcctga

SEQ ID NO: 5469148 - DNA, 17 bp, Homo sapiens
tccagctggcctggaca

SEQ ID NO: 5469149 - DNA, 18 bp, Homo sapiens
tccagctggcctggacag

SEQ ID NO: 5469150 - DNA, 21 bp, Homo sapiens
tccagctgggacctaatgctg

SEQ ID NO: 5469151 - DNA, 23 bp, Homo sapiens
tccagctgggcctcctgcctccg

SEQ ID NO: 5469152 - DNA, 17 bp, Homo sapiens
tccagctggggccagag

SEQ ID NO: 5469153 - DNA, 22 bp, Homo sapiens
tccagctggggccagaggctgg

SEQ ID NO: 5469154 - DNA, 12 bp, Homo sapiens
tccagctggtgc

SEQ ID NO: 5469155 - DNA, 18 bp, Homo sapiens
tccagctggtgcccccag

SEQ ID NO: 5469156 - DNA, 22 bp, Homo sapiens
tccagctgtcagcctggttttc

SEQ ID NO: 5469157 - DNA, 14 bp, Homo sapiens
tccagctgtccccc

SEQ ID NO: 5469158 - DNA, 14 bp, Homo sapiens
tccagctgtcgtct

SEQ ID NO: 5469159 - DNA, 17 bp, Homo sapiens
tccagcttcagctcaac

SEQ ID NO: 5469160 - DNA, 14 bp, Homo sapiens
tccagcttcccgag

SEQ ID NO: 5469161 - DNA, 15 bp, Homo sapiens
tccagcttcctctga

SEQ ID NO: 5469162 - DNA, 16 bp, Homo sapiens
tccagcttcggagggc

SEQ ID NO: 5469163 - DNA, 23 bp, Homo sapiens
tccagcttctcatgttaaatatt

SEQ ID NO: 5469164 - DNA, 13 bp, Homo sapiens
tccagcttgccag

SEQ ID NO: 5469165 - DNA, 15 bp, Homo sapiens
tccagcttgctcttc

SEQ ID NO: 5469166 - DNA, 16 bp, Homo sapiens
tccagcttgctcttca

SEQ ID NO: 5469167 - DNA, 18 bp, Homo sapiens
tccagctttactgtggct

SEQ ID NO: 5469168 - DNA, 18 bp, Homo sapiens
tccagctttccttctgcc

SEQ ID NO: 5469169 - DNA, 20 bp, Homo sapiens
tccagctttccttctgccct

SEQ ID NO: 5469170 - DNA, 17 bp, Homo sapiens
tccagctttctctttgt

SEQ ID NO: 5469171 - DNA, 19 bp, Homo sapiens
tccagcttttcctcagggt

SEQ ID NO: 5469172 - DNA, 23 bp, Homo sapiens
tccagcttttgtagatggcactt

SEQ ID NO: 5469173 - DNA, 17 bp, Homo sapiens
tccaggaaaaaataaaa

SEQ ID NO: 5469174 - DNA, 19 bp, Homo sapiens
tccaggaaaaaataaaaag

SEQ ID NO: 5469175 - DNA, 21 bp, Homo sapiens
tccaggaaaaaataaaaagag

SEQ ID NO: 5469176 - DNA, 16 bp, Homo sapiens
tccaggaaaactgttt

SEQ ID NO: 5469177 - DNA, 18 bp, Homo sapiens
tccaggaaaatgtgaggg

SEQ ID NO: 5469178 - DNA, 15 bp, Homo sapiens
tccaggaaagagcag

SEQ ID NO: 5469179 - DNA, 21 bp, Homo sapiens
tccaggaaagagcagtcagag

SEQ ID NO: 5469180 - DNA, 22 bp, Homo sapiens
tccaggaaagatgtcccacagg

SEQ ID NO: 5469181 - DNA, 22 bp, Homo sapiens
tccatagttttgatgactggca

SEQ ID NO: 5469182 - DNA, 19 bp, Homo sapiens
tccatataagcccttgatt

SEQ ID NO: 5469183 - DNA, 15 bp, Homo sapiens
tccatatagtttgtt

SEQ ID NO: 5469184 - DNA, 17 bp, Homo sapiens
tccatatattagcattt

SEQ ID NO: 5469185 - DNA, 20 bp, Homo sapiens
tccatatattagcatttagt

SEQ ID NO: 5469186 - DNA, 20 bp, Homo sapiens
tccatatcagaactgtgcca

SEQ ID NO: 5469187 - DNA, 15 bp, Homo sapiens
tccatatcagacctc

SEQ ID NO: 5469188 - DNA, 23 bp, Homo sapiens
tccatatcagacctctgatccct

SEQ ID NO: 5469189 - DNA, 15 bp, Homo sapiens
tccatatcagctctg

SEQ ID NO: 5469190 - DNA, 19 bp, Homo sapiens
tccatatcagctctgcata

SEQ ID NO: 5469191 - DNA, 20 bp, Homo sapiens
tccatatcagctctgcataa

SEQ ID NO: 5469192 - DNA, 14 bp, Homo sapiens
tccatatccgggtg

SEQ ID NO: 5469193 - DNA, 16 bp, Homo sapiens
tccatatccgggtgct

SEQ ID NO: 5469194 - DNA, 20 bp, Homo sapiens
tccatatccgggtgctcaat

SEQ ID NO: 5469195 - DNA, 22 bp, Homo sapiens
tccatatccgggtgctcaataa

SEQ ID NO: 5469196 - DNA, 23 bp, Homo sapiens
tccatatccgggtgctcaataaa

SEQ ID NO: 5469197 - DNA, 13 bp, Homo sapiens
tccatatcctggt

SEQ ID NO: 5469198 - DNA, 14 bp, Homo sapiens
tccatatcctggtg

SEQ ID NO: 5469199 - DNA, 17 bp, Homo sapiens
tccatatccttctggct

SEQ ID NO: 5469200 - DNA, 22 bp, Homo sapiens
tccatatccttctggctgtaga

SEQ ID NO: 5469201 - DNA, 19 bp, Homo sapiens
tccatatctaaccagtgat

SEQ ID NO: 5469202 - DNA, 17 bp, Homo sapiens
tccatatgacctcatgc

SEQ ID NO: 5469203 - DNA, 19 bp, Homo sapiens
tccatatgacctcatgcat

SEQ ID NO: 5469204 - DNA, 24 bp, Homo sapiens
tccatatgacctcatgcatctcca

SEQ ID NO: 5469205 - DNA, 15 bp, Homo sapiens
tccatatgagggaaa

SEQ ID NO: 5469206 - DNA, 16 bp, Homo sapiens
tccatatgctccagga

SEQ ID NO: 5469207 - DNA, 20 bp, Homo sapiens
tccatatggagcatttttca

SEQ ID NO: 5469208 - DNA, 21 bp, Homo sapiens
tccatatggagcatttttcag

SEQ ID NO: 5469209 - DNA, 22 bp, Homo sapiens
tccatatggagcatttttcaga

SEQ ID NO: 5469210 - DNA, 17 bp, Homo sapiens
tccatattacgttgttt

SEQ ID NO: 5469211 - DNA, 21 bp, Homo sapiens
tccatatttaacctatttcca

SEQ ID NO: 5469212 - DNA, 13 bp, Homo sapiens
tccatatttacat

SEQ ID NO: 5469213 - DNA, 16 bp, Homo sapiens
tccatatttcaacaga

SEQ ID NO: 5469214 - DNA, 20 bp, Homo sapiens
tccatattttattactgttt

SEQ ID NO: 5469215 - DNA, 12 bp, Homo sapiens
tccatattttca

SEQ ID NO: 5469216 - DNA, 18 bp, Homo sapiens
tccatatttttttcctta

SEQ ID NO: 5469217 - DNA, 22 bp, Homo sapiens
tccatcaaacctcacatttgtg

SEQ ID NO: 5469218 - DNA, 16 bp, Homo sapiens
tccatcaaagccctcc

SEQ ID NO: 5469219 - DNA, 22 bp, Homo sapiens
tccatcaagccaagcctcctgt

SEQ ID NO: 5469220 - DNA, 15 bp, Homo sapiens
tccatcacagccagc

SEQ ID NO: 5469221 - DNA, 17 bp, Homo sapiens
tccatcaccctcttcct

SEQ ID NO: 5469222 - DNA, 23 bp, Homo sapiens
tccatcaccctcttcctgtgatc

SEQ ID NO: 5469223 - DNA, 23 bp, Homo sapiens
tccatcacctgaaacactggacc

SEQ ID NO: 5469224 - DNA, 19 bp, Homo sapiens
tccatcacgttagctgtcc

SEQ ID NO: 5469225 - DNA, 13 bp, Homo sapiens
tccatcactgaga

SEQ ID NO: 5469226 - DNA, 14 bp, Homo sapiens
tccatcagaaaacc

SEQ ID NO: 5469227 - DNA, 12 bp, Homo sapiens
tccatcagaagg

SEQ ID NO: 5469228 - DNA, 19 bp, Homo sapiens
tccatcagatgtgttcctc

SEQ ID NO: 5469229 - DNA, 16 bp, Homo sapiens
tccatcagcaatgctt

SEQ ID NO: 5469230 - DNA, 14 bp, Homo sapiens
tccatcagcagtga

SEQ ID NO: 5469231 - DNA, 16 bp, Homo sapiens
tccatcagcagtgatt

SEQ ID NO: 5469232 - DNA, 22 bp, Homo sapiens
tccatcagcgggtctcctccca

SEQ ID NO: 5469233 - DNA, 23 bp, Homo sapiens
tccatcagcgggtctcctcccag

SEQ ID NO: 5469234 - DNA, 13 bp, Homo sapiens
tccatcagctccc

SEQ ID NO: 5469235 - DNA, 14 bp, Homo sapiens
tccatcagctccct

SEQ ID NO: 5469236 - DNA, 17 bp, Homo sapiens
tccatcaggacttggga

SEQ ID NO: 5469237 - DNA, 18 bp, Homo sapiens
tccatcaggttccatccc

SEQ ID NO: 5469238 - DNA, 19 bp, Homo sapiens
tccatcaggttccatcccg

SEQ ID NO: 5469239 - DNA, 15 bp, Homo sapiens
tccatcagtgcatga

SEQ ID NO: 5469240 - DNA, 18 bp, Homo sapiens
tccatcagttagagctga

SEQ ID NO: 5469241 - DNA, 16 bp, Homo sapiens
tccatcatcactgtaa

SEQ ID NO: 5469242 - DNA, 13 bp, Homo sapiens
tccatcatcatgt

SEQ ID NO: 5469243 - DNA, 13 bp, Homo sapiens
tccatcatctgct

SEQ ID NO: 5469244 - DNA, 14 bp, Homo sapiens
tccatcatgtcccc

SEQ ID NO: 5469245 - DNA, 22 bp, Homo sapiens
tccatcatgtctgtatactcct

SEQ ID NO: 5469246 - DNA, 23 bp, Homo sapiens
tccatcatgtctgtatactcctg

SEQ ID NO: 5469247 - DNA, 13 bp, Homo sapiens
tccatcattcatc

SEQ ID NO: 5469248 - DNA, 22 bp, Homo sapiens
tccatcatttctgtctttaaga

SEQ ID NO: 5469249 - DNA, 13 bp, Homo sapiens
tccatcattttac

SEQ ID NO: 5469250 - DNA, 16 bp, Homo sapiens
tccatcattttacagt

SEQ ID NO: 5469251 - DNA, 18 bp, Homo sapiens
tccatccaaacctacctt

SEQ ID NO: 5469252 - DNA, 18 bp, Homo sapiens
tccatccacacacagcag

SEQ ID NO: 5469253 - DNA, 15 bp, Homo sapiens
tccatccacatggga

SEQ ID NO: 5469254 - DNA, 13 bp, Homo sapiens
tccatccaccacc

SEQ ID NO: 5469255 - DNA, 14 bp, Homo sapiens
tccatccaccacct

SEQ ID NO: 5469256 - DNA, 17 bp, Homo sapiens
tccatccaccaccttgc

SEQ ID NO: 5469257 - DNA, 15 bp, Homo sapiens
tccatccacccctgc

SEQ ID NO: 5469258 - DNA, 21 bp, Homo sapiens
tccatccacctcatcactgga

SEQ ID NO: 5469259 - DNA, 18 bp, Homo sapiens
tccatccacctttcccaa

SEQ ID NO: 5469260 - DNA, 15 bp, Homo sapiens
tccatccacgtggcc

SEQ ID NO: 5469261 - DNA, 22 bp, Homo sapiens
tccatccataaatccagttcta

SEQ ID NO: 5469262 - DNA, 13 bp, Homo sapiens
tccatccatcctt

SEQ ID NO: 5469263 - DNA, 14 bp, Homo sapiens
tccatccatccttc

SEQ ID NO: 5469264 - DNA, 18 bp, Homo sapiens
tccatccatgtgttccaa

SEQ ID NO: 5469265 - DNA, 17 bp, Homo sapiens
tccatccattgtgttct

SEQ ID NO: 5469266 - DNA, 17 bp, Homo sapiens
tccatcccaacacatca

SEQ ID NO: 5469267 - DNA, 19 bp, Homo sapiens
tccatcccaacagccatgc

SEQ ID NO: 5469268 - DNA, 18 bp, Homo sapiens
tccatcccaaccagtgcc

SEQ ID NO: 5469269 - DNA, 12 bp, Homo sapiens
tccatcccactc

SEQ ID NO: 5469270 - DNA, 22 bp, Homo sapiens
tccatcccaggacaccacaccc

SEQ ID NO: 5469271 - DNA, 18 bp, Homo sapiens
tccatcccaggaggccaa

SEQ ID NO: 5469272 - DNA, 16 bp, Homo sapiens
tccatcccattcactt

SEQ ID NO: 5469273 - DNA, 23 bp, Homo sapiens
tccatccccaaactgtgccctgc

SEQ ID NO: 5469274 - DNA, 12 bp, Homo sapiens
tccatccccagt

SEQ ID NO: 5469275 - DNA, 19 bp, Homo sapiens
tccatccccctctgtctgc

SEQ ID NO: 5469276 - DNA, 21 bp, Homo sapiens
tccatcccccttcttcctccc

SEQ ID NO: 5469277 - DNA, 22 bp, Homo sapiens
tccatcccccttcttcctcccc

SEQ ID NO: 5469278 - DNA, 18 bp, Homo sapiens
tccatcccctccctgcct

SEQ ID NO: 5469279 - DNA, 18 bp, Homo sapiens
tccatccctaccccctaa

SEQ ID NO: 5469280 - DNA, 20 bp, Homo sapiens
tccatccctctcctctgccc

SEQ ID NO: 5469281 - DNA, 16 bp, Homo sapiens
tccatccctgctctgg

SEQ ID NO: 5469282 - DNA, 13 bp, Homo sapiens
tccatccctggcc

SEQ ID NO: 5469283 - DNA, 15 bp, Homo sapiens
tccatcccttcccca

SEQ ID NO: 5469284 - DNA, 17 bp, Homo sapiens
tccatcccttttcctgt

SEQ ID NO: 5469285 - DNA, 20 bp, Homo sapiens
tccatcccttttcctgtcag

SEQ ID NO: 5469286 - DNA, 20 bp, Homo sapiens
tccatcctaccccctgtgcc

SEQ ID NO: 5469287 - DNA, 15 bp, Homo sapiens
tccatcctcatctct

SEQ ID NO: 5469288 - DNA, 24 bp, Homo sapiens
tccatcctcatctctcttgggcca

SEQ ID NO: 5469289 - DNA, 16 bp, Homo sapiens
tccatcctcctccttc

SEQ ID NO: 5469290 - DNA, 13 bp, Homo sapiens
tccatcctcctct

SEQ ID NO: 5469291 - DNA, 16 bp, Homo sapiens
tccatcctcctctcca

SEQ ID NO: 5469292 - DNA, 23 bp, Homo sapiens
tccatcctcctctccatgcaagt

SEQ ID NO: 5469293 - DNA, 19 bp, Homo sapiens
tccatcctcctgtgtcact

SEQ ID NO: 5469294 - DNA, 13 bp, Homo sapiens
tccatcctgagcc

SEQ ID NO: 5469295 - DNA, 23 bp, Homo sapiens
tccatcctgaggaccgccccaac

SEQ ID NO: 5469296 - DNA, 15 bp, Homo sapiens
tccatcctgaggctc

SEQ ID NO: 5469297 - DNA, 20 bp, Homo sapiens
tccatcctgaggctccactt

SEQ ID NO: 5469298 - DNA, 19 bp, Homo sapiens
tccatcctgaggtgcctcc

SEQ ID NO: 5469299 - DNA, 22 bp, Homo sapiens
tccatcctgaggtgcctcccag

SEQ ID NO: 5469300 - DNA, 23 bp, Homo sapiens
tccatcctgaggtgcctcccagt

SEQ ID NO: 5469301 - DNA, 16 bp, Homo sapiens
tccatcctgtacaagt

SEQ ID NO: 5469302 - DNA, 14 bp, Homo sapiens
tccatcctgttttt

SEQ ID NO: 5469303 - DNA, 16 bp, Homo sapiens
tccatccttaactgtc

SEQ ID NO: 5469304 - DNA, 16 bp, Homo sapiens
tccatccttgactgaa

SEQ ID NO: 5469305 - DNA, 18 bp, Homo sapiens
tccatccttgcatcactg

SEQ ID NO: 5469306 - DNA, 15 bp, Homo sapiens
tccatcctttgcatt

SEQ ID NO: 5469307 - DNA, 16 bp, Homo sapiens
tccatcctttgcattt

SEQ ID NO: 5469308 - DNA, 17 bp, Homo sapiens
tccatctagcagctggc

SEQ ID NO: 5469309 - DNA, 18 bp, Homo sapiens
tccatctccaagaatgct

SEQ ID NO: 5469310 - DNA, 18 bp, Homo sapiens
tccatctccgcctccaca

SEQ ID NO: 5469311 - DNA, 21 bp, Homo sapiens
tccatctcctataatctgtca

SEQ ID NO: 5469312 - DNA, 16 bp, Homo sapiens
tccatctcctgctcac

SEQ ID NO: 5469313 - DNA, 14 bp, Homo sapiens
tccatctcgccacc

SEQ ID NO: 5469314 - DNA, 16 bp, Homo sapiens
tccatctctcatcctc

SEQ ID NO: 5469315 - DNA, 12 bp, Homo sapiens
tccatctctctc

SEQ ID NO: 5469316 - DNA, 16 bp, Homo sapiens
tccatctctctggccc

SEQ ID NO: 5469317 - DNA, 13 bp, Homo sapiens
tccatctctgaaa

SEQ ID NO: 5469318 - DNA, 15 bp, Homo sapiens
tccatctctgaaaac

SEQ ID NO: 5469319 - DNA, 17 bp, Homo sapiens
tccatctctgaaaacaa

SEQ ID NO: 5469320 - DNA, 15 bp, Homo sapiens
tccatctcttccttt

SEQ ID NO: 5469321 - DNA, 17 bp, Homo sapiens
tccatctcttcctttcc

SEQ ID NO: 5469322 - DNA, 14 bp, Homo sapiens
tccatctcttctgc

SEQ ID NO: 5469323 - DNA, 21 bp, Homo sapiens
tccatctcttgtaccagccca

SEQ ID NO: 5469324 - DNA, 17 bp, Homo sapiens
tccatctgattccagca

SEQ ID NO: 5469325 - DNA, 19 bp, Homo sapiens
tccatctgcatcttaacat

SEQ ID NO: 5469326 - DNA, 20 bp, Homo sapiens
tccatctgcccgcctgccca

SEQ ID NO: 5469327 - DNA, 20 bp, Homo sapiens
tccatctggggatggagaat

SEQ ID NO: 5469328 - DNA, 21 bp, Homo sapiens
tccatctggttttctctccag

SEQ ID NO: 5469329 - DNA, 14 bp, Homo sapiens
tccatctgtcactt

SEQ ID NO: 5469330 - DNA, 12 bp, Homo sapiens
tccatctgtcca

SEQ ID NO: 5469331 - DNA, 16 bp, Homo sapiens
tccatctgtccgtcca

SEQ ID NO: 5469332 - DNA, 21 bp, Homo sapiens
tccatctgtccgtccagagcc

SEQ ID NO: 5469333 - DNA, 23 bp, Homo sapiens
tccatcttattcccaattaaaag

SEQ ID NO: 5469334 - DNA, 14 bp, Homo sapiens
tccatcttcagctt

SEQ ID NO: 5469335 - DNA, 21 bp, Homo sapiens
tccatcttccctacccttcct

SEQ ID NO: 5469336 - DNA, 23 bp, Homo sapiens
tccatcttctccccacagcctct

SEQ ID NO: 5469337 - DNA, 21 bp, Homo sapiens
tccatcttgagatggtgaggc

SEQ ID NO: 5469338 - DNA, 18 bp, Homo sapiens
tccatcttgagccacagt

SEQ ID NO: 5469339 - DNA, 12 bp, Homo sapiens
tccatcttgcta

SEQ ID NO: 5469340 - DNA, 18 bp, Homo sapiens
tccatcttgctttttccc

SEQ ID NO: 5469341 - DNA, 23 bp, Homo sapiens
tccatcttggtagttctgtgcct

SEQ ID NO: 5469342 - DNA, 19 bp, Homo sapiens
tccatcttgtggggccagg

SEQ ID NO: 5469343 - DNA, 20 bp, Homo sapiens
tccatcttgtggggccagga

SEQ ID NO: 5469344 - DNA, 16 bp, Homo sapiens
tccatcttgtttcatt

SEQ ID NO: 5469345 - DNA, 22 bp, Homo sapiens
tccatcttgtttcatttgcttg

SEQ ID NO: 5469346 - DNA, 18 bp, Homo sapiens
tccatctttcctgatggc

SEQ ID NO: 5469347 - DNA, 15 bp, Homo sapiens
tccatctttctacag

SEQ ID NO: 5469348 - DNA, 15 bp, Homo sapiens
tccatctttgtatat

SEQ ID NO: 5469349 - DNA, 17 bp, Homo sapiens
tccatgaaaaacagcag

SEQ ID NO: 5469350 - DNA, 15 bp, Homo sapiens
tccatgaaaacgttt

SEQ ID NO: 5469351 - DNA, 18 bp, Homo sapiens
tccatgaaaacgttttat

SEQ ID NO: 5469352 - DNA, 16 bp, Homo sapiens
tccatgaaaataaacg

SEQ ID NO: 5469353 - DNA, 13 bp, Homo sapiens
tccatgaagatgt

SEQ ID NO: 5469354 - DNA, 22 bp, Homo sapiens
tccatgaagatgtagaggagaa

SEQ ID NO: 5469355 - DNA, 15 bp, Homo sapiens
tccatgaaggcagag

SEQ ID NO: 5469356 - DNA, 19 bp, Homo sapiens
tccatgaatcgcttctctt

SEQ ID NO: 5469357 - DNA, 19 bp, Homo sapiens
tccatgacagtagcatact

SEQ ID NO: 5469358 - DNA, 20 bp, Homo sapiens
tgtccagataagttatttat

SEQ ID NO: 5469359 - DNA, 20 bp, Homo sapiens
tgtccagatgtgcaggctcc

SEQ ID NO: 5469360 - DNA, 21 bp, Homo sapiens
tgtccagcacagaaggaatct

SEQ ID NO: 5469361 - DNA, 22 bp, Homo sapiens
tgtccagcaccttgtgcctggg

SEQ ID NO: 5469362 - DNA, 15 bp, Homo sapiens
tgtccagcagtctga

SEQ ID NO: 5469363 - DNA, 19 bp, Homo sapiens
tgtccagcattgctggact

SEQ ID NO: 5469364 - DNA, 14 bp, Homo sapiens
tgtccagccacccc

SEQ ID NO: 5469365 - DNA, 15 bp, Homo sapiens
tgtccagccagctcc

SEQ ID NO: 5469366 - DNA, 12 bp, Homo sapiens
tgtccagcctgg

SEQ ID NO: 5469367 - DNA, 23 bp, Homo sapiens
tgtccagcctgggcagccaggct

SEQ ID NO: 5469368 - DNA, 17 bp, Homo sapiens
tgtccagccttaataga

SEQ ID NO: 5469369 - DNA, 19 bp, Homo sapiens
tgtccagccttaatagact

SEQ ID NO: 5469370 - DNA, 19 bp, Homo sapiens
tgtccagctagccaactcc

SEQ ID NO: 5469371 - DNA, 11 bp, Homo sapiens
tgtccagctcc

SEQ ID NO: 5469372 - DNA, 17 bp, Homo sapiens
tgtccagctgagcgcca

SEQ ID NO: 5469373 - DNA, 23 bp, Homo sapiens
tgtccagctggggccagaggctg

SEQ ID NO: 5469374 - DNA, 21 bp, Homo sapiens
tgtccaggagccccgccaggt

SEQ ID NO: 5469375 - DNA, 21 bp, Homo sapiens
tgtccaggagctaatctgacc

SEQ ID NO: 5469376 - DNA, 12 bp, Homo sapiens
tgtccaggcagc

SEQ ID NO: 5469377 - DNA, 15 bp, Homo sapiens
tgtccaggcagctcc

SEQ ID NO: 5469378 - DNA, 17 bp, Homo sapiens
tgtccaggcagctccct

SEQ ID NO: 5469379 - DNA, 16 bp, Homo sapiens
tgtccaggcccttagg

SEQ ID NO: 5469380 - DNA, 16 bp, Homo sapiens
tgtccaggctctgggc

SEQ ID NO: 5469381 - DNA, 19 bp, Homo sapiens
tgtccaggctctgggcaca

SEQ ID NO: 5469382 - DNA, 23 bp, Homo sapiens
tgtccaggctctgggcacagtgc

SEQ ID NO: 5469383 - DNA, 23 bp, Homo sapiens
tgtccaggctggtctgaaaccct

SEQ ID NO: 5469384 - DNA, 19 bp, Homo sapiens
tgtccagggaaacagcctc

SEQ ID NO: 5469385 - DNA, 22 bp, Homo sapiens
tgtccagggaaacagcctctct

SEQ ID NO: 5469386 - DNA, 12 bp, Homo sapiens
tgtccagggccc

SEQ ID NO: 5469387 - DNA, 13 bp, Homo sapiens
tgtccagggccca

SEQ ID NO: 5469388 - DNA, 16 bp, Homo sapiens
tgtccagggcccatgt

SEQ ID NO: 5469389 - DNA, 17 bp, Homo sapiens
tgtccagggcttcagat

SEQ ID NO: 5469390 - DNA, 21 bp, Homo sapiens
tgtccagggggagaaggaaga

SEQ ID NO: 5469391 - DNA, 13 bp, Homo sapiens
tgtccagggtcct

SEQ ID NO: 5469392 - DNA, 23 bp, Homo sapiens
tgtccaggtagaaaagaaatggt

SEQ ID NO: 5469393 - DNA, 13 bp, Homo sapiens
tgtccaggtcaca

SEQ ID NO: 5469394 - DNA, 21 bp, Homo sapiens
tgtccaggtctagaaggccag

SEQ ID NO: 5469395 - DNA, 22 bp, Homo sapiens
tgtccaggtctagaaggccagg

SEQ ID NO: 5469396 - DNA, 15 bp, Homo sapiens
tgtccagtccagtga

SEQ ID NO: 5469397 - DNA, 23 bp, Homo sapiens
tgtccagtgcccattcctcacct

SEQ ID NO: 5469398 - DNA, 16 bp, Homo sapiens
tgtccagtgcctacat

SEQ ID NO: 5469399 - DNA, 20 bp, Homo sapiens
tgtccatacactttgttgca

SEQ ID NO: 5469400 - DNA, 16 bp, Homo sapiens
tgtccatattttcaca

SEQ ID NO: 5469401 - DNA, 14 bp, Homo sapiens
tgtccatcagatga

SEQ ID NO: 5469402 - DNA, 16 bp, Homo sapiens
tgtccatcagatgaca

SEQ ID NO: 5469403 - DNA, 17 bp, Homo sapiens
tgtccatcagatgacaa

SEQ ID NO: 5469404 - DNA, 15 bp, Homo sapiens
tgtccatcatattaa

SEQ ID NO: 5469405 - DNA, 22 bp, Homo sapiens
tgtccatcatattaaaaatata

SEQ ID NO: 5469406 - DNA, 11 bp, Homo sapiens
tgtccatccct

SEQ ID NO: 5469407 - DNA, 14 bp, Homo sapiens
tgtccatccctttt

SEQ ID NO: 5469408 - DNA, 18 bp, Homo sapiens
tgtccatcccttttcctg

SEQ ID NO: 5469409 - DNA, 13 bp, Homo sapiens
tgtccatctgccc

SEQ ID NO: 5469410 - DNA, 14 bp, Homo sapiens
tgtccatctgcccg

SEQ ID NO: 5469411 - DNA, 18 bp, Homo sapiens
tgtccatctgtctgtcct

SEQ ID NO: 5469412 - DNA, 21 bp, Homo sapiens
tgtccatctgtctgtcctacc

SEQ ID NO: 5469413 - DNA, 10 bp, Homo sapiens
tgtccatctt

SEQ ID NO: 5469414 - DNA, 20 bp, Homo sapiens
tgtccatgaaaaacagcaga

SEQ ID NO: 5469415 - DNA, 21 bp, Homo sapiens
tgtccatgaaaaacagcagag

SEQ ID NO: 5469416 - DNA, 18 bp, Homo sapiens
tgtccatgcctacagata

SEQ ID NO: 5469417 - DNA, 20 bp, Homo sapiens
tgtccatgcgctcagggcca

SEQ ID NO: 5469418 - DNA, 22 bp, Homo sapiens
tgtccatgcgctcagggccatg

SEQ ID NO: 5469419 - DNA, 17 bp, Homo sapiens
tgtccatgcttctcatc

SEQ ID NO: 5469420 - DNA, 19 bp, Homo sapiens
tgtccatggcagctggtct

SEQ ID NO: 5469421 - DNA, 13 bp, Homo sapiens
tgtccatgtcccc

SEQ ID NO: 5469422 - DNA, 14 bp, Homo sapiens
tgtccatgtccccc

SEQ ID NO: 5469423 - DNA, 14 bp, Homo sapiens
tgtccatgtgaaat

SEQ ID NO: 5469424 - DNA, 21 bp, Homo sapiens
tgtccatgtgcacccggcctg

SEQ ID NO: 5469425 - DNA, 11 bp, Homo sapiens
tgtccatgtgt

SEQ ID NO: 5469426 - DNA, 12 bp, Homo sapiens
tgtccatgtgtg

SEQ ID NO: 5469427 - DNA, 16 bp, Homo sapiens
tgtccattacttgcca

SEQ ID NO: 5469428 - DNA, 14 bp, Homo sapiens
tgtccattgacatg

SEQ ID NO: 5469429 - DNA, 16 bp, Homo sapiens
tgtccattgacatgta

SEQ ID NO: 5469430 - DNA, 21 bp, Homo sapiens
tgtccattgccacggccatga

SEQ ID NO: 5469431 - DNA, 19 bp, Homo sapiens
tgtccattgtaaatctgaa

SEQ ID NO: 5469432 - DNA, 12 bp, Homo sapiens
tgtccatttata

SEQ ID NO: 5469433 - DNA, 13 bp, Homo sapiens
tgtccatttgtaa

SEQ ID NO: 5469434 - DNA, 16 bp, Homo sapiens
tgtccatttgtcccaa

SEQ ID NO: 5469435 - DNA, 15 bp, Homo sapiens
tgtccattttgcaaa

SEQ ID NO: 5469436 - DNA, 16 bp, Homo sapiens
tgtccattttgtgaag

SEQ ID NO: 5469437 - DNA, 22 bp, Homo sapiens
tgtccattttgtgaagccctgt

SEQ ID NO: 5469438 - DNA, 17 bp, Homo sapiens
tgtcccaaaatcccctc

SEQ ID NO: 5469439 - DNA, 18 bp, Homo sapiens
tgtcccaaaatcccctca

SEQ ID NO: 5469440 - DNA, 19 bp, Homo sapiens
tgtcccaaaatcccctcag

SEQ ID NO: 5469441 - DNA, 20 bp, Homo sapiens
tgtcccaaaatcccctcagc

SEQ ID NO: 5469442 - DNA, 21 bp, Homo sapiens
tgtcccaaatccgccagtgtt

SEQ ID NO: 5469443 - DNA, 22 bp, Homo sapiens
tgtcccaagtcctgctcctttc

SEQ ID NO: 5469444 - DNA, 12 bp, Homo sapiens
tgtcccaagtgc

SEQ ID NO: 5469445 - DNA, 14 bp, Homo sapiens
tgtcccaagtgcca

SEQ ID NO: 5469446 - DNA, 16 bp, Homo sapiens
tgtcccaattaaaata

SEQ ID NO: 5469447 - DNA, 19 bp, Homo sapiens
tgtcccacaaaatatttct

SEQ ID NO: 5469448 - DNA, 12 bp, Homo sapiens
tgtcccacaggg

SEQ ID NO: 5469449 - DNA, 18 bp, Homo sapiens
tgtcccacagggaccaca

SEQ ID NO: 5469450 - DNA, 13 bp, Homo sapiens
tgtcccaccaact

SEQ ID NO: 5469451 - DNA, 16 bp, Homo sapiens
tgtcccaccaactctg

SEQ ID NO: 5469452 - DNA, 13 bp, Homo sapiens
tgtcccaccagct

SEQ ID NO: 5469453 - DNA, 21 bp, Homo sapiens
tgtcccacccacacagctgcc

SEQ ID NO: 5469454 - DNA, 22 bp, Homo sapiens
tgtcccacccacacagctgccc

SEQ ID NO: 5469455 - DNA, 23 bp, Homo sapiens
tgtcccacccccacccccagctc

SEQ ID NO: 5469456 - DNA, 19 bp, Homo sapiens
tgtcccacccccttccccc

SEQ ID NO: 5469457 - DNA, 19 bp, Homo sapiens
tgtcccacccctagccacc

SEQ ID NO: 5469458 - DNA, 12 bp, Homo sapiens
tgtcccacctca

SEQ ID NO: 5469459 - DNA, 14 bp, Homo sapiens
tgtcccacctggct

SEQ ID NO: 5469460 - DNA, 14 bp, Homo sapiens
tgtcccactggctc

SEQ ID NO: 5469461 - DNA, 17 bp, Homo sapiens
tgtcccactggctcctc

SEQ ID NO: 5469462 - DNA, 20 bp, Homo sapiens
tgtcccactggctcctccca

SEQ ID NO: 5469463 - DNA, 16 bp, Homo sapiens
tgtcccactgggacac

SEQ ID NO: 5469464 - DNA, 20 bp, Homo sapiens
tgtcccagaggctgccccac

SEQ ID NO: 5469465 - DNA, 24 bp, Homo sapiens
tgtcccagaggttatctgcctggc

SEQ ID NO: 5469466 - DNA, 18 bp, Homo sapiens
tgtcccagatgctgtcat

SEQ ID NO: 5469467 - DNA, 12 bp, Homo sapiens
tgtcccagccac

SEQ ID NO: 5469468 - DNA, 12 bp, Homo sapiens
tgtcccagcccc

SEQ ID NO: 5469469 - DNA, 15 bp, Homo sapiens
tgtcccagcctgggg

SEQ ID NO: 5469470 - DNA, 18 bp, Homo sapiens
tgtcccagcctggggctc

SEQ ID NO: 5469471 - DNA, 16 bp, Homo sapiens
tgtcccaggcactgta

SEQ ID NO: 5469472 - DNA, 20 bp, Homo sapiens
tgtcccaggcagcacagtgt

SEQ ID NO: 5469473 - DNA, 21 bp, Homo sapiens
tgtcccaggcagcgccactgt

SEQ ID NO: 5469474 - DNA, 23 bp, Homo sapiens
tgtcccaggcagcgccactgtcc

SEQ ID NO: 5469475 - DNA, 19 bp, Homo sapiens
tgtcccaggcatgcagctg

SEQ ID NO: 5469476 - DNA, 21 bp, Homo sapiens
tgtcccaggcatgcagctgcc

SEQ ID NO: 5469477 - DNA, 18 bp, Homo sapiens
tgtcccaggccggcccag

SEQ ID NO: 5469478 - DNA, 14 bp, Homo sapiens
tgtcccagggccct

SEQ ID NO: 5469479 - DNA, 18 bp, Homo sapiens
tgtcccagggccctccca

SEQ ID NO: 5469480 - DNA, 20 bp, Homo sapiens
tgtcccagggccctcccagc

SEQ ID NO: 5469481 - DNA, 21 bp, Homo sapiens
tgtcccagggccctcccagcc

SEQ ID NO: 5469482 - DNA, 18 bp, Homo sapiens
tgtcccagggccctggat

SEQ ID NO: 5469483 - DNA, 17 bp, Homo sapiens
tgtcccagtagccaagg

SEQ ID NO: 5469484 - DNA, 22 bp, Homo sapiens
tgtcccagtcccagcctctggg

SEQ ID NO: 5469485 - DNA, 18 bp, Homo sapiens
tgtcccagtgtctggccc

SEQ ID NO: 5469486 - DNA, 19 bp, Homo sapiens
tgtcccagtgtctggccca

SEQ ID NO: 5469487 - DNA, 18 bp, Homo sapiens
tgtcccagttgtggcaac

SEQ ID NO: 5469488 - DNA, 17 bp, Homo sapiens
tgtcccatactcccact

SEQ ID NO: 5469489 - DNA, 19 bp, Homo sapiens
tgtcccatagtccctgcca

SEQ ID NO: 5469490 - DNA, 17 bp, Homo sapiens
tgtcccatctctacccc

SEQ ID NO: 5469491 - DNA, 15 bp, Homo sapiens
tgtcccatctgccct

SEQ ID NO: 5469492 - DNA, 19 bp, Homo sapiens
tgtcccatctgctcctccc

SEQ ID NO: 5469493 - DNA, 16 bp, Homo sapiens
tgtcccatgatccctg

SEQ ID NO: 5469494 - DNA, 17 bp, Homo sapiens
tgtcccatgcaggccct

SEQ ID NO: 5469495 - DNA, 18 bp, Homo sapiens
tgtcccatggacactcca

SEQ ID NO: 5469496 - DNA, 22 bp, Homo sapiens
tgtcccatggacactccagtgc

SEQ ID NO: 5469497 - DNA, 15 bp, Homo sapiens
tgtcccatgggctct

SEQ ID NO: 5469498 - DNA, 17 bp, Homo sapiens
tgtcccatgggctctgg

SEQ ID NO: 5469499 - DNA, 15 bp, Homo sapiens
tgtcccattccctgg

SEQ ID NO: 5469500 - DNA, 14 bp, Homo sapiens
tgtcccattctaga

SEQ ID NO: 5469501 - DNA, 13 bp, Homo sapiens
tgtcccatttatt

SEQ ID NO: 5469502 - DNA, 21 bp, Homo sapiens
tgtcccatttccttggaggcc

SEQ ID NO: 5469503 - DNA, 23 bp, Homo sapiens
tgtcccatttccttggaggccac

SEQ ID NO: 5469504 - DNA, 21 bp, Homo sapiens
tgtcccattttcagactgctt

SEQ ID NO: 5469505 - DNA, 16 bp, Homo sapiens
tgtccccaaaatgtga

SEQ ID NO: 5469506 - DNA, 21 bp, Homo sapiens
tgtccccaaatccgaacctcc

SEQ ID NO: 5469507 - DNA, 18 bp, Homo sapiens
tgtccccaacgtcccctc

SEQ ID NO: 5469508 - DNA, 19 bp, Homo sapiens
tgtccccaacgtcccctcc

SEQ ID NO: 5469509 - DNA, 22 bp, Homo sapiens
tgtccccaacgtcccctccgcc

SEQ ID NO: 5469510 - DNA, 22 bp, Homo sapiens
tgtccccaagacacttcccctt

SEQ ID NO: 5469511 - DNA, 18 bp, Homo sapiens
tgtccccacacagcctct

SEQ ID NO: 5469512 - DNA, 19 bp, Homo sapiens
tgtccccacacagcctcta

SEQ ID NO: 5469513 - DNA, 16 bp, Homo sapiens
tgtccccaccccatgg

SEQ ID NO: 5469514 - DNA, 18 bp, Homo sapiens
tgtccccaccgcagacag

SEQ ID NO: 5469515 - DNA, 14 bp, Homo sapiens
tgtccccagaccct

SEQ ID NO: 5469516 - DNA, 14 bp, Homo sapiens
tgtccccagcccac

SEQ ID NO: 5469517 - DNA, 15 bp, Homo sapiens
tgtccccagcccact

SEQ ID NO: 5469518 - DNA, 15 bp, Homo sapiens
tgtccccagccctgt

SEQ ID NO: 5469519 - DNA, 21 bp, Homo sapiens
tgtccccagcctacctctcca

SEQ ID NO: 5469520 - DNA, 13 bp, Homo sapiens
tgtccccagctcc

SEQ ID NO: 5469521 - DNA, 16 bp, Homo sapiens
tgtccccaggcccagc

SEQ ID NO: 5469522 - DNA, 21 bp, Homo sapiens
tgtccccaggcccagccctcc

SEQ ID NO: 5469523 - DNA, 16 bp, Homo sapiens
tgtccccaggcctggc

SEQ ID NO: 5469524 - DNA, 14 bp, Homo sapiens
tgtccccagggccc

SEQ ID NO: 5469525 - DNA, 15 bp, Homo sapiens
tgtccccagggcccc

SEQ ID NO: 5469526 - DNA, 21 bp, Homo sapiens
tgtccccaggtcctgtctctg

SEQ ID NO: 5469527 - DNA, 19 bp, Homo sapiens
tgtccccagtccccagccc

SEQ ID NO: 5469528 - DNA, 20 bp, Homo sapiens
tgtccccagtccccagccct

SEQ ID NO: 5469529 - DNA, 21 bp, Homo sapiens
tgtccccagtccccagccctg

SEQ ID NO: 5469530 - DNA, 22 bp, Homo sapiens
tgtccccagtccccagccctgg

SEQ ID NO: 5469531 - DNA, 22 bp, Homo sapiens
tgtccccagtgtggactctgga

SEQ ID NO: 5469532 - DNA, 15 bp, Homo sapiens
tgtccccataagaca

SEQ ID NO: 5469533 - DNA, 20 bp, Homo sapiens
tgtccccataagacaaacac

SEQ ID NO: 5469534 - DNA, 21 bp, Homo sapiens
tgtccccataagacaaacact

SEQ ID NO: 5469535 - DNA, 23 bp, Homo sapiens
tgtctggtgtttgtcatggtgaa

SEQ ID NO: 5469536 - DNA, 14 bp, Homo sapiens
tgtctggttctcaa

SEQ ID NO: 5469537 - DNA, 16 bp, Homo sapiens
tgtctggtttctgtcc

SEQ ID NO: 5469538 - DNA, 16 bp, Homo sapiens
tgtctggttttaacaa

SEQ ID NO: 5469539 - DNA, 21 bp, Homo sapiens
tgtctgtaaaaaatggagctc

SEQ ID NO: 5469540 - DNA, 23 bp, Homo sapiens
tgtctgtaaaaaatggagctcag

SEQ ID NO: 5469541 - DNA, 14 bp, Homo sapiens
tgtctgtaaatcaa

SEQ ID NO: 5469542 - DNA, 18 bp, Homo sapiens
tgtctgtaagagaattct

SEQ ID NO: 5469543 - DNA, 23 bp, Homo sapiens
tgtctgtaatgggatctattttt

SEQ ID NO: 5469544 - DNA, 13 bp, Homo sapiens
tgtctgtacacgt

SEQ ID NO: 5469545 - DNA, 11 bp, Homo sapiens
tgtctgtacat

SEQ ID NO: 5469546 - DNA, 20 bp, Homo sapiens
tgtctgtacatactggcctc

SEQ ID NO: 5469547 - DNA, 21 bp, Homo sapiens
tgtctgtacatactggcctct

SEQ ID NO: 5469548 - DNA, 18 bp, Homo sapiens
tgtctgtagagaatgaaa

SEQ ID NO: 5469549 - DNA, 18 bp, Homo sapiens
tgtctgtaggtgtctctg

SEQ ID NO: 5469550 - DNA, 19 bp, Homo sapiens
tgtctgtaggtgtctctgg

SEQ ID NO: 5469551 - DNA, 20 bp, Homo sapiens
tgtctgtaggtgtctctggg

SEQ ID NO: 5469552 - DNA, 15 bp, Homo sapiens
tgtctgtatccccag

SEQ ID NO: 5469553 - DNA, 20 bp, Homo sapiens
tgtctgtatttcatgtggct

SEQ ID NO: 5469554 - DNA, 16 bp, Homo sapiens
tgtctgtcacaggctg

SEQ ID NO: 5469555 - DNA, 21 bp, Homo sapiens
tgtctgtcacaggctgggtca

SEQ ID NO: 5469556 - DNA, 11 bp, Homo sapiens
tgtctgtcacc

SEQ ID NO: 5469557 - DNA, 21 bp, Homo sapiens
tgtctgtccagccgtgtgtgc

SEQ ID NO: 5469558 - DNA, 23 bp, Homo sapiens
tgtctgtccatctgtctgtccta

SEQ ID NO: 5469559 - DNA, 21 bp, Homo sapiens
tgtctgtccctaaacatagtg

SEQ ID NO: 5469560 - DNA, 21 bp, Homo sapiens
tgtctgtcccttttctttgac

SEQ ID NO: 5469561 - DNA, 14 bp, Homo sapiens
tgtctgtcctacaa

SEQ ID NO: 5469562 - DNA, 18 bp, Homo sapiens
tgtctgtcctacccgccc

SEQ ID NO: 5469563 - DNA, 19 bp, Homo sapiens
tgtctgtcctacccgcccg

SEQ ID NO: 5469564 - DNA, 12 bp, Homo sapiens
tgtctgtcctgg

SEQ ID NO: 5469565 - DNA, 13 bp, Homo sapiens
tgtctgtcctggt

SEQ ID NO: 5469566 - DNA, 14 bp, Homo sapiens
tgtctgtcctttat

SEQ ID NO: 5469567 - DNA, 18 bp, Homo sapiens
tgtctgtcgcccttctcc

SEQ ID NO: 5469568 - DNA, 22 bp, Homo sapiens
tgtctgtcgcccttctcccggc

SEQ ID NO: 5469569 - DNA, 14 bp, Homo sapiens
tgtctgtctacatt

SEQ ID NO: 5469570 - DNA, 11 bp, Homo sapiens
tgtctgtctcc

SEQ ID NO: 5469571 - DNA, 12 bp, Homo sapiens
tgtctgtctccc

SEQ ID NO: 5469572 - DNA, 15 bp, Homo sapiens
tgtctgtctccctcc

SEQ ID NO: 5469573 - DNA, 14 bp, Homo sapiens
tgtctgtctctaat

SEQ ID NO: 5469574 - DNA, 12 bp, Homo sapiens
tgtctgtctgct

SEQ ID NO: 5469575 - DNA, 14 bp, Homo sapiens
tgtctgtctgctct

SEQ ID NO: 5469576 - DNA, 16 bp, Homo sapiens
tgtctgtctgctctta

SEQ ID NO: 5469577 - DNA, 16 bp, Homo sapiens
tgtctgtctggtccat

SEQ ID NO: 5469578 - DNA, 15 bp, Homo sapiens
tgtctgtctgtccca

SEQ ID NO: 5469579 - DNA, 15 bp, Homo sapiens
tgtctgtctgtgggc

SEQ ID NO: 5469580 - DNA, 11 bp, Homo sapiens
tgtctgtcttc

SEQ ID NO: 5469581 - DNA, 14 bp, Homo sapiens
tgtctgtcttctcc

SEQ ID NO: 5469582 - DNA, 14 bp, Homo sapiens
tgtctgtgaacaga

SEQ ID NO: 5469583 - DNA, 19 bp, Homo sapiens
tgtctgtgaacagagagac

SEQ ID NO: 5469584 - DNA, 21 bp, Homo sapiens
tgtctgtgaacataggtgtgc

SEQ ID NO: 5469585 - DNA, 19 bp, Homo sapiens
tgtctgtgaagtgagacct

SEQ ID NO: 5469586 - DNA, 20 bp, Homo sapiens
tgtctgtgacttttgtgaaa

SEQ ID NO: 5469587 - DNA, 16 bp, Homo sapiens
tgtctgtgatctctgc

SEQ ID NO: 5469588 - DNA, 12 bp, Homo sapiens
tgtctgtgcaca

SEQ ID NO: 5469589 - DNA, 24 bp, Homo sapiens
tgtctgtgcacatgcctctgtaga

SEQ ID NO: 5469590 - DNA, 21 bp, Homo sapiens
tgtctgtgcagatgctttgcc

SEQ ID NO: 5469591 - DNA, 18 bp, Homo sapiens
tgtctgtgccatggcccc

SEQ ID NO: 5469592 - DNA, 18 bp, Homo sapiens
tgtctgtgccatttctca

SEQ ID NO: 5469593 - DNA, 22 bp, Homo sapiens
tgtctgtgccatttctcaggga

SEQ ID NO: 5469594 - DNA, 14 bp, Homo sapiens
tgtctgtgggcttc

SEQ ID NO: 5469595 - DNA, 12 bp, Homo sapiens
tgtctgtgtata

SEQ ID NO: 5469596 - DNA, 13 bp, Homo sapiens
tgtctgtgtatac

SEQ ID NO: 5469597 - DNA, 16 bp, Homo sapiens
tgtctgtgtatacata

SEQ ID NO: 5469598 - DNA, 15 bp, Homo sapiens
tgtctgtgtcagcct

SEQ ID NO: 5469599 - DNA, 12 bp, Homo sapiens
tgtctgtgtcct

SEQ ID NO: 5469600 - DNA, 21 bp, Homo sapiens
tgtctgtgtgcaagtgtgtgc

SEQ ID NO: 5469601 - DNA, 17 bp, Homo sapiens
tgtctgtgtgctactaa

SEQ ID NO: 5469602 - DNA, 14 bp, Homo sapiens
tgtctgtgtgctgt

SEQ ID NO: 5469603 - DNA, 15 bp, Homo sapiens
tgtctgtgtgctgta

SEQ ID NO: 5469604 - DNA, 16 bp, Homo sapiens
tgtctgtgtgctgtaa

SEQ ID NO: 5469605 - DNA, 21 bp, Homo sapiens
tgtctgtgtgtgtgtgtgcat

SEQ ID NO: 5469606 - DNA, 16 bp, Homo sapiens
tgtctgtgttgctgtt

SEQ ID NO: 5469607 - DNA, 17 bp, Homo sapiens
tgtctgtgttgctgttt

SEQ ID NO: 5469608 - DNA, 14 bp, Homo sapiens
tgtctgtgtttaat

SEQ ID NO: 5469609 - DNA, 11 bp, Homo sapiens
tgtctgttaca

SEQ ID NO: 5469610 - DNA, 19 bp, Homo sapiens
tgtctgttcagtttcccca

SEQ ID NO: 5469611 - DNA, 16 bp, Homo sapiens
tgtctgttcccagccc

SEQ ID NO: 5469612 - DNA, 17 bp, Homo sapiens
tgtctgttcccagcccc

SEQ ID NO: 5469613 - DNA, 19 bp, Homo sapiens
tgtctgttcccagcccctg

SEQ ID NO: 5469614 - DNA, 19 bp, Homo sapiens
tgtctgttcttcatttcta

SEQ ID NO: 5469615 - DNA, 22 bp, Homo sapiens
tgtctgttcttcatttctatag

SEQ ID NO: 5469616 - DNA, 15 bp, Homo sapiens
tgtctgttgaacagc

SEQ ID NO: 5469617 - DNA, 13 bp, Homo sapiens
tgtctgttgcttg

SEQ ID NO: 5469618 - DNA, 18 bp, Homo sapiens
tgtctgttggcaaatttg

SEQ ID NO: 5469619 - DNA, 22 bp, Homo sapiens
tgtctgtttcaatgacctgtat

SEQ ID NO: 5469620 - DNA, 13 bp, Homo sapiens
tgtctgtttgttt

SEQ ID NO: 5469621 - DNA, 15 bp, Homo sapiens
tgtctgtttgtttca

SEQ ID NO: 5469622 - DNA, 16 bp, Homo sapiens
tgtctgtttgtttcaa

SEQ ID NO: 5469623 - DNA, 22 bp, Homo sapiens
tgtctgtttgtttcaagaacct

SEQ ID NO: 5469624 - DNA, 19 bp, Homo sapiens
tgtctgttttccaaagata

SEQ ID NO: 5469625 - DNA, 19 bp, Homo sapiens
tgtctgtttttgtatcttt

SEQ ID NO: 5469626 - DNA, 17 bp, Homo sapiens
tgtcttaaaaatttata

SEQ ID NO: 5469627 - DNA, 18 bp, Homo sapiens
tgtcttaaaaatttatac

SEQ ID NO: 5469628 - DNA, 21 bp, Homo sapiens
tgtcttaaaacctgcttttca

SEQ ID NO: 5469629 - DNA, 22 bp, Homo sapiens
tgtcttaaaggggcctgcgcag

SEQ ID NO: 5469630 - DNA, 19 bp, Homo sapiens
tgtcttaaataaaagaaat

SEQ ID NO: 5469631 - DNA, 18 bp, Homo sapiens
tgtcttaaatgctcataa

SEQ ID NO: 5469632 - DNA, 19 bp, Homo sapiens
tgtcttaaatgctcataaa

SEQ ID NO: 5469633 - DNA, 14 bp, Homo sapiens
tgtcttaagaaaaa

SEQ ID NO: 5469634 - DNA, 22 bp, Homo sapiens
tgtcttaagatggaaatacagt

SEQ ID NO: 5469635 - DNA, 15 bp, Homo sapiens
tgtcttaagtgtttc

SEQ ID NO: 5469636 - DNA, 17 bp, Homo sapiens
tgtcttaatactgtcct

SEQ ID NO: 5469637 - DNA, 16 bp, Homo sapiens
tgtcttaatggatgaa

SEQ ID NO: 5469638 - DNA, 19 bp, Homo sapiens
tgtcttaatggatgaaatc

SEQ ID NO: 5469639 - DNA, 14 bp, Homo sapiens
tgtcttaattaagt

SEQ ID NO: 5469640 - DNA, 21 bp, Homo sapiens
tgtcttaattaagtaaactaa

SEQ ID NO: 5469641 - DNA, 22 bp, Homo sapiens
tgtcttaattaagtaaactaat

SEQ ID NO: 5469642 - DNA, 18 bp, Homo sapiens
tgtcttaattttctttca

SEQ ID NO: 5469643 - DNA, 23 bp, Homo sapiens
tgtcttacaactgactgacttag

SEQ ID NO: 5469644 - DNA, 15 bp, Homo sapiens
tgtcttagctctgga

SEQ ID NO: 5469645 - DNA, 14 bp, Homo sapiens
tgtcttaggctgat

SEQ ID NO: 5469646 - DNA, 18 bp, Homo sapiens
tgtcttaggctgatgcca

SEQ ID NO: 5469647 - DNA, 18 bp, Homo sapiens
tgtcttagtcataccatc

SEQ ID NO: 5469648 - DNA, 13 bp, Homo sapiens
tgtcttatatata

SEQ ID NO: 5469649 - DNA, 21 bp, Homo sapiens
tgtcttatcccccccagcctg

SEQ ID NO: 5469650 - DNA, 23 bp, Homo sapiens
tgtcttatcccccccagcctggc

SEQ ID NO: 5469651 - DNA, 19 bp, Homo sapiens
tgtcttatggattcattta

SEQ ID NO: 5469652 - DNA, 15 bp, Homo sapiens
tgtcttatggtccag

SEQ ID NO: 5469653 - DNA, 17 bp, Homo sapiens
tgtcttattaagactgg

SEQ ID NO: 5469654 - DNA, 12 bp, Homo sapiens
tgtcttattcct

SEQ ID NO: 5469655 - DNA, 19 bp, Homo sapiens
tgtcttattcctaattcct

SEQ ID NO: 5469656 - DNA, 12 bp, Homo sapiens
tgtcttattctt

SEQ ID NO: 5469657 - DNA, 14 bp, Homo sapiens
tgtcttattcttaa

SEQ ID NO: 5469658 - DNA, 14 bp, Homo sapiens
tgtcttattgaaaa

SEQ ID NO: 5469659 - DNA, 15 bp, Homo sapiens
tgtcttattgaaaaa

SEQ ID NO: 5469660 - DNA, 12 bp, Homo sapiens
tgtcttattgca

SEQ ID NO: 5469661 - DNA, 13 bp, Homo sapiens
tgtcttatttgtt

SEQ ID NO: 5469662 - DNA, 23 bp, Homo sapiens
tgtcttatttttagatggttaca

SEQ ID NO: 5469663 - DNA, 20 bp, Homo sapiens
tgtcttcaaccctgccctgc

SEQ ID NO: 5469664 - DNA, 13 bp, Homo sapiens
tgtcttcaaggct

SEQ ID NO: 5469665 - DNA, 20 bp, Homo sapiens
tgtcttcaaggcttcagtct

SEQ ID NO: 5469666 - DNA, 14 bp, Homo sapiens
tgtcttcacaacct

SEQ ID NO: 5469667 - DNA, 14 bp, Homo sapiens
tgtcttcacatgta

SEQ ID NO: 5469668 - DNA, 14 bp, Homo sapiens
tgtcttcacctgcc

SEQ ID NO: 5469669 - DNA, 22 bp, Homo sapiens
tgtcttcagaggctcatctaac

SEQ ID NO: 5469670 - DNA, 19 bp, Homo sapiens
tgtcttcagatcctgctgc

SEQ ID NO: 5469671 - DNA, 23 bp, Homo sapiens
tgtcttcagcagtcaatacaaat

SEQ ID NO: 5469672 - DNA, 22 bp, Homo sapiens
tgtcttcagcctctccaggcac

SEQ ID NO: 5469673 - DNA, 19 bp, Homo sapiens
tgtcttcaggagaatgtgc

SEQ ID NO: 5469674 - DNA, 20 bp, Homo sapiens
tgtcttcaggctctgcccag

SEQ ID NO: 5469675 - DNA, 21 bp, Homo sapiens
tgtcttcatcacttcttccac

SEQ ID NO: 5469676 - DNA, 16 bp, Homo sapiens
tgtcttcatttcattg

SEQ ID NO: 5469677 - DNA, 23 bp, Homo sapiens
tgtcttcatttcattgtatgatg

SEQ ID NO: 5469678 - DNA, 20 bp, Homo sapiens
tgtcttcattttcattacca

SEQ ID NO: 5469679 - DNA, 14 bp, Homo sapiens
tgtcttccaacccc

SEQ ID NO: 5469680 - DNA, 19 bp, Homo sapiens
tgtcttccaaccccagctg

SEQ ID NO: 5469681 - DNA, 22 bp, Homo sapiens
tgtcttccaaccccagctggcc

SEQ ID NO: 5469682 - DNA, 23 bp, Homo sapiens
tgtcttccaaccccagctggcct

SEQ ID NO: 5469683 - DNA, 13 bp, Homo sapiens
tgtcttccaagga

SEQ ID NO: 5469684 - DNA, 16 bp, Homo sapiens
tgtcttccaaggagac

SEQ ID NO: 5469685 - DNA, 24 bp, Homo sapiens
tgtcttccaaggagaccaagtcct

SEQ ID NO: 5469686 - DNA, 15 bp, Homo sapiens
tgtcttccactttgc

SEQ ID NO: 5469687 - DNA, 16 bp, Homo sapiens
tgtcttccaggcccag

SEQ ID NO: 5469688 - DNA, 18 bp, Homo sapiens
tgtcttccaggtccaaac

SEQ ID NO: 5469689 - DNA, 20 bp, Homo sapiens
tgtcttccaggtccaaaccc

SEQ ID NO: 5469690 - DNA, 21 bp, Homo sapiens
tgtcttcccagggtagcccgc

SEQ ID NO: 5469691 - DNA, 16 bp, Homo sapiens
tgtcttcccccctctc

SEQ ID NO: 5469692 - DNA, 17 bp, Homo sapiens
tgtcttcccccctctcc

SEQ ID NO: 5469693 - DNA, 21 bp, Homo sapiens
tgtcttcccccctctcctccc

SEQ ID NO: 5469694 - DNA, 15 bp, Homo sapiens
tgtcttccctgcctg

SEQ ID NO: 5469695 - DNA, 15 bp, Homo sapiens
tgtcttccctgggct

SEQ ID NO: 5469696 - DNA, 20 bp, Homo sapiens
tgtcttccgatcaacattta

SEQ ID NO: 5469697 - DNA, 16 bp, Homo sapiens
tgtcttcctatttcag

SEQ ID NO: 5469698 - DNA, 17 bp, Homo sapiens
tgtcttcctatttcaga

SEQ ID NO: 5469699 - DNA, 19 bp, Homo sapiens
tgtcttcctatttcagaag

SEQ ID NO: 5469700 - DNA, 10 bp, Homo sapiens
tgtcttcctc

SEQ ID NO: 5469701 - DNA, 11 bp, Homo sapiens
tgtcttcctct

SEQ ID NO: 5469702 - DNA, 23 bp, Homo sapiens
tgtcttcctctgcaagtgctcag

SEQ ID NO: 5469703 - DNA, 14 bp, Homo sapiens
tgtcttcctggtca

SEQ ID NO: 5469704 - DNA, 13 bp, Homo sapiens
tgtcttccttttc

SEQ ID NO: 5469705 - DNA, 14 bp, Homo sapiens
tgtcttcgctggct

SEQ ID NO: 5469706 - DNA, 16 bp, Homo sapiens
tgtcttcggaaacctt

SEQ ID NO: 5469707 - DNA, 20 bp, Homo sapiens
tgtcttcggaaaccttggtg

SEQ ID NO: 5469708 - DNA, 19 bp, Homo sapiens
tgtcttcggccgagctggt

SEQ ID NO: 5469709 - DNA, 16 bp, Homo sapiens
tgtcttctagtttaga

SEQ ID NO: 5469710 - DNA, 21 bp, Homo sapiens
tgtcttctcaggctctgccct

SEQ ID NO: 5469711 - DNA, 17 bp, Homo sapiens
tgtcttctcccagagca

SEQ ID NO: 5469712 - DNA, 15 bp, Homo sapiens
tgtcttctccctcct

SEQ ID NO: 5469713 - DNA, 18 bp, Homo sapiens
atgtttgatgtccccaaa

SEQ ID NO: 5469714 - DNA, 15 bp, Homo sapiens
atgtttgcatataag

SEQ ID NO: 5469715 - DNA, 23 bp, Homo sapiens
atgtttgccctgttcaaagtact

SEQ ID NO: 5469716 - DNA, 17 bp, Homo sapiens
atgtttgcctctgcctc

SEQ ID NO: 5469717 - DNA, 19 bp, Homo sapiens
atgtttgcctctgcctctg

SEQ ID NO: 5469718 - DNA, 22 bp, Homo sapiens
atgtttgcctctgcctctgaca

SEQ ID NO: 5469719 - DNA, 16 bp, Homo sapiens
atgtttgctattgaca

SEQ ID NO: 5469720 - DNA, 19 bp, Homo sapiens
atgtttgctcagaacacat

SEQ ID NO: 5469721 - DNA, 22 bp, Homo sapiens
atgtttgctgattatttatgac

SEQ ID NO: 5469722 - DNA, 15 bp, Homo sapiens
atgtttgctgttcca

SEQ ID NO: 5469723 - DNA, 18 bp, Homo sapiens
atgtttgcttcataaatg

SEQ ID NO: 5469724 - DNA, 20 bp, Homo sapiens
atgtttgcttcataaatgaa

SEQ ID NO: 5469725 - DNA, 17 bp, Homo sapiens
atgtttgcttttcactg

SEQ ID NO: 5469726 - DNA, 15 bp, Homo sapiens
atgtttggctctgct

SEQ ID NO: 5469727 - DNA, 19 bp, Homo sapiens
atgtttggctgaaattatg

SEQ ID NO: 5469728 - DNA, 20 bp, Homo sapiens
atgtttgggatattaaaaca

SEQ ID NO: 5469729 - DNA, 19 bp, Homo sapiens
atgtttggggatcgatgtg

SEQ ID NO: 5469730 - DNA, 12 bp, Homo sapiens
atgtttggggtc

SEQ ID NO: 5469731 - DNA, 23 bp, Homo sapiens
atgtttgggtgggttaagtgggc

SEQ ID NO: 5469732 - DNA, 13 bp, Homo sapiens
atgtttggtaaga

SEQ ID NO: 5469733 - DNA, 18 bp, Homo sapiens
atgtttggtgaactatat

SEQ ID NO: 5469734 - DNA, 20 bp, Homo sapiens
atgtttggtgcatagaactg

SEQ ID NO: 5469735 - DNA, 14 bp, Homo sapiens
atgtttgtaaaact

SEQ ID NO: 5469736 - DNA, 19 bp, Homo sapiens
atgtttgtaaattaatact

SEQ ID NO: 5469737 - DNA, 18 bp, Homo sapiens
atgtttgtacacaacacc

SEQ ID NO: 5469738 - DNA, 22 bp, Homo sapiens
atgtttgtacacaacacctaaa

SEQ ID NO: 5469739 - DNA, 13 bp, Homo sapiens
atgtttgtatcat

SEQ ID NO: 5469740 - DNA, 21 bp, Homo sapiens
atgtttgtctgtgtgctgtaa

SEQ ID NO: 5469741 - DNA, 24 bp, Homo sapiens
atgtttgtgagaagcttctaatta

SEQ ID NO: 5469742 - DNA, 19 bp, Homo sapiens
atgtttgtgatattaaatt

SEQ ID NO: 5469743 - DNA, 21 bp, Homo sapiens
atgtttgtgctgcagacaaaa

SEQ ID NO: 5469744 - DNA, 10 bp, Homo sapiens
atgtttgtgg

SEQ ID NO: 5469745 - DNA, 19 bp, Homo sapiens
atgtttgtggaatggattt

SEQ ID NO: 5469746 - DNA, 14 bp, Homo sapiens
atgtttgtggcctc

SEQ ID NO: 5469747 - DNA, 17 bp, Homo sapiens
atgtttgtggcctcaga

SEQ ID NO: 5469748 - DNA, 20 bp, Homo sapiens
atgtttgtggttttgggaaa

SEQ ID NO: 5469749 - DNA, 14 bp, Homo sapiens
atgtttgtgtctgt

SEQ ID NO: 5469750 - DNA, 22 bp, Homo sapiens
atgtttgttatttacactggtc

SEQ ID NO: 5469751 - DNA, 23 bp, Homo sapiens
atgtttgttggttgattgtttaa

SEQ ID NO: 5469752 - DNA, 13 bp, Homo sapiens
atgtttgtttcag

SEQ ID NO: 5469753 - DNA, 13 bp, Homo sapiens
atgtttgttttca

SEQ ID NO: 5469754 - DNA, 16 bp, Homo sapiens
atgttttaaaagtttg

SEQ ID NO: 5469755 - DNA, 18 bp, Homo sapiens
atgttttaaaattatata

SEQ ID NO: 5469756 - DNA, 19 bp, Homo sapiens
atgttttaaaattatatag

SEQ ID NO: 5469757 - DNA, 18 bp, Homo sapiens
atgttttaaatgtacaga

SEQ ID NO: 5469758 - DNA, 15 bp, Homo sapiens
atgttttaacaaaaa

SEQ ID NO: 5469759 - DNA, 16 bp, Homo sapiens
atgttttaagaggcag

SEQ ID NO: 5469760 - DNA, 18 bp, Homo sapiens
atgttttaagaggcaggg

SEQ ID NO: 5469761 - DNA, 19 bp, Homo sapiens
atgttttaattccatgaat

SEQ ID NO: 5469762 - DNA, 16 bp, Homo sapiens
atgttttacactgtac

SEQ ID NO: 5469763 - DNA, 20 bp, Homo sapiens
atgttttaccgtaataatta

SEQ ID NO: 5469764 - DNA, 17 bp, Homo sapiens
atgttttacgcaaggaa

SEQ ID NO: 5469765 - DNA, 21 bp, Homo sapiens
atgttttacgcaaggaaggac

SEQ ID NO: 5469766 - DNA, 23 bp, Homo sapiens
atgttttacgcaaggaaggactt

SEQ ID NO: 5469767 - DNA, 16 bp, Homo sapiens
atgttttacgtgcaaa

SEQ ID NO: 5469768 - DNA, 18 bp, Homo sapiens
atgttttagagataaata

SEQ ID NO: 5469769 - DNA, 17 bp, Homo sapiens
atgttttagcacagcgt

SEQ ID NO: 5469770 - DNA, 18 bp, Homo sapiens
atgttttagcatttgtat

SEQ ID NO: 5469771 - DNA, 22 bp, Homo sapiens
atgttttagtaaaaaagagaat

SEQ ID NO: 5469772 - DNA, 20 bp, Homo sapiens
atgttttagtttaaaaatca

SEQ ID NO: 5469773 - DNA, 18 bp, Homo sapiens
atgttttatactgctcta

SEQ ID NO: 5469774 - DNA, 22 bp, Homo sapiens
atgttttatcgtccagtgactt

SEQ ID NO: 5469775 - DNA, 15 bp, Homo sapiens
atgttttatgacatt

SEQ ID NO: 5469776 - DNA, 18 bp, Homo sapiens
atgttttattatttctat

SEQ ID NO: 5469777 - DNA, 21 bp, Homo sapiens
atgttttattggggaattaaa

SEQ ID NO: 5469778 - DNA, 20 bp, Homo sapiens
atgttttatttaaatgcttt

SEQ ID NO: 5469779 - DNA, 23 bp, Homo sapiens
atgttttatttatcaaaatgtag

SEQ ID NO: 5469780 - DNA, 13 bp, Homo sapiens
atgttttcaaatg

SEQ ID NO: 5469781 - DNA, 15 bp, Homo sapiens
atgttttcaaatgga

SEQ ID NO: 5469782 - DNA, 13 bp, Homo sapiens
atgttttcacagt

SEQ ID NO: 5469783 - DNA, 15 bp, Homo sapiens
atgttttcaggctag

SEQ ID NO: 5469784 - DNA, 12 bp, Homo sapiens
atgttttcatta

SEQ ID NO: 5469785 - DNA, 12 bp, Homo sapiens
atgttttcattt

SEQ ID NO: 5469786 - DNA, 15 bp, Homo sapiens
atgttttccacataa

SEQ ID NO: 5469787 - DNA, 16 bp, Homo sapiens
atgttttccagctcct

SEQ ID NO: 5469788 - DNA, 14 bp, Homo sapiens
atgttttccatgag

SEQ ID NO: 5469789 - DNA, 20 bp, Homo sapiens
atgttttccatttgggcaca

SEQ ID NO: 5469790 - DNA, 21 bp, Homo sapiens
atgttttccccaattatcctc

SEQ ID NO: 5469791 - DNA, 23 bp, Homo sapiens
atgttttcctttgtcatcattgt

SEQ ID NO: 5469792 - DNA, 15 bp, Homo sapiens
atgttttctgcttta

SEQ ID NO: 5469793 - DNA, 16 bp, Homo sapiens
atgttttctttgcaaa

SEQ ID NO: 5469794 - DNA, 17 bp, Homo sapiens
atgttttctttgcaaag

SEQ ID NO: 5469795 - DNA, 21 bp, Homo sapiens
atgttttctttgcaaagtatt

SEQ ID NO: 5469796 - DNA, 18 bp, Homo sapiens
atgttttctttgtttcct

SEQ ID NO: 5469797 - DNA, 15 bp, Homo sapiens
atgttttgaatgtgg

SEQ ID NO: 5469798 - DNA, 16 bp, Homo sapiens
atgttttgaatgtgga

SEQ ID NO: 5469799 - DNA, 17 bp, Homo sapiens
atgttttgaatgtggat

SEQ ID NO: 5469800 - DNA, 12 bp, Homo sapiens
atgttttgagaa

SEQ ID NO: 5469801 - DNA, 14 bp, Homo sapiens
atgttttgagaaaa

SEQ ID NO: 5469802 - DNA, 21 bp, Homo sapiens
atgttttgagacataaatgtt

SEQ ID NO: 5469803 - DNA, 12 bp, Homo sapiens
atgttttgataa

SEQ ID NO: 5469804 - DNA, 22 bp, Homo sapiens
atgttttgatatttatttcctg

SEQ ID NO: 5469805 - DNA, 14 bp, Homo sapiens
atgttttgcaaagg

SEQ ID NO: 5469806 - DNA, 23 bp, Homo sapiens
atgttttgcatgtaaaagcctag

SEQ ID NO: 5469807 - DNA, 22 bp, Homo sapiens
atgttttggagagagcaatctt

SEQ ID NO: 5469808 - DNA, 21 bp, Homo sapiens
atgttttgggatcaggagccc

SEQ ID NO: 5469809 - DNA, 20 bp, Homo sapiens
atgttttggtatctgttctt

SEQ ID NO: 5469810 - DNA, 17 bp, Homo sapiens
atgttttggtccacttt

SEQ ID NO: 5469811 - DNA, 13 bp, Homo sapiens
atgttttgtaaga

SEQ ID NO: 5469812 - DNA, 16 bp, Homo sapiens
atgttttgtataaaat

SEQ ID NO: 5469813 - DNA, 14 bp, Homo sapiens
atgttttgtataca

SEQ ID NO: 5469814 - DNA, 22 bp, Homo sapiens
atgttttgtatacaaatatatt

SEQ ID NO: 5469815 - DNA, 17 bp, Homo sapiens
atgttttgtatatacag

SEQ ID NO: 5469816 - DNA, 17 bp, Homo sapiens
atgttttgtgactatat

SEQ ID NO: 5469817 - DNA, 15 bp, Homo sapiens
atgttttgtgcattt

SEQ ID NO: 5469818 - DNA, 22 bp, Homo sapiens
atgttttgtgcatttgtaaatg

SEQ ID NO: 5469819 - DNA, 14 bp, Homo sapiens
atgttttgtttctg

SEQ ID NO: 5469820 - DNA, 19 bp, Homo sapiens
atgttttgtttctgaaaat

SEQ ID NO: 5469821 - DNA, 23 bp, Homo sapiens
atgtttttaaaaacctattttga

SEQ ID NO: 5469822 - DNA, 20 bp, Homo sapiens
atgtttttaaaagtttcaat

SEQ ID NO: 5469823 - DNA, 22 bp, Homo sapiens
atgtttttaaaagtttcaatgt

SEQ ID NO: 5469824 - DNA, 23 bp, Homo sapiens
atgtttttaaaagtttcaatgtg

SEQ ID NO: 5469825 - DNA, 13 bp, Homo sapiens
atgtttttaaaat

SEQ ID NO: 5469826 - DNA, 23 bp, Homo sapiens
atgtttttaaaatcttattaaag

SEQ ID NO: 5469827 - DNA, 17 bp, Homo sapiens
atgtttttaaagtgtac

SEQ ID NO: 5469828 - DNA, 15 bp, Homo sapiens
atgtttttaactttt

SEQ ID NO: 5469829 - DNA, 18 bp, Homo sapiens
atgtttttaagtgctatg

SEQ ID NO: 5469830 - DNA, 16 bp, Homo sapiens
atgtttttaataaaag

SEQ ID NO: 5469831 - DNA, 19 bp, Homo sapiens
atgtttttaataaaagaaa

SEQ ID NO: 5469832 - DNA, 21 bp, Homo sapiens
atgtttttacattatgcaaat

SEQ ID NO: 5469833 - DNA, 23 bp, Homo sapiens
atgtttttactgaatgatctatt

SEQ ID NO: 5469834 - DNA, 23 bp, Homo sapiens
atgtttttagttctgactttgaa

SEQ ID NO: 5469835 - DNA, 18 bp, Homo sapiens
atgtttttatacaaaata

SEQ ID NO: 5469836 - DNA, 15 bp, Homo sapiens
atgtttttatttcaa

SEQ ID NO: 5469837 - DNA, 16 bp, Homo sapiens
atgtttttatttcaat

SEQ ID NO: 5469838 - DNA, 14 bp, Homo sapiens
atgtttttatttcc

SEQ ID NO: 5469839 - DNA, 13 bp, Homo sapiens
atgtttttcagtt

SEQ ID NO: 5469840 - DNA, 16 bp, Homo sapiens
atgtttttcagttcaa

SEQ ID NO: 5469841 - DNA, 19 bp, Homo sapiens
atgtttttcatccattcct

SEQ ID NO: 5469842 - DNA, 15 bp, Homo sapiens
atgtttttcatgaaa

SEQ ID NO: 5469843 - DNA, 15 bp, Homo sapiens
atgtttttccctccc

SEQ ID NO: 5469844 - DNA, 20 bp, Homo sapiens
atgtttttccctccccagaa

SEQ ID NO: 5469845 - DNA, 17 bp, Homo sapiens
atgtttttcctttctta

SEQ ID NO: 5469846 - DNA, 14 bp, Homo sapiens
atgtttttctcaaa

SEQ ID NO: 5469847 - DNA, 18 bp, Homo sapiens
atgtttttgaaaagctaa

SEQ ID NO: 5469848 - DNA, 19 bp, Homo sapiens
atgtttttgaaggcagaaa

SEQ ID NO: 5469849 - DNA, 22 bp, Homo sapiens
atgtttttgatcaaaaactatt

SEQ ID NO: 5469850 - DNA, 13 bp, Homo sapiens
atgtttttgtgta

SEQ ID NO: 5469851 - DNA, 17 bp, Homo sapiens
atgtttttgtgtatttg

SEQ ID NO: 5469852 - DNA, 13 bp, Homo sapiens
atgttttttagaa

SEQ ID NO: 5469853 - DNA, 22 bp, Homo sapiens
atgttttttatacttcaaatgt

SEQ ID NO: 5469854 - DNA, 16 bp, Homo sapiens
atgttttttctgtaat

SEQ ID NO: 5469855 - DNA, 20 bp, Homo sapiens
atgttttttctgtaatgtaa

SEQ ID NO: 5469856 - DNA, 21 bp, Homo sapiens
atgttttttctgtaatgtaaa

SEQ ID NO: 5469857 - DNA, 20 bp, Homo sapiens
atgttttttcttcaaatgtt

SEQ ID NO: 5469858 - DNA, 19 bp, Homo sapiens
atgttttttgaagttctgg

SEQ ID NO: 5469859 - DNA, 18 bp, Homo sapiens
atgttttttggaaattca

SEQ ID NO: 5469860 - DNA, 16 bp, Homo sapiens
atgtttttttaattaa

SEQ ID NO: 5469861 - DNA, 23 bp, Homo sapiens
atgtttttttccaatgcttctta

SEQ ID NO: 5469862 - DNA, 15 bp, Homo sapiens
attaaaaaaaacaaa

SEQ ID NO: 5469863 - DNA, 18 bp, Homo sapiens
attaaaaaaacacaaaaa

SEQ ID NO: 5469864 - DNA, 14 bp, Homo sapiens
attaaaaaaatttt

SEQ ID NO: 5469865 - DNA, 24 bp, Homo sapiens
attaaaaaaattttaagtatctag

SEQ ID NO: 5469866 - DNA, 13 bp, Homo sapiens
attaaaaaacaat

SEQ ID NO: 5469867 - DNA, 20 bp, Homo sapiens
attaaaaaacaattaactgc

SEQ ID NO: 5469868 - DNA, 13 bp, Homo sapiens
attaaaaaagaaa

SEQ ID NO: 5469869 - DNA, 18 bp, Homo sapiens
attaaaaaagataaacac

SEQ ID NO: 5469870 - DNA, 12 bp, Homo sapiens
attaaaaaattt

SEQ ID NO: 5469871 - DNA, 15 bp, Homo sapiens
attaaaaaatttgta

SEQ ID NO: 5469872 - DNA, 15 bp, Homo sapiens
attaaaaacacctaa

SEQ ID NO: 5469873 - DNA, 14 bp, Homo sapiens
attaaaaacagaaa

SEQ ID NO: 5469874 - DNA, 15 bp, Homo sapiens
attaaaaacagaaaa

SEQ ID NO: 5469875 - DNA, 16 bp, Homo sapiens
attaaaaacagaaaat

SEQ ID NO: 5469876 - DNA, 17 bp, Homo sapiens
attaaaaacatagaaaa

SEQ ID NO: 5469877 - DNA, 14 bp, Homo sapiens
attaaaaacatgaa

SEQ ID NO: 5469878 - DNA, 13 bp, Homo sapiens
attaaaaacattt

SEQ ID NO: 5469879 - DNA, 18 bp, Homo sapiens
attaaaaacgaaaacctg

SEQ ID NO: 5469880 - DNA, 21 bp, Homo sapiens
attaaaaacgaaaacctgact

SEQ ID NO: 5469881 - DNA, 17 bp, Homo sapiens
attaaaaactagtagtt

SEQ ID NO: 5469882 - DNA, 13 bp, Homo sapiens
attaaaaacttta

SEQ ID NO: 5469883 - DNA, 14 bp, Homo sapiens
attaaaaactttaa

SEQ ID NO: 5469884 - DNA, 14 bp, Homo sapiens
attaaaaagaagat

SEQ ID NO: 5469885 - DNA, 16 bp, Homo sapiens
attaaaaagaatagaa

SEQ ID NO: 5469886 - DNA, 15 bp, Homo sapiens
attaaaaagacactt

SEQ ID NO: 5469887 - DNA, 19 bp, Homo sapiens
attaaaaagattctttttc

SEQ ID NO: 5469888 - DNA, 13 bp, Homo sapiens
attaaaaagcctt

SEQ ID NO: 5469889 - DNA, 14 bp, Homo sapiens
attaaaaagcctta

SEQ ID NO: 5469890 - DNA, 22 bp, Homo sapiens
attaacctgccagggagacaga

SEQ ID NO: 5469891 - DNA, 14 bp, Homo sapiens
attaacctggtgct

SEQ ID NO: 5469892 - DNA, 17 bp, Homo sapiens
attaacctggtgctgga

SEQ ID NO: 5469893 - DNA, 17 bp, Homo sapiens
attaaccttactaatta

SEQ ID NO: 5469894 - DNA, 16 bp, Homo sapiens
attaacctttcaggaa

SEQ ID NO: 5469895 - DNA, 21 bp, Homo sapiens
attaacgctaaaggtgtaaga

SEQ ID NO: 5469896 - DNA, 14 bp, Homo sapiens
attaactaaagaag

SEQ ID NO: 5469897 - DNA, 13 bp, Homo sapiens
attaactaaatgc

SEQ ID NO: 5469898 - DNA, 14 bp, Homo sapiens
attaactaaatgct

SEQ ID NO: 5469899 - DNA, 20 bp, Homo sapiens
attaactactgaataatgct

SEQ ID NO: 5469900 - DNA, 21 bp, Homo sapiens
attaactactgaataatgcta

SEQ ID NO: 5469901 - DNA, 21 bp, Homo sapiens
attaactatcttctttggact

SEQ ID NO: 5469902 - DNA, 15 bp, Homo sapiens
attaactattagtat

SEQ ID NO: 5469903 - DNA, 20 bp, Homo sapiens
attaactcaccagatttact

SEQ ID NO: 5469904 - DNA, 19 bp, Homo sapiens
attaactccctccaccagc

SEQ ID NO: 5469905 - DNA, 18 bp, Homo sapiens
attaactccgtttccaaa

SEQ ID NO: 5469906 - DNA, 14 bp, Homo sapiens
attaactctccagt

SEQ ID NO: 5469907 - DNA, 22 bp, Homo sapiens
attaactcttagaagtgttgta

SEQ ID NO: 5469908 - DNA, 14 bp, Homo sapiens
attaactgaaacat

SEQ ID NO: 5469909 - DNA, 19 bp, Homo sapiens
attaactgaagcaaatacc

SEQ ID NO: 5469910 - DNA, 19 bp, Homo sapiens
attaactgacgaagaagca

SEQ ID NO: 5469911 - DNA, 22 bp, Homo sapiens
attaactgagtagctctcctga

SEQ ID NO: 5469912 - DNA, 22 bp, Homo sapiens
attaactgccctctgaaataat

SEQ ID NO: 5469913 - DNA, 23 bp, Homo sapiens
attaactgctccaaatttaacca

SEQ ID NO: 5469914 - DNA, 19 bp, Homo sapiens
attaactgggtaatgaaac

SEQ ID NO: 5469915 - DNA, 17 bp, Homo sapiens
attaactgggtacccaa

SEQ ID NO: 5469916 - DNA, 21 bp, Homo sapiens
attaactgggtacccaaaaca

SEQ ID NO: 5469917 - DNA, 15 bp, Homo sapiens
attaactgtaaactt

SEQ ID NO: 5469918 - DNA, 16 bp, Homo sapiens
attaactgtattttct

SEQ ID NO: 5469919 - DNA, 16 bp, Homo sapiens
attaactgttgcactt

SEQ ID NO: 5469920 - DNA, 15 bp, Homo sapiens
attaacttagttttt

SEQ ID NO: 5469921 - DNA, 18 bp, Homo sapiens
attaacttctattttcaa

SEQ ID NO: 5469922 - DNA, 19 bp, Homo sapiens
attaacttgtattttctta

SEQ ID NO: 5469923 - DNA, 17 bp, Homo sapiens
attaacttttaaatgtt

SEQ ID NO: 5469924 - DNA, 18 bp, Homo sapiens
attaacttttaaatgttt

SEQ ID NO: 5469925 - DNA, 13 bp, Homo sapiens
attaacttttaat

SEQ ID NO: 5469926 - DNA, 14 bp, Homo sapiens
attaacttttaatg

SEQ ID NO: 5469927 - DNA, 12 bp, Homo sapiens
attaacttttat

SEQ ID NO: 5469928 - DNA, 14 bp, Homo sapiens
attaacttttgtaa

SEQ ID NO: 5469929 - DNA, 21 bp, Homo sapiens
attaagaaaaacaataaagat

SEQ ID NO: 5469930 - DNA, 13 bp, Homo sapiens
attaagaaaacta

SEQ ID NO: 5469931 - DNA, 18 bp, Homo sapiens
attaagaaaatattctaa

SEQ ID NO: 5469932 - DNA, 15 bp, Homo sapiens
attaagaaaatattt

SEQ ID NO: 5469933 - DNA, 12 bp, Homo sapiens
attaagaaaatc

SEQ ID NO: 5469934 - DNA, 14 bp, Homo sapiens
attaagaaaatcat

SEQ ID NO: 5469935 - DNA, 15 bp, Homo sapiens
attaagaaaatcata

SEQ ID NO: 5469936 - DNA, 20 bp, Homo sapiens
attaagaaaatcatattgct

SEQ ID NO: 5469937 - DNA, 12 bp, Homo sapiens
attaagaaaccc

SEQ ID NO: 5469938 - DNA, 11 bp, Homo sapiens
attaagaaact

SEQ ID NO: 5469939 - DNA, 14 bp, Homo sapiens
attaagaaagacta

SEQ ID NO: 5469940 - DNA, 16 bp, Homo sapiens
attaagaaagattaaa

SEQ ID NO: 5469941 - DNA, 19 bp, Homo sapiens
attaagaaagattaaatat

SEQ ID NO: 5469942 - DNA, 13 bp, Homo sapiens
attaagaaaggaa

SEQ ID NO: 5469943 - DNA, 14 bp, Homo sapiens
attaagaaaggaag

SEQ ID NO: 5469944 - DNA, 17 bp, Homo sapiens
attaagaaaggaagcat

SEQ ID NO: 5469945 - DNA, 15 bp, Homo sapiens
attaagaaaggaagt

SEQ ID NO: 5469946 - DNA, 12 bp, Homo sapiens
attaagaaatag

SEQ ID NO: 5469947 - DNA, 13 bp, Homo sapiens
attaagaacacta

SEQ ID NO: 5469948 - DNA, 15 bp, Homo sapiens
attaagaacatttta

SEQ ID NO: 5469949 - DNA, 19 bp, Homo sapiens
attaagaactgctgtttca

SEQ ID NO: 5469950 - DNA, 19 bp, Homo sapiens
attaagaaggcaaaaatgt

SEQ ID NO: 5469951 - DNA, 17 bp, Homo sapiens
attaagaatagtctctg

SEQ ID NO: 5469952 - DNA, 18 bp, Homo sapiens
attaagaatcattgtgct

SEQ ID NO: 5469953 - DNA, 21 bp, Homo sapiens
attaagaatcttagataactt

SEQ ID NO: 5469954 - DNA, 22 bp, Homo sapiens
attaagaatgaaatactgtttg

SEQ ID NO: 5469955 - DNA, 14 bp, Homo sapiens
attaagacaaaaag

SEQ ID NO: 5469956 - DNA, 13 bp, Homo sapiens
attaagacagtgt

SEQ ID NO: 5469957 - DNA, 15 bp, Homo sapiens
attaagacagtgtac

SEQ ID NO: 5469958 - DNA, 17 bp, Homo sapiens
attaagacagtgtacaa

SEQ ID NO: 5469959 - DNA, 23 bp, Homo sapiens
attaagacagtgtacaaaactgt

SEQ ID NO: 5469960 - DNA, 21 bp, Homo sapiens
attaagaccaaagacttgtta

SEQ ID NO: 5469961 - DNA, 24 bp, Homo sapiens
attaagacttacttgcattgctgg

SEQ ID NO: 5469962 - DNA, 11 bp, Homo sapiens
attaagacttt

SEQ ID NO: 5469963 - DNA, 13 bp, Homo sapiens
attaagactttaa

SEQ ID NO: 5469964 - DNA, 20 bp, Homo sapiens
attaagagagtctatttacg

SEQ ID NO: 5469965 - DNA, 23 bp, Homo sapiens
attaagagcaaactttagtgtct

SEQ ID NO: 5469966 - DNA, 21 bp, Homo sapiens
attaagagctattttagaaag

SEQ ID NO: 5469967 - DNA, 14 bp, Homo sapiens
attaagagtgaatg

SEQ ID NO: 5469968 - DNA, 14 bp, Homo sapiens
attaagatacaaat

SEQ ID NO: 5469969 - DNA, 14 bp, Homo sapiens
attaagatacttag

SEQ ID NO: 5469970 - DNA, 17 bp, Homo sapiens
attaagatcctaaactc

SEQ ID NO: 5469971 - DNA, 18 bp, Homo sapiens
attaagatctgtgtttta

SEQ ID NO: 5469972 - DNA, 20 bp, Homo sapiens
attaagatggattctcagat

SEQ ID NO: 5469973 - DNA, 13 bp, Homo sapiens
attaagattataa

SEQ ID NO: 5469974 - DNA, 16 bp, Homo sapiens
attaagattataattg

SEQ ID NO: 5469975 - DNA, 17 bp, Homo sapiens
attaagattataattgt

SEQ ID NO: 5469976 - DNA, 15 bp, Homo sapiens
attaagattatttta

SEQ ID NO: 5469977 - DNA, 13 bp, Homo sapiens
attaagatttcca

SEQ ID NO: 5469978 - DNA, 16 bp, Homo sapiens
attaagatttccaagt

SEQ ID NO: 5469979 - DNA, 17 bp, Homo sapiens
attaagattttacttta

SEQ ID NO: 5469980 - DNA, 11 bp, Homo sapiens
attaagcaaat

SEQ ID NO: 5469981 - DNA, 12 bp, Homo sapiens
attaagcacaca

SEQ ID NO: 5469982 - DNA, 17 bp, Homo sapiens
attaagcacacacatct

SEQ ID NO: 5469983 - DNA, 20 bp, Homo sapiens
attaagcacattattgtaga

SEQ ID NO: 5469984 - DNA, 22 bp, Homo sapiens
attaagcacattattgtagaga

SEQ ID NO: 5469985 - DNA, 21 bp, Homo sapiens
attaagcactttaagctcctt

SEQ ID NO: 5469986 - DNA, 14 bp, Homo sapiens
attaagcagaaaca

SEQ ID NO: 5469987 - DNA, 12 bp, Homo sapiens
attaagcagttc

SEQ ID NO: 5469988 - DNA, 13 bp, Homo sapiens
attaagcagttca

SEQ ID NO: 5469989 - DNA, 20 bp, Homo sapiens
attaagcatgacagaaaata

SEQ ID NO: 5469990 - DNA, 20 bp, Homo sapiens
attaagcattttgaaacaaa

SEQ ID NO: 5469991 - DNA, 14 bp, Homo sapiens
attaagccaaacat

SEQ ID NO: 5469992 - DNA, 17 bp, Homo sapiens
attaagccacttaaaat

SEQ ID NO: 5469993 - DNA, 19 bp, Homo sapiens
attaagccaggaaacatga

SEQ ID NO: 5469994 - DNA, 18 bp, Homo sapiens
attaagcccacagtatat

SEQ ID NO: 5469995 - DNA, 22 bp, Homo sapiens
attaagccccaacatgttcaga

SEQ ID NO: 5469996 - DNA, 20 bp, Homo sapiens
attaagccctcttccatcat

SEQ ID NO: 5469997 - DNA, 21 bp, Homo sapiens
attaagcccttatttgttttg

SEQ ID NO: 5469998 - DNA, 21 bp, Homo sapiens
attaagcctaccgtatttcag

SEQ ID NO: 5469999 - DNA, 19 bp, Homo sapiens
attaagctctcatagctca

SEQ ID NO: 5470000 - DNA, 22 bp, Homo sapiens
attaagctgttcctgttcagta

SEQ ID NO: 5470001 - DNA, 13 bp, Homo sapiens
attaagcttaaaa

SEQ ID NO: 5470002 - DNA, 22 bp, Homo sapiens
attaagcttaaaaaagaaagat

SEQ ID NO: 5470003 - DNA, 21 bp, Homo sapiens
attaagcttttcattttaata

SEQ ID NO: 5470004 - DNA, 18 bp, Homo sapiens
attaagctttttggaatc

SEQ ID NO: 5470005 - DNA, 20 bp, Homo sapiens
attaagctttttttttttga

SEQ ID NO: 5470006 - DNA, 14 bp, Homo sapiens
attaaggaaatgtt

SEQ ID NO: 5470007 - DNA, 13 bp, Homo sapiens
attaaggaagaca

SEQ ID NO: 5470008 - DNA, 19 bp, Homo sapiens
attaaggcaactgaacaaa

SEQ ID NO: 5470009 - DNA, 19 bp, Homo sapiens
attaagggaaaggaaaaga

SEQ ID NO: 5470010 - DNA, 21 bp, Homo sapiens
attaagggacatttctataaa

SEQ ID NO: 5470011 - DNA, 22 bp, Homo sapiens
attaagggacatttctataaaa

SEQ ID NO: 5470012 - DNA, 14 bp, Homo sapiens
attaagggtaggat

SEQ ID NO: 5470013 - DNA, 14 bp, Homo sapiens
attaaggtacatca

SEQ ID NO: 5470014 - DNA, 22 bp, Homo sapiens
attaaggtacatcattattgta

SEQ ID NO: 5470015 - DNA, 14 bp, Homo sapiens
attaaggtatttcg

SEQ ID NO: 5470016 - DNA, 17 bp, Homo sapiens
attaaggtctctctttg

SEQ ID NO: 5470017 - DNA, 21 bp, Homo sapiens
attaaggtctctctttggact

SEQ ID NO: 5470018 - DNA, 23 bp, Homo sapiens
attaaggtctgggagtgttctgt

SEQ ID NO: 5470019 - DNA, 15 bp, Homo sapiens
attaaggtttgccct

SEQ ID NO: 5470020 - DNA, 20 bp, Homo sapiens
attaaggtttgccctgcctg

SEQ ID NO: 5470021 - DNA, 15 bp, Homo sapiens
attaagtaatcaata

SEQ ID NO: 5470022 - DNA, 21 bp, Homo sapiens
attaagtaatctttttacagt

SEQ ID NO: 5470023 - DNA, 15 bp, Homo sapiens
attaagtaatgataa

SEQ ID NO: 5470024 - DNA, 15 bp, Homo sapiens
attaagtagatgaaa

SEQ ID NO: 5470025 - DNA, 14 bp, Homo sapiens
attaagtatatttg

SEQ ID NO: 5470026 - DNA, 16 bp, Homo sapiens
attaagtatatttgta

SEQ ID NO: 5470027 - DNA, 19 bp, Homo sapiens
attaagtatatttgtaaaa

SEQ ID NO: 5470028 - DNA, 23 bp, Homo sapiens
attaagtatatttgtaaaagcta

SEQ ID NO: 5470029 - DNA, 17 bp, Homo sapiens
attaagtatctgacatc

SEQ ID NO: 5470030 - DNA, 22 bp, Homo sapiens
attaagtatctgggattattct

SEQ ID NO: 5470031 - DNA, 22 bp, Homo sapiens
attaagtattccttggcccagc

SEQ ID NO: 5470032 - DNA, 20 bp, Homo sapiens
attaagtcagtggctttgca

SEQ ID NO: 5470033 - DNA, 15 bp, Homo sapiens
attaagtcatcatct

SEQ ID NO: 5470034 - DNA, 14 bp, Homo sapiens
attaagtcatgtgt

SEQ ID NO: 5470035 - DNA, 16 bp, Homo sapiens
attaagtcatgtgtga

SEQ ID NO: 5470036 - DNA, 22 bp, Homo sapiens
attaagtctcagtacacttcct

SEQ ID NO: 5470037 - DNA, 21 bp, Homo sapiens
attaagtggggtagactgagg

SEQ ID NO: 5470038 - DNA, 19 bp, Homo sapiens
attaagtggtcccaatgct

SEQ ID NO: 5470039 - DNA, 20 bp, Homo sapiens
attaagtggttactttgtgt

SEQ ID NO: 5470040 - DNA, 12 bp, Homo sapiens
attaagtgttga

SEQ ID NO: 5470041 - DNA, 14 bp, Homo sapiens
attaagtgttgtac

SEQ ID NO: 5470042 - DNA, 13 bp, Homo sapiens
attaagttatctt

SEQ ID NO: 5470043 - DNA, 22 bp, Homo sapiens
attaagtttgaaaatagttacc

SEQ ID NO: 5470044 - DNA, 18 bp, Homo sapiens
attaagttttaaataaac

SEQ ID NO: 5470045 - DNA, 14 bp, Homo sapiens
attaataaaactgt

SEQ ID NO: 5470046 - DNA, 16 bp, Homo sapiens
attaataaaactgtgc

SEQ ID NO: 5470047 - DNA, 12 bp, Homo sapiens
attaataaaata

SEQ ID NO: 5470048 - DNA, 15 bp, Homo sapiens
attaataaaatatct

SEQ ID NO: 5470049 - DNA, 18 bp, Homo sapiens
attaataaagaaaaagaa

SEQ ID NO: 5470050 - DNA, 11 bp, Homo sapiens
attaataaagc

SEQ ID NO: 5470051 - DNA, 12 bp, Homo sapiens
attaataaagca

SEQ ID NO: 5470052 - DNA, 13 bp, Homo sapiens
attaataaagcat

SEQ ID NO: 5470053 - DNA, 15 bp, Homo sapiens
attaataaagcattc

SEQ ID NO: 5470054 - DNA, 16 bp, Homo sapiens
attaataaagcattct

SEQ ID NO: 5470055 - DNA, 17 bp, Homo sapiens
attaataaatagagcaa

SEQ ID NO: 5470056 - DNA, 15 bp, Homo sapiens
attaataaatttata

SEQ ID NO: 5470057 - DNA, 14 bp, Homo sapiens
attaataacctgcc

SEQ ID NO: 5470058 - DNA, 17 bp, Homo sapiens
attaataactgaataaa

SEQ ID NO: 5470059 - DNA, 12 bp, Homo sapiens
attaataacttt

SEQ ID NO: 5470060 - DNA, 22 bp, Homo sapiens
attaataactttctctgtgaaa

SEQ ID NO: 5470061 - DNA, 23 bp, Homo sapiens
attaataactttctctgtgaaag

SEQ ID NO: 5470062 - DNA, 21 bp, Homo sapiens
attaataagatttttcaaaat

SEQ ID NO: 5470063 - DNA, 11 bp, Homo sapiens
attaataatag

SEQ ID NO: 5470064 - DNA, 17 bp, Homo sapiens
attaataatatttatgt

SEQ ID NO: 5470065 - DNA, 12 bp, Homo sapiens
attaataatctt

SEQ ID NO: 5470066 - DNA, 15 bp, Homo sapiens
attaataatgaagta

SEQ ID NO: 5470067 - DNA, 15 bp, Homo sapiens
attaatacaatatta

SEQ ID NO: 5470068 - DNA, 18 bp, Homo sapiens
attaatacaatattaatt

SEQ ID NO: 5470069 - DNA, 19 bp, Homo sapiens
ccacaggatctgaactttg

SEQ ID NO: 5470070 - DNA, 22 bp, Homo sapiens
ccacaggatgaactagccatga

SEQ ID NO: 5470071 - DNA, 15 bp, Homo sapiens
ccacaggatgcatat

SEQ ID NO: 5470072 - DNA, 17 bp, Homo sapiens
ccacaggcaaaactcag

SEQ ID NO: 5470073 - DNA, 15 bp, Homo sapiens
ccacaggcagcccag

SEQ ID NO: 5470074 - DNA, 13 bp, Homo sapiens
ccacaggcagctt

SEQ ID NO: 5470075 - DNA, 19 bp, Homo sapiens
ccacaggcaggggtgagag

SEQ ID NO: 5470076 - DNA, 14 bp, Homo sapiens
ccacaggcagtcca

SEQ ID NO: 5470077 - DNA, 23 bp, Homo sapiens
ccacaggcatctacacagcctgg

SEQ ID NO: 5470078 - DNA, 18 bp, Homo sapiens
ccacaggccactgcaaac

SEQ ID NO: 5470079 - DNA, 16 bp, Homo sapiens
ccacaggcccacagta

SEQ ID NO: 5470080 - DNA, 20 bp, Homo sapiens
ccacaggccccccgcagcac

SEQ ID NO: 5470081 - DNA, 21 bp, Homo sapiens
ccacaggccccccgcagcacc

SEQ ID NO: 5470082 - DNA, 16 bp, Homo sapiens
ccacaggcccttcctc

SEQ ID NO: 5470083 - DNA, 18 bp, Homo sapiens
ccacaggcccttcctctc

SEQ ID NO: 5470084 - DNA, 19 bp, Homo sapiens
ccacaggccctttcctcag

SEQ ID NO: 5470085 - DNA, 16 bp, Homo sapiens
ccacaggccgccctgc

SEQ ID NO: 5470086 - DNA, 17 bp, Homo sapiens
ccacaggccgccctgcg

SEQ ID NO: 5470087 - DNA, 13 bp, Homo sapiens
ccacaggcctccc

SEQ ID NO: 5470088 - DNA, 14 bp, Homo sapiens
ccacaggcctgaga

SEQ ID NO: 5470089 - DNA, 22 bp, Homo sapiens
ccacaggcctgagatttcatct

SEQ ID NO: 5470090 - DNA, 20 bp, Homo sapiens
ccacaggcctgttcccttgt

SEQ ID NO: 5470091 - DNA, 16 bp, Homo sapiens
ccacaggctcaggcag

SEQ ID NO: 5470092 - DNA, 20 bp, Homo sapiens
ccacaggctcaggcaggggc

SEQ ID NO: 5470093 - DNA, 21 bp, Homo sapiens
ccacaggcttagggacaggac

SEQ ID NO: 5470094 - DNA, 21 bp, Homo sapiens
ccacagggaaatgtgtatcta

SEQ ID NO: 5470095 - DNA, 17 bp, Homo sapiens
ccacagggaagctcaca

SEQ ID NO: 5470096 - DNA, 12 bp, Homo sapiens
ccacagggacca

SEQ ID NO: 5470097 - DNA, 17 bp, Homo sapiens
ccacagggaccagggcc

SEQ ID NO: 5470098 - DNA, 15 bp, Homo sapiens
ccacagggagccaca

SEQ ID NO: 5470099 - DNA, 12 bp, Homo sapiens
ccacagggccag

SEQ ID NO: 5470100 - DNA, 15 bp, Homo sapiens
ccacagggccagagg

SEQ ID NO: 5470101 - DNA, 16 bp, Homo sapiens
ccacagggccagaggg

SEQ ID NO: 5470102 - DNA, 19 bp, Homo sapiens
ccacagggccagagggagc

SEQ ID NO: 5470103 - DNA, 24 bp, Homo sapiens
ccacagggccagagggagctggaa

SEQ ID NO: 5470104 - DNA, 12 bp, Homo sapiens
ccacagggcctg

SEQ ID NO: 5470105 - DNA, 21 bp, Homo sapiens
ccacagggcctgacttttaca

SEQ ID NO: 5470106 - DNA, 19 bp, Homo sapiens
ccacagggctcctgaagga

SEQ ID NO: 5470107 - DNA, 14 bp, Homo sapiens
ccacaggggcaggc

SEQ ID NO: 5470108 - DNA, 16 bp, Homo sapiens
ccacaggggcaggcct

SEQ ID NO: 5470109 - DNA, 17 bp, Homo sapiens
ccacaggggcaggcctg

SEQ ID NO: 5470110 - DNA, 18 bp, Homo sapiens
ccacaggggcaggcctgg

SEQ ID NO: 5470111 - DNA, 19 bp, Homo sapiens
ccacagggtcccacagcca

SEQ ID NO: 5470112 - DNA, 11 bp, Homo sapiens
ccacagggtct

SEQ ID NO: 5470113 - DNA, 16 bp, Homo sapiens
ccacagggtctgcctc

SEQ ID NO: 5470114 - DNA, 15 bp, Homo sapiens
ccacagggtgggatg

SEQ ID NO: 5470115 - DNA, 17 bp, Homo sapiens
ccacaggtcatcagatg

SEQ ID NO: 5470116 - DNA, 21 bp, Homo sapiens
ccacaggtcatcagatgcctg

SEQ ID NO: 5470117 - DNA, 22 bp, Homo sapiens
ccacaggtcttcactgcccagg

SEQ ID NO: 5470118 - DNA, 17 bp, Homo sapiens
ccacaggtgaggggcag

SEQ ID NO: 5470119 - DNA, 15 bp, Homo sapiens
ccacaggtgtcccca

SEQ ID NO: 5470120 - DNA, 22 bp, Homo sapiens
ccacaggtgtccccagcccact

SEQ ID NO: 5470121 - DNA, 22 bp, Homo sapiens
ccacaggtttccccaaggcctc

SEQ ID NO: 5470122 - DNA, 16 bp, Homo sapiens
ccacagtaagttccta

SEQ ID NO: 5470123 - DNA, 18 bp, Homo sapiens
ccacagtacatatgtaat

SEQ ID NO: 5470124 - DNA, 15 bp, Homo sapiens
ccacagtactcactt

SEQ ID NO: 5470125 - DNA, 23 bp, Homo sapiens
ccacagtatattttatttcaatg

SEQ ID NO: 5470126 - DNA, 15 bp, Homo sapiens
ccacagtcactggat

SEQ ID NO: 5470127 - DNA, 18 bp, Homo sapiens
ccacagtcccccacccac

SEQ ID NO: 5470128 - DNA, 18 bp, Homo sapiens
ccacagtcctcacagcct

SEQ ID NO: 5470129 - DNA, 15 bp, Homo sapiens
ccacagtctctggga

SEQ ID NO: 5470130 - DNA, 15 bp, Homo sapiens
ccacagtgacagtca

SEQ ID NO: 5470131 - DNA, 17 bp, Homo sapiens
ccacagtgacagtcact

SEQ ID NO: 5470132 - DNA, 18 bp, Homo sapiens
ccacagtgacagtcactt

SEQ ID NO: 5470133 - DNA, 17 bp, Homo sapiens
ccacagtgactgggccc

SEQ ID NO: 5470134 - DNA, 22 bp, Homo sapiens
ccacagtgactgggccctgtcc

SEQ ID NO: 5470135 - DNA, 23 bp, Homo sapiens
ccacagtgactgggccctgtcca

SEQ ID NO: 5470136 - DNA, 23 bp, Homo sapiens
ccacagtgagaggggagggctcc

SEQ ID NO: 5470137 - DNA, 16 bp, Homo sapiens
ccacagtgctcagttg

SEQ ID NO: 5470138 - DNA, 13 bp, Homo sapiens
ccacagtgctgct

SEQ ID NO: 5470139 - DNA, 14 bp, Homo sapiens
ccacagtgctgtct

SEQ ID NO: 5470140 - DNA, 15 bp, Homo sapiens
ccacagtggggccca

SEQ ID NO: 5470141 - DNA, 21 bp, Homo sapiens
ccacagtggggcccatggccc

SEQ ID NO: 5470142 - DNA, 22 bp, Homo sapiens
ccacagtgggtggcacctcctg

SEQ ID NO: 5470143 - DNA, 21 bp, Homo sapiens
ccacagtgtaccattaaaata

SEQ ID NO: 5470144 - DNA, 23 bp, Homo sapiens
ccacagtgtcactggtcaggtgc

SEQ ID NO: 5470145 - DNA, 14 bp, Homo sapiens
ccacagtgtcaggc

SEQ ID NO: 5470146 - DNA, 17 bp, Homo sapiens
ccacagttatcttagct

SEQ ID NO: 5470147 - DNA, 22 bp, Homo sapiens
ccacagttcttaatacaggaga

SEQ ID NO: 5470148 - DNA, 16 bp, Homo sapiens
ccacagttgccaccac

SEQ ID NO: 5470149 - DNA, 14 bp, Homo sapiens
ccacagttgctcta

SEQ ID NO: 5470150 - DNA, 23 bp, Homo sapiens
ccacagttgtcagttgtgaagag

SEQ ID NO: 5470151 - DNA, 21 bp, Homo sapiens
ccacagttgtgttcatgctga

SEQ ID NO: 5470152 - DNA, 15 bp, Homo sapiens
ccacagttttaataa

SEQ ID NO: 5470153 - DNA, 18 bp, Homo sapiens
ccacagttttagttggtg

SEQ ID NO: 5470154 - DNA, 14 bp, Homo sapiens
ccacagttttgcct

SEQ ID NO: 5470155 - DNA, 21 bp, Homo sapiens
ccacataaaagccccagcttg

SEQ ID NO: 5470156 - DNA, 24 bp, Homo sapiens
ccacataaaagccccagcttggct

SEQ ID NO: 5470157 - DNA, 21 bp, Homo sapiens
ccacataaacacttctcctta

SEQ ID NO: 5470158 - DNA, 23 bp, Homo sapiens
ccacataaacacttctccttaac

SEQ ID NO: 5470159 - DNA, 14 bp, Homo sapiens
ccacataaatttta

SEQ ID NO: 5470160 - DNA, 13 bp, Homo sapiens
ccacataagtcca

SEQ ID NO: 5470161 - DNA, 24 bp, Homo sapiens
ccacataatacattccatcacagc

SEQ ID NO: 5470162 - DNA, 23 bp, Homo sapiens
ccacataattctgttactttgct

SEQ ID NO: 5470163 - DNA, 20 bp, Homo sapiens
ccacatacaacacaaagaga

SEQ ID NO: 5470164 - DNA, 19 bp, Homo sapiens
ccacatacaggtgctcaat

SEQ ID NO: 5470165 - DNA, 12 bp, Homo sapiens
ccacatacctct

SEQ ID NO: 5470166 - DNA, 23 bp, Homo sapiens
ccacatacgtgagggggagctga

SEQ ID NO: 5470167 - DNA, 23 bp, Homo sapiens
ccacatagcatgcttcctttctc

SEQ ID NO: 5470168 - DNA, 20 bp, Homo sapiens
ccacatatctagatttttct

SEQ ID NO: 5470169 - DNA, 19 bp, Homo sapiens
ccacatatcttacagccag

SEQ ID NO: 5470170 - DNA, 23 bp, Homo sapiens
ccacatatttcaaaaacatgctt

SEQ ID NO: 5470171 - DNA, 17 bp, Homo sapiens
ccacatcagccccacag

SEQ ID NO: 5470172 - DNA, 19 bp, Homo sapiens
ccacatcatggaccaaatg

SEQ ID NO: 5470173 - DNA, 22 bp, Homo sapiens
ccacatccaacatttcctcagg

SEQ ID NO: 5470174 - DNA, 18 bp, Homo sapiens
ccacatccaactccagca

SEQ ID NO: 5470175 - DNA, 22 bp, Homo sapiens
ccacatccacacacgcaggaac

SEQ ID NO: 5470176 - DNA, 16 bp, Homo sapiens
ccacatccacagtctc

SEQ ID NO: 5470177 - DNA, 22 bp, Homo sapiens
ccacatccaccccagccccact

SEQ ID NO: 5470178 - DNA, 22 bp, Homo sapiens
ccacatcccactcacaacagct

SEQ ID NO: 5470179 - DNA, 14 bp, Homo sapiens
ccacatcccactgg

SEQ ID NO: 5470180 - DNA, 20 bp, Homo sapiens
ccacatcccactggatctgg

SEQ ID NO: 5470181 - DNA, 14 bp, Homo sapiens
ccacatcccagcag

SEQ ID NO: 5470182 - DNA, 16 bp, Homo sapiens
ccacatcccagcagcc

SEQ ID NO: 5470183 - DNA, 17 bp, Homo sapiens
ccacatcccagcagccc

SEQ ID NO: 5470184 - DNA, 15 bp, Homo sapiens
ccacatcccaggctt

SEQ ID NO: 5470185 - DNA, 13 bp, Homo sapiens
ccacatccccaat

SEQ ID NO: 5470186 - DNA, 17 bp, Homo sapiens
ccacatccccaccttcc

SEQ ID NO: 5470187 - DNA, 21 bp, Homo sapiens
ccacatccccagagcccagct

SEQ ID NO: 5470188 - DNA, 15 bp, Homo sapiens
ccacatcctcatggc

SEQ ID NO: 5470189 - DNA, 19 bp, Homo sapiens
ccacatcctccgtccagcc

SEQ ID NO: 5470190 - DNA, 13 bp, Homo sapiens
ccacatcctgtgt

SEQ ID NO: 5470191 - DNA, 14 bp, Homo sapiens
ccacatcctgtgtc

SEQ ID NO: 5470192 - DNA, 15 bp, Homo sapiens
ccacatcctgtgtca

SEQ ID NO: 5470193 - DNA, 13 bp, Homo sapiens
ccacatcgcacac

SEQ ID NO: 5470194 - DNA, 19 bp, Homo sapiens
ccacatcgcacactggggc

SEQ ID NO: 5470195 - DNA, 16 bp, Homo sapiens
ccacatctctgaaagc

SEQ ID NO: 5470196 - DNA, 15 bp, Homo sapiens
ccacatctgccagac

SEQ ID NO: 5470197 - DNA, 12 bp, Homo sapiens
ccacatctgcct

SEQ ID NO: 5470198 - DNA, 13 bp, Homo sapiens
ccacatctgcctc

SEQ ID NO: 5470199 - DNA, 18 bp, Homo sapiens
ccacatctgcctcctctc

SEQ ID NO: 5470200 - DNA, 19 bp, Homo sapiens
ccacatctgcctcctctcc

SEQ ID NO: 5470201 - DNA, 22 bp, Homo sapiens
ccacatctgccttaaaaccaaa

SEQ ID NO: 5470202 - DNA, 23 bp, Homo sapiens
ccacatctgccttaaaaccaaag

SEQ ID NO: 5470203 - DNA, 13 bp, Homo sapiens
ccacatctgctct

SEQ ID NO: 5470204 - DNA, 18 bp, Homo sapiens
ccacatctgtcctcaccc

SEQ ID NO: 5470205 - DNA, 18 bp, Homo sapiens
ccacatcttccatttcca

SEQ ID NO: 5470206 - DNA, 18 bp, Homo sapiens
ccacatcttgctctgctg

SEQ ID NO: 5470207 - DNA, 19 bp, Homo sapiens
ccacatcttgctctgctga

SEQ ID NO: 5470208 - DNA, 14 bp, Homo sapiens
ccacatgaaaccta

SEQ ID NO: 5470209 - DNA, 21 bp, Homo sapiens
ccacatgaggccatctcagga

SEQ ID NO: 5470210 - DNA, 21 bp, Homo sapiens
ccacatgatcttgagatttct

SEQ ID NO: 5470211 - DNA, 13 bp, Homo sapiens
ccacatgcacatg

SEQ ID NO: 5470212 - DNA, 17 bp, Homo sapiens
ccacatgcacatgtatt

SEQ ID NO: 5470213 - DNA, 13 bp, Homo sapiens
ccacatgcatgtc

SEQ ID NO: 5470214 - DNA, 14 bp, Homo sapiens
ccacatgcatgtct

SEQ ID NO: 5470215 - DNA, 16 bp, Homo sapiens
ccacatgccactgcct

SEQ ID NO: 5470216 - DNA, 20 bp, Homo sapiens
ccacatgccgcgtccctgcc

SEQ ID NO: 5470217 - DNA, 21 bp, Homo sapiens
ccacatgccgcgtccctgccc

SEQ ID NO: 5470218 - DNA, 15 bp, Homo sapiens
ccacatgctgcctgg

SEQ ID NO: 5470219 - DNA, 22 bp, Homo sapiens
ccacatgctgcctggcacagac

SEQ ID NO: 5470220 - DNA, 21 bp, Homo sapiens
ccacatggaacttaaaacata

SEQ ID NO: 5470221 - DNA, 15 bp, Homo sapiens
ccacatggagccccc

SEQ ID NO: 5470222 - DNA, 15 bp, Homo sapiens
ccacatggcacagag

SEQ ID NO: 5470223 - DNA, 18 bp, Homo sapiens
ccacatggccatcttctt

SEQ ID NO: 5470224 - DNA, 21 bp, Homo sapiens
ccacatggccatcttctttct

SEQ ID NO: 5470225 - DNA, 18 bp, Homo sapiens
ccacatggccgctgccca

SEQ ID NO: 5470226 - DNA, 23 bp, Homo sapiens
ccacatgggaggaaggcccaggg

SEQ ID NO: 5470227 - DNA, 15 bp, Homo sapiens
ccacatgggctgggg

SEQ ID NO: 5470228 - DNA, 20 bp, Homo sapiens
ccacatgggctgggggccag

SEQ ID NO: 5470229 - DNA, 21 bp, Homo sapiens
ccacatggtcttcgtccttga

SEQ ID NO: 5470230 - DNA, 16 bp, Homo sapiens
ccacatggtgtctccc

SEQ ID NO: 5470231 - DNA, 20 bp, Homo sapiens
ccacatggtgtctcccaaca

SEQ ID NO: 5470232 - DNA, 16 bp, Homo sapiens
ccacatggtgtggcca

SEQ ID NO: 5470233 - DNA, 22 bp, Homo sapiens
ccacatgtatttattcctctgt

SEQ ID NO: 5470234 - DNA, 14 bp, Homo sapiens
ccacatgtcaccgt

SEQ ID NO: 5470235 - DNA, 13 bp, Homo sapiens
ccacatgtccagc

SEQ ID NO: 5470236 - DNA, 16 bp, Homo sapiens
ccacatgtgcacatgc

SEQ ID NO: 5470237 - DNA, 21 bp, Homo sapiens
ccacatgttctaggtttcagc

SEQ ID NO: 5470238 - DNA, 16 bp, Homo sapiens
ccacattaaagaagac

SEQ ID NO: 5470239 - DNA, 15 bp, Homo sapiens
ccacattccatgacg

SEQ ID NO: 5470240 - DNA, 15 bp, Homo sapiens
ccacattcccatgaa

SEQ ID NO: 5470241 - DNA, 23 bp, Homo sapiens
ccacattcccccttcaacaaaca

SEQ ID NO: 5470242 - DNA, 13 bp, Homo sapiens
ccacattctactt

SEQ ID NO: 5470243 - DNA, 13 bp, Homo sapiens
ccacattctgctg

SEQ ID NO: 5470244 - DNA, 23 bp, Homo sapiens
ccacattctgctgcccccagacc

SEQ ID NO: 5470245 - DNA, 16 bp, Homo sapiens
ccaccctttctggcac

SEQ ID NO: 5470246 - DNA, 19 bp, Homo sapiens
ccaccgaagagccctgagc

SEQ ID NO: 5470247 - DNA, 17 bp, Homo sapiens
ccaccgaccaactgccc

SEQ ID NO: 5470248 - DNA, 12 bp, Homo sapiens
ccaccgaccccc

SEQ ID NO: 5470249 - DNA, 13 bp, Homo sapiens
ccaccgaccccct

SEQ ID NO: 5470250 - DNA, 14 bp, Homo sapiens
ccaccgagctctgt

SEQ ID NO: 5470251 - DNA, 16 bp, Homo sapiens
ccaccgagctggagcg

SEQ ID NO: 5470252 - DNA, 17 bp, Homo sapiens
ccaccgaggagccccag

SEQ ID NO: 5470253 - DNA, 22 bp, Homo sapiens
ccaccgaggagccccagccccg

SEQ ID NO: 5470254 - DNA, 14 bp, Homo sapiens
ccaccgatggagcc

SEQ ID NO: 5470255 - DNA, 20 bp, Homo sapiens
ccaccgatggagcccccaga

SEQ ID NO: 5470256 - DNA, 16 bp, Homo sapiens
ccaccgcagaaggaag

SEQ ID NO: 5470257 - DNA, 14 bp, Homo sapiens
ccaccgcagacagg

SEQ ID NO: 5470258 - DNA, 18 bp, Homo sapiens
ccaccgcagacaggacca

SEQ ID NO: 5470259 - DNA, 22 bp, Homo sapiens
ccaccgcagcgtcccccgccgc

SEQ ID NO: 5470260 - DNA, 21 bp, Homo sapiens
ccaccgcaggggactgtctca

SEQ ID NO: 5470261 - DNA, 18 bp, Homo sapiens
ccaccgcatcctcactgg

SEQ ID NO: 5470262 - DNA, 17 bp, Homo sapiens
ccaccgcatgccccctc

SEQ ID NO: 5470263 - DNA, 18 bp, Homo sapiens
ccaccgcatgccccctcg

SEQ ID NO: 5470264 - DNA, 14 bp, Homo sapiens
ccaccgccacccca

SEQ ID NO: 5470265 - DNA, 18 bp, Homo sapiens
ccaccgccaccgtgtgcc

SEQ ID NO: 5470266 - DNA, 18 bp, Homo sapiens
ccaccgcccactctccac

SEQ ID NO: 5470267 - DNA, 15 bp, Homo sapiens
ccaccgccctcctcc

SEQ ID NO: 5470268 - DNA, 16 bp, Homo sapiens
ccaccgccctcctcca

SEQ ID NO: 5470269 - DNA, 15 bp, Homo sapiens
ccaccgccctgcctc

SEQ ID NO: 5470270 - DNA, 18 bp, Homo sapiens
ccaccgccggggtcctgg

SEQ ID NO: 5470271 - DNA, 19 bp, Homo sapiens
ccaccgccggggtcctggg

SEQ ID NO: 5470272 - DNA, 20 bp, Homo sapiens
ccaccgccggggtcctggga

SEQ ID NO: 5470273 - DNA, 14 bp, Homo sapiens
ccaccgcctctggc

SEQ ID NO: 5470274 - DNA, 19 bp, Homo sapiens
ccaccgccttgcccagcct

SEQ ID NO: 5470275 - DNA, 14 bp, Homo sapiens
ccaccgcgcccagc

SEQ ID NO: 5470276 - DNA, 12 bp, Homo sapiens
ccaccgcgcccc

SEQ ID NO: 5470277 - DNA, 14 bp, Homo sapiens
ccaccgctcagtgt

SEQ ID NO: 5470278 - DNA, 14 bp, Homo sapiens
ccaccgctccccag

SEQ ID NO: 5470279 - DNA, 21 bp, Homo sapiens
ccaccgctccccagcccaggg

SEQ ID NO: 5470280 - DNA, 20 bp, Homo sapiens
ccaccgctgccagcacagag

SEQ ID NO: 5470281 - DNA, 14 bp, Homo sapiens
ccaccgctgcctcg

SEQ ID NO: 5470282 - DNA, 18 bp, Homo sapiens
ccaccggaactgggctgg

SEQ ID NO: 5470283 - DNA, 18 bp, Homo sapiens
ccaccggatgctgtgcct

SEQ ID NO: 5470284 - DNA, 20 bp, Homo sapiens
ccaccggatgctgtgcctgg

SEQ ID NO: 5470285 - DNA, 13 bp, Homo sapiens
ccaccggcccctg

SEQ ID NO: 5470286 - DNA, 23 bp, Homo sapiens
ccaccggcctgtgggtctctgaa

SEQ ID NO: 5470287 - DNA, 17 bp, Homo sapiens
ccaccgggacagacctg

SEQ ID NO: 5470288 - DNA, 19 bp, Homo sapiens
ccaccgggcatgtctgcct

SEQ ID NO: 5470289 - DNA, 14 bp, Homo sapiens
ccaccgggccactc

SEQ ID NO: 5470290 - DNA, 18 bp, Homo sapiens
ccaccgggccactccttc

SEQ ID NO: 5470291 - DNA, 14 bp, Homo sapiens
ccaccgggctgcag

SEQ ID NO: 5470292 - DNA, 15 bp, Homo sapiens
ccaccgggctgcagg

SEQ ID NO: 5470293 - DNA, 19 bp, Homo sapiens
ccaccgggctgggagctct

SEQ ID NO: 5470294 - DNA, 21 bp, Homo sapiens
ccaccggggaacccagccctg

SEQ ID NO: 5470295 - DNA, 17 bp, Homo sapiens
ccaccggggcaagaggg

SEQ ID NO: 5470296 - DNA, 19 bp, Homo sapiens
ccaccggggcaagagggaa

SEQ ID NO: 5470297 - DNA, 16 bp, Homo sapiens
ccaccggggcactggc

SEQ ID NO: 5470298 - DNA, 13 bp, Homo sapiens
ccaccgggtgaaa

SEQ ID NO: 5470299 - DNA, 23 bp, Homo sapiens
ccaccgggttctgcagcggcaga

SEQ ID NO: 5470300 - DNA, 17 bp, Homo sapiens
ccaccggtccagctggc

SEQ ID NO: 5470301 - DNA, 14 bp, Homo sapiens
ccaccggtgccaaa

SEQ ID NO: 5470302 - DNA, 14 bp, Homo sapiens
ccaccggtgggcag

SEQ ID NO: 5470303 - DNA, 20 bp, Homo sapiens
ccaccggttgcttctgggaa

SEQ ID NO: 5470304 - DNA, 21 bp, Homo sapiens
ccaccgtagggcctgactcct

SEQ ID NO: 5470305 - DNA, 18 bp, Homo sapiens
ccaccgtccctctgcaga

SEQ ID NO: 5470306 - DNA, 15 bp, Homo sapiens
ccaccgtccgccctg

SEQ ID NO: 5470307 - DNA, 17 bp, Homo sapiens
ccaccgtccgccctgct

SEQ ID NO: 5470308 - DNA, 20 bp, Homo sapiens
ccaccgtccgccctgctcct

SEQ ID NO: 5470309 - DNA, 20 bp, Homo sapiens
ccaccgtctcggccctgaac

SEQ ID NO: 5470310 - DNA, 14 bp, Homo sapiens
ccaccgtgcctggc

SEQ ID NO: 5470311 - DNA, 15 bp, Homo sapiens
ccaccgtgcctggct

SEQ ID NO: 5470312 - DNA, 18 bp, Homo sapiens
ccaccgttcaagcgccag

SEQ ID NO: 5470313 - DNA, 19 bp, Homo sapiens
ccaccgttgtctcatgcca

SEQ ID NO: 5470314 - DNA, 21 bp, Homo sapiens
ccacctaaagggaagccctga

SEQ ID NO: 5470315 - DNA, 23 bp, Homo sapiens
ccacctaattcgatgaaggctgc

SEQ ID NO: 5470316 - DNA, 19 bp, Homo sapiens
ccacctacaatacatctga

SEQ ID NO: 5470317 - DNA, 20 bp, Homo sapiens
ccacctacacccctgtgctc

SEQ ID NO: 5470318 - DNA, 13 bp, Homo sapiens
ccacctacccagc

SEQ ID NO: 5470319 - DNA, 20 bp, Homo sapiens
ccacctaccttcaaagctga

SEQ ID NO: 5470320 - DNA, 14 bp, Homo sapiens
ccacctactctcag

SEQ ID NO: 5470321 - DNA, 22 bp, Homo sapiens
ccacctactgcactttccccct

SEQ ID NO: 5470322 - DNA, 22 bp, Homo sapiens
ccacctacttagatatttcatg

SEQ ID NO: 5470323 - DNA, 19 bp, Homo sapiens
ccacctacttgtgactgaa

SEQ ID NO: 5470324 - DNA, 21 bp, Homo sapiens
ccacctagaaaggggcccatt

SEQ ID NO: 5470325 - DNA, 22 bp, Homo sapiens
ccacctagaagtctccctgcac

SEQ ID NO: 5470326 - DNA, 21 bp, Homo sapiens
ccacctagactgtaaacctct

SEQ ID NO: 5470327 - DNA, 16 bp, Homo sapiens
ccacctagtgccccag

SEQ ID NO: 5470328 - DNA, 19 bp, Homo sapiens
ccacctagtgccccagact

SEQ ID NO: 5470329 - DNA, 16 bp, Homo sapiens
ccacctagtggctgtc

SEQ ID NO: 5470330 - DNA, 19 bp, Homo sapiens
ccacctagtggctgtccag

SEQ ID NO: 5470331 - DNA, 20 bp, Homo sapiens
ccacctagtggctgtccagt

SEQ ID NO: 5470332 - DNA, 20 bp, Homo sapiens
ccacctatctcgtgggagag

SEQ ID NO: 5470333 - DNA, 20 bp, Homo sapiens
ccacctatgccagtgctcaa

SEQ ID NO: 5470334 - DNA, 20 bp, Homo sapiens
ccacctatgcctgtggtgaa

SEQ ID NO: 5470335 - DNA, 21 bp, Homo sapiens
ccacctatgcctgtggtgaag

SEQ ID NO: 5470336 - DNA, 14 bp, Homo sapiens
ccacctcaaattta

SEQ ID NO: 5470337 - DNA, 14 bp, Homo sapiens
ccacctcacagcta

SEQ ID NO: 5470338 - DNA, 12 bp, Homo sapiens
ccacctcacccc

SEQ ID NO: 5470339 - DNA, 15 bp, Homo sapiens
ccacctcacccggcc

SEQ ID NO: 5470340 - DNA, 19 bp, Homo sapiens
ccacctcacctagcctgat

SEQ ID NO: 5470341 - DNA, 19 bp, Homo sapiens
ccacctcacctctttgttc

SEQ ID NO: 5470342 - DNA, 18 bp, Homo sapiens
ccacctcactagctcccc

SEQ ID NO: 5470343 - DNA, 15 bp, Homo sapiens
ccacctcagaaagga

SEQ ID NO: 5470344 - DNA, 17 bp, Homo sapiens
ccacctcagcctcccag

SEQ ID NO: 5470345 - DNA, 19 bp, Homo sapiens
ccacctcagcctcccaggt

SEQ ID NO: 5470346 - DNA, 16 bp, Homo sapiens
ccacctcagccttgga

SEQ ID NO: 5470347 - DNA, 16 bp, Homo sapiens
ccacctcagggcacgc

SEQ ID NO: 5470348 - DNA, 20 bp, Homo sapiens
ccacctcagggcacgcagga

SEQ ID NO: 5470349 - DNA, 14 bp, Homo sapiens
ccacctcaggggag

SEQ ID NO: 5470350 - DNA, 18 bp, Homo sapiens
ccacctcatcactggact

SEQ ID NO: 5470351 - DNA, 19 bp, Homo sapiens
ccacctcatcactggactg

SEQ ID NO: 5470352 - DNA, 23 bp, Homo sapiens
ccacctcatcactggactgcatg

SEQ ID NO: 5470353 - DNA, 14 bp, Homo sapiens
ccacctccacccag

SEQ ID NO: 5470354 - DNA, 15 bp, Homo sapiens
ccacctccacccagc

SEQ ID NO: 5470355 - DNA, 23 bp, Homo sapiens
ccacctccacccccaagaaacct

SEQ ID NO: 5470356 - DNA, 13 bp, Homo sapiens
ccacctccacctg

SEQ ID NO: 5470357 - DNA, 19 bp, Homo sapiens
ccacctccagcccgggagc

SEQ ID NO: 5470358 - DNA, 13 bp, Homo sapiens
ccacctccagcct

SEQ ID NO: 5470359 - DNA, 24 bp, Homo sapiens
ccacctccagtccccctatccttg

SEQ ID NO: 5470360 - DNA, 19 bp, Homo sapiens
ccacctcccaagagggctc

SEQ ID NO: 5470361 - DNA, 20 bp, Homo sapiens
ccacctcccaaggactttcc

SEQ ID NO: 5470362 - DNA, 17 bp, Homo sapiens
ccacctcccacaaagga

SEQ ID NO: 5470363 - DNA, 14 bp, Homo sapiens
ccacctcccacccc

SEQ ID NO: 5470364 - DNA, 15 bp, Homo sapiens
ccacctcccacccca

SEQ ID NO: 5470365 - DNA, 19 bp, Homo sapiens
ccacctcccaccccactcc

SEQ ID NO: 5470366 - DNA, 19 bp, Homo sapiens
ccacctcccactcctgctg

SEQ ID NO: 5470367 - DNA, 12 bp, Homo sapiens
ccacctccccac

SEQ ID NO: 5470368 - DNA, 23 bp, Homo sapiens
ccacctccccacgccctcccctc

SEQ ID NO: 5470369 - DNA, 13 bp, Homo sapiens
ccacctccccagg

SEQ ID NO: 5470370 - DNA, 16 bp, Homo sapiens
ccacctccccaggccg

SEQ ID NO: 5470371 - DNA, 20 bp, Homo sapiens
ccacctcccccaaaccctgc

SEQ ID NO: 5470372 - DNA, 21 bp, Homo sapiens
ccacctcccccaaaccctgct

SEQ ID NO: 5470373 - DNA, 20 bp, Homo sapiens
ccacctccccctcccccttc

SEQ ID NO: 5470374 - DNA, 17 bp, Homo sapiens
ccacctcccctatccac

SEQ ID NO: 5470375 - DNA, 16 bp, Homo sapiens
ccacctccccttgggc

SEQ ID NO: 5470376 - DNA, 13 bp, Homo sapiens
ccacctcccgccc

SEQ ID NO: 5470377 - DNA, 22 bp, Homo sapiens
ccacctcccgggttcacgccat

SEQ ID NO: 5470378 - DNA, 15 bp, Homo sapiens
ccacctccctcacca

SEQ ID NO: 5470379 - DNA, 12 bp, Homo sapiens
ccacctccctgc

SEQ ID NO: 5470380 - DNA, 14 bp, Homo sapiens
ccacctccctgcaa

SEQ ID NO: 5470381 - DNA, 15 bp, Homo sapiens
ccacctccctgcaat

SEQ ID NO: 5470382 - DNA, 15 bp, Homo sapiens
ccacctccctgccca

SEQ ID NO: 5470383 - DNA, 16 bp, Homo sapiens
ccacctccctgcccag

SEQ ID NO: 5470384 - DNA, 14 bp, Homo sapiens
ccacctccctgcct

SEQ ID NO: 5470385 - DNA, 18 bp, Homo sapiens
ccacctccctgcctccag

SEQ ID NO: 5470386 - DNA, 13 bp, Homo sapiens
ccacctccgccag

SEQ ID NO: 5470387 - DNA, 15 bp, Homo sapiens
ccacctccgccagac

SEQ ID NO: 5470388 - DNA, 18 bp, Homo sapiens
ccacctccgccagacccc

SEQ ID NO: 5470389 - DNA, 19 bp, Homo sapiens
ccacctccgccccagacac

SEQ ID NO: 5470390 - DNA, 24 bp, Homo sapiens
ccacctcctaccccttcctgtcct

SEQ ID NO: 5470391 - DNA, 14 bp, Homo sapiens
ccacctcctccagc

SEQ ID NO: 5470392 - DNA, 12 bp, Homo sapiens
ccacctcctccc

SEQ ID NO: 5470393 - DNA, 22 bp, Homo sapiens
ccacctcctccccctgttctgt

SEQ ID NO: 5470394 - DNA, 15 bp, Homo sapiens
ccacctcctctcttg

SEQ ID NO: 5470395 - DNA, 21 bp, Homo sapiens
ccacctcctctgccagcagga

SEQ ID NO: 5470396 - DNA, 15 bp, Homo sapiens
ccacctcctgcggct

SEQ ID NO: 5470397 - DNA, 15 bp, Homo sapiens
ccacctcggcacaca

SEQ ID NO: 5470398 - DNA, 15 bp, Homo sapiens
ccacctcggcctccc

SEQ ID NO: 5470399 - DNA, 18 bp, Homo sapiens
ccacctcggcctcccaaa

SEQ ID NO: 5470400 - DNA, 18 bp, Homo sapiens
ccacctcggcctcccaga

SEQ ID NO: 5470401 - DNA, 19 bp, Homo sapiens
ccacctcggtcactccaac

SEQ ID NO: 5470402 - DNA, 19 bp, Homo sapiens
ccacctctcacgggccctg

SEQ ID NO: 5470403 - DNA, 22 bp, Homo sapiens
ccacctctcacgggccctgccc

SEQ ID NO: 5470404 - DNA, 17 bp, Homo sapiens
ccacctctccaagggct

SEQ ID NO: 5470405 - DNA, 13 bp, Homo sapiens
ccacctctcccag

SEQ ID NO: 5470406 - DNA, 14 bp, Homo sapiens
ccacctctcccagc

SEQ ID NO: 5470407 - DNA, 13 bp, Homo sapiens
ccacctctccctg

SEQ ID NO: 5470408 - DNA, 18 bp, Homo sapiens
ccacctctccctgaccct

SEQ ID NO: 5470409 - DNA, 16 bp, Homo sapiens
ccacctctccctgcat

SEQ ID NO: 5470410 - DNA, 17 bp, Homo sapiens
ccacctctccctgcatc

SEQ ID NO: 5470411 - DNA, 19 bp, Homo sapiens
ccacctctctcactccttg

SEQ ID NO: 5470412 - DNA, 16 bp, Homo sapiens
ccacctctctgcctgt

SEQ ID NO: 5470413 - DNA, 14 bp, Homo sapiens
ccacctctgcctct

SEQ ID NO: 5470414 - DNA, 20 bp, Homo sapiens
ccacctctgcggaccccagc

SEQ ID NO: 5470415 - DNA, 14 bp, Homo sapiens
ccacctctgctgcc

SEQ ID NO: 5470416 - DNA, 17 bp, Homo sapiens
ccacctctgctgcctcc

SEQ ID NO: 5470417 - DNA, 16 bp, Homo sapiens
ccacctctggccctgt

SEQ ID NO: 5470418 - DNA, 18 bp, Homo sapiens
ccacctctggccctgttg

SEQ ID NO: 5470419 - DNA, 22 bp, Homo sapiens
ccacctctgggtccttggctcc

SEQ ID NO: 5470420 - DNA, 11 bp, Homo sapiens
ccacctctggt

SEQ ID NO: 5470421 - DNA, 14 bp, Homo sapiens
ccacctctggtcca

SEQ ID NO: 5470422 - DNA, 21 bp, Homo sapiens
ccacctctggtggctcctcct

SEQ ID NO: 5470423 - DNA, 19 bp, Homo sapiens
ctcgacccagaatggagcc

SEQ ID NO: 5470424 - DNA, 13 bp, Homo sapiens
ctcgaccctgtcc

SEQ ID NO: 5470425 - DNA, 21 bp, Homo sapiens
ctcgaccctgtcccctaggga

SEQ ID NO: 5470426 - DNA, 16 bp, Homo sapiens
ctcgacctccccaccc

SEQ ID NO: 5470427 - DNA, 16 bp, Homo sapiens
ctcgacggcacgcact

SEQ ID NO: 5470428 - DNA, 20 bp, Homo sapiens
ctcgacggcacgcacttgcc

SEQ ID NO: 5470429 - DNA, 16 bp, Homo sapiens
ctcgacgtcccttgga

SEQ ID NO: 5470430 - DNA, 23 bp, Homo sapiens
ctcgacgtttacaagccccccct

SEQ ID NO: 5470431 - DNA, 13 bp, Homo sapiens
ctcgactcagcac

SEQ ID NO: 5470432 - DNA, 16 bp, Homo sapiens
ctcgactctgctgctc

SEQ ID NO: 5470433 - DNA, 22 bp, Homo sapiens
ctcgactgagctttagacagca

SEQ ID NO: 5470434 - DNA, 22 bp, Homo sapiens
ctcgactggaggaccacactca

SEQ ID NO: 5470435 - DNA, 18 bp, Homo sapiens
ctcgagagggctgagccc

SEQ ID NO: 5470436 - DNA, 19 bp, Homo sapiens
ctcgagagggctgagcccc

SEQ ID NO: 5470437 - DNA, 21 bp, Homo sapiens
ctcgagagggctgagcccctc

SEQ ID NO: 5470438 - DNA, 23 bp, Homo sapiens
ctcgagagggctgagcccctcct

SEQ ID NO: 5470439 - DNA, 23 bp, Homo sapiens
ctcgagatcccaacactgccagc

SEQ ID NO: 5470440 - DNA, 20 bp, Homo sapiens
ctcgagatgggtgctggtcc

SEQ ID NO: 5470441 - DNA, 17 bp, Homo sapiens
ctcgagcagtcctgcct

SEQ ID NO: 5470442 - DNA, 15 bp, Homo sapiens
ctcgagcatgcctgg

SEQ ID NO: 5470443 - DNA, 19 bp, Homo sapiens
ctcgagcatgcctggatgg

SEQ ID NO: 5470444 - DNA, 15 bp, Homo sapiens
ctcgagccccctgga

SEQ ID NO: 5470445 - DNA, 23 bp, Homo sapiens
ctcgagccccctggatgtcccct

SEQ ID NO: 5470446 - DNA, 15 bp, Homo sapiens
ctcgagcgccctgca

SEQ ID NO: 5470447 - DNA, 16 bp, Homo sapiens
ctcgagcgccctgcag

SEQ ID NO: 5470448 - DNA, 19 bp, Homo sapiens
ctcgagcgccctgcagacc

SEQ ID NO: 5470449 - DNA, 18 bp, Homo sapiens
ctcgagctcggggctggg

SEQ ID NO: 5470450 - DNA, 18 bp, Homo sapiens
ctcgagctctgtagcctg

SEQ ID NO: 5470451 - DNA, 15 bp, Homo sapiens
ctcgagcttggggca

SEQ ID NO: 5470452 - DNA, 17 bp, Homo sapiens
ctcgaggactgtatttg

SEQ ID NO: 5470453 - DNA, 22 bp, Homo sapiens
ctcgaggactgtatttgtgact

SEQ ID NO: 5470454 - DNA, 20 bp, Homo sapiens
ctcgaggcaccggcgctgca

SEQ ID NO: 5470455 - DNA, 17 bp, Homo sapiens
ctcgaggctggtgccag

SEQ ID NO: 5470456 - DNA, 15 bp, Homo sapiens
ctcgaggctggtggt

SEQ ID NO: 5470457 - DNA, 23 bp, Homo sapiens
ctcgaggggcccagggaagcctg

SEQ ID NO: 5470458 - DNA, 14 bp, Homo sapiens
ctcgaggggtgggc

SEQ ID NO: 5470459 - DNA, 15 bp, Homo sapiens
ctcgaggtgccttct

SEQ ID NO: 5470460 - DNA, 20 bp, Homo sapiens
ctcgaggtgccttcttcagg

SEQ ID NO: 5470461 - DNA, 13 bp, Homo sapiens
ctcgagtactgtg

SEQ ID NO: 5470462 - DNA, 17 bp, Homo sapiens
ctcgagtactgtgggca

SEQ ID NO: 5470463 - DNA, 20 bp, Homo sapiens
ctcgagtcacattctgctta

SEQ ID NO: 5470464 - DNA, 16 bp, Homo sapiens
ctcgagtccccccacc

SEQ ID NO: 5470465 - DNA, 17 bp, Homo sapiens
ctcgagtccccccaccc

SEQ ID NO: 5470466 - DNA, 22 bp, Homo sapiens
ctcgagtgaatttctaaatgtt

SEQ ID NO: 5470467 - DNA, 20 bp, Homo sapiens
ctcgagtgtttaaatgctgt

SEQ ID NO: 5470468 - DNA, 16 bp, Homo sapiens
ctcgagttacagacaa

SEQ ID NO: 5470469 - DNA, 14 bp, Homo sapiens
ctcgatgcactgac

SEQ ID NO: 5470470 - DNA, 15 bp, Homo sapiens
ctcgatgcactgacc

SEQ ID NO: 5470471 - DNA, 21 bp, Homo sapiens
ctcgatgtaagggattccttg

SEQ ID NO: 5470472 - DNA, 18 bp, Homo sapiens
ctcgatgtcctcctctgt

SEQ ID NO: 5470473 - DNA, 13 bp, Homo sapiens
ctcgatgttcatg

SEQ ID NO: 5470474 - DNA, 17 bp, Homo sapiens
ctcgattcatattgaat

SEQ ID NO: 5470475 - DNA, 18 bp, Homo sapiens
ctcgatttaaactccagc

SEQ ID NO: 5470476 - DNA, 14 bp, Homo sapiens
ctcgatttctccag

SEQ ID NO: 5470477 - DNA, 18 bp, Homo sapiens
ctcgattttgtatctgca

SEQ ID NO: 5470478 - DNA, 15 bp, Homo sapiens
ctcgcaaccctgcct

SEQ ID NO: 5470479 - DNA, 17 bp, Homo sapiens
ctcgcaaccctgcctgt

SEQ ID NO: 5470480 - DNA, 21 bp, Homo sapiens
ctcgcaagagggtctctttgt

SEQ ID NO: 5470481 - DNA, 14 bp, Homo sapiens
ctcgcacacagggc

SEQ ID NO: 5470482 - DNA, 15 bp, Homo sapiens
ctcgcacacagggct

SEQ ID NO: 5470483 - DNA, 17 bp, Homo sapiens
ctcgcacacagggctca

SEQ ID NO: 5470484 - DNA, 21 bp, Homo sapiens
ctcgcacacagggctcacagg

SEQ ID NO: 5470485 - DNA, 14 bp, Homo sapiens
ctcgcacccccact

SEQ ID NO: 5470486 - DNA, 16 bp, Homo sapiens
ctcgcacccccctgtt

SEQ ID NO: 5470487 - DNA, 17 bp, Homo sapiens
ctcgcacccccctgttc

SEQ ID NO: 5470488 - DNA, 19 bp, Homo sapiens
ctcgcacccccctgttcta

SEQ ID NO: 5470489 - DNA, 19 bp, Homo sapiens
ctcgcacctcttggctttg

SEQ ID NO: 5470490 - DNA, 15 bp, Homo sapiens
ctcgcacctgtgctg

SEQ ID NO: 5470491 - DNA, 15 bp, Homo sapiens
ctcgcacctttccaa

SEQ ID NO: 5470492 - DNA, 23 bp, Homo sapiens
ctcgcactacatctgatatcagg

SEQ ID NO: 5470493 - DNA, 13 bp, Homo sapiens
ctcgcactgccca

SEQ ID NO: 5470494 - DNA, 22 bp, Homo sapiens
ctcgcactgcccacatgggacc

SEQ ID NO: 5470495 - DNA, 17 bp, Homo sapiens
ctcgcacttgcagagga

SEQ ID NO: 5470496 - DNA, 22 bp, Homo sapiens
ctcgcacttgcagaggagccca

SEQ ID NO: 5470497 - DNA, 14 bp, Homo sapiens
ctcgcagagaggcc

SEQ ID NO: 5470498 - DNA, 20 bp, Homo sapiens
ctcgcagagaggccaggtgc

SEQ ID NO: 5470499 - DNA, 17 bp, Homo sapiens
ctcgcagcacccacagc

SEQ ID NO: 5470500 - DNA, 18 bp, Homo sapiens
ctcgcagcctgaagcctg

SEQ ID NO: 5470501 - DNA, 20 bp, Homo sapiens
ctcgcagcctgaagcctgga

SEQ ID NO: 5470502 - DNA, 20 bp, Homo sapiens
ctcgcagcctggcggggcag

SEQ ID NO: 5470503 - DNA, 21 bp, Homo sapiens
ctcgcagcctggcggggcagg

SEQ ID NO: 5470504 - DNA, 23 bp, Homo sapiens
ctcgcagcctggcggggcaggag

SEQ ID NO: 5470505 - DNA, 12 bp, Homo sapiens
ctcgcaggaaga

SEQ ID NO: 5470506 - DNA, 13 bp, Homo sapiens
ctcgcaggaagac

SEQ ID NO: 5470507 - DNA, 15 bp, Homo sapiens
ctcgcaggaccaagg

SEQ ID NO: 5470508 - DNA, 17 bp, Homo sapiens
ctcgcaggggcgctggc

SEQ ID NO: 5470509 - DNA, 16 bp, Homo sapiens
ctcgcagggtgcagga

SEQ ID NO: 5470510 - DNA, 14 bp, Homo sapiens
ctcgcatcattgca

SEQ ID NO: 5470511 - DNA, 18 bp, Homo sapiens
ctcgcatccgcctctgag

SEQ ID NO: 5470512 - DNA, 19 bp, Homo sapiens
ctcgcatccgcctctgagc

SEQ ID NO: 5470513 - DNA, 15 bp, Homo sapiens
ctcgcatcctatgct

SEQ ID NO: 5470514 - DNA, 17 bp, Homo sapiens
ctcgcatgccagagcct

SEQ ID NO: 5470515 - DNA, 14 bp, Homo sapiens
ctcgcattgacaca

SEQ ID NO: 5470516 - DNA, 17 bp, Homo sapiens
ctcgccaaggcctagga

SEQ ID NO: 5470517 - DNA, 17 bp, Homo sapiens
ctcgccacgctcagtgc

SEQ ID NO: 5470518 - DNA, 16 bp, Homo sapiens
ctcgccacggggaggg

SEQ ID NO: 5470519 - DNA, 14 bp, Homo sapiens
ctcgccagcttctc

SEQ ID NO: 5470520 - DNA, 19 bp, Homo sapiens
ctcgccagcttctcctgcg

SEQ ID NO: 5470521 - DNA, 15 bp, Homo sapiens
ctcgccagcttggct

SEQ ID NO: 5470522 - DNA, 24 bp, Homo sapiens
ctcgccatgatcagacatacagct

SEQ ID NO: 5470523 - DNA, 19 bp, Homo sapiens
ctcgccatttcctcacgtg

SEQ ID NO: 5470524 - DNA, 20 bp, Homo sapiens
ctcgccatttcctcacgtgc

SEQ ID NO: 5470525 - DNA, 18 bp, Homo sapiens
ctcgcccaccgcatgccc

SEQ ID NO: 5470526 - DNA, 21 bp, Homo sapiens
ctcgcccatcagtgccagccc

SEQ ID NO: 5470527 - DNA, 17 bp, Homo sapiens
ctcgccccaaagttgct

SEQ ID NO: 5470528 - DNA, 19 bp, Homo sapiens
ctcgccccaaagttgctca

SEQ ID NO: 5470529 - DNA, 14 bp, Homo sapiens
ctcgccccacctcc

SEQ ID NO: 5470530 - DNA, 18 bp, Homo sapiens
ctcgccccacctccacct

SEQ ID NO: 5470531 - DNA, 14 bp, Homo sapiens
ctcgccccagcagg

SEQ ID NO: 5470532 - DNA, 12 bp, Homo sapiens
ctcgccccagcc

SEQ ID NO: 5470533 - DNA, 19 bp, Homo sapiens
ctcgccccagccaagcctg

SEQ ID NO: 5470534 - DNA, 13 bp, Homo sapiens
ctcgccccagcct

SEQ ID NO: 5470535 - DNA, 15 bp, Homo sapiens
ctcgccccatccctg

SEQ ID NO: 5470536 - DNA, 13 bp, Homo sapiens
ctcgcccccacca

SEQ ID NO: 5470537 - DNA, 18 bp, Homo sapiens
ctcgcccccacttttcta

SEQ ID NO: 5470538 - DNA, 16 bp, Homo sapiens
ctcgcccctccagtgt

SEQ ID NO: 5470539 - DNA, 18 bp, Homo sapiens
ctcgcccctccagtgttg

SEQ ID NO: 5470540 - DNA, 20 bp, Homo sapiens
ctcgcccctcccctcagcct

SEQ ID NO: 5470541 - DNA, 21 bp, Homo sapiens
ctcgcccctcccctcagcctg

SEQ ID NO: 5470542 - DNA, 16 bp, Homo sapiens
ctcgcccctggcagag

SEQ ID NO: 5470543 - DNA, 12 bp, Homo sapiens
ctcgccccttcc

SEQ ID NO: 5470544 - DNA, 15 bp, Homo sapiens
ctcgcccgcccactg

SEQ ID NO: 5470545 - DNA, 15 bp, Homo sapiens
ctcgccctcctttct

SEQ ID NO: 5470546 - DNA, 19 bp, Homo sapiens
ctcgccctcctttctgtgc

SEQ ID NO: 5470547 - DNA, 19 bp, Homo sapiens
ctcgccctctctcaccagc

SEQ ID NO: 5470548 - DNA, 21 bp, Homo sapiens
ctcgccctctctcaccagcct

SEQ ID NO: 5470549 - DNA, 22 bp, Homo sapiens
ctcgccctctctcaccagcctt

SEQ ID NO: 5470550 - DNA, 20 bp, Homo sapiens
ctcgccctgcggtagatggg

SEQ ID NO: 5470551 - DNA, 18 bp, Homo sapiens
ctcgccctggccagggcc

SEQ ID NO: 5470552 - DNA, 13 bp, Homo sapiens
ctcgccctgtccc

SEQ ID NO: 5470553 - DNA, 17 bp, Homo sapiens
ctcgccctgtccctccc

SEQ ID NO: 5470554 - DNA, 19 bp, Homo sapiens
ctcgccctgtccctcccac

SEQ ID NO: 5470555 - DNA, 14 bp, Homo sapiens
ctcgccctgtgagg

SEQ ID NO: 5470556 - DNA, 16 bp, Homo sapiens
ctcgccctgtgccctc

SEQ ID NO: 5470557 - DNA, 17 bp, Homo sapiens
ctcgcccttcagcccac

SEQ ID NO: 5470558 - DNA, 22 bp, Homo sapiens
ctcgccgagctgtcggagggct

SEQ ID NO: 5470559 - DNA, 17 bp, Homo sapiens
ctcgccgggccattctg

SEQ ID NO: 5470560 - DNA, 19 bp, Homo sapiens
ctcgccgtccctcccaggt

SEQ ID NO: 5470561 - DNA, 16 bp, Homo sapiens
ctcgccgtctgtgaat

SEQ ID NO: 5470562 - DNA, 19 bp, Homo sapiens
ctcgcctaccaatctctgc

SEQ ID NO: 5470563 - DNA, 19 bp, Homo sapiens
ctcgcctactaagtaccct

SEQ ID NO: 5470564 - DNA, 16 bp, Homo sapiens
ctcgcctaggcctgtg

SEQ ID NO: 5470565 - DNA, 17 bp, Homo sapiens
ctcgcctatcttaggta

SEQ ID NO: 5470566 - DNA, 17 bp, Homo sapiens
ctcgcctcactttccac

SEQ ID NO: 5470567 - DNA, 21 bp, Homo sapiens
ctcgcctcactttccaccaag

SEQ ID NO: 5470568 - DNA, 11 bp, Homo sapiens
ctcgcctcagc

SEQ ID NO: 5470569 - DNA, 17 bp, Homo sapiens
ctcgcctcagcctgatc

SEQ ID NO: 5470570 - DNA, 17 bp, Homo sapiens
ctcgcctcctactctga

SEQ ID NO: 5470571 - DNA, 18 bp, Homo sapiens
ctcgcctcctactctgag

SEQ ID NO: 5470572 - DNA, 12 bp, Homo sapiens
ctcgcctcctcc

SEQ ID NO: 5470573 - DNA, 13 bp, Homo sapiens
ctcgcctcctcct

SEQ ID NO: 5470574 - DNA, 18 bp, Homo sapiens
ctcgcctcctcctcctgc

SEQ ID NO: 5470575 - DNA, 19 bp, Homo sapiens
ctcgcctcctcctcctgcc

SEQ ID NO: 5470576 - DNA, 20 bp, Homo sapiens
ctcgcctcctcctcctgccc

SEQ ID NO: 5470577 - DNA, 14 bp, Homo sapiens
ctcgcctctcccac

SEQ ID NO: 5470578 - DNA, 13 bp, Homo sapiens
ctcgcctgaggga

SEQ ID NO: 5470579 - DNA, 18 bp, Homo sapiens
ctcgcctggaaacagagg

SEQ ID NO: 5470580 - DNA, 16 bp, Homo sapiens
ctcgcctggcctgagg

SEQ ID NO: 5470581 - DNA, 20 bp, Homo sapiens
ctcgcctggcctgaggtctc

SEQ ID NO: 5470582 - DNA, 21 bp, Homo sapiens
ctcgcctgggaaattgctcca

SEQ ID NO: 5470583 - DNA, 16 bp, Homo sapiens
ctcgcctgggcccagg

SEQ ID NO: 5470584 - DNA, 19 bp, Homo sapiens
ctcgcctgggcccaggctc

SEQ ID NO: 5470585 - DNA, 21 bp, Homo sapiens
ctcgcctgggcccaggctctg

SEQ ID NO: 5470586 - DNA, 22 bp, Homo sapiens
ctcgcctgggcccaggctctgg

SEQ ID NO: 5470587 - DNA, 16 bp, Homo sapiens
ctcgccttccctcctg

SEQ ID NO: 5470588 - DNA, 17 bp, Homo sapiens
ctcgccttccctcctgc

SEQ ID NO: 5470589 - DNA, 15 bp, Homo sapiens
ctcgccttcctgcag

SEQ ID NO: 5470590 - DNA, 14 bp, Homo sapiens
ctcgcgcccctgtc

SEQ ID NO: 5470591 - DNA, 16 bp, Homo sapiens
ctcgcgcgactgagaa

SEQ ID NO: 5470592 - DNA, 21 bp, Homo sapiens
ctcgcggcctcttctctcaga

SEQ ID NO: 5470593 - DNA, 13 bp, Homo sapiens
ctcgctagtcagt

SEQ ID NO: 5470594 - DNA, 14 bp, Homo sapiens
ctcgctcagaagag

SEQ ID NO: 5470595 - DNA, 13 bp, Homo sapiens
ctcgctcaggtga

SEQ ID NO: 5470596 - DNA, 20 bp, Homo sapiens
ctcgctcagtcagtgcacta

SEQ ID NO: 5470597 - DNA, 24 bp, Homo sapiens
ctcgctccaactccaacatccact

SEQ ID NO: 5470598 - DNA, 17 bp, Homo sapiens
ctcgctccccactctgc

SEQ ID NO: 5470599 - DNA, 16 bp, Homo sapiens
ctcgctcccctctgcc

SEQ ID NO: 5470600 - DNA, 17 bp, Homo sapiens
ctcgctcccctctggaa

SEQ ID NO: 5470601 - DNA, 17 bp, Homo sapiens
ctcgggctcctgtgccc

SEQ ID NO: 5470602 - DNA, 18 bp, Homo sapiens
ctcgggctggagcctccg

SEQ ID NO: 5470603 - DNA, 23 bp, Homo sapiens
ctcgggctggtgtcttgagacca

SEQ ID NO: 5470604 - DNA, 18 bp, Homo sapiens
ctcggggacaccagagct

SEQ ID NO: 5470605 - DNA, 18 bp, Homo sapiens
ctcggggagagggggagg

SEQ ID NO: 5470606 - DNA, 15 bp, Homo sapiens
ctcggggatggggag

SEQ ID NO: 5470607 - DNA, 20 bp, Homo sapiens
ctcggggcccttggggcctg

SEQ ID NO: 5470608 - DNA, 15 bp, Homo sapiens
ctcggggctccaggc

SEQ ID NO: 5470609 - DNA, 16 bp, Homo sapiens
ctcggggctccaggct

SEQ ID NO: 5470610 - DNA, 14 bp, Homo sapiens
ctcggggctcccca

SEQ ID NO: 5470611 - DNA, 16 bp, Homo sapiens
ctcggggctgggcaga

SEQ ID NO: 5470612 - DNA, 14 bp, Homo sapiens
ctcgggggcctgtg

SEQ ID NO: 5470613 - DNA, 16 bp, Homo sapiens
ctcgggggcgcctgga

SEQ ID NO: 5470614 - DNA, 23 bp, Homo sapiens
ctcgggggcgcctggagggatgc

SEQ ID NO: 5470615 - DNA, 16 bp, Homo sapiens
ctcgggggctcttccc

SEQ ID NO: 5470616 - DNA, 18 bp, Homo sapiens
ctcgggggctgtctcaga

SEQ ID NO: 5470617 - DNA, 16 bp, Homo sapiens
ctcggggggctctgcc

SEQ ID NO: 5470618 - DNA, 18 bp, Homo sapiens
ctcggggggctctgcctt

SEQ ID NO: 5470619 - DNA, 18 bp, Homo sapiens
ctcggggggtcacaggcc

SEQ ID NO: 5470620 - DNA, 23 bp, Homo sapiens
ctcgggggtggagtgagactgac

SEQ ID NO: 5470621 - DNA, 19 bp, Homo sapiens
ctcggggtaaaaagtggct

SEQ ID NO: 5470622 - DNA, 16 bp, Homo sapiens
ctcggggtgcacagga

SEQ ID NO: 5470623 - DNA, 16 bp, Homo sapiens
ctcgggtcaccctgct

SEQ ID NO: 5470624 - DNA, 18 bp, Homo sapiens
ctcgggtctccccacctg

SEQ ID NO: 5470625 - DNA, 23 bp, Homo sapiens
ctcgggtgcgtgtgtttgtatgt

SEQ ID NO: 5470626 - DNA, 16 bp, Homo sapiens
ctcgggtggggcctgc

SEQ ID NO: 5470627 - DNA, 19 bp, Homo sapiens
ctcgggtggggctggtggg

SEQ ID NO: 5470628 - DNA, 21 bp, Homo sapiens
ctcggtacccggggcccaggg

SEQ ID NO: 5470629 - DNA, 19 bp, Homo sapiens
ctcggtagcagaggccctg

SEQ ID NO: 5470630 - DNA, 12 bp, Homo sapiens
ctcggtatctgg

SEQ ID NO: 5470631 - DNA, 22 bp, Homo sapiens
ctcggtatctggcttccctgga

SEQ ID NO: 5470632 - DNA, 23 bp, Homo sapiens
ctcggtatctggcttccctggaa

SEQ ID NO: 5470633 - DNA, 13 bp, Homo sapiens
ctcggtcactgag

SEQ ID NO: 5470634 - DNA, 20 bp, Homo sapiens
ctcggtctccaccccagggt

SEQ ID NO: 5470635 - DNA, 20 bp, Homo sapiens
ctcggtctcccaaagtgctg

SEQ ID NO: 5470636 - DNA, 23 bp, Homo sapiens
ctcggtctcccttccgtccatcc

SEQ ID NO: 5470637 - DNA, 14 bp, Homo sapiens
ctcggtgagccggg

SEQ ID NO: 5470638 - DNA, 17 bp, Homo sapiens
ctcggtgatgccttccg

SEQ ID NO: 5470639 - DNA, 21 bp, Homo sapiens
ctcggtgcagagtgcagaggc

SEQ ID NO: 5470640 - DNA, 22 bp, Homo sapiens
ctcggtgcagagtgcagaggcg

SEQ ID NO: 5470641 - DNA, 13 bp, Homo sapiens
ctcggtggccatg

SEQ ID NO: 5470642 - DNA, 16 bp, Homo sapiens
ctcggtggccatgctt

SEQ ID NO: 5470643 - DNA, 18 bp, Homo sapiens
ctcggtggccatgcttct

SEQ ID NO: 5470644 - DNA, 19 bp, Homo sapiens
ctcggtggccatgcttctt

SEQ ID NO: 5470645 - DNA, 15 bp, Homo sapiens
ctcggtggctctggg

SEQ ID NO: 5470646 - DNA, 19 bp, Homo sapiens
ctcggtgggccagagctga

SEQ ID NO: 5470647 - DNA, 11 bp, Homo sapiens
ctcggtggtac

SEQ ID NO: 5470648 - DNA, 13 bp, Homo sapiens
ctcggtgtcccca

SEQ ID NO: 5470649 - DNA, 21 bp, Homo sapiens
ctcggtgtccccaccatctgc

SEQ ID NO: 5470650 - DNA, 15 bp, Homo sapiens
ctcggtgtggcgtga

SEQ ID NO: 5470651 - DNA, 23 bp, Homo sapiens
ctcggtgtgtggccgcctggcag

SEQ ID NO: 5470652 - DNA, 20 bp, Homo sapiens
ctcggttctgcgccacttcc

SEQ ID NO: 5470653 - DNA, 22 bp, Homo sapiens
ctcggtttgccaaaattcattt

SEQ ID NO: 5470654 - DNA, 14 bp, Homo sapiens
ctcgtaactggttt

SEQ ID NO: 5470655 - DNA, 20 bp, Homo sapiens
ctcgtaatagcttctgtgtg

SEQ ID NO: 5470656 - DNA, 16 bp, Homo sapiens
ctcgtaccagccagga

SEQ ID NO: 5470657 - DNA, 14 bp, Homo sapiens
ctcgtagagtgacc

SEQ ID NO: 5470658 - DNA, 20 bp, Homo sapiens
ctcgtagagtgacctcggac

SEQ ID NO: 5470659 - DNA, 15 bp, Homo sapiens
ctcgtagatgctgcc

SEQ ID NO: 5470660 - DNA, 13 bp, Homo sapiens
ctcgtaggcctgc

SEQ ID NO: 5470661 - DNA, 13 bp, Homo sapiens
ctcgtatagcatg

SEQ ID NO: 5470662 - DNA, 21 bp, Homo sapiens
ctcgtatcccaaatctgtcag

SEQ ID NO: 5470663 - DNA, 24 bp, Homo sapiens
ctcgtcaagagcatgcacatgctg

SEQ ID NO: 5470664 - DNA, 17 bp, Homo sapiens
ctcgtcagccacctggg

SEQ ID NO: 5470665 - DNA, 15 bp, Homo sapiens
ctcgtcaggctgcca

SEQ ID NO: 5470666 - DNA, 16 bp, Homo sapiens
ctcgtcaggctgccag

SEQ ID NO: 5470667 - DNA, 14 bp, Homo sapiens
ctcgtcagtctctc

SEQ ID NO: 5470668 - DNA, 22 bp, Homo sapiens
ctcgtcatcatttttccttccc

SEQ ID NO: 5470669 - DNA, 19 bp, Homo sapiens
ctcgtccaaggcagttctg

SEQ ID NO: 5470670 - DNA, 20 bp, Homo sapiens
ctcgtccaagggacagccca

SEQ ID NO: 5470671 - DNA, 15 bp, Homo sapiens
ctcgtccacaggggc

SEQ ID NO: 5470672 - DNA, 16 bp, Homo sapiens
ctcgtccacaggggca

SEQ ID NO: 5470673 - DNA, 18 bp, Homo sapiens
ctcgtccacaggggcagg

SEQ ID NO: 5470674 - DNA, 20 bp, Homo sapiens
ctcgtccacaggggcaggcc

SEQ ID NO: 5470675 - DNA, 23 bp, Homo sapiens
ctcgtccacaggggcaggcctgg

SEQ ID NO: 5470676 - DNA, 23 bp, Homo sapiens
ctcgtccaccccccacacacact

SEQ ID NO: 5470677 - DNA, 15 bp, Homo sapiens
ctcgtcccagccctc

SEQ ID NO: 5470678 - DNA, 15 bp, Homo sapiens
ctcgtccccattgct

SEQ ID NO: 5470679 - DNA, 13 bp, Homo sapiens
ctcgtccccctcc

SEQ ID NO: 5470680 - DNA, 14 bp, Homo sapiens
ctcgtccccctccc

SEQ ID NO: 5470681 - DNA, 21 bp, Homo sapiens
ctcgtccccctccctgcccaa

SEQ ID NO: 5470682 - DNA, 19 bp, Homo sapiens
ctcgtcccgagggcgcctg

SEQ ID NO: 5470683 - DNA, 22 bp, Homo sapiens
ctcgtcccgagggcgcctgggt

SEQ ID NO: 5470684 - DNA, 16 bp, Homo sapiens
ctcgtccctctgctcc

SEQ ID NO: 5470685 - DNA, 18 bp, Homo sapiens
ctcgtccctctgctccgt

SEQ ID NO: 5470686 - DNA, 13 bp, Homo sapiens
ctcgtccggcctg

SEQ ID NO: 5470687 - DNA, 15 bp, Homo sapiens
ctcgtccggcctgca

SEQ ID NO: 5470688 - DNA, 17 bp, Homo sapiens
ctcgtccggcctgcagc

SEQ ID NO: 5470689 - DNA, 20 bp, Homo sapiens
ctcgtccggcctgcagccca

SEQ ID NO: 5470690 - DNA, 14 bp, Homo sapiens
ctcgtcctccccct

SEQ ID NO: 5470691 - DNA, 20 bp, Homo sapiens
ctcgtcctccccctgccagt

SEQ ID NO: 5470692 - DNA, 24 bp, Homo sapiens
ctcgtcctccccctgccagtgcct

SEQ ID NO: 5470693 - DNA, 16 bp, Homo sapiens
ctcgtcttcagctgca

SEQ ID NO: 5470694 - DNA, 14 bp, Homo sapiens
ctcgtctttcagcg

SEQ ID NO: 5470695 - DNA, 16 bp, Homo sapiens
ctcgtctttcagcgag

SEQ ID NO: 5470696 - DNA, 13 bp, Homo sapiens
ctcgtctttccca

SEQ ID NO: 5470697 - DNA, 22 bp, Homo sapiens
ctcgtctttgcttgtcctgctc

SEQ ID NO: 5470698 - DNA, 14 bp, Homo sapiens
ctcgtgacagcctc

SEQ ID NO: 5470699 - DNA, 14 bp, Homo sapiens
ctcgtgacccagtg

SEQ ID NO: 5470700 - DNA, 15 bp, Homo sapiens
ctcgtgaggggcaag

SEQ ID NO: 5470701 - DNA, 20 bp, Homo sapiens
ctcgtgagtcatttaaatgt

SEQ ID NO: 5470702 - DNA, 19 bp, Homo sapiens
ctcgtgatccgcctgcctc

SEQ ID NO: 5470703 - DNA, 13 bp, Homo sapiens
ctcgtgcagagct

SEQ ID NO: 5470704 - DNA, 18 bp, Homo sapiens
ctcgtgcagagctggggc

SEQ ID NO: 5470705 - DNA, 14 bp, Homo sapiens
ctcgtgcatgtaat

SEQ ID NO: 5470706 - DNA, 20 bp, Homo sapiens
ctcgtgcattaaaatttctt

SEQ ID NO: 5470707 - DNA, 21 bp, Homo sapiens
ctcgtgcattaaaatttctta

SEQ ID NO: 5470708 - DNA, 12 bp, Homo sapiens
ctcgtgccagca

SEQ ID NO: 5470709 - DNA, 17 bp, Homo sapiens
ctcgtgccagcagcctc

SEQ ID NO: 5470710 - DNA, 19 bp, Homo sapiens
ctcgtgccagcagcctcgc

SEQ ID NO: 5470711 - DNA, 21 bp, Homo sapiens
ctcgtgccagcagcctcgcac

SEQ ID NO: 5470712 - DNA, 22 bp, Homo sapiens
ctcgtgccagtcgcgctgcctg

SEQ ID NO: 5470713 - DNA, 24 bp, Homo sapiens
ctcgtgccagtcgcgctgcctgtg

SEQ ID NO: 5470714 - DNA, 17 bp, Homo sapiens
ctcgtgccatgatctgt

SEQ ID NO: 5470715 - DNA, 18 bp, Homo sapiens
ctcgtgcgcatctcagaa

SEQ ID NO: 5470716 - DNA, 15 bp, Homo sapiens
ctcgtggagctcgcc

SEQ ID NO: 5470717 - DNA, 23 bp, Homo sapiens
ctcgtggagctcgcccctcccct

SEQ ID NO: 5470718 - DNA, 12 bp, Homo sapiens
ctcgtggccagc

SEQ ID NO: 5470719 - DNA, 18 bp, Homo sapiens
ctcgtggccagcccggct

SEQ ID NO: 5470720 - DNA, 20 bp, Homo sapiens
ctcgtggccttccccagcct

SEQ ID NO: 5470721 - DNA, 14 bp, Homo sapiens
ctcgtgggctctgg

SEQ ID NO: 5470722 - DNA, 15 bp, Homo sapiens
ctcgtgggctctggc

SEQ ID NO: 5470723 - DNA, 16 bp, Homo sapiens
ctcgtgggctctggct

SEQ ID NO: 5470724 - DNA, 11 bp, Homo sapiens
ctcgtgggtcc

SEQ ID NO: 5470725 - DNA, 14 bp, Homo sapiens
ctcgtgggttcttc

SEQ ID NO: 5470726 - DNA, 16 bp, Homo sapiens
ctcgtggtccccaaca

SEQ ID NO: 5470727 - DNA, 17 bp, Homo sapiens
ctcgtggtgaggctgac

SEQ ID NO: 5470728 - DNA, 20 bp, Homo sapiens
ctcgtggttggaagcctccc

SEQ ID NO: 5470729 - DNA, 15 bp, Homo sapiens
ctcgtgtatcctggg

SEQ ID NO: 5470730 - DNA, 21 bp, Homo sapiens
ctcgtgtcagtaatttatatg

SEQ ID NO: 5470731 - DNA, 13 bp, Homo sapiens
ctcgtgtcctgct

SEQ ID NO: 5470732 - DNA, 21 bp, Homo sapiens
ctcgtgtcctgctagctgtct

SEQ ID NO: 5470733 - DNA, 15 bp, Homo sapiens
ctcgtgtctggcaca

SEQ ID NO: 5470734 - DNA, 13 bp, Homo sapiens
ctcgtgtgcatga

SEQ ID NO: 5470735 - DNA, 18 bp, Homo sapiens
ctcgtgttcgctggctga

SEQ ID NO: 5470736 - DNA, 14 bp, Homo sapiens
ctcgtgtttcacag

SEQ ID NO: 5470737 - DNA, 16 bp, Homo sapiens
ctcgttaggacaaggc

SEQ ID NO: 5470738 - DNA, 16 bp, Homo sapiens
ctcgttcaaaacattc

SEQ ID NO: 5470739 - DNA, 23 bp, Homo sapiens
ctcgttcctacctggctggagac

SEQ ID NO: 5470740 - DNA, 14 bp, Homo sapiens
ctcgttctccctgg

SEQ ID NO: 5470741 - DNA, 16 bp, Homo sapiens
ctcgttctccctggga

SEQ ID NO: 5470742 - DNA, 16 bp, Homo sapiens
ctcgttctccttcccc

SEQ ID NO: 5470743 - DNA, 23 bp, Homo sapiens
ctcgttctccttccccatttcca

SEQ ID NO: 5470744 - DNA, 20 bp, Homo sapiens
ctcgttctcgtgacccagtg

SEQ ID NO: 5470745 - DNA, 15 bp, Homo sapiens
ctcgttcttatttaa

SEQ ID NO: 5470746 - DNA, 23 bp, Homo sapiens
ctcgttcttatttaatctccatt

SEQ ID NO: 5470747 - DNA, 19 bp, Homo sapiens
ctcgttgcctctgattttc

SEQ ID NO: 5470748 - DNA, 16 bp, Homo sapiens
ctcgttggatgtctgt

SEQ ID NO: 5470749 - DNA, 21 bp, Homo sapiens
ctcgttgggccgctctgattt

SEQ ID NO: 5470750 - DNA, 16 bp, Homo sapiens
ctcgtttagtgccaat

SEQ ID NO: 5470751 - DNA, 12 bp, Homo sapiens
ctcgtttgatag

SEQ ID NO: 5470752 - DNA, 14 bp, Homo sapiens
ctcgtttgggagtg

SEQ ID NO: 5470753 - DNA, 16 bp, Homo sapiens
ctcgttttgggccaga

SEQ ID NO: 5470754 - DNA, 23 bp, Homo sapiens
ctcgttttgggtactttctatct

SEQ ID NO: 5470755 - DNA, 19 bp, Homo sapiens
ctcgtttttcagcaccccc

SEQ ID NO: 5470756 - DNA, 23 bp, Homo sapiens
ctctaaaaaaataaaaatagaaa

SEQ ID NO: 5470757 - DNA, 19 bp, Homo sapiens
ctctaaaaagaagccacag

SEQ ID NO: 5470758 - DNA, 18 bp, Homo sapiens
ctctaaaaataaaatgat

SEQ ID NO: 5470759 - DNA, 20 bp, Homo sapiens
ctctaaaagatcctttttaa

SEQ ID NO: 5470760 - DNA, 16 bp, Homo sapiens
ctctaaaaggttcagg

SEQ ID NO: 5470761 - DNA, 17 bp, Homo sapiens
ctctaaaaggttcaggg

SEQ ID NO: 5470762 - DNA, 23 bp, Homo sapiens
ctctaaaataggtaaatgtattt

SEQ ID NO: 5470763 - DNA, 18 bp, Homo sapiens
ctctaaaatggacatttt

SEQ ID NO: 5470764 - DNA, 15 bp, Homo sapiens
ctctaaaattataaa

SEQ ID NO: 5470765 - DNA, 15 bp, Homo sapiens
ctctaaaattctagt

SEQ ID NO: 5470766 - DNA, 16 bp, Homo sapiens
ctctaaacacacaagt

SEQ ID NO: 5470767 - DNA, 13 bp, Homo sapiens
ctctaaactgttt

SEQ ID NO: 5470768 - DNA, 21 bp, Homo sapiens
ctctaaacttccctctagttg

SEQ ID NO: 5470769 - DNA, 18 bp, Homo sapiens
ctctaaagaaaaatgcct

SEQ ID NO: 5470770 - DNA, 14 bp, Homo sapiens
ctctaaagaaactt

SEQ ID NO: 5470771 - DNA, 14 bp, Homo sapiens
ctctaaagaccaaa

SEQ ID NO: 5470772 - DNA, 17 bp, Homo sapiens
ctctaaagccaagcact

SEQ ID NO: 5470773 - DNA, 17 bp, Homo sapiens
ctctaaagtagcaactg

SEQ ID NO: 5470774 - DNA, 15 bp, Homo sapiens
ctctaaataaagacg

SEQ ID NO: 5470775 - DNA, 23 bp, Homo sapiens
ctctaaatactgagaaaacctgt

SEQ ID NO: 5470776 - DNA, 22 bp, Homo sapiens
ctctaaatgaggggcctcaggt

SEQ ID NO: 5470777 - DNA, 13 bp, Homo sapiens
ctctaacaaatga

SEQ ID NO: 5470778 - DNA, 22 bp, Homo sapiens
ctctattttacttttctgccaa

SEQ ID NO: 5470779 - DNA, 13 bp, Homo sapiens
ctctattttgtga

SEQ ID NO: 5470780 - DNA, 15 bp, Homo sapiens
ctctattttgtgatg

SEQ ID NO: 5470781 - DNA, 22 bp, Homo sapiens
ctctatttttgtaaaaagggaa

SEQ ID NO: 5470782 - DNA, 13 bp, Homo sapiens
ctctatttttgtt

SEQ ID NO: 5470783 - DNA, 23 bp, Homo sapiens
ctctatttttgttaatcatcttc

SEQ ID NO: 5470784 - DNA, 15 bp, Homo sapiens
ctctatttttgttgg

SEQ ID NO: 5470785 - DNA, 23 bp, Homo sapiens
ctctcaaaacaatattactttgt

SEQ ID NO: 5470786 - DNA, 23 bp, Homo sapiens
ctctcaaaagagaaaaacaaaac

SEQ ID NO: 5470787 - DNA, 19 bp, Homo sapiens
ctctcaaaagtctattttt

SEQ ID NO: 5470788 - DNA, 16 bp, Homo sapiens
ctctcaaacctggcag

SEQ ID NO: 5470789 - DNA, 17 bp, Homo sapiens
ctctcaaacctggcaga

SEQ ID NO: 5470790 - DNA, 20 bp, Homo sapiens
ctctcaaacggcaacattcc

SEQ ID NO: 5470791 - DNA, 15 bp, Homo sapiens
ctctcaaagacccca

SEQ ID NO: 5470792 - DNA, 21 bp, Homo sapiens
ctctcaaagccatgtgtggag

SEQ ID NO: 5470793 - DNA, 16 bp, Homo sapiens
ctctcaaatccctctc

SEQ ID NO: 5470794 - DNA, 13 bp, Homo sapiens
ctctcaaatgtga

SEQ ID NO: 5470795 - DNA, 20 bp, Homo sapiens
ctctcaaatgtgtgttcctg

SEQ ID NO: 5470796 - DNA, 15 bp, Homo sapiens
ctctcaaattcagct

SEQ ID NO: 5470797 - DNA, 18 bp, Homo sapiens
ctctcaaattcagctctg

SEQ ID NO: 5470798 - DNA, 18 bp, Homo sapiens
ctctcaaccttggccttc

SEQ ID NO: 5470799 - DNA, 16 bp, Homo sapiens
ctctcaagagtgctga

SEQ ID NO: 5470800 - DNA, 15 bp, Homo sapiens
ctctcaagctagcca

SEQ ID NO: 5470801 - DNA, 21 bp, Homo sapiens
ctctcaagctagtgtttctag

SEQ ID NO: 5470802 - DNA, 14 bp, Homo sapiens
ctctcaaggcttgg

SEQ ID NO: 5470803 - DNA, 23 bp, Homo sapiens
ctctcaaggcttggagaggtatg

SEQ ID NO: 5470804 - DNA, 11 bp, Homo sapiens
ctctcaagtga

SEQ ID NO: 5470805 - DNA, 17 bp, Homo sapiens
ctctcaataaaattata

SEQ ID NO: 5470806 - DNA, 10 bp, Homo sapiens
ctctcaatat

SEQ ID NO: 5470807 - DNA, 19 bp, Homo sapiens
ctctcaatattcaataaag

SEQ ID NO: 5470808 - DNA, 21 bp, Homo sapiens
ctctcaatattcaataaagct

SEQ ID NO: 5470809 - DNA, 16 bp, Homo sapiens
ctctcaatccctttgc

SEQ ID NO: 5470810 - DNA, 19 bp, Homo sapiens
ctctcaatgctgtttgggt

SEQ ID NO: 5470811 - DNA, 13 bp, Homo sapiens
ctctcaattaaag

SEQ ID NO: 5470812 - DNA, 19 bp, Homo sapiens
ctctcaatttttggttgaa

SEQ ID NO: 5470813 - DNA, 13 bp, Homo sapiens
ctctcacacacac

SEQ ID NO: 5470814 - DNA, 14 bp, Homo sapiens
ctctcacacacata

SEQ ID NO: 5470815 - DNA, 21 bp, Homo sapiens
ctctcacacacatagattaat

SEQ ID NO: 5470816 - DNA, 13 bp, Homo sapiens
ctctcacactgaa

SEQ ID NO: 5470817 - DNA, 14 bp, Homo sapiens
ctctcacagacagg

SEQ ID NO: 5470818 - DNA, 11 bp, Homo sapiens
ctctcacagat

SEQ ID NO: 5470819 - DNA, 12 bp, Homo sapiens
ctctcacagata

SEQ ID NO: 5470820 - DNA, 17 bp, Homo sapiens
ctctcacagctgagttg

SEQ ID NO: 5470821 - DNA, 20 bp, Homo sapiens
ctctcacaggcagctctgag

SEQ ID NO: 5470822 - DNA, 22 bp, Homo sapiens
ctctcacaggcagctctgagcc

SEQ ID NO: 5470823 - DNA, 22 bp, Homo sapiens
ctctcacatgtttagagttgca

SEQ ID NO: 5470824 - DNA, 19 bp, Homo sapiens
ctctcaccatgatgtgaag

SEQ ID NO: 5470825 - DNA, 16 bp, Homo sapiens
ctctcaccatttggat

SEQ ID NO: 5470826 - DNA, 13 bp, Homo sapiens
ctctcacccacca

SEQ ID NO: 5470827 - DNA, 14 bp, Homo sapiens
ctctcacccaccag

SEQ ID NO: 5470828 - DNA, 23 bp, Homo sapiens
ctctcacccagaatccctctaac

SEQ ID NO: 5470829 - DNA, 13 bp, Homo sapiens
ctctcaccccact

SEQ ID NO: 5470830 - DNA, 15 bp, Homo sapiens
ctctcaccccactcc

SEQ ID NO: 5470831 - DNA, 19 bp, Homo sapiens
ctctcaccccactcctgtc

SEQ ID NO: 5470832 - DNA, 13 bp, Homo sapiens
ctctcacccccat

SEQ ID NO: 5470833 - DNA, 22 bp, Homo sapiens
ctctcaccccccgacctggctg

SEQ ID NO: 5470834 - DNA, 19 bp, Homo sapiens
ctctcacccgggactctcc

SEQ ID NO: 5470835 - DNA, 15 bp, Homo sapiens
ctctcacctcagcct

SEQ ID NO: 5470836 - DNA, 13 bp, Homo sapiens
ctctcacctcgtg

SEQ ID NO: 5470837 - DNA, 14 bp, Homo sapiens
ctctcacctctagg

SEQ ID NO: 5470838 - DNA, 18 bp, Homo sapiens
ctctcacctgctcccagt

SEQ ID NO: 5470839 - DNA, 16 bp, Homo sapiens
ctctcacctgtactct

SEQ ID NO: 5470840 - DNA, 23 bp, Homo sapiens
ctctcaccttggttcctggggca

SEQ ID NO: 5470841 - DNA, 15 bp, Homo sapiens
ctctcacgggccctg

SEQ ID NO: 5470842 - DNA, 17 bp, Homo sapiens
ctctcacgggccctgcc

SEQ ID NO: 5470843 - DNA, 21 bp, Homo sapiens
ctctcactaaactttacccaa

SEQ ID NO: 5470844 - DNA, 16 bp, Homo sapiens
ctctcactagtgccaa

SEQ ID NO: 5470845 - DNA, 17 bp, Homo sapiens
ctctcactcacattttc

SEQ ID NO: 5470846 - DNA, 18 bp, Homo sapiens
ctctcactcacattttct

SEQ ID NO: 5470847 - DNA, 12 bp, Homo sapiens
ctctcactccag

SEQ ID NO: 5470848 - DNA, 22 bp, Homo sapiens
ctctcactccccagcctgggcc

SEQ ID NO: 5470849 - DNA, 23 bp, Homo sapiens
ctctcactccccagcctgggccc

SEQ ID NO: 5470850 - DNA, 18 bp, Homo sapiens
ctctcactctcttccttt

SEQ ID NO: 5470851 - DNA, 22 bp, Homo sapiens
ctctcactctggcagcctcaga

SEQ ID NO: 5470852 - DNA, 23 bp, Homo sapiens
ctctcactctggcagcctcagag

SEQ ID NO: 5470853 - DNA, 14 bp, Homo sapiens
ctctcactgcctcc

SEQ ID NO: 5470854 - DNA, 12 bp, Homo sapiens
ctctcactgtct

SEQ ID NO: 5470855 - DNA, 19 bp, Homo sapiens
ctctcactgtgttactgct

SEQ ID NO: 5470856 - DNA, 20 bp, Homo sapiens
ctctcactgtgttactgctt

SEQ ID NO: 5470857 - DNA, 23 bp, Homo sapiens
ctctcacttaccccgagacctca

SEQ ID NO: 5470858 - DNA, 12 bp, Homo sapiens
ctctcagaacat

SEQ ID NO: 5470859 - DNA, 21 bp, Homo sapiens
ctctcagaccgtcttcctcca

SEQ ID NO: 5470860 - DNA, 17 bp, Homo sapiens
ctctcagagactcccag

SEQ ID NO: 5470861 - DNA, 22 bp, Homo sapiens
ctctcagagactcccaggagtt

SEQ ID NO: 5470862 - DNA, 14 bp, Homo sapiens
ctctcagagcagca

SEQ ID NO: 5470863 - DNA, 22 bp, Homo sapiens
ctctcagagcatctggctgttt

SEQ ID NO: 5470864 - DNA, 16 bp, Homo sapiens
ctctcagagcctcagc

SEQ ID NO: 5470865 - DNA, 20 bp, Homo sapiens
ctctcagagctacttgggcc

SEQ ID NO: 5470866 - DNA, 22 bp, Homo sapiens
ctctcagaggcctgctgccagt

SEQ ID NO: 5470867 - DNA, 20 bp, Homo sapiens
ctctcagatacccagtggaa

SEQ ID NO: 5470868 - DNA, 21 bp, Homo sapiens
ctctcagatcaccccagcctc

SEQ ID NO: 5470869 - DNA, 18 bp, Homo sapiens
ctctcagatccctcggtc

SEQ ID NO: 5470870 - DNA, 12 bp, Homo sapiens
ctctcagatttc

SEQ ID NO: 5470871 - DNA, 19 bp, Homo sapiens
ctctcagatttccacagag

SEQ ID NO: 5470872 - DNA, 13 bp, Homo sapiens
ctctcagcaagtg

SEQ ID NO: 5470873 - DNA, 22 bp, Homo sapiens
ctctcagcaagtgcccagtgga

SEQ ID NO: 5470874 - DNA, 15 bp, Homo sapiens
ctctcagcacagcct

SEQ ID NO: 5470875 - DNA, 19 bp, Homo sapiens
ctctcagcatagcctgcct

SEQ ID NO: 5470876 - DNA, 22 bp, Homo sapiens
ctctcagcatagcctgcctgat

SEQ ID NO: 5470877 - DNA, 23 bp, Homo sapiens
ctctcagcataggtatgcttact

SEQ ID NO: 5470878 - DNA, 14 bp, Homo sapiens
ctctcagcccagaa

SEQ ID NO: 5470879 - DNA, 15 bp, Homo sapiens
ctctcagcccagaag

SEQ ID NO: 5470880 - DNA, 16 bp, Homo sapiens
ctctcagcccaggtct

SEQ ID NO: 5470881 - DNA, 20 bp, Homo sapiens
ctctcagcccaggtctcctg

SEQ ID NO: 5470882 - DNA, 18 bp, Homo sapiens
ctctcagccccatcgccc

SEQ ID NO: 5470883 - DNA, 17 bp, Homo sapiens
ctctcagcccctcagag

SEQ ID NO: 5470884 - DNA, 21 bp, Homo sapiens
ctctcagcccctgatcctgtg

SEQ ID NO: 5470885 - DNA, 19 bp, Homo sapiens
ctctcagcctcccaacccc

SEQ ID NO: 5470886 - DNA, 22 bp, Homo sapiens
ctctcagcctcccaaccccagg

SEQ ID NO: 5470887 - DNA, 15 bp, Homo sapiens
ctctcagcctcccac

SEQ ID NO: 5470888 - DNA, 17 bp, Homo sapiens
ctctcagccttacattt

SEQ ID NO: 5470889 - DNA, 19 bp, Homo sapiens
ctctcagccttacatttgt

SEQ ID NO: 5470890 - DNA, 15 bp, Homo sapiens
ctctcagctcccagg

SEQ ID NO: 5470891 - DNA, 18 bp, Homo sapiens
ctctcagctcccaggcca

SEQ ID NO: 5470892 - DNA, 12 bp, Homo sapiens
ctctcagctgcc

SEQ ID NO: 5470893 - DNA, 15 bp, Homo sapiens
ctctcagctgctgga

SEQ ID NO: 5470894 - DNA, 17 bp, Homo sapiens
ctctcagctgctggatg

SEQ ID NO: 5470895 - DNA, 20 bp, Homo sapiens
ctctcaggaccaccctgcca

SEQ ID NO: 5470896 - DNA, 22 bp, Homo sapiens
ctctcaggaccaccctgccaag

SEQ ID NO: 5470897 - DNA, 23 bp, Homo sapiens
ctctcaggaccaccctgccaagg

SEQ ID NO: 5470898 - DNA, 15 bp, Homo sapiens
ctctcaggagcacag

SEQ ID NO: 5470899 - DNA, 17 bp, Homo sapiens
ctctcaggagcacaggc

SEQ ID NO: 5470900 - DNA, 18 bp, Homo sapiens
ctctcaggagcacaggca

SEQ ID NO: 5470901 - DNA, 19 bp, Homo sapiens
ctctcaggagcacaggcag

SEQ ID NO: 5470902 - DNA, 19 bp, Homo sapiens
ctctcaggaggcgcagccc

SEQ ID NO: 5470903 - DNA, 21 bp, Homo sapiens
ctctcaggaggcgcagcccga

SEQ ID NO: 5470904 - DNA, 14 bp, Homo sapiens
ctctcaggatcaag

SEQ ID NO: 5470905 - DNA, 14 bp, Homo sapiens
ctctcaggatccaa

SEQ ID NO: 5470906 - DNA, 16 bp, Homo sapiens
ctctcaggatccaagc

SEQ ID NO: 5470907 - DNA, 19 bp, Homo sapiens
ctctcaggcatgcctgtgt

SEQ ID NO: 5470908 - DNA, 21 bp, Homo sapiens
ctctcaggcatgcctgtgtga

SEQ ID NO: 5470909 - DNA, 20 bp, Homo sapiens
ctctcaggccaaactcacct

SEQ ID NO: 5470910 - DNA, 21 bp, Homo sapiens
ctctcaggccaaactcacctg

SEQ ID NO: 5470911 - DNA, 13 bp, Homo sapiens
ctctcaggccagc

SEQ ID NO: 5470912 - DNA, 15 bp, Homo sapiens
ctctcaggccagctg

SEQ ID NO: 5470913 - DNA, 18 bp, Homo sapiens
ctctcaggccagctgctt

SEQ ID NO: 5470914 - DNA, 21 bp, Homo sapiens
ctctcaggccagctgcttggg

SEQ ID NO: 5470915 - DNA, 22 bp, Homo sapiens
ctctcaggccagctgcttgggc

SEQ ID NO: 5470916 - DNA, 23 bp, Homo sapiens
ctctcaggccagctgcttgggct

SEQ ID NO: 5470917 - DNA, 14 bp, Homo sapiens
ctctcaggccgaga

SEQ ID NO: 5470918 - DNA, 18 bp, Homo sapiens
ctctcaggccgagagcct

SEQ ID NO: 5470919 - DNA, 18 bp, Homo sapiens
ctctcaggctgtcccaag

SEQ ID NO: 5470920 - DNA, 16 bp, Homo sapiens
ctctcaggctgtgctt

SEQ ID NO: 5470921 - DNA, 19 bp, Homo sapiens
ctctcagggccaggcctct

SEQ ID NO: 5470922 - DNA, 13 bp, Homo sapiens
ctctcagggcctg

SEQ ID NO: 5470923 - DNA, 17 bp, Homo sapiens
ctctcagggcctggcag

SEQ ID NO: 5470924 - DNA, 24 bp, Homo sapiens
ctctcagggcctggcaggccagtg

SEQ ID NO: 5470925 - DNA, 18 bp, Homo sapiens
ctctcaggggccagtgag

SEQ ID NO: 5470926 - DNA, 20 bp, Homo sapiens
ctctcaggggccagtgaggg

SEQ ID NO: 5470927 - DNA, 16 bp, Homo sapiens
ctctcaggtcactcca

SEQ ID NO: 5470928 - DNA, 18 bp, Homo sapiens
ctctcaggtgaaaggaaa

SEQ ID NO: 5470929 - DNA, 19 bp, Homo sapiens
ctctcagtatcttaaaatt

SEQ ID NO: 5470930 - DNA, 13 bp, Homo sapiens
ctctcagtctctg

SEQ ID NO: 5470931 - DNA, 15 bp, Homo sapiens
ctctcagtctctgag

SEQ ID NO: 5470932 - DNA, 18 bp, Homo sapiens
ctctcagtctctgagcag

SEQ ID NO: 5470933 - DNA, 17 bp, Homo sapiens
ctctcagtgccctccag

SEQ ID NO: 5470934 - DNA, 14 bp, Homo sapiens
ctctcagtgccttc

SEQ ID NO: 5470935 - DNA, 13 bp, Homo sapiens
ctctcagtgtgtt

SEQ ID NO: 5470936 - DNA, 15 bp, Homo sapiens
ctctcagttctctcc

SEQ ID NO: 5470937 - DNA, 16 bp, Homo sapiens
ctctcagttctctccc

SEQ ID NO: 5470938 - DNA, 17 bp, Homo sapiens
ctctcatagaacattga

SEQ ID NO: 5470939 - DNA, 16 bp, Homo sapiens
ctctcatatatatttt

SEQ ID NO: 5470940 - DNA, 21 bp, Homo sapiens
ctctcatatgccaccccatgt

SEQ ID NO: 5470941 - DNA, 12 bp, Homo sapiens
ctctcatattcg

SEQ ID NO: 5470942 - DNA, 16 bp, Homo sapiens
ctctcatcaactgaat

SEQ ID NO: 5470943 - DNA, 17 bp, Homo sapiens
ctctcatcaactgaatg

SEQ ID NO: 5470944 - DNA, 22 bp, Homo sapiens
ctctcatcacagtgggaagaat

SEQ ID NO: 5470945 - DNA, 20 bp, Homo sapiens
ctctcatcaccccagaggcc

SEQ ID NO: 5470946 - DNA, 22 bp, Homo sapiens
ctctcatcaccccagaggcctt

SEQ ID NO: 5470947 - DNA, 23 bp, Homo sapiens
ctctcatcatttgcattgggcat

SEQ ID NO: 5470948 - DNA, 12 bp, Homo sapiens
ctctcatccccc

SEQ ID NO: 5470949 - DNA, 18 bp, Homo sapiens
ctctcatccccctgtgga

SEQ ID NO: 5470950 - DNA, 18 bp, Homo sapiens
ctctcatccttttctcct

SEQ ID NO: 5470951 - DNA, 14 bp, Homo sapiens
ctctcatcggaggc

SEQ ID NO: 5470952 - DNA, 13 bp, Homo sapiens
ctctcatgcctcc

SEQ ID NO: 5470953 - DNA, 20 bp, Homo sapiens
ctctcatgcctcctgaggct

SEQ ID NO: 5470954 - DNA, 16 bp, Homo sapiens
ctctcatgcctgcctg

SEQ ID NO: 5470955 - DNA, 14 bp, Homo sapiens
gatctcaggggctg

SEQ ID NO: 5470956 - DNA, 19 bp, Homo sapiens
gatctcaggggctgtttga

SEQ ID NO: 5470957 - DNA, 16 bp, Homo sapiens
gatctcataatgcttt

SEQ ID NO: 5470958 - DNA, 14 bp, Homo sapiens
gatctcatagatga

SEQ ID NO: 5470959 - DNA, 22 bp, Homo sapiens
gatctcatggaaactggccagg

SEQ ID NO: 5470960 - DNA, 15 bp, Homo sapiens
gatctccaggcccag

SEQ ID NO: 5470961 - DNA, 18 bp, Homo sapiens
gatctccaggcccagcct

SEQ ID NO: 5470962 - DNA, 19 bp, Homo sapiens
gatctccatggcttcctcc

SEQ ID NO: 5470963 - DNA, 14 bp, Homo sapiens
gatctcccagggct

SEQ ID NO: 5470964 - DNA, 20 bp, Homo sapiens
gatctcccagggctctctgg

SEQ ID NO: 5470965 - DNA, 16 bp, Homo sapiens
gatctccccgaatctc

SEQ ID NO: 5470966 - DNA, 13 bp, Homo sapiens
gatctccctgccg

SEQ ID NO: 5470967 - DNA, 18 bp, Homo sapiens
gatctccctgccgcctca

SEQ ID NO: 5470968 - DNA, 20 bp, Homo sapiens
gatctcccttggtcttccat

SEQ ID NO: 5470969 - DNA, 22 bp, Homo sapiens
gatctcccttggtcttccatgg

SEQ ID NO: 5470970 - DNA, 19 bp, Homo sapiens
gatctcctgccagcccagc

SEQ ID NO: 5470971 - DNA, 20 bp, Homo sapiens
gatctcctgccagcccagct

SEQ ID NO: 5470972 - DNA, 16 bp, Homo sapiens
gatctcctgctgcctt

SEQ ID NO: 5470973 - DNA, 14 bp, Homo sapiens
gatctcctgtgcac

SEQ ID NO: 5470974 - DNA, 14 bp, Homo sapiens
gatctccttccctt

SEQ ID NO: 5470975 - DNA, 13 bp, Homo sapiens
gatctcggtgctg

SEQ ID NO: 5470976 - DNA, 20 bp, Homo sapiens
gatctcggtttgccaaaatt

SEQ ID NO: 5470977 - DNA, 22 bp, Homo sapiens
gatctcgtgatccgcctgcctc

SEQ ID NO: 5470978 - DNA, 18 bp, Homo sapiens
gatctctattatatcttg

SEQ ID NO: 5470979 - DNA, 14 bp, Homo sapiens
gatctctcaggagc

SEQ ID NO: 5470980 - DNA, 17 bp, Homo sapiens
gatctctcaggagcaca

SEQ ID NO: 5470981 - DNA, 22 bp, Homo sapiens
gatctctcaggagcacaggcag

SEQ ID NO: 5470982 - DNA, 23 bp, Homo sapiens
gatctctcaggagcacaggcagc

SEQ ID NO: 5470983 - DNA, 16 bp, Homo sapiens
gatctctcctggccta

SEQ ID NO: 5470984 - DNA, 16 bp, Homo sapiens
gatctctcttgtcctc

SEQ ID NO: 5470985 - DNA, 20 bp, Homo sapiens
gatctctcttgtcctcttct

SEQ ID NO: 5470986 - DNA, 22 bp, Homo sapiens
gatctctcttgtcctcttctgc

SEQ ID NO: 5470987 - DNA, 17 bp, Homo sapiens
gatctctgacctctgct

SEQ ID NO: 5470988 - DNA, 18 bp, Homo sapiens
gatctctgagaccacaga

SEQ ID NO: 5470989 - DNA, 24 bp, Homo sapiens
gatctctgagaccacagaggctca

SEQ ID NO: 5470990 - DNA, 23 bp, Homo sapiens
gatctctgcaggaaatggctgtg

SEQ ID NO: 5470991 - DNA, 20 bp, Homo sapiens
gatctctgcagggccgccag

SEQ ID NO: 5470992 - DNA, 11 bp, Homo sapiens
gatctctgctt

SEQ ID NO: 5470993 - DNA, 12 bp, Homo sapiens
gatctctgctta

SEQ ID NO: 5470994 - DNA, 22 bp, Homo sapiens
gatctctgggatttatgctcat

SEQ ID NO: 5470995 - DNA, 18 bp, Homo sapiens
gatctctgtagaaggagt

SEQ ID NO: 5470996 - DNA, 15 bp, Homo sapiens
gatctctgtcacatc

SEQ ID NO: 5470997 - DNA, 18 bp, Homo sapiens
gatctctgttctttcata

SEQ ID NO: 5470998 - DNA, 21 bp, Homo sapiens
gatctcttagaagccatggga

SEQ ID NO: 5470999 - DNA, 21 bp, Homo sapiens
gatctcttcttaatgtacata

SEQ ID NO: 5471000 - DNA, 12 bp, Homo sapiens
gatctcttgagc

SEQ ID NO: 5471001 - DNA, 17 bp, Homo sapiens
gatctgaaaacttggct

SEQ ID NO: 5471002 - DNA, 14 bp, Homo sapiens
gatctgaaatccat

SEQ ID NO: 5471003 - DNA, 15 bp, Homo sapiens
gatctgaaatccata

SEQ ID NO: 5471004 - DNA, 12 bp, Homo sapiens
gatctgaacaga

SEQ ID NO: 5471005 - DNA, 19 bp, Homo sapiens
gatctgaacagaaatacca

SEQ ID NO: 5471006 - DNA, 23 bp, Homo sapiens
gatctgaactttgtttccagaaa

SEQ ID NO: 5471007 - DNA, 21 bp, Homo sapiens
gatctgacatgattccttcct

SEQ ID NO: 5471008 - DNA, 21 bp, Homo sapiens
gatctgagaacacgttgccag

SEQ ID NO: 5471009 - DNA, 14 bp, Homo sapiens
gatctgagaatctt

SEQ ID NO: 5471010 - DNA, 21 bp, Homo sapiens
gatctgagctcccacctccct

SEQ ID NO: 5471011 - DNA, 24 bp, Homo sapiens
gatctgagctcccacctcccttcc

SEQ ID NO: 5471012 - DNA, 14 bp, Homo sapiens
gatctgaggacaag

SEQ ID NO: 5471013 - DNA, 22 bp, Homo sapiens
gatctgaggttggatttgctca

SEQ ID NO: 5471014 - DNA, 22 bp, Homo sapiens
gatctgagtcagagccatgtct

SEQ ID NO: 5471015 - DNA, 15 bp, Homo sapiens
gatctgagtcccagg

SEQ ID NO: 5471016 - DNA, 19 bp, Homo sapiens
gatctgatccccaagacat

SEQ ID NO: 5471017 - DNA, 17 bp, Homo sapiens
gatctgatctgtaccat

SEQ ID NO: 5471018 - DNA, 18 bp, Homo sapiens
gatctgatggtgagctgg

SEQ ID NO: 5471019 - DNA, 23 bp, Homo sapiens
gatctgattgaccgtgttggtct

SEQ ID NO: 5471020 - DNA, 12 bp, Homo sapiens
gatctgattttt

SEQ ID NO: 5471021 - DNA, 15 bp, Homo sapiens
gatctgcacagtcag

SEQ ID NO: 5471022 - DNA, 16 bp, Homo sapiens
gatctgcacagtcaga

SEQ ID NO: 5471023 - DNA, 20 bp, Homo sapiens
gatctgcacagtcagaagga

SEQ ID NO: 5471024 - DNA, 15 bp, Homo sapiens
gatctgcactgggtg

SEQ ID NO: 5471025 - DNA, 16 bp, Homo sapiens
gatctgcaggggtctg

SEQ ID NO: 5471026 - DNA, 17 bp, Homo sapiens
gatctgcaggggtctgg

SEQ ID NO: 5471027 - DNA, 18 bp, Homo sapiens
gatctgcatatttctgta

SEQ ID NO: 5471028 - DNA, 20 bp, Homo sapiens
gatctgcatatttctgtata

SEQ ID NO: 5471029 - DNA, 22 bp, Homo sapiens
gatctgcatatttctgtatatt

SEQ ID NO: 5471030 - DNA, 17 bp, Homo sapiens
gatctgcattccccgct

SEQ ID NO: 5471031 - DNA, 22 bp, Homo sapiens
gatctgcattccccgctgccca

SEQ ID NO: 5471032 - DNA, 17 bp, Homo sapiens
gatctgccattgggacc

SEQ ID NO: 5471033 - DNA, 19 bp, Homo sapiens
gatctgcccatcgtgaaga

SEQ ID NO: 5471034 - DNA, 23 bp, Homo sapiens
gatctgccccctagttcaggtcc

SEQ ID NO: 5471035 - DNA, 13 bp, Homo sapiens
gatctgcccctcc

SEQ ID NO: 5471036 - DNA, 23 bp, Homo sapiens
gatctgcccgcctcggcctccca

SEQ ID NO: 5471037 - DNA, 23 bp, Homo sapiens
gatctgcccgcctcggtctccca

SEQ ID NO: 5471038 - DNA, 19 bp, Homo sapiens
gatctgcccttctctgcct

SEQ ID NO: 5471039 - DNA, 20 bp, Homo sapiens
gatctgcctaaggacttctt

SEQ ID NO: 5471040 - DNA, 11 bp, Homo sapiens
gatctgcctgg

SEQ ID NO: 5471041 - DNA, 12 bp, Homo sapiens
gatctgcctggg

SEQ ID NO: 5471042 - DNA, 13 bp, Homo sapiens
gatctgcctgggc

SEQ ID NO: 5471043 - DNA, 21 bp, Homo sapiens
gatctgcctgggcctgtgcag

SEQ ID NO: 5471044 - DNA, 21 bp, Homo sapiens
gatctgcggatctcagctttg

SEQ ID NO: 5471045 - DNA, 15 bp, Homo sapiens
gatctgctagtgctg

SEQ ID NO: 5471046 - DNA, 14 bp, Homo sapiens
gatctgctcagccc

SEQ ID NO: 5471047 - DNA, 18 bp, Homo sapiens
gatctgctcagccctgga

SEQ ID NO: 5471048 - DNA, 17 bp, Homo sapiens
gatctgctccatgcaga

SEQ ID NO: 5471049 - DNA, 18 bp, Homo sapiens
gatctgctgcagagcagt

SEQ ID NO: 5471050 - DNA, 13 bp, Homo sapiens
gatctgcttcttc

SEQ ID NO: 5471051 - DNA, 20 bp, Homo sapiens
gatctgcttgatatcccaag

SEQ ID NO: 5471052 - DNA, 13 bp, Homo sapiens
gatctgctttctg

SEQ ID NO: 5471053 - DNA, 16 bp, Homo sapiens
gatctgctttctgttc

SEQ ID NO: 5471054 - DNA, 17 bp, Homo sapiens
gatctgctttctgttca

SEQ ID NO: 5471055 - DNA, 20 bp, Homo sapiens
gatctgctttctgttcatct

SEQ ID NO: 5471056 - DNA, 15 bp, Homo sapiens
gatctggaacccaga

SEQ ID NO: 5471057 - DNA, 17 bp, Homo sapiens
gatctggaacccagact

SEQ ID NO: 5471058 - DNA, 18 bp, Homo sapiens
gatctggaacccagactc

SEQ ID NO: 5471059 - DNA, 20 bp, Homo sapiens
gatctggaacccagactcag

SEQ ID NO: 5471060 - DNA, 18 bp, Homo sapiens
gatctggaacctcagcct

SEQ ID NO: 5471061 - DNA, 17 bp, Homo sapiens
gatctggaagggccaag

SEQ ID NO: 5471062 - DNA, 18 bp, Homo sapiens
gatctggacagaacattt

SEQ ID NO: 5471063 - DNA, 17 bp, Homo sapiens
gatctggagtctgaagg

SEQ ID NO: 5471064 - DNA, 17 bp, Homo sapiens
gatctggcccaagctgg

SEQ ID NO: 5471065 - DNA, 17 bp, Homo sapiens
gatctgggaactcccaa

SEQ ID NO: 5471066 - DNA, 17 bp, Homo sapiens
gatctgggaccctttcc

SEQ ID NO: 5471067 - DNA, 23 bp, Homo sapiens
gatctgggaccctttccttcctt

SEQ ID NO: 5471068 - DNA, 21 bp, Homo sapiens
gatctgggcattttcctcctc

SEQ ID NO: 5471069 - DNA, 23 bp, Homo sapiens
gatctgggcattttcctcctctg

SEQ ID NO: 5471070 - DNA, 20 bp, Homo sapiens
gatctggggagagcggctgg

SEQ ID NO: 5471071 - DNA, 12 bp, Homo sapiens
gatctggggagt

SEQ ID NO: 5471072 - DNA, 13 bp, Homo sapiens
gatctggggagtg

SEQ ID NO: 5471073 - DNA, 19 bp, Homo sapiens
gatctggggcatgaaaaaa

SEQ ID NO: 5471074 - DNA, 18 bp, Homo sapiens
gatctggggctctgggat

SEQ ID NO: 5471075 - DNA, 16 bp, Homo sapiens
gatctggggggtgggg

SEQ ID NO: 5471076 - DNA, 18 bp, Homo sapiens
gatctggggggtggggag

SEQ ID NO: 5471077 - DNA, 19 bp, Homo sapiens
gatctggggggtggggagg

SEQ ID NO: 5471078 - DNA, 21 bp, Homo sapiens
gatctggtgcgtgtggccctg

SEQ ID NO: 5471079 - DNA, 19 bp, Homo sapiens
gatctggtggtcagcccta

SEQ ID NO: 5471080 - DNA, 18 bp, Homo sapiens
gatctggttttgctatta

SEQ ID NO: 5471081 - DNA, 14 bp, Homo sapiens
gatctgtactgtaa

SEQ ID NO: 5471082 - DNA, 15 bp, Homo sapiens
gatctgtactgtaat

SEQ ID NO: 5471083 - DNA, 22 bp, Homo sapiens
gatctgtataaataagagcatg

SEQ ID NO: 5471084 - DNA, 20 bp, Homo sapiens
gatctgtatatacaataaca

SEQ ID NO: 5471085 - DNA, 17 bp, Homo sapiens
gatctgtcacaccagcc

SEQ ID NO: 5471086 - DNA, 19 bp, Homo sapiens
gatctgtcacaccagccat

SEQ ID NO: 5471087 - DNA, 14 bp, Homo sapiens
gatctgtcctcagc

SEQ ID NO: 5471088 - DNA, 16 bp, Homo sapiens
gatctgtcctcagcct

SEQ ID NO: 5471089 - DNA, 11 bp, Homo sapiens
gatctgtcctg

SEQ ID NO: 5471090 - DNA, 12 bp, Homo sapiens
gatctgtcctgg

SEQ ID NO: 5471091 - DNA, 12 bp, Homo sapiens
gatctgtccttc

SEQ ID NO: 5471092 - DNA, 15 bp, Homo sapiens
gatctgtctgtgcac

SEQ ID NO: 5471093 - DNA, 14 bp, Homo sapiens
gatctgtcttggca

SEQ ID NO: 5471094 - DNA, 14 bp, Homo sapiens
gatctgtgattggc

SEQ ID NO: 5471095 - DNA, 15 bp, Homo sapiens
gatctgtgattggct

SEQ ID NO: 5471096 - DNA, 17 bp, Homo sapiens
gatctgtgattggctgg

SEQ ID NO: 5471097 - DNA, 19 bp, Homo sapiens
gatctgtgattggctggtt

SEQ ID NO: 5471098 - DNA, 17 bp, Homo sapiens
gatctgtgatttcttct

SEQ ID NO: 5471099 - DNA, 16 bp, Homo sapiens
gatctgtgcccagaga

SEQ ID NO: 5471100 - DNA, 13 bp, Homo sapiens
gatctgtgcctgg

SEQ ID NO: 5471101 - DNA, 20 bp, Homo sapiens
gatctgtgctttccagctca

SEQ ID NO: 5471102 - DNA, 23 bp, Homo sapiens
gatctgtgctttccagctcaccc

SEQ ID NO: 5471103 - DNA, 11 bp, Homo sapiens
gatctgtgtgg

SEQ ID NO: 5471104 - DNA, 13 bp, Homo sapiens
gatctgtgtggct

SEQ ID NO: 5471105 - DNA, 18 bp, Homo sapiens
gatctgtgtggctcctgg

SEQ ID NO: 5471106 - DNA, 12 bp, Homo sapiens
gatctgttcagt

SEQ ID NO: 5471107 - DNA, 21 bp, Homo sapiens
gatctgttgcaaactcagcct

SEQ ID NO: 5471108 - DNA, 15 bp, Homo sapiens
gatctgttttacagg

SEQ ID NO: 5471109 - DNA, 13 bp, Homo sapiens
gatctgttttgaa

SEQ ID NO: 5471110 - DNA, 21 bp, Homo sapiens
gatctgttttggatgttgcta

SEQ ID NO: 5471111 - DNA, 12 bp, Homo sapiens
gatcttaaattt

SEQ ID NO: 5471112 - DNA, 19 bp, Homo sapiens
gatcttaagaggctgacag

SEQ ID NO: 5471113 - DNA, 19 bp, Homo sapiens
gatcttactctactgctgc

SEQ ID NO: 5471114 - DNA, 18 bp, Homo sapiens
gatcttagggaactttga

SEQ ID NO: 5471115 - DNA, 19 bp, Homo sapiens
gatcttagggaactttgat

SEQ ID NO: 5471116 - DNA, 19 bp, Homo sapiens
gatcttagggtgaaccact

SEQ ID NO: 5471117 - DNA, 13 bp, Homo sapiens
gatcttatttgga

SEQ ID NO: 5471118 - DNA, 18 bp, Homo sapiens
gatcttattttgtgaact

SEQ ID NO: 5471119 - DNA, 19 bp, Homo sapiens
gatcttatttttctaaacg

SEQ ID NO: 5471120 - DNA, 17 bp, Homo sapiens
gatcttcagaactgccc

SEQ ID NO: 5471121 - DNA, 15 bp, Homo sapiens
gatcttcagaaggct

SEQ ID NO: 5471122 - DNA, 23 bp, Homo sapiens
gatcttcccacaggagggccagc

SEQ ID NO: 5471123 - DNA, 23 bp, Homo sapiens
gatcttccttccgctctgaggca

SEQ ID NO: 5471124 - DNA, 18 bp, Homo sapiens
gatcttctatcattccaa

SEQ ID NO: 5471125 - DNA, 19 bp, Homo sapiens
gatcttctatcattccaat

SEQ ID NO: 5471126 - DNA, 15 bp, Homo sapiens
gatcttctgaaatga

SEQ ID NO: 5471127 - DNA, 13 bp, Homo sapiens
gatcttgaactcc

SEQ ID NO: 5471128 - DNA, 17 bp, Homo sapiens
gatcttgagagagaaat

SEQ ID NO: 5471129 - DNA, 16 bp, Homo sapiens
gatcttgagagctgct

SEQ ID NO: 5471130 - DNA, 18 bp, Homo sapiens
gatcttgagagctgctga

SEQ ID NO: 5471131 - DNA, 17 bp, Homo sapiens
gatcttgccacatttct

SEQ ID NO: 5471132 - DNA, 13 bp, Homo sapiens
gatcttgcctgtc

SEQ ID NO: 5471133 - DNA, 15 bp, Homo sapiens
gatcttgtgctcagc

SEQ ID NO: 5471134 - DNA, 16 bp, Homo sapiens
gatcttgttctttgct

SEQ ID NO: 5471135 - DNA, 14 bp, Homo sapiens
gatctttaaaatac

SEQ ID NO: 5471136 - DNA, 16 bp, Homo sapiens
gatctttaaatacagt

SEQ ID NO: 5471137 - DNA, 19 bp, Homo sapiens
gatctttcacccacagaaa

SEQ ID NO: 5471138 - DNA, 12 bp, Homo sapiens
gatctttcagaa

SEQ ID NO: 5471139 - DNA, 15 bp, Homo sapiens
gatctttcagaaata

SEQ ID NO: 5471140 - DNA, 19 bp, Homo sapiens
gatctttctcttccctgaa

SEQ ID NO: 5471141 - DNA, 14 bp, Homo sapiens
gatctttctgggag

SEQ ID NO: 5471142 - DNA, 18 bp, Homo sapiens
gatctttctttccaaaac

SEQ ID NO: 5471143 - DNA, 19 bp, Homo sapiens
gatctttctttccaaaaca

SEQ ID NO: 5471144 - DNA, 14 bp, Homo sapiens
gatctttgagccca

SEQ ID NO: 5471145 - DNA, 15 bp, Homo sapiens
gatctttgagcccat

SEQ ID NO: 5471146 - DNA, 22 bp, Homo sapiens
gatctttgagcccattcttctg

SEQ ID NO: 5471147 - DNA, 23 bp, Homo sapiens
gatctttgagcccattcttctgg

SEQ ID NO: 5471148 - DNA, 16 bp, Homo sapiens
gatctttgcagacagg

SEQ ID NO: 5471149 - DNA, 14 bp, Homo sapiens
gatctttgtggcca

SEQ ID NO: 5471150 - DNA, 20 bp, Homo sapiens
gatcttttaaagtgttactt

SEQ ID NO: 5471151 - DNA, 14 bp, Homo sapiens
gatcttttattttg

SEQ ID NO: 5471152 - DNA, 15 bp, Homo sapiens
gatcttttattttgc

SEQ ID NO: 5471153 - DNA, 19 bp, Homo sapiens
gatcttttggtggagtcag

SEQ ID NO: 5471154 - DNA, 11 bp, Homo sapiens
gatcttttgta

SEQ ID NO: 5471155 - DNA, 17 bp, Homo sapiens
gatctttttatattctt

SEQ ID NO: 5471156 - DNA, 19 bp, Homo sapiens
gatctttttgtgaaattca

SEQ ID NO: 5471157 - DNA, 16 bp, Homo sapiens
gatctttttttaagtg

SEQ ID NO: 5471158 - DNA, 13 bp, Homo sapiens
gatgaaaaagaat

SEQ ID NO: 5471159 - DNA, 21 bp, Homo sapiens
gatgaaaaagaataaaaactt

SEQ ID NO: 5471160 - DNA, 18 bp, Homo sapiens
gatgaaaaatatttctga

SEQ ID NO: 5471161 - DNA, 18 bp, Homo sapiens
gatgaaaaattgctgact

SEQ ID NO: 5471162 - DNA, 13 bp, Homo sapiens
gatgaaaagccat

SEQ ID NO: 5471163 - DNA, 15 bp, Homo sapiens
gatgaaaagccatat

SEQ ID NO: 5471164 - DNA, 21 bp, Homo sapiens
gatgaaaagtatattgataac

SEQ ID NO: 5471165 - DNA, 23 bp, Homo sapiens
gatgaaaagtatattgataacct

SEQ ID NO: 5471166 - DNA, 11 bp, Homo sapiens
gatgaaaataa

SEQ ID NO: 5471167 - DNA, 18 bp, Homo sapiens
gatgaaaataaagaatgg

SEQ ID NO: 5471168 - DNA, 14 bp, Homo sapiens
gatgaaaatattta

SEQ ID NO: 5471169 - DNA, 20 bp, Homo sapiens
gatgaaaccttgaagttctg

SEQ ID NO: 5471170 - DNA, 19 bp, Homo sapiens
gatgaaagagaaggtgggt

SEQ ID NO: 5471171 - DNA, 14 bp, Homo sapiens
gatgaaagaggagg

SEQ ID NO: 5471172 - DNA, 16 bp, Homo sapiens
gatgaaagttccccca

SEQ ID NO: 5471173 - DNA, 18 bp, Homo sapiens
gatgaaataactccttct

SEQ ID NO: 5471174 - DNA, 19 bp, Homo sapiens
gatgaaatcttacagctgg

SEQ ID NO: 5471175 - DNA, 20 bp, Homo sapiens
gatgaaatcttacagctggg

SEQ ID NO: 5471176 - DNA, 21 bp, Homo sapiens
gatgaaatgaggtcagagcct

SEQ ID NO: 5471177 - DNA, 13 bp, Homo sapiens
gatgaaatgccaa

SEQ ID NO: 5471178 - DNA, 18 bp, Homo sapiens
gatgaaatgccaagactc

SEQ ID NO: 5471179 - DNA, 16 bp, Homo sapiens
gatgaaatgtaaatac

SEQ ID NO: 5471180 - DNA, 17 bp, Homo sapiens
gatgaaattccatttgt

SEQ ID NO: 5471181 - DNA, 13 bp, Homo sapiens
gatgaacacaggc

SEQ ID NO: 5471182 - DNA, 15 bp, Homo sapiens
gatgaacatattcat

SEQ ID NO: 5471183 - DNA, 13 bp, Homo sapiens
gatgaacctgcag

SEQ ID NO: 5471184 - DNA, 16 bp, Homo sapiens
gatgaactagccatga

SEQ ID NO: 5471185 - DNA, 18 bp, Homo sapiens
gatgaactcaatgcatga

SEQ ID NO: 5471186 - DNA, 23 bp, Homo sapiens
gatgaactcaatgcatgatgact

SEQ ID NO: 5471187 - DNA, 18 bp, Homo sapiens
gatgaacttgagctctgt

SEQ ID NO: 5471188 - DNA, 12 bp, Homo sapiens
gatgaacttttt

SEQ ID NO: 5471189 - DNA, 20 bp, Homo sapiens
gatgaagaaaagtgggccag

SEQ ID NO: 5471190 - DNA, 16 bp, Homo sapiens
gatgaagaacatctgg

SEQ ID NO: 5471191 - DNA, 12 bp, Homo sapiens
gatgaagaccct

SEQ ID NO: 5471192 - DNA, 21 bp, Homo sapiens
gatgaagagagagagggcctg

SEQ ID NO: 5471193 - DNA, 21 bp, Homo sapiens
gatgaagagtgagagggcatg

SEQ ID NO: 5471194 - DNA, 15 bp, Homo sapiens
gatgaagcaaacaca

SEQ ID NO: 5471195 - DNA, 16 bp, Homo sapiens
gatgaagcaaacacat

SEQ ID NO: 5471196 - DNA, 19 bp, Homo sapiens
gatgaagccgaccttagat

SEQ ID NO: 5471197 - DNA, 19 bp, Homo sapiens
gatgaagctgaggctgctg

SEQ ID NO: 5471198 - DNA, 22 bp, Homo sapiens
gatgaagcttggaggtcacagc

SEQ ID NO: 5471199 - DNA, 18 bp, Homo sapiens
gatgaaggctgtgaaaaa

SEQ ID NO: 5471200 - DNA, 18 bp, Homo sapiens
gatgaagggcgagtgaat

SEQ ID NO: 5471201 - DNA, 15 bp, Homo sapiens
gatgaagtatacttt

SEQ ID NO: 5471202 - DNA, 14 bp, Homo sapiens
gatgaataaaatgt

SEQ ID NO: 5471203 - DNA, 17 bp, Homo sapiens
gatgaataaacactttt

SEQ ID NO: 5471204 - DNA, 14 bp, Homo sapiens
gatgaatacatttt

SEQ ID NO: 5471205 - DNA, 20 bp, Homo sapiens
gatgaatagaagaaagaaaa

SEQ ID NO: 5471206 - DNA, 14 bp, Homo sapiens
gatgaatatgagct

SEQ ID NO: 5471207 - DNA, 15 bp, Homo sapiens
gatgaatccaaatgt

SEQ ID NO: 5471208 - DNA, 19 bp, Homo sapiens
gatgaatccaaatgtgaaa

SEQ ID NO: 5471209 - DNA, 17 bp, Homo sapiens
gatgaatctacatttgt

SEQ ID NO: 5471210 - DNA, 18 bp, Homo sapiens
gatgaatctacatttgtt

SEQ ID NO: 5471211 - DNA, 19 bp, Homo sapiens
gatgaatctcccactccag

SEQ ID NO: 5471212 - DNA, 15 bp, Homo sapiens
gatgaatgccgtgga

SEQ ID NO: 5471213 - DNA, 14 bp, Homo sapiens
gatgaatgtattta

SEQ ID NO: 5471214 - DNA, 16 bp, Homo sapiens
gatgaattaaatttaa

SEQ ID NO: 5471215 - DNA, 18 bp, Homo sapiens
gatgaattcttcctctcc

SEQ ID NO: 5471216 - DNA, 19 bp, Homo sapiens
gatgaattcttcctctcct

SEQ ID NO: 5471217 - DNA, 23 bp, Homo sapiens
gatgaattcttcctctccttccc

SEQ ID NO: 5471218 - DNA, 18 bp, Homo sapiens
gatgaattgtcacatcta

SEQ ID NO: 5471219 - DNA, 19 bp, Homo sapiens
gatgaattttccagaccta

SEQ ID NO: 5471220 - DNA, 16 bp, Homo sapiens
gatgaattttctgcag

SEQ ID NO: 5471221 - DNA, 18 bp, Homo sapiens
gatgaattttctgcagct

SEQ ID NO: 5471222 - DNA, 20 bp, Homo sapiens
gatgaattttctgcagctgt

SEQ ID NO: 5471223 - DNA, 22 bp, Homo sapiens
gatgaattttctgcagctgttt

SEQ ID NO: 5471224 - DNA, 12 bp, Homo sapiens
gatgacaaagaa

SEQ ID NO: 5471225 - DNA, 17 bp, Homo sapiens
gatgacaacaaattttg

SEQ ID NO: 5471226 - DNA, 23 bp, Homo sapiens
gatgacaacctgtgtgagagaat

SEQ ID NO: 5471227 - DNA, 19 bp, Homo sapiens
gatgacaactacagaaaaa

SEQ ID NO: 5471228 - DNA, 17 bp, Homo sapiens
gatgacaagatggtaca

SEQ ID NO: 5471229 - DNA, 15 bp, Homo sapiens
gatgacaccctggcc

SEQ ID NO: 5471230 - DNA, 17 bp, Homo sapiens
gatgacaccctggcctg

SEQ ID NO: 5471231 - DNA, 20 bp, Homo sapiens
gatgacacctccatttctct

SEQ ID NO: 5471232 - DNA, 21 bp, Homo sapiens
gatgacagctcttctaaggaa

SEQ ID NO: 5471233 - DNA, 19 bp, Homo sapiens
gatgacaggcgcctgccat

SEQ ID NO: 5471234 - DNA, 20 bp, Homo sapiens
gatgacaggcgcctgccatc

SEQ ID NO: 5471235 - DNA, 13 bp, Homo sapiens
gatgacaggctct

SEQ ID NO: 5471236 - DNA, 19 bp, Homo sapiens
gatgacagggagctgggga

SEQ ID NO: 5471237 - DNA, 22 bp, Homo sapiens
gatgacaggtgtgagccactgc

SEQ ID NO: 5471238 - DNA, 22 bp, Homo sapiens
gatgacagtgctctaggctgcc

SEQ ID NO: 5471239 - DNA, 22 bp, Homo sapiens
gatgacataaaatttacattta

SEQ ID NO: 5471240 - DNA, 18 bp, Homo sapiens
gatgacatgtgactccta

SEQ ID NO: 5471241 - DNA, 20 bp, Homo sapiens
gatgacattccaccattgtg

SEQ ID NO: 5471242 - DNA, 21 bp, Homo sapiens
gatgacattgactatttttgt

SEQ ID NO: 5471243 - DNA, 23 bp, Homo sapiens
gatgacattgactatttttgttt

SEQ ID NO: 5471244 - DNA, 21 bp, Homo sapiens
gatgacattgctaagatgctc

SEQ ID NO: 5471245 - DNA, 14 bp, Homo sapiens
gatgacatttcgtt

SEQ ID NO: 5471246 - DNA, 22 bp, Homo sapiens
gatgaccaaagtcccttcctgc

SEQ ID NO: 5471247 - DNA, 18 bp, Homo sapiens
gatgaccaatctctgtga

SEQ ID NO: 5471248 - DNA, 18 bp, Homo sapiens
gatgaccaatgggatgag

SEQ ID NO: 5471249 - DNA, 19 bp, Homo sapiens
gatgaccacgcacctccac

SEQ ID NO: 5471250 - DNA, 14 bp, Homo sapiens
gatgaccacttttt

SEQ ID NO: 5471251 - DNA, 14 bp, Homo sapiens
gatgaccagggatg

SEQ ID NO: 5471252 - DNA, 16 bp, Homo sapiens
gatgacccactaaaga

SEQ ID NO: 5471253 - DNA, 13 bp, Homo sapiens
gatgacccaggct

SEQ ID NO: 5471254 - DNA, 17 bp, Homo sapiens
gatgaccccatagacct

SEQ ID NO: 5471255 - DNA, 20 bp, Homo sapiens
gatgacccctaccccctcat

SEQ ID NO: 5471256 - DNA, 12 bp, Homo sapiens
gatgacccctcc

SEQ ID NO: 5471257 - DNA, 23 bp, Homo sapiens
gatgaccctgcgaaggggccctg

SEQ ID NO: 5471258 - DNA, 14 bp, Homo sapiens
gatgaccgtgtaca

SEQ ID NO: 5471259 - DNA, 15 bp, Homo sapiens
gatgaccgtgtacaa

SEQ ID NO: 5471260 - DNA, 20 bp, Homo sapiens
gatgacctccttagaaaaga

SEQ ID NO: 5471261 - DNA, 22 bp, Homo sapiens
gatgacctcgtactcaggagcc

SEQ ID NO: 5471262 - DNA, 15 bp, Homo sapiens
gatgacctggataac

SEQ ID NO: 5471263 - DNA, 20 bp, Homo sapiens
gatgaccttgaatgatgcca

SEQ ID NO: 5471264 - DNA, 18 bp, Homo sapiens
gatgacgcctctggacct

SEQ ID NO: 5471265 - DNA, 14 bp, Homo sapiens
gatgacgcctgtct

SEQ ID NO: 5471266 - DNA, 15 bp, Homo sapiens
gatgacgggatgctc

SEQ ID NO: 5471267 - DNA, 15 bp, Homo sapiens
gatgactaaaatatt

SEQ ID NO: 5471268 - DNA, 15 bp, Homo sapiens
gatgactaacaagat

SEQ ID NO: 5471269 - DNA, 22 bp, Homo sapiens
gatgactatgcagaggcctggg

SEQ ID NO: 5471270 - DNA, 16 bp, Homo sapiens
gatgactcaagattcc

SEQ ID NO: 5471271 - DNA, 22 bp, Homo sapiens
gatgactcaagattttttctgg

SEQ ID NO: 5471272 - DNA, 18 bp, Homo sapiens
gatgactcccttaaaata

SEQ ID NO: 5471273 - DNA, 12 bp, Homo sapiens
gatgactctgag

SEQ ID NO: 5471274 - DNA, 22 bp, Homo sapiens
gatgactcttcttatcacactt

SEQ ID NO: 5471275 - DNA, 18 bp, Homo sapiens
gatgactgaaaatgaact

SEQ ID NO: 5471276 - DNA, 16 bp, Homo sapiens
gatgactgaatttcta

SEQ ID NO: 5471277 - DNA, 13 bp, Homo sapiens
gatgactgccttg

SEQ ID NO: 5471278 - DNA, 22 bp, Homo sapiens
gatgactgccttgcctcctcag

SEQ ID NO: 5471279 - DNA, 12 bp, Homo sapiens
gatgactgctga

SEQ ID NO: 5471280 - DNA, 14 bp, Homo sapiens
gatgactgctgatt

SEQ ID NO: 5471281 - DNA, 18 bp, Homo sapiens
gatgactggcattttata

SEQ ID NO: 5471282 - DNA, 16 bp, Homo sapiens
gatgacttgagatgaa

SEQ ID NO: 5471283 - DNA, 15 bp, Homo sapiens
gatgacttgagccct

SEQ ID NO: 5471284 - DNA, 22 bp, Homo sapiens
gatgacttggggacaccccaga

SEQ ID NO: 5471285 - DNA, 13 bp, Homo sapiens
gatgactttagaa

SEQ ID NO: 5471286 - DNA, 14 bp, Homo sapiens
gatgactttgcaga

SEQ ID NO: 5471287 - DNA, 18 bp, Homo sapiens
gatgagaaaactgagagg

SEQ ID NO: 5471288 - DNA, 22 bp, Homo sapiens
gatgagaaaggttgaagcacca

SEQ ID NO: 5471289 - DNA, 14 bp, Homo sapiens
gatgagaacaagct

SEQ ID NO: 5471290 - DNA, 13 bp, Homo sapiens
gatgagaatgtga

SEQ ID NO: 5471291 - DNA, 16 bp, Homo sapiens
gatgagacaacacaca

SEQ ID NO: 5471292 - DNA, 23 bp, Homo sapiens
gatgagacagggttttttcattt

SEQ ID NO: 5471293 - DNA, 19 bp, Homo sapiens
gatgagacccagccccttc

SEQ ID NO: 5471294 - DNA, 21 bp, Homo sapiens
gatgagacccagccccttccc

SEQ ID NO: 5471295 - DNA, 11 bp, Homo sapiens
gatgagagaat

SEQ ID NO: 5471296 - DNA, 14 bp, Homo sapiens
gatgagagcccaga

SEQ ID NO: 5471297 - DNA, 21 bp, Homo sapiens
gatgagagcccagaggtaaca

SEQ ID NO: 5471298 - DNA, 11 bp, Homo sapiens
gatgagaggca

SEQ ID NO: 5471299 - DNA, 15 bp, Homo sapiens
gatgagaggcagagg

SEQ ID NO: 5471300 - DNA, 14 bp, Homo sapiens
gatgagaggccagc

SEQ ID NO: 5471301 - DNA, 13 bp, Homo sapiens
gatgagagtggct

SEQ ID NO: 5471302 - DNA, 18 bp, Homo sapiens
gatgagagtggcttaaaa

SEQ ID NO: 5471303 - DNA, 21 bp, Homo sapiens
gatgagagttttggatgcagt

SEQ ID NO: 5471304 - DNA, 18 bp, Homo sapiens
gatgagatattaaattct

SEQ ID NO: 5471305 - DNA, 20 bp, Homo sapiens
gatgagattccctctcctcc

SEQ ID NO: 5471306 - DNA, 20 bp, Homo sapiens
gatgagattggcatggcttt

SEQ ID NO: 5471307 - DNA, 21 bp, Homo sapiens
gatgagatttgccagcacagg

SEQ ID NO: 5471308 - DNA, 17 bp, Homo sapiens
gatgagatttttcatgt

SEQ ID NO: 5471309 - DNA, 20 bp, Homo sapiens
gatgagcacatctctctgcc

SEQ ID NO: 5471310 - DNA, 12 bp, Homo sapiens
gatgctgaggcc

SEQ ID NO: 5471311 - DNA, 16 bp, Homo sapiens
gatgctgaggccaccc

SEQ ID NO: 5471312 - DNA, 18 bp, Homo sapiens
gatgctgaggccacccac

SEQ ID NO: 5471313 - DNA, 15 bp, Homo sapiens
gatgctgaggcccct

SEQ ID NO: 5471314 - DNA, 13 bp, Homo sapiens
gatgctgatgttc

SEQ ID NO: 5471315 - DNA, 23 bp, Homo sapiens
gatgctgccccgttccctgtcag

SEQ ID NO: 5471316 - DNA, 19 bp, Homo sapiens
gatgctgctccgcccgctc

SEQ ID NO: 5471317 - DNA, 16 bp, Homo sapiens
gatgctgctggcctcc

SEQ ID NO: 5471318 - DNA, 18 bp, Homo sapiens
gatgctgctggcctccct

SEQ ID NO: 5471319 - DNA, 14 bp, Homo sapiens
gatgctggagaggt

SEQ ID NO: 5471320 - DNA, 16 bp, Homo sapiens
gatgctggagaggtta

SEQ ID NO: 5471321 - DNA, 14 bp, Homo sapiens
gatgctggatgctc

SEQ ID NO: 5471322 - DNA, 18 bp, Homo sapiens
gatgctggatgctccttc

SEQ ID NO: 5471323 - DNA, 22 bp, Homo sapiens
gatgctggcccagggcccagag

SEQ ID NO: 5471324 - DNA, 23 bp, Homo sapiens
gatgctggcccagggcccagagc

SEQ ID NO: 5471325 - DNA, 22 bp, Homo sapiens
gatgctggcctgcgcctgcacc

SEQ ID NO: 5471326 - DNA, 13 bp, Homo sapiens
gatgctggctggg

SEQ ID NO: 5471327 - DNA, 15 bp, Homo sapiens
gatgctgggaccctc

SEQ ID NO: 5471328 - DNA, 13 bp, Homo sapiens
gatgctgggaggg

SEQ ID NO: 5471329 - DNA, 16 bp, Homo sapiens
gatgctgggagggctg

SEQ ID NO: 5471330 - DNA, 19 bp, Homo sapiens
gatgctgggagttctaaca

SEQ ID NO: 5471331 - DNA, 19 bp, Homo sapiens
gatgctgggcaatgaggca

SEQ ID NO: 5471332 - DNA, 21 bp, Homo sapiens
gatgctgggcacttcatctga

SEQ ID NO: 5471333 - DNA, 11 bp, Homo sapiens
gatgctgggct

SEQ ID NO: 5471334 - DNA, 20 bp, Homo sapiens
gatgctgggctctgttcttg

SEQ ID NO: 5471335 - DNA, 17 bp, Homo sapiens
gatgctgggctggctcc

SEQ ID NO: 5471336 - DNA, 22 bp, Homo sapiens
gatgctgggctggctccctctt

SEQ ID NO: 5471337 - DNA, 20 bp, Homo sapiens
gatgctgggctgggccctct

SEQ ID NO: 5471338 - DNA, 20 bp, Homo sapiens
gatgctggggagaatgaaga

SEQ ID NO: 5471339 - DNA, 12 bp, Homo sapiens
gatgctgggtgg

SEQ ID NO: 5471340 - DNA, 23 bp, Homo sapiens
gatgctggtcaagccccctttga

SEQ ID NO: 5471341 - DNA, 19 bp, Homo sapiens
gatgctggtggaggaaggg

SEQ ID NO: 5471342 - DNA, 20 bp, Homo sapiens
gatgctggtggaggaagggc

SEQ ID NO: 5471343 - DNA, 21 bp, Homo sapiens
gatgctggtggaggaagggct

SEQ ID NO: 5471344 - DNA, 22 bp, Homo sapiens
gatgctggtggaggaagggctg

SEQ ID NO: 5471345 - DNA, 23 bp, Homo sapiens
gatgctggtggaggaagggctgg

SEQ ID NO: 5471346 - DNA, 13 bp, Homo sapiens
gatgctgtatttg

SEQ ID NO: 5471347 - DNA, 18 bp, Homo sapiens
gatgctgtcggcaccatg

SEQ ID NO: 5471348 - DNA, 16 bp, Homo sapiens
gatgctgtgcctccca

SEQ ID NO: 5471349 - DNA, 12 bp, Homo sapiens
gatgctgttgcc

SEQ ID NO: 5471350 - DNA, 19 bp, Homo sapiens
gatgcttaataaacgcagc

SEQ ID NO: 5471351 - DNA, 14 bp, Homo sapiens
gatgcttacagtga

SEQ ID NO: 5471352 - DNA, 18 bp, Homo sapiens
gatgcttacagtgactgt

SEQ ID NO: 5471353 - DNA, 15 bp, Homo sapiens
gatgcttacatctgg

SEQ ID NO: 5471354 - DNA, 20 bp, Homo sapiens
gatgcttaggtgaaggcaga

SEQ ID NO: 5471355 - DNA, 11 bp, Homo sapiens
gatgcttctgc

SEQ ID NO: 5471356 - DNA, 19 bp, Homo sapiens
gatgcttggagcaatcaga

SEQ ID NO: 5471357 - DNA, 21 bp, Homo sapiens
gatgcttgtaacaagaaaaca

SEQ ID NO: 5471358 - DNA, 16 bp, Homo sapiens
gatgcttgtacataat

SEQ ID NO: 5471359 - DNA, 21 bp, Homo sapiens
gatgctttaccaaacagcaaa

SEQ ID NO: 5471360 - DNA, 23 bp, Homo sapiens
gatgctttgtttctttcatatga

SEQ ID NO: 5471361 - DNA, 14 bp, Homo sapiens
gatgcttttaacag

SEQ ID NO: 5471362 - DNA, 14 bp, Homo sapiens
gatgcttttctctc

SEQ ID NO: 5471363 - DNA, 20 bp, Homo sapiens
gatgcttttctgtctctgcc

SEQ ID NO: 5471364 - DNA, 11 bp, Homo sapiens
gatgcttttgc

SEQ ID NO: 5471365 - DNA, 19 bp, Homo sapiens
gatgcttttgctgctgctt

SEQ ID NO: 5471366 - DNA, 20 bp, Homo sapiens
gatggaaaaaaaaaacaaaa

SEQ ID NO: 5471367 - DNA, 13 bp, Homo sapiens
gatggaaaaataa

SEQ ID NO: 5471368 - DNA, 18 bp, Homo sapiens
gatggaaaagaactagga

SEQ ID NO: 5471369 - DNA, 15 bp, Homo sapiens
gatggaaaaggaaga

SEQ ID NO: 5471370 - DNA, 17 bp, Homo sapiens
gatggaaaaggaagact

SEQ ID NO: 5471371 - DNA, 16 bp, Homo sapiens
gatggaaaataaacat

SEQ ID NO: 5471372 - DNA, 14 bp, Homo sapiens
gatggaaacaaagt

SEQ ID NO: 5471373 - DNA, 18 bp, Homo sapiens
gatggaaacaatgtggag

SEQ ID NO: 5471374 - DNA, 16 bp, Homo sapiens
gatggaaacgcactta

SEQ ID NO: 5471375 - DNA, 19 bp, Homo sapiens
gatggaaacgcacttacaa

SEQ ID NO: 5471376 - DNA, 15 bp, Homo sapiens
gatggaaactgccaa

SEQ ID NO: 5471377 - DNA, 14 bp, Homo sapiens
gatggaaatacagt

SEQ ID NO: 5471378 - DNA, 21 bp, Homo sapiens
gatggaaattctgaaaactga

SEQ ID NO: 5471379 - DNA, 15 bp, Homo sapiens
gatggaacatcagtg

SEQ ID NO: 5471380 - DNA, 19 bp, Homo sapiens
gatggaaccgcaggaagct

SEQ ID NO: 5471381 - DNA, 18 bp, Homo sapiens
gatggaactgtgtattta

SEQ ID NO: 5471382 - DNA, 16 bp, Homo sapiens
gatggaagaaagaagc

SEQ ID NO: 5471383 - DNA, 14 bp, Homo sapiens
gatggaagagtcat

SEQ ID NO: 5471384 - DNA, 13 bp, Homo sapiens
gatggaagcacac

SEQ ID NO: 5471385 - DNA, 20 bp, Homo sapiens
gatggaagtgggccagtcct

SEQ ID NO: 5471386 - DNA, 22 bp, Homo sapiens
gatggaagtgggccagtcctgg

SEQ ID NO: 5471387 - DNA, 20 bp, Homo sapiens
gatggaatatcatgaatgtg

SEQ ID NO: 5471388 - DNA, 14 bp, Homo sapiens
gatggaatcacagc

SEQ ID NO: 5471389 - DNA, 16 bp, Homo sapiens
gatggaatcacagcca

SEQ ID NO: 5471390 - DNA, 17 bp, Homo sapiens
gatggaatcacagccaa

SEQ ID NO: 5471391 - DNA, 13 bp, Homo sapiens
gatggaatgatgg

SEQ ID NO: 5471392 - DNA, 17 bp, Homo sapiens
gatggaatgtgccacct

SEQ ID NO: 5471393 - DNA, 20 bp, Homo sapiens
gatggaattcttcctcctct

SEQ ID NO: 5471394 - DNA, 21 bp, Homo sapiens
gatggaattcttcctcctctg

SEQ ID NO: 5471395 - DNA, 21 bp, Homo sapiens
gatggaatttttctgtacttc

SEQ ID NO: 5471396 - DNA, 18 bp, Homo sapiens
gatggacaaaggcctggc

SEQ ID NO: 5471397 - DNA, 16 bp, Homo sapiens
gatggacacccccagc

SEQ ID NO: 5471398 - DNA, 11 bp, Homo sapiens
gatggacagac

SEQ ID NO: 5471399 - DNA, 13 bp, Homo sapiens
gatggacagacac

SEQ ID NO: 5471400 - DNA, 14 bp, Homo sapiens
gatggacagacacc

SEQ ID NO: 5471401 - DNA, 15 bp, Homo sapiens
gatggacagacacct

SEQ ID NO: 5471402 - DNA, 17 bp, Homo sapiens
gatggacagacacctcc

SEQ ID NO: 5471403 - DNA, 20 bp, Homo sapiens
gatggacagacacctccccc

SEQ ID NO: 5471404 - DNA, 15 bp, Homo sapiens
gatggacagatggac

SEQ ID NO: 5471405 - DNA, 15 bp, Homo sapiens
gatggacaggaaagg

SEQ ID NO: 5471406 - DNA, 16 bp, Homo sapiens
gatggacagtttgttt

SEQ ID NO: 5471407 - DNA, 14 bp, Homo sapiens
gatggaccaaagcc

SEQ ID NO: 5471408 - DNA, 15 bp, Homo sapiens
gatggaccaaagcca

SEQ ID NO: 5471409 - DNA, 21 bp, Homo sapiens
gatggaccaaagccacctgct

SEQ ID NO: 5471410 - DNA, 18 bp, Homo sapiens
gatggaccaacctgctct

SEQ ID NO: 5471411 - DNA, 13 bp, Homo sapiens
gatggaccccagc

SEQ ID NO: 5471412 - DNA, 14 bp, Homo sapiens
gatggaccccagca

SEQ ID NO: 5471413 - DNA, 13 bp, Homo sapiens
gatggaccctcgc

SEQ ID NO: 5471414 - DNA, 18 bp, Homo sapiens
gatggaccctcgcagcag

SEQ ID NO: 5471415 - DNA, 19 bp, Homo sapiens
gatggaccgggtgggcctg

SEQ ID NO: 5471416 - DNA, 22 bp, Homo sapiens
gatggaccgggtgggcctggcc

SEQ ID NO: 5471417 - DNA, 24 bp, Homo sapiens
gatggacctgccccggacctacct

SEQ ID NO: 5471418 - DNA, 16 bp, Homo sapiens
gatggactgggaggag

SEQ ID NO: 5471419 - DNA, 14 bp, Homo sapiens
gatggacttgaaaa

SEQ ID NO: 5471420 - DNA, 23 bp, Homo sapiens
gatggacttgtgattggctgcag

SEQ ID NO: 5471421 - DNA, 16 bp, Homo sapiens
gatggagaaacaggct

SEQ ID NO: 5471422 - DNA, 18 bp, Homo sapiens
gatggagaaagaagtgga

SEQ ID NO: 5471423 - DNA, 11 bp, Homo sapiens
gatggagaagg

SEQ ID NO: 5471424 - DNA, 15 bp, Homo sapiens
gatggagaaggaagg

SEQ ID NO: 5471425 - DNA, 16 bp, Homo sapiens
gatggagaaggaaggc

SEQ ID NO: 5471426 - DNA, 17 bp, Homo sapiens
gatggagaatgccagcc

SEQ ID NO: 5471427 - DNA, 19 bp, Homo sapiens
gatggagaatgccagccca

SEQ ID NO: 5471428 - DNA, 18 bp, Homo sapiens
gatggagacaccctctgg

SEQ ID NO: 5471429 - DNA, 22 bp, Homo sapiens
gatggagacaccctctgggggt

SEQ ID NO: 5471430 - DNA, 15 bp, Homo sapiens
gatggagacacgggg

SEQ ID NO: 5471431 - DNA, 18 bp, Homo sapiens
gatggagaggaagaaacg

SEQ ID NO: 5471432 - DNA, 14 bp, Homo sapiens
gatggagaggcatg

SEQ ID NO: 5471433 - DNA, 23 bp, Homo sapiens
gatggagaggcatgggggcccaa

SEQ ID NO: 5471434 - DNA, 15 bp, Homo sapiens
gatggagaggcggcc

SEQ ID NO: 5471435 - DNA, 17 bp, Homo sapiens
gatggagcaagctcttc

SEQ ID NO: 5471436 - DNA, 21 bp, Homo sapiens
gatggagcaagctcttccctt

SEQ ID NO: 5471437 - DNA, 17 bp, Homo sapiens
gatggagcccaggcggg

SEQ ID NO: 5471438 - DNA, 22 bp, Homo sapiens
gatggagcccaggcgggagcgg

SEQ ID NO: 5471439 - DNA, 16 bp, Homo sapiens
gatggagccccacctt

SEQ ID NO: 5471440 - DNA, 23 bp, Homo sapiens
gatggagccccaccttgtctgct

SEQ ID NO: 5471441 - DNA, 18 bp, Homo sapiens
gatggagcccccagatag

SEQ ID NO: 5471442 - DNA, 16 bp, Homo sapiens
gatggagcctgaaccg

SEQ ID NO: 5471443 - DNA, 15 bp, Homo sapiens
gatggaggaaaaagg

SEQ ID NO: 5471444 - DNA, 21 bp, Homo sapiens
gatggaggaacccaagaaagg

SEQ ID NO: 5471445 - DNA, 13 bp, Homo sapiens
gatggaggagaag

SEQ ID NO: 5471446 - DNA, 12 bp, Homo sapiens
gatggaggccag

SEQ ID NO: 5471447 - DNA, 18 bp, Homo sapiens
gatggaggcctacctctc

SEQ ID NO: 5471448 - DNA, 14 bp, Homo sapiens
gatggaggggagag

SEQ ID NO: 5471449 - DNA, 19 bp, Homo sapiens
gatggagggggctggggtc

SEQ ID NO: 5471450 - DNA, 21 bp, Homo sapiens
gatggaggggtggtcctgact

SEQ ID NO: 5471451 - DNA, 22 bp, Homo sapiens
gatggaggggtggtcctgactc

SEQ ID NO: 5471452 - DNA, 14 bp, Homo sapiens
gatggaggtagggc

SEQ ID NO: 5471453 - DNA, 19 bp, Homo sapiens
gatggaggttctctcggag

SEQ ID NO: 5471454 - DNA, 16 bp, Homo sapiens
gatggaggtttcatac

SEQ ID NO: 5471455 - DNA, 18 bp, Homo sapiens
gatggagtccagggaaga

SEQ ID NO: 5471456 - DNA, 17 bp, Homo sapiens
gatggagtgagcccatg

SEQ ID NO: 5471457 - DNA, 14 bp, Homo sapiens
gatggagtgtgcag

SEQ ID NO: 5471458 - DNA, 16 bp, Homo sapiens
gatggagttcttgtgc

SEQ ID NO: 5471459 - DNA, 17 bp, Homo sapiens
gatggagtttctctctt

SEQ ID NO: 5471460 - DNA, 17 bp, Homo sapiens
gatggataaactgagcc

SEQ ID NO: 5471461 - DNA, 18 bp, Homo sapiens
gatggataaactgagcct

SEQ ID NO: 5471462 - DNA, 18 bp, Homo sapiens
gatggataacctatatga

SEQ ID NO: 5471463 - DNA, 14 bp, Homo sapiens
gatggatcaccatt

SEQ ID NO: 5471464 - DNA, 15 bp, Homo sapiens
gatggatctgctcca

SEQ ID NO: 5471465 - DNA, 18 bp, Homo sapiens
gatggatctgctccatgc

SEQ ID NO: 5471466 - DNA, 14 bp, Homo sapiens
gatggatggacaga

SEQ ID NO: 5471467 - DNA, 16 bp, Homo sapiens
gatggatggacagaat

SEQ ID NO: 5471468 - DNA, 17 bp, Homo sapiens
gatggatggacagaatg

SEQ ID NO: 5471469 - DNA, 17 bp, Homo sapiens
gatggatggcacaatga

SEQ ID NO: 5471470 - DNA, 18 bp, Homo sapiens
gatggatggcaccctgga

SEQ ID NO: 5471471 - DNA, 19 bp, Homo sapiens
gatggatggcaccctggaa

SEQ ID NO: 5471472 - DNA, 14 bp, Homo sapiens
gatggatggcagac

SEQ ID NO: 5471473 - DNA, 16 bp, Homo sapiens
gatggatggcagactc

SEQ ID NO: 5471474 - DNA, 17 bp, Homo sapiens
gatggatgtagatacag

SEQ ID NO: 5471475 - DNA, 14 bp, Homo sapiens
gatggattcatcat

SEQ ID NO: 5471476 - DNA, 22 bp, Homo sapiens
gatggattccaaccccaactcc

SEQ ID NO: 5471477 - DNA, 21 bp, Homo sapiens
gatggattcccccccctttcc

SEQ ID NO: 5471478 - DNA, 23 bp, Homo sapiens
gatggattcccccccctttccta

SEQ ID NO: 5471479 - DNA, 16 bp, Homo sapiens
gatggattctcagata

SEQ ID NO: 5471480 - DNA, 19 bp, Homo sapiens
gatggattctcagatattt

SEQ ID NO: 5471481 - DNA, 20 bp, Homo sapiens
gatggattggcctccagggc

SEQ ID NO: 5471482 - DNA, 17 bp, Homo sapiens
gatggatttaacagcat

SEQ ID NO: 5471483 - DNA, 22 bp, Homo sapiens
gatggatttaacagcatgacaa

SEQ ID NO: 5471484 - DNA, 14 bp, Homo sapiens
gatggatttgacac

SEQ ID NO: 5471485 - DNA, 19 bp, Homo sapiens
gatggatttgacacactca

SEQ ID NO: 5471486 - DNA, 14 bp, Homo sapiens
gatggatttgcctg

SEQ ID NO: 5471487 - DNA, 15 bp, Homo sapiens
gatggcaacagatct

SEQ ID NO: 5471488 - DNA, 17 bp, Homo sapiens
gatggcaacattggaca

SEQ ID NO: 5471489 - DNA, 22 bp, Homo sapiens
tattttcacagatggaagaagt

SEQ ID NO: 5471490 - DNA, 12 bp, Homo sapiens
tattttcagaat

SEQ ID NO: 5471491 - DNA, 22 bp, Homo sapiens
tattttcagaatctgaatgtaa

SEQ ID NO: 5471492 - DNA, 14 bp, Homo sapiens
tattttcagatgtg

SEQ ID NO: 5471493 - DNA, 16 bp, Homo sapiens
tattttcagctcaatt

SEQ ID NO: 5471494 - DNA, 17 bp, Homo sapiens
tattttcagtattttgg

SEQ ID NO: 5471495 - DNA, 19 bp, Homo sapiens
tattttcagtcaaaacttt

SEQ ID NO: 5471496 - DNA, 16 bp, Homo sapiens
tattttcataattcat

SEQ ID NO: 5471497 - DNA, 11 bp, Homo sapiens
tattttcatag

SEQ ID NO: 5471498 - DNA, 13 bp, Homo sapiens
tattttcatagtg

SEQ ID NO: 5471499 - DNA, 13 bp, Homo sapiens
tattttcatattt

SEQ ID NO: 5471500 - DNA, 18 bp, Homo sapiens
tattttcattctgccaaa

SEQ ID NO: 5471501 - DNA, 13 bp, Homo sapiens
tattttcattgta

SEQ ID NO: 5471502 - DNA, 15 bp, Homo sapiens
tattttcattgtaaa

SEQ ID NO: 5471503 - DNA, 20 bp, Homo sapiens
tattttcatttaactacaaa

SEQ ID NO: 5471504 - DNA, 14 bp, Homo sapiens
tattttcatttcta

SEQ ID NO: 5471505 - DNA, 22 bp, Homo sapiens
tattttccaaaagtggcctctt

SEQ ID NO: 5471506 - DNA, 18 bp, Homo sapiens
tattttccaccttttgtt

SEQ ID NO: 5471507 - DNA, 14 bp, Homo sapiens
tattttccatatat

SEQ ID NO: 5471508 - DNA, 18 bp, Homo sapiens
tattttcccaatagcact

SEQ ID NO: 5471509 - DNA, 23 bp, Homo sapiens
tattttcccaatagcactttcat

SEQ ID NO: 5471510 - DNA, 19 bp, Homo sapiens
tattttcccacaattcttt

SEQ ID NO: 5471511 - DNA, 19 bp, Homo sapiens
tattttcccctatcattta

SEQ ID NO: 5471512 - DNA, 16 bp, Homo sapiens
tattttccctacctaa

SEQ ID NO: 5471513 - DNA, 20 bp, Homo sapiens
tattttccctacctaagaat

SEQ ID NO: 5471514 - DNA, 20 bp, Homo sapiens
tattttcccttcatgtttta

SEQ ID NO: 5471515 - DNA, 20 bp, Homo sapiens
tattttccctttttaaaaaa

SEQ ID NO: 5471516 - DNA, 14 bp, Homo sapiens
tattttcctgtaaa

SEQ ID NO: 5471517 - DNA, 18 bp, Homo sapiens
tattttccttccatgctc

SEQ ID NO: 5471518 - DNA, 22 bp, Homo sapiens
tattttccttccatgctcccaa

SEQ ID NO: 5471519 - DNA, 19 bp, Homo sapiens
tattttccttgcttttctt

SEQ ID NO: 5471520 - DNA, 14 bp, Homo sapiens
tattttcctttaga

SEQ ID NO: 5471521 - DNA, 17 bp, Homo sapiens
tattttcgtgcatttgt

SEQ ID NO: 5471522 - DNA, 23 bp, Homo sapiens
tattttcgtgcatttgtgagcca

SEQ ID NO: 5471523 - DNA, 20 bp, Homo sapiens
tattttctacgtttctttaa

SEQ ID NO: 5471524 - DNA, 13 bp, Homo sapiens
tattttctatatt

SEQ ID NO: 5471525 - DNA, 19 bp, Homo sapiens
tattttctatatttggatt

SEQ ID NO: 5471526 - DNA, 19 bp, Homo sapiens
tattttctatatttgtaac

SEQ ID NO: 5471527 - DNA, 20 bp, Homo sapiens
tattttctatatttgtaact

SEQ ID NO: 5471528 - DNA, 14 bp, Homo sapiens
tattttctatgtac

SEQ ID NO: 5471529 - DNA, 15 bp, Homo sapiens
tattttctatgtact

SEQ ID NO: 5471530 - DNA, 17 bp, Homo sapiens
tattttctatgtactag

SEQ ID NO: 5471531 - DNA, 16 bp, Homo sapiens
tattttctccacttca

SEQ ID NO: 5471532 - DNA, 12 bp, Homo sapiens
tattttctgaat

SEQ ID NO: 5471533 - DNA, 11 bp, Homo sapiens
tattttctgac

SEQ ID NO: 5471534 - DNA, 14 bp, Homo sapiens
tattttctgaccaa

SEQ ID NO: 5471535 - DNA, 15 bp, Homo sapiens
tattttctgaccaaa

SEQ ID NO: 5471536 - DNA, 12 bp, Homo sapiens
tattttctgcaa

SEQ ID NO: 5471537 - DNA, 17 bp, Homo sapiens
tattttctgtaattctt

SEQ ID NO: 5471538 - DNA, 13 bp, Homo sapiens
tattttctgtcac

SEQ ID NO: 5471539 - DNA, 14 bp, Homo sapiens
tattttctgtcaga

SEQ ID NO: 5471540 - DNA, 17 bp, Homo sapiens
tattttctgtcagatga

SEQ ID NO: 5471541 - DNA, 17 bp, Homo sapiens
tattttctgtgtaaaat

SEQ ID NO: 5471542 - DNA, 16 bp, Homo sapiens
tattttctgtgtgttc

SEQ ID NO: 5471543 - DNA, 17 bp, Homo sapiens
tattttctgtgtgttcc

SEQ ID NO: 5471544 - DNA, 12 bp, Homo sapiens
tattttctgttt

SEQ ID NO: 5471545 - DNA, 12 bp, Homo sapiens
tattttcttaaa

SEQ ID NO: 5471546 - DNA, 20 bp, Homo sapiens
tattttcttatgtaagtttg

SEQ ID NO: 5471547 - DNA, 13 bp, Homo sapiens
tattttctttcac

SEQ ID NO: 5471548 - DNA, 19 bp, Homo sapiens
tattttctttgaaattcat

SEQ ID NO: 5471549 - DNA, 22 bp, Homo sapiens
tattttcttttatatctgtaaa

SEQ ID NO: 5471550 - DNA, 16 bp, Homo sapiens
tattttcttttgtaaa

SEQ ID NO: 5471551 - DNA, 17 bp, Homo sapiens
tattttgaaaacactta

SEQ ID NO: 5471552 - DNA, 20 bp, Homo sapiens
tattttgaaaagcttcttaa

SEQ ID NO: 5471553 - DNA, 12 bp, Homo sapiens
tattttgaaagg

SEQ ID NO: 5471554 - DNA, 13 bp, Homo sapiens
tattttgaaatga

SEQ ID NO: 5471555 - DNA, 17 bp, Homo sapiens
tattttgaaatggaaat

SEQ ID NO: 5471556 - DNA, 12 bp, Homo sapiens
tattttgaaatt

SEQ ID NO: 5471557 - DNA, 12 bp, Homo sapiens
tattttgaacaa

SEQ ID NO: 5471558 - DNA, 14 bp, Homo sapiens
tattttgaagaaaa

SEQ ID NO: 5471559 - DNA, 14 bp, Homo sapiens
tattttgaagaata

SEQ ID NO: 5471560 - DNA, 21 bp, Homo sapiens
tattttgaagaatatttaaga

SEQ ID NO: 5471561 - DNA, 11 bp, Homo sapiens
tattttgaagt

SEQ ID NO: 5471562 - DNA, 14 bp, Homo sapiens
tattttgaagttta

SEQ ID NO: 5471563 - DNA, 18 bp, Homo sapiens
tattttgaagtttacatt

SEQ ID NO: 5471564 - DNA, 13 bp, Homo sapiens
tattttgaatcaa

SEQ ID NO: 5471565 - DNA, 15 bp, Homo sapiens
tattttgaatcaata

SEQ ID NO: 5471566 - DNA, 11 bp, Homo sapiens
tattttgaatg

SEQ ID NO: 5471567 - DNA, 16 bp, Homo sapiens
tattttgaatgtacct

SEQ ID NO: 5471568 - DNA, 12 bp, Homo sapiens
tattttgacaaa

SEQ ID NO: 5471569 - DNA, 14 bp, Homo sapiens
tattttgacaaaaa

SEQ ID NO: 5471570 - DNA, 15 bp, Homo sapiens
tattttgacaaaaat

SEQ ID NO: 5471571 - DNA, 20 bp, Homo sapiens
tattttgacttgttgagggt

SEQ ID NO: 5471572 - DNA, 18 bp, Homo sapiens
tattttgagtttcagctg

SEQ ID NO: 5471573 - DNA, 14 bp, Homo sapiens
tattttgataataa

SEQ ID NO: 5471574 - DNA, 18 bp, Homo sapiens
tattttgataataatatt

SEQ ID NO: 5471575 - DNA, 12 bp, Homo sapiens
tattttgatcac

SEQ ID NO: 5471576 - DNA, 12 bp, Homo sapiens
tattttgatctt

SEQ ID NO: 5471577 - DNA, 14 bp, Homo sapiens
tattttgatcttca

SEQ ID NO: 5471578 - DNA, 18 bp, Homo sapiens
tattttgatcttcaacaa

SEQ ID NO: 5471579 - DNA, 13 bp, Homo sapiens
tattttgatgcag

SEQ ID NO: 5471580 - DNA, 17 bp, Homo sapiens
tattttgatgcagcatt

SEQ ID NO: 5471581 - DNA, 19 bp, Homo sapiens
tattttgatgcagcatttg

SEQ ID NO: 5471582 - DNA, 23 bp, Homo sapiens
tattttgatgcagcatttgataa

SEQ ID NO: 5471583 - DNA, 17 bp, Homo sapiens
tattttgatgtaaagat

SEQ ID NO: 5471584 - DNA, 16 bp, Homo sapiens
tattttgattttacat

SEQ ID NO: 5471585 - DNA, 13 bp, Homo sapiens
tattttgcaaaca

SEQ ID NO: 5471586 - DNA, 21 bp, Homo sapiens
tattttgcagttcccacatta

SEQ ID NO: 5471587 - DNA, 18 bp, Homo sapiens
tattttgcatatatgttc

SEQ ID NO: 5471588 - DNA, 13 bp, Homo sapiens
tattttgccactg

SEQ ID NO: 5471589 - DNA, 15 bp, Homo sapiens
tattttgctaactgg

SEQ ID NO: 5471590 - DNA, 16 bp, Homo sapiens
tattttgctaactggt

SEQ ID NO: 5471591 - DNA, 17 bp, Homo sapiens
tattttgctaactggtt

SEQ ID NO: 5471592 - DNA, 19 bp, Homo sapiens
tattttgctaactggttaa

SEQ ID NO: 5471593 - DNA, 22 bp, Homo sapiens
tattttgctaactggttaaaca
